United States Patent 11,976,277 (PARTICLE DELIVERY SYSTEMS) - sequence listing, part 3

SEQ ID NO: 17591 - protein, 81 aa, Odocoileus virginianus
PLQGSVSFSDVAVDFSREEWQQLDLDQKNLYRDVMLETYSHLLSIGYQVPETEVFMLEQGNEPWPLQEELWQIGDQIESYH

SEQ ID NO: 17592 - protein, 81 aa, Cebus imitator
MDTVALEDMAVNFTQEEWALLGPSQKNLYRDVMQETIRNLDCIKMIYEDQNIEDQYKNPRRNLRCHMAERLSESKDNSQCG

SEQ ID NO: 17593 - protein, 81 aa, Cebus imitator
SQGSVTFEDVAVYFSWEEWDLLDETQKHLYFDVMLENFVLTSSMGKALILNPCAGLELLTSGDTPTTASHSARITGVSHHA

SEQ ID NO: 17594 - protein, 81 aa, Cebus imitator
AQMLVTFKDVAVTFTQEEWRQLDLAQRTLYQEVMLETCGLLVSLGYWVPKPELVHLLEHGQELWTVKRGRSHPTCVKKPRK

SEQ ID NO: 17595 - protein, 81 aa, Callithrix jacchus
VTFGDVAVHFSREEWQCLDPGQRALYREVMLENHSSVAGLDSTIRTDNEQACEDMDILKSESSGTMVRISPQDFAQNPGFG

SEQ ID NO: 17596 - protein, 81 aa, Macaca mulatta
YQDSVTFDDVAVDFTQEEWTLLDPSQRDLYRDVMRENYENLASVGRDLFKPSVICWLEEEEELRAEQRGVLQEWRLKTKGP

SEQ ID NO: 17597 - protein, 81 aa, Macaca mulatta
TQGPLKFMDVAIEFSQEEWKCLEPAQRTLYRDVMLENYRNLVSLGICLPDLSVISMLEQKKDPWILQSEEKIANNPDGREC

SEQ ID NO: 17598 - protein, 81 aa, Macaca mulatta
EKGPLTFRDVVIEFSQEEWQCLDTAQQDLYRKVMLENFRNLVFLGIDVSKPDLITCLGQEKDPWNMKRHSMVATPPESGLL

SEQ ID NO: 17599 - protein, 81 aa, Callithrix jacchus
DHELVTFRDVLINFSQEEWEYLDSAQRNLYWDVMMENYSNLLSLDLESKYDTKLLSVGTDIIKNTGSQWEVMESSKLCGLE

SEQ ID NO: 17600 - protein, 81 aa, Callithrix jacchus
AQVSVTFDDVAVTFTQEEWGQLDLAQRTLYQEVMLENCGLLVSLGCPVPRPELICHLDHGQEPWTGKEDLSQGTRPGDKGK

SEQ ID NO: 17601 - protein, 81 aa, Macaca mulatta
VMFRDVAIDFSQEEWECLDSAQRDLYRDVMLENYSNLVSLDLPSRCASKDLSPEKNTYETELSQWEMSDRLEKCDLEESKS

SEQ ID NO: 17602 - protein, 81 aa, Callithrix jacchus
FQGLLTFRDVAIEFSLEEWEHLDSNQKNLYRDVMLENYRNLVCLGFAVSKPDLITFLEQRKEPCNVKSIETVAIQPVETGL

SEQ ID NO: 17603 - protein, 81 aa, Macaca mulatta
HLVTFEDVAVDFTQEEWTLLDQTQRDLYRDVMLENYKNLIILAGSEFCKPSLMSELEQMEELRTGVTGVLQELDLQLKTKG

SEQ ID NO: 17604 - protein, 81 aa, Bos taurus
KVPVTFDDVAVHFSEQEWGNLSEWQKELYKNVMRGNYESLVSMAHDGIVIKIEVQTNDEGSESLETPEPLMGQVEEHGFQD

SEQ ID NO: 17605 - protein, 81 aa, Bos taurus
SLDAVTFTDVAVNFSQDEWEWLTLAQRTLYKKVMLENYSSLASLGLCISKPDVISLLEQDKEPWMMKGELTRALYPDLEYV

SEQ ID NO: 17606 - protein, 81 aa, Bos taurus
RNLGWLTFQDVAIDFTQEEWECLDLGQRELYRDVMLENYGNLASLGLVSKLDLVTFLEQLEDPRNIRRMGTTAIYPAVSPQ

SEQ ID NO: 17607 - protein, 81 aa, Ovis aries
WSQMPVTFEDVALYLSREEWGRLDHTQQSFYREVLQKRSGLSLGFPFNRPFWASQVQGKGEAPGSSRQLGREEEKRGVVEA

SEQ ID NO: 17608 - protein, 81 aa, Ovis aries
MDVAVGVMWEEWQLLAPAQKALYRDVVLENYSNLVSVGTGYQVSKPDVLSKLELGIPFLFDILSFSLKSQITPSKEVDDHV

SEQ ID NO: 17609 - protein, 81 aa, Ovis aries
DLDQVTFEDVVVDFTQEEWGCLEPAQRTLYRDVMLETFRLLVSVGHWLPKPDVISLLEQEAELWAANEGGPRGVCPDLETR

SEQ ID NO: 17610 - protein, 81 aa, Ovis aries
LVLFKDVAIDFSQEEWAYLDLEQKDLYRDVMLENYSNLVSVETGVSISKLDVLSLLEQGKEPWKVVQDVTRDLSPDWESRC

SEQ ID NO: 17611 - protein, 81 aa, Ovis aries
SQGLVTFKDVALNFSQEEWEWLDSSQKDLYRDVMLENYRNLVWLGLSISKPNMISLLEQGKEPWMVEREMSDSQHADWESW

SEQ ID NO: 17612 - protein, 81 aa, Ovis aries
LGPVTFEDVAVYFSQEEWRILDETQRHLYCYVMLETFALVASLGCWQRAEVKEKSSERNASVEVPQIITSKTDPSIQKAYP

SEQ ID NO: 17613 - protein, 81 aa, Ovis aries
SLLTFEEVAMYFSQEEWELLDPTQKALYNDVMQENYETVISLAVPAHQLLAFPEQTDTSEWTVAPELILPESQSLLTFEEV

SEQ ID NO: 17614 - protein, 81 aa, Ovis aries
QVSIAFQDLAVRFSKDEWRLLGEGQRALYLDVMQENYDTLASLGTAELLPLSAFLSPSEPGGAVGARSRAGDRQELPQGGG

SEQ ID NO: 17615 - protein, 81 aa, Rhinopithecus roxellana
GAVSFADVAVYFSPEEWGCLRPAQRALYRDVMRETYGHLGALGDAPNRKEEEPEEVPRAKGPRKAPVKESPEVLVECNPDP

SEQ ID NO: 17616 - protein, 81 aa, Rhinopithecus roxellana
AQGQVNFEDVFVYFSQEEWVLLDEAQRLLYRDVMLENFALMASLGHTSFMSHVVASLVMGSEPWVPDWVDMTLPVATETPG

SEQ ID NO: 17617 - protein, 81 aa, Rhinopithecus roxellana
PKVPVSFEDVSVYFTKTEWKLLDLRQKVLYKRVMLENYSHLVSLGFSFSKPHLISQLERGEGPWVADIPRTWTTAGLHIGD

SEQ ID NO: 17618 - protein, 81 aa, Rhinopithecus roxellana
AQESLTLEDVAVDFTWEEWQFLSPAQKDLYRDVMLENYSNLVAVGYQASKPDALSKLEQGEEPCTTEDEVYTRICCGGQPQ

SEQ ID NO: 17619 - protein, 81 aa, Rhinopithecus roxellana
GPLTFRDVTVEFSLEEWECLDTVQQDLYWDVMLENYRNLVFLGIIVSKPDLITCLEQGKEPWNMKRHEMVAKTPVMCSHIA

SEQ ID NO: 17620 - protein, 81 aa, Rhinopithecus roxellana
LQEPVTFRDVAVDFTQEEWGQLDPTQRILYRDVMLETFGHLLSIGPELPKPEVISQLEQGTELWVAERETIQGCHPGWEAP

SEQ ID NO: 17621 - protein, 81 aa, Rhinopithecus roxellana
SQEQVSFKDVCVDFTQEEWYLLDPAQKVLYRDVILENYSNLVSVGYCITKPEVIFKIEQGEEPWILEKGFPSQCHPERKWK

SEQ ID NO: 17622 - protein, 81 aa, Bison bison
AQLTFKDVAIEFTQEEWECLDPAQRALYRDVMVETLRNLVSLDISHMHVIKKLQLNANIYGGEGFQIVILGRHKRNKIEDF

SEQ ID NO: 17623 - protein, 81 aa, Bison bison
RLTCEDVAIEFTQEEWEFLDPAQRALYREVMLETYRNLLSVDISPTHVIKHLQPKATSDKRETFQTLMLGRPESCEIECFH

SEQ ID NO: 17624 - protein, 81 aa, Bison bison
HVTFEDVAVSFSQEEWGLLGEAQRLLYYDVMLENLSLIASLGCWRGGDTEEARSDQCVSVEQVTRDRNPQVDSSILKAVTS

SEQ ID NO: 17625 - protein, 81 aa, Bison bison
GQSRVTFEDVAVYFSQEEWCLLDEAQIQLYLDVMLENFALACMLGSWPGVGDEETPFEQSKSAGVSQIGNPRTDSSAEKVQ

SEQ ID NO: 17626 - protein, 81 aa, Odocoileus virginianus
MFSDVAVDFSQKEWECLDLEQRHLYRDVILENYSNLVSLGLCIYQPEVFSLMEKGGEPWMTLKDETFPDIQYRCQIKKLSP

SEQ ID NO: 17627 - protein, 81 aa, Odocoileus virginianus
LQGLMTFEDVAVDFTQEEWQYLNPPQRTLYRDVMLETYSNLVSVAGHHVTKPDLILKLEVEERCLLEGKIPIWSFPEEACQ

SEQ ID NO: 17628 - protein, 81 aa, Odocoileus virginianus
PQESVTFEDVAVNFSYEEWQCLTHAQRHLYTDVMLENYGNMVSLGFSFSKPPLISRLEQGTEPYVQDRQDWEFLNCSYPAA

SEQ ID NO: 17629 - protein, 81 aa, Odocoileus virginianus
QQRPVSFKDVVVGFTQEEWHGLNPAQRALYRDVMLETYSNLVSVGYEGTKPYVILRLEQEEAPWICEAACSGCHCRENIWQ

SEQ ID NO: 17630 - protein, 81 aa, Odocoileus virginianus
PLQGSVSFSDVAVDFSREEWQQLDLDQKNLYRDVMLETYSHLLSIGYQVPETEVFMLEQGNEPWPLQGEGPYQSCPEELWQ

SEQ ID NO: 17631 - protein, 81 aa, Callithrix jacchus
TARSQETVTFKDVAMDFTPEEWGKLDPAQRDMMLENYRNLVSLWLPVSKLENYTLENGKEPLKLERKAPKNSYSDMKTRPE

SEQ ID NO: 17632 - protein, 81 aa, Callithrix jacchus
LVGVLTFRDVAIEFSRKEWQCLDTAQRNLYSNVMLENYGNLVFLGIAASKPDLITCLEQGKEPWNVKRHEFEAKLPETGVP

SEQ ID NO: 17633 - protein, 81 aa, Macaca mulatta
QLTFRDVAIEFSQEEWKCLNSTQRTLYRDVMLENYRNLVSLDLSRNCMIKELAPQRESNREEVFHTVTLEQHEKHDIEEFC

SEQ ID NO: 17634 - protein, 81 aa, Callithrix jacchus
AQESLTLEDVAVGFTREEWQLLGPAQKDLYRDVMLENYSNLVAVGYPASKPDALLKLERGEEPCCTTEDEIYTQICSDSGS

SEQ ID NO: 17635 - protein, 81 aa, Macaca mulatta
EEWKCLDPAQQNLYRDVMLENYRNLVFLGISPKCVIKELPPTENSNTGERFQTVALERHQSCDIENLYFREIQKHLYDLEF

SEQ ID NO: 17636 - protein, 81 aa, Callithrix jacchus
QEQVSFKDVCVDFTEEEWYLLDPAQKMLYRDVILENYSNLVSVERKWKADDVLKSSQDHEDDHFWELLFHNNKRVSAESGD

SEQ ID NO: 17637 - protein, 81 aa, Callithrix jacchus
MEFVTLKDVAMDFALEDWEQFGLDQGDLFWDTALENYQNLFLLNPPRPNLTSHADGSEDLEPLARGSPEAMGPDLAETTTN

SEQ ID NO: 17638 - protein, 81 aa, Callithrix jacchus
ASVSFKDVTVEFTQEEWQHMGPVERTLYRDVMLENYSHLVSVGYCFTKPELIFTLEQGEDPWLLEKEKGFLSRTSPENSQP

SEQ ID NO: 17639 - protein, 81 aa, Bos taurus
QDPVTFEEVSVDFSQEEWAQLAPAQKILYQDVMLENYRNLTSVGECGWPPLFVSRFCFSELSVTQVQSLGRLGRFPREGNG

SEQ ID NO: 17640 - protein, 81 aa, Ovis aries
SCEVSVSLRDVAVDFSREEWQQLDLDQKNLYRDVMLETCSHLLSIGYQVPEIEVFMLEQGKEPWALQEELWQIGDQIESYH

SEQ ID NO: 17641 - protein, 81 aa, Ovis aries
AQGLVVFEDVAIYFSQEEWGLLDEAQRLLYYQVMVQNVALLSSVGCQHTTQDEVALSEQHDVAAWSQVKTPQPGLCIQKPH

SEQ ID NO: 17642 - protein, 81 aa, Ovis aries
QGLFTFKDVAVEFTQEEWECLDPTQRALYRDVMLETYRNLLSLGSYSATFAVKELSSPKEDISKGELCHLMTLEKNETYGI

SEQ ID NO: 17643 - protein, 81 aa, Ovis aries
RLTFKDVAIEFTPEEWECLDLPQRALYREVMVETLRNLLSVDTSPKRVLKGSAPKQSGHTGGILQTMLSERHKSHDTKDHG

SEQ ID NO: 17644 - protein, 81 aa, Ovis aries
KDQGSLTLEDVAVDFTWEEWQLLAAPQKALYRDVMLENYSNLVSVGYQASKPAALSRLERGELWPMEDEVHSRICPDLCWE

SEQ ID NO: 17645 - protein, 81 aa, Ovis aries
ALALISFEDVAITFTGEEWRHLDLAQRTLYQEVMLETCGLLVSLGHPVPEAELIQLLEYGPELWTVKRGLSGNTCIGEKSN

SEQ ID NO: 17646 - protein, 81 aa, Callithrix jacchus
AQGLVTFADVAIDFSQEEWACLNSAQRDLYWDVMLENYSNVVSLDLESAYETKNLPTEKSLHEIRVSKRHSDRRSKSLGHS

SEQ ID NO: 17647 - protein, 81 aa, Callorhinus ursinus
PQVLVSFEDVAVFLSQEEWGCLGPAQRGLYSNVMLETYRNLISLGLQDTKPDVISRLEKGEEPWAPYSSRIEEGWIRSHRS

SEQ ID NO: 17648 - protein, 81 aa, Callorhinus ursinus
MAFRDVAVDFSQEEWMLLSPAQRSLYREVMLENYSNLVSLGIPFSKPKLITQLEQGKETWREERTCPPAARPVEPKPELHL

SEQ ID NO: 17649 - protein, 81 aa, Rhinolophus ferrumequinum
CKKPVSFAEVAVYFSPEEWGCLRPAQRALYRDVMRETYGHLGALGCPGPKPALISWMEQESEAWSPAAQDPEEGESVGGAL

SEQ ID NO: 17650 - protein, 81 aa, Rhinolophus ferrumequinum
APASVSFEDVAVTFTREEWRHLDLDQKTLYQEVMLEICGLLVSLGQPVPKPELIYLLEHGRELWTVKRGLSRSSCTGKEAK

SEQ ID NO: 17651 - protein, 81 aa, Acinonyx jubatus
EALESVTFRDVAVDFTQEEWQQLEPAQKDLYRDVMLENYRNLVSLDLESRPEMKESGPKEDIAEHRPSVGAVAEGPTRNGA

SEQ ID NO: 17652 - protein, 81 aa, Rhinopithecus roxellana
NKGPMTLKDVIVEFTKEEWKLLTSAQRTLYKDVILENYSHLVSVGYHVNKPNAVFKLKQGKEPWILEVEIPHQVLPYLWSI

SEQ ID NO: 17653 - protein, 81 aa, Rhinopithecus roxellana
SHELLTFKDISVNFTQEEWGQLAPAYQNLYREVMLENYSNLVSVGYQLSKPSVISQLEKGEEPWMAEKEGPGDPSSDLKSK

SEQ ID NO: 17654 - protein, 81 aa, Bison bison
KSGMTLSQTQLTVEDVDIKFTPEEWECLDPAQRALYWDVMEETYRNLLSVGSLPLSHKEVPKACSFTCILELMNRMCLIYI

SEQ ID NO: 17655 - protein, 81 aa, Bison bison
SCEGSVSFRDVAVDFSREEWQQLDLDQKNLYRDVMLETCSHLLSIGYQVPETKVFMLEQGKEPWALQGEGPYQSCPGEKLW

SEQ ID NO: 17656 - protein, 81 aa, Bison bison
SQESLTFQDVAVDFTEKEWPLLDSTQRKLYKDVMLENYSNLASVGCQVGKPSLISHLEQEEELRTEDRELHRGPCPDWATP

SEQ ID NO: 17657 - protein, 81 aa, Bison bison
HQGSVTFEDVAMYFSWEEWCLLDEAQIQLYLDVMLENFALVCMLGSWHGVQDEETPSEQSKSARVSQFCTPRACLSPEKTQ

SEQ ID NO: 17658 - protein, 81 aa, Odocoileus virginianus
AAGSVTFNDVTMAFTRKEWEQLDPAQKSLYKDVMLENYSNLASMGYQALKPDMISKLEKGEEPWLGKGKRPKQGGSSEIAR

SEQ ID NO: 17659 - protein, 81 aa, Odocoileus virginianus
LQGSVSFKDVTVDFTQEEWQQLDPAQKALYRDVMLENYCHLISVGFHITKPDMIRKLEQGKELWTTEKIFQSQSYLEEDWK

SEQ ID NO: 17660 - protein, 81 aa, Odocoileus virginianus
VTELLTFKDISVDFTQEEWGQLAPAHRNLYREVMLENYGNLVSVAGCQLSKPSVISQLEKGEEPWMTEKEGAGDPSSDLKS

SEQ ID NO: 17661 - protein, 81 aa, Odocoileus virginianus
FQGSVTFRDVSIDFSREEWEWLQPAQRDLYRNVMLENYGHLVSLGLNISKPDVVSLLEQGKEPWLGNGDVSRELFPASKPN

SEQ ID NO: 17662 - protein, 81 aa, Odocoileus virginianus
LTFKDVAMVFSKEELALLDSAQINLYQDMMLKNFRNLVSMEQTTEAQSGQVTCPGSPSLSEELGFEPPSLTLSPVLVITRS

SEQ ID NO: 17663 - protein, 81 aa, Odocoileus virginianus
ARLTFKDVAIEFSPEEWECLDPAQRTLYRDVMVETLRNLLSVGISHIHMIKKSQLKANIDIGERYQTLILGNPESHEIKHF

SEQ ID NO: 17664 - protein, 81 aa, Odocoileus virginianus
WKMWVKKPVTFEDVAVTFTQEEWKCLDASQRVLYQDVISETVRNLMSVDLIAKLEQEEKQWEADLCSPNGEGFHSGGKKEG

SEQ ID NO: 17665 - protein, 81 aa, Cebus imitator
MLENCGLLVSLGCPVPRPELIYHLEHGQEPWTRKEDLSQGTHPGDKGKPKTTEPTTCDPALSEGISLQGQLTKGNSVASQL

SEQ ID NO: 17666 - protein, 81 aa, Cebus imitator
MGVLTFMDVAIEFSLEEWQCLNTAQRNLYRNVMLENYRNLVFLGIAASKPDLITCLEQGKEPWNVKRHEMVAKPPAVCSYF

SEQ ID NO: 17667 - protein, 81 aa, Cebus imitator
PGSLEMGLLTFRDVAIEFSLEEWQCLDTAQQNLYRNVMLENYRNLAFLAGIAVSKPELITCLEKEKGPWNMKRHEMVDEPP

SEQ ID NO: 17668 - protein, 81 aa, Cebus imitator
TQESLTLEDVAVEFSWEEWQLLDTAQKDLYRDVMVENYNHLVSLGYQTSKPDALSKLAHGQEPWITDAKIQNKNCPGIRKV

SEQ ID NO: 17669 - protein, 81 aa, Cebus imitator
MGQLTFNDVTIEFSLEEWQCLDKPQQNLYREVMLENYRNLVFLGIAVSKPDLITCLKQGKEPWNIRRHEMVTKPPAMCSHF

SEQ ID NO: 17670 - protein, 81 aa, Cebus imitator
PLTFMDVAIEFSLEEWQCLDTAQQNLYRDVMLENYRNLVFLSENNFNIIALSKPALIRYLEQGKEPWNMKRHDTVTKPPGM

SEQ ID NO: 17671 - protein, 81 aa, Cebus imitator
LQGLVTFEDVAVEFTQEEWALLAPAQRMLYRNVMLENFWNLSSSLGNQVDKPSLISHLEQEDKLMTEERGIVPGTRPDVET

SEQ ID NO: 17672 - protein, 81 aa, Cebus imitator
PKVPVAFDDVSIYFSTPEWEKLEEWQKELYKNIMKGNYESLISMDYAINQPDVLSQIQPEGEHNTEAQTGPEESEIPTDPS

SEQ ID NO: 17673 - protein, 81 aa, Callithrix jacchus
SVFLQESLTLEDVTVEFTWEEWQLLDPSQKDLYRDVMLEIYSNLVSVGFQVSKPDALSKLERGEEPWTIGDERHSRICPGT

SEQ ID NO: 17674 - protein, 81 aa, Callithrix jacchus
MGVLTFKDMAAEFSLEEWQCLDTSQQNLYTDVMLENYRNLVFLSIAASMQDMITCLEQGKEPWNVKRHEMVAEPPEFCPCH

SEQ ID NO: 17675 - protein, 81 aa, Macaca mulatta
VAVDFTQEEWGQLDPTQRILYRDVMLETFGHLLSIGPELPKPEVISQLEQGTELWVAERGTIQGCHPGWEPPSESQASRKE

SEQ ID NO: 17676 - protein, 81 aa, Callithrix jacchus
TQGCVTFEDIAIYFSQEEWGLLDEAQRLLFLEVMLENFALVASLGCGHGTEDEKTPSEQNVSIGVSQSKAGSSAQKTQPCE

SEQ ID NO: 17677 - protein, 81 aa, Bos taurus
LQDLVTFEDVTVEFTQEEWALLDSSQRKLYRDVMLENCRNLASLGYHVDKPSLISQLEQEDKVVTEEGGILPGTRPDLETV

SEQ ID NO: 17678 - protein, 81 aa, Bos taurus
ETFGMKFEDVAIDFSQEEWGLLDEAQRLLYYSVMLENFALVASLGCCHGTEDEEAPSEQSLSVEAESQVGVSKAGPSIQKI

SEQ ID NO: 17679 - protein, 81 aa, Bos taurus
LLEMHSWDPAMAIRTLTSKGQESVTFKDVAVDFTLEEWGRLGPGQRELYRDVMLENYQNLLSLGEALPPAVLSWPLCPPTA

SEQ ID NO: 17680 - protein, 81 aa, Bos taurus
ESVTFKDVAVLFTQDEWAQLSPAQRALYRDVMLENYSNLVSLDWVITPMNKKSILKADIPEGELGQWMIKERFTRDSCWKY

SEQ ID NO: 17681 - protein, 81 aa, Ovis aries
KDQGSLTLEDVAVDFTWEEWQLLAPPQKALYRDVMLENYSNLVSVGYQASKPAALSRLERGELWPMEDEVHSRICPEMRKD

SEQ ID NO: 17682 - protein, 81 aa, Ovis aries
SEEPVTFKDVAVDFSQEEWGQLGSPQRALYRDVMLENYQNLLSLGPPVCKPDVISHLERGEEPWRAPRGGPAGPGPEPGRE

SEQ ID NO: 17683 - protein, 81 aa, Delphinapterus leucas
GSVSFEDVTVEFTQDEWQYVGPALRTLYKDVMLENYSHLVSLVVTFAGYCIIKPQVIFKLEHGEEPWPSEEEFLNQKYPGC

SEQ ID NO: 17684 - protein, 81 aa, Sapajus apella
QESVTFKDVAVDFTLEEWGWLEPGQRELYRDVMLENYRNLLSLGAGLPGSKPDVISRLERGQEPRPEDREAQRVTCPDLKT

SEQ ID NO: 17685 - protein, 81 aa, Sapajus apella
AQESLTLEDVAVDFTWEEWQLLGPAQKDLYRDVMLENYSNLVAVGYQASKPDALFKLEQGQPPWTIKDGIHSGGCSEIWKF

SEQ ID NO: 17686 - protein, 81 aa, Sapajus apella
ARDLVMFRDVAVDFSQEEWECLNSYQRNLYRDVILENYSNLVSLAGCSISKPDVITLLEQGKEPWLVVRDEKRRWSLDLES

SEQ ID NO: 17687 - protein, 81 aa, Sapajus apella
FQESVAFEDVAVYFTQNQWGSLDPAQRALYSEVMLENYANVASLVAFPFPKPALISHLEKGEAPWGPDPWDAEIPSGINQG

SEQ ID NO: 17688 - protein, 81 aa, Sapajus apella
MLENYRNLAFLGIAISKPDLITWLEQGKEPWNMKSHAMVAKPPVIWSHFAQDLWPEESIKDSFQKGILRTYGKYGHESLQL

SEQ ID NO: 17689 - protein, 81 aa, Macaca mulatta
GEGSLSFEDVAVDFTREEWQFLDWSQKVLYKEVMLENYSNLVSVGYQGTKPDSLFKLEQGEPPWIVEGAAHSQTCPGFVIQ

SEQ ID NO: 17690 - protein, 81 aa, Sapajus apella
GYQDSVTFDDVAVEFTPEEWALLDTTQKYLYRDVMLENYKNLASVGCQLFIPNPTSWLKQEELKTMESGVLQQWEIQPRTQ

SEQ ID NO: 17691 - protein, 81 aa, Vombatus ursinus
MEENAWTFLFLGLPVLREDLISPFHQGEAPGTLEQKGPRNSWPDVETRFEVNEKTTQLRIFVEESGQQKFMGDGAWDLSLR

SEQ ID NO: 17692 - protein, 81 aa, Balaenoptera acutorostrata
SQLSVTFEDVAVLFTRDEWRKVTPSQRNLYRDVMLENYGNLVSLGLPFSKPEVISLLQQGEDPWKVEKESPGGSSLGCKSS

SEQ ID NO: 17693 - protein, 81 aa, Ovis aries
FREPVTFEDVALGFTPDEWGQLDLEQKSLYREVTLENYRNLVSVEHQLSKPDVVSQLEEEEELWSVERGIQDTFSECPEAQ

SEQ ID NO: 17694 - protein, 81 aa, Ursus maritimus
MAHLMMFRDVVVDLSQEEWECLDLEQRHLYRDVMLENYSNMISLGLCIYQPDVFSLLEKGKEPWMVLQDETRGPCPDVQSR

SEQ ID NO: 17695 - protein, 81 aa, Rhinolophus ferrumequinum
VDGRLTFRDVAIDFSQEEWECLHPAERKLYTDVMLENYRNLCSLGLAVSKPDLVIFLERMKDAWDVQRKKAVSIHPAMSSA

SEQ ID NO: 17696 - protein, 81 aa, Ursus maritimus
VMAHMAFRDVAVDFSQEEWLLLSPAQRSLYREVMLENYSNLVSLAGIPFSKPKLISQLEQGKETWREERTCPLATCPAEPK

SEQ ID NO: 17697 - protein, 81 aa, Phyllostomus discolor
MHFSWEEWRLLDEAQRRLYLHVMLDNFTLISSLGCCCGAKDVEAPTEENICVPVSQARNAKTAVSSQKSHPCESCGPVLRD

SEQ ID NO: 17698 - protein, 81 aa, Ursus maritimus
MMLENYRNLVSVEHQLSKPDVVSQLEEEEALWSVERGIPQDTFSEYPTAQLDPQLDPFPAGNPLMKIEVVEVLTLNQEVAR

SEQ ID NO: 17699 - protein, 81 aa, Acinonyx jubatus
QGSVTFEDVALYFSWEEWDLLDEDQRCLYHDVMLENFALTSSLGCGHGVDNEDVPLEESISVGVSQIRTLEADSSPQKAQP

SEQ ID NO: 17700 - protein, 81 aa, Acinonyx jubatus
LFQGLLTLRDVAIEFSQEEWGCLNHSQRELYRDVMLETYGHLLFLGLIVSKPDLVIVLEQEEELWGVKRKETVASHSGRWE

SEQ ID NO: 17701 - protein, 81 aa, Rhinopithecus roxellana
RDVTVEFSLEEWECLDTVQQDLYWDVMLENYRNLVFLGIIVSKPDLITCLEQGKEPWNMKRHEMVAKTPVEMRFHHVSQAS

SEQ ID NO: 17702 - protein, 81 aa, Rhinopithecus roxellana
RAEEAMTFKDVAVVFTEEELGLLDPAQRKLYQDVMLENFRNLLSVGHQAFHRDTFHFLREERIWMMKTATQREGNSGDKIQ

SEQ ID NO: 17703 - protein, 81 aa, Acinonyx jubatus
MLENYGNLVSVGYQLSKPGVISQLEKGQEPWLIEREVSGGPRSDLESKAETKESAVKNDTSWEELHHGLMKEQSTRGSTLY

SEQ ID NO: 17704 - protein, 81 aa, Rhinopithecus roxellana
HLTFMDVAIEFSQDEWKCLDPGQRALYRDVMLENYRNLVSLGRSCILGSNAENKPIKNQLGFTLESRLSELQLFQAGRKIY

SEQ ID NO: 17705 - protein, 81 aa, Rhinopithecus roxellana
AHALVTFRDVAIDFSQKEWECLDTTQRKLYRDVMLENYSNLVSLGYSGSKPDVITLLEHGKEPCVAVRDVTGRQYPGLLSR

SEQ ID NO: 17706 - protein, 81 aa, Rhinopithecus roxellana
TGGDVTFSDVAIDFSHEEWAWLDSAQRDLYKDVMVQNYENLVSVGLSVTKPYVIMLLEDGKEPWMVEKKLSKDWKSRWENK

SEQ ID NO: 17707 - protein, 81 aa, Rhinopithecus roxellana
MDSLVFEEVAVNFTPEEWALLDHAQRSLYRDVMLETCRNLASLDCCIYVRTSGSSSQSDVLGNGISNDEEIVKFTSDYWSI

SEQ ID NO: 17708 - protein, 81 aa, Acinonyx jubatus
YTLESLTLEDVAVDFTQEEWRLLAPAQKDLYWDVMLENFRNLVSVGYVASMPAALSRLERGGQWMTEDETRHWICPEIKKD

SEQ ID NO: 17709 - protein, 81 aa, Rhinopithecus roxellana
SLESELFRDVAIVFSQEEWQCLAPAQRDLYRDVMLETYSNLVSLGLAISKPDVISFLEQGKEPWMVERVVSGGLCPVLKYR

SEQ ID NO: 17710 - protein, 81 aa, Rhinopithecus roxellana
KSQESLTLEDVAVEFTWEEWQFLGPAQKDLYRDVMLENYSNLVSVGYQASKPDALSKLEQGEPWTVENEIHSQICPEIKKV

SEQ ID NO: 17711 - protein, 81 aa, Acinonyx jubatus
SVTFEDVAVEFTPEEWALLDPCQRTLYRDVMQENRRNLASLDLETLLRAKGLTSKQHVFRQEQHKGVKMERNHLGVKVNEC

SEQ ID NO: 17712 - protein, 81 aa, Rhinopithecus roxellana
FQGSVSFKDVTVGFTQEEWQHLDPSQRALYRDVMLENYSNLVSVGYCVHKPEVIFRLEQGEEPWRLEEEFPSQRFPEVWTA

SEQ ID NO: 17713 - protein, 81 aa, Rhinopithecus roxellana
MELLTFRDVAIEFSPEEWKCLDPAQQNLYRDVMLENYRNLVSLGFVISNPDLVTCLEQIKEPYSLKIHETAAKPPVVQHFW

SEQ ID NO: 17714 - protein, 81 aa, Rhinopithecus roxellana
FQEAVTFKDVAVAFTEEELGLLDPAQRKLYRDVMLENFRNLVSVGHQSFKPDMISQLEREEKLWMKEFQTQRGKHSGDRNL

SEQ ID NO: 17715 - protein, 81 aa, Bison bison
MLENYQNLLSLGPPVCKPDVISHLERGEEPWQAPRDGPAGPDPEPGWEPGPEAEETLVYKEEPPWELIAVGLVRSGVHNPG

SEQ ID NO: 17716 - protein, 81 aa, Bison bison
SLSPVTFEDVAVYFSQEEWRLLGEAQKFLYRDVMLETFALVMSLGCCHTAEDEQTPSEQNVSVEVPQRNTKKTDLSSQKVC

SEQ ID NO: 17717 - protein, 81 aa, Bison bison
SQGLVSFKDVAVDFTQEEWQQLDSAQKTLYRDVMLENYSHLVSMGHPVSKPDVISKLEQGEDPWIIKRDIPNWICPYEGQA

SEQ ID NO: 17718 - protein, 81 aa, Bison bison
QVSIAFQDLAVRFSKDEWRLLGEGQRALYLDVMRENYDTLASLGTAEPLPLSAFLSPSEPGGAVGARSRAGDRQEPPQGGG

SEQ ID NO: 17719 - protein, 81 aa, Odocoileus virginianus
SEIELVTFEDVAIDFTQEEWSLLDKSQKNLFRNVMMEIITHLVSVGYQISKSDVISQLEQGKELWSEAGGFQGQRPGSERP

SEQ ID NO: 17720 - protein, 81 aa, Odocoileus virginianus
PQDLLTFEDVAVEFTWWEWGQLDPAQKDLYWEVMLENFKNLASLGFPVSKPYMIRQLEEGEEPCILEREISTGVHSDWERR

SEQ ID NO: 17721 - protein, 81 aa, Odocoileus virginianus
MLENYQNLLSLGPPVCKPDVISHLERGEEPWQAPRDGPAGPGPEPGWEPRPAAETLVYKEEPPWEPIADGPARSSVHNPGF

SEQ ID NO: 17722 - protein, 81 aa, Odocoileus virginianus
FQGSVSFKDVTVGFTQEEWQHLDSTQRSLYRDVMLENYRNLVSVGYCITKPEVIFRLEQGEEPWILEEEFPSQSFSEVCKT

SEQ ID NO: 17723 - protein, 81 aa, Odocoileus virginianus
SKDLVTFKDVAVDFSQEEWGWLSPAQRGLYRSMMLENYQSLVSLGLCISKPYVISLLEQGKEPWTMMENEMRSPFPDWESI

SEQ ID NO: 17724 - protein, 81 aa, Odocoileus virginianus
QGFVVFEDVAVYFSQEEWGLLDEAQRLLYCQVMLQNIALLSSIGGDRGSELDPSHGPTTPRGVCGFRRLFNTVLLTGPHGG

SEQ ID NO: 17725 - protein, 81 aa, Cebus imitator
KSLESVSFKDVTVDFSRDEWQQLNIAQKSLYRDVMLENYFNLISVGCQVPKPEVIFNLEQEEPCMLNGGISSQSCPDGKIG

SEQ ID NO: 17726 - protein, 81 aa, Cebus imitator
EPGAVSFGDVAVYFSREEWGCLRPAQRALYRDVMRETYSHLGALGVGGSKPALISWSGNKEEERQREGSGALEKSLPVATG

SEQ ID NO: 17727 - protein, 81 aa, Cebus imitator
PQGLVTFEDVAVAFTQEEWQYLNPLQRTLYRDVMLETYSNLVFVGQQVTKPDLILKLEVEECLVEGKIPFWSFPEVCQVNE

SEQ ID NO: 17728 - protein, 81 aa, Cebus imitator
TSKEAVTFKDVAVVFTEEELGLLDPAQRRLYRDVMLENFRNLLSVGHQPFNRDTFYFLREEKFWMMDIATQREGNSGGKIQ

SEQ ID NO: 17729 - protein, 81 aa, Cebus imitator
PQESVAFDDVAVYFTKKEWAIMVPDQRALYRDVMLENYEAVAFVAVPPTSKPALVSHLEQGKEPCFTQPQGVLSRRDWRAG

SEQ ID NO: 17730 - protein, 81 aa, Callithrix jacchus
SQELLTFKDISIDFTQEEWGQLTPAYQNLYREVMLENYSNLVSVGYQLSKPSVISQLEKGEEPWMTEKEGSGDPSSDLKSN

SEQ ID NO: 17731 - protein, 81 aa, Callithrix jacchus
MLENYGNLVFLGIAASKPDLITCLEQGKEPWNVKRHEFEAKLPVASSYFAQDLWPKQVIKNHFQKVILRRYKKCRHENFQL

SEQ ID NO: 17732 - protein, 81 aa, Callithrix jacchus
TQEPLGFRDVAIEFSLEEWHCLDTVQRNLYWDVMLENYRNLVFLGKHNLNTQGDSLEFGRGRLQSAMTLCIILDLWPEQGI

SEQ ID NO: 17733 - protein, 81 aa, Macaca mulatta
VAVDFTQEEWQQLDPAQKALYRDVMLENYCHFVSVGFHMTKPDMIRKLEQGEELWTQRIFPSYSYLEEDGKTEDVLVKFKE

SEQ ID NO: 17734 - protein, 81 aa, Callithrix jacchus
PQVSLTFEDVAVLFTRDEWRKLAPSQRNLYRDVMLENYRNLVSLGLPFTKPKVISLLQQGEDPWKVEKDCFGGSFLGCKSN

SEQ ID NO: 17735 - protein, 81 aa, Callithrix jacchus
FQGSISFKDVTVGFTQEEWHHLDPSQRALYRDVMLENYSNLVSVGYCVHKPEVIFRLEQGEEPWRLEEEFPSQSFPEIWTA

SEQ ID NO: 17736 - protein, 81 aa, Callithrix jacchus
FQELVTFKDVVVHFSLEELRSLSAAQRSLYREVTLENYRNLVSLGYRFSKPDIISRLEKEESRAVETDSNAVICQGESHED

SEQ ID NO: 17737 - protein, 81 aa, Callithrix jacchus
LLTFRDVAIEFSQEEWRCLDPAQRTLYRDVMLENYRNLVSLDIFSKCETKELPPEEKSNTGETFQTVMLERENQGVGDVSC

SEQ ID NO: 17738 - protein, 81 aa, Bos taurus
AVTFTQEEWGHLDPAQRTLYQEVMLENCGLLVSLGCPVPRPELIYRLEHGQELWTVKRDLSRSTCAGDKGKPKTRESTTSE

SEQ ID NO: 17739 - protein, 81 aa, Bos taurus
QGHLTFKDVAIEFSQEEWECLHTAQRALYRDVMLETYRNLLSVGGFLTTGPPGKLLCMFHFPIYSLINSQSICDVSHMIWG

SEQ ID NO: 17740 - protein, 81 aa, Ovis aries
QEQLTSEDVAIEFSQEEWEFLDAAQRALYRDVMLETYRNLLSVDISPTHVTKHLQPKATSDKRETFQTLMLGSPESCEIER

SEQ ID NO: 17741 - protein, 81 aa, Bos taurus
MYFSQEEWELLDPTQKALYNDVMQENYETVISLALFVLPKPKVISCLEQGEEPWVQRPLEFKDSSEELPAGLKLKNDTENI

SEQ ID NO: 17742 - protein, 81 aa, Acinonyx jubatus
SQGLLTFRDVAIEFSQDEWGCLNQSQRELYRDVMLETCGHLLFLGLIVSKPHLVIFLEQKRELWDVKRKKTVASPAAIASH

SEQ ID NO: 17743 - protein, 81 aa, Rhinopithecus roxellana
SCEGSVSFRDVAINFSREEWQHLDPSQRNLYRDVMLETYSHLLSVGYQVPEAEVVMLEQGKEPWALQGERPRQSCPGEKLW

SEQ ID NO: 17744 - protein, 81 aa, Rhinopithecus roxellana
QEGVNFKIVTVDFTQEEKSTWNPAQRTLDRDVILENHRDLISWDLATAVGKKDPTSKQSIFDEEPANGVKIERLTRDDPWL

SEQ ID NO: 17745 - protein, 81 aa, Rhinopithecus roxellana
GSVTFEDVAIYFSQEEWGLLDEAQRLLYRDVMLENFALITALVCCHGTEDEETPEQSVSVERVPQVRTPEASPSTQKTQSC

SEQ ID NO: 17746 - protein, 81 aa, Acinonyx jubatus
SKGSMMFRDVSINFSQEEWECLDSGQMNLYKEVMLENFSNLVSVGLSNSKPAVISLLEQGKEPWMVERELTRGLCSDLESM

SEQ ID NO: 17747 - protein, 81 aa, Rhinopithecus roxellana
GKELLSFEDVAMYFTREEWDHLDWGQKDLYRDVMLENYRNMVLLGFQFPKPEVICQLENWDEQWILDLPRAGSRKASGSAC

SEQ ID NO: 17748 - protein, 81 aa, Acinonyx jubatus
WRAWVQKPVTFEDVAVNFTQEEWMYLDASQRALYQDVMSEIVRNLMSVDLVTKLEEEEQWRTELQLQPPNGEGLPSGSRKQ

SEQ ID NO: 17749 - protein, 81 aa, Rhinopithecus roxellana
CWGLLSFKDISMEFTWDEWQLLDSTQKYLYRDVILENYHNLLSVGYHGTKPDLIFKLEQGEDPWIINAKISRQSHPDGWEE

SEQ ID NO: 17750 - protein, 81 aa, Rhinopithecus roxellana
QGLLTFSDVAIEFSQEEWKCLDPAQRTLYRDVMLENYRNLVSLDISSKCMMKEFSSTAQGNTEVIHRGTMQRRECHHIGDF

SEQ ID NO: 17751 - protein, 81 aa, Rhinopithecus roxellana
PQASVCFEDVAMAFTQEEWEQLDLAQRTLYREVTLETWEHIVSLGLFLSKSDVISQLEQEEDLCRAEQVAPREKRVLGSFL

SEQ ID NO: 17752 - protein, 81 aa, Acinonyx jubatus
VQRFVSFKDVTVDFTWEEWQQLDSAQRNLYRDVMLENYSNLVSVDFETGMKELTTQKSISEEVVLHNMIVYSTFEDWKLED

SEQ ID NO: 17753 - protein, 81 aa, Odocoileus virginianus
WGSLVAFEEVAMHFSREEWELLDEAQRQLYHTVMLETLELVTSLGCWPVVEGEELPSEKNASGEVVAQVRTPSVPPSIQKA

SEQ ID NO: 17754 - protein, 81 aa, Odocoileus virginianus
QGCVTFEDVAVYFSQEEWGLLDEAQRHLYHKVMLENFALTASMVCLHETETKEIPSEQNVSLEALSQVRTPKVVTFKDVAM

SEQ ID NO: 17755 - protein, 81 aa, Odocoileus virginianus
PLESVTFEDVAVDFTQEEWALLDTSQRKLFRDVMLENISHLVFVGYQHCKLDVTFQLEQGEELWIEGRGFFQSHSPGRESA

SEQ ID NO: 17756 - protein, 81 aa, Odocoileus virginianus
KVSRSLENDGVCFSEQEWENLEDWQKELYANVMKSNYETLVSLKPRPVEACPEGQCDRSGGRETEGEDGQRGDEVLGQPEG

SEQ ID NO: 17757 - protein, 81 aa, Odocoileus virginianus
RGSVTFEDVAVYFSWEEWALLDEAQRCLYHDVMLENFALTSSLGYWHGVEDKGAPSEKSISVEGVSLIKTLKADSSPQKDQ

SEQ ID NO: 17758 - protein, 81 aa, Odocoileus virginianus
QACVTFEDVAIYFSQEEWRLLNETQRFLYCDVMLENFALTTSLGCWRGVGKEEAPSEQSVFVAVSHIHTSKADSLTQMAYP

SEQ ID NO: 17759 - protein, 81 aa, Cebus imitator
SYEGSVSFRDVAIDFSREEWRHLDLSQRNLYRDVMLETYSHLLSVGYQVPEAEVVMLEQGNEPWALQGERPHQSCPGEKLW

SEQ ID NO: 17760 - protein, 81 aa, Cebus imitator
SQELLTFKDISIDFTQEEWGQLTPAHQNLYREVMLENYSNLVSVGYQLSKPIVISQLEKGEEPWMTEKEGPGDPSSDLKSN

SEQ ID NO: 17761 - protein, 81 aa, Cebus imitator
QESVTFQDVAVDFTEKEWPLLDSSQRKLYKDVMLENYSNLTSLDWETPSKTKWSLLMEDIFGKETPSGVTMERAGLGEKPT

SEQ ID NO: 17762 - protein, 81 aa, Cebus imitator
SQELVTFEDVAVYFIRKEWKRLEPAQRDLYRDVMLENYGNVFSLDGETRTENDQAVSEDTRSHGVLLGRFQKDISQGLKFK

SEQ ID NO: 17763 - protein, 81 aa, Cebus imitator
GPLTFRDVTIEFSHEEWKCLDPAQKALYKDVMLENYRNLVFLGITPKCTTKELPPIGNNNTGEKFRTVTLERHECYDIEDI

SEQ ID NO: 17764 - protein, 81 aa, Macaca mulatta
RVTFKDLAVVFTKEELALLDKAQINLYQDVMLENFRNLISVGDGIKNNILNLQEKGLSYLSQEVLRCWQIWKQRIRDLTVS

SEQ ID NO: 17765 - protein, 81 aa, Macaca mulatta
GTVTFEDVAVNFTQEEWNLLSEAQRCLYRDVMLENLALISSLGCWCGVEDEEGPSKQSIYKQRETQIRIPMAGVSLKKAHP

SEQ ID NO: 17766 - protein, 81 aa, Callithrix jacchus
EMETLTFRDVAIEFSLEEWQCLNPAQQDLYRNVMLENYRNLVFLAGITVCKENPITCLVQGKEPCNVKTHEMVARPNESRS

SEQ ID NO: 17767 - protein, 81 aa, Callithrix jacchus
KSLESVSFKDVTVDFSRDEWQRLNIAQKSLYRDVMLENYFNLISVGCQVPKPEVIFNLEQEEPCMLNGGISSQSCPDGKIG

SEQ ID NO: 17768 - protein, 81 aa, Macaca mulatta
AVTFKDVAVVFSREELRLLDLTQRKLYRDVMVENFKNLVAVGSKHQNKMETLQKFALKYLSNQELSCWQIWKQVARELTRC

SEQ ID NO: 17769 - protein, 81 aa, Callithrix jacchus
SSRDPPASDVSVEFSSAEWKCLTPAQRALYRDVMLENYRNLESVGEENVPPDTSNPSLFIWKPYKCNECGKTFHQVSFLTC

SEQ ID NO: 17770 - protein, 81 aa, Callithrix jacchus
CRSITFRDVAIDFSHQEWEYLNLVQKTLYQEVMMENYDNLVSLVNKMFFFYVLCLLDLDSRREIINDKKMDIYRKDSSVTL

SEQ ID NO: 17771 - protein, 81 aa, Monodon monoceros
VKKPVTSEDVAVNFNQEEWECLDASQRVLYQDVMSETFRNLMSVVRIFLSNPDLIAKFEQEEKQWRAGLRPPNGEGLHSGG

SEQ ID NO: 17772 - protein, 81 aa, Macaca mulatta
GQLTLKDVAIEFSQEEWTYLDPAQKTLYRDVMLENYRNLVSLDISCKCVNKDPPPKGKNSTGEAFHMVKLEGLESCDEALS

SEQ ID NO: 17773 - protein, 81 aa, Callithrix jacchus
QDSVAFEDVDVNFTQDEWALLDPSQKNLYRDVMQETFRNLASVGKKWKDQKIEDEYKNPRSNLRGLMGERLLESKTGHQLG

SEQ ID NO: 17774 - protein, 81 aa, Macaca mulatta
MLDNYRNLVFLGIAVSKRDLIPCLEQEKEPWNVKTHDMVAKPPVICSRIAQDLWPEQGIKDYFQEVILRQYKKCGHENLLL

SEQ ID NO: 17775 - protein, 81 aa, Macaca mulatta
MEPLKFRDVAVEFSLEEWQCLDTIQQNLYRNVMLENYRNLVFLGIAVSKPDLITCLEQEKEPLTMQRHEMVDEPPVMCSHF

SEQ ID NO: 17776 - protein, 81 aa, Callithrix jacchus
EMEPLTFRDVAIEFSLEEWQCLNPAQQDLFRNVMLENYRNLVFLGIAASKPDLITCLEKAKEPWKMKQHEMVDEPPGASTF

SEQ ID NO: 17777 - protein, 81 aa, Callithrix jacchus
MGFTQEEWQHLDPAQRTLYKDVMLENYSPVVSVGYYIPKPGVIVKLEQGEHPWILEEELPGHKYPVEQKFQGSISFKDVTV

SEQ ID NO: 17778 - protein, 81 aa, Macaca mulatta
SVAFEDVAVNFTQEEWSLLDPSQKNLYREVMQETLRNLASIGKKWKDQNIENEYKNPRSNQRGLMEERLFESEGHQPGEIL

SEQ ID NO: 17779 - protein, 81 aa, Bos taurus
LQGLMTFEDVAVDFTQEEWQYLNPPQRTLYRDVMLETYSNLVSVAGHHVTKPDLILKLEVEEKCLPEGKIPIWSFPEEACQ

SEQ ID NO: 17780 - protein, 81 aa, Acinonyx jubatus
ELVTFRDVVISFSQEEWEYLDSAQRDLYWDVMMENYSNLVSLDLESKYDTKYLFNGKDIIENNGFQWKVTEGKFIGLESSI

SEQ ID NO: 17781 - protein, 81 aa, Rhinopithecus roxellana
MGLLTFRDVAIEFSLEEWQCLDTAQRNLYKNVILENYRNLVFLGIAVSKPDLITCLEQEKEPLTMQRHEMVDEPPVMCSHF

SEQ ID NO: 17782 - protein, 81 aa, Rhinopithecus roxellana
PQASVCFEDVAMAFTQEEWEQLDLAQRTLYREVTLETWEHIVSLGLFLSKSDVISQLEQEEDLCRAEQVAPRGTSGLSQVT

SEQ ID NO: 17783 - protein, 81 aa, Rhinopithecus roxellana
SQGLVTIKDVSLCFSQEEWRSLDPSQTDFYGEYVMQENCGIVVSLRFPIPKLDMLSQLEGGEEQWVPDSQDLEERDILRVT

SEQ ID NO: 17784 - protein, 81 aa, Acinonyx jubatus
SQELLTFKDISVDFTQEEWGQLPLAHRNLYREVMLENYGNLLSVGYQLSKPSVISQLEKGQEPWMTEKEGPGDPSSDLKNK

SEQ ID NO: 17785 - protein, 81 aa, Rhinopithecus roxellana
VTFEDIAIYFSQEEWGLLDEAQRLLYLEVMLENFALVASLGCSHGTEDEETPSGQNVSVRVSQSKAGSSTQKTQSCEMCVP

SEQ ID NO: 17786 - protein, 81 aa, Rhinopithecus roxellana
GTVTFEDMAVKFPREEWNLLSEVQRCLYCDVTLENLALISSLGKPCLYSLCYTPRVRIPMAGVSPKKAHPCEMCGSILGDI

SEQ ID NO: 17787 - protein, 81 aa, Rhinopithecus roxellana
QLTFRDVAIEFSQEEWKCLNSTQRTLYRDVMLENYRNLVSLDLSRNCMIKELAPQWEGNREEVLHTVTLEQHEKHDIEEFC

SEQ ID NO: 17788 - protein, 81 aa, Rhinopithecus roxellana
QGHVTFEDIAVYFSQEEWGLLDEAQRCLYHDVMLENFSLMASVAGLSQSNHKDSCSQQKVTVSLNNGVAQCSPDDGHYTPK

SEQ ID NO: 17789 - protein, 81 aa, Acinonyx jubatus
SQESVTFADVAVDFTQEEWTLLDWSQRKLFRDVMLENISHLVSVGKQLYKLDTIFHLEQGEQLSTEGIGLLQCQSLGVPAD

SEQ ID NO: 17790 - protein, 81 aa, Rhinopithecus roxellana
HGKGPLQFRDVAIEFSLEEWHCLDTAQRNLYRNVMLENYRNLVFLGIIVSKPDLITRLEQGKKPLTMKRHEMVVKPPGRCE

SEQ ID NO: 17791 - protein, 81 aa, Rhinopithecus roxellana
MSQGSVTFQDVAIDFSEEEWGFLNPAERDLYTTVMLENYQNLVWLGLSISKSVISLLEKRKLPWIMGKEEIRVPLPDAPGA

SEQ ID NO: 17792 - protein, 81 aa, Bison bison
ARLSVTFDDVAVTFTQEEWGHLDPAQRTLYQEVMLENCGLLVSLGCPVPRPELIYRLEHGQELWTVKRDLSRSTCAGDKGK

SEQ ID NO: 17793 - protein, 81 aa, Bison bison
MAFRDVAVDFTQDEWVLLSPAQRSLYREVMLENYSNLVSLGIPFSKPELITQLEQGKETWREDRKCSPVSCLEPKPELHLC

SEQ ID NO: 17794 - protein, 81 aa, Bison bison
EQLTFKDIAVEFSQEEWECLDPAQRAFYMDVMVETLRNLISVDISHIHVVKKLQPIASSDRGDAFQTVTLERQESPEMKYF

SEQ ID NO: 17795 - protein, 81 aa, Bison bison
AHGSLTFSDVAIGFSQQEWECLDPVQKTLYRDVMMENYGNLVSLAGHSISKPNVITLLEQGKEPWLVVREETRSWCTDLDS

SEQ ID NO: 17796 - protein, 81 aa, Cebus imitator
MVTFSDVAIHFSHEEWGWLDSAQRDLYKDVMVQNYKILVSLGLSITKPYVITLLEDGKEPWMMEEKLSKGVTPDWESRLEN

SEQ ID NO: 17797 - protein, 81 aa, Cebus imitator
YQTPVSFKDVVVGFTQEEWHQLNPTQRALYRDVMLETYSNLVSVGYEGTKPDVILRLEQEEAPWIGEAACLGCHCWEDTWQ

SEQ ID NO: 17798 - protein, 81 aa, Cebus imitator
AQGSVTFEDVAVTFTQEEWGQLDATQRTLYQEVMMETCGLLVSLGCPLSKPELIYQLDHRQELWMSKKDLSQSSYPGDSTK

SEQ ID NO: 17799 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPELTEAS

SEQ ID NO: 17800 - protein, 81 aa, Cebus imitator
VQESVTFKDVAVLFTQEEWGQLSPAQRALYRDVMLENYSNLVSLGLLGPKPDIFSQLEKREEWMPEDPSGGFCLDWMTMPV

SEQ ID NO: 17801 - protein, 81 aa, Cebus imitator
TESVMAFGDVTVDFTQKEWRLLSPAQRALYREVTLENYSHLISLGILHSKPELIKRLEQGEAPWGEERRRQPGPHAGIYAE

SEQ ID NO: 17802 - protein, 81 aa, Callithrix jacchus
AQVSVTFEDVAVTFTQEEWGQLDATQRTLYQEVMLETCGLLASLGCPLSKPELIYRLDHRQEPWMVKRDLSQSSYPGDSTK

SEQ ID NO: 17803 - protein, 81 aa, Macaca mulatta
FQGLVTFADVAIDFSQEEWACLNSAQRDLYWDVMLENYSNLVSLDLESAYENKSLPTGKNIHEIRASKRNSDRRSKSLGRN

SEQ ID NO: 17804 - protein, 81 aa, Callithrix jacchus
SQASVSFQDVAVEFTQEEWQHLGLVEWTLYRDVMLENYSHLVSVGYCITKPKVISQLEQGEEPWSLEDEFLNQKYPGHFKV

SEQ ID NO: 17805 - protein, 81 aa, Macaca mulatta
QGYVTFEDVAVYFSQEEWRLLDETQRLLYRNVMLENFSLLASLGLASSKTHDITQLESWKEPFMPASEVVTSAIPRGCWHG

SEQ ID NO: 17806 - protein, 81 aa, Callithrix jacchus
FQLPLTFEDVAIYFSEQEWQDLQAWQKELYKRVMRSNYETLISLDDGLPKPELIAWIEQGEEPFRNWRESQKSGNIICSSV

SEQ ID NO: 17807 - protein, 81 aa, Callithrix jacchus
SQESVSFKDVTIEFTQEEWQQMAPVQRNLYRDVMLENYSHLVSVGYCLFKPEVIFKLEQGAEPWFSEEEFSNKSHPKDYRG

SEQ ID NO: 17808 - protein, 81 aa, Macaca mulatta
QELLTFRDVAIEFSPEEWKCLDPAQQNLYKDVMLENYRNLVSLGFVISNPDLVTCLEQIKEPYNLKMHETAAKPPAMCSPF

SEQ ID NO: 17809 - protein, 81 aa, Macaca mulatta
MLETYSNLVFVGQQVTKPNLILKLEVEEYPAEGKIPFWNFPEVCQVDEQIERQHQDDQEKRLLMQVGFSDKKTITTKSGRD

SEQ ID NO: 17810 - protein, 81 aa, Callithrix jacchus
TIKEAVTFKDVTVVFTEEELGLLDPAQRKLYRDVMLENFRNLLSIGNQPFHEDTFHFLRKEKFWMMKTTSQREGNLGGKIQ

SEQ ID NO: 17811 - protein, 81 aa, Macaca mulatta
QVLLTFRDVAIEFSQEEWKCLDPAQRTLYRDVMLENYRNLVSLDISSKCTMKEVLSTAQGNREVFHTGTLQRHESHHIGDF

SEQ ID NO: 17812 - protein, 81 aa, Callithrix jacchus
TQESLTLEDVAVDFTREEWQLLGPAQKDLYRDVMLENYSNLVAVGYQASKPDALFKLGQGQPPWTVKDGIHSGACSEIWKF

SEQ ID NO: 17813 - protein, 81 aa, Macaca mulatta
MSSGRAFPFSKPDLIFQLEQGEAAWGPDPWTLAGGEALRGMCTGGKTKTKNEEQTAQLNISKESESHRLIVEGLLMNIPQH

SEQ ID NO: 17814 - protein, 81 aa, Callithrix jacchus
ARGCMVFEDVFVYFSREEWELLDDAQRLLYHDVMLENFALLASLGIAFSRSDAVMKLEQGEEPWVYDQVDMTSATGREAKR

SEQ ID NO: 17815 - protein, 81 aa, Bos taurus
MKLGSVTFEDVAVYFSWEEWALLDEAQRCLYHDVMLENFALTSSLVVSSSSHTIAQLGLGEESFVLPRMHMIPLSTRWAQR

SEQ ID NO: 17816 - protein, 81 aa, Acinonyx jubatus
IQGSLTFGDVAVAFTHIEWKHLDAAQRALYKDVMLENYGNLVSVGLLSSKPKLITQLEQGSEPRMEVQQVPSGTCSVQEYW

SEQ ID NO: 17817 - protein, 81 aa, Rhinopithecus roxellana
VAFEDVAIYFSQEEWELLDETQRLLYHDVMLENFAVMASLGCWCGAEDEGAPSAESISVAELSQGRTPKADTSTDKSHPCE

SEQ ID NO: 17818 - protein, 81 aa, Rhinopithecus roxellana
MDLLLVTFDDVAVDFTQEEWTLLDPTQRSLYSDVMLENYKNLATVGGQIIKPSLISWLEQEESRTVRAGVLQGWEMQLETQ

SEQ ID NO: 17819 - protein, 81 aa, Rhinopithecus roxellana
PQESVAFEDVAVYFTTKEWAIMMPAERALYRDVMLENYEAVAFVVPPTSKPALVSHLEQGKESCFIQPQGVLSRSDWRAGL

SEQ ID NO: 17820 - protein, 81 aa, Acinonyx jubatus
SQELLTFKDISVDFTQEEWGQLPLAHRNLYREVMLENYGNLLSVAGYQLSKPSVISQLEKGQEPWMTEKEGPGDPSSDLKN

SEQ ID NO: 17821 - protein, 81 aa, Rhinopithecus roxellana
GSVTFEDVAVYFSWEEWDLLDEAQKRLYFDVMLENFALTSSLGCWHGVEHEETPEQRISVEGVPQFRTSKEGSSSQNAYSC

SEQ ID NO: 17822 - protein, 81 aa, Cebus imitator
LQGSVSFKDVTVDFTQEEWQQLDPAQKALYRDVMLENYCHFISVGFHMTKPDMIRKLEQGEELWTQRIFPSYSYLEEDGKT

SEQ ID NO: 17823 - protein, 81 aa, Cebus imitator
TEDRVVFEDVAIYFSQEEWGHLDEAQRLLYRDVMLENLALLSSLGCWHGAEDEVAPSQQGFSAGVSEVTTSKSCMITQKIH

SEQ ID NO: 17824 - protein, 81 aa, Cebus imitator
SQGPLTFMDVAIEFSQEEWKCLDLAQRTLYKDVMLENYRNLVSLGVGLPDLSVVSMLEQKREPWTLQSEEKIARDPDGREC

SEQ ID NO: 17825 - protein, 81 aa, Cebus imitator
RNTMPQDNESPPQQGEANQNDSLAFEDVAVNFTSEEWALLDPSQKTLYQEVMQETLRNLASIEVLWKRDSLKAKVISVEKF

SEQ ID NO: 17826 - protein, 81 aa, Cebus imitator
RDVAIEFSLEEWEHLDSNQKNLYGDVMLENYRNLVCLGLAVSKPDLITFLEQRKEPWNVKSAETVAIQPDIFSLDTQALLR

SEQ ID NO: 17827 - protein, 81 aa, Cebus imitator
SYEGSVSFRDVAIDFSREEWRHLDLSQRNLYRDVMLETYSHLLSVGYQFPKPEVVMLEQGKEPWILQGERPHHSCPGEKLW

SEQ ID NO: 17828 - protein, 81 aa, Cebus imitator
VRLTFRDVAIEFSQEEWRCLDPTQRALYRDVMLENYWSLVSLGLCHFDMNIISMLEEGKEPWTVKSYLKIARKPRMRECVK

SEQ ID NO: 17829 - protein, 81 aa, Cebus imitator
METLTFRDVAIEFSLEEWQSLNPAQQNLYRNVMLENYRNLVFLADIAVSKQNPITGLEQKKESCNMKRHEMVARPTAMCSS

SEQ ID NO: 17830 - protein, 81 aa, Cebus imitator
LQGLVMFEDVAVYFSREEWGLLNVTQKGLYQDVMLENFALLSSLGLAPSRSPVFTQLVDDEQLCVPSWVDVTLVSRTEASR

SEQ ID NO: 17831 - protein, 81 aa, Cebus imitator
GQGLLSFEDVAVDFTREEWQFLDPSQKVLYKEVMSENYRNLVSVGYQGTKPDSLFKLERGEPPWIVEGAARCQTCLGFVIQ

SEQ ID NO: 17832 - protein, 81 aa, Cebus imitator
AGWLTNYSQDSVTFEDVAVDFTPEEWTLLDQTQRNLYRDVMLENYKNLVAVDWKIHINIKWTAPQQNFFQGKSSMVEMNSE

SEQ ID NO: 17833 - protein, 81 aa, Macaca mulatta
PPQESVSFKDITVDFSRDEWQQLDLAQKSLYREVMLENYFNLISVGCQVPKPEVIFSLEQEEPCMLDGEISGQSHPDGDIG

SEQ ID NO: 17834 - protein, 81 aa, Macaca mulatta
RREQVTFEDVVVDFSQEEWGQLKPAQRTLYRDVMLDTFRLLVSVGHWLPKPNVISLLEQEAEPRAVDSRVPPGVYPEIKGH

SEQ ID NO: 17835 - protein, 81 aa, Callithrix jacchus
AAGSVTFKDVTMAFTQKEWEQLDPAQRNLYKDVMLENYSNLASMGCQAPKPDMISKLEKGEAPCLGKGKRLSQGCPSKIAR

SEQ ID NO: 17836 - protein, 81 aa, Callithrix jacchus
MLENYGNVASLGFPLLKPAVISQLEGGGELGGPSPLAAGTGLHVLRTGKGVDIQTDSDFTKEMYDRKEDVSFELQRDFSQE

SEQ ID NO: 17837 - protein, 81 aa, Macaca mulatta
ESVTFKDVAVLFTQEEWGQLSPAQRALYRDVMLENYSNLVSLDWMTLPASKKSTLRVAIPEEELGQWTIKERFRSSSHWKC

SEQ ID NO: 17838 - protein, 81 aa, Callithrix jacchus
RESGKAPVTFDDITVYLLQEEWVLLSQQQKELCGSDKLVPPLGPTVANPELFRKFRRGPEPWLGSVQGQRSLLEHHPGKKQ

SEQ ID NO: 17839 - protein, 81 aa, Callithrix jacchus
PPLPPGFKDVAIEFSLEEWQCLDTAQRNLYKNVILENYRNLVFLGIAVSKPDLIACLEQEKEPLIMKRDEMAGEPPVMCSH

SEQ ID NO: 17840 - protein, 81 aa, Macaca mulatta
ESVSFKDVAGDFTQEEWGQLDSPQRALYRDVMLENYQNLLALGPPLHKPDVISHLERGEEPWSMQREVPGGPRPEWQLKAV

SEQ ID NO: 17841 - protein, 81 aa, Callithrix jacchus
VAFEDVAVNFTQEEWALLDRSQKKLYREVMQETLRNLTSIGKTWSNQNAEERHQNPRRNLRRLIGERLFQSKESHQHAEVL

SEQ ID NO: 17842 - protein, 81 aa, Callithrix jacchus
SQGSVTFRDVAIDFSQEEWKWLQPAQRDLYRCVMLENYGHLVSLGLSISKPDVVSLLEQGKEPWLGKRDVKRDLFPALSPQ

SEQ ID NO: 17843 - protein, 81 aa, Macaca mulatta
VKESVTFKDVAIDFTLEEWRLMDPTQRNLHKDVMLENYRNLVSLGLAVSKPDMISHLENGKGPWVTMREISRIPYPDMEPK

SEQ ID NO: 17844 - protein, 81 aa, Callithrix jacchus
PTPNIWSVEFTQEEWTLLDPTERNLYRDVMLENYKNLFSVGKCGIIPCSFLWNKIQIMYLLCSRISDVKSEYSGMYTHCKN

SEQ ID NO: 17845 - protein, 81 aa, Bos taurus
LQGSVSFEDVAVDFTRQEWHTLDLAQRTMHRDVMLENYSNLASVGLCVAKPEMIFKLERGEELWILEEESSDNGRSSGLVF

SEQ ID NO: 17846 - protein, 81 aa, Bos taurus
SLGSVSFRDVAVDFTQEEWQHLDPEQKTTYRDVMLENYSHLISVEEVWKVHDLMEGSQENEDKHSRQTESINNKTLPEGRG

SEQ ID NO: 17847 - protein, 81 aa, Bos taurus
LQGSFSFEDLSVDFTQKEWQLLDPHQKDLYKDVMLENYSSLVSLGYEVMKPGVILKLEQGEDPWTGDGEIPSSGSIDQVFQ

SEQ ID NO: 17848 - protein, 81 aa, Bos taurus
MASFLVRIQGLILNVFHFPQAGLNMSKPDVVSLLEQGKEPWLGNGDVSRELFPASKSNGEIKEFSPKNVIFEDDSSQYLIM

SEQ ID NO: 17849 - protein, 81 aa, Papio anubis
KSKEPVTFKDVAVVFSEEELRLLNLAQRKLYRDVMLENFRNVVSVGHQSTPDGLTQLEREEKLWMMNMATQRDNSSGGKNL

SEQ ID NO: 17850 - protein, 81 aa, Callorhinus ursinus
VQESVTFKDVVVLFTRDEWAQLSPTQRALYRDVMLENYSNLVSLGLLGPQPELFSQLGKGEEWMLEDASGSFCLDWMTMPV

SEQ ID NO: 17851 - protein, 81 aa, Callorhinus ursinus
APGLVTFEDVAVYFSREEWGLLNLTQRSLYRDVMLENFALIGSLGFAPSRSHVVAQLESEEDLWMPNMVDLTLGSRAEARR

SEQ ID NO: 17852 - protein, 81 aa, Vulpes vulpes
MFLDSAQRNLYRDVMLENYRNLASVGDQLGKPSMFSHLEPGEELWPTERRIFPGTHPEPPIQPQDSISNQDIFAEISSIGM

SEQ ID NO: 17853 - protein, 81 aa, Callorhinus ursinus
QQRPVSFKDVVVGFTQEEWHRLNPAQRALYRDVMLETYSNLVSVGYEGTKPYVILKLEQEEAPWICEAACSGCHCQENICQ

SEQ ID NO: 17854 - protein, 81 aa, Callorhinus ursinus
CQGSLSFRDVAVGFTRKEWQQLDPTQRTLYRDVMLENYSHLVSVGCQVTKPAVISRLEQGQEPWMEEEEILRWSFPEEILQ

SEQ ID NO: 17855 - protein, 81 aa, Rhinolophus ferrumequinum
GQESLTFDDVAVDFTWEEWQLLVPEQKDLYRDVMLENYSHLVSLGYQACKPDMLSKLDRGESPWTMADEVHCWTRSEIWKD

SEQ ID NO: 17856 - protein, 81 aa, Rhinolophus ferrumequinum
SYERSVSFRDVAVDFSREEWQHLDLAQKNLYRDVMLETYSHLLSVGYQVPEPEVFMLEQGKKSWTLQDESPHQSCSEEKLW

SEQ ID NO: 17857 - protein, 81 aa, Ursus maritimus
VFKEAVTFKDVAVAFTEEELGLLDSAQRKLYQDVMLENFRNLVSVGHQPFKRDKWHIEREERLWSMKTATQIERNVGGSNQ

SEQ ID NO: 17858 - protein, 81 aa, Phyllostomus discolor
VQESVTFKDVIVDFTQEEWKQLDPVQRDLFRDVTLENYTHLVSIGLQVSKPDVISQLEQGTEPWIMEPGILVGGSGDWEAK

SEQ ID NO: 17859 - protein, 81 aa, Rhinopithecus roxellana
PQGLLTFRDVAIEFSQEEWKCLDPAQRTLYRDVMLENYRNLVSLDISSKCMMEFLSTAQSNREVIHTGTLERHESHHIGDF

SEQ ID NO: 17860 - protein, 81 aa, Acinonyx jubatus
LQVSVSFEDVTVNFSREEWQRLDPAQRRLYRDVTLENYSHLRSVGYQVPKPEVIFKLEQGEGPWTLEGETPHQSCSGEDIG

SEQ ID NO: 17861 - protein, 81 aa, Acinonyx jubatus
PQDLMTFKDVAVEFTQWEWGQLDPAQKDLYREVMLENFKNLASLGLPVSKPYVICQLEEGEEPCVVEGEISTGEGSYKSDT

SEQ ID NO: 17862 - protein, 81 aa, Acinonyx jubatus
NSQGLLTFRDVAIEFSQEELRCLNHSQWELYRDVMFENYGHLLFLGLVVSKPDLVIFLEQKKDVWAVKRKETVATHPGRWE

SEQ ID NO: 17863 - protein, 81 aa, Cebus imitator
QDSVAFEDVAVRFTQEEWALLVPSQKNLYRDVMQETFKNLASVGKTWKVQNIEDGYKDFRRNLSLLIREKHIESKESNHCG

SEQ ID NO: 17864 - protein, 81 aa, Cebus imitator
PEGLLSFKDISVEFTWDEWQLLDSTQKYLYREVVLENYHNLISVGYHGAKPDLIFKLEQGEDPWIVNAKISRESCPDGWEE

SEQ ID NO: 17865 - protein, 81 aa, Cebus imitator
LQESFSFDDLSVDFTQKEWQLLDPSQKNLYKDVMLENYSSLVSLGYEAMKPDVIFKLEQGEEPWIGDEEIPSSYSPEVWKV

SEQ ID NO: 17866 - protein, 81 aa, Bubalus bubalis
SQESVTFQDVAVDFTQEEWALLDTSQRMLSRDVMLENISHLVSVGNQLYKSDVISHLEQGEQLSREGLGFLQGQSPVISDR

SEQ ID NO: 17867 - protein, 81 aa, Cebus imitator
GSVSFTDVTVDFTQEEWEQLDPSQRILYMDVMLENYSNLLSVEVWKADDQMERDHRNPDQQPRQFIILKNQTPMEERGDLF

SEQ ID NO: 17868 - protein, 81 aa, Cebus imitator
AAGSVTFKDVTMAFTQKEWEQLDPAQRNLYKDVMLENYSNLASMGCQAPKPDMISKLEKGEAPCLGKGKRPSQHCPSKMAR

SEQ ID NO: 17869 - protein, 81 aa, Cebus imitator
QLTFRDVAIEFSQEEWKCLNSTQRTLYRDVMLENYRNLVSLALSHNGVIKELAPKQESNMGDVFHTVALEQHETPDMQEFC

SEQ ID NO: 17870 - protein, 81 aa, Cebus imitator
LPFQVTFSDVAIHFSHEEWGWLDSAQRDLYKDVMVQNYKILVSLAGLSITKPYVITLLEDGKEPWMMEEKLSKALSRLDSV

SEQ ID NO: 17871 - protein, 81 aa, Macaca mulatta
MLENYNNLITVGYPFTKPDVIFKLEQEEEPWVMEEEVLRRHWKGEIWGVDEHQKNQDRLLRQVEVKFQKTLTEEKGNECQK

SEQ ID NO: 17872 - protein, 81 aa, Macaca mulatta
MLETYNNLVSLGLAISKPDVISFLEQGKEPWMVERVVSGGLCPVLESRYDTKELSPKQHVYEVESPQWEIMESLTSYGLEC

SEQ ID NO: 17873 - protein, 81 aa, Macaca mulatta
KTGLLAFSDVVIEFSPEEWACLDPAQRNLYRDVMFENYRNLVSLAILSYSIQDLLPEQDMKDLCQKVTLTRHRSWGLDNLH

SEQ ID NO: 17874 - protein, 81 aa, Callithrix jacchus
VQESVTFRDVAVFFSPDEWLHLDSAQRALYREVMLENYSSLVSLGILFSKPKVISHLEQGENPWMVESGVPQGTHLGWESL

SEQ ID NO: 17875 - protein, 81 aa, Callithrix jacchus
MCEIHVIFNKTGIAASKPDLITCLEQGKEPWNVKRHEFEAKLPVASSYFAQDLWPKQVIKNHFQKVILRRYKKCRHENFQL

SEQ ID NO: 17876 - protein, 81 aa, Macaca mulatta
AQESVTFRDVAVFFSQDEWLHLGSAQRALYREVMLENYSSLVSLGIPFSMPKLIHQLQQGEDPCLEEREVPSDTCLGFKTW

SEQ ID NO: 17877 - protein, 81 aa, Callithrix jacchus
AQVSVTFDDVAVTFTEEEWGQLDLAQRTLYQEVMLENCGLLVSLGCPVPRPELICHLDHGQEPWTGKEDLSQGTRPGDKGK

SEQ ID NO: 17878 - protein, 81 aa, Monodon monoceros
CFVSKPDVISLLEQGKEPWKVVRKGRRRYPDLETNYETKKLSSENDIHEINLSQWKVMERIKNHGLNRLILKNDWESKRKF

SEQ ID NO: 17879 - protein, 81 aa, Callithrix jacchus
YQELVTFRDVAVDFSQEEWDCLDSSQRHLYSNVMLENYRILVSLGLCFSKPGVILLLEQGKAPWMVKRELTKGLCSGWAPL

SEQ ID NO: 17880 - protein, 81 aa, Macaca mulatta
LGIAVSKPDLITCLEQRNEPWNVKKHETIGRHPAVSSHFTQDLLPEHGIKDSFQKVILGRYGSCGTENLDLKKDWERVGES

SEQ ID NO: 17881 - protein, 81 aa, Monodon monoceros
MLEKGRGIENEGLGSSLQREHSGGNGYCVSDYQIPGLPVPGPDVIFQLKRGDEPWIVELHGSEGKECAENVSQDWETKPEI

SEQ ID NO: 17882 - protein, 81 aa, Monodon monoceros
GVMESVTLEDVAVGLIQEWALLDDARRNLYRYVLLDNCRTLAPRGTPSCKACLVSQVGPREELMTAEQGILCATGVDWESQ

SEQ ID NO: 17883 - protein, 81 aa, Callithrix jacchus
SYEGSVSFRDVAIDFSREEWRHLDPSQRNLYRDVMLETYSHLLSVGYQVPEAEVVMLEQGNEPWALQGERPRHSCPGEKLW

SEQ ID NO: 17884 - protein, 81 aa, Bos taurus
PQGSVTFEDVAVYFSWNEWCLLDEVQIRLYLDVMLENFALVCMLGSWRGVQDKETPSEEIKPAGVLQFRTPRAGLSPEKTQ

SEQ ID NO: 17885 - protein, 81 aa, Bos taurus
SLDAVTFTDVAVNFSQDEWEWLTLAQRTLYKKVMLENYSSLASLGLCISKPDVISLLEQDKEPWMMKGELTRGLCPDLEYV

SEQ ID NO: 17886 - protein, 81 aa, Zalophus californianus
ASVSFKDVTVEFTQEEWQQMGPIQRTLYRDVMLENYNNLVSVGEHIGNCIFKPAVIFKLEQGEEPWFLEEEFSNQSHREDY

SEQ ID NO: 17887 - protein, 81 aa, Pan troglodytes
MLENYKNLATVGYQLFKPSLISWLEQEESRTVQRGDFQASEGKVQLKAKELALQQDVLGEPTSSGIQMIGSHNGGEVSDVK

SEQ ID NO: 17888 - protein, 81 aa, Sapajus apella
AQKVLTFRDVAIEFSLEEWKFLDPAQQNLYRDVMLENYRNLFSIGLTVSKPGLITCLEQRKAPWNLKRREAVDGHPAMSSH

SEQ ID NO: 17889 - protein, 81 aa, Delphinapterus leucas
AQGLMTFEDVAVDFTQEEWQYLNPPQRNLYRDVMLETYSNLVSVAGQQVTKPDLILKLEVEEPCLPEGKIPIWSFPEEACQ

SEQ ID NO: 17890 - protein, 81 aa, Pan troglodytes
TFKEGLTFKDVAVVFTEEELGLLDPVQRNLYQDVMLENFRNLLSVGHHPFKHDVFLLEKEKKLDIMKTAIQRKGKSADKIQ

SEQ ID NO: 17891 - protein, 81 aa, Sapajus apella
MAHLMFRDVAIDFSQEEWEGLDLKQRDLYRDVMLENYSNMVSLGLCIYQPDVFSLLEKGKEPWKILRDETRGPCPDMQSRC

SEQ ID NO: 17892 - protein, 81 aa, Acinonyx jubatus
KPGALSFADVAVYFSSEEWGCLRPAQRALYRDVMRETYGHLGALGFAGPKPALISWMERKKEAWSPEAEDPEDRARHPGYG

SEQ ID NO: 17893 - protein, 81 aa, Acinonyx jubatus
FQGSVSFRDVAISFSQEEWACLDPAQRALYRDVMLENYSHLLSLGRSISKPDVITLLEQEKEPWVVVRKETSGWYPDLESN

SEQ ID NO: 17894 - protein, 81 aa, Acinonyx jubatus
VQERLTFRDVAIEFSQEEWVCLDPSQRALYRDVMLENYRNLVSLGKENVPPEVGICPNSSATFVIKELLPKKDLNNGELYQ

SEQ ID NO: 17895 - protein, 81 aa, Rhinopithecus roxellana
PQSLLTFSDVAIEFSQEEWKCLDPVQRTLYRDVMLENYRNLVSLEFRSVTQAKVQWCDLGSLQPPLPRFKQLSCLSLPSSW

SEQ ID NO: 17896 - protein, 81 aa, Acinonyx jubatus
QEPVTFEDVAVYFTQNQWASLDPMQRALYREVMLENYTNMASLGGESRIKNEEAAGKREASEEAEWPRMPGGGLLRNVSQH

SEQ ID NO: 17897 - protein, 81 aa, Rhinopithecus roxellana
MAFEDVAVYFSQEEWGLLDTAQRALYRRVMLDNFALVASLGLSTSRPRVVIQLERGEEPWVPSGTDTVLSRNTYRRRNPGS

SEQ ID NO: 17898 - protein, 81 aa, Rhinopithecus roxellana
FSREPVCPFEEETKVERMVEDYLANSYQDSVMFDDVAVEFTPEEWVLLDTTQKYLYRDVMLENYMNLASVADKKLQWMETL

SEQ ID NO: 17899 - protein, 81 aa, Rhinopithecus roxellana
VMFRDVAIDFSQEEWECLDSAQRDLYRDVMLENYSNLVSLDLPSRCASKDLSPEKNTYETELSQWEMNDRLENCDLEESKS

SEQ ID NO: 17900 - protein, 81 aa, Acinonyx jubatus
MDSVAFEDVTVKFTMEEWALLDPSQKKLYRDVMQETFRNLASIVCISEEKWEVYDSEDQDENHGTHLISQMVGRLCKCKEC

SEQ ID NO: 17901 - protein, 81 aa, Rhinopithecus roxellana
FQELVTFRDVAIDFSQQEWEYLDPNQRDLYRDVMLENYRNLVSLGGHSISKPVVVDLLERGKEPWMILREETQFTDLDLQC

SEQ ID NO: 17902 - protein, 81 aa, Rhinopithecus roxellana
LIGLLQFRDVAIEFSLEEWHCLDTAQRNLYRDVMLENYRNLVFLGIPVSKPDLITCLEQGKKPLTMKRHEMVAKSPGPGMV

SEQ ID NO: 17903 - protein, 81 aa, Rhinopithecus roxellana
GRLTFRDVAIEFSFMEWKCLNPAQRALYREVMLENYRNLEFVDSSLKSMMEFSSHEHSNTGEGFYTGTLERRKSYHIGDFC

SEQ ID NO: 17904 - protein, 81 aa, Rhinopithecus roxellana
QASVCFEDVAMAFTQEEWEQLDLAQRTLYREVTLETWEHIVSLDWKTTLEENRLNSEKDGAREELSHHVEVKQCVQEEPPC

SEQ ID NO: 17905 - protein, 81 aa, Acinonyx jubatus
NFWILRLPPGSKGEAPKEWGKLDEWQKELYKHVMRGNYETLVSLDYAISKPEVLSQTEQGKEPCSWRRTAPKVPDVPVDPS

SEQ ID NO: 17906 - protein, 81 aa, Bison bison
PLESVTFGDVAIDFTQEEWSLLDKSQKNLFRNVMLETVTHLVSVAYQISKSDVVFQLEQGKELWTQAAGGLQGQSPGSESL

SEQ ID NO: 17907 - protein, 81 aa, Bison bison
FQEPVSFKDVAVVFTEEELGLLDSAQRRLYQEVMLENFQNLLSVGNQPFKPELIFQLEREERLMMESQRDGCSGTKSPHNM

SEQ ID NO: 17908 - protein, 81 aa, Bison bison
FQGSVTFRDVSIDFSQEEWEWLQPAQRDLYRHVMLENYGHLVSLGLNMSKPDVVSLLEQGKEPWLGNGDVSRELFPASKSN

SEQ ID NO: 17909 - protein, 81 aa, Cebus imitator
VQEPVTFKDVAVDFTQEEWGQLDLVQRTLYRDVMLETYGHLLSVGNQIAKPEVISLLEQGEEPWSVEQTCPQRACPEWMRN

SEQ ID NO: 17910 - protein, 81 aa, Cebus imitator
LQGLVTFEDVAVEFTQEEWALLDPAQRTLYKDVMLENCRNLASLGCHVNKPRLISQLEQDKKVMTEERGILPNTCPDLETL

SEQ ID NO: 17911 - protein, 81 aa, Cebus imitator
IQDSVVFEDVAVNFTQEEWALLDLAQRNLYRDVMLENFQNLASLGYLLHTPHLISQWEQEEDLQTVKRELIQGICVREHQE

SEQ ID NO: 17912 - protein, 81 aa, Cebus imitator
MNSVAFEDVAVNFTQEEWALLDPSQKNLYRDVMQETFRNLASIGNKGEDQSFEDQYKKSWRNLRHIISHSGNNPHRCEECR

SEQ ID NO: 17913 - protein, 81 aa, Callithrix jacchus
KPGLVTFEDVAVAFTQEEWQYLNPLQRTLYRDVMLETYSNLVFVGQQVTKPDLILKLEVEECPVEEKIPFWSFPEICQVNE

SEQ ID NO: 17914 - protein, 81 aa, Callithrix jacchus
GHLTFTDVAIEFSQEEWKCLEPTQKALYKDVMLENYRNLVSLGISLPDLNINSMLERRRELWSGESEVKIAKRSDRRERIE

SEQ ID NO: 17915 - protein, 81 aa, Callithrix jacchus
LVTKESMTFKDVAVDITQEDWELMRPVQKELYKTVTLQNYWNMVSLGLTVYRPTVIPILEEPWMVIKEILEGPSPEWETKA

SEQ ID NO: 17916 - protein, 81 aa, Monodon monoceros
LVKYILSVLFSQGGCSVSKPDVITLLEQGKEPWMVVRDEKRRRSLDLESRYGTKKLFEVKDVCEMNVSQWEIMERIRSCGL

SEQ ID NO: 17917 - protein, 81 aa, Callithrix jacchus
PKVPVSFEDVSLYFTKTEWKLLDLRQKVLYKRVMLENYSHLVSLGFSFSKPHLISQLERGEGPWVADIPRTRATRGLLIGD

SEQ ID NO: 17918 - protein, 81 aa, Callithrix jacchus
SQGLVTFRDVALDFSQEEWEWLKPSQKDLYRDVMLENYRNLVWLGLSFSKPNMISLLEQGKEPWMVERKMSQGHCADWESW

SEQ ID NO: 17919 - protein, 81 aa, Callithrix jacchus
ALRSVIFSDISIDFSPEEWEYLDLEQKDLYRDVMLENYSNLVSLGCFISKPDVISLLEQGKEPWKVVRKRRRQYPDLETKC

SEQ ID NO: 17920 - protein, 81 aa, Callithrix jacchus
EMGVLTFREVAIEFCLEEWQCLDTAQRNLYRNVMLENYRNLVFLGIAASKPDLITCLEQGKEPWNVKRREMVAEAPGWSHV

SEQ ID NO: 17921 - protein, 81 aa, Callithrix jacchus
KVSITFKDLAVRFSEEEWRLLEEGQREFYRDVMRENYETLVSVGTAELLPLSAFLSPSEPGGAIGGGSRTDEGQEPAGCGG

SEQ ID NO: 17922 - protein, 81 aa, Callithrix jacchus
NFWILRLPPGSKGEAPKEWGKLEDWRKELYKHVMRGNYETLVSLDYAISKPEVLSQIEQGKEPCSWRCPGLKIPDVPVDPS

SEQ ID NO: 17923 - protein, 81 aa, Ovis aries
MTFKDVAVDITQEDWELMRPVQKELYKTVTLQNYWNMVSLGLTVYRPTVIPMLEEPWMVLKEILEGPSPEWETKAQEYTLV

SEQ ID NO: 17924 - protein, 81 aa, Ovis aries
LLEIHSWDPAMAIRTLMSKGQESVTFKDVAVDFTLEEWGRLGPGQRELYRDVMLENYQNLLSLGEALPPALLSCPLCPPTA

SEQ ID NO: 17925 - protein, 81 aa, Ovis aries
MEFSWEEWQLLDSVQKHLYRDVTLENYSNLVSVGYHGTKPDLIFKLEQGEEPWIINLEVSHQSCPDGWEKWHQKSHDEFES

SEQ ID NO: 17926 - protein, 81 aa, Ovis aries
DLMTFEDVAVEFTWWEWGQLDSTQKDLYREVMLENFKNLASLDWERRPQTKEPMLSQGLSKEELFQRASVEKHISDELRTS

SEQ ID NO: 17927 - protein, 81 aa, Ovis aries
AAGSVTFNDVTMAFTRKEWEQLDPAQKSLYKDVMLENYSNLASMGYQALKPDMISKLEKGEEPWLGKGKRPKQAGSSEIAR

SEQ ID NO: 17928 - protein, 81 aa, Ovis aries
SHTLVTFKDILVNFTREEWKLLDAAQQIMYKDVMLENYRNLVSLGHQLPKPDVILRLEKGEEPWLVEREIHQETHPDLETS

SEQ ID NO: 17929 - protein, 81 aa, Ovis aries
SLGSVSFKDISVDFSREEWQQLDLAQKSLYRDVMLENYFNLISVGCQVPKAEVIFNLEWGEEPFMWNGKISSQSCLDQHIG

SEQ ID NO: 17930 - protein, 81 aa, Vulpes vulpes
QESVTFKDVAVDFTLEEWGQLGPGQRELYRDVMLENYRNLLSLGAGPPGSKPEVISRLERGEEPKMEKREAWQATCPDLDT

SEQ ID NO: 17931 - protein, 81 aa, Ovis aries
RLEGQLTFQDVAIDFTQEEWECLDLGQRELYRDVMLQNYGNLASLGLVSKLDLVAFLEQLKDPRNIKRMETTATYPAMSPQ

SEQ ID NO: 17932 - protein, 81 aa, Phyllostomus discolor
AQESVTFGDVAVLFSRDEWLCLDSAQRTLYREVMLENYHSLVSLGILFSKPKVIFQLQQGEDPWMVGNGLSYGARLGWGSL

SEQ ID NO: 17933 - protein, 81 aa, Phyllostomus discolor
KLQGMLSFSDVAVYFTWEEWQLLDTAQRNLYQDVMLENHSNLMSLGCQATKPEAMVCLEKEEQGIIEREFPSHFSPEAMWQ

SEQ ID NO: 17934 - protein, 81 aa, Ursus maritimus
SQSFLTFEDVAMYFSQEEWELLDPTQKALYNDVMWENYETVISLAVPVHQILAFSEKTNTKDWTVAPELILPESQSFLTFE

SEQ ID NO: 17935 - protein, 81 aa, Phyllostomus discolor
AQESVMFSDVSIDFSQEEWECLNDDQRDLYRDVMLENYNNLVSMAGHSISKPDVISFLEQGKEPWLVNREVTGGQCPVLGS

SEQ ID NO: 17936 - protein, 81 aa, Phyllostomus discolor
PKVPVSFEDVSVYFTKTEWKLLDIKQRILYKRVMLENYRHLVSLGLSSSKPHLVSLLERGEGPWAADINRTRAATGIQTGE

SEQ ID NO: 17937 - protein, 81 aa, Rhinopithecus roxellana
GWVPALFDEVAIYFSDEEWEVLTEQQKALYREVMRMNYETVLSLEFPFPKPDMITRLEGEEESQNSDDWQLQGGTSAENEE

SEQ ID NO: 17938 - protein, 81 aa, Rhinopithecus roxellana
MLFISNKAGIAVTKPDLITCLEQGKEPWNIKSHEMVAKPSVICSHFAQDLWPERDIKDCFQEAILKKYGNYEHDNLQLQKG

SEQ ID NO: 17939 - protein, 81 aa, Rhinopithecus roxellana
QGRVTFRDVAIEFSLAEWKCLNPAQRALYREVMLENYRNLESVDISSKCMMKEVSSTGQCNTEVFHTGTVQRHESHHIRDS

SEQ ID NO: 17940 - protein, 81 aa, Rhinopithecus roxellana
MGLLTFRDVAIEFSLEEWEHLEPAQKNLYQDVMLENYRNLVSLGLLVSKPDLITFLEQRKEPWNVKREETVAIQPDVFSHY

SEQ ID NO: 17941 - protein, 81 aa, Rhinopithecus roxellana
ADVSLAFRDVSIDLSQEEWECLDPAQRDLYKDVMLENYSNLVSLGYTIAKPDVITLLEQQQEPWIVMREGTRSWYADLEYK

SEQ ID NO: 17942 - protein, 81 aa, Bison bison
APVVVTFKDVAVTFTPEEWGQLDLDQRTLFREVMLETCGLLVSLGHPIPKPELIHLLEHGQKLWTGTRGLPHSTSPGDRPK

SEQ ID NO: 17943 - protein, 81 aa, Bison bison
AHGSVTFRDVAIDFSQEEWEFLDSAQRDLYRDVMWENYSNFISLGPSMSKPDVITLLDEGKEPWMVVREGTGKHHPDLESR

SEQ ID NO: 17944 - protein, 81 aa, Odocoileus virginianus
PQVSVNFEDVAVTFSWEEWGLLDEPQRCLYRDVMLENLALITSLGCCHEVENEKTSFEQNVYFQRMSQIRTPRADLSSKKA

SEQ ID NO: 17945 - protein, 81 aa, Odocoileus virginianus
SRSLENDGVCFSEQEWENLEDWQKELYANVMKSNYETLVSLKVLGQPEGDMELGAEMPGDLEEEESHGGHPVEEVVVKQET

SEQ ID NO: 17946 - protein, 81 aa, Cebus imitator
SQGLVSFKDVAVDFTQEEWQQLDPAQRTLYRDVMLENYSHLVSMGYPVSKPDVISKLEQGEEPWIVKRGISNWIYPDEYQA

SEQ ID NO: 17947 - protein, 81 aa, Cebus imitator
MLENYRNLVSLGICLPDLSIISTLKQSRGPWNLQSEVKIENTPDGRECIKGVNTESSSKLGSNTGNKSLKNQLGLTFQLHL

SEQ ID NO: 17948 - protein, 80 aa, Cebus imitator
MPLFSQHVAIEFSLEEWQCLDTAQRNLYRNVMLENYRNLVFLGIAVSKPDLITCLEKEKEPWNMKRHGMVDKPPGWSAVK

SEQ ID NO: 17949 - protein, 81 aa, Cebus imitator
CQEMVTFEDVAVHFTKTEWTSLSPAQRALYRSVMLENYGNLTAMGYPVPKPALISLLEGGDVAWDLEAQDDPLAEGTKNIC

SEQ ID NO: 17950 - protein, 81 aa, Callithrix jacchus
SQGSVTFRDVAIDFSQEEWKWLQPAQRDLYRCVMLENYGHLVSLAGLSISKPDVVSLLEQGKEPWLGKRDVKRDLFPVSES

SEQ ID NO: 17951 - protein, 81 aa, Macaca mulatta
SLGSVTFTDVAIDFSQDEWEWLNLAQRSLYKKVMLENYRNLVSVGLCLSKPDMISLLEQEKDPWVIKGEMTRSLCPDLECV

SEQ ID NO: 17952 - protein, 81 aa, Callithrix jacchus
VKESVTFKDVAIDFTLEEWRLMDPIQRNLHKDVMLENYRNLVFVGLAVSKPDMISHLENGKGPWVTVREISRMPYPDLETK

SEQ ID NO: 17953 - protein, 81 aa, Macaca mulatta
FQGSVSFKDVTVGFTQEEWQHLDPAQRTLYRDVMLENYSHLVSVGYCIPKPEVILKLEKGEEPWILEEKFPSQRHLELINT

SEQ ID NO: 17954 - protein, 81 aa, Macaca mulatta
LKGLVTFEDVAVEFTQEEWALLDPAQRTLYRDVMLENFRNVASLGDQVDKPGLITQLEQEDEVMTEERGILPDVENPFKAK

SEQ ID NO: 17955 - protein, 81 aa, Ovis aries
SVTFEDVVVYFSWEEWGLLDENQRCLYHDVMLENFALVTSLGCWYGMEEAVAFSVESVPVEQTSRGKTVVPYPSIEKTQPC

SEQ ID NO: 17956 - protein, 81 aa, Ovis aries
PQEPVTFADVAVLFTPEEWLFLDSSQKSLYRDVMLENYRNVASVGDQLCKTRMSSHLEQREELCVTERGIFPGAHLGPHLQ

SEQ ID NO: 17957 - protein, 81 aa, Ovis aries
RGSVTFEDVAVYFSWEEWALLDEAQRCLYHDVMLENFALTSSLGCCHGVEDKGAPSEKSISVEGMSQIKTLKADSSPQKGQ

SEQ ID NO: 17958 - protein, 81 aa, Ovis aries
FQDPVTFEEVSVDFSQDEWAQLAPAQKILYQDVMLENYRDLTSVGYHLCKPRLLTQEELRTRKRRLLQDTCADQNSQLKTK

SEQ ID NO: 17959 - protein, 81 aa, Ovis aries
VQDCVVFEDVAVYFSQEEWGLLDEAQKHLYHAVMTENLALVTSLGCWHGAPGEEASSEQGVSIGMSEVRTAKPDPASRKAQ

SEQ ID NO: 17960 - protein, 81 aa, Ovis aries
QEQLTFEDVAIEFTQEEWEFLDPAQRALYRDVMLETYRNLLSVGVGQAGGLDPLWLLLRKMKQKTVMETVFLMLFSCSVQS

SEQ ID NO: 17961 - protein, 81 aa, Ovis aries
MGFSKQKISKPSVTSQLEQKEEAWVLPLQNFEARKILRESHTEFKHQVGQLDQDVSETAEPCGTSSEGANKDISPPPSWGG

SEQ ID NO: 17962 - protein, 81 aa, Ovis aries
FRKGQLTFQDVAIDFTQEEWECLDLGQRELYRDVMLQNYGNLASLGLVSMLDLVAFLEQLKDPRSMRRMETTAIYPAMSSQ

SEQ ID NO: 17963 - protein, 81 aa, Ovis aries
CGSLVAFEEVAMHFSREEWELLDEAQRQLYHTVMLETLELVTSLGCWPVVEDEEVPSERNASGEVVSQVRTPSVPPSMQKA

SEQ ID NO: 17964 - protein, 81 aa, Ovis aries
QAPVTLKDVVVTFTRQEWKLLDPTQRTLYQEVVLETSGLLASLGDKAETKTTETTASQQALFKGRLLQRSLTQEGCSVSPL

SEQ ID NO: 17965 - protein, 81 aa, Ovis aries
AHGLVMFKDVAIDVSQEEWECLNPAQRNLYKDVMLENYSNLVSLGLSISKPAVITSLEQGKEPWMVMREVTRERCPDLVSK

SEQ ID NO: 17966 - protein, 81 aa, Ovis aries
SQAPVTFEDMAMYLTREEWRPLDPTQRDIYRDVMQENYGNVVSLDFEIRSENEVNPKQEISEDVEFEAASERPVGNTEENP

SEQ ID NO: 17967 - protein, 81 aa, Ovis aries
SMCEVSFEDVTVDFSQEEWQHLDPVQRRLYWDVTLETYSHLCAVGYQVPKPEVIFRLEQGEGSWTLEKETPHHSCSDEGFG

SEQ ID NO: 17968 - protein, 81 aa, Bison bison
MGRLTFQDVAIDFTQEEWECLDLDQRELYRDVMLQNYGNLASLGLVSKLDLVTFLEQLKDSRNVRRMETTAIYPGRYEWLE

SEQ ID NO: 17969 - protein, 81 aa, Bison bison
LRGLVMFKDVAIDVSQEEWECLNPAQRNLYKDVMLENYSNLVSLGLSISKPAVITSLEQGKEPWMVMREMTRERCPDLVSQ

SEQ ID NO: 17970 - protein, 81 aa, Bison bison
QGHVTFEDVAVSFSQEEWGLLGEAQRLLYYDVMLENLSLIASLGCWQGGKAEKAISKQCVSVEQVTQDRSPQPDPSTLKTL

SEQ ID NO: 17971 - protein, 81 aa, Bison bison
QACVTFEDVAIYFSQDEWRLLNETQRFLYCDVMLENFALTTSLGCWHRVDKEEAASEQSVSVAVSHIHTSKADSLTQMAHP

SEQ ID NO: 17972 - protein, 81 aa, Bison bison
QITVEDVAIKFTPEEWECLAPAQRTLYWDVMLETYRNLLSVDISPIHIIKKLQSKENTNSTDTFQTVILGRHESHGVQDFY

SEQ ID NO: 17973 - protein, 81 aa, Odocoileus virginianus
FEGSVSFEDVAVDFTRQEWHSLDLAQRTMHRDVMLENYSNLASVGLCVAKPEMIFKLERGEELWILEEESSDHGYTGANSS

SEQ ID NO: 17974 - protein, 81 aa, Odocoileus virginianus
FKGSVTLQDVAVEFTPEEWQLLDCDQRTLYWDVMLENFRNLISVGCPVTETTVIFKVEQGQEPWMVEGENSRWSSPEADCP

SEQ ID NO: 17975 - protein, 81 aa, Odocoileus virginianus
QDSVTFEDVAVNFSWEEWGLLDESQKRLYHDVMLENLALISSLGCWPGEEDKEAFSEQSISDQGYSQIKIVKAGLSPQKAN

SEQ ID NO: 17976 - protein, 81 aa, Odocoileus virginianus
TQVSVTFDDVAVTFTQEEWGHLDPAQRTLYQEVMLETCRLLLSLGCPVPRPELIYQLEHGQELWVVKRDLSGSTCPGYRSE

SEQ ID NO: 17977 - protein, 81 aa, Odocoileus virginianus
PVTFDDVAVYFSQEEWRLLGEAQRLLYHDVMLENFALVASLGCWHTAENVSVEVPQRNTKKTDLSSQKICPWEMGNLALEG

SEQ ID NO: 17978 - protein, 81 aa, Odocoileus virginianus
AHTSLSFRDVAIDLSQEEWECLNPVQRALYRDVMLENYSNLVSLGCSTPKPDMITLLEQEKEPWMIMREGTGSWFTDLESK

SEQ ID NO: 17979 - protein, 81 aa, Odocoileus virginianus
TQLTIEDVDIKFTPEEWECLDPAQRALYWDVMEETYRNLLSVDMSQMHMVKKLQGTRNSGKGEITQKVMLGRAESHEIKDD

SEQ ID NO: 17980 - protein, 81 aa, Odocoileus virginianus
MESVTLEDVAMELIQEWTLLDDAGRNLCRRVLQDNCRTPAPRAAGTPPCKASLVSQVEPREELKAAEHSVLCATGVDWESQ

SEQ ID NO: 17981 - protein, 81 aa, Cebus imitator
AQELVMFRDVAIDVSQEEWECLNPAQRNLYKDVMLENYSNLVSLGLSVSKPAIISSLEQGKEPWMLVREESGRWCPDLASR

SEQ ID NO: 17982 - protein, 81 aa, Cebus imitator
MLENYGSVASLAAFPFPKPALISQLEQGEAPWCSAPQGALDGEGQRGISSGEILELPGATMWSLRIKPIPKKTVAKRETRS

SEQ ID NO: 17983 - protein, 81 aa, Callithrix jacchus
CEASVSFEDVTMAFSREEWQQLDPAQKRLYQDVMLELYSHLFSVGYQIPNPDVIFRRLKEKEPCTEEAELSHQRCQEGEFG

SEQ ID NO: 17984 - protein, 81 aa, Callithrix jacchus
PLGSELFRDVAIVFSQEEWQWLAPAQRDLYRDVMLETYSNLVSLGLAISKPDVISFLEQGKEPWMVERVVAGGLCPVLESR

SEQ ID NO: 17985 - protein, 81 aa, Macaca mulatta
FQGSVSFEDVTVGFSQEEWQHLDLSQRALYRDVMLENYSNLVSVGYCVYKPEVIFRLEQGEEPWRLEEEFPSQSFPEVWTA

SEQ ID NO: 17986 - protein, 81 aa, Callithrix jacchus
MLENYRNLVSLGLPFTKPKVISLLQQGEDPWKVEKDSSGSPCLGLKSSRKTTKSTQTQDSSFQGLILKRSNRNGPWDLKLE

SEQ ID NO: 17987 - protein, 81 aa, Callithrix jacchus
METLTFRDVAIEFSLEEWQCLNPAQQNLYRNVMLENYRNLVFLDIAVSKQNPITCLEQTKEPCNMKRHEMVARPTAMCSSF

SEQ ID NO: 17988 - protein, 81 aa, Callithrix jacchus
KPGAVSFADVAVYFSPEEWGCLRPAQRALYRDVMRETCGHLGALGFSGPKSAFISWVEGEMEAWSPEVQDPEGESPGTVSG

SEQ ID NO: 17989 - protein, 81 aa, Macaca mulatta
EMGPLTFQDVTIEFSLEEWQCLDTAQQTLYRDVMLENYRNLVFLGIAVSKLDLIACLKQGKESWNMKRHEMVTKPPVTRSH

SEQ ID NO: 17990 - protein, 81 aa, Macaca mulatta
FQGFVSFKDVAVNFTEEEWRELDPAERVLYRDVMLETYRNLVSLIGCPFSKPAIISQLEEVVNPQTHMQEGEVPRSSCTGK

SEQ ID NO: 17991 - protein, 81 aa, Callithrix jacchus
SRPGALSFADVAVYFSPEWGCLRPAQRALYRDVMRETCGHLGALGFSGPKSAFISWVEGEMEAWSPEVQDPEGESPGTVSG

SEQ ID NO: 17992 - protein, 81 aa, Callithrix jacchus
MLENYGSVASLAAFPFPKPALISQLEQGKAPWCLAPRVALDGEGQRGISSGEIRELPGATMWRLRIKPIPKKTVTKQRETR

SEQ ID NO: 17993 - protein, 81 aa, Callithrix jacchus
KPGAVSFGDVAVYFSREEWGCLRPAQRALYRDVMRETYSHLSALGVGGSMQALISWVKEAELWGPAAQDPEVAKRPTEADP

SEQ ID NO: 17994 - protein, 81 aa, Bos taurus
FQESVTFEDVAVNFSHEEWQCLTHAQRHLYKDVMLENYGNMVSLGFSFSKPPLISHLEQGTEPYVQDRQDWEFLSCSYPVS

SEQ ID NO: 17995 - protein, 81 aa, Bos taurus
FQMPLTFSDVSIDFSQEEWECLNSDQKNLCRDVMLETYTNLVSLDFDFTTENNKLSSEKSSFEVNSYHWEIMKSKTFNLMG

SEQ ID NO: 17996 - protein, 81 aa, Ovis aries
WKAWVKKPVTFEDVAVNFTQEEWKCLDASQKVLYQDVISETVRNLMSVDLIAKLEQEEKQWEADLCSPNGEGFHSGGEKEE

SEQ ID NO: 17997 - protein, 81 aa, Ovis aries
AHMSLSFRDVAIDLSQEEWECLDPVQRALYRDVMLENYSNLVSLGCSTPKPDMITLLEQEKEPWMIMREGTGSWFTGLESK

SEQ ID NO: 17998 - protein, 81 aa, Ovis aries
SQESVTFEDVAVDFTQEEWALLDTSQRKLFRDVMLENISHLASVGNQLYKSDVISHLEQGEQLSKEELGFLQSRSPDREDD

SEQ ID NO: 17999 - protein, 81 aa, Ovis aries
SQGPVTFEDVAVYFSQEEWRLIGEAQRLLYHDVMLENFTLVASLGCSHTAEDEQTPSEQNVSVEVPQRNTKKTDLSSQKVC

SEQ ID NO: 18000 - protein, 81 aa, Ovis aries
AQVSVTFDDVAVTFTQEEWGHLEPAQRTLYQEVMLETCRLLMSLGCPVPRPELIYQLEHGQELWTVKRDLSRSTCPGYSSE

SEQ ID NO: 18001 - protein, 81 aa, Ovis aries
HQGSVTFEDVAMYFSCEEWCLLDEAQIQLYLDVMLENFALVCMLGSWRGVQDKETPSEEIKPAGVLQFLTPRAGLSPEKTQ

SEQ ID NO: 18002 - protein, 81 aa, Ovis aries
RLTSEDVAIKFTQEEWEFLDPAQRALYRDVMLETYRNLLSVDISPTYVIKDLQPKVNSDKRETFRTLMLGRPKSCEIKHVH

SEQ ID NO: 18003 - protein, 81 aa, Vulpes vulpes
SQELVAFEDVLVDFTPEEWQYLNSSQKTLYREVMLETYSNLVSVAGQQDTKPDLILKLELEGPCLAERKISVWSFPEEACQ

SEQ ID NO: 18004 - protein, 81 aa, Vulpes vulpes
MLENYQNLVSLGLSFRRPNVITLLEKGKAPWVVEPVRKRRGLDSGFKCETKKLPPNLGIKSGQSIYQKQVSASQNIPTGKR

SEQ ID NO: 18005 - protein, 81 aa, Acinonyx jubatus
GCVTFEDVFVYFSQEEWELLEEAQRLLYRDVMLENFALVASLDCWREADNEETPEQNVFVGVSQLRTPESGPFIQKAHPCE

SEQ ID NO: 18006 - protein, 81 aa, Acinonyx jubatus
VQGQVNFEDVAVYFSREEWGLLDEAQRLLYRDVMLENLALTASLGSWHGTEDEETAFEQNISVGVSQVRTPKAGPSTQKAH

SEQ ID NO: 18007 - protein, 81 aa, Acinonyx jubatus
FQEAVTFGDVAVHFSREEWQCLDPGQRALYKEVMLENHSSVAGLGFLVFKPELISRLEQGQEPWVLDLKGVEGREVARTSL

SEQ ID NO: 18008 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMVRFRSLTLLPR

SEQ ID NO: 18009 - protein, 81 aa, Rhinopithecus roxellana
NQQTKNKSLFVSFEEVAVHFTWEEWQDRDDAQRTLYRDVMLETYSSLVSLGRCVSKPEVIFKLEQGSEPWLGEEWANQCLS

SEQ ID NO: 18010 - protein, 81 aa, Rhinopithecus roxellana
ACESITFRDVAIDFSHQEWEYLNLVQKTLYQEVMMENYDNLVSLGHSISKPDLITLLEQGKEPWMIVREETGGECTDLDSR

SEQ ID NO: 18011 - protein, 81 aa, Acinonyx jubatus
FKEAVTFKDVAVVFTVEELGLLDSAQRKLYRDVMVENFENLLSVGHLPFKPDMMSQLEAEEKLWMMERETQRNGYSSENHV

SEQ ID NO: 18012 - protein, 81 aa, Rhinopithecus roxellana
SRSLENDGVCFTEQEWENLEDWQKELYRNVMESNYETLVSLKVLGQTEGEAKLGTEMLGDLEEEGPGGAHPAGGVMIKQEL

SEQ ID NO: 18013 - protein, 81 aa, Rhinopithecus roxellana
MGPLTFTDVAIEFSLEEWQCLDPAQQNLYRNVMLENYRNLVFLGIAVSKPDLITCLEKEKEPWNMKRHEMVDEPPVICSHF

SEQ ID NO: 18014 - protein, 81 aa, Rhinopithecus roxellana
AQELLTLEDVTVEFTWEEWQLLDPFQKDLYRDVMLEIYSNLVSMGYQVSKPDALSRLERGEEPWTMEDERHSRICPENNKV

SEQ ID NO: 18015 - protein, 81 aa, Acinonyx jubatus
MDFSREEWEQLGPAQRCLYWDVMLEICSHLLSLGYPIPRPEMIFRMEKEEEPWIREAQLPHQWRPKGEFGLKTSRQKIFEK

SEQ ID NO: 18016 - protein, 81 aa, Acinonyx jubatus
KPGALSFADVAVYFSSEEWGCLRPAQRALYRDVMRETYGHLGALGCAGPKPALISWLERNTDDWEPAALDPQECPRGVAVQ

SEQ ID NO: 18017 - protein, 81 aa, Bison bison
LQGGVTFEDVAVDFTQEEWQRLSPEQRDLYRDVTLENYRNLVSMGEQDSTKPEVILRLENGEEPWMVGTQELRSCSPAGKD

SEQ ID NO: 18018 - protein, 81 aa, Bison bison
SLGSVSFRDVAVDFTQEEWQHLDPEQKTTYRDVMLENYSHLISVGCHIIKPEVITKLEQGEEPWVVEGEFLLQSHPEEVWK

SEQ ID NO: 18019 - protein, 81 aa, Acinonyx jubatus
PQDLMTFKDVAVEFTQWEWGQLDPAQKDLYREVMLENFKNLASLGLPVSKPYVICQLEEGEEPCVVEGEISTDWEKRPKAK

SEQ ID NO: 18020 - protein, 81 aa, Rhinopithecus roxellana
MDVAIEFSQDEWKCLDPGQRALYRDVMLENYRNLVSLGICLPDLSIISMLKQRREPLTLQSEVKIVKNPDGRECVRSVNTG

SEQ ID NO: 18021 - protein, 81 aa, Bison bison
MMFRDVAVDFSQEEWECLDLEQRHLYRAVMLENYSNLVLLGLCIYQPEVFSLLEKGREPWMALKDETCPDMQSRCQTKKLS

SEQ ID NO: 18022 - protein, 81 aa, Bison bison
QERLTSEDVAIEFTQEEWEFLDPAQRALYRDVMLETYRNLLSVGEDDFLPELPLGICIFPVCPLGGPDVFHLRVLTSLSKF

SEQ ID NO: 18023 - protein, 81 aa, Bison bison
FQGLLTFGDVAVHFTQEEGERLDAGQRTLYRDVMLETYRNLVSLGVPESKPDLISQLEQGREPWGSDLLGAQEAETAGNAG

SEQ ID NO: 18024 - protein, 81 aa, Bison bison
AQLTFKDVAIEFSPEEWECLDPAQRTLYRDVMVETLRNLLSVAISHIHMIKKSQLKSNIGIGERFQTVMLGNRESHEVKHF

SEQ ID NO: 18025 - protein, 81 aa, Cebus imitator
QLNKLSFKDVCVDFTQEEWYLLDPAQKMLYRDVILENYSNLVSVGYCITKPEVIFKIEQGEEPWILEKGFPSQCNPERKWK

SEQ ID NO: 18026 - protein, 81 aa, Cebus imitator
FQEQVSFKDVCVDFTQEEWYLLDPAQKMLYRDVILENYSNLVSVGYCITKPEVIFKIEQGEEPWILEKGFPSQCNPERKWK

SEQ ID NO: 18027 - protein, 81 aa, Cebus imitator
FVTFEDVAIYFSQEERELLSGTQRLLYRDMMLENFAVMASLGCWCGAEDKEAHSADSISEEELSQVRTPKADPSTHKSHPC

SEQ ID NO: 18028 - protein, 81 aa, Cebus imitator
SWGPLSFMDVFVDFTWEEWQLLDPAQKCLYRSVMLENYSNLVSLGYQHTKPDIIFKLEQGEELCMVPAPIPNQCCPNKVWK

SEQ ID NO: 18029 - protein, 81 aa, Cebus imitator
EQGCVAFEDVAVYFSQEEWRLLDEAQRLLYRNVMLENFSLMASLGLASSKTHEITQLESWEEPFMPAWEVMTSAIPRGCWH

SEQ ID NO: 18030 - protein, 81 aa, Callithrix jacchus
EMGPLTFRDVAIEFSLEEWQCLDTAQQNLYRHVMLENYRNLVFLGIAVSKPDLITCLEQGKEPWNMKRHAMVAKPPVVCSQ

SEQ ID NO: 18031 - protein, 81 aa, Callithrix jacchus
GRLTFKDVSVEFSSAEWKCLTPAQRALYRDVMLENYRNLDLYFVGISSKCIRKKFSSTGQGSTEVFHTGTLARQESHHIGE

SEQ ID NO: 18032 - protein, 81 aa, Callithrix jacchus
LQGLLTFRDVAIEFSLEEWQCLDTAQRNLYKNVILENYRNLVFLGIAVSKPDLIACLEQEKEPLIMKRDEMAGEPPVMCSH

SEQ ID NO: 18033 - protein, 81 aa, Callithrix jacchus
PQESVAFDDVAVYFTKKEWAIMVPDQRALYRDVMLENYEAVAFVAVPPTSKPALISHLEQGKEPCFTQPQGVLSRRDWRAG

SEQ ID NO: 18034 - protein, 81 aa, Callithrix jacchus
MPLDVAIVFSQEEWQWLAPAQRDLYRDVMLETYSNLVSLGLAISKPDVISFLEQGKEPWMVERVVAGGLCPVLESRYDTKE

SEQ ID NO: 18035 - protein, 81 aa, Macaca mulatta
PQGHLTFRDVAIEFSQAEWKCLDLAQRALYKDVMLENYRNLVSLGISLPDLNINSMLEQRREPWSGESEVKIAKNSDGKEH

SEQ ID NO: 18036 - protein, 81 aa, Callithrix jacchus
DFMTFEDIIIDFTREEWALLDTSQRKLFRDVMLENISHLVSIGKEGDIKHQEIPFIQHIYQKDTSTISTMRSHTQDDPFLC

SEQ ID NO: 18037 - protein, 81 aa, Callithrix jacchus
QLNKLSFKDVCVDFTEEEWYLLDPAQKMLYRDVILENYSNLVSVGYCITKPEVIFKIEQGEEPWILEKGFPSQCHPERKWK

SEQ ID NO: 18038 - protein, 81 aa, Macaca mulatta
FQGPVTLKDVIVEFTKEEWKLLTPAQRTLYKDVMLENYSHLVSVGYHVNKPNAVFKLKQGREPWILEVEYPHRGFPEDLWS

SEQ ID NO: 18039 - protein, 81 aa, Callithrix jacchus
GPPGSLEMGVLTFKHVAIEFSRKEWQCLDTAQQNLYRNVMLENYRNLVFLGIAASKPDLITCLEQGKEPWNVKRHDLLSYI

SEQ ID NO: 18040 - protein, 81 aa, Callithrix jacchus
VWGPLSFMDVFVDFTWEEWQLLDPAQKCLYRSVMLENYSNLVSLGYQHTKPDIIFKLEQGEELCMVQAPIPNQCCPNKVWK

SEQ ID NO: 18041 - protein, 81 aa, Macaca mulatta
MSQGSVTFQDVAIDFSKEEWRFLNPAQRDLYTTVMLENYQNLVWLGLSISKSVISLLEKRKLPWIMGKEEIRVPLPDTPGA

SEQ ID NO: 18042 - protein, 81 aa, Ovis aries
TFRGMVIEFFPHEWEFLDSLQKKLYCDVMMENYSNLVSLGHSISKPDIIVLLEEGRNPWMVEFTLFWQKKPRGLISSYRSK

SEQ ID NO: 18043 - protein, 81 aa, Ovis aries
HAEGQLTFQDVAIDFTQEEWECLDLGQRELYRDVMLENYGNLASLGLVSMLDLVTFLEQLKDPRNIRRMETTAIYPAVSPQ

SEQ ID NO: 18044 - protein, 81 aa, Ovis aries
QAQETFTFDDVAVDFTWEEWQLLAPVQKALYRDVMLENYSNLVSAGFQASTPEVLSKLEQGEPWMMDDEIHCQTRSEVWKF

SEQ ID NO: 18045 - protein, 81 aa, Ovis aries
NVLPEAPVTFDDITVYLLEEEWVLLSQQQKDICGSDKLVAPLGPTIASPELFYKFERGPEPWLASVQGQRSHLSPNPGKTK

SEQ ID NO: 18046 - protein, 81 aa, Ovis aries
MARSQASVTFKDVAMDFTPEEWGRLDPAQRDVMLENYRNLVSLWLPVSKPENHSLENGKEPLLLERKAPKSSCSDSETSPR

SEQ ID NO: 18047 - protein, 81 aa, Ovis aries
MLENYSNLVSVGYQASKPAALSRLERGELWPMEDEVHSRICPEIRKDDCLLQENLQNQSCPKRAERCHEHNALGNVYQSKS

SEQ ID NO: 18048 - protein, 81 aa, Ovis aries
AQGYVTFEDVTIYFSPEEWGLLDEAQRLLYCDVMLENFALIASLGLASFRSHIVAQLEMGAEPWVPDRVDMTSAMARGMYR

SEQ ID NO: 18049 - protein, 81 aa, Ovis aries
QERLTSEDVAINFTQEEWEFLDPAQRALYRDVMLETYRNLLSVDISPIHVMKHLQPKANSDKRETFQTLMLGSPESCEIKH

SEQ ID NO: 18050 - protein, 81 aa, Ovis aries
PQDLMTFEDVAVEFTWWEWGQLDSTQKDLYREVMLENFKNLASLGFPVSKPYMICQLEEGEEPCILERAISTGVHSDWERR

SEQ ID NO: 18051 - protein, 81 aa, Ovis aries
AKAPVTFGDLAIYFSQEEWEWLSPIQKDLYEDVMLENYQNLVSLGLSFRRPNVISLLEKGKAPWMVDPVKRRRGLDLGSKC

SEQ ID NO: 18052 - protein, 81 aa, Vulpes vulpes
CEGSVSFEDVTMDFSREEWQQLDPAQRCLYQDVMLEIYSHLLFVGYNIPNPEIISRMEKGEEPWMREVQLPHQRHRERAFG

SEQ ID NO: 18053 - protein, 81 aa, Vulpes vulpes
MLENYGHLESLGFLSSKPHLVSWLEQGEGPWGADMCGTPAAAGMQTDDRIKTRTSISKPKHCLEELARTDLPAGNNKSQGD

SEQ ID NO: 18054 - protein, 81 aa, Cebus imitator
KEAFAAFRDVAVDFTQEEWRLLSPAQRTLHREVMLETYNHLVSLEIASSKPKLIAQLERGEEPWREKRKCSLDLRPGSKPE

SEQ ID NO: 18055 - protein, 81 aa, Cebus imitator
EMGVLTFSDVTIGFCLQEWQCLDTAQQNLCRNVMLENYRNLVFLGIAAFKPYLITYLEQGKEPWSVKRHEMVPPKVLGLQV

SEQ ID NO: 18056 - protein, 81 aa, Cebus imitator
MFKEAVTFKDVAVAFTEEELGLLGPAQRKLYRDVMVENFRNLLSVGHQPFKRDVSPIERKEQLCIMKTATQRQRNSGENNQ

SEQ ID NO: 18057 - protein, 81 aa, Macaca mulatta
QVSLTFEDVAVLFTRDEWRKLVPSQRNLYRDVMLENYRNLVALFTKPKVISLLQQGEDPWKVEKDSSGDSSNPGRKASSCS

SEQ ID NO: 18058 - protein, 81 aa, Macaca mulatta
FQGSISFKDVTVGFSQEEWQHLDPSQRALYRDVMLENYSNLVSVGYCVHKPEVISRLEQGEEPWRLEEEFPSQSFPEVWTA

SEQ ID NO: 18059 - protein, 81 aa, Callithrix jacchus
VTFEDVAVNFSKEEWCLLSEAQRCLYRDVMLENLALISSLGCWCGLKDEAAPSKQSMIVQTESQDRTPRAVSPRKAHSCDT

SEQ ID NO: 18060 - protein, 81 aa, Callithrix jacchus
GWLSFKDISMEFTWDEWQLLDSTQKYLYREVILENYHNLISVDGWEEWYQKNQDELESVERSYACSVLGRLNLSKTHDSSR

SEQ ID NO: 18061 - protein, 81 aa, Callithrix jacchus
AQGSVSFNDVTVDFTQEEWQHLDHAQKTLYMDVMLENYCHLISVGCHMTKPDVILKLERGEEPWTSFAGHTRLEENWKAED

SEQ ID NO: 18062 - protein, 81 aa, Macaca mulatta
GTVTFEDVAVKFTREEWNLLSEAQRCLYRDVTLENLALISSLGCWCGVEDEEGPSKQSIYKQRETQIRIPMAGVSLKKAHP

SEQ ID NO: 18063 - protein, 81 aa, Macaca mulatta
SYEGSVSFRDVAINFSREEWQHLDLSQRNLYRDVMLETYSHLLSVGYQVPKPEVIMLEQGKEPWALQGERPRQSCPGEKLW

SEQ ID NO: 18064 - protein, 81 aa, Callithrix jacchus
PLRLLTFRDVAIEFSLEEWEHLDSDQKNLYGDVMLENYRNLVCLGLAVSKPDLITFLEQRKEPWNVKSAETVAIQPDIFSH

SEQ ID NO: 18065 - protein, 81 aa, Callithrix jacchus
SQEPVTFADVAVVFTPEEWVFLDSTQRSLYRDVMLENYRNLASVAGDQLCKPNALSYLEQRGEQWTTERGVISDICPEPQL

SEQ ID NO: 18066 - protein, 81 aa, Bos taurus
QAPVILKDVVVTFTRQEWKLLDLTQRTLYQEVVLETSRLLVSLGKFLFTSAPCPPQRPGPGCALRHFLGLPLTFPQLVLIL

SEQ ID NO: 18067 - protein, 81 aa, Bos taurus
MYFSWEEWCLLDEAQIQLYLDVMLENFALVCMLGSWHGVQDEETPSEQSKSARVSQFCIPRTCLSPEKTQPCKMCIPVLRD

SEQ ID NO: 18068 - protein, 81 aa, Ovis aries
RLTSADVAINFTQEEWEFLDPAQRALYRDVMLETYRNLLSVDISPTHVIKLLQPKANSDKRETFQTLMLGRPESCEIKHVH

SEQ ID NO: 18069 - protein, 81 aa, Ovis aries
SVTFEDVAVYFSWEEWRLLAETQRSVYLDVMLENYALISSLGCCCGTENAETPSEQITSLEVSQARTPKAALSSQKIHPCE

SEQ ID NO: 18070 - protein, 81 aa, Ovis aries
VKESVTFKDVAVDFTLEEWRLMDPMQRDLHKDVMLENYRNLVSLGLAISKPDMISHLEDGKGPWVVVREISRTSFSELETK

SEQ ID NO: 18071 - protein, 81 aa, Ovis aries
IQGLVTFRDVAVEFSQEEWKCLEPAQRDLYREVTLENFGNLVSLGLSISKPDVVSLLEQGKEPWMVVNDMTGPWCPDLESR

SEQ ID NO: 18072 - protein, 81 aa, Ovis aries
SQGRLTLQDVAIDFTEEEWECLDLGQAELYRDVMLENYSHLVSLGLVVSKPDLITFLEQLKNPWDVRRLETPAIYTAVSSH

SEQ ID NO: 18073 - protein, 81 aa, Ovis aries
MAFRDVAVDFTQDEWVLLSPAQRSLYREVMLENYSNLVSLGIPFSKPKLITQLEQGKESWREERKCSPVSCLGEWGHWVVQ

SEQ ID NO: 18074 - protein, 81 aa, Ovis aries
QDSVVFEDVAVNFTLEEWELLDPAQRKLYRDVMLETCRNLATVLALKLRSSISQIIDLTVHGSYQTKIQPHQCITCGKAFT

SEQ ID NO: 18075 - protein, 81 aa, Ovis aries
PQDLVTFKDVAVDFSQEEWQWLSPAQRSLYRRMMLENYQSLVSLGLCISKPSVISLLEQGKEPWMMMENELRSPFPDWESI

SEQ ID NO: 18076 - protein, 81 aa, Ovis aries
PQGSTPFSSVTVDFTHGGWRQLAPAPRDRFEEGMPEKSRNLVLLGLPVSQPGMNSQLEQREGSWMLEGDGLRNACPDWKII

SEQ ID NO: 18077 - protein, 81 aa, Ovis aries
QDSVVFEDVAVNFTLEEWELLDPAQRKLYRDVMLETCRNLATVGSCPQVKVSVSSPQWDILETELCIEREVVRFTRNDSRS

SEQ ID NO: 18078 - protein, 81 aa, Ovis aries
MEAVTFKDVAVAFTEEELGLLDSAQRKLYQDVMVENFRNLVSVEENNQSELRAVQERGLHEELSCWQIWQQIANDLTRCQD

SEQ ID NO: 18079 - protein, 81 aa, Vulpes vulpes
AQGLVTFEDVAVYFSREEWGLLNLTQRSLYRDVMLENFALIGSLGFAPSRSHVVAQLENEEELWVPNVVDLTLISRAEARR

SEQ ID NO: 18080 - protein, 81 aa, Vulpes vulpes
SVAFQDLAVRFSEEEWQLLGEGQRALYRDVMQENYETLRSLGTAERLPLSAFLSPTEPGGTMEGRSYAGEEQEPPRGGGPL

SEQ ID NO: 18081 - protein, 81 aa, Vulpes vulpes
ARELVTYEDVAVDFTQEEWQHLDPAQKTLHRDVMLEIYSHLVSVGCSGIKPGIIFKLEYEEDPWIIKNREESFDSSQQVIS

SEQ ID NO: 18082 - protein, 81 aa, Otolemur garnettii
LTFKDVAVVFTEEELELLDPIQRKLYQDVMLENFQNLLSVVFQICQGHLFEIEKGQKTVILWGNRKIEMAVGEKSHTYDEC

SEQ ID NO: 18083 - protein, 81 aa, Otolemur garnettii
VTFKDVAVDFTLEEWRLMDPTQRSLHKDVMLENYRNLASLGLAVSKPDMISYLENGKGPWAMVREITRTPYPVNLFPHYLT

SEQ ID NO: 18084 - protein, 81 aa, Vulpes vulpes
FQPPVNFKDVAVTFTQEEAGQLDLAQRMVYGNMTLETCSHLVSLGLLLSKPDVIIWLEQGQDPWRSEQGPPADWKNTFEKS

SEQ ID NO: 18085 - protein, 81 aa, Vulpes vulpes
FQHLVMFRDVAVDFSQEEWECLNSYQRNLYRDVILENYSNLVSVAGCSISKPDVITLLEQGKEPWMVVRDERRRSLDLESR

SEQ ID NO: 18086 - protein, 81 aa, Otolemur garnettii
EESVTFRDVAVFFSQDEWSHLDSAERTLYREVMLDNYRTLASLGTGIVFSKPKVISQLELGEDPWMVENGIPQSPLLGWES

SEQ ID NO: 18087 - protein, 81 aa, Vulpes vulpes
SAESVTFKDVAVDFTQEEWGQLDSPQRALYRDVMLENYQNLLALAGPPVCKPDVISHLERGEEPWWMPGEVPGGACSGGEP

SEQ ID NO: 18088 - protein, 81 aa, Vulpes vulpes
SQSLVTFGDVAINFSQEEWEWLNSAQRNLYRSVMLENYRNLVSLGLCVSKPDMISSLEQRKEPWMVKRKLTRGRCPDLKAV

SEQ ID NO: 18089 - protein, 81 aa, Vulpes vulpes
TQDSVVFEDVAVDFTQEEWALLDLAQRSLYRDVMLENFQNLASLGYPLHTPYLISQWKQEEDLETVEQGPIQGKHQEGFKI

SEQ ID NO: 18090 - protein, 81 aa, Carlito syrichta
FQEEVTFNDVAVVFTEEELGLLDSTQRQLYQDVMLENFRNLLSVGQQPFYQDTVHFIKEEEEEFWEMDTATQEEENSETSS

SEQ ID NO: 18091 - protein, 81 aa, Sapajus apella
SQDSMTFEDIVVDFTREEWALLDTSQRKLFRDVMLENISHLVSIGNQFCKSVVFSHLEQVEKLSTQGIRLPQGKEGDIKHQ

SEQ ID NO: 18092 - protein, 81 aa, Pan troglodytes
TFKEAVTFKDVAVVFTEEELGLLDPAQRKLYRDVMLENFRNLLLVGNQPFHQDTFHFLRKEEFWMMKTTSQREGNSGGKIQ

SEQ ID NO: 18093 - protein, 81 aa, Sapajus apella
FQRSVSFQDLTVNFTEEEWQQLDPAQRLLYRDVMLENYSNLVSVGYHVSKPDVIFKLEQGEEPWIVEEFSNQNYPEVDDAL

SEQ ID NO: 18094 - protein, 81 aa, Macaca mulatta
QGLLTFRDVAIEFSQEEWKCLDPAQRTLYRDVMLENYRNLVSLGQGNTEVIHTGTLQRQASHHIGDICFQEIGKDIHDFVF

SEQ ID NO: 18095 - protein, 81 aa, Sapajus apella
TSQESLTLEDVAVEFTLEEWQLLGASQKDLYRDVMLENYSNLVSVGYQASKPDVLSMLEQGEPWTTENEIHSQICPEIKKV

SEQ ID NO: 18096 - protein, 81 aa, Sapajus apella
PQERLTFRDVAIEFSQEEWKCLDPAQRTLYRNVMLENYRNLVSLAGISLPEMNIVSTLEQGKEPRTVESEVKITKTSNGWK

SEQ ID NO: 18097 - protein, 81 aa, Sapajus apella
MLETYSNLVSLGLAISKPDVISFLEQGREPWMVERVVAGGLCPVLESRYDTKELSPKPHVYEVESPQWELMESITSYGLEC

SEQ ID NO: 18098 - protein, 81 aa, Acinonyx jubatus
ASVVFEDVAVNFTPEEWALLNPGQRKLYRDVMLETCRNLSAVGCRSQGNTSTPRPQWSILLNEPPGEDKTGIFTRKDSCSV

SEQ ID NO: 18099 - protein, 81 aa, Rhinopithecus roxellana
DFISLEDVAVNFTLEEWALLDPGQRNIYRDVMRATFKNLACIGEKWKDQDIEDDPKNQGRKLSSPTVETLCENKDDRPCGK

SEQ ID NO: 18100 - protein, 81 aa, Rhinopithecus roxellana
TFKEGLTFKDVAVVFTEEELGLLDPVQRNLYRDVMLENFRNLLSVGHHPFKHDVFPLEKGKKLDMMKTATQRKGKSADKIQ

SEQ ID NO: 18101 - protein, 81 aa, Acinonyx jubatus
GRVTFEDVAVYFSGEEWGLLDEAQRCLYQDVMLETLAHITSLGCWHGAGDEEAPEQSVSVQGVSRGRTSKAAVSSQKAPPR

SEQ ID NO: 18102 - protein, 81 aa, Rhinopithecus roxellana
FEDVAVNFSQEEWCLLREVQRCLYRDVMLENLALISSLDCWCGSKDKEAPSKQSISVQRESQNTTPRAAVSPKKAHPCEMC

SEQ ID NO: 18103 - protein, 81 aa, Rhinopithecus roxellana
SVTFRDVAIDFSQEEWKWLQPAQRDLYRRVMLENYGHLVSLASESSGEIKDFSPKNVIYDDSSQYLIMERILSQGPMYSSF

SEQ ID NO: 18104 - protein, 81 aa, Rhinopithecus roxellana
MRSNYETLVSLDDGLPKPELISWIEHGGEPFRNWRESQKSRNIICSSSDLHFDPGFQEQLFWGSQQAVNSRKTKSHFQLDP

SEQ ID NO: 18105 - protein, 81 aa, Acinonyx jubatus
EEKERMQNELLQAMSKEEWECLDSGQMNLYKEVMLENFSNLVSVGLSNSKPAVISLLEQGKEPWMVERELTRGLCSDLESM

SEQ ID NO: 18106 - protein, 81 aa, Acinonyx jubatus
MGMAGPISEGFIQRCHVGELQELGLSISKPNMISLLEQGKEPWMVEKEMSDGQYADWESWYEIKELPPKWYIDEEEISQGM

SEQ ID NO: 18107 - protein, 81 aa, Acinonyx jubatus
RESGKAPVTFDDITVYLLQGEWMLLSQQQKEICGSDKLVAPLGPTIANPELFYKFERGPEPWVGSAQGQRNVLSHHPGKNQ

SEQ ID NO: 18108 - protein, 81 aa, Rhinopithecus roxellana
AHGSVTFRDVAIDFSQEEWEFLDPAQRDLYRDVMWENYNNFISLGPSISKPDVITLLDEEGKEPGMVVREGTRRYCPDLES

SEQ ID NO: 18109 - protein, 81 aa, Rhinopithecus roxellana
QGRVTFRDVAIEFSLAEWKCLNPAQRALYREVMLENYRNLESVDITSKCMMKEVLSTGQGNTEVFYPGTLQRPESHHIGDF

SEQ ID NO: 18110 - protein, 81 aa, Rhinopithecus roxellana
FQESVTFQDVAVDFTAEEWQLLDCTERTLYWDVMLENYRNLISVGCPINKTKVILKVEQGQEPWMVEGVNPHQSSPESDCP

SEQ ID NO: 18111 - protein, 81 aa, Acinonyx jubatus
RPRAVKFADVAVYFSTEEWGCLRPAQRALYRDVMQETYGHLGALGCAGPKPALISWLERNTDDWEPAALDPQECPRGVAVQ

SEQ ID NO: 18112 - protein, 81 aa, Rhinopithecus roxellana
SLGSVTFTDVAIDFSQDEWEWLNLAQRSLYRKVMLENYRNLVSVGLCLSKPDVISLLEQEKDPWVIKGEMTRGLCPDILKM

SEQ ID NO: 18113 - protein, 81 aa, Rhinopithecus roxellana
VMLENYSLLLSVGYCITKPVVICKLEHGEVLWILEEEFPSQSHLDCCIDDDLNGVLGKTFYLDTNPILLRKIHGNYGSYGV

SEQ ID NO: 18114 - protein, 81 aa, Bison bison
PLESVTFEDVAVDFTQEEWSLLDKSQKNLFRNVMLETVSHLVSVGYQMSKSEVISQLEQGKELWTAAAGGLQGQSPGSERP

SEQ ID NO: 18115 - protein, 81 aa, Bison bison
PQGSTPFSNVTVDFTQGGWRQLAPAPRDRFEEGMPENSRNLVLLGLPVSQPGMNSQLEQREGSWMLERDGLRNACPDWKII

SEQ ID NO: 18116 - protein, 81 aa, Bison bison
FQMPLTFSDVSIDFSQEEWECLNSDQKNLYRDVMLETYTNLVSLDFDFTTENNKLSSEKSSFEVNSYHWKIMKSKTFNLMG

SEQ ID NO: 18117 - protein, 81 aa, Bison bison
FQGLVSFKDVTVGFTQEEWQHLDSTQRSLYRDVMLENYRNLVSVGFCITKPEVIFRLEQGEEPWILEEEFLSQSFSEVWKT

SEQ ID NO: 18118 - protein, 81 aa, Bison bison
HSEGRLMFQDVAIDFTQEEWECLDPGQRKLYRDVMVENYRNLASLGLVSKVDLVTFLELLKDPRNMRRMEATAIYPAMSPQ

SEQ ID NO: 18119 - protein, 81 aa, Odocoileus virginianus
LQVSVSFEDVTVDFSREEWQHLDSAQRRLYQDVMLEIYSHLLSLGYEVPKPEVIFKLEQGEEPWALKKKTLHHSCSDGKFG

SEQ ID NO: 18120 - protein, 81 aa, Cebus imitator
MAHLMFRDVAIDFSQEEWEGLDLKQRDLYRDVMLENYSNMVSLGLCIYQPDVFSLLEKGKEPWKILTDETRGPCPDMQSRC

SEQ ID NO: 18121 - protein, 81 aa, Macaca mulatta
QGLLTFRDVAVEFSLEEWEHLEPAQKTLYQDVMLENYRNLVSLGLLVSKPDLITFLEQRKEAWNVKSEETVAVQPDVFSHY

SEQ ID NO: 18122 - protein, 81 aa, Callithrix jacchus
YQTPVSFRDVVVGFTQEEWHRLNPTQRALYRDVMLETYSNLVSVGYEGTKPDVILRLEQEEAPWIGEAACLGCHCWEDIWK

SEQ ID NO: 18123 - protein, 81 aa, Callithrix jacchus
MEPLTFKDVAIEFSLEEWQCLDTAQQDLYRNVMLENYGNLVFLGIAVSKPDLITCLEQGKVPWNRKRHEMVAKPPVVCSYF

SEQ ID NO: 18124 - protein, 81 aa, Callithrix jacchus
LTGRLTFKDVSVEFSSAEWKCLTPAQRALYRDVMLENYRNLESVGEENVPPDTSNPSLFIWKPYKCNECGKTFHQVSFLTC

SEQ ID NO: 18125 - protein, 81 aa, Callithrix jacchus
FFPREAICPLEEKTKVERTVVDYLANGYQDSVTFDDVAVEFTPEEWALLDTTQKYLYRDVMLENYKNLASVGKKLQVRETL

SEQ ID NO: 18126 - protein, 81 aa, Callithrix jacchus
GTVTFEDVAVNFSREEWSLLSEVQRCLYHDVMLENWVLTSSLGCWCESEYEEAPSKQNISIQRVSPVSTPRAGVSLKKAHP

SEQ ID NO: 18127 - protein, 81 aa, Callithrix jacchus
WQCLDAAQRNLYKNVILENYRNLVFLGIAVSKPDLIACLEQEKEPLIMKRDEMADEPPVMCSHFAQEFWPEQNIKDSSQNM

SEQ ID NO: 18128 - protein, 81 aa, Callithrix jacchus
RPRALKFVDVAVYFSSEEWGCLRPAQRALYRDVMRETYGHLGALGFSGPKSAFISWVEGEMEAWSPEVQDPEGESPGTVSG

SEQ ID NO: 18129 - protein, 81 aa, Macaca mulatta
AQVSVTFDDVAVTFTKEEWGQLDLAQRTLYQEVMLENCGLLVSLGCPIPRPELIYHLEHGQEPWTRKEDLSQDTCPGNKGK

SEQ ID NO: 18130 - protein, 81 aa, Macaca mulatta
YQEFVTFEDVAVHLTREEWGYLDPVQRDLYREVMLENYGNVVSLGFPISKPDGISQLEQDLQVFDLETKTREVLRGDCSDG

SEQ ID NO: 18131 - protein, 81 aa, Macaca mulatta
LSFEDVAMYFTREEWGHLDWGQKDLYRDVMLENYRNMVLLGSEARHRMKKLTPKQKFSEDLESYKISVVMQESAEKLSEKL

SEQ ID NO: 18132 - protein, 81 aa, Callithrix jacchus
GACGDSVSSLSGAVPSCGFSETRPTSFCSSKTMAHGSVTFRDVAIDFSQEEWEFLDPAERDLYRDVMWENYSNFISLDISL

SEQ ID NO: 18133 - protein, 81 aa, Callithrix jacchus
EMGPLTFMDVAVEFSLEEWQCVDTAQQNLYRNVMLENYRNLVFLGIAVSKPDLITFLDQEKKPWNIKRCEMVPKPSECDYS

SEQ ID NO: 18134 - protein, 81 aa, Monodon monoceros
LLKFLPFLQLHLLGISCYSGSVRNEEGMEAELLTARSHVILYLSLGTGHQLPKPEVILQLEKGEEPWLLERGIHQETYPGE

SEQ ID NO: 18135 - protein, 81 aa, Bos taurus
NLFEWQKELYKNVMRGNYESLVSMDYAISKPDLMSQMERGERPAMQEQEDSEEGEAPADPSAAHDGIVIKIEVQTNDEGSE

SEQ ID NO: 18136 - protein, 81 aa, Ovis aries
MAEPCSEESVQDGDAGQLQEPGVSVSKPDVISLLEQGKAPWMVEEEEPRGACPDWEYAFKNKEFPSKQVIYEESSKVMMMG

SEQ ID NO: 18137 - protein, 81 aa, Ovis aries
SQDSVTFADVAVNFTQEEWTLLNCFQRKLYRDVMLENYKNLTTAGYQVFKPTLISWLEEEELSTVEKGVLQEWGIQLKAKD

SEQ ID NO: 18138 - protein, 81 aa, Ovis aries
RRGSVTFEDVAVNFSWEEWGLLDESHKRLYHDVMLENYALISSLGFWSGEEKVETSFAQSVSVAVSQARTSKEASSSQKTH

SEQ ID NO: 18139 - protein, 81 aa, Ovis aries
QGHVTFEDVAVSFSQEEWGLLGEAQRLLYYDVMLENLSLIASLGCWRGGDTEEAGSEQCVSAEQVTRDRHPRVDSSILKAV

SEQ ID NO: 18140 - protein, 81 aa, Rhinopithecus roxellana
MEPLKFRDVAIEFSLEEWQCLDTAQQNLYRNVMLENYRNLVFLGIAVSKPDLITCLEQEKEPWTRKRHRIVAKPPVTCSHF

SEQ ID NO: 18141 - protein, 81 aa, Rhinopithecus roxellana
MAFEDVAVYFSQEEWGLLDTAQRALYRHVMLDNFTLVTSLGLSTSRPHVVIQLERGEEPWVPSGKDMTLARNTYRRLNAGE

SEQ ID NO: 18142 - protein, 81 aa, Rhinopithecus roxellana
FEELVTFEDVFVDFSPEELSSLSAAQRNLYREVMLENYRNLVSLGYQFSKPDIISRLEAEESHAMVTDSRHTVICQGESHD

SEQ ID NO: 18143 - protein, 81 aa, Acinonyx jubatus
QESVTFKDVAVDFTLEEWGWLGPGQRELYRDVMLENYQNLLSLGAGPPGFKPDVISRLERGEEPSMEKREGWQMACPDLET

SEQ ID NO: 18144 - protein, 81 aa, Acinonyx jubatus
SLLTFEEVAMYFSQEEWELLDPTQKALYNDVMRENYETVISLAVPAHQILAFPEQTITKDWTVAPELVLPESQSLLTFEEV

SEQ ID NO: 18145 - protein, 81 aa, Rhinopithecus roxellana
MAKPCEWQHLDPSQRNLYRDVMLETYSHLLSVGYQVPEAEVVMLEQGKEPWALQGERPRQSCPGEKLWDHNQCRKILSYKQ

SEQ ID NO: 18146 - protein, 81 aa, Rhinopithecus roxellana
QGLLTFRDVAIEFSQEEWKCLDAAQRTLYRDVMLENYRNLVSLDISSKCMRNTLLSTGQGNTEVFHTGTLQRQARYHIGAL

SEQ ID NO: 18147 - protein, 81 aa, Rhinopithecus roxellana
MVTFEDVAVHFTKTEWTGLSPAQRALYRSVMLENFGNLTALGYPVPKPALISLLEGGDMAWGLEAQDDPLAERTKNICKGV

SEQ ID NO: 18148 - protein, 81 aa, Acinonyx jubatus
AQAPLSFEDVAVSFSREEWRLLVPAQKDLYRDVMLENYRNLVSVGYQASEPDSLFQLEHGGPLWVVEGAAPRPPCPEEIWE

SEQ ID NO: 18149 - protein, 81 aa, Acinonyx jubatus
SQDLVTFKDVAIDFSQEEWEWLNPAQRSLYKNMMLENYRNLVSLDLESMYETHELSLKHFVYDDVLMERITGYGLEHSTFS

SEQ ID NO: 18150 - protein, 81 aa, Rhinopithecus roxellana
ASVTVTFDDVALYFSEQEWEILEKWQKQMYKQEMKTNYQTLDSLGYAFSKPDLITWMEQGRMLFISEQGYLDKTRRTTSPP

SEQ ID NO: 18151 - protein, 81 aa, Bison bison
RRVPVTYEDVAVTFTQEEWGHLGPMQRTLYWEVMLETCRLLVSLGCPLPEPELISPVEPGPESQTSRRGPTPSSCSGDNTK

SEQ ID NO: 18152 - protein, 81 aa, Bison bison
AQGNVTFEDVFVSFSQEEWGLLDEAQRLLYREVMLENFALMASLGYASSMSHGVSPQELGREPWVSDWADTIPALTREAQS

SEQ ID NO: 18153 - protein, 81 aa, Bison bison
SPVGERSGSRRLRGPRREWGCLRPAQRALYRDVMQETYGHLGALGFRGTKPALISWVEEEAQLWGPDAGPPEMGECVTEAD

SEQ ID NO: 18154 - protein, 81 aa, Odocoileus virginianus
KAQETLTFDDVAVAFTWEEWQLLAPAQKALYRDVMLENHSNLLSAGFQASTPEVLSKLDQGEPWTMDDEVHCRTRSEVWKF

SEQ ID NO: 18155 - protein, 81 aa, Odocoileus virginianus
SLGSDLFRDVAIVFSQEEWEQLAPTQRDLYRDVMLETYSNLVSLGLAVSKPDVISFLEQGKEPWTVEEVAAGGLCPVLKSR

SEQ ID NO: 18156 - protein, 81 aa, Odocoileus virginianus
QDSVVFEDVAVNFTLEEWELLDPAQRKLYRDVMLETCRNLATVGSCPQVKVNMSSPQWDILETGLCIEREVVRFTRNDSRS

SEQ ID NO: 18157 - protein, 81 aa, Odocoileus virginianus
EALPVVFEDVAVYFTREEWGALDKRQKEMYRDVMRMNYELLASLGPAAAKPDLISKLERRAAPWIKDPHGPKWGKGRPPGK

SEQ ID NO: 18158 - protein, 81 aa, Odocoileus virginianus
SQGLLTLQDVAIDFTQEEWECLDLSQRDLYRDVILENYRNLAALGLVVTGLNLVTFLEQLNDPRTIRRIETTAIYPGVSPQ

SEQ ID NO: 18159 - protein, 81 aa, Cebus imitator
MFKEAVTFKDVAVVFTEEELGLLGPAQRKLYRDVMLENFRNLLSVGHQPFHGDTFHLQREEKFWMMETATQREGNSGGKIQ

SEQ ID NO: 18160 - protein, 81 aa, Cebus imitator
ELVTFRDVLINFSQEEWEYLDSAQRNLYWDVMMENYSNLLSLDLESKYETKLLPVGTDIIKNTGSQWEVMESSKLCGLENS

SEQ ID NO: 18161 - protein, 81 aa, Callithrix jacchus
AHVSLAFRDVSIDLSQEEWECLDPAQRDLYKDVMFENYSNLVSLGYTIPKPDVITLLEQEKEPWIVMREGTRSWCTDLEYK

SEQ ID NO: 18162 - protein, 81 aa, Macaca mulatta
FQEAVTFKDVAVAFTEEELGLLDPAQRKLYRDVMLENFRNLVSVGHQSFKPDMISQLEREEKLWMKEFQTQRGDRNQNEMA

SEQ ID NO: 18163 - protein, 81 aa, Callithrix jacchus
ACRSITFRDVAIDFSHQEWEYLNLVQKTLYQEVMMENYDNLVSLGHSISKPDLITLLEQGKEPWMIVREETRGECTDLDSR

SEQ ID NO: 18164 - protein, 81 aa, Callithrix jacchus
TKDSFSFDDLSVDFTQKEWQLLDPSQKNLYKDVMLENYSSLVSLGYEAMKPDVIFKLEQGEEPWIGDEEIPSSWSPDIWKV

SEQ ID NO: 18165 - protein, 81 aa, Callithrix jacchus
AAGRVTFEDVTVSFTKGEWQQLNPEQRELYRDVMLENYGNLVSVGLEETSKPSVILRLEEGKEPWSEEEVLRGGRPEKNWD

SEQ ID NO: 18166 - protein, 81 aa, Macaca mulatta
TQGQVTFRDVAIEFSQEEWTCLDPAQRTLYRDVMLENYRNLASLGISCFDLSIISMLEQGKEPFTVESQVQIARNPDGWEW

SEQ ID NO: 18167 - protein, 81 aa, Macaca mulatta
GSLTFRDVAIEFSQEEWKCLDPIQKALYRDVMLENYRNLGFLGIYPKRVIKELPPIQNNNTGEKFQTVMLEGHESYDIENV

SEQ ID NO: 18168 - protein, 81 aa, Callithrix jacchus
PQESVAFDDVAVYFTKKEWAIMVPDQRALYRDVMLENYEAVAFVVPPTSKPALISHLEQGKEPCFTQPQGVLSRRDWRAGF

SEQ ID NO: 18169 - protein, 81 aa, Macaca mulatta
VAVDFTQEEWTLLDQTQRDLYRDVMLENYKNLIILAGCEFCKPSLMSGLEQMEELRTGVTGVLQELDLQLKTKGSPLLQDI

SEQ ID NO: 18170 - protein, 81 aa, Callithrix jacchus
ACRSITFRDVAIDFSHQEWEYLNLVQKTLYQEVMMENYDNLVSLAGHSISKPDLITLLEQGKEPWMIVREETRGECTDLDS

SEQ ID NO: 18171 - protein, 81 aa, Bos taurus
VQDCVVFEDVAVYFSQEEWGLLDETQRHLYHAVMTENLALVTSLGCCHGAQGEEASSEQGVSIGMSEVRTAKPDPSSRKAQ

SEQ ID NO: 18172 - protein, 81 aa, Bos taurus
PLESVTFGDVAIDFTQEEWNLLDKSQKNLFRNVMLETVTHLVSVGYQISKSDVVFQLEQGKELWTQAAGGFQGQSPGSESL

SEQ ID NO: 18173 - protein, 81 aa, Bos taurus
LQGLMTFEDVAVDFTQEEWQYLNPPQRTLYRDVMLETYSNLVSVGHHVTKPDLILKLEVEEKCLPEGKIPIWSFPDMGPQT

SEQ ID NO: 18174 - protein, 81 aa, Bos taurus
CSVVSDSFVTFEDVVVYFSWEEWGLLDENQRCLYHDVMLENFALVTSLGKALTPTPVPCTQLCSLQTQVLPPFPSCLAGRH

SEQ ID NO: 18175 - protein, 81 aa, Ovis aries
QEETLTFRDVFVDFTQEEWQQLDAAQKNLHRVVMLENYSHLVSVGYLVAQPHGIFRLGQEEEEAGMAAGESPPWSCPGKPM

SEQ ID NO: 18176 - protein, 81 aa, Ovis aries
VTFEDVAVDFTREEWSLLDKSQKNLFRNVMMETITHLVFVGSERPLGQQEMILMPSVYRKHISPTMAMVSHLQGNSAGCTD

SEQ ID NO: 18177 - protein, 81 aa, Ovis aries
FQEAVTFKDVAVVFTEEELGLLDSAQRKLYQDVMVENFRNLVSVGHLPFKADMVSQLETEEKLWTLERETQRNGHSSEIHS

SEQ ID NO: 18178 - protein, 81 aa, Ovis aries
QGRLRFQDVAIDFTLEEWECLDLGQRELYRDVMLENYGNLASLGLVVSKPDLVTFLEKMRDPQDVRGIETTAIHPEFLDND

SEQ ID NO: 18179 - protein, 81 aa, Ovis aries
AHGSVTFRDVAIDFSQEEWEFLDSAQRDLYRDVMWENYSNFISLGPSMSKPDVITLLDEGKEPWMVVREGIGRHHPDLESR

SEQ ID NO: 18180 - protein, 81 aa, Ovis aries
MDVAVDFSQDEWEWLTLAQRTLYKKVMLENYSNLASLGLCISKPDVISFLEQDKEPWMMKGELTRGLCPGLEYVWMKKELS

SEQ ID NO: 18181 - protein, 81 aa, Ovis aries
SQVSVTFEDVAVLFTRDEWRKLAPPQRNLYQDVMLENYSNLVSLGLLFPKPKVISLLQQGEDPWKVEKENLGGSSLGWKNS

SEQ ID NO: 18182 - protein, 81 aa, Ovis aries
VQGPVSFEDVAVGFSGEEWQLLGPSQKALYWDVMLENYCNLVSVGYQAPKPDSLFQLEQGGPPWTVKGAVLSPTCPGFVAE

SEQ ID NO: 18183 - protein, 81 aa, Ovis aries
YRGPVTFKDITVEFTREEWKLLDTAQRTLYREVMQENYSHLISVGYCANRPNAIFKLKQGKEPWILEVQFPRQKNPEDLCN

SEQ ID NO: 18184 - protein, 81 aa, Otolemur garnettii
QKLLTFEDVAIDFSVEEWTCLDSAQRNLYKDVMSENYRNLVSVDEIGLAASKPDLITCLEQSQEPWNVGEALAGHPGRWKW

SEQ ID NO: 18185 - protein, 81 aa, Cebus imitator
AHALVTFRDVAIDFSQKEWECLDPTQRKLYRDVMLENYGNLVSLGLLSRHKTKKLSSEKDIHEIGFSKGNIIEKSKTLHLK

SEQ ID NO: 18186 - protein, 81 aa, Cebus imitator
QGHLTFKDVAVEFSLEEWKCLTPAQRALYRDVMLENYSNLESVDISSKCMMKKFSLTAQGNTEMFHTGTLETHESHHIGVF

SEQ ID NO: 18187 - protein, 81 aa, Callithrix jacchus
GEGLLSFEDVAVDFTREEWQFLDPSQKVLYKEVMSENYRNLVSVGYQGTKPDSLFKLERGKPPWIVEGAAHSETCPGFVIQ

SEQ ID NO: 18188 - protein, 81 aa, Callithrix jacchus
KQGQVNFEDVFVYFSQEEWVLLDEAQRLLYRDVMLENFALMASLGCWPGMKDEEIPFEQSFSIGLSQIRIPKGSPSTQKAY

SEQ ID NO: 18189 - protein, 81 aa, Callithrix jacchus
AQKVLTFRDVAIEFSLEEWKFLDAAQQNLYRDVMLENYRNLFSIGLTVSKPGLITCLEQRKAPWNLKRREAADGHPELGFH

SEQ ID NO: 18190 - protein, 81 aa, Macaca mulatta
EMGPLTFRDVAIEFSLEEWQCLDTAQRNLYRKVMFENYRNLVFLVIYSHFTEDLWPEHSIKDSFQKVILRGYGKCEHENLQ

SEQ ID NO: 18191 - protein, 81 aa, Callithrix jacchus
TLVTFKDVFVDFTREEWKLLDTAQQIVYRNVMLENYKNLVSLDSETAFEIKSSVSSRSIFKDKQSCDIKMEGMARSDLWYL

SEQ ID NO: 18192 - protein, 81 aa, Callithrix jacchus
RPRALKFVDVAVYFSSEEWGCLRPAQRALYRDVMRETYGHLGALGFPGPKPALISWMEQESEAWSSAAQDPENGESLGGAR

SEQ ID NO: 18193 - protein, 81 aa, Callithrix jacchus
VNDLVTFKDVAIDFSQEEWQWMNPAQKRLYRSMMLENYQSLVSLGLCVSKPYVISLLEQGREPWEMTSEMRRSPFSDWESI

SEQ ID NO: 18194 - protein, 81 aa, Monodon monoceros
MGMGLTCDLTSLSNKKNPVSYDGFLLSKFYPSLGLSSSKPTVISLLEQGKEPWMVDRELTRGLCSDLESMCETKLLSLKKR

SEQ ID NO: 18195 - protein, 80 aa, Macaca mulatta
VFQGPLTFRDVTVEFSLEEWQCLDTAQQNLYRDVMLENYRNLVFLDKTGIAVSKPDLVTCLKQGKEPWNMKRHEMVAKTP

SEQ ID NO: 18196 - protein, 81 aa, Macaca mulatta
MRENYENLASVGRDLFKPSVICWLEEEEELRAEQRGVLQEWRLKTKGPALRQDRSWFRTSNETQTQARSHNGGQLCDRTQC

SEQ ID NO: 18197 - protein, 81 aa, Macaca mulatta
AIKFSQEEWKCLDPAQRTLCRDVMLENYRNLVSLDISSKCMMKEILSTGQGNTEVFHTGTLQRHESHHIGDFCFQDIEKEM

SEQ ID NO: 18198 - protein, 81 aa, Callithrix jacchus
MLENYSNLVAVGYQASKPDALFKLGQGQPPWTVKDGIHSGACSEIWKFDDQLLEHLQCENLVNRRKPCHENDAFENILHWS

SEQ ID NO: 18199 - protein, 81 aa, Bos taurus
VTFRDVAIDFSQEEWEFLDPAQRDLYVDVMLENYSNLVSLDLESTYETKNTLSKKDIFEINFSQWKIKERSKTIELEASIF

SEQ ID NO: 18200 - protein, 81 aa, Bos taurus
VKESVTFKDVAVDFTLEEWRLMDPTQRDLHKDVMLENYRNLVSLGLAISKPDMISHLENGKGPWVVVREISRTPFSELETK

SEQ ID NO: 18201 - protein, 81 aa, Bos taurus
MSSFHLICPPLLSSKDKAMRMNSEKALFSHCRKVTFFFLFQCIGLQVSKPDVISQLEQGTEPWIVEPSIPVGTPGDWVTRP

SEQ ID NO: 18202 - protein, 81 aa, Ovis aries
FKGSVTLQDVAVEFTPEEWQLLDCDQRTLFWDVMLENFRNLISVGCPVTETTVIFRVEQGQEPWMVEGEDSRWSSPEADCP

SEQ ID NO: 18203 - protein, 81 aa, Ovis aries
MLENYSHLLSLGYEVPKPEVIFKLEQGEEPWALKEKALHHSCSDGKFGIKNLQKRISGKVSFHGEMEGEDAKDDSLYSILE

SEQ ID NO: 18204 - protein, 81 aa, Ovis aries
FQGRLTFQDVAIDFTEEEWECLDLGQRELYRDVMLENYRNLASLGLVVSKPDLVTFLEQMQNPWDVRRLEMPAIYTGRCEW

SEQ ID NO: 18205 - protein, 81 aa, Ovis aries
QMAVTFEDVTVSFTWEEWKLLDSSQKKLYREVMWENYTNVMLVGNWKESCKPQEERFSYLDHENLSCWQGWKTASTPIYEN

SEQ ID NO: 18206 - protein, 81 aa, Ovis aries
MSKQAQLIFKDVFLDFTPEEWECLDPAQRTLYKDMMVETVRNGLSEAQKRRKMKEKESGMALSQAQSTFKDVFLDFTPEKW

SEQ ID NO: 18207 - protein, 81 aa, Ovis aries
QESVTFKDVAVDFTLEEWGRLGPGQRELYRDVMLENYQNLLSLGAGFPGAKPYVISCLERGEEPRMERRETQQVTCPDLET

SEQ ID NO: 18208 - protein, 81 aa, Ovis aries
MESVTLEDVAMELIQEWTLLDDAGRNLCRHVLQDNCRTPAARAGTPPCKASLVSQVESREELKAAEHGVLYATGVDWESQF

SEQ ID NO: 18209 - protein, 81 aa, Ovis aries
KVSRSLENDGVCFSEQEWENLEDWQKELYASVMKSNYEALASLKVLGQPEGEMELGAEMPGDLEEESRDVHPAEEVVAKQE

SEQ ID NO: 18210 - protein, 81 aa, Vulpes vulpes
MLENYSSLVSLGYEVVKPDVIFRLEQGEEPWIGAGELSSLDCPEQVLQVNGHMTWHQDNQEKLRNMKQDDECDAFGKKINL

SEQ ID NO: 18211 - protein, 81 aa, Otolemur garnettii
LTFKDVAVVFTEEELGLLDPAQRKLYRDVMLENFRNLVSVENDIPKVKESCLDFSLSDGNSQYKTSQWQRDCSRILHIGTY

SEQ ID NO: 18212 - protein, 81 aa, Otolemur garnettii
YQELVTFRDVAVDFSQEEWDCLNSSQKHLYSNVMLENYRILVSLGLCFSKPSLILLLEQGKEPWMVKRELTKDLYSGWEPI

SEQ ID NO: 18213 - protein, 81 aa, Otolemur garnettii
SDELVTFTDVAIDFSQQEWEYLDPNQRNLYRDVMLENYRNLVSLAGHSISKPDVVDLLEQGKEPWMILRDETQYTGPSVQL

SEQ ID NO: 18214 - protein, 81 aa, Macaca mulatta
MLVIFNKTGIAVSKPDLITCLEQGKEPWNMKRHEMVDKAPAICPHFAQDFWPEQGMEDSFQKVLLRKYEKCGHENLQLRKS

SEQ ID NO: 18215 - protein, 81 aa, Macaca mulatta
DSVTFEDVAVDFTQEEWTLLDQTQRNLYRDVMLENYNNLVAVDWESHINTKWSAPQQNFLQGKTSSVVEMERNHFGEELFD

SEQ ID NO: 18216 - protein, 81 aa, Callithrix jacchus
HEPLGFRDVAIEFSLEEWHCLDTVQRNLYWDVMLENYRNLVFLAPDLMVCLPCGILMVMHSHFAQDLWPEQGIKDSFQKMI

SEQ ID NO: 18217 - protein, 81 aa, Callithrix jacchus
KQGYVTFEDVAVYFSQEEWRLLDEAQRLLYRNVMLENFSLMASLGLASSKTHEITQLESWEEPFMPAWEVVTSAIPGGCWH

SEQ ID NO: 18218 - protein, 81 aa, Macaca mulatta
MLENYRNLVFLGIPVSKPDLITCLEQGKKPWTMKRHEMVAKSPVIYSHFAQDLWPEQSIKDTFQKVILRRYEKCGHDDLQL

SEQ ID NO: 18219 - protein, 81 aa, Bos taurus
LGHVTFEDVAVSFSQEEWGLLGEAQRLLYYDVMLENLNILELVLMRWMNLEPITQSEVSQKEKNKYINVCIYMCVCIYIYL

SEQ ID NO: 18220 - protein, 81 aa, Bos taurus
LQEPVTFRDVAVDFTQEEWGQLGPAQRTLYRDVMLETFGHLLSVGPELPKPDVISQLEQGAELWVAERGLPQGCRPALPLF

SEQ ID NO: 18221 - protein, 81 aa, Bos taurus
KGSTSTFRDVAIHFSQQEWECLNPVQKNLYQDVMMENYDNLVSLAGHSISKPDVITLLEQGKEPWMVVREETRRWCAGQYK

SEQ ID NO: 18222 - protein, 81 aa, Ovis aries
CEVSVSFEDVTVDFSREEWQHLDSAQRRLYQDVMLENYSHLLSLGYEVPKPEVIFKLEQGEEPWALKEKALHHSCSDGKFG

SEQ ID NO: 18223 - protein, 81 aa, Ovis aries
QAQLTFKDVFLDFTPEEWECLDPAQRTLYKDVMVEILRNLLSVDMSHIHMTKKLQAKANSGKGAIFQRVMFGRAEILEIRD

SEQ ID NO: 18224 - protein, 81 aa, Ovis aries
AQVSVTFDDVAVTFTQEEWGALEPAQRTLYQEVMLETCRLLMSLGCPVPRPELIYQLEHGQELWTVKRDLSRSTCPGYSSE

SEQ ID NO: 18225 - protein, 81 aa, Ovis aries
ELGPVTFEDVAVYFSQEEWRILDETQRHLYCYVMLETFALVASLGLASSRSHVVVPLELGGEPWVQDRVDMTPGTARGAQS

SEQ ID NO: 18226 - protein, 81 aa, Ovis aries
DVSLRSHIPTEDAEQEEEEEEMAASQGRLTFQDVAIDFTEEEWECLDLSQRELYRDVMLENYRNLASLDSQVTEWEEVCCR

SEQ ID NO: 18227 - protein, 81 aa, Ovis aries
AQGSVSFKDVTVDFSQEEWQHLDPAQKTLYMDVMLENYCHLISIGCHMTKPDVILKLERGEEPWTSFKGHTCLEENWKAED

SEQ ID NO: 18228 - protein, 81 aa, Ovis aries
MAQISFEDVAVNFTLEEWQLLNPTQKTLYRDVMLENYSNLVLLGYQVIKPETIFRLEQEKPWLLDEEILSQNFSEKVWLDN

SEQ ID NO: 18229 - protein, 81 aa, Ovis aries
ESVTFEDVAIDFTQEEWSLLDKSQKNLFRNVMLETVTHLVSVGYQISKSDVIFQLEQGKELWPEAAGGLQGQSPGSESLFR

SEQ ID NO: 18230 - protein, 81 aa, Ovis aries
QGRLTFEDVATDFTQEEWECLDLCQQELYRDVILENYGNLASLGLVVSKPDLVTFLEQMKDPWDIRRMEMPAIHPAVSSHD

SEQ ID NO: 18231 - protein, 81 aa, Vulpes vulpes
MARQDLAVRFSEEEWQLLGEGQRALYRDVMQENYETLRSLGTAERLPLSAFLSPTEPGGTMEGRSYAGEEQEPPRGGGPLA

SEQ ID NO: 18232 - protein, 81 aa, Otolemur garnettii
SKGSMMFKDVSVDFSQEEWECLDSGQMSLYKEVMLENFSNLVSVGLSNSKPAVISLLEQGKEPWMVERVLTRSLCSDLESM

SEQ ID NO: 18233 - protein, 81 aa, Otolemur garnettii
LKVFVAFRDVAVDFTQQEWKLLSPAQRTLHREVMLETYNHLVSLGIPFSKPKLITQLEQGEEPCREERKCLLDIHPGSTLE

SEQ ID NO: 18234 - protein, 81 aa, Otolemur garnettii
QESVTFKDVSVDFTQEEWHHIDTAQRSLYRDVMLENYSHLVSVGYQVSKPEVIFKLEQGEEPWISEGEIQRPFCPDWKTRP

SEQ ID NO: 18235 - protein, 81 aa, Otolemur garnettii
FQESVTFKDVIVDFTREEWKQLDPVQRDLFRDVTLENYTHLVSIGLQVSKPDVISQLEQGTEPWVIEPGFPVGTFADWETR

SEQ ID NO: 18236 - protein, 81 aa, Otolemur garnettii
LQDLVTFKDVAVEFTQEEWALLNPSQRTLYRDVMLENCRNLASLGCHVDKPNFLSHLEQEDKVMTEERKIIPSICPDVPTL

SEQ ID NO: 18237 - protein, 81 aa, Otolemur garnettii
FQSSVTFRDVAIDFSQEEWEFLDSAQRDLYRDVMWENYSNFISLGSSISKPDMITSLDEEGKEPGMLVREGARRYCPDLES

SEQ ID NO: 18238 - protein, 81 aa, Vulpes vulpes
SRSLENDGVCFSEQEWENLDDWQKEVYRNVMKSNYETLVSLKVLGQPEGEAELGAGMLGDLEEEGPGDIHPAEGVLIKQEI

SEQ ID NO: 18239 - protein, 81 aa, Vulpes vulpes
MRENCRNLASLGYHVDKPSLISQLEQEDKVMTEERGILQGTCSDLETVLKAKWLTPKKHVFRKEHSNGIKAERSHLGVKLN

SEQ ID NO: 18240 - protein, 81 aa, Otolemur garnettii
QEPVTFKDVIVEFSEEEWGHLDSAVKKMYRDVMLENYKNLNSLHKAHLLAKPAEIPKLENKIKRWIMEEEIPRTAVFDMKT

SEQ ID NO: 18241 - protein, 81 aa, Tursiops truncatus
SQLSVTFEDVAVLFTRDEWRKLAPSQRNLYQDVMLENYSNLVSLGLPFSKPEVISLLQQGEDPWKVVKESPGGSSLGRKNS

SEQ ID NO: 18242 - protein, 81 aa, Tursiops truncatus
FQEAVTFKDVAVTFTEEELGLLDSAQRKLYQDVMVENFRNLVSVGHLPFKPDMVSQLETEEKIWMMERETQRNGHSSENRK

SEQ ID NO: 18243 - protein, 81 aa, Acinonyx jubatus
MLENYANVASLAFLFTRPVLVSQLERGELPWGPEPWEPAGREVLGGICPELCSSETRAEKEESSPKEHIPEETESHRLTLG

SEQ ID NO: 18244 - protein, 81 aa, Tursiops truncatus
KTWGPLSFMDVFVDFTWEEWQLLDPAQKHLYRSVMLENYSNLVSLGYQHTKPNIIFQLEQEELWMMQIPSEGHMDEVWEID

SEQ ID NO: 18245 - protein, 81 aa, Tursiops truncatus
WKAWVKKPVTSEDVAVNFNQEEWECLDASQRVLYQDVMSETFRNLMSVDLIAKFEQEEKQWRAGLRPPNGEGLHSGGKREE

SEQ ID NO: 18246 - protein, 81 aa, Tursiops truncatus
SQDLVTFEEVAVDFSQEEWALLDPAQKILYRDVMLENFRNLASVGYHLCKHSLFTEVEQEELRPEQRRILQGAYRDQDTQL

SEQ ID NO: 18247 - protein, 81 aa, Tursiops truncatus
MDPTQRKLHKDVMLENYRNLVSLGLAVSKPDMISHLEDGKGPWVVVRETSKTRYSELETKPTTKNAIPTENISEECLSQET

SEQ ID NO: 18248 - protein, 81 aa, Rhinopithecus roxellana
QGLLTFRDVAIEFSQEEWKCLDPAQRTLYRDVMLENYRNLVSLDISSKCTMKDFSSTAQGNTEVIYTRTLERHHIGDFCFQ

SEQ ID NO: 18249 - protein, 81 aa, Leptonychotes weddellii
AHGMVMFKDVAIDVSQEEWECLNPTQRNLYKDVMLENYSNLVSLGLSISKPAVISSLEQGKEPWMVVREVTGGRCPAALYT

SEQ ID NO: 18250 - protein, 81 aa, Callithrix jacchus
LQGLVTFEDVAVEFTQEEWALLDPAQRTLYKDVMLENCRNLASLGCHVNKPRLISQWEQDKKVMTEERGILPSTCPDLETL

SEQ ID NO: 18251 - protein, 81 aa, Zalophus californianus
CEVSVSFEDVTVDFSREEWQHLDPAQRRLYRDVTLENYSHLRSVGYQVPKPEVIFKLEQGEGPWTLEGETPHQGCSDEATG

SEQ ID NO: 18252 - protein, 81 aa, Callithrix jacchus
CQESVTFEDVAVVFTDEEWSHLVPIQRDLYKEVMLENYKSVVSLGLPVPQPDMIFQLKRGEEPWMVDLHGSEEREWPESVS

SEQ ID NO: 18253 - protein, 81 aa, Acinonyx jubatus
AHRSVTFRDVAIYFSQQEWEYLDSVQKNLYRDVMMENYDNLVSLAEHSISKPDVITLLEQRKEPWMVVGEDTKRWCTDLES

SEQ ID NO: 18254 - protein, 81 aa, Rhinopithecus roxellana
RPRALKFVDVAVYFSPEEWGCLRPAQRALYRDVMRETYGHLGALGFPGPKPALISWMEQESEAWSPAAQDPEKGERLGGAR

SEQ ID NO: 18255 - protein, 81 aa, Rhinopithecus roxellana
PQGLVTFGDVAVDFSQEEWEWLNPNQRNLYRKVMLENYRNLASLGLCVSKPDVISSLEQGKEPWTVKRKMTRAGCPDLKTV

SEQ ID NO: 18256 - protein, 81 aa, Bison bison
MLENYSNLVSVGYQASKSAALSRLERGELWPVEDKVHSRICPEMRKDDCLLQENLQNQSCPKRMEQCHEHNALGNVYQSKN

SEQ ID NO: 18257 - protein, 81 aa, Bison bison
TFKEAVTFTDVAVTFTEEEFGLLDSAQKKLYQDVMLENFRNLVSVGCHPFRHDIFHLEKEKRLWVVKTATQREGKSEEKIQ

SEQ ID NO: 18258 - protein, 81 aa, Bison bison
QGSVTFEDVAVYFSWNEWCLLDEVQIRLYLDVMLENFALVCMLGSCHGVQHAETCSEQNVFAEGASQIRTLRAELSPENTQ

SEQ ID NO: 18259 - protein, 81 aa, Odocoileus virginianus
SQSLLTFEEVAIYFSQEEWELLDPTQKALYNDVMHENYETVISLALFVLPKPKVISCLDQGEEPYIQGSPVFKDNPGELLS

SEQ ID NO: 18260 - protein, 81 aa, Odocoileus virginianus
GQSRVTFEDVAVYFSQEEWCLLDEAQIQLYLDVMLENFALVCMLGSWPGAGDEETPFEQSRSVGVSQIGTPRADSSAEKVQ

SEQ ID NO: 18261 - protein, 81 aa, Odocoileus virginianus
SRESVTFEDIAVDFTQEEWALLDTSQRKLFRDVMLENISHLVSVGNQLYKSDVISHLEQGEQLSREELGFLQGQSPVISDR

SEQ ID NO: 18262 - protein, 81 aa, Cebus imitator
LGYSSFEKDVKIEFSLEEWQCLDTAQRNLYRDVMLENYRNLAFLGIAISKPDLITWLEQGKEPWNMKSHAMVAKPPGRSDS

SEQ ID NO: 18263 - protein, 81 aa, Cebus imitator
FEDVAVLFTRDEWRKLAPSQRNLYRDVMLENYRNLVSLGLPFTKPKVISLLQQGEDPWKVEKDCSGSSFLGCKSNPKMTKT

SEQ ID NO: 18264 - protein, 81 aa, Cebus imitator
LQGPLTFRDVAIQFSPEEWKCLDRAQRTLYRDVMLENYRNLVSVGESNFPPEAETCPWRFQRPRLVHDFGSGFRDQAGQHD

SEQ ID NO: 18265 - protein, 81 aa, Cebus imitator
MLENYFNLISVGCQVPKPEVIFNLEQEEPCMLNGGISSQSCPDGKIGFEPLQQRMSEEVSFQSERINLFTRDDPYSILEKL

SEQ ID NO: 18266 - protein, 81 aa, Cebus imitator
KPGAVSFADVAVYFSPEEWGCLRPAQRSLYRDVMRETYGHLGALGFPGPKPALISWMEQESEAWSSAAQDPEKGESLGGAQ

SEQ ID NO: 18267 - protein, 81 aa, Panthera pardus
AHHLVMFRDVAVDFSQEEWECLNSYQRNLYRDVILENYSNLVSVAGYTISKPDVITLLEQGKEPWMVVRDERRRRSLALRS

SEQ ID NO: 18268 - protein, 81 aa, Tursiops truncatus
PQKSVTFEDVAVYFTQTEWDGLSPAQRALYRDVMLENYGNVASLGFPLLKPTVISQLEGGGELEGPSPLASGTGTGPQGLW

SEQ ID NO: 18269 - protein, 81 aa, Acinonyx jubatus
SQEQVSFKDVCVDFTQEEWYLLDPAQKILYRDVILENYSHLVSVGYCFAKPEVVFKIEQGEEPWILEAGFPSHCHQEDWKV

SEQ ID NO: 18270 - protein, 81 aa, Acinonyx jubatus
TPDVVTFEDVAVCFSSGEWQCLTRAQRHLYTDVMLENYGNMLSAGLACPKPPLISHLEQGAVPCAEDLQDWGFLTCSFPVS

SEQ ID NO: 18271 - protein, 81 aa, Ursus arctos
PQEPVTFADVAVLFTPEEWMFLDSAQRSLYRDVMLENYRNLASVGDQLGKPSTFSHLEPGEERWPPERSSFPGTHPEPQHQ

SEQ ID NO: 18272 - protein, 81 aa, Leptonychotes weddellii
MKMHLPSPSEALSSDNLAHVLCHFPLTGLCVAKPEMIFKLERGEELWILEEESSGHGYPGSLSMLCGNNSVGGNAVRHDND

SEQ ID NO: 18273 - protein, 81 aa, Leptonychotes weddellii
MFPVTFSDVAIDFSHEEWGWLDSAQRDLYKDVMVQNYENLVSLAGLSIPKPYVISLLEDGKEPWMVEKKLSKGMFPDWESR

SEQ ID NO: 18274 - protein, 81 aa, Neophocaena asiaeorientalis
QAEVTFEDVAVLLSREEWGRLGPVQKGLYRDVMLETYRNLVSLGGGPAGPKPEVITQLERGDEPWVPDVQGRERLTIDGSA

SEQ ID NO: 18275 - protein, 81 aa, Odocoileus virginianus
WSQDLVTFEEVSVDFSQEEWALLAPAQKIMYRDVMLENFRNLASVGYHLCKHSLITEVAHEQPRPEGRGIFQSAYTDGATQ

SEQ ID NO: 18276 - protein, 81 aa, Odocoileus virginianus
LSQGLVTFKDVAVCFSQDQWSDLDPTQKEFYGEYVLEEDCGIVVSLSFPIPRLDEISYVREEPLVPDVPEPQEPEEPEILS

SEQ ID NO: 18277 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPDSGSKC

SEQ ID NO: 18278 - protein, 81 aa, Pteropus vampyrus
FQASVSFKDVTVELTQEEWQQMGPLQRTLYRDVMLENYNNLVSVGSCIYKPEVIFKLEQGEEPWLLEEEFSNQSYQVLEHY

SEQ ID NO: 18279 - protein, 81 aa, Pteropus vampyrus
QDLVTFEEVVVDFSQEEWALLDPAQKILYRDVMLENLRNLASVGAGYHLCKHSLITELEQEELRTEDRSLRDARSDWDTQL

SEQ ID NO: 18280 - protein, 81 aa, Panthera pardus
SQDLVTFKDVAIDFSQEEWEWLNPAQRSLYKNMMLENYRNLVSLGLCLSKPYVISSLEQGGEPWEKKNEMTESPDLESMYE

SEQ ID NO: 18281 - protein, 81 aa, Panthera pardus
MAEGFKFKDVAIYFSQKEWECLHPSQKGLYRDVMLENYSNLISLGLSDSKPNVISLLEQGKEPWMVNSKETKEWCPDWESR

SEQ ID NO: 18282 - protein, 81 aa, Panthera pardus
TFKEAVTFKDVAVVFTEEELGLLDPTQRKLYREVMLENFGNLVSVGHQPFKRDMVQLVREGKFWMMKLATQGKGNSGDKIQ

SEQ ID NO: 18283 - protein, 81 aa, Panthera pardus
FQDFVSFKDVAVNFTEEEWRELDPVQRVLYRDVMLENYRNLVSLGFPFSKPDIISQLEQAVNPRMQEGEVLRSSCTHLETR

SEQ ID NO: 18284 - protein, 81 aa, Ursus arctos
LLTFRDVAVEFSAEEWECLDPAQRALYRDVMLENYRNLVSLDISVRSMIKELSPKEDINKEELFQRLMLERHKRNDIKNFG

SEQ ID NO: 18285 - protein, 81 aa, Sus scrofa
PKVPVTFDDVAVYFSEQEWGKLDEWQKELYKHVMRGNYETLVSLDYAISKPDILSRMERGEEPCPEGAWGREEGRQSEEAR

SEQ ID NO: 18286 - protein, 81 aa, Sus scrofa
AAVRFADVAVYFSPEEWGCLRPAQRALYRDVMRETYGHLGALGDAANQKEDEPEAGPGAKGPRKTSGKERPEELVKHTPDS

SEQ ID NO: 18287 - protein, 81 aa, Leptonychotes weddellii
SQASVSFKDVTVEFTQEEWRQMGPIQRTLYRDVMLENYNNLVSVGNCIFKPAVIFKLEQGEEPWFLEEEISNQSHREDYRD

SEQ ID NO: 18288 - protein, 81 aa, Neophocaena asiaeorientalis
FQDPVTFEDVAVVFTDEEWRCLVPTQRDLYKEVMLENYKSIVSLGLPVPGPDVIFQLKRGDEPWIVELHGSEGKECAENVS

SEQ ID NO: 18289 - protein, 81 aa, Vicugna pacos
VPLTFKDVAIRFSQEEQEFLDPAQRALYRDVMLETCRNLLTVDLSQMHVIKKLQVKANTDRGDVLQIVMLGGCERNEMKHF

SEQ ID NO: 18290 - protein, 81 aa, Neophocaena asiaeorientalis
SQDSVTFEEVAVDFSQEEWALLDPAQKILYRDVMLENFRNLASVGHHLCKHSLFTEVEQEELRPEQRRILQGAYRDQDTQL

SEQ ID NO: 18291 - protein, 81 aa, Phascolarctos cinereus
AQESLTFKDVAVNFTREEWRHLDLRQRDLYREVMLENYRNLVSLGHHISKPNMISQLEKGKEPWMVESGTSRCTCSNRETR

SEQ ID NO: 18292 - protein, 81 aa, Neomonachus schauinslandi
PQDLMTFEDVAVEFTQWEWGQLDLAQKDLYRAVMLENFKNLASLGLPVSKPYVISQMEEGKEPYVLEGEISTDWEKRPKAK

SEQ ID NO: 18293 - protein, 81 aa, Phascolarctos cinereus
LKETVTFKNVAVDFTQEEWGLLDLPQKELYKGVMLENAWNLLSLGLAVPREDVISYFEQREAPWMLEQEDLRSRCPEEEIR

SEQ ID NO: 18294 - protein, 81 aa, Phascolarctos cinereus
SQGLVTFEDVAVYFSLEEWGRLNEAQKDLYKEVMQENYGILVSLGYPIPKPDVISRMERGEELWVPDSPVPEEGDIVTGVY

SEQ ID NO: 18295 - protein, 81 aa, Macaca nemestrina
QGLLTFRDVAIEFSQEEWKCLDPAQRTLYRDVMLENYRNLVSLDISSKCMLKTLSSTGQGNTEVILIGTLQRQASHHTGEF

SEQ ID NO: 18296 - protein, 81 aa, Tursiops truncatus
SQGLVTFRDVALNFSQEEWEWLDSSQKDLYRDVMLENYRNLVWLGLSVSKPNMISLLEQGKDPCMVEREMSDGQYAEWDSL

SEQ ID NO: 18297 - protein, 81 aa, Acinonyx jubatus
AQESLTFDDVAVNFTWEEWQLLAPAQKNLYRDVMLENYRNLVSLGFYPRKPDVLTKLDQGKPTGTVEDDIPFRTCSEIWKL

SEQ ID NO: 18298 - protein, 81 aa, Tursiops truncatus
GSVSFTDVTVDFTQEEWEQLDPSQRILYMDVMLENYSNLLSVEVWKADDQMERDHRNPDEQARPFIIFKNQTPIEERDNLF

SEQ ID NO: 18299 - protein, 81 aa, Tursiops truncatus
GWVPALFDEVAIYFSDEEWDVLTEQQKALYREVMRMNYETVLSLEFPFPKPDMITRLEREEESQNSDEWQFQGGTFAENEE

SEQ ID NO: 18300 - protein, 81 aa, Acinonyx jubatus
HQEVVTFEDVAVYFSGTEWTGLSPGQKALYRSVMLENYGNLTSLGYQVPRPALISLLEAGNLPWGLEAQDNLSAERTKDIC

SEQ ID NO: 18301 - protein, 81 aa, Cercocebus atys
LQGLVSFEEVAVHFTWEEWQDLDDAQRTLYRDVMLETYSSLVSLGHCITKPEVIFKLEQGAEPWLGEEWANQCLSGVQTVD

SEQ ID NO: 18302 - protein, 81 aa, Sus scrofa
KEAVTFKDVAVAFTEEELGLLDSAQRKLYQEVMVENFRNLVSVGHQPFKRDTSCKERREALDDEFSNPGENSQNQSELRAI

SEQ ID NO: 18303 - protein, 81 aa, Odocoileus virginianus
DPEQVTFEDVVVDFTQEEWGHLEPAQRTLYRDVMLETFRLLVSVGHWLPKPDVISLLEQEAELWAADEGGPQGVCPDLETR

SEQ ID NO: 18304 - protein, 81 aa, Macaca fascicularis
QGRLTFRDVAIEFSLAEWKCLNPAQRALYREVMLENYRNLESVDISSKCMMKEILSTGQGNTEVFHTGTLQRHESHHIGDF

SEQ ID NO: 18305 - protein, 81 aa, Leptonychotes weddellii
PQKSVTFEDVAVYFTQTEWDGLSPAQRALYRDVMLENYGNVASLGFSLLKPAVISQLEGAGELGGPSPLVDGTETGPQGLW

SEQ ID NO: 18306 - protein, 81 aa, Leptonychotes weddellii
PLESVTFEDVVVDFTKEEWALLDISQRKLFRDVMLENIRHLVSLGYQHCKSDVIFPLEQGEELWREGTGFLQGQSPGRESA

SEQ ID NO: 18307 - protein, 81 aa, Odocoileus virginianus
PQAKVTFEDVAVFLSQDEWDRLGPAQRGLYRHVMMETYGNVVSVGIPGSKPEVISQLERGEEPWVLDKQGSEQLRGWGISR

SEQ ID NO: 18308 - protein, 81 aa, Neophocaena asiaeorientalis
WSQMPVTFEDVAVYLSREEWGRLDHTQQSFYRDILQKRNGLSLAGFPFSRPFWASQVQGKGEASGSCQQMGDEEEEKRGAV

SEQ ID NO: 18309 - protein, 81 aa, Odocoileus virginianus
LQDLVTFKDVTVEFNQEEWALLDSSQQKLYRDVMLENYGNLASLGYHVDKPSLISQLEQEDKVMTEEEGILPGTCPDLEMV

SEQ ID NO: 18310 - protein, 81 aa, Phascolarctos cinereus
PQEWVTFKDVAVDFTPEEWGHLSLSQKELYRDVMLENFRNLVCLGLAMSKPDVISQLERGEAPWMPEGNGLRCRLGNKTEN

SEQ ID NO: 18311 - protein, 81 aa, Cercocebus atys
PLSFKDVAVVFTEEELGLLDSTQRQLYRDVMLENFRNLLSVGDKNGRDMEYIQDEELRLFSHEELSSCKIWEEVVGELPGS

SEQ ID NO: 18312 - protein, 81 aa, Ursus arctos
FKETVTFKDVAVVFTEEELGLLDPAQRKLYRDVMLENFRNLISVGGKIQSKMKMILEAEPPEELSCWRIWQQIASDLTRCQ

SEQ ID NO: 18313 - protein, 81 aa, Sus scrofa
KEAVTFKDVAVVFTEEELGLLDLTQRKLYQEVMLENFRNLVSVGGKIQHETETVPEAGPHEELSCWQIWQHIARDLTRCQD

SEQ ID NO: 18314 - protein, 81 aa, Ursus arctos
PLESVTFEDVAIDFTKEEWALLDTSQRKLFRDVMLENIRHLVSLGYQHCKSDVIFQLEQGEELWREGPGFLRGPSPGRESA

SEQ ID NO: 18315 - protein, 81 aa, Ursus arctos
GSVSFTDVTVDFTQEEWEQLDPSQRILYMDVMLENYSNLLSVEVWKADDQVERDRSNPDEQARPFIIFKNQTPIEERGNLF

SEQ ID NO: 18316 - protein, 81 aa, Ursus arctos
LQGQVNFEDVAVYFSQEEWGLLDETQRLLYRDVMLENLALMASLGCWHGMEDEEIAFEQNVSVGVSQVRTPKAGPSTQKAR

SEQ ID NO: 18317 - protein, 81 aa, Ursus arctos
AQESLTFGDVFVDFTLEEWQQLDSAQKNLYRDVTLENYSHLVSVGYLVPKPDEVLRLGRGEEARRAEGEPPTRSYPELGQG

SEQ ID NO: 18318 - protein, 81 aa, Sus scrofa
SQGLLTFEDVAIDFSPEEWECLDLGQRHLYRDVMLEICRHLVSLEYVISKPDLVRLLEQKTDPWDVKGMETVAIQPALSSH

SEQ ID NO: 18319 - protein, 81 aa, Vicugna pacos
FQGSVTFRDVAIAFSQQEWESLDSAQRDLYRDVMLENYSNVVSLAGHSRSKPHVITLLEQCKEPWMVVKKDQRRQYTDFQP

SEQ ID NO: 18320 - protein, 81 aa, Pan troglodytes
MAFEDVAVYFSQEEWGLLDTAQRALYRRVMLDNFALVASLGLSTSRPRVVIQLERGEEPWVPSGKDMTLARNTYGRLNSGS

SEQ ID NO: 18321 - protein, 81 aa, Sapajus apella
MGVLTFRDVAIEFSPEEWECLDSAQQHLYRDVMLENYRNLVSLGLAIFKPDLITCLEQRKEPWNLKKQETVAKYPAGSFLF

SEQ ID NO: 18322 - protein, 81 aa, Rhinolophus ferrumequinum
VTFEDVALYLSREEWGRLDHTQQSFYRDVLQKRNRLALGFPFSRTFWASQVQSKGEASSSCQQTGDEEKRGALEVGKEETP

SEQ ID NO: 18323 - protein, 81 aa, Camelus dromedarius
LQELVTFKDVTVDFTQEEWEHLDPSQRHLYSEVMLENYGNLISVAGHLLSKPEMISHFEQDDVWLELKIPRSSYSGEKLHH

SEQ ID NO: 18324 - protein, 81 aa, Camelus dromedarius
ESVTFRDVAVFFSRDEWLHLNSAQRALYREVMLDNYSALVSLETLRLDLSARVSPHVCTVDSFSFLLMNRDSVFQTKGYPP

SEQ ID NO: 18325 - protein, 81 aa, Ursus maritimus
FQESVTFKDVIVDFTQEEWKQLDPVQRDLFRDVTLENYTHLVSIGLQVSKPDVISQLEQGTEPWIVEPGIPVGTVGDCATR

SEQ ID NO: 18326 - protein, 81 aa, Acinonyx jubatus
KEAVTFKDVAVVFSEEELGLLDPAQKKLYGDVMLENFRNLLSLGGKIQNKMKTVLETEPHKELSCWQIWQQIASDLTQCEG

SEQ ID NO: 18327 - protein, 81 aa, Rhinopithecus roxellana
GLVTFEDVAVDFTQEEWQYLNSPQRTLYRDVMLETYSNLVFVGQQVTKPNLILKLEVEECPAEGKIPFWNFPEVCQVGEQI

SEQ ID NO: 18328 - protein, 81 aa, Acinonyx jubatus
SLESDLFRDVAVVFSQEEWERLAPAQRDLYRDVMLETYSNLVSLGLAISKPDVISFLEQGKEPWMVEKAAAGGLCPGLTLP

SEQ ID NO: 18329 - protein, 81 aa, Acinonyx jubatus
PGALSFADVAVYFSSEEWGCLRPAQRALYRDVMRETYGHLGALESKKKKNEPSSRIRAKELEDPPVKNGPLMKARLVPGFR

SEQ ID NO: 18330 - protein, 81 aa, Rhinopithecus roxellana
QDSVAFEDVAVNFTQEEWSLLDPSQKNLYREVMQETLRNLASLGAKWKDENIEDQYKTPRNNLRSLLGERVNENTEENHCG

SEQ ID NO: 18331 - protein, 81 aa, Rhinopithecus roxellana
QQGYVTFEDVAVYFSQEEWRLLDEAQRLLCRNVMLENFSLLASLGLASSKTHEITQLESWEEPFMPAWEVMTSAIPRGCWH

SEQ ID NO: 18332 - protein, 81 aa, Rhinopithecus roxellana
CYQDSVTFDDLAVDFTPEEWTLLDPTQRNLYRDVMLENYKNLATVGCQLFKPSLISWLEQEESRTVQRGDFQASEWKVQLK

SEQ ID NO: 18333 - protein, 81 aa, Rhinopithecus roxellana
LKGLVTFEDVAVEFTQEEWALLDPAQRTLYRDVMLENFRNLASLGNQVDKPGLISQLEQEDKVMTEERGIFPGACPDVENP

SEQ ID NO: 18334 - protein, 81 aa, Acinonyx jubatus
DPVQVNFEDVAVYFSREEWGLLDEAQRLLYRDVMLENLALTASLGYESSMSLGVASLELGGKPWVSDWADVTPARTREAQG

SEQ ID NO: 18335 - protein, 81 aa, Rhinopithecus roxellana
PQGHLTFMDVAIEFSQDEWKCLDPGQRALYRDVMLENYRNLVSLGICLPDLSIISMLKQRREPLTLQSEVKIVKNPDGREC

SEQ ID NO: 18336 - protein, 81 aa, Bison bison
ESGSLTFADVYIEFSQEEWECLDPAQRTLYRDVMLETYRNLLSSSMTNFNSPSVMFSTHVRFELAILESKLRFCIVYCSLF

SEQ ID NO: 18337 - protein, 81 aa, Bison bison
PQDLVTFKDVAIDFSQEEWEWLSPAQRSLYRSMMLENYQSLVSLGLCISKPYVISLLEQGKEPWMVMENEMRSPFPDWESI

SEQ ID NO: 18338 - protein, 81 aa, Bison bison
EKTVSRSLENDGVCFSEQEWENLEDWQKELYANVMKSNYETLVSLKVLGQPEGEMELGAEMPGDLEEEESRSVHPGEWLQN

SEQ ID NO: 18339 - protein, 81 aa, Bison bison
TELTVEDVDIKFTPEKWECLDPAQRALYWDVMEETYRNNLLSVAEEDLWIVENEVQMSGNQMSCKGVHTGEKPYKYYVCGK

SEQ ID NO: 18340 - protein, 81 aa, Odocoileus virginianus
FQEPVTFEDVAVYFTQNQWASLDSAQRALYREVMLENYANVASLVSPFPRPDLISQLERGEAPWDPNPWEAEDLRGICPGE

SEQ ID NO: 18341 - protein, 81 aa, Odocoileus virginianus
EPVTFEDVAVDFTQEEWQQLWQYPGGVGQKTLRRDVMLEIYSHLVSVGCSDLKLDIISKLEHGKDPWIIESELSRWTYSEE

SEQ ID NO: 18342 - protein, 81 aa, Odocoileus virginianus
MLENYGNLVSLGFPIFKPDGISQLEQDLQVFDLETKNREVLRDDCSDGETREENKLLIPKQKIPEEVHSYKVRVGRFKKDI

SEQ ID NO: 18343 - protein, 81 aa, Odocoileus virginianus
CSGLLSFTDISMQFSWEEWQLLDSVQKHLYRDVTLENYSNLVAIGYHGNKPDLIFKLEQGEEPWIINSKVSHQSCPDGWEE

SEQ ID NO: 18344 - protein, 81 aa, Cebus imitator
FQESVTFQDVAVDFTPEEWQLLDCAERTLYWDVMLENYRNLISVGCPVTKTKVTLKVEQGQEPWMVEGVNPHQSSPESDCP

SEQ ID NO: 18345 - protein, 81 aa, Cebus imitator
QVTFSDVALDFSHEEWGWLDSAQRDLYKDVMVQNYENLVSLAGLSITKPHVITLLEDGKEPWMVEEKLSKECLHILFLIVS

SEQ ID NO: 18346 - protein, 81 aa, Cebus imitator
EGPLTFRDVAIEFSLEEWQCLDTAQQNLYRHVMLENYRNLVFLANIVYCTLDDRERPCYQKKKKKKKKKPLFVCSQDLWPK

SEQ ID NO: 18347 - protein, 81 aa, Macaca mulatta
EPGIVSFADVAVYFCREEWGCLRPAQRALYRDVMRETYGHLGALGIGGNKPALISWVEEEAELWGPAARDPETKCPTETDP

SEQ ID NO: 18348 - protein, 81 aa, Callithrix jacchus
CEASVSFEDVTMAFSREEWQQLDPAQKRLYQDVMLELYSHLFSVGYQIPNPDVVFRRLKEKEPCTEEAELSHQRCQEGEFG

SEQ ID NO: 18349 - protein, 81 aa, Callithrix jacchus
EPGLLTFRDVAIEFSLEEWQCLDAAQRNLYKNVILENYRNLVFLGIAVSKPDLIACLEQEKEPLIMKRDEMADEPPVMCSH

SEQ ID NO: 18350 - protein, 81 aa, Callithrix jacchus
SVASEDVAVNFTLEEWALLDPSQKKLYRDVMRETFRNLACVGKKWEDQSIEDWYKNQGRILSNHVEVGLSESKEHDQCGEA

SEQ ID NO: 18351 - protein, 81 aa, Callithrix jacchus
RWKTEEAVTFKDVAVVFTEEELGLLGPAQRKLYRDVMLENFRNLLSVGHQPFHRDTFHLQREEKFWMMETATQREGNSGPL

SEQ ID NO: 18352 - protein, 81 aa, Macaca mulatta
LTFQDVTIEFSLEEWQCLDTAQQTLYRDVMLENYRNLVFLGIAVSKLDLIACLKQGKESWNMKRHEMKNFKGFMYYYFNIS

SEQ ID NO: 18353 - protein, 81 aa, Monodon monoceros
MRNQSHGLKAPLTGLSITKPAVISSLEQGKEPWMVMREVIGDQFPDLVSKCEAKKLSPERNIYETESSQWAIMEPFKSHSP

SEQ ID NO: 18354 - protein, 81 aa, Callithrix jacchus
WSQNSVSFQEVAVDFSQEEWALLDLAQKNLYKDVMLENFRNLTSVGYELCRHNLISKVDQEELKTDERGILESDCAEWETQ

SEQ ID NO: 18355 - protein, 81 aa, Callithrix jacchus
TCTGCGPPERQEMEEWALLDPSQKTLYRDVMQENFRNLASVGKKWKAQNIYVEYKNLRRNLRNLMGKRLFESKEDHQHGEI

SEQ ID NO: 18356 - protein, 81 aa, Callithrix jacchus
SCVTFEDVFVYFSREEWELLEEAQRFLYRDVMLENFALVATLGFWCETENEEAPSEQSISLEGVSQVRTAESGLFQAHPCE

SEQ ID NO: 18357 - protein, 81 aa, Macaca mulatta
VHGSVTFRDVAIDFSQEEWECLQPDQRTLYRNVMLENYSHLISLGSSISKPDVITLLEQEKEPWIVVRKETSRWYSDLESK

SEQ ID NO: 18358 - protein, 81 aa, Acinonyx jubatus
MMSQGLMAFEDVAVYFSQEEWELLDAAHVMLENFALVSSLGLSASRPRVVLQLERGEEPWVLSGTVVTPARNAQRKPSPGP

SEQ ID NO: 18359 - protein, 81 aa, Rhinopithecus roxellana
VMFDDVAVEFTPEEWVLLDTTQKYLYRDVMLENYMNLASVDFFFCLTSEWEIQPRTKRSSLQQGFLKNQIFTGIQMQTRSY

SEQ ID NO: 18360 - protein, 81 aa, Rhinopithecus roxellana
TAHSLKKVTFEDVWNFLLMDTSNRKLYRDVMLENISHLVSLRYQISKSYIILQLEHGKELWREGREFLQGQSPYRESALRK

SEQ ID NO: 18361 - protein, 81 aa, Rhinopithecus roxellana
YQTPVSFKDVVVGFTQEEWHRLSPAQRALYRDVMLETYSNLVSVGYEGTKPDVILRLEQEEAPWIGGAARPGCHCWEDIWQ

SEQ ID NO: 18362 - protein, 81 aa, Rhinopithecus roxellana
GCAFVAFRDVAVDFTQEEWRLLSPAQRTLHREVMLETYNHLVSLEIPSSKPRLIAQLERGEEPWREERKCSLDLCPESKPE

SEQ ID NO: 18363 - protein, 81 aa, Bison bison
SGMTLSQTQLTVEDVDIKFTPEEWECLDPAQRALYWDVMEETYRNLLSVAGSLPLSHKEVPKACSFTCILELMNRMCLIYI

SEQ ID NO: 18364 - protein, 81 aa, Bison bison
WKGLLSFEDVVLYFTREEWDMLDWAQKALYRDVMLDNYRHVVSLDSEARFQTKELTPKENTSEDLMLWKMSALKQKTAKEP

SEQ ID NO: 18365 - protein, 81 aa, Bison bison
PLKLVTFEDVAVDFTQEEWSLLDKSQKNLFRNVMMETIHHLVSVGYQISKSDVISQLEQGKELWSKAAGGFQGQRPGEHQG

SEQ ID NO: 18366 - protein, 81 aa, Odocoileus virginianus
GRLTFQNVAIDFTQEECECQDLSQRDLYRDVILENYRNLACLGLVVTGLNLVTFLEQLNNPRTIRRIETTAIYPGVSPQDT

SEQ ID NO: 18367 - protein, 81 aa, Odocoileus virginianus
PQGCVTFEDVAVYFSQEEWGLLDEAQRHLYHKVMLENFALTASMVCLHETETKEIPSEQNVSLEALSQVRTPKNSQWREAF

SEQ ID NO: 18368 - protein, 81 aa, Odocoileus virginianus
SEDPVTFQEVSVDFSREEWAQLAPAQKILYQDVMLENYRNLTSVGYHLRKPCLLTQGELRTRKRRLLQDTCADQNSQLKTK

SEQ ID NO: 18369 - protein, 81 aa, Odocoileus virginianus
DPVAFEDVAVNFTLEEWALLGPSQKKLYRDVMRETLSNLALISKDDDIPSLREQVPPAHQCCSQIWNGEREIFGDKWEDHY

SEQ ID NO: 18370 - protein, 81 aa, Odocoileus virginianus
MFQESVTFKDVAVDITQEDWELMRPVQKELYKTVTLQNYWNMVSLGLTVYRPTVIPMLEEPWMVLKEILEGPSPEWETKAQ

SEQ ID NO: 18371 - protein, 81 aa, Cebus imitator
PGSLEMGPLTFMDVAIEFSLEEWQCLDTAQKNLYRTVMLENYRNLVFLDLITCLEKGKEPWNMKMGAKPQVLSYFPKDLWL

SEQ ID NO: 18372 - protein, 81 aa, Cebus imitator
TQGQVTFRDVAIEFSQEEWTCLNPAQRSLYRDVMLENYRNLASLAGISCFDLSIISMLEQRKEPFTLESQVQIAGNPDGWE

SEQ ID NO: 18373 - protein, 81 aa, Cebus imitator
QGHLTFKDVAIEFSLEEWKCLTPSQRALYREVMLENYRNLESVDISSKCMMKKFSLTAQGNTEMFHTGTLETHESHHIGVF

SEQ ID NO: 18374 - protein, 81 aa, Cebus imitator
SPGSVTFTDVAIDFSQDEWEWLNLAQRSLYKKVMLENYRNLVSVGLCISKPDVIFLLEQEKDPWVIKGETTRGLCSDILKM

SEQ ID NO: 18375 - protein, 81 aa, Cebus imitator
MTFEDVAVEFTQWEWGQLNPAQKNLYREVMLENFRNLTLLGFLVSKPYVICQLEEGGEPFMVKREISIGAHSDWERRSKSK

SEQ ID NO: 18376 - protein, 81 aa, Cebus imitator
FQGVLTFRDVAIELSRKEWQCLDTAQQNLYRTVMLENYRNLVFLGIAASKPDLITCLEQGKEPWNVKRHEMVAESPVACSY

SEQ ID NO: 18377 - protein, 81 aa, Macaca mulatta
SQHLVTFEDVAVDFTQEEWTLLDQTQRDLYRDVMLENYKNLIILGSEFCKPSLMSELEQMEELRTGVTGVLQELDLQLKTK

SEQ ID NO: 18378 - protein, 81 aa, Callithrix jacchus
MLMFRDVAIDFSQEEWEGLDLKQRDLYRDVMLENYSNMVSLGFCVYQPDVFSLLEKGKEPWKILRDETRGPCPDMQSRCPN

SEQ ID NO: 18379 - protein, 81 aa, Callithrix jacchus
LPGLLTFRDVAIEFSLEEWQCLDTAQRNLYKNVILENYRNLVFLGIAVSKPDLIACLEQEKEPLIMKRDEMRSSTLTTHKR

SEQ ID NO: 18380 - protein, 81 aa, Macaca mulatta
MLENYRNLVSLGVAISNPDLVTCLEQRKEPYNVKIRKIVARPPAVRSHFTQDRWPVQGIEDSFHNLILRRYEKCRHENLQL

SEQ ID NO: 18381 - protein, 81 aa, Callithrix jacchus
ENGILTFRDVAVEFSPEEWKCLDSAQQHLYRNVMLENYRNLVYLGIAMSKPDLNNHLEERKKPWNVKKQESRTEGDRNTKK

SEQ ID NO: 18382 - protein, 81 aa, Macaca mulatta
CEASVSFEDVTVDFSREEWQHLDPAQRRLYWDVTLENYSHLLSVGYQVPKSEAAFKLEQGEGPWMLAGEAPHQSCSGEAIE

SEQ ID NO: 18383 - protein, 81 aa, Callithrix jacchus
ALALVSFEDVVVTFTGEEWGHLDLAQRTLYQEVMLETFRLLISLGHPVPKPEMIYLLEHGQEPWTEKRGLSQSTCAGEKAK

SEQ ID NO: 18384 - protein, 81 aa, Callithrix jacchus
GSVSFTDVTVDFTQEEWEQLDPSQRILYMDVMLENYSNLLSVEVWKADDQMERDHRNPDEQPRQFIILKNQTPMEERGDLF

SEQ ID NO: 18385 - protein, 81 aa, Macaca mulatta
FQVQLTFRDVTVEFSLEEWQCLDTVQQNLYRDVMLENYRNLVFLGIAVSKPDLVTCLEQGKEPWNMKRHEMVATPPGRFSH

SEQ ID NO: 18386 - protein, 81 aa, Macaca mulatta
QDLVTFDDVAWYLTTGEWFKLDPEQRVLAYYRNVTSVGVPVLNPALVPHLAQGQVLLVSDPSPNTDPAKYSENTSATRHQT

SEQ ID NO: 18387 - protein, 81 aa, Macaca mulatta
VFLGIAVSKPDLITWLEQGKEPWNMKRREMVDKTPVMCSHFTQDVWPEQSIKDSFQKVILRTCGKYGHENLQLRKDHKSVD

SEQ ID NO: 18388 - protein, 81 aa, Macaca mulatta
EKGPLTFRDVAIEFSLEEWQCLDTAQQGLYRKVMLENYRNLVFLAGIAVTKPDLITCLEQRKEPWNIKRHEMVAKPSVICS

SEQ ID NO: 18389 - protein, 81 aa, Macaca mulatta
QGLLTFRDVAVEFSLEEWQCLDTAQRNLYKNVILENYRNLVFLGIAVSKPDLITCLEQEKEPLTMQRHEVVDEPPVMCSHF

SEQ ID NO: 18390 - protein, 81 aa, Macaca mulatta
VTFDDVAVEFTPEEWVLLDTTQKYLYRDVMLENYMNLASVDFFFCLTSEWEIQPRTKRSSLQQGFLKNQIFTGIQMQTRNY

SEQ ID NO: 18391 - protein, 81 aa, Callithrix jacchus
SQGPLTFIDVAIEFSQEEWKCLDPAQRTLYKDVMLENYRNLVSLGVDLPDLSFISMLEQKREPWTLQSEEKIARNPDGREC

SEQ ID NO: 18392 - protein, 81 aa, Callithrix jacchus
TQGQVTFRDVAIEFSQEEWTCLDPAQRSLYRDVMLENYRNLASLAGISCFDLSIISMLEQGKGPFALESQVQRAGNPDGWE

SEQ ID NO: 18393 - protein, 81 aa, Macaca mulatta
SMTFEDVAVNFTPEEWALLDPSQKNLYQEVMQETLRNLASIGKKWKDQNIENEYKNPRSNQRGLMEERLFESEGHQPGEIL

SEQ ID NO: 18394 - protein, 81 aa, Ursus maritimus
CEGSLSFEDVTMDFSREEWQQLDPAQRRLYQDVMGEVYSHLLSLEGVFGLKTSQQKMFEKASCHNDKESEVTRGGPWCSIS

SEQ ID NO: 18395 - protein, 81 aa, Camelus dromedarius
SQGQLTFKDVAIEFSQEEWECLDAAQRALYRDVMLETCRNLLSLGISVSDLNSNPILKQENEPWTVKSDMKISKNQVAGSM

SEQ ID NO: 18396 - protein, 81 aa, Acinonyx jubatus
AQELLTLEDVAVDFSREEWQLLAPAQKDLYRDVMLENYRNLVSVGCQATKRDALSVLEHRDEAWMKAEDEIQGRTRAGIGK

SEQ ID NO: 18397 - protein, 81 aa, Acinonyx jubatus
NPQELLTFNDVAIEFSQEEWGFLNHSQRELYRDVMLENYGHLLLLGLVSKPDLVNFLEQKKEAWDVNGKGTVATHLSAVSS

SEQ ID NO: 18398 - protein, 81 aa, Rhinopithecus roxellana
QGLLTFRDVAIELSQEEWKCLDPAQRTLYRDVMLENYRNLVSLDISSRCVMKTLSSTGQRNTEVIHKGTLQRQASHHIGEC

SEQ ID NO: 18399 - protein, 81 aa, Acinonyx jubatus
FQGWLTFRDVAIEFSQEEWECLDPAQRALYRDVMLENYRNLVSLGEDNFSPEVVPEAKCVKWIHSAVLRLDMPAVYFPQVF

SEQ ID NO: 18400 - protein, 80 aa, Rhinopithecus roxellana
MTVSQGLFTFKDVAIEFSQEEWECLDPAQRALYRDVMLENYRNLLSLDEDNVPPENVFYPVQELRETLVFLISYSSKIYL

SEQ ID NO: 18401 - protein, 81 aa, Acinonyx jubatus
SQSSLTFEEVAMYFSQEEWEFLDPTQEALYNDVMRENYETVISLALFVLPKPKVISYLEQGEEPWVQGSTELKDSPGELPT

SEQ ID NO: 18402 - protein, 81 aa, Rhinopithecus roxellana
NKGPVTLKDVIVEFTKEEWKLLTPAQRTLYKDVMLENYSHLVSVGYHVNKPNAVFKLKQGRKPWILEVEYPHRGFSEDLWS

SEQ ID NO: 18403 - protein, 81 aa, Rhinopithecus roxellana
GLLTFRDVAIEFSQEEWKCLDPAQRTLYRAVMLENYRNLVSLDISSKCKMKEFLSTAQSNREVLHTWTLQRHESHQIGDYC

SEQ ID NO: 18404 - protein, 81 aa, Rhinopithecus roxellana
RVTFKDVAVVFTKEELALLDKAQINLYQDVMLENFRNLISVGDGIKNNILNLQEKGLSYLSQEVLHCWQIWKQRIWDLTVN

SEQ ID NO: 18405 - protein, 81 aa, Rhinopithecus roxellana
IWGPLSFMDVFVDFTWEEWQLLDSAQKCLYRNVMLENYSNLVSLGYQHTKPDIIFKLEQGEELCVVQAQIPNQSCPILKAG

SEQ ID NO: 18406 - protein, 81 aa, Acinonyx jubatus
MLETYRNLVSLGLQRSKPDVISRLEKGEEPWAPRSLRIEESWIRNHRSGSFESLMEKKELTPKQEISKAGESQRAKPEEHA

SEQ ID NO: 18407 - protein, 81 aa, Rhinopithecus roxellana
PQGLLTFRDVAIEFSQEEWKCLDPAQRTLYRDVMLENYRNLVSLAISSKCRMKMFSSTAQGNSEVIHTGALQRHASHHIGE

SEQ ID NO: 18408 - protein, 81 aa, Rhinopithecus roxellana
RNMIPQDNENPPQQGEANQNDLMAFEDVAVNFTPEEWALLDPSQKNLYREVMQETLRNLASIEFLQKRDYLKVKVISVEKF

SEQ ID NO: 18409 - protein, 81 aa, Rhinopithecus roxellana
DSVAFEDVAINFTCEEWALLGPSQKSLYRDVMQETIRNLDCIGMIWQNHNIEEDQYKDLRRNLRCHMVERSCEIKDNSQCG

SEQ ID NO: 18410 - protein, 81 aa, Rhinopithecus roxellana
PQDTVAYEDLCVDYTQKKWKGPALSQRALQWNMMPGNDRIMASLGENMMKGSELTPKQEIFKGSESSNRMGLFGVVPRGAE

SEQ ID NO: 18411 - protein, 81 aa, Rhinopithecus roxellana
RAEEAVTFKDVAVVFTEEELGLLDPAQRKLYQDVMLENFRNLLSVGHQPFHGDTFHFLREEKFWVMETTSQREGNSGKSQT

SEQ ID NO: 18412 - protein, 81 aa, Rhinopithecus roxellana
EMGLLTFRDVAIEFSLEEWQHLDIAQQNLYRNVMLENYRNLAFLGIAVSKPDLITCLEQGKEPWNMIRHEMADESPGICPH

SEQ ID NO: 18413 - protein, 81 aa, Acinonyx jubatus
MLFEDLAVFFSQEECVCLHSVQRSLSRDTTQECFEEMALMGGKGKTEITQQLNLDSMGVEELAPENSSIAVPLVYYPEKSS

SEQ ID NO: 18414 - protein, 81 aa, Rhinopithecus roxellana
PQGLLTFRDVAIEFSQEEWKCLDAAQRTLYRDVMLENYRNLVSLDISSKCMLKTLSSTGEGNREVILTRTLQRQANHHTGD

SEQ ID NO: 18415 - protein, 81 aa, Rhinopithecus roxellana
KVPVTFVDIAVYFSEDEWKNLDEWQKELYNNLVKENYKTLMSLDAEGPVPKPDAPAHPEPREEPCVWEQRHPEEREISMDP

SEQ ID NO: 18416 - protein, 81 aa, Bison bison
MLENYSHLVSVGYCFTKPELIFMLEQGEDPWLLEKEFINRSSPEEFQPDELLEESLENQGKRLRQVLFINKSLTMEQEISG

SEQ ID NO: 18417 - protein, 81 aa, Bison bison
KLQEALTFKDVAVTFTEEELGLLDLAQRKLYRDVMLENFRNLLSVGHQSSKPDMISELEREEFWMTEIQPQRGGCSGGGNH

SEQ ID NO: 18418 - protein, 81 aa, Odocoileus virginianus
QGLFTFRDVAIEFSQEEWECLAPSQRALYRDVMLDTYRNLVSLDDLIGILSAGFAINKLSPRENTNVGELYGNENRGIKDF

SEQ ID NO: 18419 - protein, 81 aa, Odocoileus virginianus
QGGVTFPDVAVCFSQREWRLLDETQRRLYLDVMLENYTLISSLGCCCGAEGEETPCEKTVPVGVSWTGSPTAAPFSQKTHP

SEQ ID NO: 18420 - protein, 81 aa, Cebus imitator
VVFEDVAVDFTLEEWALLDSAQRNLYRDVMLETFRNLASVDDETPCKADRSVSQQDMYGGNISQEQTILNFTRNNSCAYAL

SEQ ID NO: 18421 - protein, 81 aa, Cebus imitator
SKAPITFGDLAIYFSQEEWEWLSPIQKDLYEDVMLENYRNLVSLGLSFRRPNVITLLEKGKAPWMVEPARRRRGPDSGSKV

SEQ ID NO: 18422 - protein, 81 aa, Cebus imitator
ALALVSFEDVIVTFTGEEWGHLDLAQRTLYQEVMLETCRLLISLGQPVPKPELIYLLEHGQELWTVKRGLSQSTCAASFSL

SEQ ID NO: 18423 - protein, 81 aa, Cebus imitator
RESGKAPVTFDDITVYLLQEEWVLLSQQQKELCGSDKLVPPLGPTVANPELFCKFRRGPQPWLGSVQDQRSLLEHHPGKKQ

SEQ ID NO: 18424 - protein, 81 aa, Cebus imitator
GLLTFRDVAIEFSMEEWEHLDSNQKNLYGDVMLENYRNLVCLGLAVSKPDLITFLEQRKEPWNVKSAETVAIQPDVFSHDT

SEQ ID NO: 18425 - protein, 81 aa, Macaca mulatta
GMEPLQFRDVAIEFSLEEWHCLDTAQQNLYRDVMLENYGNLVFLGIVVSKPDLITRLEQGENPLTVKRHEMTANPSVMCSH

SEQ ID NO: 18426 - protein, 81 aa, Macaca mulatta
ARDLVMFRDVAVDFSQEEWECLNSYQRNLYRDVILENYSNLVSLAGCSISKPDVITLLEQGKEPWMVMRDEKRRWTLDLES

SEQ ID NO: 18427 - protein, 81 aa, Macaca mulatta
KSLVTFEDVAVYFSQEEWELLDAAQRHLYHSVMLENLELVTSLGCWHGVEGEEAHPKQNISVEEVLPVRIPNADSSTKKAN

SEQ ID NO: 18428 - protein, 81 aa, Macaca mulatta
MGLLTFMDVAVEFSLEEWQCLDTAQQNLYRNVMLENYRNLVFLAMCSHFAKDLRPEQYIKNSFQQVILRRYGKCGYQNLQL

SEQ ID NO: 18429 - protein, 81 aa, Macaca mulatta
MGLLTFRDVAIEFSQEEWEHLDSDQKLLYGDVMLENYRNLVSLGLLVSKPDLITFLEQRKEPWNVKREETVAVQPDVFSHY

SEQ ID NO: 18430 - protein, 81 aa, Callithrix jacchus
MAATGPCSEAPVQGCDAGELQQLGLCGVPDVQRSWSKFCNFPLTGYHVSKPDVIFKLEQGEEPWIVEEFSNQNYPEVDDAL

SEQ ID NO: 18431 - protein, 81 aa, Macaca mulatta
RESGKAPVTVDDITVYLLQEEWVLLSQQQKELCGSDKLVAPLGPTVANPELFCKFGPGPEPWLGSVQGQRSHLEHHPGKKQ

SEQ ID NO: 18432 - protein, 81 aa, Macaca mulatta
MGPLTFTDVAVEFSLEEWQCLDTAQQNLYRNVMLENYRNLVFLVICSHFAEDFWPEQDIKDSFKKVTLRRYDKCGPENLQL

SEQ ID NO: 18433 - protein, 81 aa, Callithrix jacchus
RPRALKFVDVAVYFSSEEWGCLRPAQRALYRDVMRETYGHLGALGVEGSKPALISWVEEEAELWGPAAQDPEVAKRPTEAD

SEQ ID NO: 18434 - protein, 81 aa, Callithrix jacchus
PQGPLTFRDVAIEFSQEEWRCLDPTQKALYKDVMLENYRNLVFLDLTFKELTILTEREAQKRKKKEKESGMALTQGSLTFK

SEQ ID NO: 18435 - protein, 81 aa, Callithrix jacchus
EMGLLTFRDVAVEFSLEEWQCLNHAQQNLYRDVMFENYRNLVTLGIAVSKPELITCLEGNKESWNIKRNEMVAKHPVTYSY

SEQ ID NO: 18436 - protein, 81 aa, Callithrix jacchus
MSQVTFSDVAIDFSHEEWEWLDSAQRDLYKDVMVQNYENLASLAGLSITKPHVITLLEDGKEPWMVEEKLSKDWESRWTNK

SEQ ID NO: 18437 - protein, 81 aa, Sapajus apella
QGSVTFRDVAIDFSQEEWEFLDPAQRDLYRDVMWENYSNFISLAGPSISKTDVITLLDEEGKEPGMVVREGIRRYCPDLDS

SEQ ID NO: 18438 - protein, 81 aa, Ailuropoda melanoleuca
QESLTFDDVAVDFTWEEWQLLVPAQKELYRDVMLENYRNLVSVGSHTSKPDMLSRFDQGEPSWTVEDDIACRTRSEIWKLD

SEQ ID NO: 18439 - protein, 81 aa, Balaenoptera acutorostrata
FQDPVTFEDVAVVFTDEEWRRLVPTQRDLYKEVMLENYKSIVSLGLPVPGPDVIFQLKRGDEPWIVELHGSEGKECAENVS

SEQ ID NO: 18440 - protein, 81 aa, Balaenoptera acutorostrata
MLENFALIASLGLTSFRSHVVAQLEMGAEPWVPDQVDMTSAMARGAYRGPGSDFCHGTEGEESPAELSVSVEVSQDMNPKV

SEQ ID NO: 18441 - protein, 81 aa, Balaenoptera acutorostrata
QAEVTFEDVAVLLSREEWGRLGPVQKGLYRDVMLETYRNLVSLGAGPTGPKPEVITQLERGDEPWVLDVQGREGPTIDGSA

SEQ ID NO: 18442 - protein, 81 aa, Vulpes vulpes
FQEVVTFKDVAVVFTIEELGLLDSTQRKLYRDVMVENFKNLVSVGRLPFKPDMVSQLEAEEKLWMMERETQRNGYSSEDHV

SEQ ID NO: 18443 - protein, 81 aa, Rhinolophus ferrumequinum
QDQESVTLEDVAVDFTWEEWQLLAPEQKDLHRDVMLENYSNLVSVGYQVSKPDALSRLERGEPWAIEGEAYSQICSEIKKD

SEQ ID NO: 18444 - protein, 81 aa, Rhinolophus ferrumequinum
MSQELLTFRDVFVDFTLEEWQQLDSTQKSLYRDVMLENYSHLVSVGYLVAKPDVIFRLGHGEEAGRADGEPTMQSSPGQSP

SEQ ID NO: 18445 - protein, 81 aa, Acinonyx jubatus
PPVSLTFEDVAVLFTRDEWRKLGPSQRNLYQDVMLENYSNLVSLGLLFSKPKVISLLQQGEDPWKVEKESPGGPSLGYKSS

SEQ ID NO: 18446 - protein, 81 aa, Acinonyx jubatus
AAGSVTFKDVTMAFTQKEWEQLDPVQRNLYKDVMLENYSNLASMGYQAPKPDMISKLEKGEEPWLGKGKTPRQGGPSEIAR

SEQ ID NO: 18447 - protein, 81 aa, Acinonyx jubatus
YLLQGLLTFRDVAIEFSQEEWGCLSHSQQELYRDVMLENYGHLLFLGLVLSKPDLVIFLEQKELWDVKRNHTVASHPGRWE

SEQ ID NO: 18448 - protein, 81 aa, Rhinopithecus roxellana
PQGLLTFRDVAIEFSQEEWKCLDPAQRTLYRDVMLENYRNLVSLDISSKCMLKTLSSTGEGNREVILTRTLQRQANHHTGD

SEQ ID NO: 18449 - protein, 81 aa, Odocoileus virginianus
MFQVTFSDVAIDFSHEEWRWLSSTQRNLYKDVMVQNYENLVSLGLSVPKPYVIALLEDGKEPWMVEEKLSKDMVPDCKSRW

SEQ ID NO: 18450 - protein, 81 aa, Cebus imitator
SQGLVTFGDVAIDFSQEEWEWLSPIQRNLYRKVMLENYRNLASLGLCVSKPDVISLLEQGKEPWTVKRRMTRARCPDTQHL

SEQ ID NO: 18451 - protein, 81 aa, Cebus imitator
PKVPVSFEDVSVYFTKTEWKLLDLRQKVLYKRVMLENYSHLVSLGFSFSKPHLISQLERGEGPWVADIPRTWATKGLLIGD

SEQ ID NO: 18452 - protein, 81 aa, Cebus imitator
VTFEDVVVDFTQEEWGQLEPAQRTLYCDVMLDTFRLLVTVGKATPVFILPLPISPQTLFQTISSKQGISEEISNSVILVER

SEQ ID NO: 18453 - protein, 81 aa, Callithrix jacchus
LTFRDVAIEFSLEEWQCLDTAQRNLYKNVILENYRNLVFLVRTHGHRWKASHTGVCWQRLGEGQQEVWRFRRDNMGRNGRY

SEQ ID NO: 18454 - protein, 81 aa, Callithrix jacchus
FQEAVTFKDVAVAFTEEELGLLDSAQRKLYRDVMLENFRNLVSVGRQSFKPDMISQLEREEKLWMKEFQTQRGRHSGDRNQ

SEQ ID NO: 18455 - protein, 81 aa, Callithrix jacchus
RPRALKFVDVAVYFSSEEWGCLRPAQRALYRDVMRETYGHLGALESKTRKKNGEKEVFPPKEAPRKGKRGRRPSKPRLIPR

SEQ ID NO: 18456 - protein, 81 aa, Callithrix jacchus
TQESLTLEDVAVDFTREEWQLLGPAQKDLYRDVMLENYSNLVAVGYPASKPDALLKLERGEEPCCTTEDEIYTQICSEIRK

SEQ ID NO: 18457 - protein, 81 aa, Callithrix jacchus
KEAFVAFRDVAVDFTQEEWRLLSPAQRTLHREVMLETYNHLVSLEIPSSKPKLIVQLKRGEEPWREERKCSLDLRPAGSKP

SEQ ID NO: 18458 - protein, 81 aa, Macaca mulatta
EMGLLTYRDIAIEFSLAEWQCLDRAQRNLYRDVMLENYRNLVSLGIAVSKPDLIACLEQNKEPRNIKRNEMVSKHPVMCSH

SEQ ID NO: 18459 - protein, 81 aa, Callithrix jacchus
QDSVAFEDVAVNFTHEEWALLGPTQKNLYRDVMQETIRNLNCIGMKWENQNTDDWYQNLRRNLRCDVVERFGKSKDGSQCG

SEQ ID NO: 18460 - protein, 81 aa, Macaca mulatta
MLENYRNLGFLGLCLPDLNIISMLEQGKEPWTVVSQVKIARNPNWGECMKGVITGIYPKRVIKELPPIQNNNTGEKFQTVM

SEQ ID NO: 18461 - protein, 81 aa, Macaca mulatta
MGSLRFRDVAIEFSVEEWQCLDTAQRNLYRNVMLENYRNLVFLGIAVSKLDLIACLKQGKESWNMKRHEMVTKPPVTRSHF

SEQ ID NO: 18462 - protein, 81 aa, Callithrix jacchus
KTGPLTFRDVAIEFSLEEWQCLNPAQQDLYRKVMLENYRNLVFLGIAVSKADLITCLQEEKDPWNMKRHSMAATPPDGISP

SEQ ID NO: 18463 - protein, 81 aa, Callithrix jacchus
MELLTFRDVAIEFSSEEWKCLDPAQQNLYRDVMLENYRNLVSLGVALSNPDLVTCLEQRKEPYNVKIHQTVARSPAMCSPF

SEQ ID NO: 18464 - protein, 81 aa, Ursus maritimus
RLTFRDVAIEFSQEEWECLDPAQRELYRDVMLENYRNLVSLDVSPTHVIKKLQPKENSNTREVFQTAMLERHEGHEIKDFY

SEQ ID NO: 18465 - protein, 81 aa, Ursus maritimus
WSQDSVTFEEVAVDFSQEEWALLDAAQKILYRDVMLENYRNLASVGYPLCKHSLITEVKQEALGTEEGGILQGACTDWDIQ

SEQ ID NO: 18466 - protein, 81 aa, Rhinopithecus roxellana
FQGPLTFRDVTVEFSLEEWQCLDTVQQNLYRNVMLENYRNLVFLGIAVSKPDLITCLEQGKEPWNMNRYEMVAKPPVMCSH

SEQ ID NO: 18467 - protein, 81 aa, Rhinopithecus roxellana
SQTLVTFKDVFVDFTREEWKLLDTAQQSVYRNVMLENYKNLVSLGYQLTKPDVILRLEKGEEPWLVERGIHQEAHPDSETA

SEQ ID NO: 18468 - protein, 81 aa, Rhinopithecus roxellana
MESVTLEDVAVEFIQEWALLGSARRSLCRYGMLDQCRTLTSRGTPPCKPSRVSQLGPRAEPRATERGILHATGVAWESQLK

SEQ ID NO: 18469 - protein, 81 aa, Rhinopithecus roxellana
FQEAVTFKDVAVVFSREELRLLNLTQRKLYRDVMVENFKNLVAVGHLPFQPDMVSQLEAEEKLWMMETETQRSSQHQNKME

SEQ ID NO: 18470 - protein, 81 aa, Rhinopithecus roxellana
MFQEAVTFNDVAVAFTEEELGLLGPAQRKLYRDVMVENFRNLLSVGHQPFKQDVSPIERNEQLWMTTATQRQRNLDTLLVK

SEQ ID NO: 18471 - protein, 81 aa, Rhinopithecus roxellana
AQGSVTFEDVAVYFSWEEWDLLDEAQKRLYFDVMLENFALTSSLGLTSSWSHVVAQLGLGKVSSVLHRMFMTPASARWDQR

SEQ ID NO: 18472 - protein, 81 aa, Rhinopithecus roxellana
TQGHLTFRDVAIEFSQEEWKCLDPAQRALYKDVMLENYRNLVSLGISLPDLNINSMLEQRREPWSGEREVKIAKNSDGKGH

SEQ ID NO: 18473 - protein, 81 aa, Acinonyx jubatus
PAATSFHPPRIQEEWGLLDRSQKELYWDAMLEKYGTVVSLAGLPAPLPEARVESEPGVLRSGTEGQRSLHPGECFSMRSEP

SEQ ID NO: 18474 - protein, 81 aa, Bison bison
TQLTVEDVDIKFTPEEWECLDPAQRALYWDVMEETYRNLLSVDVSHIHMTKKLQAKGNSGKGKNFQTVMFGRAETHEIKDF

SEQ ID NO: 18475 - protein, 81 aa, Bison bison
MDPTQRDLHKDVMLENYRNLVSLGLAISKPDMISHLENGKGPWVVVREISRTPFSELETKPTTKNTIPTEDFSKKHLSQDA

SEQ ID NO: 18476 - protein, 81 aa, Bison bison
ESVTFKDVAVLFTQDEWAQLSPAQRALYRDVMLENYSNLVSLDWVITPTNKKSILKADIPEGELGQWMIKERFTRDSCWKY

SEQ ID NO: 18477 - protein, 81 aa, Bison bison
LLTFEEVAMYFSQEEWELLDPTQKALYNDVMQENYETVISLAVPAHQLLAFPKQTNTSEWTVAPELILPESQSLLTFEEVA

SEQ ID NO: 18478 - protein, 81 aa, Bison bison
ETLTFRDVFVDFTQEEWQQLDAAQKNLHRDVMLENYSHPVSVGYLVAQPHGIFRLGQGEEEAGMAAGESPLWSCPGKPMSG

SEQ ID NO: 18479 - protein, 81 aa, Cebus imitator
GSVTFEDVAVYFSWEEWDLLDETQKHLYFDVMLENFVLTSSMGYWRGLEHEEAPSSSRISVKGVPQFRTSEGSSSQNAYSC

SEQ ID NO: 18480 - protein, 81 aa, Cebus imitator
GSCRASVSFEDVTMDFSREEWQQLDPAQKRLYQDLYSHLFSVGYQIPNPDVIFRRLKEKEPCMEEAEFSHQRCQGLAQLGP

SEQ ID NO: 18481 - protein, 81 aa, Cebus imitator
PARGMTFEDVAIYFSQEEWELLDEAQRFLYCDVMLENFAHVTSLGYCHGTENEAIASEQSVSLQVRTSQGDTPTQKTHLSE

SEQ ID NO: 18482 - protein, 81 aa, Cebus imitator
DSVAFEDVAINFTCEEWALLGPSQKSLYRDVMQETIRNLDCIGMKWQNLNIEEDKYKNPGRNLRCFMVERSCEIKDNSQCG

SEQ ID NO: 18483 - protein, 81 aa, Cebus imitator
TSQESLTLEDVAVEFTLEEWQLLGPSQKDLYRDVMLENYSNLVSVGYQASKPDVLSMLEQGEPWTTENEIHSQICPEIKKV

SEQ ID NO: 18484 - protein, 81 aa, Macaca mulatta
GTATFQDMAVNFPQKKWSLLSEVRRCLYRDVMLENLALISSLGCWCGVEDEEGPSKQSIYIQRETQIRIPMAGVSLKKAHP

SEQ ID NO: 18485 - protein, 81 aa, Callithrix jacchus
PKVPVTFDDVAVHFSEQEWGNLSEWQKELYKNVMRGNYESLVSMDYAISKPDLMSQMERGERPTMQEQEDSEEGEAPTDPS

SEQ ID NO: 18486 - protein, 81 aa, Callithrix jacchus
MLVSFKDVAVTFTQEEWRQLDPAQRTLYQEVMLETCGLLVSLGDKAQVQTREPTTYPPVLSERAFLRGSLTLECSSDSRLG

SEQ ID NO: 18487 - protein, 81 aa, Monodon monoceros
MLENYRNLASLRHQLSKPPLITQMEQEDEMETVERRIHQDTCSDELILLKAKQPQQKQGILEKYTLNGKKEQTLGGNPIQC

SEQ ID NO: 18488 - protein, 81 aa, Macaca mulatta
QEEWALLDPAQKNLYKDVMLENFRNLASVGYQLCRHSLISKVDQEELKTDERGILQGDCADWETRLKSKDAIAVQNIPGGK

SEQ ID NO: 18489 - protein, 81 aa, Callithrix jacchus
IQGLLTFGDVAVAFTRIEWRHLDAAQRALYRDVMLENYGNLVSVGLLSSKPKLIAQLEQGAEPWMEVREAPSGTRAVPDYW

SEQ ID NO: 18490 - protein, 81 aa, Callithrix jacchus
EMEPLTFRDVAIEFSPEEWQCLDTAQQNFYRNVILENYRNLPFLDRQATSSSSSLTPQSGKSTKMGKKQHKKDETIKDQNT

SEQ ID NO: 18491 - protein, 81 aa, Callithrix jacchus
FQELVTFRDVAIDFSGQEWEYLDPHQRDLYRDVMLENYRNLVSLGHSISKPVLVDLLEQGKEPWMILREETQFPGKEDRGH

SEQ ID NO: 18492 - protein, 81 aa, Aotus trivirgatus
TSQESLTLEDVAVEFTWEEWQLLGPSQKDLYRDVMSENYSNLVSVGYQASKPDALSKLEQGEPWTIENEIHSRICPEIKKV

SEQ ID NO: 18493 - protein, 81 aa, Sapajus apella
AQESLTLEDVTVEFTWEEWQLLDPFQKDLYRDVMLEIYSNLVSVGFQVSKPDALSKLEQGEEPWIIEDERHSRICPENNKV

SEQ ID NO: 18494 - protein, 81 aa, Balaenoptera acutorostrata
SQVSVTFEDVAVLFTRDEWRKLAPSQRNLYQDVMLENYSNLVSLGLPFSKPKVISLLQQGEDPWKVEKESPGGSSLGWKNS

SEQ ID NO: 18495 - protein, 81 aa, Callorhinus ursinus
PQEPVTFEDVAVYFTQNQWASLDPMQRALYREVMLENYASVASLAFPFPKPDLVSQLERGEAPWSPDPWEAEVLKGTCPGG

SEQ ID NO: 18496 - protein, 81 aa, Callorhinus ursinus
KDQESLTLEDVAVDFTWEEWQLLAPTQKDLYRDVMLENYRNLVSVGYVARKPDALSRLEQGELWTTEHEIPSRICPEIKKD

SEQ ID NO: 18497 - protein, 81 aa, Callorhinus ursinus
MLENYRNLLSLGLCISKPDVIALLEQGKEPWMMKGEMTGGLCPDLEYIWMTKELSPNQGIYEEKLSQAMIMESLPSCDLKC

SEQ ID NO: 18498 - protein, 81 aa, Vulpes vulpes
LQEPVTFADVAVLFTPEEWMFLDSAQRNLYRDVMLENYRNLASVGDQLGKPSMFSHLEPGEELWPTERRIFPGTHPEPPIQ

SEQ ID NO: 18499 - protein, 81 aa, Callorhinus ursinus
GLVTFSDVAIDFSQEEWACLDSTQRDLYWDVMLENYSNLVSLDLESPYGTKSLPTEKGIYEINLSKWNSDGKSKSLGLDWM

SEQ ID NO: 18500 - protein, 81 aa, Callorhinus ursinus
IQEPVTFKDVAVDFTQEEWGRLDPVQRTLYRDVMLETYRHLLSVGNQIAKPEVISLLEQGEEPWSVEQAYPQSTCPAVDTE

SEQ ID NO: 18501 - protein, 81 aa, Callorhinus ursinus
SHTLVTFKDILVNFTREEWKLLDTAQQIMYKDVMLENYKNLISLGHQLPKPDVILQLEKGEEPWLVERGIHRETHPDLETA

SEQ ID NO: 18502 - protein, 81 aa, Rhinolophus ferrumequinum
GSVTFRDVAIDFSQEEWECLDPAQRALYMDVMLENYSNLVSLDLESTYETKNTCSGKNIFEIKFSQWEIKERNKTLGLEAS

SEQ ID NO: 18503 - protein, 81 aa, Ursus maritimus
CEVSVSFEDVTVDFSREEWQQLDPAQRRLYQDVTLENYSHLLSVGYQVPKPEVIFKLEQGEGPWTLEGETPHQSCSDEGIG

SEQ ID NO: 18504 - protein, 81 aa, Colobus angolensis
MGPLTFRDVKIEFSLEEWQCLDAAQRNLYRDVMLENYRNLVFLGIAVSKPDLITWLEQGKEPWNMKRREMVDKTPVMCSHF

SEQ ID NO: 18505 - protein, 81 aa, Phyllostomus discolor
SQGLVSFKDVAVDFTQEEWQQLDPAQRTLYRDVMLENYSHLVSMGHPVSKPDVIAKLEQGEDPWIIKRDISNWLFPDRKHR

SEQ ID NO: 18506 - protein, 81 aa, Acinonyx jubatus
MLENYSNLVSLGLLFSKPKVISLLQQGEDPWKVEKESPGGPSLGWKGSHKTTKSTQTQDSSFQELIMRRSKRNGPWDFKSE

SEQ ID NO: 18507 - protein, 81 aa, Rhinopithecus roxellana
EKETLTFRDVAIEFSLEEWECLNPAQQNLYMNVMLENYKNLVFLAGIAVSKQDPVTCLEQEKEPWNTKRHEMVDEPPAMCS

SEQ ID NO: 18508 - protein, 81 aa, Rhinopithecus roxellana
VTFKDVAVTFTQEEWRQLDLTQRTLYREVMLETCGLLVSLGDRTQVHTREPTTYPPVLSERAFLRGSLTLESSTSSDSRLG

SEQ ID NO: 18509 - protein, 81 aa, Bison bison
HLTFKDVAIEFSQEEWEYLHPAQRALYRDVMLETYRNLLSVAVCHIHVIKKLKPKANSDTGVFQRVMLGRYKSQEVRDFYF

SEQ ID NO: 18510 - protein, 81 aa, Bison bison
EVLKDPSEGSITFEDVAVYFSSEEWALLDEAQKLLYCDVMLENFALTASLEDKPVTGFLFALISFEDVAITFTGEEWRHLD

SEQ ID NO: 18511 - protein, 81 aa, Bison bison
HQEVVTFEDVAIYFTRTEWAGLSPAQRALYRSVMLEIYRSLTSLGYPVPKPALISLLERGDLPVGLETQDNPPAQGTRDIY

SEQ ID NO: 18512 - protein, 81 aa, Bison bison
SVTFEDVAVYFSWEEWRLLAEAQRSVYLDVMLENYALIASLGCCCGTEKAEAPSEQITSLGVSQARTSKAALSSQKIHPCE

SEQ ID NO: 18513 - protein, 81 aa, Odocoileus virginianus
TSEPVSFADVAVYFSPEEWACLRPAQRALYRDVMRETYGHLGALGFRGTKPALISWVEEEAELWGPDAGPPEMGECLTEAD

SEQ ID NO: 18514 - protein, 81 aa, Odocoileus virginianus
MDPTQRDLHKDVMLENYRNLVSLGLAISKPDMISHLEDGKGPWVVVREISRTPFSELETKPTTKNTIPMEDFSKRQLSQEA

SEQ ID NO: 18515 - protein, 81 aa, Cebus imitator
GTVTFEDVAVHFSWEEWGLLDEAQRCLYRDVMLENLALLTSLDVHYQKQHLREKHFRSNVDRALFVKTCIFHVSGETSTCK

SEQ ID NO: 18516 - protein, 81 aa, Cebus imitator
MGLLTFRDVAIEFSVEEWEHLEPAQKNLYWDVMLENYRNLVSLGLAVSKPDLITFLEQRKEPWNAKSAETVAIQPDMFSHY

SEQ ID NO: 18517 - protein, 81 aa, Cebus imitator
EPGAVSFGDVAVYFSREEWGCLRPAQRALYRDVMRETYSHLGALGVGGSKPALISWMEEEAELWVPAAQDPEVAKCPTEAD

SEQ ID NO: 18518 - protein, 81 aa, Cebus imitator
SQTLVTFKDIFVDFTREEWKLLDTAQQIVYRNVMLENYKNLVSLGYQITKPDVILRLEKGEEPWVVERGILQETHPDSETA

SEQ ID NO: 18519 - protein, 81 aa, Cebus imitator
ESVAFEDVAVYFTQNQWGSLDPAQRALYREVMLENYANVASLVAFPFPKPALISHLEKGEAPWGPDPWDAEIPSGISQGGE

SEQ ID NO: 18520 - protein, 81 aa, Callithrix jacchus
ETLTFRDVAIEFSLEEWQCLDTAQQSLYRNVMLENYRNLVFLGIAVSKQNPVTCLEQGKEPQNMIRYEIMAKPTVLCSHFG

SEQ ID NO: 18521 - protein, 81 aa, Callithrix jacchus
ISFEDVAVDFTLEEWQLLNPTQKNLYREVMLENYSNLVFLEVWLDNPKMWLQDNQDNLKSMERGNKYGVFGNIFKSSINFV

SEQ ID NO: 18522 - protein, 81 aa, Macaca mulatta
QEQVSFEDVCVDFTQEEWYLLDPAQKILYRDVILENYSNLVSVGYCITKPEVVFKIEQGEEPWILEKGFPSQCHPERKWKV

SEQ ID NO: 18523 - protein, 81 aa, Callithrix jacchus
QCLDTAQRNLYKNVILENYRNLVFLGIAVSKPDLIACLEQEKEPLIMKRDEMAGEPPVMCSHFAQEFWPEQNIQDSSQNMT

SEQ ID NO: 18524 - protein, 81 aa, Callithrix jacchus
SYEGSVSFRDVAIDFSREEWRHLDPSQRNLYRDVMLETYSHLLSVGYQVPEAEVVMLEQGNEPWALQGERPHQSCPGEKLW

SEQ ID NO: 18525 - protein, 81 aa, Pan troglodytes
SVAFEDVAVNFTQEEWALLSPSQKNLYRDVTLETFRNLTSVGIQWKDQDIENLYQNLGIKLRSLVERLCGRKEGNEHRETF

SEQ ID NO: 18526 - protein, 81 aa, Pan troglodytes
WSQMPVTFEDVALYLSREEWGRLDHTQQNFYRDVLQKKNRLSLGFPFSRPFWAPQAHGKGEASGSSRQAGDEEEWRGACTG

SEQ ID NO: 18527 - protein, 81 aa, Bos taurus
DSLLPQEIIIKVEGEDARSLAVPSQEGVNFKIVTVDFTQEEEGTLSSAQRTLDRDVILENHGDSWDLVHKSFWPLPLNHEF

SEQ ID NO: 18528 - protein, 81 aa, Vulpes vulpes
MNSSQEEWYLLDPAQKILYRDVILENYSHFVSVGYCITKPEVVFKIEQGEEPWILEAGFPSHCHQEDWKVADLIESSQNNE

SEQ ID NO: 18529 - protein, 81 aa, Rhinopithecus roxellana
MLENYRNLLSLGIAVSKPDLITCLEQRNEPWNVKKHETIGRHPAVSSHFTQDLLPEHSIKDSFQKVILGRYGSCGTENLHL

SEQ ID NO: 18530 - protein, 81 aa, Acinonyx jubatus
AQDSVSFEDVAVYFSWEEWRLLDEAQRCLYHNVMLENFALISSLGCCCGAEDAEAPLEQSVSVGVSQASTPKAALSSRKTH

SEQ ID NO: 18531 - protein, 81 aa, Rhinopithecus roxellana
TEGLVMFEDVAVYFSREEWGLLNVTQKGLYQDVMLENFALVSSLGLAPSRSPVFSQLENDEQSWVPSWVDVTPVSRAEARR

SEQ ID NO: 18532 - protein, 81 aa, Rhinopithecus roxellana
GLLTFRDVAIEFSQEEWKCLDPAQRTLYRDVMVENYRNLVSLDISSKCKMKEFLSTAQSNREVLHTWTLQRHESHQIGDYC

SEQ ID NO: 18533 - protein, 81 aa, Bison bison
VTFRDVAVFFSRDEWLCLDSAQRTLYQEVMLENYSTLFSLGWESLFETRISEEENQEVMNQLLGDGPFDFRLGKIYINEET

SEQ ID NO: 18534 - protein, 81 aa, Odocoileus virginianus
AQGCVTFEDVTIYFSQEEWGLLDKAQRLLYCDVMLENFALIASLGLTSFRSHIVAQLEMGAEPWVPDQVDMTSSMARGVYR

SEQ ID NO: 18535 - protein, 81 aa, Odocoileus virginianus
MLENYSNLVLLGYQVIKPEMIFKLEQEKPWLLDEEILSQNFSEKVWLDNDLKMWHQDNQDKLKSLERGHEYDIFERMFHLG

SEQ ID NO: 18536 - protein, 81 aa, Odocoileus virginianus
RLTFKDVAIEFTPEEWECLDPAQRALYREVMVETLRNLLSVDTSPRRVMKGSAPKQSSHTGGILQTALSERHKSHDTKDHG

SEQ ID NO: 18537 - protein, 81 aa, Odocoileus virginianus
TARSQASVTFKDVAMDFTPEEWGRLDPAQRDVMLENYRNLVSLWLPVSKPENHSLENGKEQLLLERKAPKSSCSDSETSPR

SEQ ID NO: 18538 - protein, 81 aa, Cebus imitator
IMEEAVTFKDVAVFFTEEELGLLDLAQRKLYRDVMLENFRNLLSVGHQPFQDVFHFLRGEKFWMMETATQREGNSGGKIQT

SEQ ID NO: 18539 - protein, 81 aa, Cebus imitator
KKKPVTFEDVAVNFTQEEWDFLDASQRVLYQDVMSETFKNLASVARMFLHKPELITKLEQQEKQWRVFLHLPNTEGLSEGK

SEQ ID NO: 18540 - protein, 81 aa, Cebus imitator
DSMTFEDIVVDFTREEWALLDTSQRKLFRDVMLENISHLVSIGKEGDIKHQEIPFIQHIDQKDTSTISTMRSHTQDDPFLC

SEQ ID NO: 18541 - protein, 80 aa, Cebus imitator
LCGPFGLKMGVLTFRDVATEFCLEEWQCLDTAENVMLENYRNLVFLGIAASKPDLITYLEQGKEPWNVKRCEMVVEPPAF

SEQ ID NO: 18542 - protein, 81 aa, Callithrix jacchus
TMGVLTFRDVAIEFSRKEWQCLDTAQRNLYRNVMLENYRKLVFLGIAASMPDLITCLDQTPSCIFLFCPRSLAKAGFLHIK

SEQ ID NO: 18543 - protein, 81 aa, Macaca mulatta
DSVTFDDVAVDFTQEEWTLLDPTQRSLYSDVMLENYKNLATVGWEMQLETQWSTLQQDSLTGQTSIGMQLEGKHNGGELCD

SEQ ID NO: 18544 - protein, 81 aa, Macaca mulatta
PGIVSFADVAVYFCREEWGCLRPAQRALYRDVMRETYGHLSALADSRNKEEERQREGMEALEKPVPVATGSPGLKAPQAPL

SEQ ID NO: 18545 - protein, 81 aa, Callithrix jacchus
FQESVAFEDVAVYFTQNQWASLDPAQRALYREVMLENYANVTSLVAFPFPKPALISHLEKGEAPWGPDPWDAEIPRGISQG

SEQ ID NO: 18546 - protein, 81 aa, Zalophus californianus
SVAFQDLAVRFSEEEWQLLGEGQRALYRDVMRENYETLRSLGTDELLPLSAFLSPTEPGGATEGRSYAGEGQEPPRGGGPL

SEQ ID NO: 18547 - protein, 81 aa, Zalophus californianus
MLETYRNLVSLGAGPAGPKPGVITQLERGDEPWVLDAQGAKGKERLRVSISGHGTRTEYKELSSGEMLDEEELDQLQRAVP

SEQ ID NO: 18548 - protein, 81 aa, Delphinapterus leucas
QAEVTFEDVAVLLSREEWGRLGPVQKGLYRDVMLETYRNLVSLGAGPAGPKPEVITQLERGDEPWVPDVQGRERPNIDGSA

SEQ ID NO: 18549 - protein, 81 aa, Zalophus californianus
FQELVTFRDVAIDFSRQEWEYLDPIQRDLYRDVMLENYRNLVSLGHSISKPDVVDLLEQGKEPWMILREETQGEYTDLDLH

SEQ ID NO: 18550 - protein, 81 aa, Pan troglodytes
SLGSVTFTDVAIDFSQDEWEWLNLAQRSLYKKVMLENYRNLVSVGLCISKPVVISLLEQEKDPWVIKGGMNRGLCPDLECV

SEQ ID NO: 18551 - protein, 81 aa, Pan troglodytes
PQGLLTFRDVAIEFSQEEWKCLDPAQRTLYRDVMLENYRNLVFLDTSSKCMMKMFSSTGQGNTEVVHTGTLQIHASHHIGD

SEQ ID NO: 18552 - protein, 81 aa, Sapajus apella
MAFEDVAVYFSQEEWGLLDTAQRALYRRVMLDNFALVASLGLSTSRPRVVIQLERGEEPWVPSGTDMTMSRNTHRRRNSGF

SEQ ID NO: 18553 - protein, 81 aa, Pan troglodytes
QFHGVTFEDVAVDFTQEEWQQLNPTQKTLHRDVMVETYNHLVSMGCSGIKPDVIFKLEHGKDPWIIESELSRWIYPDRVKG

SEQ ID NO: 18554 - protein, 81 aa, Muntiacus muntjak
TLKEAVTFTDVAVTFTEEELGLLDLAQKKLYQDVMLENFRNLVSVGCHPFRHDIFHLEKEKRLWVVKTATQSEGKSEEKIQ

SEQ ID NO: 18555 - protein, 81 aa, Ovis aries
PQESVTLKDIAVDFTKEEWALLDASQRKLFREVMQESISHLVSVGYELCKSDVISQLEQGAELWKEEKGFPQCPSSDRKSD

SEQ ID NO: 18556 - protein, 81 aa, Ovis aries
LQDLVTFEDVTVEFTQEEWALLDSSQRKLYRDVMLENCRNLAWLGYHVDKRSLISQLEQEDKVITEEGGILPGTCPDLETV

SEQ ID NO: 18557 - protein, 81 aa, Ovis aries
AQLTFKDVAIEFTQEEWECLDPAQRALYRDVMVETLRNLVSLDISHILVIKKLQLNEKTDRGEEFQTVILGRHERNKIKNF

SEQ ID NO: 18558 - protein, 81 aa, Callorhinus ursinus
LQDTFSFEDLSVDFTQKEWQLLDPSQKDLYKDVMLENYSSLVSLGYEVMKPDVIFKLEQGEEPWIGDGEVPSSDRPEQVLQ

SEQ ID NO: 18559 - protein, 81 aa, Rhinolophus ferrumequinum
GWGTFEDVAVFFSQEEWELLDEAQRCLYHNVMLENLALVASLGCWCGAEETRPEQGVSIQGMLQFRTPEAGLSTQKVNPCD

SEQ ID NO: 18560 - protein, 81 aa, Acinonyx jubatus
QVSVTFDDVAVTFTQEEWGQLDPAQKTLYQEVMLENCGLLVSLGPGSSAGTREAVRVVLLGGWQFCPQEPFGNVCGHSGLS

SEQ ID NO: 18561 - protein, 81 aa, Rhinopithecus roxellana
EMGPLTFRDVAIEFSLEEWQCLDTSQQNLYRNVMLDNYRNLVFLGIAVSKPDLIICLEQGKEPCNMKRHAMVVKPPVVCSH

SEQ ID NO: 18562 - protein, 81 aa, Rhinopithecus roxellana
QRGSLSFEDVAVDFTREEWQSLDWSQKVLYKEVMLENYSNLVSVGYQGTKPDSLFKLEQGEPPWIVEGAAHSQTCPGFVIQ

SEQ ID NO: 18563 - protein, 81 aa, Bison bison
SLEEIATLKDIAMDFTSENWEQLGQGQGDLFWDTALDNYWNLFLLNPPGPNLTFHPDGGEKLEALVKESPESTDTGIAETS

SEQ ID NO: 18564 - protein, 81 aa, Bison bison
CVTFEDVTIYFSPEEWGLLDEAQRLLYCDVMLENFALIASLDFYCGTESEESPAELSVSVEVSQNMNSKAVPSTQKGYPCN

SEQ ID NO: 18565 - protein, 81 aa, Odocoileus virginianus
LQELVTFKDVAVDFTEEEWEHLDPSQRHLYREVMLENFGNLISLAGHLLSEPEMIFHFEQEDDVWMEETISRSSYSGVRDE

SEQ ID NO: 18566 - protein, 81 aa, Odocoileus virginianus
PKVPVTFDDVAVYFSELEWGKLDEWQKELYKHVMRGNYEMLVSLDYAISKPDILTRMEKGEEPCPEGPWGGEEGNEREEAC

SEQ ID NO: 18567 - protein, 81 aa, Odocoileus virginianus
MSQESLTFQDVAVDFTREEWDQLYPAQKNLYRDVMLENYRNLVALGHQLCKPEVITQLEQEERWMMGRVSPPDTHPDGENR

SEQ ID NO: 18568 - protein, 81 aa, Cebus imitator
EDALMGFWDVAVAFTQKEWKLLSSAQRTLYREVMLEESKHLLDLLGIAFSKPKLITQLEQGDEPWREENKHLLDLCPEPRT

SEQ ID NO: 18569 - protein, 81 aa, Cebus imitator
IQGLLTFGDVAVAFTRIEWRHLDAAQRALYRDVMLENYGNLVSVGLLSSKPKLIAQLEQGAEPWMEMREAPSGTRAVPDYW

SEQ ID NO: 18570 - protein, 81 aa, Cebus imitator
PQGHLTFTDVAIEFSQEEWKCLDPAQRALYKDVMLENYRNLVSLGISLPDLNINSMLEQRRELWSGESEVKIAKSSDRREC

SEQ ID NO: 18571 - protein, 81 aa, Cebus imitator
SLEMGVLTFMDVAIESSLEEWQCLDAAQQNLYMDVMLENYRNLVFLGIAASKPDLITCLEQGKEPWNVTRHETVAELPGLQ

SEQ ID NO: 18572 - protein, 81 aa, Cebus imitator
QVPVTFVDIAVYFSEDEWKNLDEWQKELYNNLVKENYKTLMSLDADGPVPKPDAPAQAEPREEPCVWEQRHPEEREIPMDP

SEQ ID NO: 18573 - protein, 81 aa, Cebus imitator
QYLIAFEDVAVNFTQEEWALLGPSQKSLYRDVMWETIRNLDYIGFTQEEWALLDTNTEDQHKNPRRSLRCHIVERFRESSQ

SEQ ID NO: 18574 - protein, 81 aa, Cebus imitator
PRGSTSFSSVTAAFAQEGWRCLVSTPRDRFKEGIPEKSRNLVLLGLPVSQPGMNSQLELREGAWILEGKDLRNPSPNWKIV

SEQ ID NO: 18575 - protein, 81 aa, Macaca mulatta
MLFIFNKTGIAVSNLDLITCLEQGKEPWNMKRHEMVAKPPAMCSHFAKDLRPEQYIKNSFQQVILRRYGKCGYQNLQLRKG

SEQ ID NO: 18576 - protein, 81 aa, Macaca mulatta
MLETYGLLVSLGCPLFEPELIYQLDRREELWIVKKDLSQSSYPGDNTKPKTTEPSFFHLALPEEVLLRERLTQGVSKDSQL

SEQ ID NO: 18577 - protein, 81 aa, Callithrix jacchus
PQVSLTFEDVAVLFTRDEWRKLAPSQRNLYRDVMLENYRNLVSLGLPFTKPKVISLLQQGEDPWKVEKGSSGSPCLGLKSS

SEQ ID NO: 18578 - protein, 81 aa, Callithrix jacchus
ETLTFRDVAIEFSLEEWQCLNPAQQDLYRNVMLENYRNLVFLGITVCKENPITCLVQGKEPCNVKRHEMVARPNAMCSYFP

SEQ ID NO: 18579 - protein, 81 aa, Delphinapterus leucas
AQESLTYDDVTMKFTWEEWQLLDPDQKDLYRDVMLENYSNLLSVGYQASKPDAVSRLERGEQLWPVEDDSHGRICPEIRKV

SEQ ID NO: 18580 - protein, 81 aa, Delphinapterus leucas
TARSQASVTFKDVAMDFTPEEWGRLDPAQRDVMLENYRNLVSLWLPVSKPENHNLENGKEPLMLERKAPKSSCSDSETRPG

SEQ ID NO: 18581 - protein, 81 aa, Ailuropoda melanoleuca
MAVTFEDVTVIFTWEEWKFLDSSQKKLYREVMWENYTNVMSVGNWKESYKPQEERFRYLEHENCLSWQGWRNASAQIYENR

SEQ ID NO: 18582 - protein, 81 aa, Vulpes vulpes
SQGLVSFKDVAVDFTQEEWQQLDPAQRTLYKDVMLENFSHLVSMGYPVSKPDVISKLEQGEDPWIIKRDIPNWIYPDENQA

SEQ ID NO: 18583 - protein, 81 aa, Callorhinus ursinus
FQDSVTFEDVAVRFSSGEWQCLTRAQRHLYADVMLENYWNVISVGFAVPKPPLISHLEQGAEPCVQDLQDGGFLSCSFPVS

SEQ ID NO: 18584 - protein, 81 aa, Callorhinus ursinus
RPIAVSFADVAVYFSPEEWGCLRPAQRALYRDVMRETYGHLGALESKKKNEPSSKIGAEELEEAPVRNAPAVQARLVPSFR

SEQ ID NO: 18585 - protein, 81 aa, Rhinopithecus bieti
VQESVTFRDVAVFFSQDEWLHLDSAQRALYREVMLENYSSLVSLGILFSKPKVISQLEQGEDPWMVESGVPQGTHLGWESL

SEQ ID NO: 18586 - protein, 81 aa, Cebus imitator
QTEVTFEDVAVLLSREEWGRLGPAQRDLYRDVMLETYGNLVSLGVGPAGPKPGVISQLERGDEPWVLDVQGTSGREYLRVN

SEQ ID NO: 18587 - protein, 81 aa, Cebus imitator
MGPLTFRDVAIEFSLEEWQCLDTAQRNLYRNVMLENYRNLVFLGIAVCKPDLIICLEQEKEVWSRKSQEIMVAKPPVMRSH

SEQ ID NO: 18588 - protein, 81 aa, Cebus imitator
CEVSVSFEDVTVDFSREEWQQLDSTQRRLYQDVMLENYSHLLSVGFEVPKPEVIFKLEQGEGPWTWEGETPHHSCSDGKFG

SEQ ID NO: 18589 - protein, 81 aa, Cebus imitator
MRPLTFMDVAIEFSPEEWQCLDTTQQNLYRNVMLENYRNMVFLGIAVSKPDLITCLEQGKEPWNMKRQEMVAKLPGMCSYF

SEQ ID NO: 18590 - protein, 81 aa, Macaca mulatta
GSVSFSDVALGFTQEEWQHLDPAQRTPYRDVMLENYNLLLCTGYCITKPVVICKLEHGEVLWILEEESPSQSHLDCCIDDN

SEQ ID NO: 18591 - protein, 81 aa, Macaca mulatta
MLENYSNLVSVGYCVHKPEVISRLEQGEEPWRLEEEFPSQSFPEVWTADHLKERSQENQSKHLWEVVFINNEMLTKEQGDV

SEQ ID NO: 18592 - protein, 81 aa, Callithrix jacchus
MDVAIEFSLEEWQFLDTTQQNLYRNVMLENYRNLVFLGIAIPKPDLIACLEQGKELWNMRRHETVAKPPGKRVNTMDNIDE

SEQ ID NO: 18593 - protein, 81 aa, Macaca mulatta
LQESVTFKDVAVLFTQEEWGQLSPAQRALYRDVMLENYSNLVSLGILFSKPKVISQLEQGEDPWMVESGVPQGAHLGWESL

SEQ ID NO: 18594 - protein, 81 aa, Callithrix jacchus
MGPLTFRDVAIEFSLEEWQCLDTAQRNLYRKVMFENYRNLVFLVMCSHVAEDLWPEHRIKDSFQKMILRGYGKCGHENLQL

SEQ ID NO: 18595 - protein, 81 aa, Callithrix jacchus
WSQMPVTFEDVALYLSREEWGRLDHTQQSFYREVLQKRNGLSLGFPFSRPFWAPQVPGKGEASGSSRQTGDEKEDWRGACT

SEQ ID NO: 18596 - protein, 81 aa, Callithrix jacchus
GRLTFKDVSVEFSSAEWKCLTPAQRALYRDVMLENYRNLESVGEENVPPDTRNPSLFIWALPGGEGCSEPRSCHCSKHQIN

SEQ ID NO: 18597 - protein, 81 aa, Macaca mulatta
MDVFVDFTWEEWQLLDPAQKCLYRNVMLENYSNLVSLGYQHTKPDIIFKLEQGEELCVVQAQIPNQSCPNTVWKIDDLMEW

SEQ ID NO: 18598 - protein, 81 aa, Callithrix jacchus
GPLTFMDVAIEFSLEEWQCLDTAQQNLYRNVMLENYRNLVFLAFSWSSNLTKHKIIHTGEKPYKCEECGKAFKQSSTLIIH

SEQ ID NO: 18599 - protein, 81 aa, Macaca mulatta
RQAFLAFGDVTVDFTQKEWRLLNPAQRALYREVTLENYSHLVSLGILHSKPELIRRLEQGEAPWGEERRCRPGPRAGIYAE

SEQ ID NO: 18600 - protein, 81 aa, Callithrix jacchus
VEGVLTFRDVAIEFSQKEWQCLDTAQRNLYRNVMLENYGNLVYLGIATSKPDLITCLEQGQEPWNVKRHEFEAKLPGSLSC

SEQ ID NO: 18601 - protein, 81 aa, Cebus imitator
SQGHVTFEDIAVYFSQEEWGLLDEAQRCLYHDVMLENFSLMTSVAGLSQNNHKDSCLQWKVPVSMNNVAQCSPDEVHYTPM

SEQ ID NO: 18602 - protein, 81 aa, Cebus imitator
ARDLVMFRDVAVDFSQEEWECLNSYQRNLYRDVILENYSNLVSLGCSISKPDVITLLEQGKEPWLVVRDEKRRWSLGPTFK

SEQ ID NO: 18603 - protein, 81 aa, Cebus imitator
MDSVTFDDVAVDFTQEEWTLLDPTQRSLYSDVMLENYKNLATVGGQIIKPSLISWLEQEESRTVQGGVLQGWELQLETQWS

SEQ ID NO: 18604 - protein, 81 aa, Macaca mulatta
DSISLEDVAVNFTLEEWALLDPGQRNIYRDVMRATFKNLACIGEKWKDQDVEDDPKNQGRKPSSPMVETLCENKEDRPCGK

SEQ ID NO: 18605 - protein, 81 aa, Callithrix jacchus
ETRSLTFRDVVIEFSLKEWQCLYTTQWNLYRNVMLGNYRKMVSLGIAVSKSDLITCLEKNKKPWNMKRHEMVAKPPRPLAR

SEQ ID NO: 18606 - protein, 81 aa, Callithrix jacchus
RSQESLTFQDVAVDFTREEWDRLYPAQKDLYRDVMLENYRNLVALGHQLYKPEVIAQLELEEEWVIERGSLLDPCPDGENR

SEQ ID NO: 18607 - protein, 81 aa, Macaca mulatta
PQGLVTFGDVAVDFSQEEWEWLNPNQRTLYRKVMLENYKNLASLGLCVSKPDVISSLEQGKEPWTVKRKMTRAWCPDLKIV

SEQ ID NO: 18608 - protein, 81 aa, Macaca mulatta
IVSLQASVSFEDVTVDFSREEWQHLDPAQRRLYWDVTLENYSHLLSVGEAIEKMQQQGIPGEIFFHCERFDQPIGEDSLCS

SEQ ID NO: 18609 - protein, 81 aa, Callithrix jacchus
FQGRLTFKDVSVEFSSAEWKCLTPAQRALYRDVMLENYRNLESVGEENVPPDTRNPLHTGEKPYKCNECGKTFSQMSSLTY

SEQ ID NO: 18610 - protein, 81 aa, Macaca mulatta
MLENYKNLIILAGSEFCKPSLMSELEQMEELRTGVTGVLQELDLQLKTKGSPLLQDISAERSSNGIQLERSNTAEKLYDSN

SEQ ID NO: 18611 - protein, 81 aa, Bos taurus
SQGRLTFQDIAIDFTQEEWECLDLGQRELYKDVMLENYGNLASLGLVISKPDLVTFLEQMKDPWDTRRMETPAVHPAVSSH

SEQ ID NO: 18612 - protein, 81 aa, Bos taurus
TKDQIKLRRDVAIDFTQEEWECLDLSQRELYRDVMLENYGNLASLGLVSNLDLVTFLEPLKDPRNIRRMGTTEPESSNKDS

SEQ ID NO: 18613 - protein, 81 aa, Bos taurus
SQGRLTFQDVAIDFTQEEWECLDLGQRELYRDVMLENYGNLASLGLVISKPDLVTFLEQMKDPWDTRRMETPAVHPAVSSH

SEQ ID NO: 18614 - protein, 81 aa, Bos taurus
MGIMVSVSFEDMTVDFRREEWQHLDSAQSHLLSLGYEVPKPEVIFKLEQGEEPWALKEKTLHHSCSDGKFGIKTLQKRISG

SEQ ID NO: 18615 - protein, 81 aa, Bos taurus
MYFSWEEWCLLDEAQIQLYLDVMLENFALVCMLGSWRGVQDKETPSEEIKPAGVLQFRTPRAGLSPEKTQPCAMCIPVLRD

SEQ ID NO: 18616 - protein, 81 aa, Ovis aries
QGGVTFPDVAVHFSQREWRLLDETQRRLYLDVMLENYTLVSSLGCCCGAEGEETPCEKTVPVGVSWTGSPTAAPFSQKTHP

SEQ ID NO: 18617 - protein, 81 aa, Ovis aries
VTESVTFRDIAVLFSRDEWLHLDAAQRTLYREVMLENYSTLVSLGIPFSMPKLICQLQQGEDPCMVEREIPQDACLGFKTW

SEQ ID NO: 18618 - protein, 81 aa, Ovis aries
AQELVTFEDVAVYFIRKEWKRLEPAQRDLYRDVMLENYGNVFSLDGETRTEPDSEISEDRGSHGVLLGRFQKDISQGLKFE

SEQ ID NO: 18619 - protein, 81 aa, Ovis aries
SQQSLTFRDVAIDFSQEEWGFLDPAQRELYTAVMLETYQNLVWLGISVAEPNIAFLLEQGPQPWVIREEDAGAPGAGESGT

SEQ ID NO: 18620 - protein, 81 aa, Ovis aries
MLENYRNLASLGLMVSKPDLVTFLEQMKNPWDVRRLETPAVYTGWKPFKYTKCGNTSSQNSELSQDQQIHTGKKPYECKEC

SEQ ID NO: 18621 - protein, 81 aa, Ovis aries
SLDAVTFMDVAVDFSQDEWEWLTLAQRTLYKKVMLENYSNLASLGLCISKPDVISFLEQDKEPWMMKGELTRGLCPGLEYV

SEQ ID NO: 18622 - protein, 81 aa, Ovis aries
WKGLLSFEDVALYFTREEWDTLDWAQKALYRDVMLDNYRHVVSLDSEARFQTKELTPKENTSEDLMLWKMSAVKQKTAKEP

SEQ ID NO: 18623 - protein, 81 aa, Ovis aries
VTFEDVFIRFTREEWDLLTESQKRLYHKTMVDNFALVMSVGLESSRYRLISPPEPESAPEVPARIGIAAAVEEVSQESPAP

SEQ ID NO: 18624 - protein, 81 aa, Ovis aries
QMGWLTFRDVAIDFTQEEWECLDLGQRELYRDVMVENYRNLACLGLVVSKPDLVTFLEQMKDLRNIRRMETVGVYPAMSPQ

SEQ ID NO: 18625 - protein, 81 aa, Ovis aries
MAVRCLPTMVQDEWAQLSPAQRALYRDVMLENYSNVVSLGLLGPKPDMFSQLGKGEEWMPEDSLGGFCLDWVITPMNKKSI

SEQ ID NO: 18626 - protein, 81 aa, Ovis aries
WQGNVTFEDVFVSFSQEEWGLLDEAQRLLYHEVMLENYALMASLGCWHGMEEEEIRFEQSISVKRVSKGMIPKMIPSSQKA

SEQ ID NO: 18627 - protein, 81 aa, Otolemur garnettii
GAEVTFEDVVVLLSQEEWGHLGPAQRGLYRDVMLETYGNLVSLGVGPAGPKPGVISQLERGDVPWVLDVQSVSGTPLGTCP

SEQ ID NO: 18628 - protein, 81 aa, Vulpes vulpes
LQGPVSFRDVAVDFTQEEWQQLEPDEKTTYRDVMLENYSHLVSVGYDSTKPKVILKLEQGEEPWVAEGELPCQSHLEVWKV

SEQ ID NO: 18629 - protein, 81 aa, Otolemur garnettii
QNLVTFGDVAVNFSQEEWEWLNPAQRNLYRKVMLENYKSLVSLAGVSVSKPDVISLLEQGKEPWMVKKEGARGISPGLGIH

SEQ ID NO: 18630 - protein, 81 aa, Otolemur garnettii
LQESFSFEDLSVDFTQKEWQLLDPYQKNLYKDVMLENYSSLVSLGYKVMKPDVIFKLEQGEEPWIGDREIPHSCSLEEAWQ

SEQ ID NO: 18631 - protein, 81 aa, Otolemur garnettii
FQESVKFRDVGVVFSPDEWHHLNPEQRNLYKDVMLDNCDYLVSLGNWTYKAKVMSSLKEGKEPWEMEKEVTSVPCPGTCNK

SEQ ID NO: 18632 - protein, 81 aa, Otolemur garnettii
LQGSVSFKDVTVDFSREEWQQLDLAQKSLYRDVMLENYFNLISVGYQVPKPEVIFSLEQGEEPCEVDDRPPCQSYSGPGWI

SEQ ID NO: 18633 - protein, 81 aa, Otolemur garnettii
MDSVTFEDMAVNFTLDKWACWILPNKRKSVYRNVMQETFRNLATIERLFERKEGSPFGETFRTHPNKKTSPGVNPCESSVC

SEQ ID NO: 18634 - protein, 81 aa, Otolemur garnettii
FQGPLSFEDVIVGFTQEEWQHLDPAQRTLYKDVMLENYSHLVSVGCCIPKPEVIFKLEQGEQPWILQEEPTNQSYPEYFKY

SEQ ID NO: 18635 - protein, 81 aa, Otolemur garnettii
CENSVSFEDVAVDFSREEWQQLDPAQRHLYQDVMLEIYNHLFSVGCHIPSPEVIFRIVKGQELWMERAELPPQKDHEGKFV

SEQ ID NO: 18636 - protein, 81 aa, Vulpes vulpes
SKDLVTFGDVAVDFSQEEWEWLNPGQRNLYRKVMLENYRSLVSLGVSVSKPDVISLLEQGKEPWMVKKEGTRGPCPDWEYI

SEQ ID NO: 18637 - protein, 81 aa, Enhydra lutris
SPGAVSFADVAVYFSREEWRCLQPAQRALYRDVMRETYGYLGALGFSGPKPAFISWVEGEVEAWSPEAQDPEGETPAAVIR

SEQ ID NO: 18638 - protein, 81 aa, Pongo abelii
SKDLVTFGDVAVSFSQEEWEWLNPAQRNLYRKVMLENYRSLVSLGVSVSKPDVISLLEQGKEPWMVKKEGTRGPCPDWEYV

SEQ ID NO: 18639 - protein, 81 aa, Pongo abelii
SVQDVTVEFTQEEWQHLGLVERTMYRDVVLENYSHLISVVLSFSPPFYSPRLECNGAILAHCNLHLLCSKTESRSVAQAGV

SEQ ID NO: 18640 - protein, 81 aa, Pongo abelii
GPQAKLTFEDVAVLLSDEWDRLCPAQRGLYRNVMMETYGNVVSLGLPGSKPDIISQLERGEDPWVLDRKGAKKSQGLWSDY

SEQ ID NO: 18641 - protein, 81 aa, Pongo abelii
SLELVSFEEVAVHFIWEEWQDLDDTQRTLYRDVMLETYSSLVSLGHHITKPEMIFKLEQGAEPWIVEAPDLRLSGGSRKRV

SEQ ID NO: 18642 - protein, 81 aa, Pongo abelii
PQEAVVFEDVAVYFTRIEWSCLAPDQQALYRDVMLENYGNLASLGFLVAKPALISLLEQGEEPGALILQGAEQSVAKASLC

SEQ ID NO: 18643 - protein, 81 aa, Cebus imitator
MELLTFRDVTIEFSLEEWEFLKPAQQNLYRNVMLENYRNLVSLGLTVSKPELISCLEQRQEPWSVKRPKTVAKPPAMSCHY

SEQ ID NO: 18644 - protein, 81 aa, Cebus imitator
AQESMTFRDVAVFFSQDEWLHLDSAQRALYREVMLENYSTLVSLGIPFSMPKVIHQLQQGQDPCMVEGEVASDTCLGFKAW

SEQ ID NO: 18645 - protein, 81 aa, Cebus imitator
ISFEDVAVDFTLEEWQLLNPTQKNLYRDVMLENYSNLVFLEVWLDNPKTWLQDNQDNLKSTERGRKYGVFGKIFKSSINFV

SEQ ID NO: 18646 - protein, 81 aa, Callithrix jacchus
LRLPLTFEDVAIYFSEQEWQDLQAWEKELYKRVVRSNYETLISLDDGLPKPELIAWIEQGEEPFRNWRESQKSGNIICSSV

SEQ ID NO: 18647 - protein, 81 aa, Callithrix jacchus
FQGLVTFRDVAIEFSLEEWKCLEPAQRDLYREVTLENFGHLVSLGLSIPKPDVISLLEQGKEPWIIANDVTGPWCPDLESR

SEQ ID NO: 18648 - protein, 81 aa, Callithrix jacchus
TSQESLTLEDVAVEFTWEEWQLLGPSQKDLYRDVMLENYSNLVSVGYQASKPDALSKLEQGEPWTIENEIHSQVCPENKKV

SEQ ID NO: 18649 - protein, 81 aa, Macaca mulatta
MLENFQNLASLGYLLHTPHLICQWEQEEDLQTVKRELIQVIFMGEHQEGFETQLKTNESVAPQDICGEKISNEQKIVRFKR

SEQ ID NO: 18650 - protein, 81 aa, Callithrix jacchus
YQDSVTFDDVAVDFTQEEWTLLDPTQRSLYSDVMLENYKNLATVGGQIIKPSLISWLEQEEESRTVQGGVLQGWELQLETQ

SEQ ID NO: 18651 - protein, 81 aa, Callithrix jacchus
AHDLVMFRDVAVDFSQEEWECLNSYQRNLYRDVILENYSNLVSLAGCSISKPDVITLLEQGKEPWLVERDEKRRWSLDLES

SEQ ID NO: 18652 - protein, 81 aa, Callithrix jacchus
YQDSVTFDDLAVDFTPEEWTLLDPTQRNLYRDVMLENYKNLATVGCQLFKPSLISWLEQEESRTVQRGDFQEWKVQLKTKQ

SEQ ID NO: 18653 - protein, 81 aa, Monodon monoceros
YDSTKPNVILKLEQGEEPWVADGEFPRQFHPEEVWKVDDLMERAQENKDECSRQAVSINSRTLTEEREVAFDKTYNMEISL

SEQ ID NO: 18654 - protein, 81 aa, Callithrix jacchus
LQGPVSFKDVAVDFTQEEWQQLDPDEKIIYRDVMLENYSHLVSVGCDITKPNVIIKLEQGEEPWIMEDEFPCQHSPEVWKV

SEQ ID NO: 18655 - protein, 81 aa, Callithrix jacchus
AMSQESLIHVFVDFTLEEWQQLDSAQKNLCRDLMLENNSHLVSVGHLVAKSDVIFRLGPEEESWMAHGGILVTTCAEVWQV

SEQ ID NO: 18656 - protein, 81 aa, Macaca mulatta
VNFTQEEWALLDPSQKNLYRDVMQETFRNLASIGNKGKDQSIEDQYKNSSRNLSSFQMHQRNHTGEKPYECMECGKALGFS

SEQ ID NO: 18657 - protein, 81 aa, Monodon monoceros
YCVNKPNAVFKLKQGKEPWILEVEFPRQKYPGKLEIITCEEKTYGILMTKEQDTRKAKLKIQGKNGELTKHQKTHTNEKSY

SEQ ID NO: 18658 - protein, 81 aa, Macaca mulatta
SVAFEDVAVTFTQEEWALLDPSQKTLYRDVMQETFRNLASVGKKWKAQNMYVEYENLKRNLRTFVGERLFESKEGHQHGEI

SEQ ID NO: 18659 - protein, 81 aa, Callithrix jacchus
FQKPVTFEDLAVNFTQEEWDCLDASQRVLYQDVMSETFKNLASVARMFLHKPELITKLEHQEKQWRVTRVLQASRGGPPFF

SEQ ID NO: 18660 - protein, 81 aa, Callithrix jacchus
LSLPGLLTFRDVTIEFSQEEWRCLDPEGRMLHPEVLLEVRLTGKTPLMKGLLSTAQGNTEGFHTGILDRHESHHIGDFCFQ

SEQ ID NO: 18661 - protein, 81 aa, Macaca mulatta
LDPAQRTLYRDVMLENYWNLVSLGLCHFDMNIISMLEEGKEPWTVKNCVKIARKPRMRECVKGVITDIPPKCTTKDLLPEE

SEQ ID NO: 18662 - protein, 81 aa, Callithrix jacchus
AQEQVTFWDVAIYFSREEWECLEPSQRALYRDVMLDTFSNVAALGFCSPRPDLISRLEQWEEPWVEDRERPELQAVQRGPS

SEQ ID NO: 18663 - protein, 81 aa, Callithrix jacchus
GKGLFCFKACLSSFKNSETQGGNPSCELVVCLAPWPHFYVVFLLTGCPVTKTKVIIKAEQGQEPWMVERVNPHQSSPESDC

SEQ ID NO: 18664 - protein, 81 aa, Bos taurus
MSKPDVITLLDEGKEPWMVVREGTGKHHPDLESRYSANILSSEKDIYEIYSFQWEIMERIKSCSLQDSIFRNDWECKSKIE

SEQ ID NO: 18665 - protein, 81 aa, Bos taurus
KGPYFADVAVYFSPEEWGYLRPAQRALYRDVMRETYGHLGALGEAPPARLCSHPRPPRPASGSCTWSGRPQEVGTLGGGLP

SEQ ID NO: 18666 - protein, 81 aa, Bos taurus
TARSQASVTFKDVAMDFTPEWGRLDPTQRDVMLENYRNLVSLWLPVSKPENHSLENGKEPLLLERKAPKSSCSDSETSPRS

SEQ ID NO: 18667 - protein, 81 aa, Ovis aries
PRESVTFEDVAVNFSHEEWQCLTHSQRHLYKDVMLENYGNMVSLGFSFSKPPLISCLEQGAESYVQDQQDWEFLSCSYPVS

SEQ ID NO: 18668 - protein, 81 aa, Ovis aries
ERLTSEDVAIKFTQEWEFLDPAQRALYRDVMLETYRNLLSVDVSQIHMIKKLQQMETVVKKFFEEWCLEEPKAMKSKIISS

SEQ ID NO: 18669 - protein, 81 aa, Ovis aries
GQSRVTFEDVAVYFSQEEWCLLDEAQIQLYLDVMLENFALVCMLGSWPGVGDEETPFEQSKSAGVSQIGTPRTDSSAEKVQ

SEQ ID NO: 18670 - protein, 81 aa, Ovis aries
EVEDFRFKDVVIYFSQKEWECLHSAQKNLYQDVMLENYNNLISLGFTSFKPGVISLLEQGKEPWMVKGKETEEWCPDWECR

SEQ ID NO: 18671 - protein, 81 aa, Ovis aries
SQGRLTFQDVALDFTQEEWECLDLGQRELYRDVMLENYRNLVSLAGLVVSKPDLVTFLEQMKTPWDVRRLAMPAIYTAVSS

SEQ ID NO: 18672 - protein, 81 aa, Ovis aries
SQGLVSFKDVAVDFTQEEWQQLDPAQKTLYRDVMLENYSHLVSMGHPVSKPDVISKLEQGEDPWIIKTDIPNWICPYEGQA

SEQ ID NO: 18673 - protein, 81 aa, Ovis aries
QAEVTFEDVAVFLSQEEWGLLGPAQKGLYREVMLETYRNLVSLGAGLAGPKPEVIVHLERGDELWVLDMRGAEQPSVDGSA

SEQ ID NO: 18674 - protein, 81 aa, Vulpes vulpes
AQGGVTFEDVAVYFSREEWDLLDEAQRLLYHDVMLENFVLISSLGCCCGVEDAEALFEQSISVGVSQPWTQKEPRSPQKTH

SEQ ID NO: 18675 - protein, 81 aa, Vulpes vulpes
QKESLTFRDVCVDFTLEEWQQLDSAQKNLYRDVMLENYSHLVSVGYLGAKPDVVLRLGRGEEAGLTEGETPTWKYPEFWQV

SEQ ID NO: 18676 - protein, 81 aa, Vulpes vulpes
SQGSVLFEDISMDFTQKEWQLLDPAQRLLYRDVMLENYRHLVSLGHCVTKPELIFKLEQGEEPWVPKKELPRQSRPEVQEA

SEQ ID NO: 18677 - protein, 81 aa, Otolemur garnettii
SISFKDITIDFCRQEWEYLDLVQRTLYREVMMENYGNLVSMAGHSMSKPDIITLLEQRKEPWMLVREETRRECTGQCESAV

SEQ ID NO: 18678 - protein, 81 aa, Otolemur garnettii
KELPSVFEDVAVYFTREEWGMLDKRQKELYRDVMRMNYELLASLGPAAAKPDLISKLERRAAPWIKDPNGPKWGEGHPPGK

SEQ ID NO: 18679 - protein, 81 aa, Otolemur garnettii
FQALLTFRDVSIEFSMDEWACLDPAQQNLYRDVMLETYRNLVFLGEIVVSKENTIFCLQHSIQNVNVRRWSILRDNPPANS

SEQ ID NO: 18680 - protein, 81 aa, Otolemur garnettii
PKVPVTFDDVAVYFSEVEWGKLEDWQKELYKHVMRGNYETLVSLDYAISKPDILTRIERGEQPCPGDQWDQEKGNEEEAAC

SEQ ID NO: 18681 - protein, 81 aa, Vulpes vulpes
SQDPVTFQDVAVEFTQEEWEHLGTTQRALYREVMLENYRSLASLGCQDFKPDVISQLEQGRSPWMVWRDIPRDPSPDQETR

SEQ ID NO: 18682 - protein, 81 aa, Otolemur garnettii
PKLPLTFEDVAIYFSEQEWQNLEAWQKELYKHVMRTNYEMLISLDDGLPKPELICWIEQEREPFRNLKQSQTLENIIRSSA

SEQ ID NO: 18683 - protein, 81 aa, Otolemur garnettii
SGSLENDGICFSEQEWENLEDWQKELYKNVMESNYETLVSLKVLGQPEGEAELGTEMLGDLEEEGLVGAHPADGAMIKQEL

SEQ ID NO: 18684 - protein, 81 aa, Odocoileus virginianus
QGCVTFEDVAVYFSQEEWGLLDEAQRHLYHKVMLENFALTASMVCLHETETKEIPSEQNVSLEALSQVRTPKVGPFTENAH

SEQ ID NO: 18685 - protein, 81 aa, Odocoileus virginianus
MVENFRNLVSVGHVPFKADMVSQLETEGKLWTVERETQRNGHSSEIHSAVTSGNKNPNEMETLGKVMLKYLSCEELSCWQI

SEQ ID NO: 18686 - protein, 81 aa, Odocoileus virginianus
RESGKAPVTFDDITVYLLQEEWVLLSQQQKDICGSDKMVAPLGPSIASPELLYKFERGPEPWLASVQGQRSHLSPNPGKNK

SEQ ID NO: 18687 - protein, 81 aa, Cebus imitator
SKGSVMFRDVSIDFSQEEWEYLDSGQMNLYKEVMLENFSNLVSVGLSSSKPAMISLLEQGREPWLVDRELTRGLCSDLESM

SEQ ID NO: 18688 - protein, 81 aa, Callithrix jacchus
MQSGLTDVSVEFSSAEWKCLTPAQRALYRDVMLENYRNLESVGEENVPPDTRNPSLFIWIMPLQSAGNLNCSSLLKKHQIN

SEQ ID NO: 18689 - protein, 81 aa, Callithrix jacchus
KKKPVTFEDLAVNFTQEEWDCLDASQRVLYQDVMSETFKNLASVARMFLHKPELITKLEHQEKQWRVFLQLPNTEGLSEGK

SEQ ID NO: 18690 - protein, 81 aa, Macaca mulatta
IQGLLTFGDVAVAFTRIEWRHLDAAQRALYRDVMLENYGNLVSVVQDYWFETKMSALKQSTSAGSVVGERRKSVMMEKGLD

SEQ ID NO: 18691 - protein, 81 aa, Macaca mulatta
IQGQVNFEDVFVYFSQEEWVLLDEAQRLLYRDVMLENFALMASLGHTSFMSHIVASLVMGSEPWLPDWVDMTLPVATETLG

SEQ ID NO: 18692 - protein, 81 aa, Callithrix jacchus
AHELVMFRDVAIDVSQEEWECLNPAQRNLYKDVMLENYSNLVSLGLSVSKPAIISSLEQGKEPWMVVREESGRWCPDLASR

SEQ ID NO: 18693 - protein, 81 aa, Monodon monoceros
MTVELVKAIPQPYVISLLEQGKEPWEMKSEMRRTPFPDWESVYETQELPLKQFVCDDVLMERIISYGLECPTFGEDWKCED

SEQ ID NO: 18694 - protein, 81 aa, Callithrix jacchus
EMGVLTSRDVAIEHCLEEWQCLDTAQQNLYRNVMLENYRNLAFLGIASSKPHLITCLEQGKEPWNVKRHGLVAGPPDSLTV

SEQ ID NO: 18695 - protein, 81 aa, Macaca mulatta
VKESVTFKDVAIDFTLEEWRLMDPTQRNLHKDVMLENYRNLVSLGLAVSKPDMISHLENGKEPWVTMTEISRIPYPDMEPK

SEQ ID NO: 18696 - protein, 81 aa, Callithrix jacchus
LVTFEDVAVYFSQEEWGLLDVAQRHLYHNVMVENFELITSLGLLPRSPVEAKVGDDTESCSVSSIQVSLKKKNQQSLGPLL

SEQ ID NO: 18697 - protein, 81 aa, Callithrix jacchus
FQEQVSFKDVCVDFTEEEWYLLDPAQKMLYRDVILENYSNLVSVGYCITKPEVIFKIEQGEEPWILEKGFPSQCHPERKWK

SEQ ID NO: 18698 - protein, 81 aa, Monodon monoceros
MQLTQVLKYFPFTGYCFTKPELIFMLEQGEDPWLLEKEFVNRSSPEESQPDELLQESLENQGKHLRQVLFVNKSLTTEQEI

SEQ ID NO: 18699 - protein, 81 aa, Macaca mulatta
MLENYRNLVSVGLCLSKPDVISLLEQEKDPWVIKGEMTRSLCPDLECVWVTKSLSLNQDIYEEKLPPAIIMERLTSCDLEC

SEQ ID NO: 18700 - protein, 81 aa, Callithrix jacchus
SQGSVLFEDVSVYFTQEEWQLLDPAQRFLYRDVMLENYRHLVSLGHCATKPELIVKLKQGDEPWILKRELPSQSHSEVQKV

SEQ ID NO: 18701 - protein, 81 aa, Callithrix jacchus
LQGPLTFMDVAIEFSLEEWQCLDTAQQNLYRNVMLENYRNLVFLGIAVSKPDLITFLDQEKKPWNIKRREMVPKPSVICSH

SEQ ID NO: 18702 - protein, 81 aa, Callithrix jacchus
QPLPPGFRDVAIEFSLEEWQCLDAAQRNLYKNVILENYRNLVFLGIAVSKPDLIACLEQEKEPLIMKRDEMADEPPVMCSH

SEQ ID NO: 18703 - protein, 81 aa, Callithrix jacchus
LDTAQRDLYRNVLLENYRNLVFLGIAVSKPYLITCLEQKKEPWNMKRCEMVAKPPVMCFHFAQDLWSEQNMKDSFQNVTLR

SEQ ID NO: 18704 - protein, 81 aa, Bos taurus
LDLKTIDFTQEEWECLDLGQRELYRDTMLENYGNLASLGEDNCLQNPLSTHWVMVPAFPECLLESSASYNRVSDPCFLGKE

SEQ ID NO: 18705 - protein, 81 aa, Bos taurus
HQEVVTFEDVAVYFTRTEWAGLSPAQRALYRSVMLEIYRSLTSLDSRTHMDSELTPTWGISEERDLMMSHGPQKNVLNKSS

SEQ ID NO: 18706 - protein, 81 aa, Bos taurus
ALPGVTFSDVAIDFSHEEWRWLNSTQRNLYKDVMVQNYENLVSLGNPNPKGEYIILVMYGCEIWTVKKELSQNTCLITRGK

SEQ ID NO: 18707 - protein, 81 aa, Bos taurus
SLETVTFKDVAVDLTQEEWQQMKPAQRNLYRDVMLENYSNLVTVGCQVTKPDVIFKLEHEEEPWVVEEEMLGRHCPDFRLN

SEQ ID NO: 18708 - protein, 81 aa, Ovis aries
QGSLSFEHVTVGFTQEEWQKLDPAQRTLYRDVMLENYSHLISVGYCIPKPELIFKLDQGEQLWVLEAESPSQSYPGELGIV

SEQ ID NO: 18709 - protein, 81 aa, Otolemur garnettii
TARSQETVTFKDVAMDFTPEEWGKLDPIQRDVMLENYRNLVSLWLPVSKSENYSLENGKEPLKLERRAPISTCSDVEARPK

SEQ ID NO: 18710 - protein, 81 aa, Otolemur garnettii
AQESMMFEDVAVKFTSREWQYLSYDQRHLYKDVMLENYGNMISLGFSFPKPHLISHLEQGAEPCVQDLQDREFLSCSYPVS

SEQ ID NO: 18711 - protein, 81 aa, Vulpes vulpes
RPGAVSFADVAVYFSPEEWGCLQAAQRALYRDVMRETYGHLGALGFADAKPVLISWLERKAEVWTPEAEDPEEGARHPGSG

SEQ ID NO: 18712 - protein, 81 aa, Vulpes vulpes
WWKAWVQKPITFEDVAVNFTQEEWMCLDASQRALYQDVMSETFRNLMSVDLIIKLGQEESQQRAEFQLCLLNGEGLLSGEH

SEQ ID NO: 18713 - protein, 81 aa, Otolemur garnettii
LTFQDVSVEFSMDEWACLDPAQQTLYRDVMLENYRHLVFLGLTLSKPDVITCLEQSKAPWKVKAQQTVVKPPDMCTHTISN

SEQ ID NO: 18714 - protein, 81 aa, Otolemur garnettii
MAFEDVAVYFSQEEWGLLDTAQRALYRHVMLENFTLVSSLGLSTSRPRVVVQLERGEEPWVPSRIDSTPARNAQGRRNPGS

SEQ ID NO: 18715 - protein, 81 aa, Otolemur garnettii
VTFEDVAVNFTQEEWACLDVSQRVLYQDVMSETFENLASVARFFLHKPDLISKLEQEEEQWRIYLHLSNREGLLSGKNCKR

SEQ ID NO: 18716 - protein, 81 aa, Otolemur garnettii
SEGHVTFEDVAVCFSREEWKLLDEAQRLLYRSVMLENFAVMASLGLASSRTCEIIQLELWGELFMPAWGLKAPAIPKGYYH

SEQ ID NO: 18717 - protein, 81 aa, Otolemur garnettii
FQELLTFGDVTIEFSPEEWACLDPAWWNLYRDVMLENYRNLASLGLTASKPALITCLEQRKEPWNVKRHKKVAEHSGRWEA

SEQ ID NO: 18718 - protein, 81 aa, Otolemur garnettii
MTFEDVAVYFSQEEWRLLDTAQKALYHHVMLENFTLVSSLGLSTSRPRVVVQLERGEEPWVPSRIDSTPARNAQGRRNPGE

SEQ ID NO: 18719 - protein, 81 aa, Vulpes vulpes
TQDCVISEDVFVYFSWEEWMLLDDSQRLLYQDVMLENFALLASLGIASSRSHLVTQLNPRKDPQMPEQVNMNPATEREAQK

SEQ ID NO: 18720 - protein, 81 aa, Otolemur garnettii
SQGLVTFEDVAVYFSLEEWEKLDVDQRSLYQEVMQENYGILGSLGYPIPKPDLIFRLEQGEEPWVPDSPRPEEGDIVTGVY

SEQ ID NO: 18721 - protein, 81 aa, Otolemur garnettii
LQVPVSFEDVTVDFSREEWQHLDSAQRRLYRDVTLENYSHLLSVGYRVPKPEAIFLLEQGEGPWTLDGEAPHQSGSVQPSL

SEQ ID NO: 18722 - protein, 81 aa, Cebus imitator
WQESVTFQDVAVGFTPEEWQLLDCADRTLYWDVMLENYRNLFSVGCPVTKTKVILKAEQEQEPWMVEGVNPHHSSPESDCP

SEQ ID NO: 18723 - protein, 81 aa, Macaca mulatta
GRPLEMAVSEPETSAAKEWKQLDPAQRNVYHDVMLENYSNQASMGYQAPKPDLISKLEKGEAPWLGKGKRPSQGCPSKIAR

SEQ ID NO: 18724 - protein, 81 aa, Callithrix jacchus
PSPPPRLDVAIEFSQEEWRCLDPAQKTLHRDVMLENYRNLVSLGEDVMLENYRNLESVGEEPVPPDTRNLPLSILALPGMY

SEQ ID NO: 18725 - protein, 81 aa, Callithrix jacchus
LFQVTFSDVAIDFSHEEWEWLDSAQRDLYKDVMVQNYENLASLAGLSITKPHVITLLEDGKEPWMVEEKMSKGVTPDWESR

SEQ ID NO: 18726 - protein, 81 aa, Callithrix jacchus
SQGLVSFKDVAVDFTQEEWQQLDPAQRTLYRDVMLENYSHLVSMGYPVSKPDVICKLEQGEEPWILKTDISNWIYPDEYQA

SEQ ID NO: 18727 - protein, 81 aa, Callithrix jacchus
YQDSVTFDDVAVAFTQEEWTLLDPSQRDLYRDVMLENYENLASVGHHLFKPSVICWLEEEGPSRAGQRGVLQEWRLKSKGS

SEQ ID NO: 18728 - protein, 81 aa, Macaca mulatta
SHELLTFKDISVDFTQEEWGQLAPAYQNLYREVMLENYSNLVSVAGYQLSKPSVISQLEKGEEPWMAEKEGPGDPSSDLKS

SEQ ID NO: 18729 - protein, 81 aa, Callithrix jacchus
TVGVLTFRDVAIEFCLEEWQCLDTAQQNLYRNVMLENYRNLVFLGIAALKPDLITCLEQGKEPWNVKRHEMVAELPGCSAM

SEQ ID NO: 18730 - protein, 81 aa, Callithrix jacchus
RRGHLTFRDVAIEFSQEEWKCLEPAQRALYRDVMLENYRNLVSLGICPYDLSIISTLEQSGGPWNLQSEVKIANTPDGREC

SEQ ID NO: 18731 - protein, 81 aa, Macaca mulatta
VAFEDVAVNFTREEWALLDIFQKNLYREVMLETFRNLTSIGKSWKDQNIEYEYQNPRRNFRSLIEEKVNEIKEDSHCGETV

SEQ ID NO: 18732 - protein, 81 aa, Callithrix jacchus
PLTFMDVTVEFSLEEWQCLDIAQQNLYRDVMLENYRNLVFLIMCSHFAEDLWLEEGIKVLFQKVILRRYDKYGHENLQLRK

SEQ ID NO: 18733 - protein, 81 aa, Monodon monoceros
WFQDLKFKDVAIYFTQKEWECLHSAQKDLYRDVMLENYNTLISLGFSDSKPDVISLLEQGKEPWMVNSKETKEWCPDWESR

SEQ ID NO: 18734 - protein, 81 aa, Macaca mulatta
GQVNFEDVFVYFSQEEWVLLDEAQRLLYRDVMLENFALMASLGCWHGMEDEEIPFEQSFSIGMSQIRISKGGPSTQKAYPC

SEQ ID NO: 18735 - protein, 81 aa, Bos taurus
FKEAVTFKDVAVVFTEEEMGLLDLAQRKLYQEVMLENFRNLLSVGHQSFTPDVPSQLEREEKLQMIRTAAQSCCSSGESPV

SEQ ID NO: 18736 - protein, 81 aa, Ovis aries
SCPQDVDLFACNGLEPHTSTSVEPSQESVTFQDVAVDFTEKEWPLLDSTQRKLYKDVMLENYSNLASVGKAGVISSLLVHP

SEQ ID NO: 18737 - protein, 81 aa, Ovis aries
TSQSPLTFGDVAVEFSGEEWAWLDSAQRSLHRSVMLENYRNLASLGKVSKPEMISSLEQRKEPWAVTRKTTGGECADSQTL

SEQ ID NO: 18738 - protein, 81 aa, Ovis aries
APVPLTFSDVSIDFSQEEWECLDSDQKNLYKDVMLETYTNLVSLDFDFTTENNKLSSEKRSFEVNSYHWETIKSKTFNLMG

SEQ ID NO: 18739 - protein, 81 aa, Ovis aries
DYQKVTFSDVAIDFSHEEWRWLSSTQRDLYKDVMVQNYENLVSLAGLSIPKPYVIALLEDGKEPWMVEEKLSKDMFSDCKS

SEQ ID NO: 18740 - protein, 81 aa, Ovis aries
SQEPLTFKDIIVDFTQEEWGHLATAHQNLYREAMLENYGNLVSVGYQLSKPGVISQLEKGEEPWLMKREVSGGPSPDLEDE

SEQ ID NO: 18741 - protein, 81 aa, Ovis aries
PQDSVTFEDVAVYFSWNEWCLLDEVQIRLYLDVMLENFALVCMLGSCGVQDAETCSEQNVSAERASQIRTPRAELSPENTQ

SEQ ID NO: 18742 - protein, 81 aa, Vulpes vulpes
SQGSLSFRDVTVGFTQEEWQHLNLAQRTLYRDVMLENYSHLVSVGYSIDKPEVILKLEQGEESWILEEAFPSQSDPELINS

SEQ ID NO: 18743 - protein, 81 aa, Otolemur garnettii
SCEPVTFEDVTLGFTGEEWGLLDLEQKSLYREVMLENYSNLVSVAEHQLSKPDVVSQLEEAEEFWPLERGIPQDTLPAEYL

SEQ ID NO: 18744 - protein, 81 aa, Otolemur garnettii
FQGVLTFKDVSIEFSMEEWACLDPAQKHLYQEVMLETYRNLVFLGLAVSKPDLITCLEQSKDPWKLKTQQTLLKPPALPNH

SEQ ID NO: 18745 - protein, 81 aa, Otolemur garnettii
QELLTFRDVGIEFSPEEWEYLDPAQRHLYRDVMSEISRHLDFVGLIISFFDLGIRVEVRTQPRPAKQQMTTASPPERRIYS

SEQ ID NO: 18746 - protein, 81 aa, Otolemur garnettii
FQGLVMFEDVAVYFSREEWGLLNVTQKSLYHDVMLENFALISSLGLAPSRSHVSTQLEDGEESWVVPSRVKVIPVSRMEAK

SEQ ID NO: 18747 - protein, 81 aa, Vulpes vulpes
MYFTQNEWQLLEPAQKDLYRDVMLENYGHLASLGHWFFKPKLITRLEQGDEPCVKERDIPPAPQRGSAGISGSCISTDKKR

SEQ ID NO: 18748 - protein, 81 aa, Otolemur garnettii
SQGLVTFGDVAVDFSQEEWAWLSTTQRTLYRKVTLENYRNLASLGLCVSKPAVISLLEQGKEPWIVKRKMTRGGCPDLNAV

SEQ ID NO: 18749 - protein, 81 aa, Otolemur garnettii
ESVSFMDVTVDFTQEEWEQLDPSQRILYMDVMLENYSNLLSVEVWKADDQMERDHGNPEEQARQFVILKNQTPIEERDNLF

SEQ ID NO: 18750 - protein, 81 aa, Enhydra lutris
LGSAAYQFLSVDYTERKWKGPALSQRAVYRSIMPENCCSVASMAGETRMQHSELPAKQEVSKEPLLPDGTSGGLCGVVSEE

SEQ ID NO: 18751 - protein, 81 aa, Enhydra lutris
SSVTFEDVAVYFSQEEWRFLNKAQRHLYRDVMLEVFALVSSLGGGRGALEAAAPSEQNMSGGGSQKAYTQDCSLDSEGDLQ

SEQ ID NO: 18752 - protein, 81 aa, Macaca mulatta
MGLLTFRDVAVEFSLEEWEHLEPAQKTLYQDVMLENYRNLVSLDVFSHYNKDLLTEQCTEASFQKVVSRRHGNCHLENLHL

SEQ ID NO: 18753 - protein, 81 aa, Callithrix jacchus
AQESMTFRDVAVFFSQDEWLHLDSAQRALYREVMLENYSTLVSLGIPFSMPKVIHQLQQGQDPCTVEGDVPSNTCLGFKTW

SEQ ID NO: 18754 - protein, 81 aa, Callithrix jacchus
PLTFRDVAIEFSQEEWRCLDPTQKALYKDVMLENYRNLVFLGISPKCMIKELPPTENSNTRERCQTVTLERHQSYNLENLY

SEQ ID NO: 18755 - protein, 81 aa, Macaca mulatta
SCEPVNFEDVTLGFTPEEWGLLDLKQKSLYREVMLENYRNLVAVEHQLSKPDVVSQLEEAEDFWPVERGIPQDTIPEYSEL

SEQ ID NO: 18756 - protein, 81 aa, Callithrix jacchus
EMGPLTFRDVKIEFSLEEWQCLDTVQRNLYRDVMLENYRNLVFLGIAVSKPDLITWLEQGKEPWNMKSHAMVAKPPVICSH

SEQ ID NO: 18757 - protein, 81 aa, Callithrix jacchus
PQGRLTFKDVSVEFSSAEWKCLTPAQRALYRDVMLENYRNLESVGEENVPPDTRQGNTEVFHTGTLARQESHHIGEFCFQE

SEQ ID NO: 18758 - protein, 81 aa, Macaca mulatta
MLENYRNLVFLGITVSKPDLITCLEKEKEPWNMKRYEMVDEPPVICSHFAEDFWPEQDIKDSFKKVTLRRYDKCGPENLQL

SEQ ID NO: 18759 - protein, 81 aa, Macaca mulatta
EEWKCLDPAQQNLYRDVMLENYRNLVSLGFVISNPDLVTCLEQIKEPYNLKIHETAAKPPAMCSPFSQDLSPVQGIEDSFQ

SEQ ID NO: 18760 - protein, 81 aa, Monodon monoceros
AVENEHSSGYCIIKPQVIFKLEHGEEPWPSEEEFLNQKYPGCYRIDVHIEENQEKQEKPLWQVVFTDNKILSKEEQKALEK

SEQ ID NO: 18761 - protein, 81 aa, Callithrix jacchus
VHGSVTFRDVAIDFSQEEWECLQPAQKTLYRDVMLENYSHLISLAGSSVSKPDVITLLEQEKEPWMVIWSQNVDLRKYLWK

SEQ ID NO: 18762 - protein, 81 aa, Macaca mulatta
PQGRLTFRDVAIEFSQEEWKCLDPAQRALYRDVMLENYRNLVSLDISSKCMMKEFSSTAQGNTEVIHRGTIQRHERHHIGD

SEQ ID NO: 18763 - protein, 81 aa, Bos taurus
VEELSCQTDVTIDFTLEEWECLDLDQQELYRNVMLENYGNLASLGLVVSKPDLVTFLEQMKNPWDIRRTDTTATYPFAVWE

SEQ ID NO: 18764 - protein, 81 aa, Bos taurus
TQLTFKDVFIDFTPEEWECLDPAQRTLYKDVMVETLRILLSVVNSDKGEVFHTVMLGRPESREITDFFLREIQENLHEFEC

SEQ ID NO: 18765 - protein, 81 aa, Bos taurus
SLTFQDVAIDFSQEEWGFLDPAQRELYTAVMLETYQNLVWLGKCTQPLVHICLPKRINGETYHHERVMKKTSSTGREYGKA

SEQ ID NO: 18766 - protein, 81 aa, Bos taurus
NRNFWILRLPPGSKGEPEWGKLDEWQKELYKHVMRGNYEMLVSLDYAISKPDILTRMERGEEPCPEGPWGREEGNEREEVC

SEQ ID NO: 18767 - protein, 81 aa, Ovis aries
CQDPVTFEDVAIVFTDEEWRSLVPTQRDLYKEVMLENYKSIVSLAGLPIPGPDVIFQLKRGDEPWLVEFHEFEGKEGAENV

SEQ ID NO: 18768 - protein, 81 aa, Ovis aries
FQEPVSFRDVAVVFTEEELGLLDSAQRKLYQEVMLENFRNLLSVGNQPFKPELIFQLEREERLMMETQRDGCSGTKSPHNM

SEQ ID NO: 18769 - protein, 81 aa, Ovis aries
AKQLTIFRDVAVDFSQEEWECLDLEQRHQYRDVMLENYSNLVSLGLCIYQPEVFFLLEKGREPWMALADETCPDMQSRYQT

SEQ ID NO: 18770 - protein, 81 aa, Ovis aries
WQGNVTFEDVFVSFSQEEWGLLDEAQRLLYHEVMLENYALMASLGYASSMSHGVSPQELGREPWVFDWANTTPALTREAQS

SEQ ID NO: 18771 - protein, 81 aa, Ovis aries
MLETYSNLVSVGYEGTKPYVILQLEQEEAPWICEAACSGCHCQENIWQVNIHRKRRQDTLLRQGPFISRKTFPKERSHECN

SEQ ID NO: 18772 - protein, 81 aa, Ovis aries
NQESLTFKDVAVNFTQEEWHHVDAAQRRLYRDVMLENYSHLVFLGYQVSKPEVIFKLEQGEEPWIAEGEIQRPVYPDWKTR

SEQ ID NO: 18773 - protein, 81 aa, Ovis aries
MLENYRNLASLGLVVSKPNLVTFLEQMKNPWDVRRLETPQIHTGKKPYECKECDKAFMCYSNLSQHKRIHTGERPYKCTEC

SEQ ID NO: 18774 - protein, 81 aa, Otolemur garnettii
QGVLTFKDVAIEFSVEEWACLDPAQQHLYQEVMLETYRNLVFLGLAVSKPDLITCLEQSKEPWKVKTQQTLLKPPVLSNHS

SEQ ID NO: 18775 - protein, 81 aa, Vulpes vulpes
MMLENYRNLVSVGYQASKPDALSKLERGGELSMIEDEIHSRICPEIRKADDPLQCHLQNRSIQKSVEQCYEHNTFANILNQ

SEQ ID NO: 18776 - protein, 81 aa, Vulpes vulpes
HQELVSFKDVAVYFTQTEWAGLSPAQKALYRSVMLENYGNLTSLGYPVPRPALVSLLEGGNLPWGLEAQNNPSAERSKGIC

SEQ ID NO: 18777 - protein, 81 aa, Vulpes vulpes
CWGLLSFKDISMEFTWEEWQLLDSAQKYLYRDVILENYSHLVSLGYHGTKPDLIFKLEQGEEPWMINARVSRQSYPEGWKE

SEQ ID NO: 18778 - protein, 81 aa, Vulpes vulpes
MLENYHNFVSVGYLIKKPAVIFKLEEGKEPWIVEEELLYQNYQEDNKVHYLTERIQKYQDKYLPQLLFSNKKLSSEKVYAL

SEQ ID NO: 18779 - protein, 81 aa, Vulpes vulpes
MFKDVAIDVSQEEWECLNPTQRNLYKDVMLENYSNLVSLGLSISKPAVISSLEQGKEPWMVEREVTGGWCTDLVSRYEAKK

SEQ ID NO: 18780 - protein, 81 aa, Otolemur garnettii
QEGVNFKIVTVDFTQEEEGTWNPAQKTLDRDVILENHRDLVSWDLATTLRRRESASKWSGFDDEPFHGVKIEKLTRDDPWL

SEQ ID NO: 18781 - protein, 81 aa, Otolemur garnettii
QELVSFKDVAVDFTQEEWHQLDPAQKTLYRDVMLENYSHLVSMGYPVSKPDVISKLEQGEDPWIIKGDIPSCIYPDENQAD

SEQ ID NO: 18782 - protein, 81 aa, Odocoileus virginianus
HQGSVTFEDVAMYFSWEEWCLLDEAQIQLYLDVMLENFALVCMLGSWRGVQDKETPSEEIKPAGVLQFCTPRAGLSPEKTH

SEQ ID NO: 18783 - protein, 81 aa, Cebus imitator
YQDSVTFDDLAVDFTPEEWMLLDPTQRNLYRDVMLENYKNLATVGCQLLKPSLISWLEQEESRTVQRGDFHEWKVQLKTKE

SEQ ID NO: 18784 - protein, 81 aa, Cebus imitator
AQGCVTFEDVTIYFSKEEWGLLDEAQRLLYCDVMLENFALIASLGLISFRSHIVSQLEMGKEPWVPDSMDMTSAMARGVYG

SEQ ID NO: 18785 - protein, 81 aa, Cebus imitator
MNSVSFEDVAVNFTLEEWALLDSSQKKLYKDVMRETFKNLVCLGKRWEDQDVEDDHRNLGRNRRGHMVERLCESRKGSKCR

SEQ ID NO: 18786 - protein, 81 aa, Cebus imitator
MFKEAVTFKDVAVVFTEEELGLLGPAQRKLYRDVMLENFRNLLSVGQQAFDRDIFQFLREEKVWMMKTATQREGNSGGKIQ

SEQ ID NO: 18787 - protein, 81 aa, Macaca mulatta
LQASVSFEDVTVDFSREEWQHLDPAQRCLYWDVTLENYSHLLSVGYQVPKSEAAFKLEQGEGPWTLAGEAPHQSCSGEAIE

SEQ ID NO: 18788 - protein, 81 aa, Callithrix jacchus
TEGVLKFRDVAIEFSWKEWQYLDTAQQNLYRNVMLENYRNLVFLGIAASNSDLITCLEQGKEPWNVKRHEFEAKLPGRSGM

SEQ ID NO: 18789 - protein, 81 aa, Callithrix jacchus
GLLDPVQRNLYRDVMLENFRNLLSVAPSFHISEFSVLTADKIQSEMEAGPHEELSWGQIWKQIASDLVKYEDSMINISQFP

SEQ ID NO: 18790 - protein, 81 aa, Macaca mulatta
WDLLDEAQKHLYFDVMLENFALTSSLGCWHGVEHEETPSEQRISVEGVPQFRTSKEGSSSQNAYSCEICGLVLRDILHLAE

SEQ ID NO: 18791 - protein, 81 aa, Macaca mulatta
QGLLTFRDVAIEFSQEEWKCLDPAQRTLYRAVMLENYRNLVSLAISSKCMMKEFSSTAQGNREVLHTGTLQRHESHHIGDF

SEQ ID NO: 18792 - protein, 81 aa, Callithrix jacchus
QASVALEDVAVNFTREEWALLGPCQKNLYKDVMQETIRNLDCVGMKWKDQNIEDQYTYLRKNLRCYMLERFGESKDGRQCG

SEQ ID NO: 18793 - protein, 81 aa, Callithrix jacchus
SYEGSVSFRDVAINFSREEWRHLDLSQRNLYWDVMLETYSHLLSVGYQFPKPEVVMLEQGNEPWALQGERPRHSCPGEKLW

SEQ ID NO: 18794 - protein, 81 aa, Macaca mulatta
VQESVTFRDVAVFFSQDEWLHLDSAQRALYREVMLENYSSLVSLGILFSKPKVISQLEQGEDPWMVESGVPQGAHLGWESL

SEQ ID NO: 18795 - protein, 81 aa, Macaca mulatta
QGLLTFRDVAIEFSQEEWKCLDPAQRTLYRDVMLENYRNLVSLAISSKCMMKEFSSTAQGNREVLHTGTLQRHESHHIGDF

SEQ ID NO: 18796 - protein, 81 aa, Callithrix jacchus
GKEPLTFRDVAIEFSLEEWQCLDTAQRDLYRNVLLENYRNLVFLGIAVSKPYLITCLEQKKEPWNMKRCEMVAKPPVMCFH

SEQ ID NO: 18797 - protein, 81 aa, Macaca mulatta
MLENYKNLATVGYQLFKPSLISWLEQEESRTVERGDFQASEWKVQLKTKESALQQDFLGEPNSSGIQMIGSYNGGEANDVK

SEQ ID NO: 18798 - protein, 81 aa, Callithrix jacchus
DSVAFEDVAINFTCEEWALLGPSQKSLYRDVMQETIRNLDCIGMKWQNLDIEEDKYRNPGRNLRYYMVKRAREIKDNSQCG

SEQ ID NO: 18799 - protein, 81 aa, Bos taurus
WEGSMMFRDVSINFSQEEWECLDSGQMNLYKEVMLENFSNLVSVGLSSSKPAVISLLEQGKEPWMIDRELTRGLCSGKQEM

SEQ ID NO: 18800 - protein, 81 aa, Bos taurus
LTLQVVVTFKDVAVTFTREEWGQLDLGQRTLFREVMLETCGLLVSLGDRPKCQPRDSSSSQPVLSEEALLQGSLTLGSSWD

SEQ ID NO: 18801 - protein, 81 aa, Bos taurus
GIALSQLTFKDVFIDFTPEEWECLDPAQRTLYKDVMVETLRILLWVRITSFRSGGILWGTSACSVCVSWEPLFFLLRSKPC

SEQ ID NO: 18802 - protein, 81 aa, Ovis aries
ARLSVTFDDVAVTFTQEEWGHLEPAQRTLYREVMLENCGLLVSLGCPVPRPELIYQLEHGQELWTVKRDLSRSTCPGDKGK

SEQ ID NO: 18803 - protein, 81 aa, Ovis aries
QEAAELEFLSVNYTLKKWKGTALSQRALYWNIMLENCCSLAPLGENRMASSQLSPKQDISEESKSADRTSGILCRLILGGP

SEQ ID NO: 18804 - protein, 81 aa, Ovis aries
LQETLTFRDVFVDFTQEEWQQLDAAQKNLHRVVMLENYSHLVSVGYLVAQPHGIFRLGQGEEEARMAAGESVMWSCPGKPT

SEQ ID NO: 18805 - protein, 81 aa, Ovis aries
PQGSVTFEDVAVYFSWEEWALLDEAQRCLYHDVMLENFALTSSLGCWHGVEDKEAPSEQSICIGVSQIRTLKADSSPQKGQ

SEQ ID NO: 18806 - protein, 81 aa, Ovis aries
SCEVSVSLRDVAVDFSREEWQQLDLDQKNLYRDVMLETCSHLLSIGYQVPEIEVFMLEQGKEPWALQGEGPYQSCPEELWQ

SEQ ID NO: 18807 - protein, 81 aa, Otolemur garnettii
QALLTFRDVSVEFSMDEWACLEPAQQNLYRDVMLETYRHLVFLGEDNLHTQFIVIFKENISSWHRKKTHQTVVKHPVISNH

SEQ ID NO: 18808 - protein, 81 aa, Otolemur garnettii
ASVTVAFDDVALYFTEQEWDILEKWQKEMYKQVMKTNYETLDSLGCAFSKPDLITWMEQGRMLLIGDQKCLEKRLTISPSN

SEQ ID NO: 18809 - protein, 81 aa, Otolemur garnettii
MLETYGHLLSVGLGNQITKPEVISLLEQGEEPWSVEQACPQSTCPEWMRNIESKALIPTQTIFEEEQSPGMKLERYIWDDP

SEQ ID NO: 18810 - protein, 81 aa, Vulpes vulpes
ARELVTYEDVAVDFTQEEWQHLDPAQKTLHRDVMLEIYSHLVSVGCSGIKPGIIFKLEYEEDPWIIKSELSRWIHSDREES

SEQ ID NO: 18811 - protein, 81 aa, Enhydra lutris
LQEPVTFRDVAVDFTQEEWGQLGPAQRTLYRDVMLETFGHLLSVGPELPKPEVISQLEQGAELWATERGIAQGYCPGRESG

SEQ ID NO: 18812 - protein, 81 aa, Enhydra lutris
PQDLMTFEDVAVEFTQWEWGQLDPAQKDLYRVVMLENFKNLASLGFPVAKPYVISQLEKGKEPCVLEGEISTGEFSDWEKR

SEQ ID NO: 18813 - protein, 81 aa, Enhydra lutris
GPVTMTFDDVALYFSEQEWEILEKWQKEMYQQVMKTNYETLDSLGGIFSKPNLITWIEQGRMLLIRDRGPLEKNMTLSPST

SEQ ID NO: 18814 - protein, 81 aa, Enhydra lutris
QDTVVFADVAVNFTPEEWALLDRGQRRLYRDVMLETCRNLASLDRCTQVNPCGSGIQLNILENELSSEDKIVTFTRNDSWA

SEQ ID NO: 18815 - protein, 81 aa, Enhydra lutris
ILLPLTFEDVAIYFSEQEWQNLEAWQKELYKHVMRTNYEILVSLDNGLPKPELISWIEQEREFFQNWQETQKSGTIICSSA

SEQ ID NO: 18816 - protein, 81 aa, Enhydra lutris
RPGAVSFADVAVYFSPEEWGCLRPAQRALYRDVMREIYCHLGALGFRGTKPALISWVEEEADLWGPAARDPEVGECLPEAD

SEQ ID NO: 18817 - protein, 81 aa, Enhydra lutris
PLESVTFEDVAIDFTKEEWDLLDISQRKLFRDVMLENIRHLVSLGYQHCKSDLIFQLEQGQELWSEGTRFLQGQSPGRGNA

SEQ ID NO: 18818 - protein, 81 aa, Enhydra lutris
LRGSVSFEDVAVDFTRQEWHSLDPAQRTMHKDVMLENYSNLASVGLCVAKPEMIFKLERGEELWILEEESPGPGYPGSLSL

SEQ ID NO: 18819 - protein, 81 aa, Pongo abelii
FQNSVAFEDVAVSFTQEEWALLDPSQKSLYRDVMQETFKNLTSVGKTWKVQNIEDEFKNPRRNLSLMREKLCESKESHHCG

SEQ ID NO: 18820 - protein, 81 aa, Pongo abelii
MELLTFRDVAVEFSPEEWKCLDPAQQNLYRDVMLENYRNLVSLGVAISNPDLVIYLEQRKEPYKMKIHETVAKHPDRSPFK

SEQ ID NO: 18821 - protein, 81 aa, Pongo abelii
QEGVNFKIVTVDFTQEEQGTWNPAQRTLDRDVILENHRDLVSWDLATAVGKKDSTSKQRIFDEELANGVKIERFTRDDPWL

SEQ ID NO: 18822 - protein, 81 aa, Pongo abelii
MLENFRNLVFLGIVVSKPDLITCLEQGKKSLTMKRHEMIANPPVMCFHFAQDLCPEQSLKDSFQKVILRRYEKREYGNLEL

SEQ ID NO: 18823 - protein, 81 aa, Pongo abelii
TVAYEDLSEDYTQKKWKGVALSQRALHWNMMLENDRSMTSLGRNMMESSELTPKQEIFKVSESSNSTSGGFFGVVPGETET

SEQ ID NO: 18824 - protein, 81 aa, Pongo abelii
LKGLVTFEDVAVEFTQEEWALLDPAQRTLYRDVMLENFRNLASSLGNQVDKPSLISQLEQEDKVMTEERGILSGTCPDVEN

SEQ ID NO: 18825 - protein, 81 aa, Pongo abelii
PRLPLTFEDVAIYFSEQEWQDLEAWQKELYKHVMRSNYETLISLDDGLPKPELISWIEHGGEPFRKWRESQKSGNIICSSV

SEQ ID NO: 18826 - protein, 81 aa, Cebus imitator
MTLLDVAIEFSLEEWKFLDPAQQNLYRDVMLENYRNLFSIGLTVSKPGLITCLEQRKAPWNLKRREAVDGHPEIGFCHVVQ

SEQ ID NO: 18827 - protein, 81 aa, Cebus imitator
MESVTFEDVAVEFIQEWALLDSARRNLCRYGMLDKCRSLASRESPWESQLKPKELPSMRDILEEASSRDMQMGPGLFLRMQ

SEQ ID NO: 18828 - protein, 81 aa, Callithrix jacchus
FQVPVTLKDVIVEFTKEEWKLLTPAQRTLYKDVMLENYSHLVSVGYRVNKPNVVFKLKQGKEPWMLEVEFPHRGLPEDLWN

SEQ ID NO: 18829 - protein, 81 aa, Callithrix jacchus
AQGCVTFEDVTIYFSKEEWGLLDEAQRLLYCDVMLENFALIASLGLISFRSHIVSQLEMGKEPWVPDSMDMTSAVARGAYG

SEQ ID NO: 18830 - protein, 81 aa, Callithrix jacchus
AQMLVSFKDVAVTFTQEEWRQLDPAQRTLYQEVMLETCGLLVSLGYWVPKAELVHLLEHGQELWTVKSGRSHPTCVGDKAQ

SEQ ID NO: 18831 - protein, 81 aa, Monodon monoceros
MGGKHGLCISKPDVISLLEQDKEPWMMKGEITRGLPPDLEYVWMRKELSPNQDIYEEKLSQAMIMERLTGCDLKCSTLGEN

SEQ ID NO: 18832 - protein, 81 aa, Macaca mulatta
DSVTFDDVAVEFTPEEWVLLDTTQKYLYRDVMLENYMNLASVGFFSREPVCPFEEKTKAERMVEDYLANSYQDSVTFDDVA

SEQ ID NO: 18833 - protein, 81 aa, Bos taurus
FQPTVSFKDVAVTFTWVKWGHVDLAQRTVYREVVLETCSRLVSLVKAVATHHQTQGVAHFRHAWTGPEEKGILPGNFAGFL

SEQ ID NO: 18834 - protein, 81 aa, Bos taurus
DLTFFSRWFTDVAVVFSPDLWAHLSLEERELYRDVMLDTCAQLVLLGRWTYKAEVISSLRQGRDLRMLEGEATSAAWPEPQ

SEQ ID NO: 18835 - protein, 81 aa, Ovis aries
FQVPVTYEDVAVTFTQEEWGHLGPVQRMLYWEVMLETCRLLVSLGCPLPEPELISPAEPGPESQTSRRGPTPGSCSGDNTK

SEQ ID NO: 18836 - protein, 81 aa, Ovis aries
AQETLSFKDVAVDFTWEEWQLLAPAQKTLYRDVMLENYSNLVSVGYRVSKSDVLSKLKQGKERWMTEDEIHSRTWPETGNI

SEQ ID NO: 18837 - protein, 81 aa, Ovis aries
VTFGDVAVHFSREEWQCLDPGQRALYKEVMLENHSSVAGLDATVGTDAEQACEDMDSLKSESGGVMVKTLPQDFPQSPGFG

SEQ ID NO: 18838 - protein, 81 aa, Ovis aries
QAQETLTFDDVAMDFTWEEWQLLTPVQKALYRHVMLENYSNLVSAGFQASISEVLSKLDQGEPWMMDDEIHCQTRSEVWKV

SEQ ID NO: 18839 - protein, 81 aa, Ovis aries
QGGVTFPDVAVRFSQREWRLLDETQRRLYLDVMLENYTLVSSLGCCCGAEGEETPCEKTVPVGVSWTGSPTAAPFSQKTHP

SEQ ID NO: 18840 - protein, 81 aa, Ovis aries
MAGQDLAVRFSKDEWRLLGEGQRALYLDVMQENYDTLASLGTAELLPLSAFLSPSEPGGAVGARSRAGDRQELPQGGGPLG

SEQ ID NO: 18841 - protein, 81 aa, Ovis aries
QEPVTFEDVAVDFTQEEWQQLAPAQKTLHRDVMLEIYSHLVSAGCSDLKLDIISKLEHGKDPWITESELSRRTYSGKEQSS

SEQ ID NO: 18842 - protein, 81 aa, Ovis aries
MFKDVAIDVSQEEWECLNPAQRNLYKDVMLENYSNLVSLGLSISKPAVITSLEQGKEPWMVMREVTRERCPDLVSKCEPKK

SEQ ID NO: 18843 - protein, 81 aa, Ovis aries
MLENYSSLVSLGYEVMKPGVILKLEQGEEPWTGDGEIPSSDSLDQVFQVNGHMTWHKDNKKFKNMKQDHECDALGKKFNLS

SEQ ID NO: 18844 - protein, 81 aa, Ovis aries
SKGSMMFRDVSVNFSQEEWECLDSGQMNLYKEVMLENFSNLVSVGLSSSKPAVISLLEQGKEPWMIDRELTRGLCSDLESM

SEQ ID NO: 18845 - protein, 81 aa, Ovis aries
HQEVVTFEDVAVYFTQTEWAGLSPAQRALYRSVMLEIYGNLTSLGYPVPKPELVSLLERGDLPVGLETQDNPPAQGTRDIY

SEQ ID NO: 18846 - protein, 81 aa, Otolemur garnettii
HFELLTFRDVTIEFSPEEWACLDPAQWNLYRDVMLENYRNLVSLGLAASKPDLITCLEQRKGPWNVKRHEVVTEHPAMSSH

SEQ ID NO: 18847 - protein, 81 aa, Vulpes vulpes
TQGRVTFEDVAVYFSWEEWGLLDEAQRCLYQDVMLENLALITSLGCWLGAEDEEAPEQRVSVQGVSQVRILKAVVSPQEAH

SEQ ID NO: 18848 - protein, 81 aa, Vulpes vulpes
MNFEDVAIDFSQEEWGLLDETQRLLYCDVMLENFALVASLDLHQQQRHDSGEKPWERDVHRASWVTSCNFGVSGQSFTCRK

SEQ ID NO: 18849 - protein, 81 aa, Vulpes vulpes
FKEMVTFKDVAVIFTEEELGLLDPAQRKLYGDVMLENFRNLLSVGHQPFTPDVMLQLERGEKLRMVKTAAWGPSASGDKNL

SEQ ID NO: 18850 - protein, 81 aa, Otolemur garnettii
ISFEDVAVDFTWEEWQLLNPTQKNLYRDVMLENYSHLIFLGYQIIKPAGIFKLEQEEAWIMDEEILSQNFSGWGDRDPGSM

SEQ ID NO: 18851 - protein, 81 aa, Otolemur garnettii
RPRAVKFVDVAVYFSPEEWGYLRPGQRALYRDVMRETYGHLGALGCAGPKPALISWLERNTDDWEPAALDPQENGRGVTVQ

SEQ ID NO: 18852 - protein, 81 aa, Vulpes vulpes
SQHLVTFEDVAVDFTQEEWTLLDQAQRDLYRDVMLENYQNLITLGYESCHPDLNSTMEVAEELRTGGRGVLQELELQLKTK

SEQ ID NO: 18853 - protein, 81 aa, Enhydra lutris
SQGSVSFEDISVDFTQKEWQLLDPAQRLLYREVMLENYRQLVSLGHCVTTPELILKLEQGEEPWVPKRELPSPSHPEVQKT

SEQ ID NO: 18854 - protein, 81 aa, Enhydra lutris
FEELVTFEDVAVYFSENEWTSLAPTQRVLYRDVMLENYGAVASLAAFPFPKPALISQLERGEAPWCKAPQGALDGEGPRGI

SEQ ID NO: 18855 - protein, 81 aa, Enhydra lutris
SQHLVTFEDVAVTFTQEEWTLLDQTQRDLYRDVMLENYQNLIILGYESCKPDLNSLMGGAEELRTGGRGILQELDLLKTKG

SEQ ID NO: 18856 - protein, 81 aa, Pongo abelii
IMEEAVTFKDVAVFFTEEELGLLDPAQRKLYRDVMLENFRNLLSMGHQPFHQDTFHFLKEETFWMMGTATQREGNSGGKIQ

SEQ ID NO: 18857 - protein, 81 aa, Pongo abelii
VASEDVAVNFTLEEWALLDPSQKKLYRDVMRETFRNLACVGKKWEDQSIEDWYKNQGRILSNHMEEGLNESKEYDQCGEAF

SEQ ID NO: 18858 - protein, 81 aa, Pongo abelii
RVQSCVTFEDVFVYFSREEWELLEEAQRFLYRDVMLENFALVATLAFIFPVPCSGAVGGGRKPWVPDRAHITAATVKETYR

SEQ ID NO: 18859 - protein, 81 aa, Macaca mulatta
ESITFGDVAIDFSHQEWEYLDLVQKTLYQEVMMENYDNLVSLAGHSISKPDLITLLEQGKEPWMIVGEETRGECTDLDSRY

SEQ ID NO: 18860 - protein, 81 aa, Callithrix jacchus
PQVSLTFEDVAVLFTRDEWRKLAPSQRNLYRDVMLENYRNLVSLGLPFTKPKVISLLQQGEDPWKVEKDSSGSPCLGLKSS

SEQ ID NO: 18861 - protein, 81 aa, Callithrix jacchus
MERFWDVAIEFSLEEWQCLDTAQRNLYKNVILENYRNLVFLGIAVSKPDLIACLEQEKEPLIMKRDEMCLPTTQSKMFLCD

SEQ ID NO: 18862 - protein, 81 aa, Macaca mulatta
TQGHLTFRDVAIEFSQEEWKCLDPVQKALYRDVMLENYRNLVSLGICLPDLSIISMLEQRRDPRNLQSEVKIANNPDGREC

SEQ ID NO: 18863 - protein, 81 aa, Macaca mulatta
MLENYCHFVSVGFHMTKPDMIRKLEQGEELWTQRIFPSYSYLEEDGKTEDVLVKFKEYQDRHSRSLIFINHKKLIKERSNI

SEQ ID NO: 18864 - protein, 81 aa, Callithrix jacchus
SQGLLIFRDVAIEFSPEEWSYLNPAQQNLYRDVMLENYRNLVSLGIAISKPDLITCLEQRNEPWSVKKCETVAKQPAISSH

SEQ ID NO: 18865 - protein, 81 aa, Bos taurus
ELVTFRDVVISFSQEEWEYLDSAQRDLYWDVMMENYSNLVSLDLESKYDTKTLSVDKVIIEKNNSQWEVIENSKLVGLQNS

SEQ ID NO: 18866 - protein, 81 aa, Bos taurus
MPGRMTFQDVAIDFTQEKWECLDLDQRELYRDVMLEKYGNLASLGLVVSKVDLVTFLEQMKDPRNISRMETMAMYPGTSTL

SEQ ID NO: 18867 - protein, 81 aa, Bos taurus
MTHSEGRLMFQDVAIDFTQEEWECLDPGQRKLYRDVMVENYRNLASLGEDNCLPESLIYPLRFCSVISRMSSELFCLPQYF

SEQ ID NO: 18868 - protein, 81 aa, Bos taurus
LQETLTFRDVFVDFTQEEWQQLDAAQKNLHRDVMLENYSHLVSVGYLVAQPHGIFRLGQGEEEARIAAGESVIWSCPEFWK

SEQ ID NO: 18869 - protein, 81 aa, Bos taurus
PAGALTQQAAFPQVPVTLEDVAVYLSQEEWGCLDLAQQDHSCDVLLEDAGAVGRPCQTPRCSWASTSSSVDGTVTAPSHRP

SEQ ID NO: 18870 - protein, 81 aa, Bos taurus
FQEPVTFEDVAVYFTQNQWASLDSAQRALYREVMLENYANVASLVSPFPRPDLISQLERGEAPWDPDPWEAEDLRGICPGG

SEQ ID NO: 18871 - protein, 81 aa, Ovis aries
ARGPITFRDVVIEFFLHEWEFLNPLQKKLYCIVMMENYSNVVSIGHFISKPDIIVLLEEERDPWMVVKEETRRWNTDLDSS

SEQ ID NO: 18872 - protein, 81 aa, Vulpes vulpes
MPQEEWQQLDPTQKALYRDVMLENYCHLISVGFHMTKPDMIRKLEQGEELWTTERIFPSQSYLEEDGKTEDVLVKFKEYQD

SEQ ID NO: 18873 - protein, 81 aa, Otolemur garnettii
SQVSLMFEDVAVLFSRDEWRKLEPSQRNLYRDVMLENYSNLISLAGLLFTKPKVISLLQQGEDPWKVEKESPPGSSLGFKS

SEQ ID NO: 18874 - protein, 81 aa, Vulpes vulpes
MLENYSNLVSLGLLFSKPKVISLLQRGEDPWKVEKESPGGPSLGWKSSHKTTKSTQTQDSSFQELIMRRSKRHGPWDFKSE

SEQ ID NO: 18875 - protein, 81 aa, Vulpes vulpes
MDFSREEWQQLDPAQRCLYQDVMLEIYSHLLFVGYNIPNPEIISRMEKGEEPWMREVQLPHQRHRERAFGLKTSQHKMFEK

SEQ ID NO: 18876 - protein, 81 aa, Vulpes vulpes
SFEGSVSFRDVAVDFSREEWQHLDLAQRNLYRDVMLETYSHLLSVGYEVPQPEVFMLEQGKEPWALQGESPHQNCTGEKLW

SEQ ID NO: 18877 - protein, 81 aa, Vulpes vulpes
MLENYGHLLFLGLIVSKPDLVSFLEQNTETWSVKRKKRVTIHPAVSSRDTQSMLSKPSIKASFQRVSMGRLKNNAIKNLHF

SEQ ID NO: 18878 - protein, 81 aa, Otolemur garnettii
MASPSPSPEPKEEWDYLDPAQRSLYKDVMMENYGNLVALDVLNRDKDEEPTVKQEIEEIEQEVEPQGVIVTRIKSEIDQDP

SEQ ID NO: 18879 - protein, 81 aa, Otolemur garnettii
GTVTFQDVAVYFSWEEWGLLDEAQRCLYRDVMLENLALITSLDVCQHQKQHFGEKYFRSIVGRTLFVKSYKFHVSGETFTC

SEQ ID NO: 18880 - protein, 81 aa, Enhydra lutris
WLQVPVTVKDVAVEFTQEEWMMLDSGQRRIYRDVMLENYANLTSLEYQLWKFIVISLSGQEEIRTMKKIILQDTYTDAEIQ

SEQ ID NO: 18881 - protein, 81 aa, Enhydra lutris
SLGPVSFRDVAVDFTQEEWQQLEPEQKTTYRDVMLENYSHLISVGCHIIKPEVIIKLEQGEEPWIVEGEFLPQSYPEEVWK

SEQ ID NO: 18882 - protein, 81 aa, Enhydra lutris
LQGSVTFQDVAVDFTPEEWQLLDCDQRTLYWDVMLENFRNLISVGGPGTKTKGIFKAEQGQEPWLGEGENPRWRCPEADCL

SEQ ID NO: 18883 - protein, 81 aa, Enhydra lutris
FTGPVSFKDVAVDFTQEEWQYLDLPQRDLYRDVMLENYINLISVGYQTTKPSVIHKLEQGEEPWMMEREIPSWSHAEEVWH

SEQ ID NO: 18884 - protein, 81 aa, Enhydra lutris
SQGSLSFRDVTVGFTQEEWQHLDPAQRTLYRDVMLENYSHLVSVGYSIPKPEVILKLEQGEEPWILEEFLSQNDPELINNS

SEQ ID NO: 18885 - protein, 81 aa, Enhydra lutris
GGAGQLNFRDVAIEFSEEEWGRLTHTQRQLYRDVMLENYGHLVFLGLITSKPDFVSFLEQKKQLWDVIRKETVVIHPGRWE

SEQ ID NO: 18886 - protein, 81 aa, Enhydra lutris
FQEAVTFKDVAVVFSEEELGLLDSTQRKLYRDVMLENFRNLVSVGHSSSKPDMISQLEREEEKLYVKEICTERGRHSDKNC

SEQ ID NO: 18887 - protein, 81 aa, Callithrix jacchus
CEVSVSFEDVTVDFSREEWQQLDSTQRRLYQDVMLENYSHLLSVGFEVPKPEVIFKLEQGEGPWTLEGETPRHSCSDGKFG

SEQ ID NO: 18888 - protein, 81 aa, Callithrix jacchus
MGPLTFMDVTVEFSLEEWQCLDIAQQNLYRDVMLENYRNLVFLNMITCLEQGIEPWNIKRYEMVAKPPVMCSHFAEDLWLE

SEQ ID NO: 18889 - protein, 81 aa, Macaca mulatta
PQAKLTFEDVAVLLSQDEWDRLCPAQRGLYRNVMMETYGNVVSLDNLKCDHTTACTQDSLSCPWECETKGENQNTDLSPKP

SEQ ID NO: 18890 - protein, 81 aa, Macaca mulatta
MLFIFNKTGIAVSKPDLITCLEQGKEPWNMERHEMVAKPPGMCCYFAQDLWPEQSIKASFQRIIPRKYEKCGHHNLQLKKG

SEQ ID NO: 18891 - protein, 81 aa, Callithrix jacchus
SYEGSVSFRDVAINFSREEWRHLDLSQRNLYWDVMLETYSHLLSVGYQVPEAEVVMLEQGNEPWALQGERPRHSCPGEKLW

SEQ ID NO: 18892 - protein, 81 aa, Macaca mulatta
NSIYTRYFDVCVDFTQEEWYLLDPAQKILYRDVILENYSNLVSVGYCITKPEVVFKIEQGEEPWILEKGFPSQCHPERKWK

SEQ ID NO: 18893 - protein, 81 aa, Macaca mulatta
WLQEPMTFKDVAVEFTQDEWMMLDSAQRSLYRDVMLENYRNLTSLEYQLCKLTVISPLDQEEIRNMEKRIPQGICPDQKIL

SEQ ID NO: 18894 - protein, 81 aa, Callithrix jacchus
KPGAVSFADVAVYFSPEEWGCLRPAQRALYRDVMRETYGHLGALGFSGPKSAFISWVEGEMEAWSPEVQDPEGESPGTVSG

SEQ ID NO: 18895 - protein, 81 aa, Macaca mulatta
GLLIFRDVAIEFSPEEWSYLDPAQQNLYRDVMLENYRNLVSLGLLVSKPDLITFLEQRKEPWNVKREETVAVQPDVFSHYN

SEQ ID NO: 18896 - protein, 81 aa, Bos taurus
MMFRDVSINFSQEEWECLDSGQMNLYKEVMLENFSNLVSHMPFCFLSDLESMCETKLLSLKKRHFSQPTFLIPHQKTINEE

SEQ ID NO: 18897 - protein, 81 aa, Bos taurus
PHGTPDVAIDFTQEKWECLDLDQRELYRDVMLEKYGNLASLGEDNCLPESLIYPLGFSSIMSRMSSEIFSNLGIYQIFHLR

SEQ ID NO: 18898 - protein, 81 aa, Bos taurus
PQDLMTFEDVAVEFTWWEWGQLDPTQKDLYWEVMLENFKNLASLGFPVSKPYMICQLEEGEEPCILEREISTGVHSDWERR

SEQ ID NO: 18899 - protein, 81 aa, Bos taurus
KESVTFKDVAVDFTLEEWRLMDPTQRDLHKDVMLENYRNLVSLELETKPTTKNTIPTEDFSKKHLSQDAIVEKLTENGLWD

SEQ ID NO: 18900 - protein, 81 aa, Bos taurus
ESVTFQDVAVDFTQEEWALLDTSQRTLFREVMLENISHLVSVVISDREDDPKKQEMLSMQHICKKDAPLISAMQWSHTQED

SEQ ID NO: 18901 - protein, 81 aa, Ovis aries
VQESVTFKDVAVLFTQDEWAQLSPAQRALYRDVMLENYSNVVSLGLLGPKPDMFSQLGKGEEWMPEDSLGGFCLDWVITPM

SEQ ID NO: 18902 - protein, 81 aa, Ovis aries
MNKSQEEWEQLEPSQRILYMDVMLENYSNLLSVEVWKADDQMETDHRNPDEQARPLVIFKDQTPTEERDNNLFGKTFNLST

SEQ ID NO: 18903 - protein, 81 aa, Ovis aries
PAQLTFKDVFIDFTPEEWDCMNPAQRTLYKDVMVETLRNLLSVDVSQIRMIKKLQTKGDSGKEEIFQRVVFGRAESHDIED

SEQ ID NO: 18904 - protein, 81 aa, Ovis aries
CSGLLSFTDISMEFSWEEWQLLDSVQKHLYRDVTLENYSNLVSVGYHGTKPDLIFKLEQGEEPWIINLEVSHQSCPDGWEK

SEQ ID NO: 18905 - protein, 81 aa, Vulpes vulpes
PLTFKDVAVVFTEEELKLLDPTQRKLYRDVMLENFRNLLSVGDKNEKVMEYIQERELKCLSYRELSYWKIWEQVSGELTGS

SEQ ID NO: 18906 - protein, 81 aa, Otolemur garnettii
FQGPLSFMDVFVDFTWEEWRLLDPAQKHLYRSVMLENYSNLVSVVWVAPMAQLSFILYSKSSWMLLSGKPRQSGKKCCESN

SEQ ID NO: 18907 - protein, 81 aa, Otolemur garnettii
LVTFRDVAINFSQEEWECLDHAQRDLYLDVMLENYSNLVSLDWESTTYETKKLFSEKDVFDINFSQWDIKEKSKTLGLEES

SEQ ID NO: 18908 - protein, 81 aa, Otolemur garnettii
LCEVPVSFEDVTVDFSREEWQHLDSTQRCLCQDVTLENYATCFQWGTVPKPEAIFQLEQGEGPWTLDGEAPHQSSSEEPWQ

SEQ ID NO: 18909 - protein, 81 aa, Otolemur garnettii
SQELLTFNDISIDFSQDEWGQLAPAHQDLYREVMLENYRNLVSVGYQLSKPSVISHLEKGEEPWMTEKEGPADPSSGLKSK

SEQ ID NO: 18910 - protein, 81 aa, Enhydra lutris
FQEAVTFKDVAVVFTREELGLLDPIQRKLYQDVMLENFRNLLSVGCEPFRSDTTLSLGREEKLWMREAETQGGGHSGFRNR

SEQ ID NO: 18911 - protein, 81 aa, Enhydra lutris
PDSVVFEDVVVDFTQEEWAMLNPSQRKLYRDVMLETFRNLVSVDDETQFKTIGSISQQDSFGEKLSNEQKIARFTKNDFWT

SEQ ID NO: 18912 - protein, 81 aa, Enhydra lutris
SQGTVTFKDVAIDFTQEEWQQLDPAQRNLYRNVMLENYNNLITVGCPFTKPDVIFKLEQEEEPWVVEEEVLRRHYPGEMWG

SEQ ID NO: 18913 - protein, 81 aa, Enhydra lutris
RDGLLSFKDISMEFTWEEWQLLDSTQKYLYRDVILENYSHLVSVGYHGTKPDLIFKLEQGEEPWIINAQVSRQSCPEGWKE

SEQ ID NO: 18914 - protein, 81 aa, Enhydra lutris
YKGPLSFEDVAIAFTKEEWQQLDRAQRTLYRDVMLENFSHLVSLGHPMSKPDVISKLEQGQEPWIVKRDIPSWIYPERETR

SEQ ID NO: 18915 - protein, 81 aa, Enhydra lutris
SSQGLLTFRDVAIEFSEEEWGLLTHTQRQLYRDVMLESYGHLLFLGLLPKPDLIMFLEQEKHLWDVKRKETRGFHSAVSSH

SEQ ID NO: 18916 - protein, 81 aa, Enhydra lutris
GGLTFEDVAVYFSQEEWRLLNEAQRRLYRDVMLENFTLLSSLGCSCRAEAAEAPFEQSISVGVSQARTPKEPRSSQKTHPC

SEQ ID NO: 18917 - protein, 81 aa, Pongo abelii
MSQVTFSDVAIDFSHEEWACLDSAQRDLYKDVMVQNYENLVSVGLSITKPYVIMLLEDGKEPWMMEKKLSKDMIPDWESRW

SEQ ID NO: 18918 - protein, 81 aa, Pongo abelii
KSQESLTLEDVAVEFTWEEWQLLGPAQKDLYRDVMLENYSNLVSVGYQASKPDALFKLDQGEPWTVENEIHSQICPEIKKV

SEQ ID NO: 18919 - protein, 81 aa, Pongo abelii
SQGLVSFKDVAVDFTQEEWQQLDPSQRTLYRDVMLENYSHLVSMGYPVSKPDVISRLEQGEEPWIIKGDISNWIYPDDYQA

SEQ ID NO: 18920 - protein, 81 aa, Pongo abelii
QGTVTFEDVAVNFTWEEWNLLSEAQRCLYRDVTLENLALISSLGCWCGVEDEEAPSKQTIYIQRETQVRTPMAGVSPKKAH

SEQ ID NO: 18921 - protein, 81 aa, Pongo abelii
FQGSVSFKDVTVGFTQEEWQHLDPSQRALYRDVMLENYSNLVSVGYCVHKPEVIFRLEQGEEPWKLEEEFPSQSFPEFICW

SEQ ID NO: 18922 - protein, 81 aa, Pongo abelii
ACGSITFRDVAIDFSHQEWEYLNLVQKTLYQEVMMENYDNLVLLAGHSKSKPDLITLLEQGKEPWMIVREETRGECTDLDS

SEQ ID NO: 18923 - protein, 81 aa, Zalophus californianus
AYGSLSFGEVAISFSQEEWECLDPAQRALYRDVMLETYSNLVSLAGSSISKPDVITLLEQEKEPWVVVRRETSRWYPDLES

SEQ ID NO: 18924 - protein, 81 aa, Carlito syrichta
QGLFTFKDVAIEFSQEEWDCLDLTQRALYRDVMLENYRNLLSLGEDNFPPEIDIFAGFANKELLPNEDINKAELCHLVILD

SEQ ID NO: 18925 - protein, 81 aa, Delphinapterus leucas
PQVLVSFEEVAVLLSQEEWGHLGPAQKRLYRDVMLETYGNLVSLGLQGSKPDVISKLEQGEEPWAPHSPRIEGSWIWRRRR

SEQ ID NO: 18926 - protein, 81 aa, Pan troglodytes
SVMGSVTFQDVAIDFSKEEWGFLNPAQRDLYTTVMLENYQNLVWLGLSISKSVISLLEKRKLPWIMAKEEIRGPLPGYFKV

SEQ ID NO: 18927 - protein, 81 aa, Zalophus californianus
SHGPLSFEDVAIAFTKEEWQQLDPAQRTLYRDVMLENFSHLVSLGHPVSKPDIISKLEQGEEPWIIKRDISDWICPERETR

SEQ ID NO: 18928 - protein, 81 aa, Balaenoptera acutorostrata
FQEPVSFKDVAVVFTEEELGLLDSAQRKLYRDVMLENFRNLLSVGNQPFKPELIFQLEREEELLMMETETQRDGCSGTKSQ

SEQ ID NO: 18929 - protein, 81 aa, Balaenoptera acutorostrata
SQGSMSFRDVTVGFTQEEWQHLDPAQRMLYRDVMLENYHNLVSVGYFITKPKVIFKLEQGEEPWILEEEFLYRSFPEDCKT

SEQ ID NO: 18930 - protein, 81 aa, Balaenoptera acutorostrata
PQGSVSFKDVTVDFTQEEWQQLDPAQKALYRDVMLENYCHLISVGFHMTKPDMIHKLEQGKELWTTEKIFPSQSYLEEDWK

SEQ ID NO: 18931 - protein, 81 aa, Ovis aries
PLTFEDVALYFSEEEWLIMDPNQRTLYLDVMQELYENVTSLGLKLKNDTGNDPPVSLPTLEIQPSGCEVVRKATMKDAETT

SEQ ID NO: 18932 - protein, 81 aa, Callorhinus ursinus
SKGSMMFRDVSINFSQEEWECLDSGQMNLYKEVMLENFSNLVSVGLSVSKPAVISLLEQGKEPWMVERALTRGLCSDLESM

SEQ ID NO: 18933 - protein, 81 aa, Callorhinus ursinus
SQSLLTFEEVAMYFSQEEWELLDPTQKALYNDVMRENYETVISLALFVLPKPKVISYLEQGEDPWVQGPLELKNSPGELPS

SEQ ID NO: 18934 - protein, 81 aa, Phyllostomus discolor
AQGLVTFRDVAIEFSQEEWKCLKPAQRDLYRDVTLENFGNLVSLGLSFSKPDVISLLEQGKEPWMITNDITGPWCPDLESR

SEQ ID NO: 18935 - protein, 81 aa, Camelus dromedarius
LPSSKVPAFSDKDSLGDEMLAAALLKAKAQELVTFEDVAVYFIRKEWKRLEPAQRDLYRDVMLENYGNVFSLDLQIDTLQV

SEQ ID NO: 18936 - protein, 81 aa, Ursus maritimus
MLENYGAVASLAAFPFPKPALISQLERGEAPWCKAPQGALDGEGPRGISSGCPFLKPAGISHLEQVEEPLNPKLQGEVPSL

SEQ ID NO: 18937 - protein, 81 aa, Rhinopithecus bieti
AHALVTFRDVAIDFSQKEWECLDTTQRKLYRDVMLENYSNLVSLGYSGSKPDVITLLEQGKEPCVAVRDVTGTQYPGLLSR

SEQ ID NO: 18938 - protein, 81 aa, Acinonyx jubatus
SQGLLIFRDVAIEFSQEEWGCLNHSQREVYRDVMLENYGHLLFLGHIVSKLDLVIILEQKKESWNVKQKERVATHLGRWRI

SEQ ID NO: 18939 - protein, 81 aa, Rhinopithecus roxellana
MEGLVMFQDLFIDFSQEEWECLDAAQKDLYRDVMMENYSSLVSLDSEFRCKTKDSCLLKEIYEVTSSQWMRMEKCHSLVGS

SEQ ID NO: 18940 - protein, 81 aa, Rhinopithecus roxellana
YQDLVIFEDTTVDFTQEEWTLLDPVQRNLYRDVMLENYENVAKVGFQLLKPSVISWLEEEELRTLQQGVLQDWAIKHQTSV

SEQ ID NO: 18941 - protein, 81 aa, Rhinopithecus roxellana
SLLTFSDVAIEFSQEEWKCLDPVQRTLYRDVMLENYRNLVSLDISSKCMLKTSSTGKDNTEVIHTGTLQRQASHHTGEFCL

SEQ ID NO: 18942 - protein, 81 aa, Rhinopithecus roxellana
IQGPLKFTDVAVEFSQEEWKCLDPVQRTLYRDVMLENYRNLVSLGICLPDLSVISMLEQKKDPWILQSEEKIANNPDGREC

SEQ ID NO: 18943 - protein, 81 aa, Rhinopithecus roxellana
PLTFKDVAIEFSQEEWKCLDPVQKALYKDVMLENYRNLVFLGISPKCVIKELPPTENSNTGERFQTVALERHQSYDIENLY

SEQ ID NO: 18944 - protein, 81 aa, Rhinopithecus roxellana
MDPTQRNLHKDVMLENYRNLVSLGLAVSKPDMISHLENGKGPWVTMREISRIPYPDIEPKRATKNTTQTKDTSEDLSQEAV

SEQ ID NO: 18945 - protein, 81 aa, Acinonyx jubatus
PKVPVTFDDISIYFSTPEWEKLEEWQKELYKNIMKGNYESLISMDYAMNQPDVLSQIQPEGEHNTEEQAGPEESEIPTDPS

SEQ ID NO: 18946 - protein, 81 aa, Cebus imitator
NAQESLTLEDVTVEFTWEEWQLLDPFQKDLYRDVMLEIYSNLVSVGFQVSKPDALSKLGQGEPWIIEDERHSRICPENNKV

SEQ ID NO: 18947 - protein, 81 aa, Cebus imitator
GTVTFEDVAVNFTWEEWNLLSEAQRCLYRDVMLENLALTSSLGCWCGVEDEEAPSKQSIYVQRETQVRTPTAGVSSKKAHP

SEQ ID NO: 18948 - protein, 81 aa, Callithrix jacchus
KESVSFRDVAVDFTQEEWGQLDSPQRALYRDVMLENYQNLLALGAGPPLHKPDVISHLERGEEPWCVQRDVPGGPCPEWEM

SEQ ID NO: 18949 - protein, 81 aa, Macaca mulatta
PQGLVTFGDVAVDFSQEEWEWLNPNQRNLYRKVMLENYKNLASLGKGDCISPDVISSLEQGKEPWTVKRKMTRAWCPDLKI

SEQ ID NO: 18950 - protein, 81 aa, Callithrix jacchus
WLQEPMTFKDIAVEFTQEEWIMLDSSQRSLYKDVMLENYRNLTSVEYQLCKLTVISPLHQEEIRSMNKINPQAICPDQKIQ

SEQ ID NO: 18951 - protein, 81 aa, Callithrix jacchus
MNKIHVIFNKTGIAASKPDLITCLEQGQEPWNVKRHEFEAKLPVASSYFAQDFWPKQDIKNHFQKLILRRYKKCGHENFQL

SEQ ID NO: 18952 - protein, 81 aa, Macaca mulatta
MLENYSNLVFLGIVVSKPDLITRLEQGKKPLTVKRHEMVAKPPVMCSHFAQDLWPEQNMKDSFQKMIPRRYEKRGHENVQL

SEQ ID NO: 18953 - protein, 81 aa, Callithrix jacchus
NMTQVTFEDVVVDFTQEEWGQLEPAQRTLYYDVILGTFRLLVAVGHWLPKLNIISLLEQEAELRAVDPGVPQGVYQDLESR

SEQ ID NO: 18954 - protein, 81 aa, Macaca mulatta
MLFIFNKAGIDVSKPNLITCLEQGKYPWNMKRHSMVVKPPVICSHFAEDLCPGPGIKDSFQKVILREYVKCGHKDLQLRKG

SEQ ID NO: 18955 - protein, 81 aa, Macaca mulatta
SLKKVTFEDVAIDFTQEEWAMMDTSKRKLYRDVILENVSHLVSLGYQISKSYITLQLEQGKELWREGREFLQGQNLDKESA

SEQ ID NO: 18956 - protein, 81 aa, Macaca mulatta
EMGLLTFRDIAIEFSLEEWQCLDRAQRNLYRDVMLENYRNLVSLGIAVSKPDLIACLEQNKEPRNIKRNEMVSKHPVTCSH

SEQ ID NO: 18957 - protein, 81 aa, Macaca mulatta
MTFKDVAVVFTEEELALLDLAQRKLYQDVMLENFRNLLSVGEDRHQAFHRDTFHFLREEKIWMMKTATQREGDSGDKIQTE

SEQ ID NO: 18958 - protein, 81 aa, Callithrix jacchus
PSGSQGVLTFMDVAIEFCLEEWQCLDTAQHDLYRNVMLENYRNLIFLGIAASKPDLITCLEQGKLPWNVKRHEMVAEPPGS

SEQ ID NO: 18959 - protein, 81 aa, Monodon monoceros
MTRHSISKPDVISFLEQGKEPWLVDRELTRDQWPVLESRCETKKLFLKKEIYEIESAQWEIMERLTRHDLQCSSFRDDWEC

SEQ ID NO: 18960 - protein, 81 aa, Macaca mulatta
FQGSISFKDVTVGFTQEEWQHLDPSQRALYRDVMLENYSNLVSVEVWTADHLKERSQENQSKHLWEVVFINNEMLTKEQGD

SEQ ID NO: 18961 - protein, 81 aa, Macaca mulatta
EAVTFNDVAVAFTEEELGLLGPAQRKLYRDVMVENFRNLLSVGHQPFKQDVSPVERNEQLWIVTTATQRQRNLGEKNQSKL

SEQ ID NO: 18962 - protein, 81 aa, Monodon monoceros
CPQDSTWCVEKTPEERRRAPRLPTAQAQVSETFVSQPHLFVSTAGNKIAKPEVISLLEQGEEPWSVEQAYPPQGACPEWVR

SEQ ID NO: 18963 - protein, 81 aa, Bos taurus
PQAKVTFEDVAVFLSQDEWDRLGPAQRGLYRHVMMETYGNVVSVGIPGSKPEVISQLERGEEPWVLDKQGNEHKGSHHSKK

SEQ ID NO: 18964 - protein, 81 aa, Ovis aries
PLESVTFEDVAVDFTQEEWSLLDKSQKNLFRNVMLETVTHLVSVGYQISKSDVIFQLEQGKELWPEAAGGLQGQSPDEVTP

SEQ ID NO: 18965 - protein, 81 aa, Ovis aries
MLENYRNLASLGLVVSKPDLVTFLEQMKNPWDVRRLETPAQIHTGKKPYECKECEKAFMCYSNLSRHQRIHTGERPYECTE

SEQ ID NO: 18966 - protein, 81 aa, Ovis aries
SLGSVSFRDVAVDFTQEEWQHLDPEQKTTYRDVMLENYSHFISVGCHIIKPEVITKLEQGEEPWVVEGEFLLQSHSEVWKV

SEQ ID NO: 18967 - protein, 81 aa, Ovis aries
MLENYTNITSLAFPFPKSDLIFWLERGEEPGRLDPWTLVGREHPRGTCRGRETKTENGGQTAELSISKGPESHKLITEVLL

SEQ ID NO: 18968 - protein, 81 aa, Ovis aries
LSQAQLTFKDVFLDFTPEEWECLDPAQRTLYKDVMVEILRNLLSVVSTSAECLRRSLEEGRKRVRNGSFLGNVLHPLTALQ

SEQ ID NO: 18969 - protein, 81 aa, Ovis aries
ARGPVTFRGMVIEFFPHEWEFLDSLQKKLYRDVMMENYSNLVSLGHSISKPDIIVLLEEGRNPWMVVRKETRSWNTDLDSS

SEQ ID NO: 18970 - protein, 81 aa, Ovis aries
QGSLSFRDVAVGFTRKEWQELDPTQRTLYRDVMLENYSHLVSVGTGCQVTKPAVISRLEQGQEPWMEEEEILRWSFPGKIS

SEQ ID NO: 18971 - protein, 81 aa, Ovis aries
QLTFEDVAIEFTQEEWEFLDRAQRALYRDVMLETYRNLLSVDISPTYVIKHLQPKANSDKQETFQTLMPGRPESCEIKHFH

SEQ ID NO: 18972 - protein, 81 aa, Vulpes vulpes
ERGSVTFKDVTMAFTQKEWEQLDPAQRSLYKDVMLENYSNLASMGYQAPKPDMISKLEKGEEPWLGKGKRLQQSGPGEIAR

SEQ ID NO: 18973 - protein, 81 aa, unidentified
  REGION 1..81: note = Bos indicus x Bos taurus
RHLSFVFQGRLTFQDVAIDFTQEEWECLDLSQRELYRDVMLENYRNLASLGEDNCLPESLIYPHGFGSCISRMSPRMFCFL

SEQ ID NO: 18974 - protein, 81 aa, Cebus imitator
PARGMTFEDVAIYFSQEEWELLDEAQRFLYCDVMLENFAHITSLGYCHGTENEAIASEQSVSVGGKLQVRTSQGDTPTQKT

SEQ ID NO: 18975 - protein, 81 aa, Macaca mulatta
EAVTFKDVVVVFTEEELGLLDLAQRKLYRDVMLEIFRNLLSVGHQPFHRDTFHFLREEKFWMMDIATQREGNSGGKIQPEM

SEQ ID NO: 18976 - protein, 81 aa, Callithrix jacchus
SLGSVTFTDVAIDFSQDEWQWLNLAQRSLYKKVMLENYRNLVSVGLCISKPDVISLLEQEKDPWVIKGELTRGLCSDLEYV

SEQ ID NO: 18977 - protein, 81 aa, Macaca mulatta
ACESITFGDVAIDFSHQEWEYLNLVQKTLYQEVMMENYDNLVSLGHSISKPDLITLLEQGKEPWMIVGEETRGECTDLDSR

SEQ ID NO: 18978 - protein, 81 aa, Macaca mulatta
GSVTFEDVAVYFSWEEWDLLDEAQKHLYFDVMLENFALTSSLGCWHGVEHEETPSEQRISVEGVPQFRTSKEGSSSQHAYS

SEQ ID NO: 18979 - protein, 81 aa, Callithrix jacchus
RLSAQGTVTFEDVAVNFTWEEWNLLSEAQRCLYRDVMLENLALTSSLETGFHHVEQVWISPRDPPVSAPQSAGIIGTSHCA

SEQ ID NO: 18980 - protein, 81 aa, Callithrix jacchus
EGLLTFRDVAIEFSLEEWQCLDAAQRNLYKNVILENYRNLVFLVMCSHFAQEFWPEQNIKDSSQNMTLRRYEQCGNENFQL

SEQ ID NO: 18981 - protein, 81 aa, Bos taurus
NKGSLSFEDVTVGSTQEEWQKLDPAQRTLYRDVMLENYSHLISVGYCIPKPELIFKLEQGEQPWVLEAGSPSQSYPEVCRI

SEQ ID NO: 18982 - protein, 81 aa, Bos taurus
QEGVNFKIVTVDFTQEEEGTLSSAQRTLDRDVILENHGDSWDLATALGRRESRLKQSVFDDKLSHSVKIEKLTRDDPWLSS

SEQ ID NO: 18983 - protein, 81 aa, Bos taurus
EQGLMAFEDVAVHFSQEEWGLLDTAQRALYRRVMLENFALLASLGLSVSRPRVVTQLECGNEPWVLSGADVTLAWDAQRRP

SEQ ID NO: 18984 - protein, 81 aa, Ovis aries
MLETYNHLVSLDILFSKLELICQLEQGEKPWIEERQRSLGLCPAGSKLEIAPCLTCRLAFSCQQALIQHVWFSHLPQLFSS

SEQ ID NO: 18985 - protein, 81 aa, Ovis aries
MKKFCEWQKLDPAQRTLYRDVMLENYSHLISVGYCIPKPELIFKLEQGEQPWVLETESPSQSYPEVCRIVNQLEQSQEMHN

SEQ ID NO: 18986 - protein, 81 aa, Ovis aries
PRVPVTFDDVAVYFSEPEWGKLDEWQKELYKHVMRGNYETLVSLDYAISKPDILTRMERGEEPCPEGPWGREEGNEREEAC

SEQ ID NO: 18987 - protein, 81 aa, Vulpes vulpes
SQESVTFADVAVDFTQEEWTLLDRSQRQLFRDVMLENISHLVSIGKQLYKSDTISHLEPGVKLSKEGISLLQCQSLDKEDG

SEQ ID NO: 18988 - protein, 81 aa, Otolemur garnettii
SLGCLTFRDVAIEFSQEEWQCLDPAQRALYRAVMLENYRNLVSLGLLLPDLTVLSMLKEGKEPWTVETKVKTPRNSNKGEW

SEQ ID NO: 18989 - protein, 81 aa, Vulpes vulpes
QLTFKDVAIKFSEEEWECLDSAQRALYRDVMLENYRNLVSLDSSASFMIKELLPKKEINNRRLCQPVVLGRQESHDLEDFD

SEQ ID NO: 18990 - protein, 81 aa, Otolemur garnettii
PKVPVAFDDVSIYFSAPEWEKLEEWQKELYKNIMKGNYESLISMDYAMNQPDVLSQIQPEGGQNTVDQAGPEESEIPADPS

SEQ ID NO: 18991 - protein, 81 aa, Otolemur garnettii
MGMLTFKDVWIEFSMEEWACLDPAQQHLYQEVMLETYRILVFLGLAVSKPDLIPCLEQSKEPWKVKTPQTLLNYPALSKHS

SEQ ID NO: 18992 - protein, 81 aa, Otolemur garnettii
QNLLTFWDVAIEFSPEEWARLDIAQRNLYRDVMIENYRNLVSLGLAASKPDLIRCLEQSKEPWNVKRVEATAKHPEMSSHY

SEQ ID NO: 18993 - protein, 81 aa, Otolemur garnettii
QGLLTFKDVSIEFSMDEWACLDPAQQTLYRDVMLENYRHLVFLGLTLSKPDLITCLEQSKQPWKVKTHQTVVKHTAISYHS

SEQ ID NO: 18994 - protein, 81 aa, Vulpes vulpes
WKELLSFDDVAMYFTREEWNRLDWAQKDLYRDVMLENYRNMILLGFQFPKPEVICLLEQWEEPWILDLPRAGTRKATSSTC

SEQ ID NO: 18995 - protein, 81 aa, Vulpes vulpes
SLDSVTFTDVAIDFSQDEWEWLNLAQRILYKRVMLENYRNLVSLGLCISKPDIISLLEQGKEPWMMKGEMTRDLYPDLKYV

SEQ ID NO: 18996 - protein, 81 aa, Otolemur garnettii
QVLMAFRDVAVAFTLKEWKLLSPAQRSLYREVMLENYSHLVSLGIAFSKPKLIIQLEQGDEPWREENECHLDLYLGEWEAL

SEQ ID NO: 18997 - protein, 81 aa, Vulpes vulpes
PKVPVTFDDVAVYLSEQEWGKLDEWQKELYKHVMRGNYETLVSLDYAISKPEVLSQTEQGKEPCSWRRPGPKVPDVPVDPS

SEQ ID NO: 18998 - protein, 81 aa, Enhydra lutris
SQVSVTFEDVAVLFTRDEWRKLGPSQRNVYQEVMLENYSNLVSLGLLFSKPRVISLLQEGEDPWKVEKESPGGPSLGWNSS

SEQ ID NO: 18999 - protein, 81 aa, Macaca mulatta
QEPLSFKDVAVVFTEEELGLLDSTQRQLYRDVMLENFRNLLSVGERNPPGDKNGRDMEYIQDEELRLFSHKELSSCKIWEE

SEQ ID NO: 19000 - protein, 81 aa, Callithrix jacchus
MGQLTFNDVIIEFSLEEWQCLDKTQQNFYRDVMLENYRNLVFVGIAVSKPDLITCLKEGKEPWSMRRHEMVTKPPAMCSHF

SEQ ID NO: 19001 - protein, 81 aa, Callithrix jacchus
GKELLSFEDVAMYFTREEWGHLDWSQKDLYRDVMLENYRNMVFLGFQFPKPEVICQLENWDEQWILDLPRAGNRKASGSAC

SEQ ID NO: 19002 - protein, 81 aa, Macaca mulatta
SYEGSVSFRDVAINFSREEWQHLDLSQRNLYRDVMLETYSHLLSVGYQVPKPEVVMLEQGKEPWALQGERPRQSCPGEKLW

SEQ ID NO: 19003 - protein, 81 aa, Macaca mulatta
VHGSVTFRDVAIDFSQEEWECLQPDQRTLYRDVMLENYSHLISLDLESKHGPEKISPENDIFEINLPKRVIKQISKTLGLE

SEQ ID NO: 19004 - protein, 81 aa, Bos taurus
AGLPFSKPEVISLLQQGEDPWKVEKESPGDSSLECKSSPKTTKATQTQDSSFSGLIRKTLKKDEPWNFISENPCIYEDRIK

SEQ ID NO: 19005 - protein, 81 aa, Bos taurus
PQEPVTFEDVAVYFTQNQWASLDSAQRALYREVMLENYENVASLVSPFPRPDLISQLERGEAPWDPDPWEAEDLRGICPGG

SEQ ID NO: 19006 - protein, 81 aa, Ovis aries
PKVPVSFEDVAMYFTKTEWKLLDHRQRKLYKQVMLENYHHLVSLGCLSSKPQLVIQLEQGEKPWVADVHRMRITTGMQAGD

SEQ ID NO: 19007 - protein, 81 aa, Ovis aries
EAPKVPFDDVAVYFSEQEWGKLDEWQKELYKHVMRGNYETLVSLDYAISKPEVLTQTEQGKEPCWRRAGPKVPDVPVDPSP

SEQ ID NO: 19008 - protein, 81 aa, Otolemur garnettii
VLEELVTFEDVAVYFTLTEWAGLSPSQRALYRSVMLENYENLTTVGYPLPKPVLISLLEEGPWDLEAQVEPIAEGTRDICK

SEQ ID NO: 19009 - protein, 81 aa, Otolemur garnettii
TQGRLTFRDVTIEFSQEEWQCLDPAQRALYRAVMLENYKNLVSLGLLLPDLTVLSMLEEGKEPWTVETKVKTRNSNKGEWI

SEQ ID NO: 19010 - protein, 81 aa, Vulpes vulpes
RESGKAPVTFDDITVYLLQEEWMLLSQQQKEICGSDKLVAQLGPTIANPELFYKFERGPEPWLGNVQGQRTLLSHHPGKNK

SEQ ID NO: 19011 - protein, 81 aa, Vulpes vulpes
GTVTFEDIAMYFSWEEWDLLDEAQRHLYQDVMLENLALITSLGCEHGAEDEKAPSEQSISVEGISQVRIPKTGLLSQKANP

SEQ ID NO: 19012 - protein, 81 aa, Enhydra lutris
MFKDVAIDFTLEEWRLMDPSQRKRKLHKDVILENYRNLFSLGLAVSKPDMISHLEAGKGPWVVVREIARTPYPELETKPAT

SEQ ID NO: 19013 - protein, 81 aa, Enhydra lutris
LRAGQLTFMDVAIEFSEEEWGCLTHTQRELYRVVMLENYRHFCFLGLIGSKPDLVSFLEQNKFWDVTRKETVAFHPAVSSH

SEQ ID NO: 19014 - protein, 81 aa, Enhydra lutris
WSQMPVTFEDVALYLSREEWGRLDHAQQSFYRDVLQKRNGLSLGFPFSRPLWGSQGQGKGEASSSCQQMGDDKEKAGVCRG

SEQ ID NO: 19015 - protein, 81 aa, Enhydra lutris
KPGAVNFADVAVYFSPEEWGCLRPAQRALYRDVMRETYGHLGALGFPGPKPALISWMEQESEAWSPAAQDPEEGESLGGAL

SEQ ID NO: 19016 - protein, 81 aa, Enhydra lutris
YRRSLSFRDVAVGFTRKEWQQLDPTQRMLYRDVMLENYSHLVSVGYQVTKPAVISRLEQGQEPWMEEEEILRWSFPEEILQ

SEQ ID NO: 19017 - protein, 81 aa, Pongo abelii
DPEQVTFEDVVVDFSQEEWGQLKPAQRTLYRDVMLDTFRLLVSVGHWLPKPNVISLLEQEAELWAVDSGLPQGVYPEIKGH

SEQ ID NO: 19018 - protein, 81 aa, Pongo abelii
EMGPLTFRDVAIEFSLEEWQCLDTAQRNLYRKVMFENYRNLVFLGIAVSKPHLITCLERGKEPWNRKRQEMVAKPPVIYSH

SEQ ID NO: 19019 - protein, 81 aa, Pongo abelii
QEVLTFRDVAIELSLEEWQCLDTAQRNLYRKMMLENYRNLVFLGIAASKPDLITCLEQGKEPWNVKRHEMVAEPPVVCSYF

SEQ ID NO: 19020 - protein, 81 aa, Pongo abelii
MAVSEPEASAAKEWKQLDPAQRNLYNDVMLENYSNQASMGCQAPKPDMISKLEKGEAPWLGKGKRPSQGCPSKIARSKQKE

SEQ ID NO: 19021 - protein, 81 aa, Pongo abelii
PQKSVTFEDVAVYFTQAEWDGLSPAQRTLHRDVMLENYGNVASLGFPLLKPAVISQLEGGGELGGPSPLAAGRGLQGLRTV

SEQ ID NO: 19022 - protein, 81 aa, Pongo abelii
IYFSQEELELLDYTQKTLYNDVMQENYKTIISLALFVLPKPKVISCLEQGEEPWVQVSPEFKDSAGKSPTGLKLKNDTENH

SEQ ID NO: 19023 - protein, 81 aa, Callithrix jacchus
SKDLVTFGDVAVNFSQEEWEWLNPAQRNLYRKVMLENYRTLVSLGVSVSKPDVISLLEQGKEPWMVKKEGTRSSCPDWEYV

SEQ ID NO: 19024 - protein, 81 aa, Macaca mulatta
QEEWALLDPAQRTLYRDVMLENCRNLASLGCRVNKPSLISQLEQDKKVMTEERGILPSTCPDLETLLKVKWLTPKKHVFRK

SEQ ID NO: 19025 - protein, 81 aa, Macaca mulatta
AVDFTQEEWQYLNPPQRTLYRDVMLETYSNLVFVGQQVTKPNLILKLEVEEYPAEGKIPFWNFPEVCQVDEQIERQHQDDQ

SEQ ID NO: 19026 - protein, 81 aa, Bos taurus
IGRLTFQDVAIDFTQEEWECLDLDQRELYRDVMLQNYGNLLACLGDDRFLPESLVYPLGFGSIISRMFLKFLIIHYAGKLF

SEQ ID NO: 19027 - protein, 81 aa, Bos taurus
RMTFQDVAIDFTQEKWECLDLDQRELYRDVMLEKYGNLASLGEDNCLPESLIYPLGFISTANTHSDNSEHRLRCENSQSKQ

SEQ ID NO: 19028 - protein, 81 aa, Bos taurus
AWLEAKVTFEDVAVFLSQDEWDRLGPAQRGLYRHVMMETYGNVVSVGSKPEVISQLERGEEPWVLDKTWVPWTEKVCPPQR

SEQ ID NO: 19029 - protein, 81 aa, Bos taurus
VQGSVSFEDVAVGFSQEEWQILGPSQKALYWDVMLENYCNLVSVGYQAPTPNSLFQLEQGGPPWTVEGAALSSTCSGYQAT

SEQ ID NO: 19030 - protein, 81 aa, Ovis aries
CQDPVTFEDVAIVFTDEEWRSLVPTQRDLYKEVMLENYKSIVSLGLPIPGPDVIFQLKRGDEPWLVEFHEFEGKEGAENVS

SEQ ID NO: 19031 - protein, 81 aa, Ovis aries
LQGPMSFKDVAVEFTQEEWMMLDSAQRSMYRDVMLENYINLTLVEYQLCKPVISLLGQEDIRTVISRIPQGTCSDWEIQFK

SEQ ID NO: 19032 - protein, 81 aa, Bos taurus
QAQETLTFDDVAVGFTWEEWQLLAPAQKALYRDVMLENYSNLVSAGFQASTPEVVSKLDQGEPWMMDDETHCQTRSEVWKF

SEQ ID NO: 19033 - protein, 81 aa, Ovis aries
SQESVKFRDVAVVFSPDQWAHLSPKKRELYRDVMLETCDHLVSLGHWAYKAEVMSSLRQGKEPWILEKEVTSAPCPACQPA

SEQ ID NO: 19034 - protein, 81 aa, Ovis aries
QGGVTFEDVAVDFTQEEWQQLSPEQRGLYRDVTLENYRNLASMGTGGEDFAKPEVILRLENGEEPWMVETQVLRSCGPAEK

SEQ ID NO: 19035 - protein, 81 aa, Ovis aries
GFGRLTFRDVAIDFAQEEWECLDLGQRELYRDVMLENYRNLASLGLVVSKLDLVTFLENIRRMETIPVYTAASSLHTQCVM

SEQ ID NO: 19036 - protein, 81 aa, Ovis aries
FQGFLTFGDVAVHFTQEEGACLDAGQRTLYRDVMLETYRNLVSLGVPGSKSDLISQLEQGREPWGSDLLGAQEAEPARDAG

SEQ ID NO: 19037 - protein, 81 aa, Ovis aries
LQGGVTFEDVAVDFTQEEWQQLSPEQRGLYRDVTLENYRNLASMGGEDFAKPEVILRLENGEEPWMVETQVLRSCGPAEKD

SEQ ID NO: 19038 - protein, 80 aa, Vulpes vulpes
MASSQGLLTFRDVAIEFSQEEWGCLNHTQRELYRDVMLENYGHLLFLGLVWKPDFIIFLVEEKQLWDVKRKETVPFHPGR

SEQ ID NO: 19039 - protein, 81 aa, Vulpes vulpes
GQGSVSFRDVTVEFTRDEWLQLTGTQKTLYRDVMLENYSHLVSVGCHLTKPEVIFRLEQGEDLWPSEGEFPDQGDQDRSEE

SEQ ID NO: 19040 - protein, 81 aa, Otolemur garnettii
TKFAVTFKDVAVIFTKEELGLLDTIQRKLYQDVMLENFRNVISVGYPSFKPDGISQLEREEKLWMMKMATQSHHSLGGKNL

SEQ ID NO: 19041 - protein, 81 aa, Otolemur garnettii
SQELLTFKDISVDFTQEEWRQLAPAHRNLYREVMLENYGNLVSVAGYQLSKPGVISQLEKGKEPWLMEGQNVGCLSSGLKN

SEQ ID NO: 19042 - protein, 81 aa, Otolemur garnettii
QALLTFRDVSIEFSMDEWACLDPAQQNLYRDVMLETYRHLVFLETGLAVSKPDLITCLEQSKEPWKVKTQQTVVKHPVILN

SEQ ID NO: 19043 - protein, 81 aa, Otolemur garnettii
KPGSLRFADVAVYFSLEEWGCLRPAQRALYRDVMRETYGHLGALGFLGPKPALISWMEQESEAWSPAAQDPEEGESLGGAR

SEQ ID NO: 19044 - protein, 81 aa, Otolemur garnettii
SQTLVTFEDVLVDFTREEWKLLDAAQQIMYKDVMLENYKNLLSLGHQLPKPDVILQLEKGEEPLLVERGIHQETHPDLETT

SEQ ID NO: 19045 - protein, 81 aa, Otolemur garnettii
FQDLVMFRDVAVDFSQEEWECLNSYQRNLYRDVILENYSNLVSLAGCSISKPDVITLLEQGKEPWMVVRDEKRRWSLDLDS

SEQ ID NO: 19046 - protein, 81 aa, Otolemur garnettii
QALVSFEDVAVTFTGEEWGHLDLAQRTLYQEVMLETCRLLVSLGTGHPVPKAELIYLLEHGQELWTVQRGLPPSTCPGEKQ

SEQ ID NO: 19047 - protein, 81 aa, Otolemur garnettii
NFWILRLPPGNKGEAPKEWGKLEDWQKELYKHVMRGNYETLVSLDYAISKPEVLSQIEQGKEPCSWRRTGPKIPDVPVDPS

SEQ ID NO: 19048 - protein, 81 aa, Vulpes vulpes
AQASLSFEDVAVSFSWEEWQLLTLSQKDLYWDVMLENYNNLVSLGYQASKQDSLFQLEQGGLPWTVEGVAHSQTCPEEIWE

SEQ ID NO: 19049 - protein, 81 aa, Enhydra lutris
RPELVTFEDVAVYFSENEWTSLAPTQRVLYRDVMLENYGAVASLAFPFPKPALISQLERGEAPWCKAPQGALDGEGPRGIS

SEQ ID NO: 19050 - protein, 81 aa, Enhydra lutris
GLLTFRDVAIEFSEEELGRLTHTQRQLYRDVMLENYGHLHFLGLLLSKPDLIMFLEQEKQLWDVKRKETGGFHPALSSHDT

SEQ ID NO: 19051 - protein, 81 aa, Enhydra lutris
CEVSVSFEDVTVDFSKEEWQQLDPAQRRLYRDVTLENYSHLRSVGCLVPKPEVIFKLEQGEGPWTLEGETPHQSWSDEDIG

SEQ ID NO: 19052 - protein, 81 aa, Enhydra lutris
FQEAVTFKDVAVVFSEEELGLLDSTQRKLYRDVMLENFRNLVSVGHSSSKPDMISQLEREEEKLYVKEICTERGGRNPNEV

SEQ ID NO: 19053 - protein, 81 aa, Enhydra lutris
MLENYSNLVSLGYQDSKPDIIFTLEQEEPWMMLAQIPSQGHPEKVGEIDRMEWHQENQGKLESMAKGYECTTFGKLCLLST

SEQ ID NO: 19054 - protein, 81 aa, Enhydra lutris
QDSVTFEEVAVDFSQEEWALLDPAQKTLYRDVMLENYRNLASVGYPLCKPSLIMEVEQEVLGTEEGAILQGACTDWDIQLK

SEQ ID NO: 19055 - protein, 81 aa, Enhydra lutris
FQEAVTFGDVAVHFSREEWQCLDPGQRALYKEVMLENHSSVAGLGFLVFKPELISRLEQGQEPWVLDLKGVEGREGARTFL

SEQ ID NO: 19056 - protein, 81 aa, Pongo abelii
ANVSLAFRDVSIDLSQEEWECLDPVQRDLYKDVMLENYSNLVSLGYTIPKPDVITLLEQEKEPWIVMREGTRNWYTDLEYK

SEQ ID NO: 19057 - protein, 81 aa, Pongo abelii
QGLLTFRDVAIEFSQEEWKCLDPAQRTLYRDVMLENYKNLVSLDISFKCMVKEFSSIGKGNTEVFHTRTLQRLASHHIGEC

SEQ ID NO: 19058 - protein, 81 aa, Pongo abelii
LVMFQDLSIDFSQEEWECLDTAQKDLYRDVMMENYSSLVSLDSKFRCKTKDSCLPKEIYEVISSQWVRMEKCHSLVGSSVR

SEQ ID NO: 19059 - protein, 81 aa, Pongo abelii
PQVSLTFDDVAVLFTRDEWRKLAPSQRNLYRDVMLENYRNLVSLGLSFTKPKVISLLQQGEDPWKVEKDSSGNSSLGSKSS

SEQ ID NO: 19060 - protein, 81 aa, Pongo abelii
EMGPLTFMDVAIEFCLEEWQCLDTAQQNLYRNVMLENYRNLVFLGIAVSKPDLITCLEQEKETWEPMRRHEMVAKPPVMCS

SEQ ID NO: 19061 - protein, 81 aa, Pongo abelii
ARGKSKSKAPVTFGDLAIYFSQEEWEWLSPIQKDLYEDVMLENYRNLVSLGLSFRRPNVITLLEKGKAPWMVEPVRRRRAP

SEQ ID NO: 19062 - protein, 81 aa, Pongo abelii
QQGYVTFEDVAVYFSQEEWRLLDEAQRLLYCNVMLENFTLLASLGLASSKTHEITQLESWEKPFMPTWEVVTSATWRGCWH

SEQ ID NO: 19063 - protein, 81 aa, Pongo abelii
PQESVAFEDVAVYFTTKEWAIMVPAERALYRDVMLENYEAVAFVVSPTSKPALVSHLEQGKESCFTRPQGVLSRNDWRAGL

SEQ ID NO: 19064 - protein, 81 aa, Pongo abelii
SQESLTFKDVFVDFTLEEWQQLDSAQKNLYRDVMLENYSHLVSVGYLVAKPDVIFRLGPGEESWMADGGTPLRTCAGEDRP

SEQ ID NO: 19065 - protein, 81 aa, Pongo abelii
QGRLTFRDVAIEFSLAEWKYLNPAQRALYREVMLENYRNLEAVDISSKCMMKEVLSTGQGNSEVFYTGTLQRHESHRIGDF

SEQ ID NO: 19066 - protein, 81 aa, Pongo abelii
PHLLVTFRDVAIDFTQEEWECLDPAQRDLYRDVMLENYSNLISLEPARTHEEQHNLPVPKAGSVNLAAGFGHSRSQTGCGS

SEQ ID NO: 19067 - protein, 81 aa, Callithrix jacchus
RRGPLTFRDVAIEFSQEEWKCLDPAQRTLYRDVMLENYRNLVSLGMCLPDLSIISMMKQRTEPWTVESEMKVAKYPARWEG

SEQ ID NO: 19068 - protein, 81 aa, Monodon monoceros
YQVSKPEVIFKLEQGEEPWIAEGEIQRPFCPDWRTRPEAKSSNQQSISEVSLSTDDPSCATLEDTWDVNGQLERHKENWKR

SEQ ID NO: 19069 - protein, 81 aa, Callithrix jacchus
MAGPPRPQSGRKSAGRGAADASGGGPFPAASRVCEPRVVLREAGFLVFKPELISRLEQGQEPWVLDLQGAEGTEAPKTFKT

SEQ ID NO: 19070 - protein, 81 aa, Callithrix jacchus
TESFMAFGDVTVDFTQKEWRLLSPAQRALYREVTLENYSHLISLGILHSKPELIRRLEQGEAPWGEERRHQPGPHAGIYAE

SEQ ID NO: 19071 - protein, 81 aa, Bos taurus
SLGSDLFRDVAVVFSQEEWEQLAPTQRDLYRDVMLETYSNLVSLGLAISKPDVISFLEQGKEPWTVEEVVTEGLCPVLKSR

SEQ ID NO: 19072 - protein, 81 aa, Bos taurus
KGSVTLQDVAVEFTPEEWQLLDCDQRTLYWDVMLENFRNLISVGTGCPVTETTVIFKVEQGQGPWMVEGENSRWSSPEADC

SEQ ID NO: 19073 - protein, 81 aa, Ovis aries
LQGLMTFEDVAVDFTQEEWQYLNPPQRTLYRDVMLETYSNLVSVGYHVTKPDLILKLEVEEQCLPEGKIPIWSFPDMGPQT

SEQ ID NO: 19074 - protein, 81 aa, Ovis aries
QAQLTFKDVAIEFTQEEWECLDPAQRALYRDVMVETLRNLVSLENSIGSTNIYLLCELRDFQKKLVMLDGMKCPRDEERNY

SEQ ID NO: 19075 - protein, 81 aa, Ovis aries
AQLTFKDVFLDFTPEEWECLDPAQRTLYQDVMEETLRNLLSVDMSPIEMIKKLQAKADSSKGEIFQRVMFGRAESLESKDF

SEQ ID NO: 19076 - protein, 81 aa, Ovis aries
IQGLVTFRDVAVEFSQEEWKCLEPAQRDLYREVTLENFGNLVSLGLTISKPDVVSLLEQGKEPWMVVNDMTGPWCPDLESR

SEQ ID NO: 19077 - protein, 81 aa, Ovis aries
QEGVNFKIVTVDFTQEEEGTLSSAQRTLDRDVILENHRDSWDSATALGRRESRLKQSIFDDKLSHSVKIEKLTRDDPWLSS

SEQ ID NO: 19078 - protein, 81 aa, Otolemur garnettii
MIKIIASVSFKDVNVEFTQDEWWNLYRDVILENYNNLVSVGYCIFKPKVIFRLEHGEAPWSSEEEFSNQSHPKGHLWGEHL

SEQ ID NO: 19079 - protein, 81 aa, Otolemur garnettii
FQGPLTFRDVAIEFSQEEWTSLDPAQRALYRDVMLENYRNLVSVVGVSLPDQTIISILEQGKEPWTVESQVKIVRNSNRGK

SEQ ID NO: 19080 - protein, 81 aa, Vulpes vulpes
KDQELLTLEDVAVDFTWEEWQLLAPAQKNLYRDVMLENYSNLVSVGYVASKPDAFFRLEQGEPWATEDEIRSQIHPEIKKD

SEQ ID NO: 19081 - protein, 81 aa, Enhydra lutris
VWGSMSFEDVIVEFTQDEWQYMSPAQRTLYRDVMLENYSHLISVGCCTTKPEMIFKLEQGEEPWSLEEEFLNQRYPGYFSV

SEQ ID NO: 19082 - protein, 81 aa, Pongo abelii
VTFEDVAVNFSQEEWSLLSEAQRCLYRDVMLENLALISSLSCWCGSKDEEVPCKQRISLQRESQSRTPRTVISPKAHPCEM

SEQ ID NO: 19083 - protein, 81 aa, Pongo abelii
AEGLVMFEDVTVYFSRDEWGLLNVTQKGLYRDVMLENFALVSSLGLASSRSPVFTQLEDDEQSWVPSWVDVTPVSRAEARR

SEQ ID NO: 19084 - protein, 81 aa, Pongo abelii
ASGSVTFEDVAVYFSWEEWDLLDETQKHLYFNVMLENFALTSSLGLTSSWSHVVAQLGLGEVPSVLHRMFMTPASASWDQR

SEQ ID NO: 19085 - protein, 81 aa, Pongo abelii
PQMLVTFKDVAVTFTREEWRQLDLAQRTLYREVMLETCGLLVSLGHRVPKPELVHLLEHGQELWTVKRGLSHPTCAGQEPR

SEQ ID NO: 19086 - protein, 81 aa, Pongo abelii
MLENYGAVASLAAFPFPKPALISQLERGETPWCSVPQGALDGEAPRGISSGEIPKLPGATIWSLRIKPIPKKTVTKQRETR

SEQ ID NO: 19087 - protein, 81 aa, Pongo abelii
PLETVTFKDVAVDLTQEEWEQMKPAQRNLYRDVMLENYSNLVTVGCQVTKPDVIFRLEQEEEPWVMEEEMFGRHCPEVWEV

SEQ ID NO: 19088 - protein, 81 aa, Pongo abelii
QGLLTFRDVAIEFSQEEWKCLDPAQRTLYRDVMLENYRNLVSLDISSKCMMKEVSSTAQGNTEVIHTGTLQRHERHHIGDF

SEQ ID NO: 19089 - protein, 81 aa, Pongo abelii
SQEPVTFEDVAVDFTQEEWQQLNPAQKTLHRDVMLETYNHLVSMGCSGIKPDVIFKLEHGKDPWIIESELSRWTYPGIFGL

SEQ ID NO: 19090 - protein, 81 aa, Pongo abelii
VTFEDVAVYLSQEEWGRLGPAQRGLYRDVMLETYGNLVSLALGTRTEYKELTSRETFGEEDPQGSEPVEACDHIRKSEGSL

SEQ ID NO: 19091 - protein, 81 aa, Callithrix jacchus
EGPLAEMDPVQDRVVFEDVAIYFSQEEWGHLDEAQRLLYRDVMLENLALLSSLGKALTLAQCPGLGWVMPVHPKAALRFPQ

SEQ ID NO: 19092 - protein, 81 aa, Callithrix jacchus
DVTFSDVAIDFSHEEWEWLDSAQRDLYKDVMVQNYENLSETPSHTLTHKNYVFSGDWESRWENKELSTKKDIYDEDSPQTV

SEQ ID NO: 19093 - protein, 81 aa, Callithrix jacchus
EPVTFEDVAVYFTQNEWTSLDPVQRALYREVMLENYANVASLAFPFTTPVLVSQLEQGERPWGLDPWEPVGREALRGVCPG

SEQ ID NO: 19094 - protein, 81 aa, Macaca mulatta
GLVMFEDVAVYFSREEWGLLNVTQKGLYRDVMLENFALVSSLGVSHLQLLVTDSSLLSDGLCRVEDERARPKHLKSYRVIQ

SEQ ID NO: 19095 - protein, 81 aa, Bos taurus
GSVTFPDVAVYFSWEEWRLLDEAQRRLYLDVMLENYALISSLGKTFSLPTDLGWPLYPASRPRRCSVLTWCRHCLLPQCSG

SEQ ID NO: 19096 - protein, 81 aa, Bos taurus
VALPTGQLTFKDVAIKFTPEAWECLNPVQRALYRDVMIETLRNMLSVVKDNLPLKFGDLPWGDKLETFQTLMLGRPESCEI

SEQ ID NO: 19097 - protein, 81 aa, Bos taurus
WKGLLSFEDVALYFTREEWDMLDWAQKALYRDVMLDNYRDVVSLGFQFPKPEVICQLEQWEEPWILDLPRAGTRKASGSAC

SEQ ID NO: 19098 - protein, 81 aa, Ovis aries
QPQGTMTFKDVEVTFSQDEWGLLDASQRNLYRDVMLENYGNMASVVGPFTKPALISWLEAREPWGLNVQGVQLKGNPGAAP

SEQ ID NO: 19099 - protein, 81 aa, Ovis aries
FEGSVSFEDVAVDFTRQEWHRLDLAQRTMHRDVMLENYSNLASVGLCVAKPEMIFKLERGEELWILEEESSDHGYTGSFSL

SEQ ID NO: 19100 - protein, 81 aa, Ovis aries
MFQVTFSDVAIDFSHEEWRWLSSTQRDLYKDVMVQNYENLVSLGLSIPKPYVIALLEDGKEPWMVEEKLSKDMFSDCKSRW

SEQ ID NO: 19101 - protein, 81 aa, Ovis aries
MESVTLEDVAMELIQEWTLLDDAGRNLCRHVLQDNCRTPAARAAGTPPCKASLVSQVESREELKAAEHGVLYATGVDWESQ

SEQ ID NO: 19102 - protein, 81 aa, Otolemur garnettii
LQESVTFRDVAVLFSQDEWLHLDSAQRTLYREVMLENYNNLASLGIPFSMPKVICQLQQGEDPCTVEGEVPSDSCIDAKGQ

SEQ ID NO: 19103 - protein, 81 aa, Enhydra lutris
KLKSVTFEDVAVYFTQTEWDGLSPAQRALYRDVMLENYGNVASLGFSLLKPAVISQLEGAVEIDIQTDNNLTKEVYEEKHN

SEQ ID NO: 19104 - protein, 81 aa, Enhydra lutris
GSVSFTDVTVDFTQEEWEQLDPSQRILYMDVMLENYSNLLSVEVWKADDQMERDRSSPDEPARPFIIFKNQTPMEERGNLF

SEQ ID NO: 19105 - protein, 81 aa, Enhydra lutris
HGSTAFNSVTVAFTQDGWRPLVAAPRGTPRFKEGLPENTRNLVLLGLPVSQPSVNSQLDQREDGPWALQGGGLRSTCPDWK

SEQ ID NO: 19106 - protein, 81 aa, Pongo abelii
EKETLTFRDVAIEFSLEEWECLNPAQQNLYMNVMLENYKNLVFLGIAVSKQDPVTCLEQEKEPWNMKRHEMVDEPSAMCSY

SEQ ID NO: 19107 - protein, 81 aa, Pongo abelii
MLENYRNLVFLGIAVSKPDLITCLEQGKEPCNMKRHAMVAKPPVVCSHFAQDLWPKQGLKDSFQKVILRRYGKYGHENLQL

SEQ ID NO: 19108 - protein, 81 aa, Pongo abelii
QLTFRDVAIEFSQEEWTCLNPAQKTLYRDVMLENYRNLVSLDISCKCINKDLPPKGKNNMGEAFYTVKLERLESHDTEGLS

SEQ ID NO: 19109 - protein, 81 aa, Pongo abelii
EMGPLTFRDVAIEFSLEEWQCLDTAQRDLYRKVMFENYRNLVFLGIAVSKPHLITCLERGKEPWNRKRQEMVAKPPVIYSH

SEQ ID NO: 19110 - protein, 81 aa, Pongo abelii
GLLTFRDVAIEFSQEEWKCLDPAQRTLYRDVMLENYRNLVSLVVVSVFVYRQGLPVLLKLVLVSWAQEILLGLLSSWDYRR

SEQ ID NO: 19111 - protein, 81 aa, Pongo abelii
QAEVTFEDVAVYLSQEEWGRLGPAQRGLYRDVMLETYGNLVSLGVGPAGPKPGVISQLERGDEPWVLDVQGTSGKEHLRVN

SEQ ID NO: 19112 - protein, 81 aa, Pongo abelii
LQASVSFEDVTVDFSREEWQHLDPAQRRLYWDVTLENYSHLLSVGYQVPKSEAAFKLEQGEGPWTLEGKAPHQSCSGEAIG

SEQ ID NO: 19113 - protein, 81 aa, Pongo abelii
EKGPLTFRDVAIEFSLEEWQCLDTDQQGLYRKVMLENYRNLVFLGIALTKPDLITCLEQGKEPWNIKRHEMVAKPPVICSH

SEQ ID NO: 19114 - protein, 81 aa, Pongo abelii
TQGPLKFRDVAIEFSQEEWKCLDPAQRTLYRDVMLENYRNLVSLGICLPDLSVTSMLEQNKDPWTLQSEEKIANNPDGREC

SEQ ID NO: 19115 - protein, 81 aa, Pongo abelii
AQESVSFEDVAVNFTNREWQCLTYAQRHLYKDVMLENYGNMVSLGFPFPKPPLISHLEREVDPCVQDPQDRESLSCSYPVS

SEQ ID NO: 19116 - protein, 81 aa, Pongo abelii
LQEPVTFRDVAVDFTQEEWGQLDPNQRILYRDVMLETFGHLLSIGPELPKPEVISQLEQGTELWVAERGTTQGCHPGWEPR

SEQ ID NO: 19117 - protein, 81 aa, Macaca mulatta
KPVTFEDVAVNFTQEEWDCLDASQRVLYQDVMSEIFKNLASVEGKKKELREQHPSLRDEGTSDDKVFLACRGAGQCPLSAP

SEQ ID NO: 19118 - protein, 81 aa, Callithrix jacchus
ILENYRNLVFLGIAVSKPDLIACLEQEKEPLIMKRDEMADEPPVMCSHFAQEFWPEQNIKDSSQSMTLRRYEKCGNENFQL

SEQ ID NO: 19119 - protein, 81 aa, Callithrix jacchus
MELLTFRDVAIEFSPEEWRCLDPAQQNLYRDVMLENYRNLVSLGVALSNPDLVTCLEQRKEPYNVKIHQTVARSPAMCSPF

SEQ ID NO: 19120 - protein, 81 aa, Callithrix jacchus
SQGLVTIKDVSLCFSQEEWRSLDPSQTDFYGEYVMQENCGIVVSLRFPIPKLDMLSQLEGGEEQWVPDTQDLEERDILRVT

SEQ ID NO: 19121 - protein, 81 aa, Macaca mulatta
FQGSVTFEDVAIAFSQQEWESLDSSQRGLYRDVMLENYRNLVSMGHSLSKPHVIALLERWKEPKVTERKDGRRWCTDLQLE

SEQ ID NO: 19122 - protein, 81 aa, Monodon monoceros
VPGSKPDLISQLEQGKEPWGSDLLGAQEGETVGDPSTDSSRGSLRKQVMARVKMTQASEPPEASGRFSGGGPPTLVCREAA

SEQ ID NO: 19123 - protein, 81 aa, Bos taurus
MLENHSSVAGLAGFLVFKPELISRLEQGQDPWVLDLQGAEGREEARTTRTDSTVGTDGEQDMDSFKSESGGVMVKTLPQNF

SEQ ID NO: 19124 - protein, 81 aa, Bos taurus
VEQTSTFRDVAIHFSQQEWECLNPVQKNLYQDVMMENYDNLVSLGHSISKPDVITLLEQGKEPWMVVREETRRWCAGQYKQ

SEQ ID NO: 19125 - protein, 81 aa, Bos taurus
RLQSMGSLRDVAIDFTQEEWECLDLSQRELYRDVMLENYGNLASLGLVSNLDLVTFLEPLKDPRNIRRMGTTVIYPDSNLM

SEQ ID NO: 19126 - protein, 81 aa, Ovis aries
MLENYSHLVFLGYQVSKPEVIFKLEQGEEPWIAEGEIQRPVYPDWKTRPEAKSSHLQQSISKVSLSTDELSHTTGEDAWDL

SEQ ID NO: 19127 - protein, 81 aa, Ovis aries
SRSLENDGICFSEQEWENLEDWQKELYASVMKSNYEALASLKVLGQPEGEMELGAEMPGDLEEEESRGVHPAEEVVAKQET

SEQ ID NO: 19128 - protein, 81 aa, Ovis aries
ELVTFRDVVISFSQEEWEYLDSVQRDLYWDVMMENYSNLVSLGKESKYDTKTLSVEDILEKNNSQWEVIENSKLVGLQNSI

SEQ ID NO: 19129 - protein, 81 aa, Ovis aries
QESVTFEDVAVDFTQEEWALLDTSQRKLFRDVMLENISHLVFVGTGYQHCKLDVIFQLEQGEELWIEGRGFFQSHSPGGES

SEQ ID NO: 19130 - protein, 81 aa, Ovis aries
AFQKIATLDDIAMDFTLENWEQLGQGQGDLFWDTALDNYQNLFLLNPPRPNLTFHLDGGEKLEALAKESPESTDAGITETS

SEQ ID NO: 19131 - protein, 81 aa, Vulpes vulpes
MLENFSHLVSLGHPVSKPDVISKLEQGEEPWIIKRDIPNWIYPGKNLAESENRLENPQLNMLGGVSFHKEILESVTRDHSL

SEQ ID NO: 19132 - protein, 81 aa, Otolemur garnettii
LSFKDVAVSFTWEEWQLLDPSQKNLYQAVMLENYNNLVSVGYQVTEADAFFQLAQEKPWIIEEEIQNEIHLQDAWQVNDRT

SEQ ID NO: 19133 - protein, 81 aa, Vulpes vulpes
LLTFKDVVIEFSQEEWECLAPAQRALYRDVMLENYRNLVSLDIPTICVRKELPPKDDLNNGELLQTLILERHLSHQFDDFD

SEQ ID NO: 19134 - protein, 81 aa, Vulpes vulpes
MLENYSHLVSVGYLGAKPDVVLRLGRGEEAGLTEGETPTWKYPEFWQVGDQIDNHKESQDRLLWQTALVDKEAQKDQSGQE

SEQ ID NO: 19135 - protein, 81 aa, Vulpes vulpes
MLETYSHLLSVGYEVPQPEVFMLEQGKEPWALQGESPHQNCTEDLWQIGDQIESYQQKENKSLRDVAFIKKILTTKKDYEY

SEQ ID NO: 19136 - protein, 81 aa, Otolemur garnettii
AQGCVIFQDVFVYFSREEWELLDNAQRLLYHDVMLENFALLASLGIASSRSQVVMQVELGEEPDQVDVTIESPRGNQRPPR

SEQ ID NO: 19137 - protein, 81 aa, Otolemur garnettii
EMELLTFKDVSVEFSMDEWACLDPAQQTLYRDVMLENYRHLVFLGLTPSKPHLITCLEQSRESWKVKTHQTVVKHPAVSNH

SEQ ID NO: 19138 - protein, 81 aa, Enhydra lutris
VSRSLENDGVCFSEQEWENLEDWQKELYRNVMKSNYETLVSLKVLGQPEEEAELGAGMLGDLEEEGPGDVHPAEGVMIKPE

SEQ ID NO: 19139 - protein, 81 aa, Enhydra lutris
SQDLVTFKDVAIDFSQEEWEWLNPAQRNLYKNMMLENYQNLVSLGLCISKPYVISLLEQGKEPCEMKTEMTRSPFPDSGSI

SEQ ID NO: 19140 - protein, 81 aa, Pongo abelii
FQESVTFQDVAVDFTAEEWQLLDCAERTLYWDVMLENYRNLISVGFPITKTKVILKVEQGQEPWMVEGVNPHQSSPESDCP

SEQ ID NO: 19141 - protein, 81 aa, Pongo abelii
RRGHLTFRDVAIEFSQEEWKCLDPVQKALYRDVMLENYRNLVSLGICLPDLSIFSMMKQRTESWTVENEMKVANNPDRWEG

SEQ ID NO: 19142 - protein, 81 aa, Pongo abelii
FQGLLTFRDVAIEFSLEEWQCLDTAQQNLYRNVMLENYRNLVFLGIAFSKPDLITCLEQGKEPWNMKQHERVDEPPAIWEA

SEQ ID NO: 19143 - protein, 81 aa, Pongo abelii
AGRPLEMAVSEPEASAAEWKQLDPAQRNLYNDVMLENYSNQASMGCQAPKPDMISKLEKGEAPWLGKGKRPSQGCPSKIAR

SEQ ID NO: 19144 - protein, 81 aa, Pongo abelii
MLESYSNLTSLGYQVGKPSLISHLEQEEEPRTEERGAHQGACADWETPSKTKWSLLMEDIFGKETPSGVTMERASLGEKST

SEQ ID NO: 19145 - protein, 81 aa, Pongo abelii
QGRLTFRDVAIEFSLSEWKFLNPAQRALYREVMLENYRNLEAVDISSKCMMKEVLSTGQGNSEVFYTGTLQRHESHRIGDF

SEQ ID NO: 19146 - protein, 81 aa, Pongo abelii
FREAVTFKDVAVAFTEEELGLLDSAQKKLYRDVMLENFRNLVSVGHQSFKPDMISQLEMEEKLWMKELQTQRGKDSGDRNQ

SEQ ID NO: 19147 - protein, 81 aa, Pongo abelii
RVTFKDVAVVFTNEELALLDKAQINLYQDVMLENFRNLISVKDGIKNNILNLQAKGLSYLSQELLHCWQIWKQRIQDLTVS

SEQ ID NO: 19148 - protein, 81 aa, Pongo abelii
LLTFRDVAIEFSQEEWKCLDPAQRTLYRDVMLENYRNLVSLGIFSKCEIKELPPKKESNTGEIFQTVMLERQESHDIQDFC

SEQ ID NO: 19149 - protein, 81 aa, Pongo abelii
IWGPLSFMDVFVDFTWEEWQLLDPAQKCLYRSVMLENYSNLVSLGYQHTKPDIIFKLEQGEELCMVQAQVPNQSCPILKAG

SEQ ID NO: 19150 - protein, 81 aa, Pongo abelii
MPGPPRSLEMIAVSKPDLITSLEQGKEPWNMKRHEMVDEPSGIYPHFAQDLWPEQGMEDSFQKAILRRYEKYGHENLQLRK

SEQ ID NO: 19151 - protein, 81 aa, Pongo abelii
PKVPVAFDDVSIYFSTPEWEKLEEWQKELYKNIMKGNYESLISMDYAINQPDVLSQIQPEGEHNTEDQAGPGESEIPTDPS

SEQ ID NO: 19152 - protein, 81 aa, Pongo abelii
FQEPVTFEDVAVYFTQNEWASLHPTQRALYRGVMLENYANVTSLSAFPFPKPDLIFQLEQGEAAWGPDPWTLDGGEALRGM

SEQ ID NO: 19153 - protein, 81 aa, Pongo abelii
SVAFEDVAVTFTQEEWALLDPSQKNLYRDVMQETFRNLASIGKKWKAQNIYVEYENLRRNLRIVGERLFESKEGHQHGEIL

SEQ ID NO: 19154 - protein, 81 aa, Pongo abelii
FQEMVTFKDVAVVFTREEVGLLDVAQRKLYQDVMLENFRNLLSVGYQPFKLDVVLQLGKEDKLWMMETEIQGDGCSGHRNQ

SEQ ID NO: 19155 - protein, 81 aa, Pongo abelii
MSKEAVTFKDVAVVFTEEELGLLDLAQRKLYRDVMLENFRNLLSVGHQPFHRDTFYFLREEKFWMMDIATQREGNSGGSVQ

SEQ ID NO: 19156 - protein, 81 aa, Callithrix jacchus
DMEMLTFSDVAIGFCPEEWECLDSSQQHLYRNMMLENYRNLVFLGLGDSKSELITRLEQGKDPWNVKRQETVVKHPAKTWN

SEQ ID NO: 19157 - protein, 81 aa, Callithrix jacchus
FQGSVMFSDVSIDFSQEEWDCLDPVQRALYRDVMLENYSNLVLMGLHTPKPQVISLLEQGKEPWMVGRELTRGLCSDLESM

SEQ ID NO: 19158 - protein, 81 aa, Callithrix jacchus
AHALVTFRDVAINFSQKEWECLDPTQRKLYRDVMLENYSNLVSLGLLSRHKTKKLSSEKDIHEISFSKGNIIEKSKTLHLK

SEQ ID NO: 19159 - protein, 81 aa, Macaca mulatta
PQGLLTFRDVAIEFSQEEWKCLDPAQRTLYRDVMLENYRNLVSLDISSKCMMKEFSSTAQGNTEVIHRGTIQRHERHHIGD

SEQ ID NO: 19160 - protein, 81 aa, Macaca mulatta
ASVTVTFDDVALYFSEQEWEILEKWQKQMYKQEMKTNYQTLDSLGYAFSKPDLITWMEQGRMLFISEQGCLDKTRRTTSPP

SEQ ID NO: 19161 - protein, 81 aa, Callithrix jacchus
SRGGQITRDVAIEFSLEEWQCLDTAQRNLYKNVILENYRNLVFLGIAVSKPDLIACLEQEKEPLIMKRDEMADEPPVMCSH

SEQ ID NO: 19162 - protein, 81 aa, Bos taurus
TGHGTIDWDVAIHFSQQEWECLNPVQKNLYQDVMMENYDNLVSLAGHSISKPDVITLLEQGKEPWMVVREETRRWCAGQYK

SEQ ID NO: 19163 - protein, 81 aa, Bos taurus
WSQMPVTFEDMALYLSREEWGRLDHTQQSFYREVLQKRSGLSLGVVEVDKEELAASLGALGDAKSFKSRMGRAQGEAPRCG

SEQ ID NO: 19164 - protein, 81 aa, Bos taurus
MLENYRNLVWLGLSISKPNMISLLEQGKEPWMVEREMSDGQHADWESWYEIKALSPKWYTDEEEISQGVITKRLTSYSLEF

SEQ ID NO: 19165 - protein, 81 aa, Bos taurus
RRKQQMTVEDVAIKFTPEEWECLSPAQRTLYWDVMLETYRNLLSVDISPIHIIKKLQSKENTNSTDTLQTLTDRKDQRGRS

SEQ ID NO: 19166 - protein, 81 aa, Ovis aries
SLSPVTFEDVAVYFSQEEWRLLGEAQKFLYRDVMLETFALVVSLGCCHTAEDEQTPSEQNVSVEVPQRNTKKTDLSSQKVC

SEQ ID NO: 19167 - protein, 81 aa, Ovis aries
SQSPLTFGDVAVEFSGEEWAWLDSAQRSLHRSVMLENYRNLASLGLCLSKPEMISSLEQRKEPWAVKRKLTGGECPDSQTL

SEQ ID NO: 19168 - protein, 81 aa, Ovis aries
EQGLMAFEDVAVHFSQEEWGLLDTAQRALYRRVMLENFALLASLGLSVSRPRVVTQLERGDEPWVLSGADVTLARDAQRRP

SEQ ID NO: 19169 - protein, 81 aa, Ovis aries
LQEALTFKDVAVTFTEEELGLLDLAQRKLYRDVMLENFRNLLSVGHQSSKPDMISQLEREEKFCTIEIQPQRGGRSGGWNH

SEQ ID NO: 19170 - protein, 81 aa, Ovis aries
SQGLVTFEDVAVYFSLEEWERLDADQRELYKEVMRENYGILVSLGYPVPKPDLIFRLEQGEEPWVPDSPRPEEGDIVTGVY

SEQ ID NO: 19171 - protein, 81 aa, Ovis aries
VMFSDVSIDFSQEEWEFLNDDQRDLYRDVMLENYSNLVSMVLESRCETKKLFLKKEIYEIESAQWEIMDRLTRHNLQCSSF

SEQ ID NO: 19172 - protein, 81 aa, Ovis aries
AQLTFKDVFLDFTPEEWECLDPAQRTLYKDVMVEILRNLLSVDMSHIHMVKKLQAKAHSGKGEIFQRVMFGRAEILEIKDF

SEQ ID NO: 19173 - protein, 81 aa, Ovis aries
QLTFEDVAIEFTQEEWEFLDRAQRALYRDVMLETYRNLLSVDIAPTHVIKLLQPKVNSDKQTFQKLMQGRPESCEMKHFHL

SEQ ID NO: 19174 - protein, 81 aa, Ovis aries
FQESMTLEDMVIYFSENEWTALASIQRALYREVMLENYGAVASLACPFPTPALILQLEAGGTPWSLAPREGLNGESPRGIF

SEQ ID NO: 19175 - protein, 81 aa, Ovis aries
RLTSEDVAIEFTQEEWEFLDPTQRALYRDVMLETYRNLLSLDISPTHVMKHLQPKANSDKRETFQTLMLGSPESCEIKHFH

SEQ ID NO: 19176 - protein, 81 aa, Ovis aries
ALVSVTFRDVAVFFSRDEWLCLDSAQRTLYQEVMLENYSTLFSLGILFSKPKVILQLEQGEDPWMVENGVSQSTYLGWESL

SEQ ID NO: 19177 - protein, 81 aa, Otolemur garnettii
KVPVTFVDIAVYFSEDEWKNLDEWQKELYNNLVKENYKTLMSLDTEGPVPKTDAPAPAEPREEPCVWEQRHPEEREISMDP

SEQ ID NO: 19178 - protein, 81 aa, Vulpes vulpes
MLENYGAVAALAAFPFPKPALISQLERGEAPWCKAPQGALDGEGPRGISSGYPFLKPAGISHFEQVEEPLNLKLQGEGPSL

SEQ ID NO: 19179 - protein, 81 aa, Vulpes vulpes
IQGSLTFGDVAVAFTQFEWKYLDATQRALYKDVMLENYGNLLSVGFLSYKPKLITQLEQGAEPWMEVQQIPSDNYSVQEYW

SEQ ID NO: 19180 - protein, 81 aa, Otolemur garnettii
QELLTFKDVSVEFSMDEWACLDPAQQTLYQDVMLENYRHLVFLGLTLSKPDLITCLEQSKEPWKVKSHQTVVKHPAVSDPP

SEQ ID NO: 19181 - protein, 81 aa, Vulpes vulpes
LVKIEDVADVAVSFILEEWGHLDQSQKSLYRDDRKENYDSITYMDYESGNDNVELVVKQISDDAESHWMTAGSTERNIPQS

SEQ ID NO: 19182 - protein, 81 aa, Otolemur garnettii
QELLTFRDITIEFTAEEWEYLDPAQQNLYRDVMLENLRNLVSVGSTNLKCFLLNILQSLSENSASHIHLRWRVQIQPGPAK

SEQ ID NO: 19183 - protein, 81 aa, Vulpes vulpes
SQASISFKDVTVEFTQEEWQQMGPMQRTLYRDVMLENYNNLVSVGNCIFKPAVIFKLEQGEEPWLLEEEFSNQSHLEDYRD

SEQ ID NO: 19184 - protein, 81 aa, Vulpes vulpes
SEESVTFEDVAIYFSENEWTGLAPAQRVLYRDVMLENYGAVAALAFPFPKPALISQLERGEAPWCKAPQGALDGEGPRGIS

SEQ ID NO: 19185 - protein, 81 aa, Otolemur garnettii
LQGLVSFKDVAVDFTWEEWQGLDDAQRTLYKDVMLEIYSSLVSLGYCIMKPELILKLEQGAEPCVVSQCILTAVVVVWRAQ

SEQ ID NO: 19186 - protein, 81 aa, Vulpes vulpes
LLTFEDVAVFFSEEEWKLLNPTQKILYSDVMQENYETVISLGLKLKNDTGNDQPISLSTLELQASGCKVLRKAKVKVAQKT

SEQ ID NO: 19187 - protein, 81 aa, Otolemur garnettii
QERVSFKDICVDFTQEEWSLLDSTQKVLYRDVILENYGNLVSVAGHCVTKPEVIFKIEQGEEPWILEKGFPSQCYPERKWK

SEQ ID NO: 19188 - protein, 81 aa, Otolemur garnettii
FQGLMTFEDVTVEFTQWEWGQLDPAQKDLYREVMLENFRNLASLGLPLSKPYVICQLEEGQEPCMLEKEISVGTQSVGEAT

SEQ ID NO: 19189 - protein, 81 aa, Otolemur garnettii
QGPVSFRDVVVDFTWEEWQCLDFPQRDLYRDVMLENYINLISVGYQTTKPAVIHRKRAMDNRERNLTSGKCTKKNECNKCG

SEQ ID NO: 19190 - protein, 81 aa, Vulpes vulpes
QVSAAYEFLSVDYTERKWKGPAVGQRAVYRSIMPGNYCSVASLGDTRMRCSELPVKLAVSKGPESSDGTSRGLCAVVSGEP

SEQ ID NO: 19191 - protein, 81 aa, Vulpes vulpes
DPVTFDDVAVEFTQEEWTLLDQTQRRPYRDVVLENYKNLASTDWEICLNSKWSAPQQNILQGKTPSVVEMVCLLRTLSGKA

SEQ ID NO: 19192 - protein, 81 aa, Vulpes vulpes
PHWLVTFRDVAIDFSQEEWECLNSTQRDLYRDVMLENYSNVISLAGCSIPKPDVFSLLEQGKDPWMVMRAMTRKRSSDLES

SEQ ID NO: 19193 - protein, 81 aa, Vulpes vulpes
LQEPVTFRDVAVDFTQEEWGQLGPAQRTLYRDVMLETFGHLLSLGPELPKPEVISQLEQGAELWAAEREIAQGYCRGREPG

SEQ ID NO: 19194 - protein, 81 aa, Otolemur garnettii
QVTFSDVAVDFSHEEWGWLDSAQRDLYKDVMVQNYENLVSLVGLSITKPYVITLLEDGKEPWMVEKNLSKSVFPDWESRWE

SEQ ID NO: 19195 - protein, 81 aa, Otolemur garnettii
ASVTFEDVAVYFSWEEWDLLDEAQKHLYFDVMLENFALTSSMGCWREVEYQGAPSEQSIAIKGVSQIRTPKENSSSQNAYP

SEQ ID NO: 19196 - protein, 81 aa, Pongo abelii
QEMPLTFQDVAVYFSQAEGQQLGPQQRALYRDVMLENYGNVASLGFPIPKPELISQLEQGKELWVLNLLGAEEPDILKSCQ

SEQ ID NO: 19197 - protein, 81 aa, Pongo abelii
MLENYRNLFSIGLTVSKPGLITCLEQRKEPWNVKRQEAVDGHPEMGFHHTTQACLELLGSSDLPASASQSAGITGVNHRAQ

SEQ ID NO: 19198 - protein, 81 aa, Pongo abelii
DSVAFEDVAVNFTLEEWALLDPSQKNLYRDVMRETFRNLASIGKQWEDQNIEDPFKIPRRNISHIPERLCESKESGQGEET

SEQ ID NO: 19199 - protein, 81 aa, Pongo abelii
QGLLTFRDVAIEFSQEEWKCLDPAQRTLYRDVMLENYRNLVSLDMSSKCTMKEFLSTAQGNREVFHAGTLQRHESHHNGDF

SEQ ID NO: 19200 - protein, 81 aa, Pongo abelii
YQDSVTFDDVAVDFTPEEWALLDTTEKYLYRDVMLENYMNLASVEWEMQPRTKRSSLQQGFLKNQIFSGIQMQTRGYSGWK

SEQ ID NO: 19201 - protein, 81 aa, Pongo abelii
MESVTFEDVAVEFIQEWALLDSARRRLCRYRMLDQCRTLASRGTPPCKPSCVSQLGPRAEPRATEQGILHATGVAWESQLK

SEQ ID NO: 19202 - protein, 81 aa, Pongo abelii
TFKEAMTFKDVAVVFTEEELGLLDLAQRKLYRDVMLENFRNLLSVGHQAFHRDTFHFLKEEKIWMMKTATQREGNSGDKIQ

SEQ ID NO: 19203 - protein, 81 aa, Pongo abelii
SQELVTFEDVAVYFIRKEWKRLEPAQRDLYRDVMLENYGNVFSLDHETRTENDQEICEDTRSHGVLLGRFQKDISQGLKFK

SEQ ID NO: 19204 - protein, 81 aa, Pongo abelii
SPDSMTFEDIVVDFTQEEWALLDTSQRKLFQDVMLENISHLVSIGKQLCKSVVLSHLEQVEKLSTQRISLLQGRQVDIKHQ

SEQ ID NO: 19205 - protein, 81 aa, Pongo abelii
FQGPVTLKGVIVEFTKEEWKLLTPAQRTLYKDVMLENYSHLVSVGYHVNKPNAVFKLKQGKQPWILEVEFPHRGFPEDLWS

SEQ ID NO: 19206 - protein, 81 aa, Pan troglodytes
YQDSVTFDDVAVDFTPEEWALLDTTEKYLYRDVMLENYTNLASVEWEIQPRTKRSSLQQGFLKNQIFSGIQMTRGYSGWKL

SEQ ID NO: 19207 - protein, 81 aa, Sapajus apella
GPLTFRDVTIEFSHDEWKCLDPAQKALYKDVMLENYRNLVFLGIIPKCTTKELPPIGNNNTGEKFRTMTLERHECYDIEDI

SEQ ID NO: 19208 - protein, 81 aa, Sapajus apella
VHGSVTFRDVAIDFSQEEWECLQPAQRTLYRDVMLENYSHLISLGSSVSKPDVITLLEQEKEPWMVVRKETSRWYTDLESK

SEQ ID NO: 19209 - protein, 81 aa, Pan troglodytes
HLTFMDVAIEFSQEEWKSLDPGQRALYRDVMLENYRNLVFLGRSCVLGSNAENKPIKNQLGLTLESHLSELQLFQAGRKIY

SEQ ID NO: 19210 - protein, 81 aa, Zalophus californianus
AQVPLTFSDVAIDFSQEEWECLNSDQRDLYRDVMLENYTNLVSLDFDFTTGTNKLSSEKSSYEVNSYHRETMKRSKTFNLM

SEQ ID NO: 19211 - protein, 81 aa, Pan troglodytes
RVTFKDIAVIFTKEELAVLDKAQINLYQDVMLENFRNFISVDGIKNNILNLQGKGLSYLSQEELHCWQIWKQRIRDLSVSQ

SEQ ID NO: 19212 - protein, 81 aa, Pan troglodytes
QGRLTFRDVAIEFSLEEWKCLNPAQRALYRAVMLENYRNLEFVDSSLKSMMEFSSTRHSNTGEVIHTGTLQRHKSHHIGDF

SEQ ID NO: 19213 - protein, 81 aa, Balaenoptera acutorostrata
AHGSVTFRDVAIDFSQEEWEFLDSAQRDLYKDVMWENYSNFISLGPSISKPDVITLLDEGKEPWMVVRERTRRHHPDLESR

SEQ ID NO: 19214 - protein, 81 aa, Vulpes vulpes
SQELVTFEDVAVYFIRKEWKRLEPAQRDLYRDVMLENYGNVFSLDGETRTGHDQDISEDTGSRGVLLGRFQKDISQGLKFE

SEQ ID NO: 19215 - protein, 81 aa, Vulpes vulpes
PQGSVSFKDVTVDFTQEEWQQLDPTQKALYRDVMLENYCHLISVGFHMTKPDMIRKLEQGEELWTTERIFPSQSYLEEDGK

SEQ ID NO: 19216 - protein, 81 aa, Rhinolophus ferrumequinum
SRSLENDGVYFAEQEEENLEDWQKELYRNVMKSNYETLVSLKVLGEPEGEAELGTEMLGELEEEGPDGVHPAEGVMLKPEL

SEQ ID NO: 19217 - protein, 81 aa, Acinonyx jubatus
FQEAVTFKDVAVVFTEEELGLLDPAQRKLYREVMLENFWNLVSVGHSSSKPDVISQLEREEKLCMKEIHTQRGGHSGGRNQ

SEQ ID NO: 19218 - protein, 81 aa, Acinonyx jubatus
REESLTLEDVAVDFTWEEWQLLAPAQKDLYWNVMLENYRNLVSLGYQARQPDSFSELEQEPPPWIFKDEVQSQTHPEIERV

SEQ ID NO: 19219 - protein, 81 aa, Acinonyx jubatus
KVPVTFVDIAVYFSEDEWKNLDEWQKELYNNLVKENYKTLVSLDAEGAVPKPDAPSQAEPREEPCVWEQRDPEEREILMDP

SEQ ID NO: 19220 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMVRFRRYNLLPS

SEQ ID NO: 19221 - protein, 81 aa, Rhinopithecus roxellana
ARGCVVFEDVFVYFSREEWELLDDAQRLLYHDVMLENFALLASLGIAFSGSCAVIKLEQAEEPWVYDQVDMTSATEREAQR

SEQ ID NO: 19222 - protein, 81 aa, Bison bison
MFRDVTVDFSQEEWECLNSNQRNLYRDVILENYSNLVSLGGCSISKPDVITLLEQGKEPWMVVRDEKRRWRLDLESRYDTK

SEQ ID NO: 19223 - protein, 81 aa, Bison bison
PKVPVTFDDVAVHFSEQEWGNLSEWQKELYKHVMRGNYESLVSMDYAISKPDLMSQMERGERPAMQEQEDSEEGEAPADPS

SEQ ID NO: 19224 - protein, 81 aa, Bison bison
MLENYSNLVLLGYQVIKPEMIFKLEQENPWLLDEEILSQNFSEKVWLDNNLKMWHQDNQDKLKSLERGHEYDIFERMFHLG

SEQ ID NO: 19225 - protein, 81 aa, Vicugna pacos
AQGSVSFKDVTVDFSQEEWQHLDPAQKTLYMDVMLENYCHLISVAGCHMTKPDVILKLERGEEPWTSCTGHTCLEESWKAE

SEQ ID NO: 19226 - protein, 81 aa, Vicugna pacos
FKEAVTFKDVAVTFTEEELGLLDPAQRELYRDVMLENFRNLVSVGHQCFIPDVISQLEREEKLWMLRTAAQSRCSSGDKNL

SEQ ID NO: 19227 - protein, 81 aa, Vicugna pacos
VQGSLSFEDVAVGFTWEEWQLLDASQKDLYRDVMLENYHNLVSVGHQATKPDSLFQWERGQPPWRAEGAAPRHTCPGEKPH

SEQ ID NO: 19228 - protein, 81 aa, Odocoileus virginianus
SQEQVSFKDVCVDFTQEEWYLLGPAQKILYRDVILENYSHLVSVGNCTTKPEVVFKIEQGEEPWILEERFPKQCRSEDWKV

SEQ ID NO: 19229 - protein, 81 aa, Phascolarctos cinereus
LESVTFQDVAVTFTPEEWEQLGPPQKALYREVMLENYGNLVCLGPTLSPRVPEQVLRAEVSTWQGEVRGRPSVMGHSPPLL

SEQ ID NO: 19230 - protein, 81 aa, Phascolarctos cinereus
SQESLTFKDVAVYFTQEEWGQLDPGQKYLYRDVMLENYRNMVSLGYHISKPDVISHLEQGEEPWMIGREILRGNSPGGMTR

SEQ ID NO: 19231 - protein, 81 aa, Pongo abelii
MVENFKNLVAVGHLPFQPDMVSQLEAEEKLWMMETETQRSSKHQNKMEALQKFALKYLSNQELSCWEIWKQVASELTRCLQ

SEQ ID NO: 19232 - protein, 81 aa, Physeter macrocephalus
QAEVTFEDVAVLLSREEWGRLGPVQKGLYRDVMLETYRNLVSLGAGPAGPKPEVITQLERGDEPWVLDVQGRERPTIDGSA

SEQ ID NO: 19233 - protein, 81 aa, Physeter macrocephalus
LEDLVTFEDVAVEFTQEEWALLDPCQRTLYRDVMLENCRNLASLGYHVDKPRLISQLEQEDKVMTEERGILPGTCPDLETV

SEQ ID NO: 19234 - protein, 81 aa, Physeter macrocephalus
FQGSLSFRDVAVGFTRKEWQQLDPTQRTLYRDVMLENYSHLVSVGCQVTKPAVIFRLEQGQEPWMKEEEILRWSFPEVLQV

SEQ ID NO: 19235 - protein, 81 aa, Trichechus manatus
SVAVEDVAVDFTEEEWALLDLSQRQLYRDVMMEIFRSLASVASQNLIDGEKLSTENVIVRFMKNDTWFSMLEVCELHGTEE

SEQ ID NO: 19236 - protein, 81 aa, Trichechus manatus
SQEPVTFEDVAVVFTQEEWVFLDSAQRSLYREVMLENCRNLAAVGYQLCKPSVFSPWGQIEELWTTERGLFQGICPEPQLQ

SEQ ID NO: 19237 - protein, 81 aa, Trichechus manatus
PPESVTFEDVAVYFTQKEWASLMPAQKALYRDVMLENYEAVAFLAPATSKPALISQLEQGVEPSFSQAQGDLSMRDRGAGL

SEQ ID NO: 19238 - protein, 81 aa, Trichechus manatus
SWGPLSFKDVFVDFTWEEWRLLDPAQKSLYRTVMLENYSNLMSLGYQHTKPDIIFKFKQGEELRMIKAQIPNQSFPEKVRE

SEQ ID NO: 19239 - protein, 81 aa, Callorhinus ursinus
FQEAVTFKDVAVVFTMEELGLLDSTQRKLYRDVMLENFRNLLSVGYEPFRLDTTLLLGREEKLWMMETQAPGDGRSGLRNQ

SEQ ID NO: 19240 - protein, 81 aa, Equus caballus
AQDSMTFEDIAVYFSWEEWRLLDEAQRHLYLDVMLENFALISSLGYWNGAEDVESPFEHSIPVRVLQASTPKTSSTSQKIH

SEQ ID NO: 19241 - protein, 81 aa, Rhinolophus ferrumequinum
LQDSVSFEDLSIDFTQKEWQLLDACQKDLYKDVMLENYSSLVSLGYEVTKPDVIFKLEQGREPWTGGGALPSSGSLEQVLQ

SEQ ID NO: 19242 - protein, 81 aa, Rhinolophus ferrumequinum
QDCVTFDDVAVFFSQEEWWLLDEAQKHLYLNVMLENLALISSLVCWHAVENEETLPEQSVSVQALSQVRTPKAGPSTQKIH

SEQ ID NO: 19243 - protein, 81 aa, Rhinolophus ferrumequinum
SQVSVTFEDVAVLFTRDEWRKLRPFQRNLYQDVMLETYSNLVSLGLPFSKPKVISLLQQGEAPWKLEEGSPGGSWPGWKSS

SEQ ID NO: 19244 - protein, 81 aa, Rhinolophus ferrumequinum
SQGLVTFEDVAVYFSLEEWERLDPDQRDLYKEVMQENYGILVSLGYPIPKPELISRLEQGEEPWVPDSPRPEEGDIVTGVY

SEQ ID NO: 19245 - protein, 81 aa, Ursus maritimus
FQGPVSFKDVAVDFTQEEWQYLDLPQRDLYRDVMLENYINLISVGYQTTKPSVIHKLEQGEEPWMVEREIPSWSYAEEVWQ

SEQ ID NO: 19246 - protein, 81 aa, Ursus maritimus
MTFEDVAVEFTQWEWGQLDPAQQGLYREVMLENFKNLASLDWEKRPKAKESILNQGISKEELLQIVSVEKHIRDELCFCKL

SEQ ID NO: 19247 - protein, 81 aa, Ursus maritimus
SLELVSFEDVAVNFSWEEWQDLDDAQRTLYRVVMLETYSSLVSLGHCITKPEVIVKLEQGAEPWTVEEAPTQSLPDVQTSG

SEQ ID NO: 19248 - protein, 81 aa, Phyllostomus discolor
MEAVTFGDVAVHFSREEWQCLDPGQRALYKEVMLENHSSVAGLAGFLLFKPELISRLEQGEEPWVLDLQGTEGRELPRTPQ

SEQ ID NO: 19249 - protein, 81 aa, Acinonyx jubatus
AQGCVISEDVFVYFSWEEWMLLDDSQRLLYQDVMLENFALLASLGIAPSISCLVAQPKQREYPWVPDQVDVTPATEREAPK

SEQ ID NO: 19250 - protein, 81 aa, Acinonyx jubatus
KSPGLLSFKDVAVVFTWEEWQLLDPIQKHLYQDVMLENYSNLVSVGRQVTKADAFYQLEQGPPWITEEEIQSQIHPDDTWQ

SEQ ID NO: 19251 - protein, 81 aa, Sapajus apella
FQESVTFQDVAVDFTPEEWQLLDCAERTLYWDVMLENYRNLISVGCPVTKTKVTLKVEQGQEPWMVEGVNPQHSSPESDCP

SEQ ID NO: 19252 - protein, 81 aa, Callithrix jacchus
FQESVTFQDVAVDFTPEEWQLLDCAERTLYWDVMLENYRNFISVGCPVTKTKVIIKAEQGQEPWMVERVNPHQSSPESDCP

SEQ ID NO: 19253 - protein, 81 aa, Carlito syrichta
PLKPVTFEDIAINFTQEEWALLDTSGRTLYKDVMLENINHLISVGYQLQKSDVIFHLKQGEMLWMVEGIEFPQGQSPGRKS

SEQ ID NO: 19254 - protein, 81 aa, Ovis aries
PQKLVTFEDVAVYFTQTEWDGLSTAQRALYRDVMLENYGNVASLGFPLLKPAVISQLEGGGELEGPSSLASGAGTGPQGLW

SEQ ID NO: 19255 - protein, 81 aa, Callorhinus ursinus
FQEAVTFKDVAVVFTMEELGLLDSTQRKLYRDVMLENFKNLVSVGHLPFRPDMVSQLEAEEELWMMEGEPQRNGYSREDHV

SEQ ID NO: 19256 - protein, 81 aa, Callorhinus ursinus
PLESVTFEDVVVDFTKEEWALLDISQRKLFRDVMLENIRHLLSLGYQHCKSDVIFPLEQGEELWREGTGFLQGQSPVILGR

SEQ ID NO: 19257 - protein, 81 aa, Equus caballus
LTFRDVAIEFSQEEWESLDPAQRALYRDVMLENYRNLLSLGEESCPPEIGRLSAGFSIKELSPREDIEKRELYHLMISESN

SEQ ID NO: 19258 - protein, 81 aa, Rhinolophus ferrumequinum
KPRGLKFADVAVYFSPEEWGCLRPAQRALYRDVMRETYGHLGALGCAGHKPALISWLERNTDDWEPAALDPQDCPRGVTVQ

SEQ ID NO: 19259 - protein, 81 aa, Callorhinus ursinus
SFGREAENDQVSPFTKEEWQQLDPAQRTLYRDVMLENFSHLVSLGHPVSKPDIISKLEQGEEPWIIKRHISDWICPERETR

SEQ ID NO: 19260 - protein, 81 aa, Rhinolophus ferrumequinum
AQKLLTLEDVTVEFSWEEWQLLAPAQKDLYQDVMLENYNSLVSLGYQATKPELFSKLEYGEEPRIIKSEIQKRTCPGIGKV

SEQ ID NO: 19261 - protein, 81 aa, Rhinolophus ferrumequinum
GSVSFTDVTVDFSQEEWEQLDPSQRILYMDVMLENYSNLLSVEVWKADDQVEREPRNPDEQARPFVIFKNQTPIEERGDLF

SEQ ID NO: 19262 - protein, 81 aa, Acinonyx jubatus
EALMAFRDVAVAFTQKEWRLLSPAQRTLYRDVMLENYSHLVSLAGPGTEFQPCVHSCPVAFSSPQFLQQYVLCGHLPQIFP

SEQ ID NO: 19263 - protein, 81 aa, Acinonyx jubatus
RLTFRDVAIEFSQEEWECLDPAQRALYRDVMLENYRNLVSVGSLSAGFALMELSPGEDIYKEVFYHLVILERNESHGIKDF

SEQ ID NO: 19264 - protein, 81 aa, Rhinopithecus roxellana
MYGLLTFMDVAVEFSLEEWQCLDTAQQNLYRNVMLENYRNLVFLGIAVSKPDLITCLEQGKEPWNMKRHEMVAKPPAMCSH

SEQ ID NO: 19265 - protein, 81 aa, Acinonyx jubatus
SQSLLTFEEVAMYFSQEEWELLDPTQKALYNDVMRENYETVISLALFVLPKPKVISYLEQGEEPWVQGSTELKDSPGELPT

SEQ ID NO: 19266 - protein, 81 aa, Rhinopithecus roxellana
MGSVSFRDVTVGFTQEEWQHLDPAQRTLYRDVMLENYSHLVSVGYCIPKPEVILKLEKGEEPWILKEKFPSQRHLEIINTS

SEQ ID NO: 19267 - protein, 81 aa, Rhinopithecus roxellana
QAFLAFGDVTVDFTQKEWRLLNPAQRALYREVTLENYSHLVSLGIYAEHVLRPKNLGLAHQRQQQLQFSDQSFQSDTAEGQ

SEQ ID NO: 19268 - protein, 81 aa, Rhinopithecus roxellana
MTFEDVAVEFTQWEWGQLNPAQKDVYREVMLENFRNLAFLGLLVSKPYVICQLEEGGEPFIVERDISTGADSDWERRSKSK

SEQ ID NO: 19269 - protein, 81 aa, Bison bison
SQGWLTFQDVAIDFTQEEWECLDLGQRELYRDVMLQNYRNLASLGFVVSKPDLVTFLEQMKYPRNIRRVETTAIYTELIQK

SEQ ID NO: 19270 - protein, 81 aa, Bison bison
SVTFPDVAVYFSWEEWRLLDEAQRRLYLDVMLENYALISSLGCCCGTENAEAPSERITSLQVSQARTPKAALSTQKMNPCE

SEQ ID NO: 19271 - protein, 81 aa, Bison bison
GLLTFEDVAVFFTQEEWDYLDPAQRSLYKDVMMENYGNLVSLDVLNRDKDEEPTVKQEIEEIEEEMEPQGIILTRIKSEID

SEQ ID NO: 19272 - protein, 81 aa, Bison bison
GWLTFRDVAIDFTQEEWECLDLGQRELYRDVMIENYRNLACLGLVVSKPDLVTFLEQMKDLRNIRRMETIGIYPGRCEWME

SEQ ID NO: 19273 - protein, 81 aa, Acinonyx jubatus
SQEPVTFEDVAVYFTQNQWASLDPMQRALYREVMLENYTNMASLAFPFPKPVLVSHLERGEAPWGPDPWEAEVLRRICPGG

SEQ ID NO: 19274 - protein, 81 aa, Bison bison
MLETYSNLVSVGYEGTKPYVILRLEQEEAPWICEAACLGCHCWENIWQVKVHRKRRQDMLLRQGPFISRKMFPKERSHECN

SEQ ID NO: 19275 - protein, 81 aa, Bison bison
MLENYSSLVSLGYEVMKPGVILKLEQGEDPWTGDGEIPSSGSIDQVFQVNGHMTWHKDNKKFKNMKQDHECDALGKKFNLS

SEQ ID NO: 19276 - protein, 81 aa, Odocoileus virginianus
PQDLLTFEDVAVEFTWWEWGQLDPAQKDLYWEVMLENFKNLASLDWERRPQAKEAMLSQGLSKEELLQRASVEKHIRDELR

SEQ ID NO: 19277 - protein, 81 aa, Odocoileus virginianus
FQEPVTFEDVAVYFTQNQWASLDSAQRALYREVMLENYANVASLAAFPLPKPDLIFWLERGEEPGCLDPWTLVGGEDLRGI

SEQ ID NO: 19278 - protein, 81 aa, Odocoileus virginianus
SVTFEDIAVDFTQEEWALLDTSQRKLFRDVMLENISHLVSVVISDREDDLKKQEMLPMQHICKKNTPLISAMQSSHSQDDP

SEQ ID NO: 19279 - protein, 81 aa, Odocoileus virginianus
SQLTFKDVFIEFSPEEWECLDPAQRTLYKDVMVETLRNLLSVDMSHIHMIKKLHAKANSGKGEIFQRVMFGRTESLDIKDF

SEQ ID NO: 19280 - protein, 81 aa, Odocoileus virginianus
PQGSTPFGSLTVDYTQGGWRQLAPAPRDRFEEGMPEKSRNLVLLGLPVSQPGMNFQLEQREGSWMLKRDDLRNACPDWKII

SEQ ID NO: 19281 - protein, 81 aa, Odocoileus virginianus
SQVSVTFEDVAVLFTRDEWRKLAPSQRNLYQDVMLENYSNLVSLGLPFSKPEVISLLQQGEDPWKVEKEGPEGSSLECKSS

SEQ ID NO: 19282 - protein, 81 aa, Odocoileus virginianus
FQGSLSFRDVAVGFTRKEWQQLDPTQRTLYRDVMLENYSHLVSVGCQVTKPAVISRLEQGQEPWMEEEEILTWSFPEVSQV

SEQ ID NO: 19283 - protein, 81 aa, Odocoileus virginianus
ALALISFEDVAITFTGEEWRHLDLAQRTLYQEVMLETCGLLVSLGHPVPKAELIHLLEYGPGLWTVKRGLSRNTCTGEKAN

SEQ ID NO: 19284 - protein, 81 aa, Odocoileus virginianus
SQGSVTFRDVSIDFSREEWEWLQPAQRDLYRNVMLENYGHLVSLAGLNISKPDVVSLLEQGKEPWLGNGDVSRELFPASKP

SEQ ID NO: 19285 - protein, 81 aa, Odocoileus virginianus
AQGNVTFEDVFVSFSQEEWGLLDEAQRLLYREVMLENFALMASLGYTSSVAHGVSPQELGREPWVSDGADTTPALTREAQS

SEQ ID NO: 19286 - protein, 81 aa, Odocoileus virginianus
SRSPLTFGDVAVEFSGEEWARLDSAQRSLHRSVMLENYRNLASLGLCMSKPEMISSLEQRKEPWAVKRKSTRGRCPDSQTA

SEQ ID NO: 19287 - protein, 81 aa, Cebus imitator
MLENYRNLVSLGVVISNPDLVTYLEQRKEPYNLKIHETAAKPPATCSPFTQDLSPVQGTEDSFHKRILRRCEKCGHENLRL

SEQ ID NO: 19288 - protein, 81 aa, Callithrix jacchus
PRGSTSFSSVTVAFAQEGWRYLVSTSRDRFKDRIPEKSRNLVLLGLPVSQPGMNSQLELREGAWMLESEDLRNPSPNWKIV

SEQ ID NO: 19289 - protein, 81 aa, Callithrix jacchus
PCLPPRPHRPLCSRHLDLMAFEDVNVYFSPEECRLLDTAQRALYHHVMLENFTLVTSLGLSTSRPLWSSNLSVVRTPGFPV

SEQ ID NO: 19290 - protein, 81 aa, Macaca mulatta
CEVSVSFEDVTVDFSREEWQQLDSTQRRLYQDVMLENYSHLLSVGFEVPKPEVIFKLEQGEGPWMLAGEAPHQSCSGEAIE

SEQ ID NO: 19291 - protein, 81 aa, Macaca mulatta
EPVTFKDVAGVFSEEELRLLNLAQRKLYRDVMLENFRNVVSVGHQSTPDGLPQLEREEKLWMMKMATQRDNSSGGKNLKEM

SEQ ID NO: 19292 - protein, 81 aa, Callithrix jacchus
PQKSVTFEDVAVYFTQAEWDGLSPAQRTLYRDVMLENYGNVASLGFPLLKPAVISQLEGGGELGGPSPLAAGTGLHVLRTV

SEQ ID NO: 19293 - protein, 81 aa, Macaca mulatta
GSVSFTDVTVDFTQEEWEQLDPSQRILYMDVMLENYSNLLSVEVWKADDQMERDHRNPDEQARQFLILKNQTPVEERGDLF

SEQ ID NO: 19294 - protein, 81 aa, Macaca mulatta
SLGSELFRDVAIVFSQEEWQCLAPAQRDLYRDVMLETYNNLVSLGLAISKPDVISFLEQGKESWMVERVVSGGLCPVLESR

SEQ ID NO: 19295 - protein, 81 aa, Monodon monoceros
NCITKPEVIFKIEQGEEPWILEERFPKQCRSEDWKVDDLIESSQENEDEHFWQLAFTNQTLSTDSGDRVRKTLNLGTDSVP

SEQ ID NO: 19296 - protein, 81 aa, Pan troglodytes
CYQDSVTFDDLAVDFTPEEWTLLDPTQRNLYRDVMLENYKNLATVGYQLFKPSLISWLEQEESRTVQRGDFQASEGKVQLK

SEQ ID NO: 19297 - protein, 81 aa, Pan troglodytes
SQASVSFKDVTIEFTQEEWQQMAPVQKNLYRDVMLENYSNLVSVGYCRFKPEVIFKLEQGEEPWFSEEEFSNQSHPKDYRG

SEQ ID NO: 19298 - protein, 81 aa, Aotus trivirgatus
SQGLVSFKDVAVDFTQEEWQQLDPTQRTLYRDVMLENYSHLVSMGYPVSKPDVISKLEQGEEPWIVKRDISNWIYPDEYQA

SEQ ID NO: 19299 - protein, 81 aa, Papio anubis
PQGPLQFRDVAIEFSLEEWHCLDTAQRNLYRNVMLENYRNLVFLGIVVSKPDLITCLEQAEKPLTMKKHEMVANPSVLCSH

SEQ ID NO: 19300 - protein, 81 aa, Sapajus apella
TQGSLTFKDVAIEFSQEEWKCLDPLQKALYRDVMLENYRNLGFLGLCLPDLNIISMLEQGKEPWTVVSQVKITRNPNWGEC

SEQ ID NO: 19301 - protein, 81 aa, Vulpes vulpes
CQGSLSFRDVAVGFTRKEWQQLDPTQRMLYRDVMLENYSHLVSVGCQVTKPAVISRLEQGQEPWMEEEEILRWSFPEEILQ

SEQ ID NO: 19302 - protein, 81 aa, Vulpes vulpes
VFQGLSFKDVAVNFTEEEWRELDPAQRDLYRDVMLENYRNLISLGFPFSKPDIICQLEQAVNPWMQKAELLRSSCTHLETR

SEQ ID NO: 19303 - protein, 81 aa, Vulpes vulpes
TGGLRQRRDTHRTEQVLEWLFISQEQSKPTQSQGPLSFVDVFVDFTWEEWRLLDPAQKHLYRSVMLENYSHLVSLGRSSLQ

SEQ ID NO: 19304 - protein, 81 aa, Callorhinus ursinus
MDHELVTFRDVVINFSQEEWECLDSAQRDLYWDVMMENYSNLVSLDLESKYDTKTRKDITGSQWKVTESKFIGLESSVFRN

SEQ ID NO: 19305 - protein, 81 aa, Callorhinus ursinus
SQSPVTFEDVAVYFSKEEWGLLDASQRHLYHNVMLENFELMTSLGCWHGVEDEGAHSKQNTSVEGMSQVRIPSANPSTQKA

SEQ ID NO: 19306 - protein, 81 aa, Rhinolophus ferrumequinum
PAQVSVTFDDVAVTFTQEEWGHLDPAQKTLYQEVMLENCGLLVSLGCPVPRPELICQLEQELWTVKKDLSQSTCPDDKGKP

SEQ ID NO: 19307 - protein, 81 aa, Rhinolophus ferrumequinum
PKVPVTFDDISIYFSTPEWEKLEEWQKELYKNIMKGNYESLISMDYAMNQPDVLSQIQPEGEHNTEDQAGPEESEIPPDPS

SEQ ID NO: 19308 - protein, 81 aa, Rhinopithecus roxellana
GLLTFEDVAVFFTQEEWDYLDPAQRSLYKDVMMENYGNLVSLDVLNRDKDEEPTVKQEIEEIEEEVEPQSVIVTRIKSEID

SEQ ID NO: 19309 - protein, 81 aa, Rhinopithecus roxellana
FFSREPICPFEEKTKVEGMVEDYLANSYQDSVTFDDVAVDFTPEEWALLDTTQKYLYRDVMLENYMNLASVDKRLQWMETL

SEQ ID NO: 19310 - protein, 81 aa, Acinonyx jubatus
PVTFEDVAVLFTPEEWMFLDSAQRSLYRDVMLENYRNLASVEPSLPPQGSIPNQDIFAEISVGMERGRPQTGENLYEPSEL

SEQ ID NO: 19311 - protein, 81 aa, Rhinopithecus roxellana
CQESVTFEDVAVVFTDEEWSHLVPIQRDLYKEVMLENYNSIVSLGLPVPQPDVIFQLKRGDKPRVVDLHGSEERERPESVS

SEQ ID NO: 19312 - protein, 81 aa, Rhinopithecus roxellana
QAEVTFEDVAVFLSREEWGRLGPAQRGLYRDVMLETYGNLVSLGVGPAGPKPGVISQLERGDEPWVLDVQGTSEREHLRVN

SEQ ID NO: 19313 - protein, 81 aa, Rhinopithecus roxellana
FQRSVLFSDVSIDFSPEEWEYLDLEQKDLYRDVMLENYSNLVSLGCFISKPDVISLLEQGKEPWKVVRKGRRQYPDLETKY

SEQ ID NO: 19314 - protein, 81 aa, Rhinopithecus roxellana
AQVSVTFDDVAVTFTQEEWGQLDLAQRTLYQEVMLENCGLLVSLGCPVPRPELIYHLEHGQEPWTRKEDLFQDACPGDKGK

SEQ ID NO: 19315 - protein, 81 aa, Acinonyx jubatus
MLQVTFSDVAIDFSHEEWGWLDSAQRDLYKDVMVQNYENLVSLDWESRWENKELLMKEDIYDEDSPQMVIIEKITKQSHEF

SEQ ID NO: 19316 - protein, 81 aa, Rhinopithecus roxellana
PNRCLMYMLGEVYFSHEEWGWLDSAQRDLYKDVMVQNYENLVSVAGLSVTKPYVIMLLEDGKEPWMVEKKLSKGMIPDWEA

SEQ ID NO: 19317 - protein, 81 aa, Acinonyx jubatus
KLKSVTFEDVAVYFTQTEWNGLSPAQRALYRDVMLENYGNVASLGFSLLKPAVILQLEGAVDIESQTDNNLTKEIYKEKHN

SEQ ID NO: 19318 - protein, 81 aa, Bison bison
GLGFCTFTSTTVTGLIPPKCTSPVLLCLTLQVVVTFKDVAVTFTREEWGQLDLDQRTLFREVMLETCGLLVSLAWKQVADT

SEQ ID NO: 19319 - protein, 81 aa, Odocoileus virginianus
PQGSVTFEDVAVYFSWEEWCLLDEVQIHLYLDVMLENFALVCMLGSWRGVQDKETPSEEIKPAGVLQFCTPRAGLSPEKTH

SEQ ID NO: 19320 - protein, 81 aa, Odocoileus virginianus
SQDSVTFADVAVYFTQEEWTLLNPFQRKLYRNVMLENYKNLTTAGHQAFKPTLISWLEQEVLKTVEKGILQEWEMQLTSND

SEQ ID NO: 19321 - protein, 81 aa, Cebus imitator
PQVSLTFEDVAVLFTRDEWRKLAPSQRNLYRDVMLENYRNLVSLGLPFTKPKVISLLQQGEDPWKVEKDCSGSSFLGCKSN

SEQ ID NO: 19322 - protein, 80 aa, Cebus imitator
MGEPLEFRDVAIEFSLEEWHCLDTAQRNLYRDVMLENYRNLVFLGIAVSKPDLITWLEQGKKPLTVKGHEMIATPPGRCK

SEQ ID NO: 19323 - protein, 81 aa, Cebus imitator
GRLTFRDVAIEFSLAEWKCLTHAQRALYREVMLENYRNLESVDRFLKSMMKFSPAGQGSTREGIHTGTLGKYTSHHIGDFC

SEQ ID NO: 19324 - protein, 81 aa, Cebus imitator
CQESVTFEDVAVVFTDEEWSHLVPIQKDLYKEVMLENYKSVVSLGLPVPQPDMIFQLKRGDEPWMVDLHGSVETEWPKSVS

SEQ ID NO: 19325 - protein, 81 aa, Cebus imitator
QDSVAFEDVAVNFTHEEWALLGPSQKNLYRDVMQETIRNLNCIGMKWENQNTDDQYQNLRRNLRCDVVERFGKSKDGSQCG

SEQ ID NO: 19326 - protein, 81 aa, Macaca mulatta
PKVPVTFDDVAVYFSEQEWGKLEDWQKELYKHVMRGNYETLVSLDYAISKPEVLSQIEQGKEPCHWRRPGPKIPDVPVDPS

SEQ ID NO: 19327 - protein, 81 aa, Zalophus californianus
KDQESLTLEDVAVDFTWEEWQLLAPTQKDLYRDVMLENYSNLVSVGYVARKPDALSRLEQGELWTTEHEIPSRIRPEIKKD

SEQ ID NO: 19328 - protein, 81 aa, Sapajus apella
ACRSITFRDVAIDFSLQEWEYLNLVQKTLYQEVMMENYDHLVSLGHSISKPDLITLLEQGKEPWMIVREETRGECTDLDSR

SEQ ID NO: 19329 - protein, 81 aa, Saimiri boliviensis
SKDLVTFGDVAVNFSQEEWEWLNPAQRNLYRKVMLENYRTLVSLGVSVSKPDVISLLEQGKEPWMVKKEATRGVCPDWEYV

SEQ ID NO: 19330 - protein, 81 aa, Rhinolophus ferrumequinum
FKEPLTFKDVAVVFTEEELGLLDSTQRKLHQDVMLENFRNMVSVGHQPFTPDVVPPLEREEKLWMTKPASQSHGSLGDKNL

SEQ ID NO: 19331 - protein, 81 aa, Ursus maritimus
SPGFVSFADVAVYFSPEEWGCLRPAQRALYRDVMRETYGLLDALGFSGPKPAFISWVEGEVEAWSPESQDPEGESPAAVIR

SEQ ID NO: 19332 - protein, 81 aa, Acinonyx jubatus
SSQGLLTFRDVAVVFSLEEAGCLNQSQRELYRDVMLETYGHLLFLGLVTKPDLVLFLELKKEFWERKRKETVATHPAVSSN

SEQ ID NO: 19333 - protein, 81 aa, Bison bison
KGGLMAFEDVAVHFSQEEWGLLDTAQRALYRRVMLENFALLASLGLSVSRPRVVTQLERGNEPWVLSGADVTLAWDAQRRP

SEQ ID NO: 19334 - protein, 81 aa, Bison bison
AQELLTLEDVAVEFNWEEWQLLDSAQRDLYWDVMLENYNNLVSLGYQGTKPDMLSKLEHGREPCIIENEMRNRIFPGIRKG

SEQ ID NO: 19335 - protein, 81 aa, Odocoileus virginianus
LQGGVTFEDVAVAFTQEEWQRLSPEQRDLYRDVTLENFRNLVSVGGGEAAKPGVILRLENGEEPWTVETQVLRSCGPAEKD

SEQ ID NO: 19336 - protein, 81 aa, Odocoileus virginianus
MLETYSHLLSIGYQVPETEVFMLEQGNEPWPLQGEGPYQSCPEELWQIGDQIESYHQRENRSLRNVAFIKKVLTIQRDYAY

SEQ ID NO: 19337 - protein, 81 aa, Odocoileus virginianus
VSIAFQDLAVRFSEDEWRLLGEGQRALYLDVMRENYDTLASLGTAEPLPLSAFLSPSEPGGAVGAWSRAGDGQEPTQGGGP

SEQ ID NO: 19338 - protein, 81 aa, Odocoileus virginianus
EEGRVTFEDVAVYFSWEEWGLLDEAQRLLYHGVMLETFSLMASLGLTSFRTHDMTQLEQCGEPCVPSEGVSTTATPAGCCC

SEQ ID NO: 19339 - protein, 81 aa, Odocoileus virginianus
QLTFKDVAVEFSQEEWECLDPAQRAFYMDVMVETLRNLISVDISHIHVVKKLQPTASSDTGDAFQTVTLERQKSPEMKYFC

SEQ ID NO: 19340 - protein, 81 aa, Odocoileus virginianus
MLDNYRSLVSLGVSVSKPDVISLLEQGKEPWLMKEEGPRGARPDWEYAFKNKEFPSKQVIYEESSKIMMMGRSHLSYNLNC

SEQ ID NO: 19341 - protein, 81 aa, Odocoileus virginianus
LQGLMTFEDVAVDFTQEEWQYLNPPQRTLYRDVMLETYSNLVSVGHHVTKPDLILKLEVEERCLLEGKIPIWSFPEACQVD

SEQ ID NO: 19342 - protein, 81 aa, Odocoileus virginianus
MLENYGNLVSVAGCQLSKPSVISQLEKGEEPWMTEKEGAGDPSSDLKSKTETSASNAKYNILQEQLYHGMMMERFMRDDVI

SEQ ID NO: 19343 - protein, 81 aa, Odocoileus virginianus
VTFRDVAVFFSRDEWLCLDSAQRTLYQEVMLENYSTLFSLGWESLFETRVSEEENQEVMNQLLGDGHFDFKLGKIYINEET

SEQ ID NO: 19344 - protein, 81 aa, Odocoileus virginianus
PKVPVSFEDLAVYFTKAEWNLLDHRQKKLYKQVMLENYDNLESVGLSFSKPQLVIQLEQGEEPWVADVNRITTGMQAGDRM

SEQ ID NO: 19345 - protein, 81 aa, Odocoileus virginianus
SQETLTFRDVFVDFTQEEWQQLDAAQKNLHRDVMLENYSHLVSVGYLVAQPHGIFRLGQGEEEAGMAAGESLMWSCPELWK

SEQ ID NO: 19346 - protein, 81 aa, Odocoileus virginianus
MVTFKDVAVTFTREEWGQLDVDQRTLFREVMLETCGLLVSLGHPVPKPELIHLLEHGQKLWTGARGLPRSTGPGDRAKCQT

SEQ ID NO: 19347 - protein, 81 aa, Cebus imitator
SRSGAVSFADVVVYFSLEEWGCLWPAQRALYRDMMRETCGHLGVLGFSGPKSAFISVEEEVEAWSPEVQDPESESSGTVSR

SEQ ID NO: 19348 - protein, 81 aa, Cebus imitator
TQGSLTFKDVAIEFSQEEWKYLDPVQKALYRDVMLENYRNLGFLGLCLPDLNIISMLEQGKEPWTVVSQVKITRNPNWGEY

SEQ ID NO: 19349 - protein, 81 aa, Callithrix jacchus
LQGLVMFEDVAVYFSREEWGLLNVTQKGLYRDVMLENFALLSSLGLAPSRSPVFTQLVDDEQSCMTSWVDVTLVSRTEASR

SEQ ID NO: 19350 - protein, 81 aa, Macaca mulatta
EQGLVTFEDVAVDFTQEEWQDLNPPQRTLYRDVMLETYSNLVFVGQQVTKPNLILKLEVEEYPAEGKIPFWNFPEVCQVDE

SEQ ID NO: 19351 - protein, 81 aa, Macaca mulatta
RSQESLTFQDVAVDFTKEEWDQLYPAQKNLYRDVMLENYRNLVALGYQLYKPEVIAQLELEEEWVIERDSLLDTLPDGENR

SEQ ID NO: 19352 - protein, 81 aa, Ursus maritimus
AQASVSFKDVTVDFTREEWQHLDPAQKTLYMDVMLENYCHLISVGCHMTKPDVILKLERGEEPWTSFTGHTCLEKNWKEED

SEQ ID NO: 19353 - protein, 81 aa, Ursus maritimus
KSLGAVSFKDVTVDFSKEEWQQLDLAQKSLYRDVMLENYFNLISVGCQVPKPEVIFNLEQEEPRMLDGEISSQSCLDGDIG

SEQ ID NO: 19354 - protein, 81 aa, Camelus dromedarius
MDVRQGSVSFEDVTVEFTQDEWQYVDPAQRTLYRDVMLENYSHLISVGYCFPTPEVIVKLEQDEEPWSLEEESLNQRYPGE

SEQ ID NO: 19355 - protein, 81 aa, Rhinopithecus bieti
PQGLLTFRDVAIEFSLEEWQCLDIAQKNLYRNVMLENYRNLAFLGIAVSKPDLIICLEKEKEPWNMKRHEMVDEPPGICPH

SEQ ID NO: 19356 - protein, 81 aa, Acinonyx jubatus
AQESVMFSDVSIDFSQEEWECLNDDQKDLYRDVMLENYSHLVSMGHSVSKPDVISFLEQGKEPWLVDRELTRDQWPVLESR

SEQ ID NO: 19357 - protein, 81 aa, Rhinopithecus roxellana
MVHLMMFRDVAVDFCQEEWECLDLEQRDLYRDVMLENYSNMVSLGLCIYQPEVFSLLEKGKEPWKILKDETRGPCPDMQSR

SEQ ID NO: 19358 - protein, 81 aa, Acinonyx jubatus
FQASVVFEDVAVNFTPEEWALLNRGQRKLYRDVMLETCRNLSAVGKDGSIPSLVFSEKQKFHSSGDLTRMQEGLLRSPLVE

SEQ ID NO: 19359 - protein, 81 aa, Rhinopithecus roxellana
KKKPVTFEDVAVNFTQEEWDCLDASQRVLYEDVMSEIFKNLASVARIFLHKPELITKLEQEDEQRREFVHLPNTEGLSEGE

SEQ ID NO: 19360 - protein, 81 aa, Rhinopithecus roxellana
YNSVAFEDVAVNFTREEWALLGPSQKTLYRDVMWETIRNLDCIGMKWEDTDVEDQHKNPRRSLRCLIVERFSESSQIPGST

SEQ ID NO: 19361 - protein, 81 aa, Rhinopithecus roxellana
THGQLLFRDVAIEFSQEEWKCLNPGQKALYRDVMLENYRNLVSLGICLPDLSVISMLEQKRDPWTLQSDVKIANNPNGRKY

SEQ ID NO: 19362 - protein, 81 aa, Rhinopithecus roxellana
MFQEAVTFNDVAVAFTEEELGLLGPAQRKLYRDVMVENFRNLLSVGHQPFKQDVSPIERNEQLWMTTATQRQRNLGEKNQS

SEQ ID NO: 19363 - protein, 81 aa, Acinonyx jubatus
DEALMAFRDVAVAFTQKEWRLLSPAQRTLYRDVMLENYSHLVSLGPGTEFQPCVHSCPVAFSSPQFLQQYVLCGHLPQIFP

SEQ ID NO: 19364 - protein, 81 aa, Odocoileus virginianus
AQELLTLEDVAVEFNWEEWQLLDSAQKDLYWDVMLENYNNLVSLGYQGTKPDMLSKLEHGKEPCIIENEMQNRICPGIGKG

SEQ ID NO: 19365 - protein, 81 aa, Odocoileus virginianus
VSVTFEDVAVYFSWEEWGLLDDAQRCLYHSVMLENLSLVISLGCWHGAEDEEAPSEQNISIRGLSQVRIPKEGMFSQKAHF

SEQ ID NO: 19366 - protein, 81 aa, Odocoileus virginianus
AQGFVVFEDVAVYFSQEEWGLLDEAQRLLYCQVMLQNIALLSSIGCRHGTQDEVALSEQHDVAARSQVKTPKPGPCIQKPH

SEQ ID NO: 19367 - protein, 81 aa, Odocoileus virginianus
SQGRLTFRDVAIDFTQEEWECLDLGQRELYTDVMVENYRNLASLGLVVSKPDLVTFLEQRKDLRNIGRMQTTGIFPGCRIL

SEQ ID NO: 19368 - protein, 81 aa, Odocoileus virginianus
SVTFEDVAVYFSWEEWRLLDEAQRSVYLDVMLENYALISSLGCCCGTENAEAPSELITSLGVSQARTPKAALSSQKMHPCE

SEQ ID NO: 19369 - protein, 81 aa, Odocoileus virginianus
MFKDVAIDVSQEEWECLNPAQRNLYKDVMLENYSNLVSLGLSVSKPAVITSLEQGKEPWMVLREVTGERCPDLVSKCEPKK

SEQ ID NO: 19370 - protein, 81 aa, Cebus imitator
ACRSITFRDVAIDFSLQEWEYLNLVQKTLYQEVMMENYDHLVSLAGHSISKPDLITLLEQGKEPWMIVREETRGECTDLDS

SEQ ID NO: 19371 - protein, 81 aa, Cebus imitator
IQGQVNFEDVFVYFSQEEWVLLDEAQRLLYRDVMLENFALMASLGHTSFTSHIVASLVWVPDWMDVTPVVATGTLSGSGPG

SEQ ID NO: 19372 - protein, 81 aa, Cebus imitator
RKVSITFKDLAVRFSEEEWRLLEEGQREFYRDVMRENYETLVSVGTAELLPLSAFLSPPEPGGAVGGGSHTDEGQEPAGCG

SEQ ID NO: 19373 - protein, 81 aa, Cebus imitator
MELLTFRDVAIEFSPEEWTYLDPAQQNLYRDVMLENYRNLVSLGVAICNPDLVTCLEQRKEPCNVKIRKTVANPPAVCSHF

SEQ ID NO: 19374 - protein, 81 aa, Cebus imitator
ARGCVVFEDVFVYFSREEWELLDDAQRLLYHDVMLENFALLASLGIAFSRSDAVMKLEQGEEPWVYDQVDMTSATGRESQR

SEQ ID NO: 19375 - protein, 81 aa, Cebus imitator
AQESVTFEDVAVNFTDREWQCLTYAQRHLYKDVMLENYGNMVSVGFPFPKPPLISHLERGVELCVQDPQDRESLSCSCLVS

SEQ ID NO: 19376 - protein, 81 aa, Callithrix jacchus
VIGWLSFKDISMEFTWDEWQLLDSTQKYLYREVILENYHNLISVGYHGAKPDLIFKLEQGEDPWIVNAKISRESCPDGWEE

SEQ ID NO: 19377 - protein, 81 aa, Macaca mulatta
EAVTFKDVAVFFTEEELGLLDPAQRKLYQDVMLENFTNLLSVGHQPFHTFHFLREEKFWMMETATQREGSSGGRTVVEAGP

SEQ ID NO: 19378 - protein, 81 aa, Macaca mulatta
MSLLEKSGAGGVSARTRGCPPTTEPHAGFLVFKPELISRLEQGEEPWVLDLQGAEGTEAPRTSKTDSTIRTENEQSCEDMD

SEQ ID NO: 19379 - protein, 81 aa, Aotus trivirgatus
VQESVTFKDVAVLFTQEEWGQLSPAQRALYRDVMLENYSNLVSLGLLGPKPDIFSQLEKKEEWMPEDPSGGFCLDWMTMPV

SEQ ID NO: 19380 - protein, 81 aa, Pan troglodytes
MFKEAVTFKDVAVAFTEEELGLLGPAQRKLYRDVMVENFRNLLSVGHQPFKQDVSPIERNEQLWVMTTATRRQGNLGEKNQ

SEQ ID NO: 19381 - protein, 81 aa, Callorhinus ursinus
GWVPALFDEVAIYFSDEEWEVLTEQQKALYREVMRMNYETVLSLEFPFPKPDMITRLEGDEEFQNSDEWQLQGGTFAENEE

SEQ ID NO: 19382 - protein, 81 aa, Acinonyx jubatus
GLGSVSFKDVTVDFTRDEWLQLTGTQRTLYRDVMLENYSHLVSVGCHLTKPEVIFKLEQGEELWPSRGESPDQGDQDSLQS

SEQ ID NO: 19383 - protein, 81 aa, Acinonyx jubatus
THGSMPFSSVTVAFTQEGWRHLIPAPKDRFKEGIPENTRNLVLLGLPVSQPGMNSQLEQREEGPWMLEGGGLRSTCTDWKI

SEQ ID NO: 19384 - protein, 81 aa, Rhinopithecus roxellana
MGPLTFMDVAIEFSVEEWQCLDTAQQNLYRNVMLENYRNLVFLGIAVSKPDLITCLEQGKEPWNVERHEMVAKPTGMCCYF

SEQ ID NO: 19385 - protein, 81 aa, Acinonyx jubatus
FQHLVMFRDVAVDFSQEEWECLNSYQRNLYRDVILENYSNLVSVGCTISKPDVITLLEQGKEPWMVVRDERRRRSLDLEAR

SEQ ID NO: 19386 - protein, 81 aa, Rhinopithecus roxellana
FQKPVTFEDVAVNFTQEEWDCLDASQRVLYEDVMSEIFKNLASVARIFLHKPELITKLEQEDEQRRETQVLQASQGGPPFF

SEQ ID NO: 19387 - protein, 81 aa, Rhinopithecus roxellana
HGSVTFRDVAIDFSQEEWEFLDPAQRDLYRDVMWENYNNFISLAGPSISKPDVITLLDEEGKEPGMVVREGTRRYCPDLES

SEQ ID NO: 19388 - protein, 81 aa, Rhinopithecus roxellana
AATLRLSAQGTVTFEDVAVKFTWEEWNLLSEAQRCLYRDVMLENLALISSLDSVLDGSADNTQTGNLGQSVLPSHPEQKTA

SEQ ID NO: 19389 - protein, 81 aa, Rhinopithecus roxellana
AQGIVTFEDVAVYFSWKEWGLLDEAQKCLYHDVMLENLTLTTSLGGCGAGDEEAPYQQSTSSQWVSQVRLPKALPSPQKTN

SEQ ID NO: 19390 - protein, 81 aa, Rhinopithecus roxellana
GSLTFQDVAIEFSLEEWQCLDTAQQNLYRNVMLENYRNLVFLGIAVPKPDLIIFLEQGKEPWNMKKHEMAEEPPVVCSHFA

SEQ ID NO: 19391 - protein, 81 aa, Acinonyx jubatus
GFRTASCWDISMEFTWDEWQLLDSAQKYLYRDVILENYSHLVSVGYHGTKPDLIFKLEQGEEPWIINAKVSRQSCPEDWKE

SEQ ID NO: 19392 - protein, 81 aa, Rhinopithecus roxellana
MVSFEDVAVPLSQEEWNCLIPAQRGLYRDVMLETYGNLVSLGLQASKPDVISRLEQGDEPWTPHILRTQGSWSWRHKREGY

SEQ ID NO: 19393 - protein, 81 aa, Rhinopithecus roxellana
EMGLLTFRDIAIEFSLAEWQCLDHAQQNLYRDVMLENYRNLVSLGIAVSKPDLITCLEQNKEPRNIKRNEMVSKHPVTCSH

SEQ ID NO: 19394 - protein, 81 aa, Rhinopithecus roxellana
THGQLLFRDVAIEFSQEEWKCLNPGQKALYRDVMLENYRNLVSLDFSLLARDPHVFRVEAWRTPNFGGNESPLPSPRALLA

SEQ ID NO: 19395 - protein, 81 aa, Bison bison
AAGSVTFNDVTMAFTRKEWEQLDPAQKSLYKDVMLENYSNLASMGYQALKPDMISKLEKGEEPWLGKGKGSRQGGSSEIAR

SEQ ID NO: 19396 - protein, 81 aa, Bison bison
MVENFRNLVSVGQVPFKADMVSQLETEEKLWTMERETQRNGHSSEIHSAVTSGSKIPNEMETLGKVMFQYLSCEELSCWQI

SEQ ID NO: 19397 - protein, 81 aa, Bison bison
GMVTFRDVAIDFSQEEWEFLDPAQRDLYVDVMLENYSNLVSLDLESTYETKNTFSKKDIFEINFSQWKIKERSKTIELEAS

SEQ ID NO: 19398 - protein, 81 aa, Odocoileus virginianus
HQGSVTFEDVAMYFSWEEWCLLDEAQIQLYLDVMLENFALVCMLGSWHGVQDEETPSEQSKSARVSQFRTPRACLSPEKAQ

SEQ ID NO: 19399 - protein, 81 aa, Odocoileus virginianus
SQGRLTFQDVAIDFTQEEWECLDLGQRELYRDVMLESYGNLASLGLMVSKPDLVTFLEQMKNSWDVRRTHTTATYPALSSH

SEQ ID NO: 19400 - protein, 81 aa, Odocoileus virginianus
PQKSVTFEDVAVYFTQTEWDSLSTAQRALYRDVMLENYGNVASLGFPLLKPAVISQLEGGDIDIQTDNNLTEEMNEEKYNT

SEQ ID NO: 19401 - protein, 81 aa, Odocoileus virginianus
VTFEDVAVNFSWEEWGLLDESQKRLYHDVMLENLALISSLGLILTSLNSIPQCFFTLLLLQCCPTSAYTFCVIRLLAWRRG

SEQ ID NO: 19402 - protein, 81 aa, Odocoileus virginianus
GSVSFTDVTVDFTQEEWEQLDPSQRILYMDVMLENYSNLLSVEVWKADDQMETDHRSPDEQARPFIIFKDQTTIEERDNNL

SEQ ID NO: 19403 - protein, 81 aa, Odocoileus virginianus
AHGSLTFSDVAIGFSQQEWECLDPVQKTLYRDVMMENYGNLVSLGHSISKPNVITLLEQGKEPWLVVREETRSWCADLDSR

SEQ ID NO: 19404 - protein, 81 aa, Odocoileus virginianus
SQEPLTFKDIIVDFTQEEWGHLAPAHWHLYLEVMLENYGNLVSVGYQLSKRGVISQLEKGEELWLMETEVSGGPSPGKSKA

SEQ ID NO: 19405 - protein, 81 aa, Cebus imitator
EEALMGFWDVAVAFTQKEWKLLSSAQRTLYREVMLGNFYSEVVLGIAFSKPKLITQLERGDEPWREESKHLLDLCPALGRQ

SEQ ID NO: 19406 - protein, 81 aa, Pan troglodytes
KEAFVAFRDVAVDFTQEEWRLLSPAQRTLHREVMLETYNHLVSLEIPSSKPKLIAQLEQGEEPWREERKCPLDLCPESKPE

SEQ ID NO: 19407 - protein, 81 aa, Carlito syrichta
SQGLVTIKDVSLCFSQEEWRSLDPSQTDFYGEYVMQENCGIVVSLRFPIPKLDMLSQLEGGEEQWVPDPHDLEERDILRVT

SEQ ID NO: 19408 - protein, 81 aa, Delphinapterus leucas
DEALMAFKDVAVAFTQKEWKLLSPAQRTLYRDVMLENYSHMVSLGIAFPKPKLIIQLEQGDEPWREESDSLLDLCPAEPRT

SEQ ID NO: 19409 - protein, 81 aa, Zalophus californianus
FKETVTFKDVAVVFTEEELGLLDPAQRKLYGDVMLENFRNLLSVGHQPFTPDVILQFERGEKLRMIKTAAQGPWASGDKNL

SEQ ID NO: 19410 - protein, 81 aa, Delphinapterus leucas
FQEAVTFKDVAVTFTEEELGLLDSTQRKLYREVMLENFRNLLSVGHQSSKPDMISQLEREEKLWMTEVQTQRGGHSGARNH

SEQ ID NO: 19411 - protein, 81 aa, Sapajus apella
QGPLTFRDVTIEFSPEEWRCLDPAQRTLYRDVMLENYRNLVSLDISPKYKMKELLSTAQGDTEVFHAGILDRHESHHIGDF

SEQ ID NO: 19412 - protein, 81 aa, Balaenoptera acutorostrata
MDSVGFEDVAVNFTAEEWALLDPAQRKLYRDVMLETFRNLASVGSCSQVKTSRSSAHWDILETGLCSEEKVVRFTRNDSRS

SEQ ID NO: 19413 - protein, 81 aa, Balaenoptera acutorostrata
WKGLLAFEDVAVYFTREEWDALHWPQKALYRDVMLDNYRNVLSLGFQFPKPEVICQLEQWEEPWILDLPRAGTRKASGSAC

SEQ ID NO: 19414 - protein, 81 aa, Vulpes vulpes
AYGSLSFRDVAISFSQEEWECLDPAQRTLYRDVMLETYSNLVSLDLQSNYGAEKLSPENDICEINLPKQSIKKISKTLCLK

SEQ ID NO: 19415 - protein, 81 aa, Rhinolophus ferrumequinum
AALPLTFEDIAIYFSAQEWRTLEAWQKELYKHVMRTNYEILVSLDGGFPKPEVISQIEQGRELFRNLGERQKSENIICSSA

SEQ ID NO: 19416 - protein, 81 aa, Ursus maritimus
AQGLVTFGDVAIEFSQEEWKCLEPAQRDLYRDVTLENFSNLVSLGLSISKPDVISLLEQGREPWMITNDMTGPWCPELESR

SEQ ID NO: 19417 - protein, 81 aa, Phyllostomus discolor
LVKIEDVADVAVSFILEEWGHLDQSQKSLYRDGRKENYESITSMDYESRSNNMELIVKQISDEAKSHWMTSGCTERNVPQS

SEQ ID NO: 19418 - protein, 81 aa, Phyllostomus discolor
VMFRDVVIDFSQEEWECLDFAQRHLYRDVMLENYSNLVSLDLPSRCANKYLPPRKDTYETELSQWEMSNRLENYDLKESSS

SEQ ID NO: 19419 - protein, 81 aa, Acinonyx jubatus
FQEPVMFKDVAVVFSEEELGLLDPTQRKLYRDVMLENFRNLVSVGNQPFKPELISQLEREEKLLMMETETQRDGCLGAKSQ

SEQ ID NO: 19420 - protein, 81 aa, Odocoileus virginianus
MLENYFNLISVGCQVPKPEVIFNLEWGEEPFMWNDKTSSQSCLDQDIGFGTSQQGISEDVSVWFEGIRLFPRDDLYSILEE

SEQ ID NO: 19421 - protein, 81 aa, Odocoileus virginianus
QAEVTFEDVAVLLSQEEWGLLGPSQKGLYREVMLETYRNLLSLAHGTRTENQEVTSGEMLFGRELDALRGSVLQGPEPGEA

SEQ ID NO: 19422 - protein, 80 aa, Odocoileus virginianus
MAAAAALRDPPQDSVTFEDVAVNFSWEEWGLLDESQKRLYHDVMLENLALISSLDPRPASPCLAGMDPESGVSPPCLPSP

SEQ ID NO: 19423 - protein, 81 aa, Odocoileus virginianus
GQGHVTFEDVAVSFSQEEWGLLGEAQRLLYYDVMLENLSLIASLGCWRGGDTKEASSEQCVSAEQVTRDRNPQVDPCILKA

SEQ ID NO: 19424 - protein, 81 aa, Odocoileus virginianus
FQESVTFEDVAVHLTREEWGCLDPVQRALYREVMLENYGNLVSLGILLRLPTTRIHSVNSCPALSHTQASAFSGEALAILS

SEQ ID NO: 19425 - protein, 81 aa, Odocoileus virginianus
FQGRLTFQDVALDFTQEEWECLDLGQWELYRDVMLENYRNLASLGLVASKPDLLTFLEQMKNPWDVRRLEMPAIYTGRCEW

SEQ ID NO: 19426 - protein, 81 aa, Odocoileus virginianus
TQGLMAFEDVAVHFSQEEWGLLDTAQRSLYRRVMLENFALLASLGLSVSRPHVVTQLECGEEPWVLSGVDVTLPQDAQRRP

SEQ ID NO: 19427 - protein, 81 aa, Cebus imitator
AQVSVTFDDVAVTFTQEEWGQLDLAQRTLYQEVMLENCGLLVSLGCPVPRPELIYHLEHGQEPWTRKEDLSQGTHPGDKGK

SEQ ID NO: 19428 - protein, 81 aa, Cebus imitator
MFSDISIDFSPEEWEYLDLEQKDLYRDVMLENYSNLVSLGCFISKPDVISLLEQGKEPWKVVRKRRGQCPDLQTKYEAKKL

SEQ ID NO: 19429 - protein, 81 aa, Cebus imitator
SQESVSFKDVTIEFTQEEWQQMAPVERNLYRDVMLENYSHLVSVGYCLFKPEVIFKLERGAEPWLSEEEFSNKSHPKDYRG

SEQ ID NO: 19430 - protein, 81 aa, Macaca mulatta
RPESVTFEDVAVYFSENEWIGLGPAQRALYRDVMLENYGAVASLAAFPFPKPALISQLERGEAPWCSVPWGALDGEDPRSI

SEQ ID NO: 19431 - protein, 81 aa, Callithrix jacchus
EPGPVTFGDVAVYFSREEWGCLRPAQRALYRDVMRETYSHLGALGVEGSKPALISWVEEEAELWGPAAQDPEVAKRPTEAD

SEQ ID NO: 19432 - protein, 81 aa, Sapajus apella
MLENYRNLVSLGLAVSKPDLITFLEQRKEPWNAKSAETVAIQPDMFSHYNKDLLTEHCTEASFQKVIPRTHESCDLENLHI

SEQ ID NO: 19433 - protein, 81 aa, Balaenoptera acutorostrata
SKAPVTFGDLAIYFSQEEWEGLSPRQKDLYEDVMLENYQNLVSLGLSFRRPNVITLLEKGKAPWMVEPVKRRGGLDLGSKC

SEQ ID NO: 19434 - protein, 81 aa, Vombatus ursinus
MLENYGNLVCLGLAASKPDVICQLERGEAPGMTGGDVVPRSDRPNWKTRPEAKESIPKLDISMETSSQKKFTRWRGSLVYN

SEQ ID NO: 19435 - protein, 81 aa, Balaenoptera acutorostrata
SHTLVTFKDILVNFTREEWKLLDPAQQLMYKDVMLENYRNLMSLGHQLPKPEVILQLEKGEEPWLVERGIHQETHPGEDQT

SEQ ID NO: 19436 - protein, 81 aa, Balaenoptera acutorostrata
FQEAVTFKDVAVTFTEEELGLLDSAQRKLYREVMLENFRNLLSVGHQSSKPDMISQLEREEKLWMMEVQTQRGGHSGARNH

SEQ ID NO: 19437 - protein, 81 aa, Rhinolophus ferrumequinum
PQESVTFKDVAVDFTQDEWRHVDPAQRRLYRDVMLENYSNLVSLGYQVSKPEVIFKLEQGQEPWLSEGEIRRPFCPDWKTR

SEQ ID NO: 19438 - protein, 81 aa, Rhinopithecus bieti
QGLLTFRDVAIEFSQEEWKCLDPAQRTLYRDVMLENYRNLVSLDISSRCVMKTLSSTGQRNTEVIHKGTLQRQASHHIGEC

SEQ ID NO: 19439 - protein, 81 aa, Colobus angolensis
MLMMFRDVAVDFCQEEWECLDLEQRDLYRDVMLENYSNMVSLGLCIYQPEVFSLLEKGKEPWKILRDETRGPCPDMQSRCH

SEQ ID NO: 19440 - protein, 81 aa, Rhinopithecus bieti
SQGSVSFRDVTVGFTQEEWQHLDPAQRTLYRDVMLENYSHLVSVGYCIPKPEVILKLEKGEEPWILKEKFPSQSHLEIINT

SEQ ID NO: 19441 - protein, 81 aa, Camelus dromedarius
GKPKSKAPVTFGDLAIYFSQEEWEWLSPIQKDLYEDVMLENYQNLVSLGLSFRRPNVIALLEKGKAPWMVEPVKRRWGSGE

SEQ ID NO: 19442 - protein, 81 aa, Phyllostomus discolor
PQRPAPFGDVTVALTHKERGRPVPAPGPGSQEETPEQSRNSVLLGLPASQPGMNSQLEQRESPWMLRGEGPRSSCPDWKTV

SEQ ID NO: 19443 - protein, 81 aa, Acinonyx jubatus
QSCVTFEDVAVYFSQEEWGLLDEAQRFLYHDVMLETFALATSLDCWCGAENEEVPSEQSVSVERVSQVRTSKTGLSIQKTH

SEQ ID NO: 19444 - protein, 81 aa, Acinonyx jubatus
MDSVAFEDVTVKFTMEEWALLDPSQKKLYRDVMQETFRNLASIVCISEEKWEVYDSEDQDENHGTHLIQMVGRLCKCKECS

SEQ ID NO: 19445 - protein, 81 aa, Rhinopithecus roxellana
EKETLTFRDVAIEFSLEEWECLNPAQQNLYMNVMLENYKNLVFLGIAVSKQDPVTCLEQEKEPWNTKRHEMVDEPPGYMCR

SEQ ID NO: 19446 - protein, 81 aa, Rhinopithecus roxellana
EMGLLTFRDIAIEFSLVEWQCLDHAQQNLYRDVMLDNYRNLVFLGIADSKPDLITCLEQNKESWNIKRNEMVAKQPVMCSH

SEQ ID NO: 19447 - protein, 81 aa, Acinonyx jubatus
NPQELLTFNDVAIEFSQEEWGFLNHSQRELYRDVMLENYGHLLLLGLVSKPDLVNFLEQKKEAWDVNGKGTVATHPDFIFK

SEQ ID NO: 19448 - protein, 81 aa, Acinonyx jubatus
SHGPLSFEDVAVAFTKEEWQQLDPAQRTLYRDVMLENFSHVISLGHPVSKPDVISKLEQGEEPWIIKRDVSDWIYPERETR

SEQ ID NO: 19449 - protein, 81 aa, Acinonyx jubatus
AEGGVTFEDVAVYFSQEEWKLLDEAQKRLYHDVMLETFALISSLGCCCGAEDAEAPLEQSVSVGVSQASVPKAALSSRKTH

SEQ ID NO: 19450 - protein, 81 aa, Odocoileus virginianus
MMLENYQSLVSLGLCISKPYVISLLEQGKEPWTMMENEMRSPFPDWESIHETQELPLKQFVCDDMLMERIASYELECPTFG

SEQ ID NO: 19451 - protein, 81 aa, Odocoileus virginianus
SLGPVTFEDVAVYFSQEEWRILDETQRRLYCYVMLETFALVASLGLASSRSHVIVPLELGGEPWVQDRVDMTPGTARGAQS

SEQ ID NO: 19452 - protein, 81 aa, Odocoileus virginianus
PKVPVTFDDISIYFSTPEWEKLEEWQKELYKNIMKGNYESLISMDYAMNQPDVLSQIQPEGDRNAEDQAGPEESGIPTDPS

SEQ ID NO: 19453 - protein, 81 aa, Odocoileus virginianus
QGLFTFKDVAVEFTQEEWECLDPTQRALYRDVMLETYRNLLSLGSYSATFAIKELSSPKEDINKGELCHLMTLEKNETYGI

SEQ ID NO: 19454 - protein, 81 aa, Cebus imitator
MDSVAFEDVAVNFTQEEWALLSPSQKQLYRDVMLETFGNLASVSLVERLCGRKEGSDHRETFSQIPDCHLNKKSRTGVKPC

SEQ ID NO: 19455 - protein, 81 aa, Cebus imitator
QEGVNFKIVTVDFTQEEQGTWNPAQRSLGGDIILESHRDLVSWDLATAVGKEDSTSKQNIFDEEPANGVKTECFTRNDPWL

SEQ ID NO: 19456 - protein, 81 aa, Cebus imitator
AFPQGRLTFRDVAIEFSLAEWKCLTPAQRALYREVMLENYRNLESVGEENVPPDMRNLPLSILAFSAFVFSAVILLYTGSF

SEQ ID NO: 19457 - protein, 81 aa, Cebus imitator
MPHLLVTFRDVAIDFSQEEWECLDPAQRDLYRDVMLENYSNLISLDLESSREINKLSSEKEIYEMESLRWENMGKFINHHV

SEQ ID NO: 19458 - protein, 81 aa, Cebus imitator
AQESLTLEDVAVDFTWEEWQLLGPAQKDLYRDVMLENYSNLVAVGYQASKPDALFKLEQGQPPWTIKDGIHGRACSEIWKF

SEQ ID NO: 19459 - protein, 81 aa, Callithrix jacchus
VQESVTFKDVAVLFTQEEWGQLSPAQRALYRDVMLENYSNLVSLGLLGPKSDIFSQLEKREEWMPEDPSGGFCLDWMTMPV

SEQ ID NO: 19460 - protein, 81 aa, Callithrix jacchus
LQGSVSFKDVTVDFTQEEWQQLDPAQKALYRDVMLENYCHFISVGFHMAKPDMIRKLEQGEELWTQRIFPSYSYLEADGKT

SEQ ID NO: 19461 - protein, 81 aa, Saimiri boliviensis
DSVTFDDVAVDFTQEEWTLLDPTQRSLYSDVMLENYKNLATVGWELQLETQWSTLQQNCLRGQTSIGVQLEGNHNGRKLCD

SEQ ID NO: 19462 - protein, 81 aa, Equus caballus
AHGSVTFRDVAIDFSQEEWECLDSAQRDLYRDVMWENYSNFVSLAGPSISKPDTVTLLDEGKEPWMVVREGTRRHCPDLES

SEQ ID NO: 19463 - protein, 81 aa, Callorhinus ursinus
SVTFRDVTVDFTQEEWQQLEPAQKDLYRDVMLENYRNLVSLDLETRPETKESGPKEDSAEDRPSVGVVVEGPPRNGARGLA

SEQ ID NO: 19464 - protein, 81 aa, Callorhinus ursinus
MFQVTFSDVAIDFSHEEWGWLDSAQRDLYKDVMVQNYENLVSLAGLSIPKPYVISLLEDGKEPWMVEEKLSKDWESRWENK

SEQ ID NO: 19465 - protein, 81 aa, Callorhinus ursinus
QDSVTFEDIAVYFSWEEWRLLDEAQRCLYHDVMLENFTLISSLGCCCGAEDEAPFAQSTSVGVSQTRTPKAALSSRKTHPC

SEQ ID NO: 19466 - protein, 81 aa, Vulpes vulpes
MAFRDVAVNFSQEEWMLLSPAQRSLYREVMLENYSNLVSLGIPFSKPKLITQLEQGKESWREEGKCPPALCPAEPKPELHL

SEQ ID NO: 19467 - protein, 81 aa, Vulpes vulpes
MDFTLEDWEHLGLDQGDLFWDTALDNYQNLFLLNPSKPKLTSCPDGGEKLEVLVGASPESECPGTAGAKTCPLAEDYLEGL

SEQ ID NO: 19468 - protein, 81 aa, Callorhinus ursinus
SQHLVTFEDVAVNFTQEEWTLLDQTQRDLYRDVMLENYQNLIILAGCESCKPDLNSSVGGAEELRTGGRGILQELDLQLKT

SEQ ID NO: 19469 - protein, 81 aa, Acinonyx jubatus
TQVSVTFDDVAVTFTQEEWGQLDPAQKTLYQEVMLENCGLLVSLGCPVPRPELICQLERGQEPWTAKRGLSQNTYPGDNGK

SEQ ID NO: 19470 - protein, 81 aa, Rhinopithecus roxellana
AQESVTFEDVAVNFTNREWQSLTYAQRHLYKHVMLENYRNMVSLGFPFPKPPLISHLERGVEPCVQDPQDKESLSCSYPVS

SEQ ID NO: 19471 - protein, 81 aa, Bison bison
VMFSDVSIDFSQEEWEFLNDDQRDLYRDVMLENYSNLVSMVLESRCETKKLFLKKEIYEIESAQWELMDRLTRHDLQCSSF

SEQ ID NO: 19472 - protein, 81 aa, Bison bison
MLENYSNLVSVGYRVSKSDVLFKLEQGEERWMTEDEIHSHTWPETGNIGNHLQVDWENKKMLKGIEQYQERNTFGNPVLQS

SEQ ID NO: 19473 - protein, 81 aa, Bison bison
MESVTLEDVAMELIQEWTLLDDAGRNLCRHVLQDNCRTPAPRAAGTPPCKASLVSQVEPREELKAAEHGVLCATGVDWESQ

SEQ ID NO: 19474 - protein, 81 aa, Bison bison
SQGSVTFRDVSIDFSQEEWEWLQPAQRDLYRHVMLENYGHLVSLAGLNMSKPDVVSLLEQGKEPWLGNGDVSRELFPASKS

SEQ ID NO: 19475 - protein, 81 aa, Bison bison
RESGKAPVTFDNITVYLLQEEWVLLSQQQQDICGSDKLVAPLESTIASPELFYKFEQGPEPWLASVQGQRSHLSPNPGKTK

SEQ ID NO: 19476 - protein, 81 aa, Bison bison
YRGSVTFRDVAIDFSQEEWEFLDSAQRDLYRDVMWENYSNFISLAGPSMSKPDVITLLDEGKEPWMVVREGTGKHHPDLES

SEQ ID NO: 19477 - protein, 81 aa, Odocoileus virginianus
GVTFPDVAVYFSWEEWRLLDEAQRRLYLDVMLENYALISSLGCCCGTENAEAPSEQITSLEMSQARTTKAALSSQKMHPCE

SEQ ID NO: 19478 - protein, 81 aa, Odocoileus virginianus
MLETYSNLVSLGLAVSKPDVISFLEQGKEPWTVEEVAAGGLCPVLKSRYDATVFSPKQHSYEVQPPPWKIMKSLTNYGLEC

SEQ ID NO: 19479 - protein, 81 aa, Odocoileus virginianus
KPVTFEDVAVTFTQEEWKCLDASQRVLYQDVISETVRNLMSVGGKKEGCQEQSQSLGDEGTVDDKKASLDHRGSGPTSPPT

SEQ ID NO: 19480 - protein, 81 aa, Odocoileus virginianus
HQESLTFKDVAVNFTQEEWHHVDAAQRRLYKDVMLENYSHLVSLGYQVSKPEVIFKLEQGEEPWIAEGEIQRPVCPDWKTR

SEQ ID NO: 19481 - protein, 81 aa, Cebus imitator
MIQSQISFEDVAVDFTLEEWQLLNPTQKNLYRDVMLENYSNLVFLGYQIIKPDAISKWEQQDPWIMDQEILSQNFSEVWLD

SEQ ID NO: 19482 - protein, 81 aa, Cebus imitator
MLVTFKDVAVTFTQEEWRQLDLAQRTLYQEVMLETCGLLVSLGDKAQVQTREPTTYLPVLSERAFLQGSLTLECSSDSRLG

SEQ ID NO: 19483 - protein, 81 aa, Cebus imitator
EMGLLTFRDVAIEFSLEEWQCLNHAQQNLYRDVMFENYRNLVSLGIVVSKPELITCLEENKVPCNIKRNEMVAKHPVTYSY

SEQ ID NO: 19484 - protein, 81 aa, Cebus imitator
MLENYRHLVFLGIAVSKPDLIACLEQEKKPWNIKRNEMVAKPPVICSHFSQNLWEEEGIEDSFQKVVLRRYEKCGHDNLQL

SEQ ID NO: 19485 - protein, 81 aa, Cebus imitator
YQDSVTFDDVAVDFTQEEWTLLDPSQRDLYRDVMLENYENLASVGRHLFKPSVICWLEEEGQLRAGQRGVLQEWQLESKGS

SEQ ID NO: 19486 - protein, 81 aa, Cebus imitator
MSQVTFSDVALDFSHEEWGWLDSAQRDLYKDVMVQNYENLVSLGLSITKPHVITLLEDGKEPWMVEEKLSKGVTPDWESRW

SEQ ID NO: 19487 - protein, 81 aa, Cebus imitator
GTVTFEDVAVKFTWEEWNLLSEAQRCLYRDVMLENLALTSSLGCWCGVEDEEAPSKQSIYVQRETQVRTPTAGVSSKKAHP

SEQ ID NO: 19488 - protein, 81 aa, Macaca mulatta
QGSVPFRDVAIEFSQEEWECLPPDQRTLYRDVMLENYSHLISLAGSSISKPDVITLLEQEKEPWMVVRKETSRWYPDLESK

SEQ ID NO: 19489 - protein, 81 aa, Delphinapterus leucas
LLTFRDVAIEFSQEEWECLDPAQRALYRDVMLETYGNLLSLGEDNAPPEVGICPNISISFLTKELLKKKNINNRELYQPVV

SEQ ID NO: 19490 - protein, 81 aa, Pan troglodytes
SQESVSFKDVTVGFTQEEWQHLDPSQRALYRDVMLENYSNLVSVGYCVHKPEVIFRLQQGEEPWKLEEEFPSQSFPEVWTA

SEQ ID NO: 19491 - protein, 81 aa, Zalophus californianus
VMAHMAFRDVAVDFSQEEWMLLSPAQRSLYREVMLENYSNLVSLGIPFSKPKLISQLEQGKETWREERTCPPAARPVEPKP

SEQ ID NO: 19492 - protein, 81 aa, Sapajus apella
MLSHGSCLCIYQPDVFSLLEKGKEPWKILRDETRGPCPDMQSRCPIKKLLPKNGIFEREIAQLEIRKICKNHSLECLCFRG

SEQ ID NO: 19493 - protein, 81 aa, Delphinapterus leucas
PQEPVTFEDVAVYFTQNQWASLEPVQKALYREVMLENYANVASLEALPFPTPVLISQLERGEAPWGPDPWEAEILRGICPG

SEQ ID NO: 19494 - protein, 81 aa, Balaenoptera acutorostrata
MTFKDVAMDFTPEEWRRLDPAQRDVMLENYRNLVSLWLPVSKPENHNLENGKEPLMLERKAPKSSCSDSETRPGSKDSTSV

SEQ ID NO: 19495 - protein, 81 aa, Ovis aries
KSWGPLSFMDVFVDFTWEEWQLLDSAQKHLYRSVMLENYRNLVSLGYQYTKPSIIFQLEQEELWMMHSPSQGHSDEVWEID

SEQ ID NO: 19496 - protein, 81 aa, Rhinolophus ferrumequinum
MASPSPPLEPKEEWDYLDPAQRSLYKDVMMENYGNLVSLDVLNRDKDEEPTVKQEIEEIEEKVESQGIIVTRIKSEIDQDP

SEQ ID NO: 19497 - protein, 81 aa, Acinonyx jubatus
LLTFRDVAIEFSQEEWGCLNQSQRELYRDVMLETYGHLLFLAISSHGSQSFLPKPCIEASSQNVSLGTWKHHALENLHVMI

SEQ ID NO: 19498 - protein, 81 aa, Acinonyx jubatus
WLTFRDVAIEFSQEEWECLDPAQRALYRDVMLENYRNLVSLALSPKCVIKELPPKENSNTGEVLQTVILERHESRDAEDCG

SEQ ID NO: 19499 - protein, 81 aa, Rhinopithecus roxellana
SCEGSVSFRDVAINFSREEWQHLDLSQRNLYRDVMLETYSHLLSVGYQVPKPEVVMLEQGKEPWALQGDRPRQSCPGEKLW

SEQ ID NO: 19500 - protein, 81 aa, Rhinopithecus roxellana
MFKEAVTFKDVAVVFTEEELGLLDPAQKKLYRDVMLENFRNLLSVGHQPSYQDTFHFQREEKFWIVETATQRQGNSRGKIQ

SEQ ID NO: 19501 - protein, 81 aa, Acinonyx jubatus
MAFTQKEWEQLDPVQRNLYKDVMLENYSNLASMGYQAPKPDMISKLEKGEEPWLGKGKTPRQGGPSEIARPKQIGTNGKEV

SEQ ID NO: 19502 - protein, 81 aa, Acinonyx jubatus
LVLFKDVAIDFSQEEWECLDLEQKDLYRDVMLENYNNLVSLAWESRCETKKLFSTKGIYEIESSQWEIIEQLTRLKCDCKS

SEQ ID NO: 19503 - protein, 81 aa, Rhinopithecus roxellana
FETGPLTFRDVAIEFCLEEWQCLDTAQQDLYRKVMLENYRNLVLGIAVSKPNLITCLEQGKDPWNMKRHNMVVKPPDGVSL

SEQ ID NO: 19504 - protein, 81 aa, Rhinopithecus roxellana
PRGSTFFSSVTVAFAQEGWRCLVSTPRERYKEGIPEKSRNLVLLGLPVSQPGMNSQLEQREGTWMLEGEDLRSPSPGWKIV

SEQ ID NO: 19505 - protein, 81 aa, Rhinopithecus roxellana
RESGKAPVTFDDITVYLLQEEWVLLSQQQKELCGSDKLVAPLGPTVANPELFCKFGRGPEPWLGSVQGQRNHLEHHSGKKQ

SEQ ID NO: 19506 - protein, 81 aa, Rhinopithecus roxellana
MIQSQISFEDVAVDFTLEEWQLLNPTQKNLYRDVMLENYSNLIFLGYQILKPDAIFKLEQQDPWIIGQEILNQNFSEVWLD

SEQ ID NO: 19507 - protein, 81 aa, Cebus imitator
EMGVLTFRDVAIEYCLEEWQCLDIAQQNLYRNVMLENYKNLAFLGIASSKPHLITCLEQEKEPWNVKRHELVAEPPDITWF

SEQ ID NO: 19508 - protein, 81 aa, Cebus imitator
VAFEDVDVNFTQDEWALLDPSQKNLYRDVMQETFRNLASVGKKWKDQKIEDEYKNPRSNLRGLMGERLLESKKDHQLGEIL

SEQ ID NO: 19509 - protein, 81 aa, Cebus imitator
MGPLEFMDVAIEFSLEEWQCLDTAQRNLYRDVMLENYRNLVFLEFQKPFFQKLLRILELKNPQAGLSVIVAFVCNTRIFLG

SEQ ID NO: 19510 - protein, 81 aa, Cebus imitator
SKDLVTFGDVAVNFSQEEWEWLNPAQRNLYRKVMLENYRTLVSLGVSVSKPDVISLLEQGKEPWMVKKEGTRGACSDWEYV

SEQ ID NO: 19511 - protein, 81 aa, Cebus imitator
AQESVMFSDVSIDFSQEEWECLNDDQRDLYRDVMLENYSNLVSMAGHSISKPNVISYLEQGKEPWLVDREITSGQWPVLES

SEQ ID NO: 19512 - protein, 81 aa, Cebus imitator
MDVMLENYCHLMSVGCHMTKPDVILKLERGEEPWTSFAGHTRLEENWKAEDFLVKFREHQEKYSRSVVSINHKKLVKEKSK

SEQ ID NO: 19513 - protein, 81 aa, Cebus imitator
FQGPVTLKDVIVEFTKEEWKLLTPVQRTLYKDVMLENYSHLVSVGYRVNKPNVVFKLKQGKEPWMLEVEYPHRGLPEDLRN

SEQ ID NO: 19514 - protein, 81 aa, Cebus imitator
LLTFMDVAIEFSLEEWQCLNTAQRNLYRNVMLENYRNLVFLAVCSYFARDLWPKQGIKNCFQNVILRRYKKCGHKNLHLRK

SEQ ID NO: 19515 - protein, 81 aa, Callithrix jacchus
LQGLVMFEDVAVYFSREEWGLLNVTQKGLYRDVMLENFALLSSLGLAPSRSPVFTQLVDDEQSCVTSWVDVTLVSRTEASR

SEQ ID NO: 19516 - protein, 81 aa, Macaca mulatta
IMEEAVTFKDVAGFFTEEEPGLLDPAQRKLYRDVMLENFRNLLSAGHQPFHQDTFHFLREEKFWMMETVTQRERNSGSKIQ

SEQ ID NO: 19517 - protein, 81 aa, Callithrix jacchus
SQAPVTFEDMAMYLTREEWRPLDPAQRDLYRDVMQENYGNVVSLDFEIRSDSEVNPKQEISEDVQFGTASERPAENAEENP

SEQ ID NO: 19518 - protein, 81 aa, Pan troglodytes
QQGYVTFEDVAVYFSQEEWRLLDDAQRLLYRNVMLENFTLLASLGLASSKTHEITQLESWEEPFMPAWEVVTSAIRRVWLR

SEQ ID NO: 19519 - protein, 81 aa, Sapajus apella
PMPGLQEAVVFEDVAVYFTRIEWSCLAPDQQVLYRDVMLENYRNLASLALISLLEQGEEPGALILQVAEQRGAKTSLCTDS

SEQ ID NO: 19520 - protein, 81 aa, Zalophus californianus
SQGLVSFKDVAVHFTQEEWQQLDPAQRTLYRDVMLENFSHLVSMGYPVSKPDVISKLEQGEDPWIIKRDIPNWIFPNENQD

SEQ ID NO: 19521 - protein, 81 aa, Delphinapterus leucas
VQESLLFEDVAVEFTREEWRLLDPAQKDLYQNVMLENYSNLLSVGYQSPKPIQIFRLKQRDKPWLVKENIHGQNFPEVGEI

SEQ ID NO: 19522 - protein, 81 aa, Sapajus apella
DGLVTFRDVAIDFSQEEWECLDPAQRDLYVDVMLENYSNLVSLDLESTTYDTKKIFSEKDIFEINFSQWEMKEKSKTPGLE

SEQ ID NO: 19523 - protein, 81 aa, Pan troglodytes
AHALVTFRDVAIDFSQKEWECLDTTQRKLYRDVMLENYNNLVSLGYSGSKPDVITLLEQGKEPCVAAKDVTGRQCPGLLSR

SEQ ID NO: 19524 - protein, 81 aa, Pan troglodytes
SPDSMTFEDIIVDFTQEEWALLDTSQRKLFQDVMLENISHLVSIGKQLCKSVVLSQLEQVEKLSTQRISFLQGREVGIKHQ

SEQ ID NO: 19525 - protein, 81 aa, Papio anubis
MAFEDVAVYFSQEEWGLLDTAQRALYRHVMLENFTLVTSLGLSTSRPYVVIQLERGEEPWVPSGKDMTLARNTYRRLNAGS

SEQ ID NO: 19526 - protein, 81 aa, Carlito syrichta
PAQGVTFEDVAIYFSQEEWVLLDETQRLLYGDVMLDNFALITSLGYYHETENEMITSDGMSQVRTSKVGTPTQKTYLSEIE

SEQ ID NO: 19527 - protein, 81 aa, Balaenoptera acutorostrata
MAFRDVAVDFTQEEWMLLSPDQRSLYREVMLENYSNLVSLGIPFSKPKLITQLEQGKETWREERKCPPATGPEPKPELHLG

SEQ ID NO: 19528 - protein, 81 aa, Rhinolophus ferrumequinum
CEVSVSFEDVTVNFSREEWQHLKPAQRRLYRDVTLENYSHLLSVGYQVPKPEVIFKLEQGEGPWMLEGETPHQSCSDEDIE

SEQ ID NO: 19529 - protein, 81 aa, Phyllostomus discolor
MKPDVIFKLEQGEEPWIGDGEVPSSESPEQVLQVNSHMMWHQDNQEKLKNVKQDYECDTFGKNFNMNINLVPLRKSNGEGD

SEQ ID NO: 19530 - protein, 81 aa, Camelus dromedarius
PKVPVSFEDVSVYFTKTEWKLLDFRQRVLYKRVMLENYRHLVSLGFSSSKPHLVSQLERGEGPWVADVHRMGAVTGMQTGD

SEQ ID NO: 19531 - protein, 81 aa, Camelus dromedarius
PEEKETSRPSLMAGILPRLSDQAMDAVFLTAWWKESLSFEDVALYFTREEWSRLDWAQKDLYRDVMLENYRNMIVLGNGLA

SEQ ID NO: 19532 - protein, 81 aa, Ursus maritimus
HQDLVTFKDVAVYFTQTEWAGLSPAQKALYRSVMLENYGNLTSLGYPVPKPALISLLEGGNLPWGLEAQDNPSAERTKDIC

SEQ ID NO: 19533 - protein, 81 aa, Phyllostomus discolor
YQEFVTFEDVAVHLTREEWGCLDPVQRDLYREVMLENYGNVVSLGFPIFKPDGISQLEQDLQVFDLDAKNREALRDDCSDA

SEQ ID NO: 19534 - protein, 81 aa, Rhinopithecus roxellana
QGRLTFRDVAVEFSLAEWKCLNPAQRALYREVMLENYRNLESVDISSKCMMKEVLSTGQGNTEVFHTGTLQRHESHHIGDF

SEQ ID NO: 19535 - protein, 81 aa, Rhinopithecus roxellana
AQESVTFRDVAVFFSQDEWLHLDSAQRALYREVMLENYSSLVSLGSPFSMPKLIHQLQQGEDPCLVEREVPPDTCLGSKTW

SEQ ID NO: 19536 - protein, 81 aa, Odocoileus virginianus
PQGSVTFEDVAVYFSWEEWCLLDEVQIHLYLDVMLENFALVCMLGSCRGVQDAETCSEQNVSAEGASQIRAPRAELSPENT

SEQ ID NO: 19537 - protein, 81 aa, Odocoileus virginianus
MEAVTFKDVAVAFTEEELGLLDSAQRKLYQDVMVENFWNLVSVDENNQSELRAVQERGLHEELSCWQIWQQIANDLTRCQD

SEQ ID NO: 19538 - protein, 81 aa, Odocoileus virginianus
YRGPVTFKDVTVEFTQEEWKLLDTAQRTLYREVMQENYSHLISVGYCANRPNAIFKLKQGKEPWILEVQFPHQNKPEDICN

SEQ ID NO: 19539 - protein, 81 aa, Odocoileus virginianus
PLESVTFEDVAVDFTQEEWSLLDKSQKNLFRDVMMETITHLVSVGYPISKSDVIFQLEQGKELWTEAADLQGQSPGDHAGY

SEQ ID NO: 19540 - protein, 81 aa, Cebus imitator
WSQMPVTFEDVALYLSREEWGRLDHTQQNFYRDVLQKRNGLSLGFPFSRPFWAPQVQGKGEASGSSRQTGDQKEDWRGACT

SEQ ID NO: 19541 - protein, 81 aa, Cebus imitator
VQESVTFRDVAVFFSPDEWLHLDCAQRALYREVMLENYSSLVSLGILFSKPKVISHLEQGEDPWMVESGVPQGTHLGWESL

SEQ ID NO: 19542 - protein, 81 aa, Cebus imitator
QASVCFEDVAMAFTQEEWEQLDLAQRTLYREVTLETWEHLVSLDWKATLEKNRLNSEKDRVWDELSHHVEVKQCVQEEPPC

SEQ ID NO: 19543 - protein, 81 aa, Cebus imitator
SLGSELFRDVAIVFSQEEWQWLAPAQRDLYRDVMLETYSNLVSLGLAISKPDVISFLEQGREPWMVERVVAGGLCPVLESR

SEQ ID NO: 19544 - protein, 81 aa, Cebus imitator
FQEPVTFEDVAVYFTQNEWTSLQPSQRALFREVMLENYATVTSLSAFPFPKPDLIFRLEQGEAAWGPDPWTLAGEEALRGL

SEQ ID NO: 19545 - protein, 81 aa, Cebus imitator
AQEPVTFEDVAVYFTQNEWTSLDPARRALYREVMLENYANVASLAFPFTTPVLVSQLEQGEREGLRGVCPGDEMRTEKEGL

SEQ ID NO: 19546 - protein, 81 aa, Panthera pardus
QAQESLTFEDVAVGFSREEWRLLAPAQKDLYRDVMLENYRNLVSVGYLASKPDALSKLEGGELWTTEDEIDSRICPEIRKV

SEQ ID NO: 19547 - protein, 81 aa, Panthera pardus
MHKDVMLENYSNLASVGLCVAKPEMIFKLERGEELWILEEESSGQGFPGSLSLLCGKSSVGGGALRHDSDLQRQKSQAVDQ

SEQ ID NO: 19548 - protein, 81 aa, Panthera pardus
FQPPVSFKDVAVTFTREEWGQLDPAQRTLYRNVTLETCSHLAFLGLLLSKPAVICWLEQGQDPWRAEHGPPGDWKNTLEKE

SEQ ID NO: 19549 - protein, 81 aa, Panthera pardus
PEGGVTFEDIAIYFSWKEWRLLDEAQRRLYYDVMLENFTLISSLGCCCGAEDAEAPLEQSVSVGVSQASTPKAALSSRKTH

SEQ ID NO: 19550 - protein, 81 aa, Panthera pardus
AHRSVTFRDVAIHFSQQEWEYLDSVQKNLYRDVMMENYDNLVSLAEHSISKPDVIRLLEQRKEPWMVVREDTKRWCTDLES

SEQ ID NO: 19551 - protein, 81 aa, Panthera pardus
AVTFTDVAVNFTKEEWALLDPAQRNLYRDVMLENCRNLASVDSLNQRKTQNSTPRQDILAEKTPQGANRVCAVSHSSRPSP

SEQ ID NO: 19552 - protein, 81 aa, Macaca nemestrina
YQTPVSFKDVVVGFTQEEWHRLSPAQRALYRDVMLETYSNLLSVGYEGTKPDVILRLEQEEAPWIGEAACPGCHCWEDIWQ

SEQ ID NO: 19553 - protein, 81 aa, Enhydra lutris
WKELVSFEDVAMYFTREEWNKLDWAQKDLYRDVMLENYRNMILLGFQFPKPEVICLLEQWEEPWILDLPRAGTRKASSSAC

SEQ ID NO: 19554 - protein, 81 aa, Tursiops truncatus
SVTFRDVTVDFTQEEWQQLEPSQKDLYRDVMLENLQNLVSLDLEMRPEMKEPDLKEEISEDRPSGAWGSAVDGARTQGDRV

SEQ ID NO: 19555 - protein, 81 aa, Acinonyx jubatus
NSQGLLTFRDVAIEFSQKELGCLNHSQWELYRDVMFENYGHLLFLGLVVSKPDLVIFLEQKKDVWAVKRKETVATHPGRWN

SEQ ID NO: 19556 - protein, 81 aa, Leptonychotes weddellii
CQEPVTFEDVAVYFTQNEWVILDSSQRALYREVMLENYANVASLAFLFTRPVLVSQLERGELPWGLEPWEPAGREALRGIC

SEQ ID NO: 19557 - protein, 81 aa, Leptonychotes weddellii
PQGSVSFKDVTVDFTQEEWQQLDPGQKALYRDVTLENYCHLISVGFHMTKPDMIRKLEQGEELWTTEKIFPSQSYLEEDGK

SEQ ID NO: 19558 - protein, 81 aa, Leptonychotes weddellii
AQGSVVFSDVSIDFSQEEWECLDPGQRDLYRDVMLENYSNLLSMGLYIPKPQVISLLEQGKEPWMVGRELTRGLCSDLESM

SEQ ID NO: 19559 - protein, 81 aa, Pteropus vampyrus
KGSVTFEDVAVYFSQEEWRLLDEAQRLLYRDVMLEVFALAVSLGTWHGTESPSEQNGFEGESQENTSQACPWKLCGLALES

SEQ ID NO: 19560 - protein, 81 aa, Pteropus vampyrus
MGPLQRTLYRDVMLENYNNLVSVGSCIYKPEVIFKLEQGEEPWLLEEEFSNQSYQVLEHYRDDALIQGDKKIKAKHLQQVT

SEQ ID NO: 19561 - protein, 81 aa, Pteropus vampyrus
SQVSVTFEDVAVLFTRDEWRKLRPSQRSLYQDVMLENYGHLVSLGFPLSKPKVISLLQQGEEPWKVEEGSCRGSWLGWKSS

SEQ ID NO: 19562 - protein, 81 aa, Physeter macrocephalus
DEALMAFKDVAVAFTQKEWKLLSPAQRTLYRDVMLENYSHMVSLGIAFPKPKLITQLEQGEEPWREESESLLDLCPAEPRT

SEQ ID NO: 19563 - protein, 81 aa, Macaca mulatta
PQASVCFEDVAMAFTQEEWEQLDLAQRTLYREVTLETWEHIVSLGLFLSKSDVISQLEQEEDLCRAEQVVPRDWKTTLEEN

SEQ ID NO: 19564 - protein, 81 aa, Aotus trivirgatus
QGLLTFRDVAIEFSQEEWRCLDPAQRTLYRDVMLENYRNLVSLDISSKYNMKELLSTARGDTEVFYAGILDRRESHHFGDF

SEQ ID NO: 19565 - protein, 81 aa, Delphinapterus leucas
QAQETLTFEDVAVDFTWEEWQLLAPPQKDLYRDVMLENYSNLLSVGFQASKPNVLSKLGQGEPWTMEDEIHCQTRSEIWKV

SEQ ID NO: 19566 - protein, 81 aa, Pan troglodytes
VHGSVTFRDVAIDFSQEEWECLQPDQRTLYRDVMLENYSHLISLAGSSISKPDVITLLEQEKEPWMVVRKETSRWYPDLES

SEQ ID NO: 19567 - protein, 81 aa, Sapajus apella
MKPAQRNLYRDVMLENYSNLVTVGCQVTKPDVIFKLEQEEEPWVMEDEMFGRHCPEVWKVDEQIKKQQETLVRKVTSISKK

SEQ ID NO: 19568 - protein, 81 aa, Sapajus apella
FQKAVTFKDVAVVFSSEELRLLDLTQRTLYRDVMVENFKNLVAVGHLPFQPDMVSQLEAEEKLWMMEAETQRSRYSGENPA

SEQ ID NO: 19569 - protein, 81 aa, Sapajus apella
MYFTREEWGHLDWGQKDLYRDVMLENYRNMVLLGFQFPKPEVICQLENWDEQWILDLPRAGNRKASGSACPGSEARHKMKK

SEQ ID NO: 19570 - protein, 81 aa, Pan troglodytes
PQGSLTFRDVAIEFSQEEWKCLDPVQKALYRDVMLENYRNLGFLGLCLPDLNIISVLEQGKEPWTVVSQVKIARNPNCGEC

SEQ ID NO: 19571 - protein, 81 aa, Ursus arctos
SQESVTFEDVAVDFTQEEWTLLDRSQRRLFRDVMLENISHLVSIGRQLYKSDTISHLEPEEQLSKGIGLLQCQSLDREDDL

SEQ ID NO: 19572 - protein, 81 aa, Vicugna pacos
SQASVSFKDVTVEFTEEEWQQMGPVQKTLYRDVMLENYNNLVSVVNCIFKPEVIFKLEKGEEPWFSEEEFSNQSHRDYRDN

SEQ ID NO: 19573 - protein, 81 aa, Leptonychotes weddellii
PQEPVTFEDVAVYFTQNQWASLDPTQRALYREVMLENYASVASLVVFPFPKPDLVSQLEREEAPWGPDPWEAEVLRGICPG

SEQ ID NO: 19574 - protein, 81 aa, Leptonychotes weddellii
AQESVTFRDVAVFFSQDEWLRLDSAQRTLYREVMLENYGTLVSLGILFSKPKVIFQLQQGEDPWMVENGVSQGPCVGWERL

SEQ ID NO: 19575 - protein, 81 aa, Sus scrofa
PQESVTFKDVAVNFTQEEWHHVDPAQRRLYRDVMLENYSHLVSVGYQVSKPEVIFKLEQGEEPWIAEGEIQRPFCPDWKTR

SEQ ID NO: 19576 - protein, 81 aa, Leptonychotes weddellii
SLETVTFKDVAVDLTQEEWQQMKPAQRNLYRDVMLENYSNLVTVGYQVTKPDVIFKLEQEEEPWVVEEEMLGRHCPESRRG

SEQ ID NO: 19577 - protein, 81 aa, Vicugna pacos
TQGLVTFRDVAVEFSQEEWKCLEPAQRDLYRDVTLENFGNLVSLGLSISKPDVISLLEQGKEPWLIANDMTGPWCPDLESK

SEQ ID NO: 19578 - protein, 81 aa, Leptonychotes weddellii
SQEPVTFEDVAVYFTQNQWASLDPMQRALYLEVMLENYANITSLAALPFPKPDLILQLEQGEAPWDLDPWTPLEGEALEGV

SEQ ID NO: 19579 - protein, 81 aa, Odocoileus virginianus
APVPLTFSDVSIDFSQEEWECLNSDQKNLYRDVMLETYTNLVSLDFDFTTENNKLSSEKSSFEVNPYHWETVKSKTFNLMG

SEQ ID NO: 19580 - protein, 81 aa, Odocoileus virginianus
MFQVTFSDVAIDFSHEEWRWLSSTQRNLYKDVMVQNYENLVSLAGLSVPKPYVIALLEDGKEPWMVEEKLSKDMVPDCKSR

SEQ ID NO: 19581 - protein, 81 aa, Leptonychotes weddellii
FQETVTFKDVAVVFSEEELGLLDSTQRKLYRDVMLENFRNLVSVGNQPFKPELIFQLEREEKLLMMETETQRDGYLGTKSQ

SEQ ID NO: 19582 - protein, 81 aa, Phascolarctos cinereus
PQESVTFKDVAVDFTWEEWEELDVAQRDLYRDVMLENYRNIISLGTQVSKPEVIFLLEQGKEPWMVKREVPRVICPGERYH

SEQ ID NO: 19583 - protein, 81 aa, Vicugna pacos
MLENYRSLVSLAGVSVSKPDVISLLEQGKEPWKVKKEWTGGTRPDWEYVLKNNELSSKQVIYDESSKSVTVGGSHLSYRLD

SEQ ID NO: 19584 - protein, 81 aa, Odocoileus virginianus
WLQGPMSFKDVAVEFTQEEWMMLDSAQRSMYRDVMLENYINLTLVEYQLCKPVISLLGQEDIRTVKSRIPQDTCPDWEIQL

SEQ ID NO: 19585 - protein, 81 aa, Neomonachus schauinslandi
PLESVTFEDVVVDFTKEEWALLDISQRKLFRDVMLENIRHLVSLGYQHCKSDVIFPLEQGEELWREGTGFLQGQSSGRESA

SEQ ID NO: 19586 - protein, 81 aa, Phascolarctos cinereus
QKASVTFGDVAVDFTPEEWARLDLSQKELYREVMLENYRNLVCLGLAVSKPEVICQLEQGGEPWIPEGEGPRCMCADWKTQ

SEQ ID NO: 19587 - protein, 81 aa, Phascolarctos cinereus
SLESVTFQDVAVNFTQEEWGHLEPAQKDLYREVMLENYQNFVSLGLPFSKPHVISQLERGEAPWITERDVPRVSCQDFFIQ

SEQ ID NO: 19588 - protein, 81 aa, Cebus imitator
MLENYENLVFLGIAVSKPDLITCLEQEKELWNMKRHEMVDKPPVMCSHIIQDLLPEKNIEDSFHKVALRRDEKYEHTNFLL

SEQ ID NO: 19589 - protein, 81 aa, Pteropus vampyrus
GSVSFTDVTVDFTQEEWEQLDPSQRILYMDVMLENYSNLLSVEVWKADDQMEREHRSPDEQARPFIIFKNQTPIEERGDLF

SEQ ID NO: 19590 - protein, 81 aa, Pteropus vampyrus
AQGSVSFEDVTVEFTPDEWQYMGPAHRTLYRDVMLENCSHFVSMGYCITKPQVIFKLEQGEEPWSLEEEFPNQRFPAQSSL

SEQ ID NO: 19591 - protein, 81 aa, Pongo abelii
AQESVMFSDVSVDFSQEEWECLNDDQRDLYRDVMLENYSNLVSMGHSVSKPNVISYLEQGKEPWLVDRELTRGQWPVLESR

SEQ ID NO: 19592 - protein, 81 aa, Pongo abelii
QGTVTFEDVAVHFSWEEWGLLDEAQRCLYRDVMLENLALLTSLDVHHQKQHLGEKHFRSNVGRAMFVKTCTFHVSGEPSTC

SEQ ID NO: 19593 - protein, 81 aa, unidentified
  REGION 1..81: note = Bos indicus x Bos taurus
MLETFGLLVSVGHWLPKPDVISLLEQEAELWAADKGGPRGVCPDLETRPQSKLSTENQGVTEEIPNSALVERFLQESLWHS

SEQ ID NO: 19594 - protein, 81 aa, Trichechus manatus
DSVAVEDVAVDFTQEEWALLDLSQRKLYRDVMMETFRNLASVSRNLDDGEKLSTENIIVRFMKSDTWPSMVGGICKLHGIE

SEQ ID NO: 19595 - protein, 81 aa, Trichechus manatus
AHDLVMFTDVAVDFSQEEWECLDSYQKNLYRDVILENYNNLVSLAGCSISKPDVVTLLEQGKEPWLIGRDKKIRWSPDLES

SEQ ID NO: 19596 - protein, 81 aa, Carlito syrichta
SQEHVSFKDVCVDFTQEEWYLLDSAQKILYRDVILENYSNLVSLGCCVTKPEVIFKIEQGEEPWILEKGFPSKWHPEKKWK

SEQ ID NO: 19597 - protein, 81 aa, Pan troglodytes
AQESLTLEDVAVDFTWEEWQLLSPAQKDLYRDVMLENYSNLVSVGYQASKPDAFSKLERGEETCTTEDEIYSRICSDSGGA

SEQ ID NO: 19598 - protein, 81 aa, Papio anubis
SQASVSFQDVTVEFTQEEWQHLGPVERTLYRDVMLENYSHLISVGYCITKPKVISRLEQGEEPWSLEDEVLNQKHQGYFKV

SEQ ID NO: 19599 - protein, 81 aa, Zalophus californianus
MLENFSHLVSLGHPVSKPDIISKLEQGEEPWIIKRDISDWICPERETRLENPQLDILEGVSFPKEILEGVTRDHSLYSIFK

SEQ ID NO: 19600 - protein, 81 aa, Zalophus californianus
FEGSVSFEDVAVDFTRQEWHRLDPAQRTMHKDVMLENYSNLASVGLCVAKPEMIFKLERGEELWILEEESSGHGYPGSLSM

SEQ ID NO: 19601 - protein, 81 aa, Saimiri boliviensis
HLTFRDVAIEFSQEEWKCLNSAQRTLYRDVMLENYRNLVSLDLSHNGVIKELAPKQKSNMGEVFHTVALEQHETPDMQEFC

SEQ ID NO: 19602 - protein, 81 aa, Lipotes vexillifer
SQEQVSFKDVCVDFTREEWYLLDPAQKILYRDVILENYSHLVSVGNCITKPEVIFKIEQGEEPWILEERFPKQCCSERNWK

SEQ ID NO: 19603 - protein, 81 aa, Callorhinus ursinus
MAAPPSGRAQISVTFDDVAVTFTQEEWGQLDPAQRTLYQEVMLENCGLLVSLGLLGRFPHKSPGTPPDNRSSRSPHSAILE

SEQ ID NO: 19604 - protein, 81 aa, Callorhinus ursinus
SLLTFEEVAMYFSQEEWELLDPTQKALYNDVMRENYETVISLAMPVHQILAFSEKTNTKDWTVAPEFILPESQSLLTFEEV

SEQ ID NO: 19605 - protein, 81 aa, Callorhinus ursinus
VQGQVNFEDVAVYFSQEEWGLLDEAQRLLYRDVMLENLALMASLGYESSMSHGVASLELGSKLWRSDWADVTPGRTREAQG

SEQ ID NO: 19606 - protein, 81 aa, Callorhinus ursinus
TQKPVTFKDVAVDFTREEWGLLGPTQRILYRDVMLRNYSNLVSLGLPDCKPDVISKLEQWEDPWTVKRDVPRGPDSEPGPR

SEQ ID NO: 19607 - protein, 81 aa, Callorhinus ursinus
TARSQASVTFKDVAMDFTPEEWGKLDPAQREVMLENYRNLVSLWLPVSRPENYNLENGKEPLMLERKAPKSSYSDLETKPE

SEQ ID NO: 19608 - protein, 81 aa, Callorhinus ursinus
SYGSFSFEDVTVGFTQEEWQHLGPAQRILYRDVMLENYSHLVSVGCCIPKPEVILKLEQGEQPWILEEESPSQSYPGLPTD

SEQ ID NO: 19609 - protein, 81 aa, Callorhinus ursinus
AHHLVMFRDVAVDFSKEEWECLNSYQRNLYRDVILENYSNLVSVAGCSISKPDVITLLEQGKEPWMVVRDERRRRSLDLES

SEQ ID NO: 19610 - protein, 81 aa, Tursiops truncatus
HQEVVTFEDVAVYFTQTEWAGLSPAQRALYRSVMLEIYGNLTSLGYPVPKPALVSLLERGDLPWGLETRDDPPAQGTKDIC

SEQ ID NO: 19611 - protein, 81 aa, Acinonyx jubatus
QAQESLTFEDVAVGFSREEWQLLAPAQKDLYRDVMLENYRNLVSVGYLTSKPDALSKLEGGELWTTEDEIDSRICPEIRKV

SEQ ID NO: 19612 - protein, 81 aa, Sus scrofa
FKEAVTFKDVAVVFTEEELGLLDLAQRKLYQEVMLENFRNLVSVGRHSFTPDIISQVEREEKLWMIKSATPSYCSSGDKNL

SEQ ID NO: 19613 - protein, 81 aa, Vicugna pacos
VADCVRNRPQDSVTFADVAVGFTQEEWILLDSFQRNLYRDVMLENYKNLTTAGYQWFKPTLISWLEQEELRTEERGAVQGE

SEQ ID NO: 19614 - protein, 81 aa, Phascolarctos cinereus
MMWLGTSGRSGLSGPCPENPLQGCHPAGLEEWALHGISRPTVISQLEQKEEPWVLDLQSLEEGEILREAHTDFENQVEKLN

SEQ ID NO: 19615 - protein, 81 aa, Vicugna pacos
CKGLVLFKDVSIHFSQEEWECLDSDQRDLYRNVILENYNNLISVGLSIPKPDVVSLLEEGEDPWMVDRELTRDLLPDCGSR

SEQ ID NO: 19616 - protein, 81 aa, Neomonachus schauinslandi
ARESLTFRDVFVDFTLEEWQQLDSAQKNLYRDVTLENYSHLVSVGYLVASPDEVLRSGRGEEARRAEGGPSAWTYPEFWQV

SEQ ID NO: 19617 - protein, 81 aa, Phascolarctos cinereus
CQETLTFKDVAVDFTREEWGHLGPAQRDLYKEVMLDNYRNLVSLGLQVSKPDVIFQLERGESPSMLEGKDSSDPCPEFLSQ

SEQ ID NO: 19618 - protein, 81 aa, Nomascus leucogenys
AQGRVVFEDVAIYFSQEEWGHLDEDQRLLYRDVMLENLALLSSLGCCHGAEDEEAPLEPGVSVGVSQVMAPKPCLSTWKTQ

SEQ ID NO: 19619 - protein, 81 aa, Phascolarctos cinereus
MLENYRNLVSLGFPVSKPDVIYQLERREASWMPEADISGSSCPGSREFTGDKPPECNECGKAFKSKAALTAHQKIHTEEKP

SEQ ID NO: 19620 - protein, 81 aa, Pteropus vampyrus
MFRDVSINFSQEEWECLDPGQMNLYKEVMLENFSNLVSVGLSSAKPVVISLLEEGKEPWMVEREVKRGLCSDLESMCETKI

SEQ ID NO: 19621 - protein, 81 aa, Pongo abelii
SRSLENDGVCFTEQEWENLEDWQKELYRNVMESNYETLVSLKVLGQTEGEAELGTQMLGDLEEEGPGGAHPAGGVMIKQEL

SEQ ID NO: 19622 - protein, 81 aa, Bos indicus
MLENYGNMASLGFPLLKPAVISQLEGGGELEGPSPLASAAGTGPQGLWTDIDIQTNNNLTEEMYEEKYNISYELQRNSFKE

SEQ ID NO: 19623 - protein, 81 aa, Pteropus vampyrus
FQEPLTFKDVAVVFTEEELGLLDAAQRKLYRDVTLENFRNLVSVGQQPCKPGKMSHLEQDRETWVTERGTLRGAHSGDNNE

SEQ ID NO: 19624 - protein, 81 aa, Pongo abelii
TQGQLSFRDVAIEFSQEEWKCLDPGQKALYRDVMLENYRNLVSLGICLPGLSVTSMLEQKRDPCTLQSEVKIANNPDGREC

SEQ ID NO: 19625 - protein, 81 aa, Physeter macrocephalus
LQGSVTFQDVAVDFTLEEWQLLGCAQRKLYWDVMLENFRNLISVGCPVTKTKVIFKVEQGQEPWMMEGENARWHSPEVICL

SEQ ID NO: 19626 - protein, 81 aa, Trichechus manatus
FQESVTFKDVIVDFTQEEWKQLDPVQRDLFRDVTLENYTHLVSIGLQVSKPDVISQLEQGTEPWTVEPGVPVGTSRDWETR

SEQ ID NO: 19627 - protein, 81 aa, Carlito syrichta
TARSQETVTFKDVAMDFTPEEWGKLDPAQRDVMLENYRNLVALWLPVSETENYKLENGKEALKLERKAPKRSYSDLETRRE

SEQ ID NO: 19628 - protein, 81 aa, Macaca mulatta
WLQEPMTFKDVAVEFTQDEWMMLDSAQRSLYRDVMLENYRNLTSVEYQLCKLTVISPLDQEEIRNMEKRIPQGICPDQKIL

SEQ ID NO: 19629 - protein, 81 aa, Sapajus apella
MDVAIEFSLEEWQCLDTAQKNLYRTVMLENYRNLVFLDLITCLEKGKEPWNMKRYKMGAKPQVLSYFPKDLWLEQNIKNSF

SEQ ID NO: 19630 - protein, 81 aa, Panthera pardus
IQETVTFKDVAVDLTQEEWQQLKPAQRNLYRDVMLENYSNLVTVGYQVTKPDVIFKLEQEEDPWVVEEEMLGRHCPEVWEV

SEQ ID NO: 19631 - protein, 81 aa, Panthera pardus
FQGSVTFRDVAIDFSQEEWEWLQPTQRDLYRHVMLENYSHLVSLAGLNISKPYVVSLLEQGKEPWLEKRGVRRDLFSEPNR

SEQ ID NO: 19632 - protein, 81 aa, Panthera pardus
FQESLTFRDVFVDFTLEEWRCLDSAQKNLYRDVMLENYSHLVSVGQLVPKPDVVIRLGQGGEARTAEGETPTRNPPEFWQV

SEQ ID NO: 19633 - protein, 81 aa, Panthera pardus
VQEPVTFKDVAVDFTQEEWGQLDSIQRTLYRDVMLETYGHLLSVGNQIAKPEVISLLEQGEEPWSVEQAYPQSTCPVPEIL

SEQ ID NO: 19634 - protein, 81 aa, Panthera pardus
PQGLVTFEDVAVDFTHEEWQYLNPSQKSLYREVMLETYSNLVSVAGQQVTKPDLILKLEVEEPCLAETKISIWDFPEAYQV

SEQ ID NO: 19635 - protein, 81 aa, Panthera pardus
QESVTFKDVAVDFTLEEWGWLGPGQRELYRDVMLENYQNLLSLGAGPPGFKPDVISRLERGEEPRMEKREGWQMTCPDSET

SEQ ID NO: 19636 - protein, 81 aa, Capra hircus
YRGPVTFKDITVEFTREEWKLLDTAQRTLYREVMQENYSHLISVGYCANRPNAIFKLKQGKEPWILEVQFPRQNNPEDLCN

SEQ ID NO: 19637 - protein, 81 aa, Tursiops truncatus
LQGSVTLQDVAVEFTPEEWQLLDCDQRTLYWDVMLENFRNLISMGCPVTKTIVIFKVEQGQEPWMVEGENPRWRSPEADCP

SEQ ID NO: 19638 - protein, 81 aa, Cercocebus atys
MFKEAVTFKDVAVVFTEEELGLLDPAQKKLYRDVMLENFRNLLSVGHQLSYQDTFHFQREEKLWIMETATQKEGNSGGKIQ

SEQ ID NO: 19639 - protein, 81 aa, Bison bison
MFQVTFSDVAIDFSHEEWRWLNSTQRNLYKDVMVQNYENLVSLAGLSIPKPYVIALLEDGKEPCMVEEKLSKDTFPDCKTR

SEQ ID NO: 19640 - protein, 81 aa, Ursus arctos
TARSQASVTFKDVAMDFTPEEWGKLDPTQREVMLENYRNLVSLWLPVSRPENYNLENGKEPLMLERKAPKSSYPDLETKPE

SEQ ID NO: 19641 - protein, 81 aa, Ursus arctos
MAFEDVAVYFSQEEWELLDAAQRALYCHVMLENFALVASLGLSASRPRVVIQLERGEDPWVLSGTVVTPARNAHRKPSPGS

SEQ ID NO: 19642 - protein, 81 aa, Ursus arctos
FQGSVTFQDVAVDFTPEEWQLLDCDQRTLYWNVMLENFRNLISVGGPVTKTKVIFKAEQGQEPWVGERENPRWRYPEADCL

SEQ ID NO: 19643 - protein, 81 aa, Ursus arctos
MEGIPENARNLVLLGLPVSQPDMNSQLEQREEGPWMLEGGGLRSTCPDWKIMSESPPEHDISEDSFQDTSVELPPGESEHR

SEQ ID NO: 19644 - protein, 81 aa, Ursus arctos
SHTLVTFEDVLVDFTREEWELLDAAQQVTYKDVMLENYKNLVSLGHQLPKPDVILQLEKGEEPWLVERGIHRETHPDLETT

SEQ ID NO: 19645 - protein, 81 aa, Ursus arctos
SKVPVTFGDLAIYFSQEEWEWLSPIQKDLYEDVMLENYQNLVSLGLSFRRPNVITLLEKGKAPWMVEPARKRRGVDSGSKC

SEQ ID NO: 19646 - protein, 81 aa, Leptonychotes weddellii
MAFEDVAVYFSHEEWELLDTAQRALYCHVMLENFALVASLGLSASRPRVVVQLERGEEPWVLGGTAATPARTAHRKPSPAP

SEQ ID NO: 19647 - protein, 81 aa, Phascolarctos cinereus
IQESVTFRDVAVDFTGEEWSCLDAAQRALYRDVVWETYESLVFLGIPVCPLDVIFLLAGRRSTREVQGRSSQRPLSRCCGD

SEQ ID NO: 19648 - protein, 81 aa, Leptonychotes weddellii
PQVLVSFEDVAVFLSREEWGCLGPAQRGLYSNVMLETYRNLISLGLQGSKPDVISRLEKGEEPWAPYSPKIEEGWIRSHRS

SEQ ID NO: 19649 - protein, 81 aa, Odocoileus virginianus
LQEPVTFRDVAVDFTQEEWGQLGPAQRTLYRDVMLETFGHLLSVGPELPKPDVISQLEQGAELWVVEGGLAQGCRPGQETG

SEQ ID NO: 19650 - protein, 81 aa, Vicugna pacos
MAMYLTREEWRPLDPTQRDLYRDVMQENYGNVVSLDFEIRSDNEVNPKQEISEDVEFGTASERPVGNTAENPESEEAFEDR

SEQ ID NO: 19651 - protein, 81 aa, Physeter macrocephalus
AQEYLTYDDVTMKFTWEEWQLLAPDQKDLYRDVMLENYSNLVSVGYQASKPDAVSRLERGEQLWPVEDDSHGRIYPEIRKV

SEQ ID NO: 19652 - protein, 81 aa, Pan troglodytes
MAFEDVAVYFSQEEWGLLDTTQRALYRHVMLENFTLVTSLGLSTSRPHVVIQLERGEEPWVPSGTDTTLSRTTYRRRNPGS

SEQ ID NO: 19653 - protein, 81 aa, Delphinapterus leucas
MLENCRNLASLGYHVDKPSLISQLEQEDKVMTEERGILPGTCPDLETVLKAKWLTPKKHVFRKEHSNGVKVERSHLGVKLN

SEQ ID NO: 19654 - protein, 81 aa, Delphinapterus leucas
MDPTQRKLHKDVMLENYRNLVSLGLAVSKPDMISHLEDGKGPWVVVRETSKTPYSELETKPTTKNALPTENISEECLSQET

SEQ ID NO: 19655 - protein, 81 aa, Aotus trivirgatus
SQGSVTFRDVAIDFSQEEWKWLQPAQRDLYRCVMLENYGHLVSLGLSISKPDVVSLLEQGKEPWLGKRDVKTDLFSVSEST

SEQ ID NO: 19656 - protein, 81 aa, Panthera pardus
GSVSFTDVTVDFTQEEWEQLDPSQRILYMDVMLENYSNLLSVEVWKADDQMERDPSNPDEQARPFIIFKNQTPIEERGNLF

SEQ ID NO: 19657 - protein, 81 aa, Panthera pardus
ERTGSVSFKDVMVDFSREEWQRLDLAQKSLYRDVMLENYFNLISVGCQVPRPEVIFNSEQEEPCVLDGDISSLNCLNGDIG

SEQ ID NO: 19658 - protein, 81 aa, Enhydra lutris
QAEVTFEDVAVLFSREEWGRLGPAQRGLYRDVMLETYRNLVSLGAGPAGPKPGVITQLERGDEPWVLDAQGTEGKERLRVS

SEQ ID NO: 19659 - protein, 81 aa, Acinonyx jubatus
MLENYSHLVAVGCCVPKPDVIFRLEQGQQPWLVEEESLDQSCPEVCRVDNQLEQNQEIQHRHFWQSPFINNKTLTVHRGNV

SEQ ID NO: 19660 - protein, 81 aa, Tursiops truncatus
SQGPVSFEDVAIDFTQEEWQQLDPAQRTLYRDVMLENYSHLVSVGYPVSKPGVISKLEQGEEPWIMKRDISNWIYPDRETR

SEQ ID NO: 19661 - protein, 81 aa, Bison bison
GWVPALFDEVAIYFSDEEWEVLTEQQKALYREVMRMNYETVLSLEFPFPKPDMITRLEREEESQNSEEWQLQGGTFAEKEE

SEQ ID NO: 19662 - protein, 81 aa, Physeter macrocephalus
MLENYFNLISVGCQVPKPEVIFNLEWEEEPCMLDGEISSQSYLDQGIGFETSQQGMSEGVSIQLERINLFTRDDLYSILEE

SEQ ID NO: 19663 - protein, 81 aa, Physeter macrocephalus
RKVPVSFEDVSVYFTKTEWKLLDLRQRMLYKRVMLENYHHLVSLGFSSSKPHLVSRLERGEGPWVADVHRMGTTTGMQAGD

SEQ ID NO: 19664 - protein, 81 aa, Trichechus manatus
SVVIEDVAVDFTQEEWALLDLAQRKLYIDVMLETFINLASVVSRNLSDGKTFSSEHTIVRFMKNDSWSSVLGDIYELHGIE

SEQ ID NO: 19665 - protein, 81 aa, Trichechus manatus
APESVTFKDVALDFTQEEWSLLDTTQRNLFRDVMKENINHLVFIGNHLCKSDVISQLEQGEELWREGVGFLQDESLVISVR

SEQ ID NO: 19666 - protein, 81 aa, Rhinolophus ferrumequinum
SQESVTFQDVAVDFTEKEWPLLDSSQRKLYKDVMLENYSNLASVGCQVGKPSLISHLEEEEELRTEETGLHGGTCSDWETP

SEQ ID NO: 19667 - protein, 81 aa, Leptonychotes weddellii
KSLGSVSFKDVTVDFSREEWQQLDLAQKSLYRDVMLENYFNLISVGCQVPKAEVIFSLEQEEPCLLDGEISSHSCLDGDIG

SEQ ID NO: 19668 - protein, 81 aa, Odocoileus virginianus
LQNSITFEDVAINFTQKEWALLNSSQRRLYKDVMLENYRNLASVGYQLSKPPLITHLEQEDEMKIVERRIHQDTCSCEHQA

SEQ ID NO: 19669 - protein, 81 aa, Phascolarctos cinereus
PQVSVMFEDVAIYLTQDEWGHLGPAQRGLYKDVMLENYENLVSLGFPGSKPEVISQLEQGEEPWILDMKRTENREILEDGE

SEQ ID NO: 19670 - protein, 81 aa, Phascolarctos cinereus
CQEPVTFQDVVVVFTREQWAYLDPSQKELYRDVMLETYRNLLCLGLAMSKPQVIRQLERREAPWIPERRIPESSCPDLETK

SEQ ID NO: 19671 - protein, 81 aa, Pteropus vampyrus
PDIISYMICSPLKRKQEEWQQLDPAQRTLYRDVMLENFSHLVSMGHPVSKPDVISKLEQGEDPWIIKRNISNWIYPDRKSN

SEQ ID NO: 19672 - protein, 81 aa, Pteropus vampyrus
MDPTQRDLHKDVMLENYRNLVSLGLAVSKPDMIAHLEDGQGPWVVVREISRTSNPELETKLAIKNAITTEDITEDLSQDTI

SEQ ID NO: 19673 - protein, 81 aa, Pteropus vampyrus
MQPLESVMFEDVAIDFTQEEWALLDTSQRKLFRDVMLETISHLVSLGYHHAIFQLEQGEELWSEGIGFLQSQSSGRESAIK

SEQ ID NO: 19674 - protein, 81 aa, Pongo abelii
AQELLTLEDVTVEFTWEEWQLLDPFQKDLYRDVTLEIYSNLVSMGYQVSKPDALSKLEQGEEPWTMEDERHSRICPENNKV

SEQ ID NO: 19675 - protein, 81 aa, Pteropus vampyrus
PVGLVSFKDVAVDFTQEEWQQLDPAQRTLYRDVMLENFSHLVSMGHPVSKPDVISKLEQGEDPWIIKRNISNWIYPDRKSN

SEQ ID NO: 19676 - protein, 81 aa, Physeter macrocephalus
LQGSVSFKDVTVDFTQEEWQQLAPAQKALYRDVMLENYCHLISVGFHMTKPDMIHKLEQGKELWTTEKIFPSQSYLEEDWK

SEQ ID NO: 19677 - protein, 81 aa, Monodelphis domestica
AQVLVTFQDVAVDFTQEEWRLLDLGQKELYKEVMLENVQNMLFLGLPVPREDWISHFDQGRAPWMLEGEGPSNSRLDGQRR

SEQ ID NO: 19678 - protein, 81 aa, Physeter macrocephalus
GSVSFEDVTVEFTQDEWQYVGPAQRTLYKDVTLENYSHLVSLVVTFAGYCIIKPQVIFKLEHGEEPWSSEEEFLNQKYPGY

SEQ ID NO: 19679 - protein, 81 aa, Physeter macrocephalus
MSFEDVAVDFTLEEWQLLNPTQKTLYRDVMLENYSNLVFLGYQMIKPEAIFKLEQEEPWILGEEILSQNFPEEVWLDNNLK

SEQ ID NO: 19680 - protein, 81 aa, Trichechus manatus
ALGSVSFEDVAVDFTQEEWQQLDTVQKTIYKDVMLENYSHLISLGHPIIKPDVITKLEQGEEPWIVEGEFLLQSYPEEAYK

SEQ ID NO: 19681 - protein, 81 aa, Pan troglodytes
YQIPVSFKDVVVGFTQEEWHQLSPAQRALYRDVMLETYSNLVSVGYEGTKPDVILRLEQEEAPWIGEAACPGCHCWEDIWR

SEQ ID NO: 19682 - protein, 81 aa, Delphinapterus leucas
MDPVAFEDVAVNFTLEEWALLGPSQKKLYRDVMRETLRNLASIGEKWEDRNTEDQYKNQGRNLRSHTLRRCCESEEGSQCG

SEQ ID NO: 19683 - protein, 81 aa, Papio anubis
GMEPLQFRDVAIEFSLEEWHCLDTAQQNLYRDVMLENYRNLVFVGIVVSKPDLITRLEQGEKPLTVKRHKMTANPSVVCSH

SEQ ID NO: 19684 - protein, 81 aa, Balaenoptera acutorostrata
MAEDLKFKDVAIYFSQKEWECLHSAQKDLYRDVMLENYNTLISLGFSDSKPDVISLLEQGKEPWMVNSKETKEWCPDWESR

SEQ ID NO: 19685 - protein, 81 aa, Saimiri boliviensis
FQEPVTFEDVVVYFTQNEWTSLQPSQRALYREVMLENYATVTSLSAFPFSKPDLIFRLEQGEAAWGSDPWTLAGEEAPRGL

SEQ ID NO: 19686 - protein, 81 aa, Saimiri boliviensis
PLTFRDVTVEFSQEEWKCLDPTQKALYKDVMLENYRNLVFLGISPKCMIKELPPTENSNTRKRFQTVTLERHQSHDLENLY

SEQ ID NO: 19687 - protein, 81 aa, Balaenoptera acutorostrata
HQEVVTFEDVAVYFTQTEWAGLSPAQRALYRSVMLEIYGNLTSLGYPVPKPALVSLLERGDLPWGLETRDDRPAQGTKDIC

SEQ ID NO: 19688 - protein, 81 aa, Balaenoptera acutorostrata
AHQLMMFRDVAVDFSQEEWECLDLEQRALYRDVMLENYSNMVSLGLCLYQPDVFSLLEKGKEPWMVLKDETRGPCPDMQSR

SEQ ID NO: 19689 - protein, 81 aa, Ovis aries
MLENISHLVFVGYQHCKLDVIFQLEQGEELWIEGRGFFQSHSPGGESAFKEELLATQHISKKDTSTIIPMQTFHTPEDPCE

SEQ ID NO: 19690 - protein, 81 aa, Callorhinus ursinus
ARASLSFEDVAVGFSWEEWQLLAPSQKDLYRDVMLENYRNLVSVGYEASKPDSVFQLEQGEPPWMVEGAAQSQTCQEEIWE

SEQ ID NO: 19691 - protein, 81 aa, Vicugna pacos
TFQEAVTFKDVAVAFTEEELGLLDSTQRKLYQDVMVENFRNLVSVGHQPFKRDTSHIEREERLWMMNTASQMERNFGEDHA

SEQ ID NO: 19692 - protein, 81 aa, Vicugna pacos
PQDRTPFSSVAVAFTQEGWRLSVPALRDRFMEGIPEESRNLVLLGLPVSQPVMNSQLEQREGSWMLEREGLRSTCPDWKPE

SEQ ID NO: 19693 - protein, 81 aa, Vicugna pacos
GLTFKDVAIEFSQEEWECLDPAQRALYRDVMLETCRNLLSLDLSPMHVVKHLQPKANSDIEEVFQTVMLGSPESRESKHFT

SEQ ID NO: 19694 - protein, 81 aa, Phascolarctos cinereus
GKESVTFKDVAVEFTQEEWVQLNPSQKKLYRDVMLENYRNLVSLGFAVSKPNVIYQLERKEASSLPETDIPRSSCPESIEF

SEQ ID NO: 19695 - protein, 81 aa, Phascolarctos cinereus
AQELVTFQDVAVDFTEEEWVLLDQLQKELYKEVMLENAQNLVSLGLPVPREDLMSYFEEKEAPWLLEHEGLRSCYPEGEIR

SEQ ID NO: 19696 - protein, 81 aa, Pteropus vampyrus
MPQDVTVDFTQEEWQQLDSDQKALYRDVMLENYCHLISVGFHMTKPDMIRKLEEGEELWTTERIFPSQSYLESPAVYCSSF

SEQ ID NO: 19697 - protein, 81 aa, Pteropus vampyrus
CWGLLSFKDVSMEFTWEEWQLLDPTQRYLYREVILENYHNLVSVGYHGTKPDLIFKLEQGEEPWILSARISHESCAASSQL

SEQ ID NO: 19698 - protein, 81 aa, Cebus imitator
LQGPVSFKDVAVDFTQEEWQQLDPDEKITYRDVMLENYSHLVSVGCDITKPNVIIKLEQGEEPWITEDEFPCQHSPEVWKV

SEQ ID NO: 19699 - protein, 81 aa, Pteropus vampyrus
RLRTASCWDVSMEFTWEEWQLLDPTQRYLYREVILENYHNLVSVGYHGTKPDLIFKLEQGEEPWILSARISHESCAEGWKE

SEQ ID NO: 19700 - protein, 81 aa, Pteropus vampyrus
MAQVPLTFSDVAIDFSPEEWECLNSDQRDLYRDVMLENYTNLVSLDFDFTTEINKLSSGKSNYEVNSYHQETTKRSKTFNF

SEQ ID NO: 19701 - protein, 81 aa, Physeter macrocephalus
RSQESLTFQDVAVDFTREEWDQLYPAQKNLYRDVMLENYRNLVALGHQLYKPEVITQLEQEEQWMMEIDSPPDTHPDGENS

SEQ ID NO: 19702 - protein, 81 aa, Trichechus manatus
QESVAFEDVAVDFTPEEWVLLDRSQRTLYREVMLETYRNLASLDWRTQLKTKESTSKQDIFGESMFKGMKMQAPTHPGKRP

SEQ ID NO: 19703 - protein, 81 aa, unidentified
  REGION 1..81: note = Bos indicus x Bos taurus
MLENYSNLVSAGFQASTPEVLSKLDQGEPWMMDDEIHCRTHSEVWKVDGHLLEHLQKKRVEKRLEQWLEQNPLDNSGHQSR

SEQ ID NO: 19704 - protein, 81 aa, Trichechus manatus
HQEPVTFEDVAVIFTEEEWRHLVPIQRDLYKEVMLENYRSIVSLGLPVPQPDVIFQLKRGEEAWIVDLRGSEERECPENIS

SEQ ID NO: 19705 - protein, 81 aa, Aotus trivirgatus
QGTVTFEDVAVYFSREEWGLLDEAEKHLYHNVMLENLALITSLDCWCETEDEEVPSEQSVSVERLSQVRVPTLSSHIKQAH

SEQ ID NO: 19706 - protein, 81 aa, Delphinapterus leucas
SQGSLSFRDVTVGFTQEEWQHLDPAQRTLYRDVMLENYSHLISVGFCIPKPEVILKLEQGEEPWILEEESPSQSVPELINS

SEQ ID NO: 19707 - protein, 81 aa, Sapajus apella
MDVAIEFCLEEWQCLDTAQQNLYRNVMLENYRNLVFLGIAVSKPDLITCLEQEKEPWNMKRHEMVAKSSVTCSHFAQDFWP

SEQ ID NO: 19708 - protein, 81 aa, Bos taurus
GRLMFQDVAIDFTQEEWESLDPSQRKLYRDVMVENYRNLASLGEDICLPESLIYPLHFCSVISRMSSEIFCFPQYFQICAL

SEQ ID NO: 19709 - protein, 81 aa, Gorilla gorilla
VTFEDVAVYFSWKEWGLLDEAQKCLYHDVMLENLTLTTSLGGSGAGDEEAPYQRSTSPQRVSQVRIPKALPSPQKTSPCEI

SEQ ID NO: 19710 - protein, 81 aa, Saimiri boliviensis
SWGPLSFMDVFVDFTREEWQLLDPAQKCLYRSVMLENYSNLVSLGYQHTKPDIIFRLEQEELCMVQTPIPNQCCPDKVWKI

SEQ ID NO: 19711 - protein, 81 aa, Neophocaena asiaeorientalis
GWVPLTFSDVAIDFSQEEWECLNSDQRNLYRDVMLENYTNLISLDIDFTSESNKLSSEKSSYEVNSYRRETMNRSKTFNFM

SEQ ID NO: 19712 - protein, 81 aa, Neophocaena asiaeorientalis
MLENYSHLVSMGHPVSKPDVIFKLEQGEDPWIIKRDIPNWIYPYEDQADGRQDRKSNLDNTQSCILGSVSFHNKILKGVTK

SEQ ID NO: 19713 - protein, 81 aa, Physeter macrocephalus
LQESFSFEDLSVDFTQKEWQLLAPYQKDLYKDVMLENYSSLVSLGYEVMKPGVILKLEHGEEPWTGDGEIPGSDSPEQVLQ

SEQ ID NO: 19714 - protein, 81 aa, Physeter macrocephalus
TDGLVTFRDVAINFSQEEWEFLDPAQRDLYVDVMLENYSNLISLDLESTYETKNTFAKKDIFEINFPQQEIKERSKTLGFE

SEQ ID NO: 19715 - protein, 81 aa, Physeter macrocephalus
PEGGVSFEDIALYFSWEEWKLLDEAQKLLYHDVMLENFALISSLGFWSGEEYVEASFEQSVSVVMSQVRTSKEPSSSQKTH

SEQ ID NO: 19716 - protein, 81 aa, unidentified
  REGION 1..81: note = Bos indicus x Bos taurus
MTKPDMIRKLEQGKELWTTEKFFQSQSYLEEDWKAEDVLVKFKEYQDRHSRSIISINHKRLIKERSNIWGKTFTIDKNHII

SEQ ID NO: 19717 - protein, 81 aa, Zalophus californianus
QGPMLFEDLAVYFSQEEYVSLHPVQRSLSRDTTQECFEDMALMGGEGKTEISQQLNLESTGFEELAPENSSITVPLIYYPE

SEQ ID NO: 19718 - protein, 81 aa, Macaca mulatta
VHGSVTFRDVAIDFSQEEWECLQPDQRTLYRDVMLENYSHLISLAGSSISKPDVITLLEQEKEPWIVVRKETSRWYPDLES

SEQ ID NO: 19719 - protein, 81 aa, Pan troglodytes
TLKEAVTFKDVAVVFTEEELRLLDLAQRKLYREVMLENFRNLLSVGHQSLHRDTFYFLKEEKFWMMEIATQREGNLGGKIQ

SEQ ID NO: 19720 - protein, 81 aa, Sapajus apella
MVSFEDVAVLLSQEEWDCLIPAQRGLYRDVMLETYGNLVSLGLQASKPDVISRLEQGDEPWTTHTLRMQGSWSWRHKREGC

SEQ ID NO: 19721 - protein, 81 aa, Muntiacus muntjak
TLKEAVTFTDVAVTFTEEELGLLDLAQKKLYQDVMLENFRNLISVGCHPFRHDIFHLEKEKRLWVVKTATQSEGKSEEKIQ

SEQ ID NO: 19722 - protein, 81 aa, Delphinapterus leucas
QEAVTFKDVAVAFTEEELGLLDSAQRKLYQDVMVENFRNLVSVEENNQSELRAVQDRGSREELSCWQIWQQIANDLTRCQD

SEQ ID NO: 19723 - protein, 81 aa, Delphinapterus leucas
KDQGSLTLEDVAVDFTWEEWQLLAPAQKDLYRDVMLENYSNLLSIGYQASKPDALSRLERGEPWPVEDEIHSQICPEMRKD

SEQ ID NO: 19724 - protein, 81 aa, Bos taurus
YQEFVTFEDVAVHLTREEWGCLDPVQRALYREVMLENYGNLVSLGILLRLPTTRIHSVNSCPALSHTQASAFSGETLAILS

SEQ ID NO: 19725 - protein, 81 aa, Balaenoptera acutorostrata
PQASVSFKDVTVEFTQEEWWQMDSAQRTLYRDVMLENYSHLVSVGYCFTKPELIFMLEQGEDPWLLEKEFVNRSSPEESQP

SEQ ID NO: 19726 - protein, 81 aa, Balaenoptera acutorostrata
SQDPVTFQEVAVDFSQEEWALLAPAQKILYRDVMLENYRNLASVGYHLRKPSLLTQEELRTKKRRIFQDTCADQNSQLKTK

SEQ ID NO: 19727 - protein, 81 aa, Balaenoptera acutorostrata
PQAKVTFEDVAVLLSQEEWDRLGPAQRGLYRHVMMETYGNVVSVGIPGSKPEVISQLERGEEPWVLDKQGNEGRRGLGIGR

SEQ ID NO: 19728 - protein, 81 aa, Balaenoptera acutorostrata
EEVPVVFEDVAVYFTREEWGALDKRQKELYRDVMRTNYELLASLGPAAAKPDLISKLERRAAPWIKDPDGPKWEKGRPPGK

SEQ ID NO: 19729 - protein, 81 aa, Callorhinus ursinus
PKVPVTFDDVAVHFSEQEWGNLSEWQKELYKNVMRGNYESLVSMDYAISKPDLMSQMERGERPTVQEQEDSEEGDTPADPS

SEQ ID NO: 19730 - protein, 81 aa, Rhinolophus ferrumequinum
NFWVLRLPPGSKGEVPKEWGKLDEWQKELYKHVMRGNYETLVSLDYAISKPEVLSQTEHGKEPCSWRRAGPKVPDVPVDPS

SEQ ID NO: 19731 - protein, 81 aa, Sus scrofa
PKVPVSFEDVSVYFTKTEWKLLDLRQRMLYKQVMLENYRHLVSLGFSFSKPHLVSQLERGEGPWVASHRMGAAAGMQAGDK

SEQ ID NO: 19732 - protein, 81 aa, Enhydra lutris
MAFRDVAVDFSQEEWMLLSPAQRSLYREVMLENYSNLVSLGIPFSKPKLIIQLEQGKETWREERTCPPATCPAEPKPELHL

SEQ ID NO: 19733 - protein, 81 aa, Enhydra lutris
YQEFVTFEDVAVHLTREEWGCLDPVQRDLYREVMLENYGNVVSLGFPLSKPDGISLREQDLQVFDLETKNREVLRDDCSDG

SEQ ID NO: 19734 - protein, 81 aa, Sus scrofa
PQDLVTFKDVAVDFSQEEWKWLNPAQRNLYRSMMLENYQSLVSLGLCISKPYVISLLEQGKEPWVMKSERTSSPFPDWESI

SEQ ID NO: 19735 - protein, 81 aa, Sus scrofa
LMEAVTFGDVAVHFSREEWQCLDPGQRALYKEVMLENHSSVAGLAGFLVFKPELISRLEQGQEPWVLDLQGTEGREAPRPS

SEQ ID NO: 19736 - protein, 81 aa, Ursus arctos
CWGLLSFKDISMEFTWEEWQLLDSTQKYLYRDVILENYSHLVSVGYHGTKPDLIFKLEQGEEPWIINAKVSRQSYPEGWKE

SEQ ID NO: 19737 - protein, 81 aa, Sus scrofa
MLENYSNLVSVGLSIPKPDVISLLEQGKEPWGVFDSEMTRGLNQDCGSRCETKEFSSKKDIYGIESCQWFSLGHLTKHGLD

SEQ ID NO: 19738 - protein, 81 aa, Neophocaena asiaeorientalis
SQGSLSFRDVTVGFTQEEWQHLDPAQRMLYRDVMLENYSHLISVGFCIPKPEVILKLEQGEEPWILEEESPSQSVPELIGS

SEQ ID NO: 19739 - protein, 81 aa, Vicugna pacos
GLTFKDVAIKFSQEEWECLDPAQRALYRDVMLETCRNLLSLAISHIHVIKKLKPKANSDIGEEFQTVMLGRHKSCEIRDFY

SEQ ID NO: 19740 - protein, 81 aa, Neophocaena asiaeorientalis
MTEEFATLEDVAMDFTLEDWEQLGLDQGDLFWDTALDNYQNLFLLNPPRPNLTSHPDDEEELAALAKGSPESTGPDTAEAK

SEQ ID NO: 19741 - protein, 81 aa, Phascolarctos cinereus
MLENYQNLLCLGLAVSKPEVICQLEQGEAPWRPEGRVPGSSHPDGEVRPETKESPPELGISVEQSSGQDRLRRHGLCVSSW

SEQ ID NO: 19742 - protein, 81 aa, Pongo abelii
IQGPLTFGDVAVAFTRIEWRHLDAAQRALYRDVMLENYGNLVSVGLLSSKPKLITQLEQGAEPWTEVREAPSGTHTVQDYW

SEQ ID NO: 19743 - protein, 81 aa, Pteropus vampyrus
MPFSNVTVAFTHEQWRHLVPAPRDKFKEGIPDKSRNLVLLGLPVSQPGMNSQLEQREGPWILEGNGLRTTCPDRKIVSQSP

SEQ ID NO: 19744 - protein, 81 aa, Pongo abelii
AQGLVTFRDVAIEFSLEEWKCLEPAQRDLYREVTLENFGHLASLGLSISKPDVVSLLEQGKEPWMIANDVTGPWYPDLESR

SEQ ID NO: 19745 - protein, 81 aa, Physeter macrocephalus
AQETMSFKDVAVDFTWEEWQLLAPLQKDLYRDVMLENYSNLLSVGYRVSKPDALSKLERGEEPWTIEDEIHSQTCPETGNV

SEQ ID NO: 19746 - protein, 81 aa, Pteropus vampyrus
AQGSVSFKDVTVDFTREEWQHLDPAQKTLYMDVMLENYCHLVSVGCRMTKPDVILKLERGEEPWTSFTGHTCLEETWKAED

SEQ ID NO: 19747 - protein, 81 aa, Pan troglodytes
FQELVTFRDVAIDFSRQEWEYLDPNQRDLYRDVMLENYRNLVSLEMRSRCVARVGLKLLVSSDPPTSTFQNAGIIGVSHRA

SEQ ID NO: 19748 - protein, 81 aa, Zalophus californianus
PLGLLSFKDISVEFTWEEWQLLDSTQKYLYRDVILENYSHLVSVGYHGTKPDLIFKLEQGEEPWIINAKVSRQSCPEGWKE

SEQ ID NO: 19749 - protein, 81 aa, Delphinapterus leucas
LQGSFSFEDLSVDFTQKEWQLLAPCQKDLYKDVMLENYSSLVSLGYEVMKPGVILKLEHGEEPWTGDGEIPGSDSSEQVLQ

SEQ ID NO: 19750 - protein, 81 aa, Ailuropoda melanoleuca
RESLTLEDVAVDFTWEEWQLLAPTQKNLYRDVMLENYRNLVSVGYVASKPDALSRLEQEEPWTTEDEIHSRFHPEIKKDDG

SEQ ID NO: 19751 - protein, 81 aa, Saimiri boliviensis
AQESLTLEDVTVEFTWEEWQLLDPCQKDLYRDVMLEIYSNLVSMGFQVSKPDALSKLERGEEPWTLEDERHSRICPENNKV

SEQ ID NO: 19752 - protein, 81 aa, Balaenoptera acutorostrata
SQGPVSFKDVAVDFTQEEWQQLDPDEKTTYRDVMLENYSHLVSVGYDSTKPNVILKLEQGEEPWVADGEFPRQFHSEEVWK

SEQ ID NO: 19753 - protein, 81 aa, Callorhinus ursinus
MDPAPEEWRLLNEAQRHLYRDVMLEVFALVASLGCGRGTEDEAAPSEQNVSVGGSQINSTQKAYTQEHGLDSESDLYSPSP

SEQ ID NO: 19754 - protein, 81 aa, Callorhinus ursinus
AQISVTFDDVAVTFTQEEWGQLDPAQRTLYQEVMLENCGLLVSLGCPVPRPELIYQLEHGQELWTWKRHLSQSAYPGRSQD

SEQ ID NO: 19755 - protein, 81 aa, Equus caballus
GQLTFRDVAIEFSQEEWESLDPAQRALYRDVMLENYRNLLSLGSISAEFAINKLSPREDIDKGKLYHLVILERNERHGVKD

SEQ ID NO: 19756 - protein, 81 aa, Callorhinus ursinus
EKPVTFDDVAVNFTQEEWVCLDASQRVLYQNVMSETFRNLMSVAPVRIFLSNPDLIIELEQEEKQWRAELQLHPPNGEGLP

SEQ ID NO: 19757 - protein, 81 aa, Erinaceus europaeus
GSVSFTDVTVDFTQEEWEQLDPSQRILYMDVMLENYSNLLSVEVWKADDQIEKEQRDPDEQAKQFVTFNNQTSTEERGNIS

SEQ ID NO: 19758 - protein, 81 aa, Tursiops truncatus
AQESLTYDDVTMKFTWEEWQLLDTDQKDLYRDVMLENYSNLLSIGYRASKPDALSRLERGEQLWPVEDDSHGRICPEIRKV

SEQ ID NO: 19759 - protein, 81 aa, Enhydra lutris
SQESVTFEDVAVDFTQEEWTLLDRSQRKLFRDVMLENISHLVSIGRQLYKSDTISHLEPGEHLSQEGLGLLQCQSLDREDD

SEQ ID NO: 19760 - protein, 81 aa, Vicugna pacos
YQEFVTFEDVAVHLTREEWGCLDPVQRDLYREVMLENYGNLVSLGYPVSKPDGIFQLEQDLQVFDLETKNREVLRDDYSDG

SEQ ID NO: 19761 - protein, 81 aa, Vicugna pacos
MFQVTFSDVAIDFSHEEWGWLDSAQRDLYKDVMVQNYENLVSLAGLSIPKPNVIALLEEGKDPWMVERKLSTGMFPDWDSR

SEQ ID NO: 19762 - protein, 81 aa, Leptonychotes weddellii
AQVCVISEDVFVFFSREEWMLLDDSQRLLYQDVMLENFALLASLGIVSSRSHAVTQLEQKEDPQMPDQVAMTPVTEREARR

SEQ ID NO: 19763 - protein, 81 aa, Odocoileus virginianus
MVQESVTFKDVAVLFTRDEWAQLSPAQRALYRDVMLENYSNLLSLGLLGSKPDMFSQLGKGEAWMPEDSLGGFCLDWVITP

SEQ ID NO: 19764 - protein, 81 aa, Pteropus vampyrus
KREAVTFKDVAVVFTEEELGLLDSAQRKLYRDVTLENFRNLVSVGHQSSKPDVISQLEREEKLRTTEASQAEAGGNENEME

SEQ ID NO: 19765 - protein, 81 aa, Pan troglodytes
PRGSTFFSSVTVAFAQGGWRCLVSTPRERFKEGIPGKSRSLVLLGLPVSQPGMNSQLEQREGAWMLEGEDLRSPSPGWKII

SEQ ID NO: 19766 - protein, 81 aa, Zalophus californianus
PQGLVTFGDVVVDFTPEEWQYLNPPQKTLYREVMLETYSNLVSVAGPQVTKPDLILKLEVEEPCPAETKISFWSFPEAACQ

SEQ ID NO: 19767 - protein, 81 aa, Vombatus ursinus
MLENYRNLVSLGHQISKPDVISQLEQGEEPWLVERKIPRDTFPDWESMPEISTSTLKQAISEKQSSQEVTMERFTRDFFCY

SEQ ID NO: 19768 - protein, 81 aa, Balaenoptera acutorostrata
YQELVTFRDVAVDFSREEWDCLNSSQRHLYSNVMLENYRILVSLGLCFSKPSVILLLEQGKEPWMVKRELTKDLCSDWESV

SEQ ID NO: 19769 - protein, 81 aa, Ursus maritimus
DEALMAFRDVAVAFTQKEWKLLSPAQRTLYRDVMLENYSHLVSLGIAFSKPRLITQLEQGDEPWREESECLLDLCPAEPGT

SEQ ID NO: 19770 - protein, 81 aa, Ursus maritimus
ARASLSFEDVAVGFSWEEWQLLAPSQKDLYRDVMLENYRNLVSVGYQASKLDSLFQSEQGGPPWTVEGAAQSQTCPEEIWE

SEQ ID NO: 19771 - protein, 81 aa, Ursus maritimus
RQKSLKFKDVAVKFSKDEWKRLVPTQRALYREVMLENYQGFISLGLLVPKPDVIFQLKRGEEPWKLDFQEDEKSEVPGSTF

SEQ ID NO: 19772 - protein, 81 aa, Phyllostomus discolor
MKFEDVAIAFSQEEWGLLDEAQRLLYCDVMWEIFNLVTSVGCLHKMEGDEIPSEQSVSIDGESQVSSSKIVPATQKTHPCE

SEQ ID NO: 19773 - protein, 81 aa, Rhinopithecus bieti
TSKEAVTFKDVVVFFTEEELRLLDSAQRKLYRDVMLENFRNLLSVGHQPFHRDTFHFLREEKFWMIDIATQREGNSGGRIQ

SEQ ID NO: 19774 - protein, 81 aa, Pan troglodytes
TQGQLSFSDVAIEFSQEEWKCLDPGQKALYRDVMLENYRNLISLGICLPDLSVTSMLEQKRDPWTLQSEVKIVNNPDGREC

SEQ ID NO: 19775 - protein, 81 aa, Pan troglodytes
CEASVSFEDVTVDFSREEWQQLDPAQRCLYRDVMLELYSHLFSVGYHIPNPEVIFRMPKEKEPRVEEAEVSHQRCQEREFG

SEQ ID NO: 19776 - protein, 81 aa, Sapajus apella
SPGSVTFTDVAIDFSQDEWEWLNLAQRSLYKKVMLENYRNLVSVGLCISKPDVISLLEQEKDPWVIKGEMTRGLCSDLEYV

SEQ ID NO: 19777 - protein, 81 aa, Delphinapterus leucas
AQGSVSFKDVTVDFSQEEWQHLDPAQKMLYMDVMLENYCHLVSVGCHMTKPDVILKLERGEEPWTSFTGHTCLEEKWKAED

SEQ ID NO: 19778 - protein, 81 aa, Sapajus apella
VHGSVTFRDVAIDFSQEEWECLQPAQRTLYRDVMLENYSHLISLAGSSVSKPDVITLLEQEKEPWMVVRKETSRWYTDLES

SEQ ID NO: 19779 - protein, 81 aa, Papio anubis
MVSFEDVAVLLSQEEWDCLIPAQRGLYRDVMLETYGNLVSLGLQASKPDVISRLEQGDEPWTPHILRTQRSWSWRHKRECY

SEQ ID NO: 19780 - protein, 81 aa, Aotus trivirgatus
MGPLTFRDVAIEFSLEEWQCLDTAQQNLYRHVMLENYRNLLFLGIAVCKPDLITCLEQGKEPWNMKRHAMVAKPPVVCSQD

SEQ ID NO: 19781 - protein, 81 aa, Zalophus californianus
SQESVTFEDVAVDFTQEEWTLLDRSQRKLFRDVMLENISHLVSIGRQLYKSDTISHLEPGEHLSKEGRGLLQCQSLDREDD

SEQ ID NO: 19782 - protein, 81 aa, Carlito syrichta
FQESVTFKDVIVDFTQEEWKQLDPVQRDLFRDVTLENYTHLVSIGLQVSKPDVISQLEQGTEPWIMEPGIPVGTFADWETR

SEQ ID NO: 19783 - protein, 81 aa, Zalophus californianus
MLETYRHLLSVGNQIAKPEVISLLEQGEEPWSVEQAYPQSTCPEWMRNLESKALIPTQSIFEEEQSHSMKLERYIWDDPWF

SEQ ID NO: 19784 - protein, 81 aa, Balaenoptera acutorostrata
MLETYSSLVSLGHCITKPEVIIKLEQGAAPWTVKETPDQGFPDVQIVDDLIETSQENHGRRLWQVVITSNKTSTKGTTDLG

SEQ ID NO: 19785 - protein, 81 aa, Vombatus ursinus
MISQLEQGEEPWILEREISRCIYSDRETRPEIEESTTKQVISTEELSQEKCKRDGCQDFKLGKTWGYEVMLEKQQGNQERP

SEQ ID NO: 19786 - protein, 81 aa, Balaenoptera acutorostrata
MLETYSNLVSVGYEGTKPYVILRLEQEEAPWICEASCSGCHCFENIWQGNVQKKRQQDMLLRQGTFISKKTLPKERSHECN

SEQ ID NO: 19787 - protein, 81 aa, Callorhinus ursinus
WSQMPVTFEDVALYLSREEWGRLDHAQQSFYRDVLQKRNGLSLGFPFSRPFWASQGQGKGEASSSCRQMGDEEEKPGATEM

SEQ ID NO: 19788 - protein, 81 aa, Callorhinus ursinus
QSRGPLSFVDVFVDFTWEEWRLLDPTQKHLYRSVMLENYSNLVSLGYQDSKPDIIFKLEQEELWMMQAQIPSQGHPEKVWE

SEQ ID NO: 19789 - protein, 81 aa, Callorhinus ursinus
FKETVTFKDVAVVFTEEELGLLDPAQRKLYGDVMLENFRNLISVGGKIQSKMKTIIEAEPPEELSCWRIWQQIASDLTRCQ

SEQ ID NO: 19790 - protein, 81 aa, Callorhinus ursinus
LQKSVTFEDVAVYFTQTEWDGLSPAQRALYRDVMLENYGNVASLGFSLFKPAVISQLEGAGELGGPSPLVDGTETGPQGLW

SEQ ID NO: 19791 - protein, 81 aa, Rhinolophus ferrumequinum
SQSLVTFGDVAVDFSQEEWERLNSAQRGLYRDVMLENYRSLVSLGLCFSKPDMISSLEQRKEPWMPKRKLMRGQCPGWKAV

SEQ ID NO: 19792 - protein, 81 aa, Phyllostomus discolor
MAEGLKFKDVAIFFSQKEWECLHSAQKDLYRAVMLENYNNLILLGLSDSKPDVISLLEQGKEPWIVKRKETKEWCPDWESR

SEQ ID NO: 19793 - protein, 81 aa, Ursus maritimus
QGPMLFEDLAVYFSQEEYVSLHPAQRSFSRDTTQECFEDMALMGGEGKTEISQQLNLESTGFEELAPESSSITVPLVYYPK

SEQ ID NO: 19794 - protein, 81 aa, Camelus dromedarius
RLTFEDVAIEFSQEEWECLDPAQRALYGEVMLETYRNLVSLGLTSKDSCSLRRKPRRGWRDQKRTREWPLLRFVIASSFNS

SEQ ID NO: 19795 - protein, 81 aa, Acinonyx jubatus
SVAFEDVTVNFTLEEWALLNPSQKKLYRDVMQETFRNLASVGDKWEDRNSKSLYEHETNRRRVVESPCHSKEGSQRGDPRR

SEQ ID NO: 19796 - protein, 81 aa, Acinonyx jubatus
SQEPVTFEDVAVYFTQNQWTSLDPMQRALYREVMLENYANMTSLGAFPFPKPELILQLERGEAPRGLDPWTPMGGEAPGDV

SEQ ID NO: 19797 - protein, 81 aa, Odocoileus virginianus
LEEEETEQESEMALSQAQLTFKDVAIEFTQEEWECLDPAQRALYRDVMVETLRNLVSLGEDDFPLKLGSALGYHCISHCVI

SEQ ID NO: 19798 - protein, 81 aa, Odocoileus virginianus
QLTSEDVAIEFTQEEWEFLDPAQRALYRDVMMETYRNLLSVDISPTHVIKRLQPKANSDKREPFQTLMLGRSESCEIKHFH

SEQ ID NO: 19799 - protein, 81 aa, Cebus imitator
FQELVTFRDVAIDFSRQEWEYLDPHQRDLYRDVMLENYRNLVSLGGHSISKPVLVDLLEQGKEPWMILREETQFPDLDLQC

SEQ ID NO: 19800 - protein, 81 aa, Cebus imitator
PQESVAFDDVAVYFTKKEWGMMVPDQRALYRDVMLENCEAVVLVAVPPTSKPALGSHLEQGKEPCSTQPQGVLSRRDWRAG

SEQ ID NO: 19801 - protein, 81 aa, Callithrix jacchus
MEPLGFRDVAIEFSLEEWHCLDTVQRNLYWDVMLENYRNLVFLGIFVSNPDLTTAPVMHSHFAQDLWPEQGIKDSFQKMIL

SEQ ID NO: 19802 - protein, 81 aa, Zalophus californianus
MYFSQEEWELLDPTQKALYNDVMRENYETVISLAVPAHQILAFPEQIITKDWTVAPELVLPESQSLLTFEEVAMYFSQEEW

SEQ ID NO: 19803 - protein, 81 aa, Zalophus californianus
VFKEAVTFKDVAVAFTEEELGLLDSAQRKLYQDVMLENFRNLVSVGHQPFKRDKWHIEREERPWLMKTATPIERNVGGSNQ

SEQ ID NO: 19804 - protein, 81 aa, Delphinapterus leucas
AQELVTFEDVAVYFIRKEWKRLEPAQRDLYRDVMLENYGNVFSLDGETRTEHDPEISEDTGSHGVLLGRFQKDISQGLKFE

SEQ ID NO: 19805 - protein, 81 aa, Phyllostomus discolor
AQEFLTFHDVAVDFTLEEWQLLDSDQKDLYRDVMLENYSNLVSVGYESSNPDVFSKLDHGETPWTEEGEIHCGNHSEIWKL

SEQ ID NO: 19806 - protein, 81 aa, Phyllostomus discolor
AHESVTFNDVFIVFSQEEWEYLDLQHRDLYRDVMLENYSNLVSLGCFIAKPDVISLLEQGKEPWKVVRKERTLYSDLGTKC

SEQ ID NO: 19807 - protein, 81 aa, Acinonyx jubatus
WSQMPVTFEDVALYLSREEWGRLDHAQQNFYRDVLQKRNGLSLGFPFSRPFWASQGQGKGEASGSCRQMGDEEKTGAIEVG

SEQ ID NO: 19808 - protein, 81 aa, Rhinopithecus roxellana
FQAKLTFEDVAVLLSQDEWDRLCPAQRGLYRNVMMETYGNVVSLGLPGSKPDIISQLERGEDPWVLDRKGTKKSQGLWSDY

SEQ ID NO: 19809 - protein, 81 aa, Bison bison
HQGSVTFEDVAMYFSWEEWCLLDEAQIQLYLDVMLENFALVCMLGSWRGVQDKETPSEEIKPAGVLQFRTPRAGLSPEKTQ

SEQ ID NO: 19810 - protein, 81 aa, Bison bison
SQGRLTFQDVAIDFTQEEWECLDLGQRELYRDVMLENYRNLASLGLVVSKLDLVTFLEQMKNPWDVRRLEPPAIYTGCRIL

SEQ ID NO: 19811 - protein, 81 aa, Bison bison
MDPVAFEDVAVNFTLEEWALLGPSQKKLYRDVMRETLSNLALIRDKWEDHNTEDQYKNQERNLRSHILQRLCESKEGSQGG

SEQ ID NO: 19812 - protein, 81 aa, Bison bison
KEAFVTLRDVAGGFTQEEWKLLSPAERTLHTEVMLEAYNHLVSLDILFSKLQLICQLEQGEEPWIEERQRSLGLCPAGSKL

SEQ ID NO: 19813 - protein, 81 aa, Odocoileus virginianus
LQELVTFKDVAVDFTEEEWEHLDPSQRHLYREVMLENFGNLISLGHLLSEPEMIFHFEQEDDVWMEETISRSSYSGVRDEN

SEQ ID NO: 19814 - protein, 81 aa, Odocoileus virginianus
HQGSVTFEDVAMYFSWEEWCLLDEAQIQLYLDVMLENFALVCMLGFWCGTQDGETPSEQSESAGVSQISTPRAGSSPENVQ

SEQ ID NO: 19815 - protein, 81 aa, Odocoileus virginianus
AQELVTFEDVAVYFIRKEWKRLEPAQRDLYRDVMLENYGNVFSLDGETRTEPDSEISEDTGSHRVLLGRFQKDISQGLKFE

SEQ ID NO: 19816 - protein, 81 aa, Odocoileus virginianus
QESVTFKDVAVDFTLEEWGRLGPGQRELYRDVMLENYQNLLSLGAGFPGAKPDVISRLERGEEPRMERRETQQVTCPDLET

SEQ ID NO: 19817 - protein, 81 aa, Cebus imitator
RREQVTFEDVVVDFTQEEWGQLEPAQRTLYCDVMLDTFRLLVTVGHWLPKPNIISLLEQEAELWAVDPGVPQGVYQDLESR

SEQ ID NO: 19818 - protein, 81 aa, Cebus imitator
RSLGSLEMEPLTFGDVAIEFSLEEWKCLNPAQRNLYRNVMLENCRNLAFLGIAISKPYLITYIEKAKEHWNMKHGMVDEPP

SEQ ID NO: 19819 - protein, 81 aa, Cebus imitator
HLTFMDVAIEFSQEEWKCLDPAQQALYRDVMLENYRNLVSLGRSCILRSNAGNKRIKNQLGLTLESHLSELQLFQAARKIY

SEQ ID NO: 19820 - protein, 81 aa, Sapajus apella
MDVMLENYCHLMSVGCHMTKPDVILKLERGEEPWTSFADHTRLEENWKAEDFLVKFREHREKYSRSVVSINHKKLVKEKSK

SEQ ID NO: 19821 - protein, 81 aa, Papio anubis
PQGLLTFRDVAIEFSQEEWKCLDPSQRTLYRDVMLENYRNLVSLDISSKCMMKTLSSTGQGNTEVILKGTLQRQASHHIGE

SEQ ID NO: 19822 - protein, 81 aa, Delphinapterus leucas
SQSLLTFEEVAIYFSQEEWELLDPTQKALYNDVMQENYETVISLALFVLPKTKVICCLEQGEEPWVQRSPIFKDSPGELFS

SEQ ID NO: 19823 - protein, 81 aa, Equus caballus
SQESVTFEDVAVVFTQEEWALLDTSQRKLFRDVMLENISHLVSIGSQFYKSDVISHLEQGEQLSREGICFLQGQSPDWEGD

SEQ ID NO: 19824 - protein, 81 aa, Ovis aries
GSVSFTDVTVDFTQEEWEQLEPSQRILYMDVMLENYSNLLSVEVWKADDQMETDHRNPDEQARPLVIFKDQTPTEERDNNL

SEQ ID NO: 19825 - protein, 81 aa, Vulpes vulpes
QGPLLFEDLAVYFSQEECVSLYPAQRSLSRDITLECFKDMALMGGEGKTEIPQQLNLESTGFEELSPENSIAVPLVYYPEK

SEQ ID NO: 19826 - protein, 81 aa, Vulpes vulpes
PLESVTFEDVAIDFSKEEWALLDMSQRKLFRDVMLENIRHLVSLGYQHCKSDVVFQLEQGEELWSEGTGFLQGQSPGRESA

SEQ ID NO: 19827 - protein, 81 aa, Acinonyx jubatus
GRLTFRDVAIEFSQEEWECLDPAQRALYRDVMLENYRNLVSLGSPSAGFVIKELSPIEDINKGELCHLVILERNESHDIQD

SEQ ID NO: 19828 - protein, 81 aa, Bison bison
CEGSVSFRDVAVDFSREEWQQLDLDQKNLYRDVMLETCSHLLSIEELWQIGDQIESYHQRENRSLRNVAFIKKVLTIQRDY

SEQ ID NO: 19829 - protein, 81 aa, Bison bison
FQESVTFEDVAVNFSHEEWQCLTHAQRHLYKDVMLENYGNMVSLGFSFSKPPLISHLEQGAEPYVQDRQDWEFLSCSYPVS

SEQ ID NO: 19830 - protein, 81 aa, Bison bison
QSQLTLNDVAIHFSPEEWECLDPAQRALYVDVMLDTFRNLLSVDISHLHIWKLQLKSHTDRGGVCRTVIWGRNEIPETKHF

SEQ ID NO: 19831 - protein, 81 aa, Bison bison
CQDPVTFEDVAVVFTDEEWRRLVPTQRDLYKEVMLENYNSIVSLGLPVPGPDVIFQLKRGDEPWLVEFHGFEGKEGAENVS

SEQ ID NO: 19832 - protein, 81 aa, Bison bison
MSKPDVVSLLEQGKEPWLGNGDVSRELFPASKSNGEIKEFSPKNVIFEDDSSQYLIMERFLSQGSEYSSFKEGWKCEGDTE

SEQ ID NO: 19833 - protein, 81 aa, Bison bison
VTAAQAGMKFEDVAIDFSQEEWGLLDEAQRLLYYSVMLENFALVASLDFHWQHRDDSGEKPWERDVERVSFVRSCHLFVSG

SEQ ID NO: 19834 - protein, 81 aa, Odocoileus virginianus
AWSQMPVTFDDVALYLSREEWGRLDHTQQSYREVLQKRSGLSLGFPFSRPFWASQVQGKGEAPGSSRQLGHEEEEKRGLPW

SEQ ID NO: 19835 - protein, 81 aa, Odocoileus virginianus
SLAFEDVAVNFTLDEWVLLDSSQRKLYRDVMRENFRNVVSVEAKQEDHDIEDQDKNQERKLRNPKAERHSEKRDINSSEES

SEQ ID NO: 19836 - protein, 81 aa, Odocoileus virginianus
SLGSVSFRDVAVDFTQEEWQHLDPEQKTTYRDVMLENYSHLISVGCHIIKPEVITKLEQGEEPWVVEGEFLLHSRPEEVWK

SEQ ID NO: 19837 - protein, 81 aa, Cebus imitator
FQASVSFKDVTVEFTQEEWQHMGPVERTLYRDVMLENYSHLISVGYCFTKPELIFTLEQGEDPWLLEKEKGFLSRTSPEDS

SEQ ID NO: 19838 - protein, 81 aa, Cebus imitator
WLQEPMTFKDVAIEFTQEEWIMLDSAQRSLYKDVMLENYQNLTSVEYQLCKLTVISPLHQKEIRNMKKRNLQGLCPDQKIQ

SEQ ID NO: 19839 - protein, 81 aa, Macaca mulatta
FMGSLSFEDVTVGFTQEEWQHLDPAQRTLYRDVMIENYSHLVSVGYCIPKQEVIFKLEQGEQPWILEEELPGQRYPDELAC

SEQ ID NO: 19840 - protein, 81 aa, Vulpes vulpes
SQGLLSFSDVSVDFTWEEWQLLDTVQRNLYRDVMLENYSNLISLGYQATRPEAMVYLEEGEQGVVEREFLSQCSPERPLQC

SEQ ID NO: 19841 - protein, 81 aa, Rhinolophus ferrumequinum
PQVKVTFEDVAVFLSQEEWDHLCPAQRGLYRHVMMETYGNVVSLGLPGTKPNVISQLERGEEPWVLDGQGTAESRGLGSGH

SEQ ID NO: 19842 - protein, 81 aa, Camelus dromedarius
KDQGSLTLEDVAVDFTWEEWQLLAPAQKALYRDVMLENYSHLVSVGYQASKTDVLSRLGRGELWTVEDEICGQICPGELEI

SEQ ID NO: 19843 - protein, 81 aa, Ursus maritimus
CQGSLSFRDVAVGFTRKEWQQLEPAQRTLYRDVMLENYSHLVSVGCQVTKPAVISRLEQGQEPWMEEEEILRWSFPEEILQ

SEQ ID NO: 19844 - protein, 81 aa, Ursus maritimus
MLENYHNFVSVGYLIKKPALIFKLEEGKEPWILEEEFLYQNYPEDSKAYYLTERMQRNQDKYVPQVLFNNKTVTSEKVYAL

SEQ ID NO: 19845 - protein, 81 aa, Phyllostomus discolor
FQGSLTFQDVAVDFTSEEWQLLDCDQRTLYWDVMLENFRNLISLGAPVTKPKAVFKVEQGPELQVVEAESPHWSHLEADCP

SEQ ID NO: 19846 - protein, 81 aa, Phyllostomus discolor
MAVTFEDVTVIFTWEEWKFLDFSQKKLYREVMYENYTNVMSLGNWKESYKPPKERLRYLEHENLFRWQGWRNVSPQSYENQ

SEQ ID NO: 19847 - protein, 81 aa, Phyllostomus discolor
PQVKVTFEDVAVLLSQEEWDQLGPAQRGLYRHVMMETYGNVVSLGLPGTKPNVISQLERGEEPWVLDGHGAKESKGLGSSG

SEQ ID NO: 19848 - protein, 81 aa, Rhinopithecus roxellana
MASVALGDVAVNFTREEWALLGPCQKNLYKDVMQETIRNLNCVGMKWKDQNIEDQYKYSRKNLRCRMLERFGENKDGSKWG

SEQ ID NO: 19849 - protein, 81 aa, Acinonyx jubatus
LLTFRDVAIEFSQDEWGCLNQSQRELYRDVMLETCGHLLFLAISSHGTQNLLPKPCIETSSQNVSLGTGKHHAFENLHLMI

SEQ ID NO: 19850 - protein, 81 aa, Rhinopithecus roxellana
LKDLVTFKDVAIDFSQEEWQWMNPAQKHLYRSMMLENYQSLVSLGLCISKPYVISLLEQGREPWEMTSEMTRSPFSDWESI

SEQ ID NO: 19851 - protein, 81 aa, Rhinopithecus roxellana
LLKKVTFEDVAIDFTQEDWAMMDTSKRKLYRDVMLENVSHLVSRGYQTSKSYVILQLERGKEPWREGREFLQGQNLDKESA

SEQ ID NO: 19852 - protein, 81 aa, Acinonyx jubatus
SVGLLTFRDVAIEFSQEEWGCLNQSQRELYRDVMLETYGHLLFLGLIVSKPHLVIFLEQKRELWDVKRKKTVASPAAIASH

SEQ ID NO: 19853 - protein, 81 aa, Rhinopithecus roxellana
EDVAVNFSQEEWSLLSEVQRCLYHDVMLENWVLISSLGYWCGSEDEEAPSKQSISIQRVRSLRLSAQAGVSRSQLTAASAS

SEQ ID NO: 19854 - protein, 81 aa, Rhinopithecus roxellana
TCELVMFRDVAIDVSQEEWECLNPAQRNLYKEVMLENYSNLVSLGLSVSKPAIISSLEQGKEPWMVVREETGRWCPGTWKT

SEQ ID NO: 19855 - protein, 81 aa, Bison bison
MYKDVMLENYRNLVSLGHQLPKPDVILRLEKGEEPWLVEREIHQETQPDLETSVEIKSTSSKSISNDKYSCDVKMERMPKS

SEQ ID NO: 19856 - protein, 81 aa, Bison bison
FTFKDVAVEFTQEEWECLDPIQRALYRDVMLETYRNLLSLVKELSSPKEDISKGELCHLMTLEKNETYGIKDFDLKEICEN

SEQ ID NO: 19857 - protein, 81 aa, Odocoileus virginianus
CEGLVSFEDVTMDFSREEWQQLDPAQRHLYQDVMLEIYSHFFSVGYHIPNPEVIFRIEEGKEPWVRETELPCQRYHEGEFG

SEQ ID NO: 19858 - protein, 81 aa, Odocoileus virginianus
TFKEAVTFTDVAVTFTEEELGLLDLAQKKLYQDVMLENFRNLVSVGCYRFRYHIFHLEEEKRLWVVKTATQREGKSEEKIQ

SEQ ID NO: 19859 - protein, 81 aa, Odocoileus virginianus
GEIESISFEDVAVNFTLEEWQLLNPTQKILYRDVMLENYSNLVLLGYQVIKPEMIFKLEQEKPWLLDEEILSQNFSEKVWL

SEQ ID NO: 19860 - protein, 81 aa, Cebus imitator
DAVVFEDLLVEFTLDEWALLNPAQRKLYRDVMLETFQNLASVGTVPSFLPLSGVSEQSGQHGETLNPRVERPRKSGKGSKR

SEQ ID NO: 19861 - protein, 81 aa, Cebus imitator
RVTFKDVAVVFTNEELALLDKTQINLYQDVMLENFRNLISVGDKIENNILNLQEKGLSYLSQEGLHCWQIWKQRIWDLTVS

SEQ ID NO: 19862 - protein, 81 aa, Balaenoptera acutorostrata
SQGLVTFRDVALNFSQEEWEWLDSSQKDLYRDVMLENYRNLVWLGLSISKPNMISLLEQGKDPCMVERETSDGQYAEGDSL

SEQ ID NO: 19863 - protein, 81 aa, Vombatus ursinus
FQGSVTFRDVAVTFSHEEWGHLDPSQKALYCEVMLENYRNMVCLGLAASQPNVMDQLERGEAPWTPEGDGAWSSFADWETR

SEQ ID NO: 19864 - protein, 81 aa, Ovis aries
YQEFVTFEDVAVHLTREEWGCLDPVQRALYREVMLENYGNLVSLGFPIFKPGGISQLEQDLQVFDLETKNREVLRDDCSDG

SEQ ID NO: 19865 - protein, 81 aa, Callorhinus ursinus
YQGPVTFKDVIVEFSREEWQLLSAAQRTLYREVMQENYGLLISVGYRVKKPNAVFKLKQGKEPWILEVEFPHRNYPEDLWK

SEQ ID NO: 19866 - protein, 81 aa, Callorhinus ursinus
MEELGLLDSTQRKLYRDVMLENFRNLLSVGYEPFRLDTTLLLGREEKLWMMETQAPGDGRSGLRNQNEIETFQKVGLRYLL

SEQ ID NO: 19867 - protein, 81 aa, Callorhinus ursinus
SQSLVTFGDVAVDFSQEEWEWLNSAQRNLYRSVMLENYRNLVSLGLCVSKPDMISSLEQRKEPWMVKRKLTRGRCPDLKTV

SEQ ID NO: 19868 - protein, 81 aa, Rhinolophus ferrumequinum
CEVSVSFEDVTVDFSREEWQQLDSNQRRLYQEVTLENYSHLLSVGYEVPKPEFIFKLEQGEEPWILEGETPHQSCLDGKFG

SEQ ID NO: 19869 - protein, 81 aa, Rhinolophus ferrumequinum
MAFRDVAVDFTQEEWMLLSPAQRSLYREVMLENYSNLVSLGIPFSKPKLITQLEQGKETWREERKCLPATCPAEPKQELHF

SEQ ID NO: 19870 - protein, 81 aa, Rhinolophus ferrumequinum
ESVTLRDVTVDFTQEEWQQLEPAQKDLYRDVMLETYRNLVSLDLETKPDVKESDLKEGISESRPSAGVVVEGPTRNGAWRS

SEQ ID NO: 19871 - protein, 81 aa, Callorhinus ursinus
MYFTREEWNKLEWAQKDLYRDVMLENYRNMILLGFQFPKPEVICLLEQWEEPWILDLPRAGTRKASSSACPGSEARCKMKK

SEQ ID NO: 19872 - protein, 81 aa, Ursus maritimus
SQGLLTFGDVAIEFSQEEWRCLSHTQRELYRDVMLENYGHLLFLGLIVSKPDLVSFLEQTKEPWDVKRRKTVVFDPAMISP

SEQ ID NO: 19873 - protein, 81 aa, Rhinopithecus roxellana
EKGPLTFRDVAIEFSLEEWQCLDTAQQDLYRKVMLENYRNLVFLAGIAVSNPDLITCLEQGKEPWNMKRHAMADEPPVIYS

SEQ ID NO: 19874 - protein, 81 aa, Acinonyx jubatus
TQASVSFKDVTVEFTQEEWQQIGPIQRTLYRDVMLENYNNLVSVGNCIFKPAVIFKLEQGEEPWFLEEEFLNQSHQEDYRD

SEQ ID NO: 19875 - protein, 81 aa, Rhinopithecus roxellana
AQGTVTFEDVAVHFSWEEWGLLDEAQRCLYRDVMLENLALLTSLDVHHRKQHLGEKHFRGNVDRALFVKTCTFHVSGEPST

SEQ ID NO: 19876 - protein, 81 aa, Rhinopithecus roxellana
GLVTFGDVAVDFSQEEWEWLNPNQRNLYRKVMLENYRNLASLGKGDCISVWTPDVISSLEQGKEPWTVKRKMTRAGCPDLK

SEQ ID NO: 19877 - protein, 81 aa, Bison bison
HQEVVTFEDVAIYFTRTEWAGLSPAQRALYRSVMLEIYRSLTSLDSRTHMDSELTPTWGISEERDLMMSHGPQKNVLNKSS

SEQ ID NO: 19878 - protein, 81 aa, Odocoileus virginianus
IQASVSFKDVTVEFTREEWHQMDSAQRTLYRDVMLENYSHLVSVGYCFTKPELIFMLEQGEDPWLLEKEFINRSSPEESQP

SEQ ID NO: 19879 - protein, 81 aa, Odocoileus virginianus
MPEKSRNLVLLGLPVSQPGMNFQLEQREGSWMLKRDDLRNACPDWKIISESPPEQDISEESFQDPSVEMPSGEPEHRNSEL

SEQ ID NO: 19880 - protein, 81 aa, Odocoileus virginianus
MTESVTFRDVAVVFSRDEWLHLDAAQRSLYREVMLENYSTLVSLGIPFSMPKLICQLQQGEDPCMVEREIPQDTCLGFKTW

SEQ ID NO: 19881 - protein, 81 aa, Odocoileus virginianus
LQELVTFKDVAVDFTEEEWEHLDPSQRHLYREVMLENFGNLISLAGHLLSEPEMIFHFEQEDDVWMEETISRSSYSVRDEN

SEQ ID NO: 19882 - protein, 81 aa, Odocoileus virginianus
LQEPVTFRDVAVDFTQEEWGQLGPAQRTLYRDVMLETFGHLLSVGPELPKPDVISQLEQGAELWVVEGGLAQGCHPLWETG

SEQ ID NO: 19883 - protein, 81 aa, Odocoileus virginianus
SQEAVTFKDVAVVFTEEELGLLDSAQRKLYQDVMVENFRNLVSVGHVPFKADMVSQLETEGKLWTVERETQRNGHSSEIHS

SEQ ID NO: 19884 - protein, 81 aa, Sapajus apella
TQGSLTFKDVAIEFSQEEWKCLDPLQKALYRDVMLENYRNLGFLAGLCLPDLNIISMLEQGKEPWTVVSQVKITRNPNWGE

SEQ ID NO: 19885 - protein, 81 aa, Sapajus apella
FQGPVTLKDVIVEFTKEEWKLLTPAQRTLYKDVMLENYSHLVSVGYRVNKPNVVFKLKQGKEPWMLEVEYPHRGLPEDLRN

SEQ ID NO: 19886 - protein, 81 aa, Delphinapterus leucas
MAFRDVAVDFTQEEWMLLSPAQRSLYREVMLENYSNLVSLGIPFSKPKLITQLEQGKETWREERKCPPATGPAEPKPELHL

SEQ ID NO: 19887 - protein, 81 aa, Delphinapterus leucas
HQEVVTFEDVAVYFTQTEWAGLSPAQRALYRSVMLEIYGNLTSLGYPVPKPALVSLLERGDLPWGLETQDDPPAQGTKHIC

SEQ ID NO: 19888 - protein, 81 aa, Sapajus apella
AQGSVSFNDVTVDFTQEEWQHLDHAQKTLYMDVMLENYCHLMSVGCHMTKPDVILKLERGEEPWTSFADHTRLEENWKAED

SEQ ID NO: 19889 - protein, 81 aa, Sapajus apella
MLENYRNLAFLGIAVSKPDLITCLEKEKGPWNMKRHEMVDEPPGICPHFAQDLWLQQGMEDSFQKVILRRYEKSGRDNLQL

SEQ ID NO: 19890 - protein, 81 aa, Ovis aries
SQGLVTFKDVAVCFSQDQWSDLDPTQKEFYGEYVLEEDCGIVVSLSFPIPRLDELSHVREEEPLVPEPQEPEEPEILSFTY

SEQ ID NO: 19891 - protein, 81 aa, Callorhinus ursinus
AQESLTFDDVAVDFTWEEWRLLAPAQKDLYRDVMLENYRNLVSVGFHTSKQDVLSKLDQGEPTWTVEDDIPCQSHSETWKL

SEQ ID NO: 19892 - protein, 81 aa, Callorhinus ursinus
PLTFRDVAVVFTEEELRLLDCAQRKLYQDVMLENFRNLLSVGDKNEKEMEYIQERELKCLSSRELSYWKIWEQVTGELTGS

SEQ ID NO: 19893 - protein, 81 aa, Callorhinus ursinus
AQVLVTFKDVAVTFTQEEWGQLDLDQRALYQEVMLETCGLLGSLGHPVPKPELTHLLEHGQELWTGKRGLSRSTCSGDSAK

SEQ ID NO: 19894 - protein, 81 aa, Rhinolophus ferrumequinum
KVPVTFVDIAVYFSEDEWKNLDEWQKELYNNLVKENYKTLMSLDAEGPVPKPDAPPQVEPREEPCVWEQRDPEEREILMDP

SEQ ID NO: 19895 - protein, 81 aa, Phyllostomus discolor
QAKVTFEDVAVLLSPEEWGHLGPAQRGLYRDVMLETYRNLVSLGAGPAGPKPGVITQLEQWDEPWVLDTQGAEGRERLGVD

SEQ ID NO: 19896 - protein, 81 aa, Acinonyx jubatus
EQESVTLKDIAVDFTQEEWALMDTSQRTLYRDVMLENISHLVSVGCHFFRSDVISPWEQRGELWREERGPPQGWSPGMKKS

SEQ ID NO: 19897 - protein, 81 aa, Rhinopithecus roxellana
FSDSMTFEDIVVDFTREEWALLDTSQRKLFQDVMLENISHLVSIGKQLCKSVVLSHLEQVEKLSTQGISLLQGREGDIKHQ

SEQ ID NO: 19898 - protein, 81 aa, Rhinopithecus roxellana
WSQMPVTFEDVALYLSREEWGRLDHMQQNFYRDVLQKRNGLSLGFPFSRPFWAPQAQGKGEASGSSRQTGDEKEEWRGAYT

SEQ ID NO: 19899 - protein, 81 aa, Rhinopithecus roxellana
GQLTFKDVTIEFSQEEWKCLDPAQKTLYRDVMLENYRNLVSLDISCKCVNEDLPPKGKNNMGEAFHMVKLERLESRDEVLS

SEQ ID NO: 19900 - protein, 81 aa, Rhinopithecus roxellana
ESRPGTVSFADVAVYFSPEEWGCLRPAQKVLYRDVMRNTFGHLGALGFSGPKPAFISGVEAWSPEAQDPEGESPAAVSRGQ

SEQ ID NO: 19901 - protein, 81 aa, Rhinopithecus roxellana
SKAPITFGDLAIYFSQEEWEWLSPIQKDLYEDVMLENYRNLVSLGLSFRRPNVITLLEKGKAPWMVEPVRRRRAPVLTKAS

SEQ ID NO: 19902 - protein, 81 aa, Rhinopithecus roxellana
GLEMEALTFRDVAIEFSLEEWQCLDIEQRNLYRHVMLDNYRNLVFLDIAVSKPDLITCLEQEKEPWNVRMHDMVAKPPGLQ

SEQ ID NO: 19903 - protein, 81 aa, Bison bison
MKPAQRNLYRDVMLENYSNLVTVGCQVTKPDVIFKLEQEEEPWVVEEEMLGRHCPEVWKVDEQIKKQQETLVRNVTSISKK

SEQ ID NO: 19904 - protein, 81 aa, Odocoileus virginianus
SQGSLSFRDVTVGFTQEEWQHLDPAQRMLYRDVMLENYSHLISVGYCIPKPEVILKLEQGEEPWILEEEYSRQSVPELINS

SEQ ID NO: 19905 - protein, 81 aa, Odocoileus virginianus
MLENYGHLVSLAGLNISKPDVVSLLEQGKEPWLGNGDVSRELFPASKPNGEIKEFSPKNVIFEDNSSQYLIMERFLSQGSE

SEQ ID NO: 19906 - protein, 81 aa, Odocoileus virginianus
HQAVVTFEDVAVYFTRTEWAGLSPAQRALYRSVMLEICGNLMSLGYPIPKPTLVSLLERGDLLAGLETQDNPPAQGTEEIY

SEQ ID NO: 19907 - protein, 81 aa, Odocoileus virginianus
QGPVTFEDVAVYFSREEWGLLNLTQRSLYCHVMLENFALIGSLGCLCRLQDEDAPRELGESCRVRLPEKPSLCGTSGRAFP

SEQ ID NO: 19908 - protein, 81 aa, Odocoileus virginianus
RPRAVKFGDVALYFSREEWGCLRPAQRALYRDVMQETYGHLGALGCAGPKPALISWLERNTDDWEPAALDPQECPKGVAVQ

SEQ ID NO: 19909 - protein, 81 aa, Cebus imitator
GPLEFMDVAIEFSLEEWQCLDTAQRNLYRDVMLENYRNLVFLEFQKPFFQKLLRIFMCSHFAKELWPEQSTKDSFQKVILR

SEQ ID NO: 19910 - protein, 81 aa, Aotus trivirgatus
AQESVTFKDVSLDFSWEEWIQPDCAQRMTAYGNVMLENYRNLVSLGNNLSKSNVTSQLEREELNLMKKELPEGGFPDWETR

SEQ ID NO: 19911 - protein, 81 aa, Zalophus californianus
MTKPDMIRKLEQGEELWTTEKIFPSQSYLGEDGKTEDVLVKFKEYQDRHSRSVIFINHKRLIKERSNIFGKTVTVGKNRII

SEQ ID NO: 19912 - protein, 81 aa, Balaenoptera acutorostrata
FQESVTFKDVIVDFTQEEWKQLDPVQRDLFRDVTLENYTHLVSIGLQVSKPDVISQLEQGTEPWTVEPSIPVGALGDWETR

SEQ ID NO: 19913 - protein, 81 aa, Ovis aries
MTVDFSREEWQDLDSAQRCLYQDVTLETYSHLCTVGNQVPKPAVIFKLEQGEGPWTLEEETPHHSCSDYIMRNAGLEETQA

SEQ ID NO: 19914 - protein, 81 aa, Ovis aries
MLENYGNLVSVAGCQLSKPSVISQLEKGEEPWMTEKEGPGDPSSDLESKTETSASNAKYNILQKQLYHGMMMERLMRDDVI

SEQ ID NO: 19915 - protein, 81 aa, Rhinolophus ferrumequinum
SEDLVTFRDVAVDFSQEEWEQLNSAQRGLYRDVMLENYRSLVSLGVSVSKPDVISLLEQGKEPWVVKEGTRGTYSDWKYAF

SEQ ID NO: 19916 - protein, 81 aa, Rhinolophus ferrumequinum
DEALMAFRDVAVAFTRKEWKLLSPAQRILYRDVMLENYSHLVSLGIAFSKPKLITQLEQGDEPWREESECLLDLCVAEPRK

SEQ ID NO: 19917 - protein, 81 aa, Ursus maritimus
SKGSMMFRDVSINFSQEEWECLDSGQMNLYKEVMLENFSNLVSVGLSNSKPAVISLLEEGKEPWMVERELTRGLCSDLESM

SEQ ID NO: 19918 - protein, 81 aa, Phyllostomus discolor
GSVAFRDVIVDFSQEEWQQLKPEQKDLYRDVMMEVYWNLISLGLETEQNMNEPDPEKESWEDRPSIAMVVGGLMKNGARGY

SEQ ID NO: 19919 - protein, 81 aa, Acinonyx jubatus
MLENYSHLVSVGSCATKPEVIFRLEQGEEPWISEEEFPSQSLPEVWETDHKKGRRQENQHKPVREVAFISKKTLTKERGNV

SEQ ID NO: 19920 - protein, 81 aa, Acinonyx jubatus
LPHSVTFEDVAVEFTPEEWALLDPCQRTLYRDVMQENRRNLASLGCHVDKRSLTSQLEQEDKVMTQEQGILPGTCPGLETV

SEQ ID NO: 19921 - protein, 81 aa, Acinonyx jubatus
MLENYRNLASLGLCVSKPDMISSLEQRKEPWMVKRRLTRGRGPDLEAGPETKELPAKKDICKEKLSQVVIMERLTNHSLEC

SEQ ID NO: 19922 - protein, 81 aa, Acinonyx jubatus
PKVPVTFDDVAVYFSEPEWGKLDEWQKELYKHVMRGNYETLVSLDYAISKPDILTQMERGEEPCPESLWGHEEGSKREAAH

SEQ ID NO: 19923 - protein, 81 aa, Rhinopithecus roxellana
DTVTFEDVAVNFSQEEWSLLSEVQRCLYRDVMLENLALISSLDCWCGSKDKGAPSKQSISVQRESQNTTPRAAVSPKKAHP

SEQ ID NO: 19924 - protein, 81 aa, Rhinopithecus roxellana
YQDSVTFDDVAVDFTQEEWTLLDPSQRDLYRDVMLENYENLASVGRDLFKPSVICWLEEEEELRAGQRRVLQEWRLKTKGP

SEQ ID NO: 19925 - protein, 81 aa, Rhinopithecus roxellana
FQDSVAFEDVAVSFTQEEWALLDPSQKNLYRDVMQETFRNLTSVGKTWKVQNMEDKYKNPRRNLSLMREKLFESKESHHCG

SEQ ID NO: 19926 - protein, 81 aa, Rhinopithecus roxellana
TFKEAVTFKDVAVVFTEDELGLLDSAQRKLYRDVMLENFRNLLSVGNQPFHQDTFHFLRKEKLWMMKTTSQREGNSGGKIQ

SEQ ID NO: 19927 - protein, 81 aa, Rhinopithecus roxellana
AVTFKDVAVVFSREELRLLNLTQRKLYRDVMVENFKNLVAVGSQHQNKMETLQKFALKYLSNQELSCWQIWKQVARELTRC

SEQ ID NO: 19928 - protein, 81 aa, Acinonyx jubatus
SQGSLSFRDVAVGFTRKEWQHLDPTQRTLYRDVMLENYSHLVSVGCQVTKPAVISRLERGQEPWMEEEELVRWSFPEAILQ

SEQ ID NO: 19929 - protein, 81 aa, Bison bison
MALSQEEWECLASSQRALYRDVMLETYRNLVSLGDDNFSPEDYLIGILSAGFAINKLSPRENINLVELYGNENHGIKDFDL

SEQ ID NO: 19930 - protein, 81 aa, Bison bison
QAQETLTFDDVAVDFTWEEWQLLAPAQKALYRDVMLENYSNLVSAGEDGSTPEVVSKLDQGEPWMMDDETHCQTRSEVWKV

SEQ ID NO: 19931 - protein, 81 aa, Bison bison
PQGSVTFEDVAVYFSWEEWALLDEAQRCLYHDVMLENFALTSSLGYWHGVEDKEAPSEQSVCIGVSQIRTLKVDSSPHKGQ

SEQ ID NO: 19932 - protein, 81 aa, Bison bison
MKGKRDVTVDFTQEEWEQLDPSQRILYMDVMLENYSNLLSVEVWKADDQMETDPRNPDEQARPFVIFKDQTPTEERDNNLF

SEQ ID NO: 19933 - protein, 81 aa, Odocoileus virginianus
SVTFEDVVVYFSWEEWGLLDENQRCLYHDVMLENFALVTSLGCWYGMEEAVAFSVESVPVEQTSRGKTVIPDPSIEKTQPC

SEQ ID NO: 19934 - protein, 81 aa, Odocoileus virginianus
ELVTFRDVVISFSQEEWEYLDSAQRDLYWDVMMENYSNLVSLDLESKYDTKTLSVEKDILEKNNSQWEVIENSKLVGLQNS

SEQ ID NO: 19935 - protein, 81 aa, Odocoileus virginianus
KERRQSFKDVAVTFTKEALGLLDLAQRKLYHEVMLENFWNLVSMGYQPFTLDIILQLGREEQLWVMEPETRGDECSGHRNQ

SEQ ID NO: 19936 - protein, 81 aa, Odocoileus virginianus
KDQGSLTLEDVAVDFTWEEWQLLAPAQKALYRDVMLENYGNLVSVGYQASKPAALSRLERGELWPVEDEVHSRLCPDLCWE

SEQ ID NO: 19937 - protein, 81 aa, Sapajus apella
SQEPVTFADVAVVFTPEEWVFLDSTQRSLYRDVMLENYRNLASVAGDQLRKPNASSDLEQRGEQWNTERGVISDTCPEPQL

SEQ ID NO: 19938 - protein, 81 aa, Callithrix jacchus
AQDRVVFEDVAIYFSQEEWGHLDEAQRLLYRDVMLENLALLSSLGCCHGAEDEEAPFQQGVSSGVLQAMAPKPRLSTQKSQ

SEQ ID NO: 19939 - protein, 81 aa, Balaenoptera acutorostrata
SLGPVSFKDVAVDFTQDEWQQLDPEQKTTYRDVMLENYSHLVSLGCHIIKPEVITKLEKGEEPWIVGGEFLLQSYPEEDWE

SEQ ID NO: 19940 - protein, 81 aa, Balaenoptera acutorostrata
WSQMPVTFEDVAVYLSREEWGRLDHTQQSFYRDVLQKRNGLSLGFPFSRPFWASQVQGKGEASGSCQQMGDEEEEKRGAVE

SEQ ID NO: 19941 - protein, 81 aa, Balaenoptera acutorostrata
PQVLVSFEEVAVLLSQEEWGRLSPAQKGLYRDVMMETYGNLVSLGLQGSKPDVISKLEQGKEPWAPHSPRIEGSWIWRRRR

SEQ ID NO: 19942 - protein, 81 aa, Balaenoptera acutorostrata
SVTFRDVTVDFTQEEWQQLEPAQKDLYRDVMLENLQNLVSLDLEMRPEMKEPDLKEEISEDRPSGAWGSAVDGARTQGGRV

SEQ ID NO: 19943 - protein, 81 aa, Vulpes vulpes
WAGSVTFRDVAIDFSQEEWEFLDSAQRDLYRDVMWENYSNFISLAEPSISKPDVITLLDEGKEPWMVVREETKRHCSDLDS

SEQ ID NO: 19944 - protein, 81 aa, Vulpes vulpes
ELVTFRDVVINFSQEEWEYLDSAQRDLYWDVMMENYSNLVSLDLESKYDTKCLSTGKDVENNGSQGKVTENKFIGLESCIF

SEQ ID NO: 19945 - protein, 81 aa, Callorhinus ursinus
FQETVTFKDVAVVFSEEELGLLDSTQKKLYRDVMLENFRNLVSVGHSSSKPDMISQLEREEKLCIKEIHTERGGRNQNEVE

SEQ ID NO: 19946 - protein, 81 aa, Callorhinus ursinus
RQGSLSFGDVAVDFSQEEWQHLDPAQRTLYKDVMLENYHNFVSVGYLIKKPSVILKLEEGKEPWILEEESLYQNYPEDSKA

SEQ ID NO: 19947 - protein, 81 aa, Vulpes vulpes
MLETYSNLVSVGYEGTKPYVILKLEQEEAPWICEAACSGCHCQENICQVNVQRKRQDMILKQGAFISKKTLPKERSHENSK

SEQ ID NO: 19948 - protein, 81 aa, Rhinolophus ferrumequinum
PLESVMFEDVAIDFTQEEWALLDTFQRKLFRDVMLETISHLVSLGYQHCKSDVIFQLEQGEELWREETGFLQSQSPGRQST

SEQ ID NO: 19949 - protein, 81 aa, Rhinolophus ferrumequinum
GPVTMTFDDVALYFSKQEWEILENWQKEMYQQVMKTNYEILNSLGCISSKPDLITWMEQERMLLIGDQGRFEKIRMTLSHC

SEQ ID NO: 19950 - protein, 81 aa, Rhinolophus ferrumequinum
YWGLLSFKDISMEFTWEEWQLLNSAQKYLYRDVILENYSNLVSVGYHGNKPDLIFKLEQGEEPWTVNAKVSHQSCAESWKE

SEQ ID NO: 19951 - protein, 81 aa, Rhinolophus ferrumequinum
SHTLVTFTDVLVSFTREEWQLLEPAQQGLYKDVTLENYENLVSLGHQCAKPDVILQLEKGDEPWLVDRGSPQNAHPDWDTA

SEQ ID NO: 19952 - protein, 81 aa, Rhinolophus ferrumequinum
MTEEFKTVKDVAMDFTLEDWAPLGLDPGNMFWDTALDNYQDLFLLNSPRSNLTSYPDGGEELEALVRGSPEVAGPDMDQAK

SEQ ID NO: 19953 - protein, 81 aa, Ursus maritimus
YQGPVTFKDVIVEFSREEWQLLNAAQRTLYREVMQENYGLLISVGYRVNKPNAVFKLKQGKEPWILEVEFPHRNYPEDLWK

SEQ ID NO: 19954 - protein, 81 aa, Acinonyx jubatus
EGTVTFEDVAVYFSREEWGLLEEAQRRLYQDVMLENLALVTSLGCQHGAENEEAPSEQSVSVEGVSHVRTPKAGLSPQKAS

SEQ ID NO: 19955 - protein, 81 aa, Rhinopithecus roxellana
PQGSLTFRDVAIEFSQEEWKCLDPIQKALYRDVMLENYRNLGFLGLCLPDLNIISMLEEGKEPWTVVSQVKIARNPNWGEC

SEQ ID NO: 19956 - protein, 81 aa, Acinonyx jubatus
AHRSVTFRDVAIYFSQQEWEYLDSVQKNLYRDVMMENYDNLVSLEHSISKPDVITLLEQRKEPWMVVGEDTKRWCTDLESK

SEQ ID NO: 19957 - protein, 81 aa, Acinonyx jubatus
MLGSVSFEDVVVEFTQDEWQYMSPAQRTLYRDVMLENYSHLISVGYCLTKPKMIFRLEQEEEPWSLEEEFLNQRYPGYFSI

SEQ ID NO: 19958 - protein, 81 aa, Acinonyx jubatus
SVVFEDVVVDFTQEEWALLKPAQKKLYKDVMLETFRNLVTVDDENQLRTNGSTSQQVIFGEKLSNEQKIARFTKNDSWTSL

SEQ ID NO: 19959 - protein, 81 aa, Rhinopithecus roxellana
KSLVTFEDVAVYFSQEEWELLDAAQRHLYHSVMLENLELVTSLGCWHAVEGEEAHPKQNISVEEVLPVRIPSADSSTKKAN

SEQ ID NO: 19960 - protein, 81 aa, Acinonyx jubatus
RPRAVKFADVAVYFSTEEWGCLRPAQRALYRDVMQETYGHLGALETRTRKKNGDKEVFPPKEAPRKGKRGRRPSKPRLIPR

SEQ ID NO: 19961 - protein, 81 aa, Bison bison
TQLTVEDVDIKFTPEEWECLDPAQRALYRDVMVETYKNLLSVDVSRIDMTMKLQAKGNSGKGEIFQRVIFGRAETSEIKDF

SEQ ID NO: 19962 - protein, 81 aa, Bison bison
PAPVILKDVVVTFTRQEWKLLDLTQRTLYQEVVLETSRLLVSLVFCVGITNRPHLYIGFPSDDKAKTKTTETAASQQALFK

SEQ ID NO: 19963 - protein, 81 aa, Bison bison
MASPSPPPQPKEEWDYLDPAQRSLYKDVMMENYGNLVSLDVLNRDKDEEPTVKQEIEEIEEEMEPQGIILTRIKSEIDQDP

SEQ ID NO: 19964 - protein, 81 aa, Bison bison
MEAVTFKDVAVAFTEEELGLLDSAQRKLYQDVMVENFRNLVSVEENNQSELSAVQERGLHEELSCWQIWQQIANDLTRCQD

SEQ ID NO: 19965 - protein, 81 aa, Odocoileus virginianus
WSQMPVTFDDVALYLSREEWGRLDHTQQSYREVLQKRSGLSLAGFPFSRPFWASQVQGKGEAPGSSRQLGHEEEEKRGAVE

SEQ ID NO: 19966 - protein, 81 aa, Odocoileus virginianus
MSKPDVITLLDEGKEPWMVVREGTGRHHPDLESRYSANILSPEKDIYEIYSFQWEIMERIKSYSLQDSIFRSDWECKSKIE

SEQ ID NO: 19967 - protein, 81 aa, Delphinapterus leucas
SLDSVSFTDIAIDFSQDEWEWLNLAQRTLYKKVMLENYRNLASLGLCISKPDVISLLEQDKEPWMMKGEITRGLPPDLKYV

SEQ ID NO: 19968 - protein, 81 aa, Carlito syrichta
SFEGSVSFRDVAIDFSREEWQHLDPSQRNLYQDVMLETYNHLLSVGYQVPEPEVFMLEQGKEPWTLQRESPHQSCPGEKLW

SEQ ID NO: 19969 - protein, 81 aa, Saimiri boliviensis
METLTFRDVAIEFSLEEWQCLNPAQQNLYRNVMLENYRNLVFLAGIAVSKQNPVTCLEQGKEPWNMKRDEIIAKPTAMCSY

SEQ ID NO: 19970 - protein, 81 aa, Saimiri boliviensis
FQEMVTFKDVAVVFTEEELGLLDSVQRKLYRDVMLENFRNLVLVAHQPFKPDLISQLEREEKLLMAETETPRDGCSGRKNQ

SEQ ID NO: 19971 - protein, 81 aa, Ovis aries
MLENYGNVASLGFPLLKPAVISQLEGGGELEGPSSLASGAGTGPQGLWTDIDIQTDNNLTEEMYEEKYNISHELQRNSFQE

SEQ ID NO: 19972 - protein, 81 aa, Vulpes vulpes
LQEALSFEDLFVDFTQKEWQLLDGRQKDLYKDVMLENYSSLVSLGYEVVKPDVIFRLEQGEEPWIGAGELSSLDCPEQVLQ

SEQ ID NO: 19973 - protein, 81 aa, Camelus dromedarius
QGSVTFEDVVVYFSWEEWGLLDETQRCLYHDVMLENFALVTSLGCWYGMEDEEAFSVQKVSVEQISPGKSLHPDPSIQKTQ

SEQ ID NO: 19974 - protein, 81 aa, Rhinopithecus roxellana
SQASVSFQDVTVEFTQEEWQHLGPVERTLYRDVMLENYSHLISVGYCITKPKVISKLEQGEEPWSLEDEFLNQRYQGYFKV

SEQ ID NO: 19975 - protein, 81 aa, Rhinopithecus roxellana
VTFEDVAVYFIRKEWKRLEPAQRDLYRDVMLENYGNVFSLAWIHISLTMQKVMLAWFTGTLSVGKGLCSSELASVEPPDTF

SEQ ID NO: 19976 - protein, 81 aa, Rhinopithecus roxellana
VHGSVTFRDVAIDFSQEEWECLQPEQRTLYRDVMLENYSHLISLGSSISKPDVITLLEQEKEPWMVVRKETSRWYPDLESK

SEQ ID NO: 19977 - protein, 81 aa, Rhinopithecus roxellana
AQVSVTFDDVAVTFTQEEWGQLDLAQRTLYQEVMLENCGLLVSLGCPIPRPELIYHLQHGQEPWTRKEDPSQDTCSGDKGK

SEQ ID NO: 19978 - protein, 81 aa, Rhinopithecus roxellana
MTEEFVTLKDVGMDFTLEDWEQLGLEQGDMFWDTALDNCQDLFLLDPPRPNLTSHPDGGEDLEPLPGGSPEAAGPDVTETK

SEQ ID NO: 19979 - protein, 81 aa, Rhinopithecus roxellana
GLLTFRDVAIEFSQEEWKCLDPAQRTLYRDVMLENYRNLVSLGIFSKYEIKELPTKKESNTGEIFQTVTLERHESHDIEDF

SEQ ID NO: 19980 - protein, 81 aa, Rhinopithecus roxellana
RREQVTFEDVVVDFSQEEWGQLKPAQRTLYRDVMLDTFRLLVSVGHWLPKPNVVSLLEQEAEPRAVDSGVPPGVYPEIKGH

SEQ ID NO: 19981 - protein, 81 aa, Bison bison
AVGLLSFRDVTAGFTQEEWQHLDPAQRMLYRDVMLENYSHRISVGYCIPKPEVILKLEQGAEPWILEEESPSEDHLELINN

SEQ ID NO: 19982 - protein, 81 aa, Odocoileus virginianus
HTLVTFKDVLVNFTREEWKLLDTAQQIMYKDVMLENYRNLVSLAILVWIMLPMADFTWGRAARTPASDPSALVGTMASQAQ

SEQ ID NO: 19983 - protein, 81 aa, Sapajus apella
AHALVTFRDVAIDFSQKEWECLDPTQRKLYRDVMLENYGNLVSLAGYSGSKPDVITLLEQGKEPCVAVRDMAGRQYPGLLS

SEQ ID NO: 19984 - protein, 81 aa, Balaenoptera acutorostrata
GWVPALFDEVAIYFSDEEWEVLTEQQKALYREVMRMNYETVLSLEFPFPKPDMITRLEREEESQNSDEWQFQGGTFAENEE

SEQ ID NO: 19985 - protein, 81 aa, Balaenoptera acutorostrata
SLGLVSFEDVAVNFTWEEWQDLDDAQRTLYRDVMLETYSSLVSLGHCITKPEVIIKLEQGAAPWTVKETPDQGFPDVQIVD

SEQ ID NO: 19986 - protein, 81 aa, Balaenoptera acutorostrata
PEGGVTFEDIALYFSWEEWKLLDEAQRRLYHDVMLENFALVSSLGFWSGEENVEASFEQSVSVVMSQVRTSKETSSSQKTH

SEQ ID NO: 19987 - protein, 81 aa, Balaenoptera acutorostrata
FRGPVTFKDVTVEFTQEEWQLLDAAQRTLYREVMQENYRHLISVGYCVNKPNAVFKLKQGKEPWILEVEFPRRNYPEDLWN

SEQ ID NO: 19988 - protein, 81 aa, Saimiri boliviensis
MRGNHEMLVSLDYAISKPEVLSQIEQGKEPCSWRRPGPKIPDVPVDPSPGSGPPVPAPDLLMQIKQEGELQLQEQQALGVE

SEQ ID NO: 19989 - protein, 81 aa, Saimiri boliviensis
QGRLTFSDVAVEFSLAEWKCLTPEQRALYREVMSENYRNLKSVANCSLNCSSFLRKQIKHLGKKQYVCDVCGKVFNDRRCL

SEQ ID NO: 19990 - protein, 81 aa, Ursus maritimus
MPLAGCPVPRPELIYQLEHGRELWTVKRDLSQSAYPGDKGKPKTTELSTCAPALSEGALFQELRQGDPGNFQLVQTTDQSG

SEQ ID NO: 19991 - protein, 81 aa, Acinonyx jubatus
AQVLVTFKDVAVTFTQEEWGQLELDQRALYQEVMLETCGLLVSLGHAVPEAELTHLLEHGRELWTGKGGLLWSTCPGDSTR

SEQ ID NO: 19992 - protein, 81 aa, Acinonyx jubatus
MLENYGNLLSVAGYQLSKPSVISQLEKGQEPWMTEKEGPGDPSSDLKNKTETSTSASKNEILQEHLYHGIMMEGFLRDDVI

SEQ ID NO: 19993 - protein, 81 aa, Rhinopithecus roxellana
IMEEAVTFKDVAVVFTEEELGLLDSAQRKLYRDVMLENFRNLLSAGHQPFHQDTFHFLREEKFWMMETVTQREGNSGGKIQ

SEQ ID NO: 19994 - protein, 81 aa, Rhinopithecus roxellana
GPLVMAEPDPTQGRVVFEDVAIYFSQEEWGHLDEAQRLLYRDVMLENLALLSSLGNALTLAQCPGLGCVTFYPKVVLRFPQ

SEQ ID NO: 19995 - protein, 81 aa, Acinonyx jubatus
SLTFQDVAVDFTREEWDQLYPAQKNLYRDVMLENYRNLVALGGENRPDIRKSIPNQNISDENQNHDMIMERLTGDSFWYSI

SEQ ID NO: 19996 - protein, 81 aa, Acinonyx jubatus
SQDLVTFKDVAIDFSQEEWEWLNPAQRSLYKNMMLENYRNLVSLGLCLSKPYVISSLEQGGEPWEIKNEMTESPDLESMYE

SEQ ID NO: 19997 - protein, 81 aa, Rhinopithecus roxellana
ACESITFRDVAIDFSHQEWEYLNLVQKTLYQEVMMENYDNLVSLAGHSISKPDLITLLEQGKEPWMIVREETGGECTDLDS

SEQ ID NO: 19998 - protein, 81 aa, Rhinopithecus roxellana
RRGHLTFRDVAIEFSQEEWKCLDPAQRTLYREVMLENYRNLVFLGICLPDLSIISMLEQRRDPRNLQSEVKIANNPDGREC

SEQ ID NO: 19999 - protein, 81 aa, Rhinopithecus roxellana
MLENYRSLVSLGVSVSKPDVISLLEQGKEPWMVKKEGTRGTCPDWEYVFKNSEFSSKQETYEESSTVVTVGTRHLSYSLDY

SEQ ID NO: 20000 - protein, 81 aa, Rhinopithecus roxellana
MDSVVFEDVAVDFTLEEWALLDSAQRNLYREVMLETFRNLASVDNKTQFKANGSVSQQDMYGEEKSKERTVPNFTRKNSCA

SEQ ID NO: 20001 - protein, 81 aa, Bison bison
LAVRFADVAVYFSPEEWGYLRPAQRALYRDVMQETYGHLGALGATPNKKEEEPEAGLGTKSPRKAPGKERPEELVKHNPGT

SEQ ID NO: 20002 - protein, 81 aa, Bison bison
QGPVTFEDVAVYFSLEEWGLLNLTQKSLYRDVMLENFGLIGSLGCLRRLQDEDALLELGESCRVLLSEKPSLCGTSGQVFP

SEQ ID NO: 20003 - protein, 81 aa, Odocoileus virginianus
AQLTFKDVFIDFTPEEWECLDPAQRTLYKDVMVETLRNLLSVDMSHIDQIKKLQAKGNSGKGEIFQRVMFGRAESLDIKDF

SEQ ID NO: 20004 - protein, 81 aa, Odocoileus virginianus
SQGRLTFQDVAIDFTQEEWECLDLGQRELYRDVMLENYGNLASLGLVVSKPDLVTFLEQMKNPWDVRRMDTTATYPAISLQ

SEQ ID NO: 20005 - protein, 81 aa, Odobenus rosmarus
PKVPVTFDDVAVHFSEQEWGNLSEWQKELYKNVMRGNYESLVSMDYAISKPDLMSQMERGERPSMQEQEDSEEGETPADPS

SEQ ID NO: 20006 - protein, 81 aa, Phascolarctos cinereus
MLENYRNLVSLGLPISKPDVIFQLEQGKEPWLLGLPRAEERELPNNSSLDWKSHETQKSTPKQKITEEVESSGTLTVDSAR

SEQ ID NO: 20007 - protein, 81 aa, Bos indicus
VRESVTFKDVAVLFTQDEWAQLSPAQRALYRDVMLENYSNLVSLGLLGPKPDMFSQLGKGEEWMPEDSLGGFCLDWVITPM

SEQ ID NO: 20008 - protein, 81 aa, Pongo abelii
AQVSVTFDDVAVTFTKEEWGQLDLAQRTLYQEVMLENCGLLVSLGCPVPRPELIYHLEHEQEPWTRKEDLSQGTCPGDKGK

SEQ ID NO: 20009 - protein, 81 aa, Phascolarctos cinereus
SQKSLTFQDVAVDFTQEEWGLLEPSQKDLFRDVMLENYENFVSLGLTESKAAVISQLERRQSLELPDGKVPGSIFVDFLHE

SEQ ID NO: 20010 - protein, 81 aa, Physeter macrocephalus
MFQVTFSDVAIDFSHEEWGWLDPAQRNLYKDVMVQNYENLVSLAGLSIPKPYVIALLEDGKEPWMVEKKLSKSLFPDWKSR

SEQ ID NO: 20011 - protein, 81 aa, Physeter macrocephalus
MDLTQRKLHKDVMLENYRNLVSLGLAVSKPDMISHLEDEKGPWVVVRETSKTPYSELETKPTTKNAIPTENISEECLSQET

SEQ ID NO: 20012 - protein, 81 aa, Trichechus manatus
SSEQVSFKDVCVDFTQEEWYLLDPAQKILYRDVILENYSHIVSVGYCVTKPEVIFKIEQGEEPWILEEGFSSLRHPEDWKV

SEQ ID NO: 20013 - protein, 81 aa, unidentified
  REGION 1..81: note = Bos indicus x Bos taurus
PQGSVTFPDVAVYFSWEEWRLLDEAQRRLYLDVMLENYALISSLGFWSGEEKVETSFEQSVSVAVSQARTSKEPSSSQKTH

SEQ ID NO: 20014 - protein, 81 aa, unidentified
  REGION 1..81: note = Bos indicus x Bos taurus
MGLLDLAQRKLYQEVMLENFRNLLSVGHQSFTPDVPSQLEREEKLQMIRTAAQSCCSSGNQNLNGIETLQEVGLRYLPHEE

SEQ ID NO: 20015 - protein, 81 aa, Macaca mulatta
GRVTFRDVAIEFSLAEWKCLNPAQRALYREVMLENYRNLESVDISSKCIMKEFSSTGQCNTEVIHTGTLQRHESHHIRDFC

SEQ ID NO: 20016 - protein, 81 aa, Pan troglodytes
PKVPVTFDDVAVYFSELEWGKLEDWQKELYKHVMRGNYEMLVSLDYAISKPDILTRIERGEEPCLDRWGQEKGNEVEVGRP

SEQ ID NO: 20017 - protein, 81 aa, Macaca mulatta
MLENYRNLVLAGIDVSKPNLITCLEQGKYPWNMKRHSMVVKPPVICSHFAEDLCPGPGIKDSFQKVILREYVKCGHKDLQL

SEQ ID NO: 20018 - protein, 81 aa, Sapajus apella
SKDLVTFGDVAVNFSQEEWEWLNPAQRNLYRKVMLENYRTLVSLGVSVSKPDVISLLEQGKEPWMVKKEGTRGACPDWEYV

SEQ ID NO: 20019 - protein, 81 aa, Macaca mulatta
VHGSVTFRDVAIDFSQEEWECLQPDQRNLYRDVMLENYSHLISLGSSISKPDVITLLEQEKEPWIVVRKETSRWYPDLESK

SEQ ID NO: 20020 - protein, 81 aa, Vulpes vulpes
TFKEAVTFKDVAVVFTEEELGLLDPAQRKLYRDVMLENFGNLVSVGHQPFKRDMIHLVREEKFWMVKLATQRKGNSGDKVQ

SEQ ID NO: 20021 - protein, 81 aa, Ursus maritimus
SQGSISFEDVTVNFTQEEWGQLDPDQRTLYRDVMLENYSIFISLEELKVDGMIESKENQDRHLWQDAFVNNKKVITEKENV

SEQ ID NO: 20022 - protein, 81 aa, Phyllostomus discolor
MAASQESLTFKDVSVDFSLEEWECLDPAQRKLYSDVMLENYSNLVSLGLVVSKPGLVTFLEQMQEVWDVSRKKSISTPPGR

SEQ ID NO: 20023 - protein, 81 aa, Rhinopithecus roxellana
PQVSLTFEDVAVLFTRDEWRKLAPSQRNLYRDVMLENYRNLVSLGFPSTKPKVISLLQQGEDPWKVEKDSSGDSSLGCKSM

SEQ ID NO: 20024 - protein, 81 aa, Acinonyx jubatus
CEVSVSFEDVTMDFSREEWEQLGPAQRCLYWDVMLEICSHLLSLGYPIPRPEMIFRMEKEEEPWIREAQLPHQWRPKGEFG

SEQ ID NO: 20025 - protein, 81 aa, Leptonychotes weddellii
AQSSVSFKDVTVDFTREEWQHLDPAQKTLYMDVMLENYCHLISVGCHMTKPDVILKLERGEEPWTSFTGHACLEENWKEED

SEQ ID NO: 20026 - protein, 81 aa, Physeter macrocephalus
IVGPVSFEDVAIDFTQEEWQQLDPAQRTLYRDVMLENYSHLVSVGYPVSKPGVISKLEQGEEPWIMKRDISYWIYPDRETR

SEQ ID NO: 20027 - protein, 81 aa, Trichechus manatus
MLENYSNLVSVGYQVSKPDALSRLERGEPPWSIEDKIHTRTFSGERPYICSECGKCFIRKLSLFVHHRTHRQLSYACIDCG

SEQ ID NO: 20028 - protein, 81 aa, unidentified
  REGION 1..81: note = Bos indicus x Bos taurus
CSELLSFTDISMEFSWEEWQLLDSVQKHLYRDVTLENYSNLVSVGHQLPKPDVILRLEKGEEPWLVEREIHQETQPDLETS

SEQ ID NO: 20029 - protein, 81 aa, Trichechus manatus
EAQESLTFSDVAVKFTWEEWQLLDPAQKDLYRDVMLENCRNLVSVGCQVNKPDALSRLKREQPWTVLDENHSGIFSEIMNI

SEQ ID NO: 20030 - protein, 81 aa, Trichechus manatus
MFSDVSIDFSQEEWECLNEDQRDLYRDVMLENYSNLVSMAGCSFSKPDVISFLEQGKEPWLVDRELTRGQWPDLESRCETK

SEQ ID NO: 20031 - protein, 81 aa, Trichechus manatus
LTFSDVAVKFTWEEWQLLDSAQKDLYQDVMLENYKNLVSLEIWKVDDHLLGPWQNESRMDGMEQCDEHNILENIVHQHKSL

SEQ ID NO: 20032 - protein, 81 aa, Sapajus apella
SQAPVTFEDMAMYLTREEWRPLDPAQRDLYRDVMQENYGNVVSLDFEIRSESEVNPKQEISEDVQFGTTSERPVENAEENP

SEQ ID NO: 20033 - protein, 81 aa, Pan troglodytes
SQASVSFQDVTVEFTREEWQHLGPVERTLYRDVMLENYSHLVSVGYCITKPKVISKLEKGEEPWSLEDEFLNQRYPGYFKV

SEQ ID NO: 20034 - protein, 81 aa, Papio anubis
MELLTFRDVAIEFSPEEWKCLDPSQQNLYKDVMLENYRNLVSLGFVISNPDLVTCLEQIKEPYNLKIHETAAKPPAMCSPF

SEQ ID NO: 20035 - protein, 81 aa, Sapajus apella
PKVPVSFEDVSVYFTKTEWKLLDLRQRVLYKRVMLENYSHLVSLGFSFSKPHLISQLERGEGPWVADIPRTWATKGLLIGD

SEQ ID NO: 20036 - protein, 81 aa, Balaenoptera acutorostrata
ELVTFRDVVISFSEEEWEYLDSAQRDLYWDVMMENYSNLVSLDLESKYDKKTLSTEKDIIEKNDSQWEVIESSKLVGLENS

SEQ ID NO: 20037 - protein, 81 aa, Rhinolophus ferrumequinum
AQGLVTFRDVAIEFSQEEWKCLEPAQRDLYRDVTLENFGNLVSLGLSVSKPDVISLLEQRKEPWMIANDITGLWCPDLESS

SEQ ID NO: 20038 - protein, 81 aa, Rhinolophus ferrumequinum
SLDSVTFTDVAIDFSQDEWQWLNLAQRTLYKKVMLENYRNLVSVGLCIFKPDVISLLEQDKEPWVTNEEMKGVLCPDMEYV

SEQ ID NO: 20039 - protein, 81 aa, Ursus maritimus
CEGSLSFEDVTMDFSREEWQQLDPAQRRLYQDVMGEVYSHLLSLGYHIPNPEIISRMEKGEKLWLREAQLPHQRQGEGVFG

SEQ ID NO: 20040 - protein, 81 aa, Phyllostomus discolor
MLENYGHLVALAGLNMSKPDVVSLLEQGKEPWLGKDVRTDFFSVSGSNGVIREFSPNNVIYENDSSQHLIKERILNYSPEH

SEQ ID NO: 20041 - protein, 81 aa, Colobus angolensis
MESVTLEDVAVEFIQEWALLDSARRSLCRYGMLDQCRTLTSRETPPCKPSRVSQLRPRAEPRATEQGILHATGVAWESQLK

SEQ ID NO: 20042 - protein, 81 aa, Phyllostomus discolor
FQGPVTFKDVIVEFTQEEWQLLDTAQRTLYREVMQENYGHLVSVGYCVNKPNALFKLKQGKEPWILEVEFPHQNYPDLWNI

SEQ ID NO: 20043 - protein, 81 aa, Acinonyx jubatus
SQGLLTFEDVAIEFSQEELIYLNYSQRELYRDVMLENYGHLLFLGLVVSKPDLVNFLEHKKGVWAVERKETVAIHPAVFSP

SEQ ID NO: 20044 - protein, 81 aa, Panthera pardus
AHGSVTFRDVAIDFSQEEWEFLDSAQRDLYRDVMWENYSNFISLAEPSISKPDVITLLDEGKEPWMVIREGTRRHYPDLES

SEQ ID NO: 20045 - protein, 81 aa, Panthera pardus
LPHSVTFEDVAVEFTQEEWALLDPSQRTLYRDVMQENCRNLASLGNQVGKPGVVSRLEQKGKVVTEETGILPGSFPDLETL

SEQ ID NO: 20046 - protein, 81 aa, Panthera pardus
SQGSLSFRDVAVGFTCKEWQHLDPAQRTLYRDVMLENYSHLVSVGCQVTKPAVISRLERGQEPWMEEEELVRWSFPEAILQ

SEQ ID NO: 20047 - protein, 81 aa, Panthera pardus
SQESVTFEDVAVDFTQDEWTLLDWSQRKLFRDVMLENISHLVSVGKQLYKSDTIFHLEQGEQLSTEGIGLLQCQSLDREDD

SEQ ID NO: 20048 - protein, 81 aa, Panthera pardus
AQESLTLEDVAVDFSREEWRLLAPAQKDLYRDVMLENFRNLVSVGHQASKPDVLAKLERGEEPWAIEEEVRSGTSPETGKV

SEQ ID NO: 20049 - protein, 81 aa, Panthera pardus
KSQGLLSFSDVAVDFTWEEWELLDTVQKNLYRDVMLENYSNLMSLGYHAPWPEATVHVERGVQGLVEREFPSSCGPERPLQ

SEQ ID NO: 20050 - protein, 81 aa, Capra hircus
YRESVTFEDVAVDFTQEEWALLDTSQRKLFRDVMLENISHLVFVGYQHCKLDVIFQLEQGEELWIEGRGIFQSHSPGGESA

SEQ ID NO: 20051 - protein, 81 aa, Tursiops truncatus
EQLTFKDVAIEFSQEEWECLDPAQRALYRDVMLETYRNLVSLDICHIYVMKKLQPKVNSDGGEIFQTVMLETCESREIRDF

SEQ ID NO: 20052 - protein, 81 aa, Ursus arctos
QESVTFKDVAVDFTLEEWGQLGPGQRKLYWDVMLENYQNLLSLGAGPPGSKPDVISRLERGEEPRMEKREAKQAACPDLDT

SEQ ID NO: 20053 - protein, 81 aa, Ursus arctos
PQKSVTFEDVAVYFTQTEWDGLSPAQRALYRDVMLENYGNVASLGFSLLKPAVISQLEGAGELEGPSPLVAGTEIGPQGLW

SEQ ID NO: 20054 - protein, 81 aa, Leptonychotes weddellii
IQGSLTFGDVAVAFTQFEWKHLDATQQALYRDVMLENYRNLVSVGLLSSKPKLITQLEQGAEPWMEVQQIPSDTCSVQEYW

SEQ ID NO: 20055 - protein, 81 aa, Physeter macrocephalus
MLENFRNLISMGCPVTKTKVIFKVEQGQEPWMVEGENPRWRSPEADCPLIDESDKHQESKDNFLNSVFFMFNKILTVKRLH

SEQ ID NO: 20056 - protein, 81 aa, Trichechus manatus
GLVTFRDVAIAFSQEEWECLDPAQRDLYVDVMLENYSNLVSLDLESIYETKNTFSEKDIFEINFSQWEIKEKSKTLGLEAS

SEQ ID NO: 20057 - protein, 81 aa, unidentified
  REGION 1..81: note = Bos indicus x Bos taurus
FKEAVTFKDVAVVFTEEELGLLDSAQRKLYQDVMVENFRNLVSVGHVPFKADMVSQLETEEKLWTTERETQRNGHSSEIHS

SEQ ID NO: 20058 - protein, 81 aa, Trichechus manatus
SQESVTFQDVAVDFTEKEWPLLDSSQRKLYKDVMLENYSNLTSVGYQLGKPSLISHLEQEELLRTEERGSHQGTCPDWEIP

SEQ ID NO: 20059 - protein, 81 aa, Trichechus manatus
LQKLVTFKDVAVDFTQEEWECLDSSQRHLHREVMLENFENLVSLGHLLSKPEMIFHFERLDDVWMEEEMPRSSCSGVRDEK

SEQ ID NO: 20060 - protein, 81 aa, Ursus maritimus
MLENYSHLVSVGYLVPKPDEVLRLGRGEEARRAEGEPPTRSYPEFWQVDDQVDNHKESQDQLLWQTALVDKETQKDLSGRE

SEQ ID NO: 20061 - protein, 81 aa, Lynx canadensis
GRLTFRDVAIEFSQEEWECLDPAQRALYRDVMLENYRNLVSLGSTSAGFAIKELSPTEDINKGEFYHLVLLERNESHGIKD

SEQ ID NO: 20062 - protein, 81 aa, Acinonyx jubatus
AQGLVTFRDVAIEFSQEEWKCLEPAQRNLYRDVTLENFSNLVSLGLSVSKPDLISLLEQGREPWMIANDMTGPWCPELESR

SEQ ID NO: 20063 - protein, 81 aa, Capra hircus
RLTSEDVAIEFTQEEWEFLDPAQRALYRDVMLETYRNLLSVDISPTHVIKLLQPKANRDKLETFQTLMLGRPESCEIKHVH

SEQ ID NO: 20064 - protein, 81 aa, Panthera pardus
MQNELLQAMSKEEWECLDSGQMNLYKEVMLENFSNLVSVGLSNSKPAVISLLEQGKEPWMVERELTRGLCSDLESMCETKI

SEQ ID NO: 20065 - protein, 81 aa, Acinonyx jubatus
SKDLVTFGDVAVDFSQEEWEWLNPAQRNLYRKVMLENYRSLVSLAGVSVSKPDVISLLEQGKEPWMVKKEGTRGTYPDWEY

SEQ ID NO: 20066 - protein, 81 aa, Sus scrofa
ESVTFEDVAVDFTQEEWALLNSSQRKLFRDVMLENISHLVSIVISGREDDLKKQEMISMQHICKKDTSLICAMRSHTQEDP

SEQ ID NO: 20067 - protein, 81 aa, Ursus arctos
LLTFEDVAVSFSEEEWKLLDPSQKILYNDVMQENYETVISLGLKLKNDTGNDQPISLSALEIQASGGKVLRKARMKVAQKT

SEQ ID NO: 20068 - protein, 81 aa, Ursus arctos
YDSVVFEDVAVDFTLDEWALLDSMQKNLYRDVMLETFQNLVSVDYETLFKASGLVSQQDRHEEKNASEQKMAKFTRNHSCA

SEQ ID NO: 20069 - protein, 81 aa, Vicugna pacos
GWVPALFDEVAIYFSDEEWEVLTEQQKALYREVMRMNYETVLSLEFPFPKPDMITRLEGEEESHHSDDWQLQGGTFAENED

SEQ ID NO: 20070 - protein, 81 aa, Neophocaena asiaeorientalis
RSQESLTFQDVAVEFTREEWDQLYPAQKNLYRDVMLENYRNLVALGHQLYKPEVITQLEREEQWMMERDCPPDSHPDGENS

SEQ ID NO: 20071 - protein, 81 aa, Neomonachus schauinslandi
MLETYGHLLSVGNQIAKPEVISLLEQGEEPWSVEQAYPQSTCPEWMRNLESKALIPTQSIFEEEQSHSMKLERYIWDDPWF

SEQ ID NO: 20072 - protein, 81 aa, Pteropus vampyrus
SQGQLTLSDVFIEFSQEEWECLSPAQRALYRDVMLESYRNLLFLGISVSDLYIVSILEQGKAPWTLESDWKTAASPNRWER

SEQ ID NO: 20073 - protein, 81 aa, Bos indicus
SQGLVAFKDVAVCFSQDAWSDLDPTQKEFYGEYVLEDDCGIVVSLSFPIPRLDEISHVREEEPLVPDVPEPQEPEEPEILS

SEQ ID NO: 20074 - protein, 81 aa, Pongo abelii
PQGHLTFMDVAIEFSQEEWKSLDPGQRALYRDVMLENYRNLVSLGICLPDRSIISMLRQRREPLVLQSQVKIVKNTDGREC

SEQ ID NO: 20075 - protein, 81 aa, Physeter macrocephalus
MAFTKKEWEQLDPAQKSLYKDVMLENYSNLASMGYQALKPHMISKLGKEEPWLGKGKRPRQGGLSEIARPKGIGANGKEVQ

SEQ ID NO: 20076 - protein, 81 aa, Monodelphis domestica
LIKFKDVAVDFTQEEWCLLDHSEKELFLEVMLENVQNLLFVEAETNFEAKEISSKLILFVEESGPQIFINEGPCDFILREI

SEQ ID NO: 20077 - protein, 81 aa, Physeter macrocephalus
KTWGPLSFMDVFVDFTWEEWQLLDPAQKHLYRSVMLENYSNLVSLGYQHTKPNIIFQLEQEELWMMQIPSEGHLDEVWEID

SEQ ID NO: 20078 - protein, 81 aa, Delphinapterus leucas
TQEPVVFEDVAVDFTQEEWALLDLAQRNLYRDVMLENFRNLASLGYPLHTPYLISQWKQEEDLEIAERGPTQGEHQEGFET

SEQ ID NO: 20079 - protein, 81 aa, Delphinapterus leucas
AQEPVTFKDVAVDFTQEEWGQLDPVQRTLYRDVMLETYGHLLSVGNKIAKPEVISLLEQGEEPWSVEQAYPPQGACPEWVR

SEQ ID NO: 20080 - protein, 81 aa, Ursus maritimus
AQESLTFDDVAVAFTWEEWQLLAPAQKELYRDVMVENYRNLVSVGFHTSKPDTLSRLDQGEPTWTVEDDFPCRTCSEIWKL

SEQ ID NO: 20081 - protein, 81 aa, Ursus maritimus
AHHLVMFRDVAVDFSQEEWECLNPYQRNLYRDVILENYSNLVSVAGCSISKPDVITLLEQGKEPWMVVRDERRRSLDLESR

SEQ ID NO: 20082 - protein, 81 aa, Camelus dromedarius
DPEQVTFEDVAVDFTWEEWGQLEPAQRTLYRDVMLETFGLLVSVGHWLPKLDVISLPEQEVELWTVDKGVPQGVCPEQTDY

SEQ ID NO: 20083 - protein, 81 aa, Phyllostomus discolor
KSQGFVSFKDVTVDFTQEEWQQLDSAQRNLYRDVMLENYSNLVAVGYQSLKSDEIFLWKEGEPWMAEGEISSWAYPAFEIR

SEQ ID NO: 20084 - protein, 81 aa, Leptonychotes weddellii
SQDLVTFKDVAIDFSQEEWEWLNPAQRNLYKNMMLENYQNLVSLGLCISKPYMISLLEQGKEPWEMKTEMTRSPFPDLGSI

SEQ ID NO: 20085 - protein, 81 aa, Ursus americanus
MLENIRHLVSLGYQHCKSDVIFQLEQGEELWREGPGFLRGPSPGRESALKEQEMIATQHISRKDTSTIMPVQKSHTPEDPF

SEQ ID NO: 20086 - protein, 81 aa, Phascolarctos cinereus
AQESVSFKDVAVDFSREEWCFLDASQKKLYKEVMLENYRNLVSLGLPVGKADVIFQLERGQVLGVLEREDLAASRPDWELR

SEQ ID NO: 20087 - protein, 81 aa, Pteropus vampyrus
PEDLVTFGDVAVDFSQEEWARLNPAQRDLYRHVMLENYRNLVSLAGVSVSKPDVISLLEQGKEPWMVKKEGSRGKCYDWEY

SEQ ID NO: 20088 - protein, 81 aa, Pteropus vampyrus
FLGSVSFEDVTVEFTPDEWQYMGPAHRTVYRDVMLENCSHFVSMGYCITKPQVIFKLEQGEEPWSLEEEFPNQRCPGYYKV

SEQ ID NO: 20089 - protein, 81 aa, Cebus imitator
PQASVCFEDVAMAFTQEEWEQLDLAQRTLYREVTLETWEHLVSLGLLLSKPDVISQLEQEEDLCRAEQVALQDWKATLEKN

SEQ ID NO: 20090 - protein, 81 aa, Monodelphis domestica
SQVSITFHDVAVGFTQEEWDLLDDSQKELYLEVLLDNVQNLLSVGLPVPREIFISCLWQGKAPWMLEQKGPRNSCPETDTN

SEQ ID NO: 20091 - protein, 81 aa, Physeter macrocephalus
VQESVTFKDVAVLFTQDEWAQLSPAQRALYRDVMLENYSNLVSLGLLGPKPDVFSQLGKGEEWMPEDSLGGFCLDWMTTPV

SEQ ID NO: 20092 - protein, 81 aa, Pan troglodytes
AQEPVTFRDVAVFFSQDEWLHLDSAQRALYREVMLENYGSLVSLGIPFSMPKLIHQLQQGEDPCMVEREVPSDTCLGFKTW

SEQ ID NO: 20093 - protein, 81 aa, Sapajus apella
MAEEFVTLKDVAMDFTLEDWEQFGLDQGDLFWDTALDNYQNLFLLNPPRPNPTSRPDGSEDLEPLARGSPEAVGPDLAETT

SEQ ID NO: 20094 - protein, 81 aa, Zalophus californianus
FQDSVTFEDVAVRFSSGEWQCLTRAQRHLYADVMLENYGNMISVGFAVPKPPLISHLEQGAEPCVQDLQDGGFLSCSFPVS

SEQ ID NO: 20095 - protein, 81 aa, Carlito syrichta
MLVTFKDVAVTFTREEWRQLDLAQRTLYQEVMLETCRLLVSLGHRVPKPELIHLLEHGQELWTVKRGLSHSTCAGDRAQLQ

SEQ ID NO: 20096 - protein, 81 aa, Saimiri boliviensis
SQGLVTIKDVSLCFSQEEWRSLDPSQTDFYGEYVMQENCGIVVSLRFPIPKLDLLSQLEGGEEQWVPDPQDLEERDILRVT

SEQ ID NO: 20097 - protein, 81 aa, Saimiri boliviensis
FQGPVTLKDVTVEFTKEEWKLLTPAQRTLYKDVMLENYSHLVSVGYRVNKPNVVFKLKQGKEPWMLEVEYPHRGLLEDLRN

SEQ ID NO: 20098 - protein, 81 aa, Vulpes vulpes
RAKKPVTFKDVAIDFIQEEWGLLDPTQRILYCDVMLTNYSNSVSLGLHDCKPDMISKLEQREDPWIMEKDILRSPDSEPRH

SEQ ID NO: 20099 - protein, 81 aa, Vulpes vulpes
PKVLVSFEDVSVYFTKTEWKLLDLQQRILYKRVMLENYGHLESLGFLSSKPHLVSWLEQGEGPWGADMCGTPAAAGMQTDD

SEQ ID NO: 20100 - protein, 81 aa, Equus caballus
DSVTFGDVAVYFSWEEWRLLGEAQRDLYHDVMLENFALISSLDCWSATEDAKAPFEHSISVGVSQATTPKTGLISQNTHTC

SEQ ID NO: 20101 - protein, 81 aa, Rhinolophus ferrumequinum
FKESVSFEDVAVDFTRQEWHRLDPAQRTMHKDVMLENYSNLASVGLCVAKPEMIFKLERGEELWVLEEESPGHGYTGSLSL

SEQ ID NO: 20102 - protein, 81 aa, Rhinolophus ferrumequinum
VQESVTFRDVAVLFSQDEWLCLDPAQRALYREVMLENYSSLVSLGILFAKPKVIFQLQRGEDPWMVENGASRGTCLGWESF

SEQ ID NO: 20103 - protein, 81 aa, Rhinolophus ferrumequinum
QSPVTFEDVAVYFSKEEWGLLDVTQRHLYHDVMLENFELMTSLGCWHGMEHEEACSKQNASVEGVSQVRIPSAHSFTQKTD

SEQ ID NO: 20104 - protein, 81 aa, Rhinolophus ferrumequinum
PSQISFEDVAVAFTLDEWQLLSPTQKSLYRDVMLENYSNFVFLEELWLDNNLKMWHQNNQDKLQSTESNHGYDVFGKILHS

SEQ ID NO: 20105 - protein, 81 aa, Rhinolophus ferrumequinum
VTFQDVAVDFTEKEWPLLDSSQRKLYKDVMLENYSNLASVDWETPSKTKWSILMEDILGKETSRDVTMERTRLGEKSTDYA

SEQ ID NO: 20106 - protein, 81 aa, Ursus maritimus
ALVTMTFDDVALYFSEQEWEILEKWQKEMYQQVMKTNYETLDSLGGVFSKPDLITWIEQGRMLLIRDQGPLEKNMTLSPST

SEQ ID NO: 20107 - protein, 81 aa, Ursus maritimus
MLENYINLISVGYQTTKPSVIHKLEQGEEPWMVEREIPSWSYAEEVWQLDDHLERHQGNQETLLKHVAFIDQETVTKEKGN

SEQ ID NO: 20108 - protein, 81 aa, Ursus maritimus
MASPSPPPEPKEEWDYLDPAQRSLYKDVMMENYGNLVSLDVLNRDKDEEPTVKQEMEEIEEEVEPQGVIVTRIKSEIDQDP

SEQ ID NO: 20109 - protein, 81 aa, Ursus maritimus
SQEPVTFEDVAVYFTQNQWANLDFTQRALYREVMLENYANVASLAFPFPKPDLVSQLERGEAPWGPDPWEAEVLRGVCPGG

SEQ ID NO: 20110 - protein, 81 aa, Camelus dromedarius
SCEGSVSFRDVAVDFSREEWQQLDLDQKNLYRDVMLETYSHLLSVGYQVPEPEVFMLEQGKEPWAMQSESLRQSCPADDLG

SEQ ID NO: 20111 - protein, 81 aa, Phyllostomus discolor
KTLGSVAFRDVIVDFTQEEWQQLKPAQKDLYRDVMMEVYWNLISLDVETRPDTKELDPQEDNWEDRPSVVVVTEGPMKNGA

SEQ ID NO: 20112 - protein, 81 aa, Phyllostomus discolor
SKDLVTFGDVAIDFSQEEWEWLNLAQRNLYRKVMLENYRNLVLLAGVSVSKPEVISLLEQGKEPWMVKEVETGGTYSDWEY

SEQ ID NO: 20113 - protein, 81 aa, Bison bison
IQGLVTFRDVAIEFSQEEWKYLEPAQRDLYREVTLENFGNLVSLGLSISKPDVVSLLEQGKEPWMVVNDMTGPWCPDLESR

SEQ ID NO: 20114 - protein, 81 aa, Bison bison
SLGSDLFRDVAVVFSQEEWEQLAPTQRDLYRDVMLETYSNLVSLGLAISKPDVISFLEQGKEPWTVEEVVTGGLCPVLKSR

SEQ ID NO: 20115 - protein, 81 aa, Sus scrofa
GVNFEDIAVYFSWEEWRLLDEAQRRLYLDVMLDNYALISSLGCCCGAEGSEAPFEQIDSLGVSQARISEAALSSQETHPCG

SEQ ID NO: 20116 - protein, 81 aa, Ursus arctos
TQGSLSFRDVTVGFTQEEWQHLDPAQRSLYRDVMLENYSHLVSLGYSISKPEVILKLEQGEEPWILEEEFPSQSDLELIKS

SEQ ID NO: 20117 - protein, 81 aa, Sus scrofa
QEPAEYEFLSVDYTQKKWKGPALSQRALYRNIVPENCHSLASLAGENGMECSDLPPKQESSKESEASDRTSGVLYEVIPGG

SEQ ID NO: 20118 - protein, 81 aa, Pteropus vampyrus
PQESVTFKDVAVDFTQEEWRHVDPAQRRLYRDVMLENYSNLVSLAGYQVSKPEVIFKLEQGEEPWLSEGEIQRPFFPDWKT

SEQ ID NO: 20119 - protein, 81 aa, Pteropus vampyrus
MLETFGHLLSVGKHTAKPEVISLLEQGEEPWLVEHAPPQRICPEMMKNLENKALIPTQSIFEEEQSRSMKLERYVWDDPWF

SEQ ID NO: 20120 - protein, 81 aa, Pteropus vampyrus
AHGSVIFSDVSIAFSQEEWEYLDLEQRDLYRDVMLENYSNLVSLGCFISKPNVISLLEQGKEPWKVVRKERRYPDMGIRYE

SEQ ID NO: 20121 - protein, 81 aa, Trichechus manatus
WSQMPVTFEDVALYLSREEWGRLDHTQQNFYREALQKRKGLSLGFPFRRPFWASQVQAKGEASSSGQQTGEEEDEEKTAVC

SEQ ID NO: 20122 - protein, 81 aa, Zalophus californianus
MAEGFTFKDVAIYFSQKEWECLHSAQKDLYRDVMLENYNNLISLGLSDSKPDVISLLEQGKEPWMVKSQETKEWCPDWESR

SEQ ID NO: 20123 - protein, 81 aa, Zalophus californianus
CQESVTFEDVAVIFTDEEWRHLVPIQRDLYKEVMLENYKSIVSLGLPVPQPDVIFQLKRGDEPWIVDLHGSEERECPENVS

SEQ ID NO: 20124 - protein, 81 aa, Phyllostomus discolor
KFEEELTFKDVAVVFTEEELGLLDSIQRKLYRDVMLENFQNVVSVGCHSFKHDIVHLEKEKRVWMMTAAQREGESGGKIQG

SEQ ID NO: 20125 - protein, 81 aa, Ursus maritimus
SQHLVTFEDVAVNFTWEEWTLLDQTQRDLYRDVMLENYQNLIILAGYESCGPDLNSPVGGAEELRTGGRGILQELDLQLKT

SEQ ID NO: 20126 - protein, 81 aa, Phyllostomus discolor
KALGSVAFRDVIVDFTQEEWLQLKPAQKDLYRDVMMENYWNLVSLDLETSPEMKELDPQKDIWKDRPSIAVVAEGPTRNGA

SEQ ID NO: 20127 - protein, 81 aa, Acinonyx jubatus
KSQGSLALEDVAVNFTRDEWQLLDSAQKNLYRNVMLENVSSLVSLGFQLIKPDVIFKLEREQPWIIGEEVPSQSLSEYWKV

SEQ ID NO: 20128 - protein, 81 aa, Tursiops truncatus
MLENYGNVASLGFPLLKPTVISQLEGGGELEGPSPLASGTGTGPQGLWTVNIDIQTDNNLTEEMYEEKHNTSFELQRNSSQ

SEQ ID NO: 20129 - protein, 81 aa, Acinonyx jubatus
MLENYGVVASLAFPFPKPALISQLERGEAPWCKAPQGALDGECPRGVSTGYPFLKPAAISHLEQVEEPLNLKLQGEGPSLI

SEQ ID NO: 20130 - protein, 81 aa, Tursiops truncatus
SRDSVTFADVAVDFTQEEWTLLDPIQRKLYRDVMLENYKNLTTAGYQSLKPTLISWWEQEDDLRTAERKGVLQASCFFLQT

SEQ ID NO: 20131 - protein, 81 aa, Bison bison
AQEILSFKDVAVDFTWEEWQLLTPAQKTLYRDVMLENYSNLVSVGYRVSKSDVLFKLEQGEERWMTEDEIHSHTWPETGNI

SEQ ID NO: 20132 - protein, 81 aa, Sus scrofa
LTLEDVAVDFTWEEWQLLTPDQKDLYQDVMLENYGNLVAVETEKVEDCVQWHCQKQNTLRRIEEGYEQSVFENITHQSKRS

SEQ ID NO: 20133 - protein, 81 aa, Sus scrofa
ELVTFRDVVITFSQEEWEYLDSAQRDLYWDVMMENYSNLVSLDLESNYHTKTLSIEKDSIGKSDSQWEVIESSKLVDFENS

SEQ ID NO: 20134 - protein, 81 aa, Leptonychotes weddellii
MIKSQISFEDVAVGFTSEEWQLLNPSQKSLYREVMLENYSNLVFLGYQIIKPDAIFKLEHKEPWIIDEEVLNQNFSEEVWL

SEQ ID NO: 20135 - protein, 81 aa, Phascolarctos cinereus
AHQALVTFKDVAVDFTQEEWGRLCPSQKELYRDVMLENYRNLVWLGQRFSPKVPGQLPADTKRSVLLGTCSFQTRCDLPVG

SEQ ID NO: 20136 - protein, 81 aa, Pongo abelii
PQESVTFKDVSVDFTQEEWYHVDPAQRSLYRDVMLENYSHLVSLGYQVSKPEVIFKLEKGEEPWISEGEIQRPFYPDWKTR

SEQ ID NO: 20137 - protein, 81 aa, Pongo abelii
TFKEAVTFKDVAVVFTEEELGLLDPAQRKLYRDVMLENFRNLLSVGNQQFHQDTFHFLRKEKFWMMKTTSQREGNSEGKIQ

SEQ ID NO: 20138 - protein, 81 aa, Pteropus vampyrus
YQELVTFRDVAVDFSQEEWDCLNSSQRHLYSNVMLENYRILVSLGLCFSKPNVILLLEEGKEPWSVKRELAKGLCSGWEST

SEQ ID NO: 20139 - protein, 81 aa, Pteropus vampyrus
VVTFEDVAVDLSQEEWELFDETQRLLYRDVMLENFALVSSLGFWFQMEAEKAASQGVSHLRIPKAGLTTQKAYSCGTCGPV

SEQ ID NO: 20140 - protein, 81 aa, Pongo abelii
WSQMPVTFEDVALYLSREEWGRLDHTQQNFYRDVLQKKNGLSLGFPFSRPFWAPQAHGKGEASGSSRQTGDEKEWRGACTG

SEQ ID NO: 20141 - protein, 81 aa, Pteropus vampyrus
SRTLVTFKDVVVNFTREEWQLLDTAQQILYKDVTLENYKNLLSLGHQLPKPDVILHLEKGEEPWLVERGVRRHTHPDWDTA

SEQ ID NO: 20142 - protein, 81 aa, Pteropus vampyrus
SKETVTFKDVAVTFTKEELRLLNSAQRKLYQDVMLENFRNLVSVGGKIQSEIKTIPEAGPCEELFCWQIWQQIASDLTRHQ

SEQ ID NO: 20143 - protein, 81 aa, Pongo abelii
CYQDSVTFDDVAVDFTQEEWTLLDSTQRSLYSDVMLENYKNLATVGGQIIKPSLISWLEQEESKTVQGGVLQGWETQLETQ

SEQ ID NO: 20144 - protein, 81 aa, Trichechus manatus
MHKDVMLENYSNLASVGLCVAKPEMIFKLERGEELWILEEESSGHNYSGSLSLLCGNNSVEGNALLLDKDILQHQKIQTLD

SEQ ID NO: 20145 - protein, 81 aa, Carlito syrichta
CEVSVSFEDVTVDFSKEEWQLLDPAQRRLYWDVTLENYSHLLSVGFEVPKPEVIFKLEQGEGLWTLQGEAPHQSRSDGKFG

SEQ ID NO: 20146 - protein, 81 aa, Trichechus manatus
SQASVTFMDVAVRFTRREWEQLAPTQRVLYRDVMLETYGNLLSVGCQYTKPDVIFKLEQGEEPWTEEGAPPRRSCREKFWK

SEQ ID NO: 20147 - protein, 81 aa, Zalophus californianus
MLEIYSHLVSVGCSGIKPGVIFKLEHEEDPWIIKTELSRWIHSDREKSLDSSQQIISEELSFQKEILEKTPKDNSLYPLLK

SEQ ID NO: 20148 - protein, 81 aa, Delphinapterus leucas
PENGVTFEDIALYFSWEEWKLLDEAQRRLYHDVMLENFALISSLGVWSGEENVEASFEQSVSVVMSQVRTSKEPSSSQKTH

SEQ ID NO: 20149 - protein, 81 aa, Lipotes vexillifer
AQESVMFSDVSIDFSQEEWEYLNDDQRDLYREVMLENYSNLVSMGHSISKPDVISFLEQGKEPWLVDRELTRDQWPVLESR

SEQ ID NO: 20150 - protein, 81 aa, Rhinolophus ferrumequinum
WKEELSFEDVAVNFTREEWNKLDWTQRDLYRDVMLENYRNMILLGFQFPKPEVICQLEQWEDPWILDLPRAGTRKASSNAC

SEQ ID NO: 20151 - protein, 81 aa, Delphinapterus leucas
SVCEVSFKDVTVDFSREEWQHLDPAQRLLYRDVTLENYSHLRSVGYQVPKPEVIFKLEQGEGPWTLEEETPHQSCSDEDNG

SEQ ID NO: 20152 - protein, 81 aa, Delphinapterus leucas
PQAKVTFEDVAVLLSQEEWDRLGPAQRGLYRHVMMETYGNVVSVGIPGSKPEVISQLERGEEPWVVDKQGNEGRRGLGTGR

SEQ ID NO: 20153 - protein, 81 aa, Aotus trivirgatus
MFKEAVTFKDVAVVFTEEELGLLDPAQKKLYRDVMLENFRNLLSVGQQAFDRDTFQFLREEKVWMMKTATQREGNSGGKIQ

SEQ ID NO: 20154 - protein, 81 aa, Aotus trivirgatus
TQGSLTFKDVAIEFSQEEWKCLDPVQKALYRDVMLENYRNLGFLGLCLPDLNIISMLEQGKEPWTVVSQVKITRNPNWGER

SEQ ID NO: 20155 - protein, 81 aa, Muntiacus muntjak
MGRLMFQDVAIDFTQEEWECLDLSQRDLYRDVMLETYGNLASLGLVVSKPDLVTFLEQMKNPWDVRRTDTKATYPAVSSHN

SEQ ID NO: 20156 - protein, 81 aa, Carlito syrichta
VPVTFRDVALIFTEAEWKSLSLEQRNLYKEVMLENYWNLLSLETKPGTYPCSSCLLVSCLQVLSQHMLQVFWGLCAENHSH

SEQ ID NO: 20157 - protein, 81 aa, Sapajus apella
MPHLLVTFRDVAIDFSQEEWECLDPAQRDLYRDVMLENYSNLISLDLESSREINKLSSEKEIYEMESLQWENMGKFINHHV

SEQ ID NO: 20158 - protein, 81 aa, Pan troglodytes
AQVSVTFDDVAVTFTKEEWGQLDLAQRTLYQEVMLENCGLLVSLGCPVPKAELICHLEHGQEPWTRKEDLSQDTSPGDKGK

SEQ ID NO: 20159 - protein, 81 aa, Balaenoptera acutorostrata
TCTQGAPVTFDDITVYLLQEEWMLLSQQQKELCGSDELVAPLGPTIANPELFYKFERGPEPWLANVQGQRNLLSLHRGRNK

SEQ ID NO: 20160 - protein, 81 aa, Rhinolophus ferrumequinum
FQEAVTFKDVAVVFTEEELGLLDSAQRKLYRDVMLENFRNLLSLGHPSSKPDVISQLEREEKLWMMEIQTQRGGSSENEMD

SEQ ID NO: 20161 - protein, 81 aa, Ursus maritimus
AQEFLTFDDVAVDFTWEEWQLLAPAQKDLYRDMMLENYRNLVSVGYQASKPDALSKLERGEELWTIEDEIHSRICPELRKV

SEQ ID NO: 20162 - protein, 81 aa, Ursus maritimus
AQESLTFGDVFVDFTLEEWQQLDSAQKYLYRDVMLENYSHLVSVGYLVPKPDEVLRLGRGEEARRAEGEPPTRSYPEFWQV

SEQ ID NO: 20163 - protein, 81 aa, Phyllostomus discolor
GLVAFRDVIVDFTQEEWQQLKPAQKDLYRDVMMENYWNLVSLDLEKRPVMKDTDPQDNISENRPPIAVVAEGPTKNGSQSC

SEQ ID NO: 20164 - protein, 81 aa, Acinonyx jubatus
MLQVTFSDVAIDFSHEEWGWLDSAQRDLYKDVMVQNYENLVSLGLSIPKPYVISLLEDGKEPWMVEKKLSKDWESRWENKE

SEQ ID NO: 20165 - protein, 81 aa, Tursiops truncatus
SLDSVSFTDIAIDFSKDEWEWLNLGQRTLYKKVMLENYRNLASLGLCISKPDVISLLEQDKEPWMLKGEITRGLPPDLEYV

SEQ ID NO: 20166 - protein, 81 aa, Tursiops truncatus
MLENHSSVAGLAGFLVFKPELISRLEQGQEPWVLDLQGAEGREAARTSQADSTIGTESEQACEDIDRLKSESHVVMVKTPS

SEQ ID NO: 20167 - protein, 81 aa, Tursiops truncatus
QVTFEDVAITFSREEWECLDPAQRALYRDVMLETYGNLLSLAVSHIHVIKKLKPKANSDRGEVFQTVMLGRHESHEIRDFY

SEQ ID NO: 20168 - protein, 81 aa, Sus scrofa
SQVSVTFEDVAVLFSRDEWRRLGPSQKNLYQDVMLENYSNLVSLGLPFSKPKVISLLQQGEDPWKVEKESPGSFSPGCKSS

SEQ ID NO: 20169 - protein, 81 aa, Tursiops truncatus
AHGSVTFRDVAIDFSQEEWEFLDSAQRDLYRDVMWENYSNFISLGPSISKPDVTTLLDEGKEPWMVVREGTRRHHPDLESR

SEQ ID NO: 20170 - protein, 81 aa, Sus scrofa
PLESVTFEDVAIDFSQEEWALLDTSQRKLFRDVMLENINHLVSLGYHHSKSDVIFHLEQGEELWFEGRGFFQSHSPGRESA

SEQ ID NO: 20171 - protein, 81 aa, Sus scrofa
SQDPVTFQEVAVDFTQEEWALLAPAQKILYRDVMLENYRNLASVGYHLRKPSLLTQEELRVKKKRILQDTCADQISQLKTK

SEQ ID NO: 20172 - protein, 81 aa, Sus scrofa
MFSDVSVDFSQEEWEFLDPAQRDLYKDVMLENYSNLVSMGLCMPKPQVISLLEQGKEPWMVGRELTKGLCSDLESMCETKL

SEQ ID NO: 20173 - protein, 81 aa, Ursus arctos
SQGLVSFKDVAVDFTQEEWQQLDPAQRTLYRDVMLENFSHLVSMGYPVSKPDVISKLEQGEDPWTIKRDIPNWIYPDENQA

SEQ ID NO: 20174 - protein, 81 aa, Ursus arctos
MFKDVAIDVSQEEWECLNSTQRDLYKDVMLENYSNLVSLGLSISKPAVISSLEQGKEPWMVVREVAGGRCPDLVSRCEAKK

SEQ ID NO: 20175 - protein, 81 aa, Vicugna pacos
MAFRDVSVDFTQEEWRLLSPAQRTLYRDVMLENYRNLVSLGIPFSKPKLITQLEQGRETWKEERKGPPAPCPAEPKPDLHL

SEQ ID NO: 20176 - protein, 81 aa, Leptonychotes weddellii
SQESVTFEDVAVDFTQEEWTLLDRSQRKLFRDVMLENISHLVSIGRQLYKSDTISHLEPGEHLSKEERGLLQCQSPDREDD

SEQ ID NO: 20177 - protein, 81 aa, Leptonychotes weddellii
WKELLSFEDVAMYFTREEWNKLERAQKDLYRDVMLENYRNMILLGFQFPKPEVICLLEQWEEPWILDLPRAGTRKASSSAC

SEQ ID NO: 20178 - protein, 81 aa, Vicugna pacos
CEVSVSFEDVTVDFSREEWQHLDPAQRRLYRDVTLENYSHLCSVGYQVPKPEVIFKLEQGEGPWTLEEETPHQSCSDEDMG

SEQ ID NO: 20179 - protein, 81 aa, Trichechus manatus
PLESVTFKDVAVDFTLEEWALLDTSQRKLFRDVMMENIDHLVFVGNHLCKSDVISQLEQGEELWRGGIGFLQDQSPGGETG

SEQ ID NO: 20180 - protein, 81 aa, Pan troglodytes
MLETYSHLLSVGYQVPEAEVVMLQQGKEPWALQGERPRHSCPGEKLWDHNQCRKILSYKQVSSQPQKMYPGEKAYECAEFE

SEQ ID NO: 20181 - protein, 81 aa, Callithrix jacchus
LQEPVTFRDVAVDFTQEEWGQLDPTQRILYRDVMLETFGHLLSIGPELPKPEVISHLEQGTEPWVTERGTTQGCYPGWEPR

SEQ ID NO: 20182 - protein, 81 aa, Pan troglodytes
TARSQETVTFKDVAMDFTPEEWGKLDPAQRDVMLENYRNLVSLWLPVSKPENYNLENGKEPLKLERKAPKSSYSDMETRPQ

SEQ ID NO: 20183 - protein, 81 aa, Delphinapterus leucas
FQESVTFKDVIVDFTQEEWKQLDPVQRDLFRDVTLENYTHLVSIGLQVSKPDVISQLEQGTEPWIVEPSIPVGALGDWETR

SEQ ID NO: 20184 - protein, 81 aa, Pan troglodytes
AQEPVTFRDVAIYFSREEWACLEPSQRTLYRDVMLDNFSSVAALGFCSPRPDLVSRLEQWEEPWVEDRERPELQAVRRGPR

SEQ ID NO: 20185 - protein, 81 aa, Rhinopithecus roxellana
RSCLSLLSNVAIELSLVEWQCLDRAQQNLYRDVMLENYKNLVSLGIAVSKPDLITHLEQNKEPRNIKKNEMLAKHPPQQGI

SEQ ID NO: 20186 - protein, 81 aa, Panthera pardus
MAFRDVAVAFTQKEWRLLSPAQRTLYRDVMLENYSHLVSLGIAFSKPKLITQLEQGDEPWKEESECLLDLCPAEPGTEFQP

SEQ ID NO: 20187 - protein, 81 aa, Panthera pardus
AQESLTFDDVAVNFTWEEWQLLAPAQKNLYRDVMLENYRNLVSLGFYPRKPDVLTKLAQGKPTGTVEDDIPFRTCSEIWKL

SEQ ID NO: 20188 - protein, 81 aa, Tursiops truncatus
SQSLLTFEEVAIYFSQEEWELLDPTQKALYNDVMQENYETVISLALFVLPKTKVICCLEQGEEPWVQGPPIFKDSPEELFS

SEQ ID NO: 20189 - protein, 81 aa, Tursiops truncatus
SQGLVSFKDVAVDFTQEEWQQLDPAQKTLYRDVMLENYSHLVSMGHPVSKPDVISKLEQGEDPWIIKRDIPNWIYPYEDQA

SEQ ID NO: 20190 - protein, 81 aa, Cercocebus atys
PLTFKDVAIEFSQEEWKSLDPVQKALYKDVMLENYRNLVFLGISPKCVIKELPPTENSNTRERFQTVALERHQSCDIENLY

SEQ ID NO: 20191 - protein, 81 aa, Sus scrofa
KFQAVTFTDVCVVFTEEELGLLDLAQRKLYRDVMLENFQNLLSVGHQSSKPDVIAQLEREERLWGTELQTQRGRLAGGRNQ

SEQ ID NO: 20192 - protein, 81 aa, Tursiops truncatus
SKAPVTFGDLAIYFSQEEWEWLSPIQKDLYEDVMLENYQNLVSLGLSFRRPNVITLLEKGKAPWMVEPVKRRRGLDLGSKC

SEQ ID NO: 20193 - protein, 81 aa, Bison bison
KPLAVRFADVAVYFSPEEWGYLRPAQRALYRDVMQETYGHLGALGFPGPKPALISWMEQESEAWSPAAQDPEEGENLGGAL

SEQ ID NO: 20194 - protein, 81 aa, Sus scrofa
VTFDDVAVTFTQEEWAQLDPAQRTLYQEVMLENFRLLVSLGERYRLEGGLEVFQPRSFRVFSSSLPPRIDVWPSVPEESST

SEQ ID NO: 20195 - protein, 81 aa, Ursus arctos
QEPVTFKDVIVEFNEEEWGQLDPAVKTLYRDVMLENYRNLNSLHQEQLLFKPVEISKLESKERRWTVEQETPSTSVSDREI

SEQ ID NO: 20196 - protein, 81 aa, Odocoileus virginianus
MDFTLENWEQLGQGQGDLFWDTALDNYQSLFLLNPPRPNLTFHPDGGEKLEALAKESPESTDADIAETFPLPQDFLEEGLF

SEQ ID NO: 20197 - protein, 81 aa, Odocoileus virginianus
QGLFTFRDVAIEFSQEEWECLAPSQRALYRDVMLDTYRNLVSLGEDNFSPEVDDLIGILSAGFAINKLSPRENTNVGELYG

SEQ ID NO: 20198 - protein, 81 aa, Muntiacus reevesi
HFKEAVIFTDVAVTFTEEELGLLDLAQKKLYQDVMLENFRNLVSVGCHPFRHDIFHLEKEKRLWVVKTATQSEGKSGNQNL

SEQ ID NO: 20199 - protein, 81 aa, Pteropus vampyrus
EVPGDGIHSVLTNTPVEEWQQLDPAQRTLYRDVMLENFSHLVSMGHPVSKPDVISKLEQGEDPWIIKRNISNWIYPDRKSN

SEQ ID NO: 20200 - protein, 81 aa, Pongo abelii
QGRLTFRDVAIEFSLAEWKFLNPAQRALYREVMLENYRNLEAVDISSKCMKKEVLSTGQGNTEVFHTGTLQRHESHHVGDF

SEQ ID NO: 20201 - protein, 81 aa, Monodelphis domestica
SQESITFKDVAVDFNQEEWGLLDHSQKELFREVMLENVQNVLIVGLPVPREIFISCFQQGKAPWLLEQKGPRNSCPEAESN

SEQ ID NO: 20202 - protein, 81 aa, Trichechus manatus
FMESVTFKDVAVVFTEEELGLLDPAQKKLYQDVMVETFRNLVSVGGKNPRQVELAPQAEPHEELSSLHIWQQIASDLTRCQ

SEQ ID NO: 20203 - protein, 81 aa, unidentified
  REGION 1..81: note = Bos indicus x Bos taurus
KDQRSLTLEDVAVDFTWEEWQLLAPPQKALYRDVMLENYSNLVSVGYQASKPAALSRLERGELWPVEDKVHSRICPEMRKD

SEQ ID NO: 20204 - protein, 81 aa, Sapajus apella
MLENYRNLVSLGLPFTKPKVISLLQQGEDPWKVEKDCSGSSSLGCKSNPKMTKTTQTQDSFQELMRKRLKRDEPWNFISER

SEQ ID NO: 20205 - protein, 81 aa, Trichechus manatus
CEVSVSFEDVTVDFSREEWRHLDSAQRRLYRDVTLENYSHLLSVGYQVPKPEVIFKLEQGEEPWTLEAETLHQSYSDSKFG

SEQ ID NO: 20206 - protein, 81 aa, Trichechus manatus
MLENYSHLVSVGYCISKPEVILKLEQGEEPLILEEEFSNLSYPDTFRWCFLSKDRETELINDSRNYSRKKTNEYNRGRKWH

SEQ ID NO: 20207 - protein, 81 aa, Trichechus manatus
KFQGSMTFKDVLVEFTQEEWRLLNPAQRTLYRDVMLENYSHLVSVGYVTKPSKVFKLKQGKEPWILEVESPRQGYPEGLWD

SEQ ID NO: 20208 - protein, 81 aa, Carlito syrichta
SKAPVTFGDLAIYFSQEEWEWLSPIQKDLYKDVMLENYENLVSLGLSSRKPNAITLLEKGKVPWMVEPARRRRGPDPRVKH

SEQ ID NO: 20209 - protein, 81 aa, Delphinapterus leucas
MAITFEDVTVNFTWEEWKFLDSSQKKLYREVMWENYTNVTSVGDWKESYRLQEERFRYFEHEHLSCWQGWRNASTQIYDNQ

SEQ ID NO: 20210 - protein, 81 aa, Carlito syrichta
AQGSVSFKDVTVDFTQEEWQHLDPAQKTLYMDVMLENYCHLISVGCHMTKPDVILKLERGEEPWTSFAGHTCLEENWKTED

SEQ ID NO: 20211 - protein, 81 aa, Rhinolophus ferrumequinum
MAVTFEDVTVIFTWEEWKFLDFSQKKLYREVMWENYTNVMSVGNWKKSYKPQKERFRYLEHENLSCWRGWRNASTQIYENR

SEQ ID NO: 20212 - protein, 81 aa, Colletotrichum gloeosporioides
LPRREVPVEFRREYWAKIQKEKRKSRRQVLEEERVKAVCGKVSVENEDVDNFADEEDNVTTEEERERKWTKKRKRIQLSRS

SEQ ID NO: 20213 - protein, 81 aa, Scylla olivacea
MLSPIEETDAQTYFTPAEWNCMVTIEKNRVTNMLRNYKCLLAQGIDAKPPDFVLRYENRKKQQLKMTEMYKSQMSFMKSPA

SEQ ID NO: 20214 - protein, 81 aa, unidentified
  REGION 1..81: note = Limnohabitans sp. Hippo4
LTFQESASLWTGRFWRGLKTFVADIARGFVNISHHSFALLGLMAVLISMLALARPEIRIQTVQSIQGWLYTRLHISDAEDE

SEQ ID NO: 20215 - protein, 81 aa, Fusobacterium varium
IGCGLDFRNRRLEIKDKVWYNLDLSEVIDYRNEMISSYPNEYNISGNILEADFWEKFPKGRAIFIFEGILMFFEKEEVYNT

SEQ ID NO: 20216 - protein, 81 aa, unidentified
  REGION 1..81: note = Gordonia sp. 852002-50816_SCH5313054-a
VDEAFADLTVDAVTGEREPESVASMRADDVVVIRSVTKTFGLAGLRAGYLLASPEIVERLSRGRRPWPLSTPALAALAECV

SEQ ID NO: 20217 - protein, 81 aa, Halomonas chromatireducens
VTVVVDEAFIDFVDEPGEALTPLLARFDNLILLRSLTKLYTLPGLRLGYLLAGAQTIRRLQAGQPPWSVNHLSAALVAPLL

SEQ ID NO: 20218 - protein, 81 aa, Callithrix jacchus
YQDSVTFDDVAVDFTQEEWTLLDPTQRSLYSDVMLENYKNLATVGGQIIKPSLISWLEQEEESRTVQGGVLQGRKPQWRET

SEQ ID NO: 20219 - protein, 81 aa, Macaca mulatta
VMFRDVAIDFSQEEWECLDSAQRDLYRDVMLENYSNLVSLDLPSRCASKDLSPEKNTYETKLSQWEMSDRLENCDLEESKS

SEQ ID NO: 20220 - protein, 81 aa, Bos taurus
MTKPDVILKLERGEEPWTSFKGHTCLEENWKAEDFLLKFKEQQDKYSRSVILINHKKLVNENRSTCEKTLTLSKNPINSKK

SEQ ID NO: 20221 - protein, 81 aa, Bos taurus
MIFYIFLFQEQLTFKDVAVEFSQEEWECLDPAQRAFYMDVMVETLRNLISVGEDHFASEIGICPWVSLHFPSVPLGSPCFA

SEQ ID NO: 20222 - protein, 81 aa, Ovis aries
MDFTLENWEQLGQGQGDLFWDTALDNYQNLFLLNPPRPNLTFHLDGGEKLEALAKESPESTDAGIAETSPLPQDFMEEGLF

SEQ ID NO: 20223 - protein, 81 aa, Otolemur garnettii
SLGHLTFRDVAIEFSQEEWKCLDPAQRALYRAVMLENYRNLVSLAGIFFPDLTVHSIWEEGNEPWSVEHEVKTATNSIQGE

SEQ ID NO: 20224 - protein, 81 aa, Otolemur garnettii
MLENYSNLVSVGYQASKPDALSRLEQGEPWTTEDEMYSRICPSKKIVDQNKSTKPNSTKSQVNKHQRTHDIEKTHVCSQCG

SEQ ID NO: 20225 - protein, 81 aa, Otolemur garnettii
SQRSTFFSNVTVAFAQEGWRHLVSTPRDRFKEGIPGKSRNLVLLGLSVSQSGMNSQLEQREGAWMLEGEDLRSTCPDWKIS

SEQ ID NO: 20226 - protein, 81 aa, Otolemur garnettii
SLVTVTFKDVAVDLTKEEWQQMKPAERILYRDVMLENYSNLVTVGCQVTKPAVIFKLEQEEEPWVMEEEMFGRHCPEVWEV

SEQ ID NO: 20227 - protein, 81 aa, Vulpes vulpes
FQGSVTFQDVAVDFTPDEWQLLDCDQRTLYWDVMLENFRNLISVGDPVTKTKVIFKAEQGQEPWMAEGEQPCWRYPEADYL

SEQ ID NO: 20228 - protein, 81 aa, Vulpes vulpes
PLTSLTFEDVAVRFSSPEWRCLNRTQRLLYTDVMLENYGNMLAVGSAFPKPPLISQLEQGAEPCLPDQGFLSCFPVSPDKS

SEQ ID NO: 20229 - protein, 81 aa, Otolemur garnettii
SVTFEDVAIYFSQEEWGLLDEAQRLLYHDVMLENFALITSLVCWHGTENEETSAPSIEGLSRVGSLKAGPSTENTHPCEMC

SEQ ID NO: 20230 - protein, 81 aa, Otolemur garnettii
SQGLVTFRDVSLNFSQEEWEWLDPSQKDLYRDVMLENYRNLVWLGLSISKPNMISLLEQGKDPWMVGTEISHSNYTDWETW

SEQ ID NO: 20231 - protein, 81 aa, Otolemur garnettii
SQASVSFKDVNVEFTQDEWQQMGPAQRNLYRDVMLENYSNLVSVGYCIFKPKVIFRLEQGEEPWSSEEEFSSQRRPKNYRD

SEQ ID NO: 20232 - protein, 81 aa, Vulpes vulpes
MFNDVSIVFSQEEWEYLDLEQKDLYRDVMLENYSNLVSLGCFISKPDVISLLEQGKEPWKVVRKGRRRYLDLENRYETKKL

SEQ ID NO: 20233 - protein, 81 aa, Otolemur garnettii
QGMLTFRDVAIEFSMEEWARLDPAQWNLYRDVMLENYRNLVSLGLAASKPDLITFLEQRKEPWNVKRHEIVAKHSVGIYIY

SEQ ID NO: 20234 - protein, 81 aa, Pan troglodytes
FEDVAVYFSQEEWRLLDDAQRLLYRNVMLENFTLLASLGLASSKTHEINSESASMPSWRAVAWISLWLRNRSANLLTQIFF

SEQ ID NO: 20235 - protein, 81 aa, Pan troglodytes
YQDSVTFDDVAVDFTPEEWALLDTTEKYLYRDVMLENYTNLASVEWEIQPRTKRSSLQQGFLKNQIFTGIQMQTRSYSGWK

SEQ ID NO: 20236 - protein, 81 aa, Pan troglodytes
LVTFADVAIDFSQEEWACLNSAQRDLYWDVMLENYSNLVSLDLESAYENKSLPTEKNIHEIRASKRNSDRRSKSLGRNWIC

SEQ ID NO: 20237 - protein, 81 aa, Pan troglodytes
FINVDQSARTRGRCVCGKTPSCGDRKSCVNSSFVTWYCFTKPELIFTLEQGEDPWLLEKEKGFLSRNSPEDSQPDEISEKS

SEQ ID NO: 20238 - protein, 81 aa, Pan troglodytes
CYQDSVTFDDVAVDFTQEEWTLLDSTQRSLYSDVMLENYKNLATVGGQIIKPSLISWLEQEESRTVQGGVLQGRKTQWRGT

SEQ ID NO: 20239 - protein, 81 aa, Pan troglodytes
RPGAVSFADVAVYFSPEEWECLRPAQRALYRDVMRETFGHLGALGFSGPKPAFISWVEGEVEAWSPEAQDPDGSRDGNEEK

SEQ ID NO: 20240 - protein, 81 aa, Pan troglodytes
PQGHLTFRDVAIEFSQAEWKCLDPAQRALYKDVMLENYRNLVSLGISLPDLNINSMLEQRREPWSGENEVKIAKNSDGREC

SEQ ID NO: 20241 - protein, 81 aa, Pan troglodytes
FQESVTFQDVAVDFTAEEWQLLDCAERTLYWDVMLENYRNLISVGCPITKTKVILKVEQGQEPWMVEEVNPHESSPGWSAV

SEQ ID NO: 20242 - protein, 81 aa, Pan troglodytes
LPQPPEDVAIEFSLEEWQCLDTAQQDLYRKVMLENYRNLVFLGIAVSKPDLVTCLEQGKDPWNMKRHSTVVKPPVICSHFA

SEQ ID NO: 20243 - protein, 81 aa, Pan troglodytes
KQGYVTFEDVAVYFSQEEWRLLDDAQRLLYRNVMLENFTLLASLGKVLIPHPSILSWSVESLHAALGIVTSAIPRGSCWQG

SEQ ID NO: 20244 - protein, 81 aa, Pan troglodytes
TVTFEDVAVKFTQEEWNLLSEAQRCLYRDVTLENLALMSSLGKFQHQRLLPREECYVCCECGKSFSKYVSFSNHQRVHTVK

SEQ ID NO: 20245 - protein, 81 aa, Camelus dromedarius
LQNSITFEDVAMDFTQEEWTLLNSSQRKLYRDVMLENYRNLASLGHQLSKPPLITQMEQEDDMEAAERRTHQDSCPGEPWL

SEQ ID NO: 20246 - protein, 81 aa, Camelus dromedarius
ALGTVTFEEVAVYFSQDEWRLLDEAQRLLYRDVMLENFVLVASLGLASSRSHVVVQLELGGEPWVVGTEQRTRRRLVCKKF

SEQ ID NO: 20247 - protein, 81 aa, Camelus dromedarius
AQETVTFKDVAVDFTQEEWGQLDPVQRTLYRDVMLETYGHLLSVGNQIAKPEVISLLEQGEEPWSMDRVYPPQRTCPEWMR

SEQ ID NO: 20248 - protein, 81 aa, Cercocebus atys
PLETVTFKDVAVDLTQEEWEQMKPAQRNLYRDVMLENYSNLVTVGCQVTKPDVIFKLEQEEEPWVMEEEMFGRNRNCCLWG

SEQ ID NO: 20249 - protein, 81 aa, Cercocebus atys
TARSQETVTFKDVAMDFTPEEWGKLDPAQRDVMLENYRNLVSLWLPVSKPENYNLENGKEPLKLERRTPKSSYSDVETRPQ

SEQ ID NO: 20250 - protein, 81 aa, Cercocebus atys
DSVTFEDVAVDFTQEEWTLLDQTQRNLYRDVMLENYKNLVAVDWESHINTKWSAPQQNFLQGKTSSVVEMGFALSPRPECS

SEQ ID NO: 20251 - protein, 81 aa, Cercocebus atys
MNSVSFEDVAVNFTLEEWALLDSSQKKLYEDVMQETFKHLVCLGKKWEDQDIEDDHRNRGGNRRGHMVERLCESRKGSKCG

SEQ ID NO: 20252 - protein, 81 aa, Leptonychotes weddellii
FEESVTFEDVAVYFSENEWTGLAPAQRVLYRDVMLENYGAVASLGCPFLKPAGISHLEQVEEPLNLKLRGEGPSLSCTEGV

SEQ ID NO: 20253 - protein, 81 aa, Leptonychotes weddellii
MLETYRNLVSLGAGPAGPKPGVITQLEQGDEPWVLDAQGAKGKERLRVSISGHGTRTEYKELSSREMLDGEELDQLQRAVP

SEQ ID NO: 20254 - protein, 81 aa, Leptonychotes weddellii
ARASLSFEDVAVGFSWEEWQLLAPSQKDLYREVMLENYRNLVSVGYQASKPDSLFHLEQGEPPWTVVGAAQSQTCQEIWEI

SEQ ID NO: 20255 - protein, 81 aa, Felis catus
PQASVSFKDITVEFTQEEWRQMDSAQRTLYRDVMLENYSHLVSVGNCIFKPAVIFKLEQGEEPWFLEEEFLNQSHQEDYRD

SEQ ID NO: 20256 - protein, 81 aa, Felis catus
AQGLMAFEDVAVYFSQEEWELLDAAQRALYCHVMLENFALVSSLGLSASRPWVVLQLERGEEPWVLSGTVVTPARNAQRKP

SEQ ID NO: 20257 - protein, 81 aa, Monodelphis domestica
SQGSITFKDVTMDFTQEEWMLLDHSQKGLYLEVMLENVQNLHSVGLLVPRENFISCFQQGEAPWLLEQDCPRRSCPEAKTN

SEQ ID NO: 20258 - protein, 81 aa, Enhydra lutris
MFKEAVTFKDVAVAFTEEELGLLDSAQRKLYQDVMLENFRNLVSVGHQPFKRDKWRTEREERLWLTKTAPQIERNVGGNSQ

SEQ ID NO: 20259 - protein, 81 aa, Pongo abelii
MDFTPEEWGKLDPAQRDVMLENYRNLVSLWLPVSKPENYNLENGKEPLKLERRAPKSSYSDVETRPQSKDSTSVQDFSKAE

SEQ ID NO: 20260 - protein, 81 aa, Pongo abelii
QGSVTFEDVAVYFSWEEWDLLDETQKHLYFNVMLENFALTSSLGCWRGVEHEETPSEQRISVERVPQFRTSKEGSSSQNAD

SEQ ID NO: 20261 - protein, 81 aa, Pongo abelii
EMGPLTFRDVAIEFSLEEWQCLDTAQQNLYRNVMLENYRNLVFLGIAVSKPDLITCLEQGKEPCNMKRHAMVAKPPVVCSH

SEQ ID NO: 20262 - protein, 81 aa, Pongo abelii
RESGKAPVTFDDITVYLLQEEWVLLSQQQKELCGSDKLVAPLGPTVANPELFCKFGRGPEPWLGSVQGQRSLLEHHPGKKQ

SEQ ID NO: 20263 - protein, 81 aa, Pongo abelii
EMGLLTFMDVAIEFSLEEWQHLDIAQQNLYRNVMLENYRNLAFLGIAVSKPDLITSLEQGKEPWNMKRHEMVDEPSGIYPH

SEQ ID NO: 20264 - protein, 81 aa, Pongo abelii
MLENYRNLVFLGIAVSKPDLITCLEQGKEAWSMKRHEIMVAKPTVMCSHFAQDLWPEQNIKDSFQKATLKRYGKCRHENLP

SEQ ID NO: 20265 - protein, 81 aa, Pongo abelii
PQVLLTFRDVAIEFSQEEWKCLDPAQRTLYRDVMLENYRNLVSLDISSKCMMKIFSTGQGNTEVFHTGTLQRQANHHVGDF

SEQ ID NO: 20266 - protein, 81 aa, unidentified
  REGION 1..81: note = Bos indicus x Bos taurus
MLENYRNLASLAGLVVSKLDLVTFLEQMKNPWDVRRLEPPAIYTAVSSHNTRGLMSKNPRLENLIQKANLGIYERAHLGNE

SEQ ID NO: 20267 - protein, 81 aa, unidentified
  REGION 1..81: note = Bos indicus x Bos taurus
AAVAICSDFGPPKIKSITVSIVSPSTCLVISKPDLVTFLEQMKDPWDTQRMETPAVHPAVSSHDTQGLRTQKPGLEDLFPT

SEQ ID NO: 20268 - protein, 81 aa, unidentified
  REGION 1..81: note = Bos indicus x Bos taurus
MGRLTFQDVAIDFTQEEWECLDLGQRELYRDVMLENYGNLASLGLVISKPDLVTFLEQMKDPWDIRRMETPAVHPGMCLWM

SEQ ID NO: 20269 - protein, 81 aa, unidentified
  REGION 1..81: note = Bos indicus x Bos taurus
GERCSLPAYLSPSWQGGVTFEDVFVYFSREEWELLEEAQRLLYRDVMLENFALVSSLGLAVSRSHGATQLEPEGSLGCLRR

SEQ ID NO: 20270 - protein, 81 aa, unidentified
  REGION 1..81: note = Bos indicus x Bos taurus
MTDLEAQQPSSSSLLYLLTGCHIIKPEVITKLEQGEEPWVVEGEFLLQSHPEEVWKVHDLMEGSQENEDKHSRQTESINNK

SEQ ID NO: 20271 - protein, 81 aa, unidentified
  REGION 1..81: note = Bos indicus x Bos taurus
VTFEDVAVSFSQEEWGLLGEAQRLLYYDVMLENLSLIASLGCWRGGDTEEARSDQCVSVERVTRDRNPQVDSSVLKAVTPT

SEQ ID NO: 20272 - protein, 81 aa, unidentified
  REGION 1..81: note = Bos indicus x Bos taurus
SQSPLTFGDVAVEFSGEEWAWLDSAQRSLHRSVMLENYRNLASLGLCLSKPEMISSLEQRKEPWAVKRKSTRGMHPDSQTL

SEQ ID NO: 20273 - protein, 81 aa, Pan troglodytes
YQDTVTFDDVAVDFTQEEWTLLDPSQRDLYRDVMLENYENLASVGHHLFKPSVIYWLEQEEELRAGRRAVLQEWRLKTKGP

SEQ ID NO: 20274 - protein, 81 aa, Pan troglodytes
SLKKVTFEDVAIDFTQEEWAMMDTSKRKLYRDVMLENISHLVSLRYQISISYIILQLEQGKELWREGREFLQDQNPDRESA

SEQ ID NO: 20275 - protein, 81 aa, Pan troglodytes
SYEGSVSFRDVAIDFSREEWRHLDPSQRNLYRDVMLETYSHLLSVGYQVPEAEVVMLQQGKEPWALQGERPRHSCPAPCLV

SEQ ID NO: 20276 - protein, 81 aa, Pan troglodytes
PQASVCFEDVAMAFTQEEWEHLDLAQRTLYREVTLETWEHIVSLDWKLTLEENRLNSEKRLRELVEVHGSSPQRAYRFRLS

SEQ ID NO: 20277 - protein, 81 aa, Pan troglodytes
PAQGIVTFEDVAVYFSWKEWGLLDEAQKCLYHDVMLENLTLTTSLGGSGAGDEEAPYEQSTSPQRVSQVRIPKALPSPQKT

SEQ ID NO: 20278 - protein, 81 aa, Pan troglodytes
HLTFKDVAIEFSQEEWKCLEPMQKALYKDVMLENYRNLVFLGISPKCVIKELPPTENSNTGERFQTVPLERHQSYDIENLY

SEQ ID NO: 20279 - protein, 81 aa, Camelus dromedarius
PCLRISVIKDVTVDFTQEEWQQLDSAQKALYRDVMLENYCHFVSVGFHMTKPDMIHKLEQGKELWTTGRIFPSRSYLGESV

SEQ ID NO: 20280 - protein, 81 aa, Camelus dromedarius
TLLSYSHFIPRLLPPPGSSPKDLTTDSPPRLHSESVTFRDVTVDFTQEEWQHLEPAQRDLYRDVMLENFRNLVSLGKGQLC

SEQ ID NO: 20281 - protein, 81 aa, Camelus dromedarius
LKGLVSFEDLSPTFTWEEWQDLDDTQRTLYRDVMLETCSSLVSLGVHIMGDLTETSQENHGRPLWQIVITSNKTSTKRTSD

SEQ ID NO: 20282 - protein, 81 aa, Camelus dromedarius
QNEGSLSFRDVAVVFTWEEWQLLDLVQKNLYQDVMLENYSNLVSVGYQDTRADAFCQLEQGKPWIAEEETHSQIHPGEWKP

SEQ ID NO: 20283 - protein, 81 aa, Myotis davidii
SQESLTFRDVFVDFTLEEWQQLDFSQKNLYRDVMLENYGHVVSVGYLVDTPDVIFRFGQGDEARREDGEPIIQSCPEFWKV

SEQ ID NO: 20284 - protein, 81 aa, Myotis davidii
WSQMPVTFEDVALYLSREEWGQLDHSQQSFYRDVLQKRNGLALGFPFSRTFWASQVQGKGEASSSCRQMGDEEEKRGAVEV

SEQ ID NO: 20285 - protein, 81 aa, Myotis davidii
LTFHDVAVDFSWEEWQLLGPEQKDLYRDVMLETYSHLVSLDPQLNLVCLSLLLFFMSRVSRQQTRHTLQVGTRGRTVGSTA

SEQ ID NO: 20286 - protein, 81 aa, Myotis davidii
FQDSVTFQDVAVDFTEKEWPLLDSSQRKLYKDVMLENYSNLASVGCQVGKPSLIFHLEQEEEPRTEERGLPQGTCPEKSTE

SEQ ID NO: 20287 - protein, 81 aa, Myotis davidii
FQEAVTFEDVAVHFTQAEWAGLSSTQRALYRSVMLENCGNLTSLGYTVPSSALISLLEGRDLPWGLEAQDDPPAERSTHVC

SEQ ID NO: 20288 - protein, 81 aa, Cercocebus atys
GEACMGGDVTFSDVAIDFSHEEDLYKDVMVQNYKNLVSVTGLSVTKPYVITLLEDGREPWMVEKKLSFGMIPDWESRWENK

SEQ ID NO: 20289 - protein, 81 aa, Cercocebus atys
YPVYFQVSVTLCEDVEWGQLDAAQRTFLSSNLTPCVLFRSPCTGCPLFEPELIYQLDRREELWIVKKDLSQSSYPDDNTKP

SEQ ID NO: 20290 - protein, 81 aa, Cercocebus atys
GSDSVAFEDVAVNFTHEKWALLDSSQKILYREVMQETCRNLASVGNKWKDQNIENHFEKPGSQYGQVVSQIPNLDLNENIS

SEQ ID NO: 20291 - protein, 81 aa, Cercocebus atys
GLTFRDVAIEFSQEEWKCLNSTQRTLYRDVMLENYRNLVSLDLSRNCMIKELAPQWESDREEVFHTVTLEQHEKHDIEEFC

SEQ ID NO: 20292 - protein, 81 aa, Cercocebus atys
QESVTLEDVAVDFTWEEWQLLGPAQKDLYRDVMLENYSNLVAVGYQASKPDVFFKLEQGEPSWTIEDGIHSGACSEIWKVD

SEQ ID NO: 20293 - protein, 81 aa, Cercocebus atys
TFKEAVTFKDVAVFFTEEELGLLDPAQRKLYQDVMLENFTNLLSVGHQPFKQDVSPLERNEQLWIVTTATQRQRNLGEKNQ

SEQ ID NO: 20294 - protein, 81 aa, Cercocebus atys
TQESLTLEDVAVEFSWEEWQLLDTAQKNLYRDVMVENYNHLVSLGYQTSKPDVLSKLAHGQEPWITAAKIQNKNCPGIGKV

SEQ ID NO: 20295 - protein, 81 aa, Leptonychotes weddellii
LQELVSFEDVVVNFSWEEWQDLDDAQQTLYRVVMLETYSSLVSLGHCITKPEVIVKLEQGAEPWTVEEAPTQSLPDVQTAD

SEQ ID NO: 20296 - protein, 81 aa, Leptonychotes weddellii
SSQGLLTFRDVAIEFSQEEWGCLNHTQRELYRDVMLENYGHLLFLGLIVSKPDLVSFLEQKKDPWDVKRKKTVAFHPGRWE

SEQ ID NO: 20297 - protein, 81 aa, Leptonychotes weddellii
PQESVTFKDIAVDFTQEEWALLDTSQRKLYRDVMLENISHLVSVGYHLCKSDVISQLEQGVELWREGRGFPQGLNPDRKSG

SEQ ID NO: 20298 - protein, 81 aa, Leptonychotes weddellii
MLENYSHLVSVGCCIPKPEVILKLEQGEQPWILEEESPSQSYPEVCKVDNQLEKNQETQDRHFCQPPFINNKTLTMHRGNV

SEQ ID NO: 20299 - protein, 81 aa, Leptonychotes weddellii
SQGLVTFEDVAVYFSLEEWERLDADQRDLYKDVMQENYGILVSLGYPIPKPDLIFRLEQGEEPWVPDSPRPDEGDIVTGVY

SEQ ID NO: 20300 - protein, 81 aa, Leptonychotes weddellii
APGLVTFEDVAVYFSREEWGLLNLTQRSLYRDVMLENFALIGSLGFAPSRSHVVAQLESEEELWVPNMVDLTLGSRAEVRK

SEQ ID NO: 20301 - protein, 81 aa, Felis catus
SQVSLTFEDVAVLFTRDEWRKLGPFQRNLYQDVMLENYSNLVSLGLLFSKPKVISLLQQGDDPWKVEKESPGGPSLGWKGS

SEQ ID NO: 20302 - protein, 81 aa, Leptonychotes weddellii
TQDSVAFEDVTVKFTMEEWALLDPSQKKLYRDVMQETFRNLASIVCISEEKWEIHDSEDQNENRGTDLSQMVERLCKSKEC

SEQ ID NO: 20303 - protein, 81 aa, Felis catus
YLLQGLLTFRDVAVEFSQEEWGCLNHSQQELYWDVMLETYGHLLFLGLVSKPDLVIFLEQKRELWDVKREETVATHPGRWE

SEQ ID NO: 20304 - protein, 81 aa, Leptonychotes weddellii
NFWILRLPPGSKGEAPKEWGKLDEWQKELYKHVMRGNYETLVSLDYAISKPEVLSQTEQGKEPCSWRRTGPKVPDVPVDPS

SEQ ID NO: 20305 - protein, 81 aa, Leptonychotes weddellii
QDSVTFEEVAVDFSQEEWALLDPAQKILYRDVMLENYRNLASVGYPLCKHSLIMEVEQEVLGTEEGAVLQGAYTDWDIQLK

SEQ ID NO: 20306 - protein, 81 aa, Neomonachus schauinslandi
SRVSVTFEDVAVLFTRDEWRKLGPSQRNVYQEVMLENYSNLVSLGLLFSKPKVISLLQQGEDPWRVEKESPGGPSLGWKSS

SEQ ID NO: 20307 - protein, 81 aa, Felis catus
MAEGFKFKDVAIYFSQKEWECLHPSQKGLYRDVMLENYNNLISLGLSDSKPNVISLLEQGKEPWMVKSKETKEWCPDWESR

SEQ ID NO: 20308 - protein, 81 aa, Neomonachus schauinslandi
SQSLLTFEEVAMYFSQEEWELLDPTQKALYNDVMRENYETIISLAVPIHQILAFSEKTNTKDWTVAPEFVLPESQSLSLTF

SEQ ID NO: 20309 - protein, 81 aa, Neomonachus schauinslandi
LMEAVTFGDVAVHFSREEWQCLDPGQRALYKEVMLENHSSVAGLAGFLVFKPELISRLEQGQEPWVIDLKGVEGREGARTC

SEQ ID NO: 20310 - protein, 81 aa, Neomonachus schauinslandi
FQGSVTFRDVAIDFSQEEWEWLQPAQRDLYRHVMLENYGHLVSLAGLNISKPYVVSLLEQGREPWLEKGDVRRDLFSESNG

SEQ ID NO: 20311 - protein, 81 aa, Cebus imitator
LVMFQDLSIDFSQEEWECLNPAQKDLYRDVMMENYNSLLSLDLKFRCKTKYSCLPKEIYEVTSSQWVRMEKRHSLVGSSIR

SEQ ID NO: 20312 - protein, 81 aa, Cebus imitator
MLENYGNLTAMGYPVPKPALISLLEGGDVAWDLEAQDDPLAEGTKNICKDAETNTDGESALTQKISEERDGMMSHGQLRSV

SEQ ID NO: 20313 - protein, 81 aa, Cebus imitator
AQEQVTFWDVAVYFSREEWECLEPSQRALYRDVMLDNFSNVAALGFCSPRPDLLSRLEQWEEPWVEDQERPELQAVQRGPH

SEQ ID NO: 20314 - protein, 81 aa, Cebus imitator
FQKPVTFEDVAVNFTQEEWDFLDASQRVLYQDVMSETFKNLASVARMFLHKPELITKLEQQEKQWRVTRVLQASRGGPPFF

SEQ ID NO: 20315 - protein, 81 aa, Macaca mulatta
LQASVSFQDVTVEFTQEEWQHLGPLERTLYRDVMLENYSHLISVGYCITKPKVISRLEQGEEPWSLEDEFLNQKHQGYFKV

SEQ ID NO: 20316 - protein, 81 aa, Callithrix jacchus
FQGRLTFKDVSVEFSSAEWKCLTPAQRALYRDVMLENYRNLESVGEENVPPDTRNPLHTGEKPYKCNECGKTFSQNSSLVM

SEQ ID NO: 20317 - protein, 81 aa, Monodon monoceros
VMFQVTFSDVAIDFSHEEWGWLDPTQRNLYKDVMVQNYENLVSLGLSIPKPYVIALLEDGKEPWMVEKKLSKSLFPDWKSR

SEQ ID NO: 20318 - protein, 81 aa, Callithrix jacchus
FQETLTFRDVAIEFSLEEWQCLDTAQQSLYRNVMLENYRNLVFLGENNFNTQFLIYSKTMCYFPKNLWPEQDMKGSSKQVI

SEQ ID NO: 20319 - protein, 81 aa, Macaca mulatta
EMGLLTFRDVAIEFSLEEWQHLDIAQQNLYRNVMLENYRNLAFLGIAVSKPDLIICLEQGKEPWNMTQHEMVDESPGICPR

SEQ ID NO: 20320 - protein, 81 aa, Callithrix jacchus
MGPLTFMDVAIEFSLEEWQLLDTAQQNLYRDVMLENYRNLVFLGTAFSKPDLITYLEQGKEPWNMKRHETVAKPPAMCSYF

SEQ ID NO: 20321 - protein, 81 aa, Macaca mulatta
MGVLTFRDVAIEFSLEEWQCLDTAQQNLYRNVMLENYRNLVFLGIGVPKPDLITCLEQGKEPWNMKRHKMVAKPPVVYSHF

SEQ ID NO: 20322 - protein, 81 aa, Bos taurus
GISVSKPDVISLLEQGKEPWMVKEEGPRGACPGWEYTFKNKEFPSKQVIYEESSKVMMMGRSHLSYNLNCSSWRGDSKSKD

SEQ ID NO: 20323 - protein, 81 aa, Bos taurus
MKVILNLLLFHVTLYFFPSVQDVSFLFFFFFLGCFISKPDVISLLEQGKEPWKVVRKGRRQYPDLETNYEIKKLSSENDIY

SEQ ID NO: 20324 - protein, 81 aa, Ovis aries
SQDSVTFADVAVYFTQEEWTLLNPFQRKLYRNVMLENYKNLTTAGYQAFKPTLVSWLEQDVLKTVERGILQEWEMQPISND

SEQ ID NO: 20325 - protein, 81 aa, Ovis aries
PVTFKDVAVDFSQEEWGQLGSPQRALYRDVMLENYQNLLSLGPPVCKPDVISHLERGEEPWRAPRFLPEPGREPGPEAEET

SEQ ID NO: 20326 - protein, 81 aa, Ovis aries
SQSPLTFGDVAVEFSGEEWAWLDSAQRSLHRSVMLENYRNLASLGLCLSKPEMISSLEQRKEPWAVKRKSTGGECADSQTL

SEQ ID NO: 20327 - protein, 81 aa, Ovis aries
QQRPVSFKDVVVGFTQEEWHGLNPAQRALYRDVMLETYSNLVSVGYKGTKPYVILQLEQEEAPWICEAACSGCHCQENIWQ

SEQ ID NO: 20328 - protein, 81 aa, Ovis aries
FQGRLTFQDVAIDFTEEEWECLDLGQRELYRDVMLENYRNLASLGLVVSKPDLVTVLEQMKTPWDVRRLETPAVYTGRGQW

SEQ ID NO: 20329 - protein, 81 aa, Otolemur garnettii
PVTIEDVVVDFTQEEWQHLDPARKTLHRDVMLDTCCHLVSVGCSGIKPVLVFRIICGELSCQREIMQRSPKDNLLYSILKA

SEQ ID NO: 20330 - protein, 81 aa, Otolemur garnettii
KQGVLTFKDVSIEFSVEEWACLDPAQQHLYREVMLETYRHLVFLDLAVSKPDLITCLEQSKEPWKVKTQQTLVKHPDTSMS

SEQ ID NO: 20331 - protein, 81 aa, Otolemur garnettii
FQESLTFRDVVINFSRHEWNYLSIAQKTLYRDVMMENYGNLVSLAGPSMSKPHIITLLEQGKEPWMVVREETRRECTGKSK

SEQ ID NO: 20332 - protein, 81 aa, Vulpes vulpes
MLENYSHLVSLGLNISKPYVVSLLEQGKGPWLEKGDLRRDLFSESHGEIKEFSPNNVICEYDSSQYLVVERILNQDPDHSS

SEQ ID NO: 20333 - protein, 81 aa, Vulpes vulpes
PQGPVTFEDVAVYFPQSQWTSLDPMQRALYREVMLENYANITSLAAFPFPKPDLIFQLERGEAPWGLDPWIPTEGEALGGV

SEQ ID NO: 20334 - protein, 81 aa, Otolemur garnettii
VTFRDVVISFSQEEWEYLDSDQRDLYWDVMMENYSNLVSLDLESRNETKSLSGGKDVIKNHDCRCEIMESSKLFSLKSSIF

SEQ ID NO: 20335 - protein, 81 aa, Vulpes vulpes
AQESVMFSDVSIDFSQEEWECLNDDQRDLYRDVMLENYSHLVSMGHSVSKPDVISFLEQGKEPWLVDRELTRDQWPVLESR

SEQ ID NO: 20336 - protein, 81 aa, Enhydra lutris
LPDLVTFEDVAVEFTQEEWALLDPSQRTLYRDVMQENCRNLASLGYHVDKPSLISQLEQEDKVVTEERGILPGSCPDLDTV

SEQ ID NO: 20337 - protein, 81 aa, Enhydra lutris
LLQGLLTFRDVAIEFSQEEWGRLTHTQWELYRDVMLENYGNLLSLSLVVSKPDLVIFLEQKRELWDVKGKETVAIHPGRWE

SEQ ID NO: 20338 - protein, 81 aa, Pongo abelii
RPGAVSFADVAVYFSPEEWGCLRPAQRALYRDVMRETFGHLGALGFSGPKPAFISWVEGEVEAWSPEAQDPDGSRDGNEEK

SEQ ID NO: 20339 - protein, 81 aa, Pongo abelii
MLETYNHLVSLEIPSSKPKLIAQLERGEEPWGEERKCPLDLCPESKPEIQLCLSRPLIFSSQQALSQHVWLSHLSQLFSSL

SEQ ID NO: 20340 - protein, 81 aa, Pongo abelii
SKESVSFKDVAVDFTQEEWGQLDSPQRALYRDVMLENYQNLLALGPPLHKPDVISHLERGEEPWSMQREVPGGPCLEWELK

SEQ ID NO: 20341 - protein, 81 aa, Pongo abelii
FQGPVTLKDVIVEFTKEEWKLLTPAQRTLYKDVMLENYSHLVSVGYHVNKPNAVFKLKQGKQPWILEVEFPHRGFPEDLWS

SEQ ID NO: 20342 - protein, 81 aa, Pongo abelii
TLKEAVTFKDVAVVFTEEELRLLDLAQRKLYQEVMLENFRNLLSVGHQPLHRDTFHFLKEEKFWMMETATQREGNLGGKIQ

SEQ ID NO: 20343 - protein, 81 aa, Pongo abelii
TGEDVTFSDVAIDFSHEEWGWLNSAQRDLYKDVMVQNYENLVSVGLSVTKPHVIMLLEDGKEPWMMEKKLSKGMIPDWESR

SEQ ID NO: 20344 - protein, 81 aa, Pongo abelii
MFKEAVTFKDVAVAFTEEELGLLGPAQRKLYRDVMVENFRNLLSVGHQPFKQDVSPIERNEQLWIVTTATRRQGNLGEKNQ

SEQ ID NO: 20345 - protein, 81 aa, Vulpes vulpes
SVGPVSFKDIAVDFTQEEWQQLDPEQKTTYRDVMLENYDHLVSVGCHIIKPEVIIKLEQGEEPWIVGGEFLPQSYPEEVWK

SEQ ID NO: 20346 - protein, 81 aa, Otolemur garnettii
LQELLTFKDVSVEFSVDEWACLDPAQQTLYRDVMLENYRHLVFLGLTPSKPHLITCLEQSKEPWKVKAYQTVVKHPAVSNH

SEQ ID NO: 20347 - protein, 81 aa, Otolemur garnettii
THELVLFRDVAIDVSQEEWECLNPAQKNLYKDVMLENYSNLVSLGKTLSQKKKKKKSVLREDSWLSAYSSVGLWPHTLGLE

SEQ ID NO: 20348 - protein, 81 aa, Vulpes vulpes
VQGSMSFEDVIVVFTQDEWQYVSPAQRTLYRDVMLENYSHLISVGYCTTKPKIIFKLEQGEESASLGEEFLNQRYLGYFSV

SEQ ID NO: 20349 - protein, 81 aa, Otolemur garnettii
LQGPVSFKDVAVDFTQEEWHQLDPEQKIIYRDVMLENYSNLVSVGYHIIKPDVIMKLEQGEEPWIVEGEFLLQSYPDFFLG

SEQ ID NO: 20350 - protein, 81 aa, Otolemur garnettii
FQGMLTFKDVSIEFSMDEWACLDPAQQNVYRDVMLENYRHLVFLGLAVSKPDLISCLEQSKEPWKVKSYQTVVKHPGRFEG

SEQ ID NO: 20351 - protein, 81 aa, Otolemur garnettii
SELFRDVAILFSQEEWQWLVPAQRDLYRDVMLETYSNLVSLVLESGCDAKVLSPKQHIYEVESPQWEIVESLTGYSLECSS

SEQ ID NO: 20352 - protein, 81 aa, Otolemur garnettii
AHDLMMFRHVAVDFSQEKWECLNSYQRNLYRDVILENYSNLVSLDCSISKPDVITLLEQGKEPWMVVRDEKRRWSLDLGSK

SEQ ID NO: 20353 - protein, 81 aa, Otolemur garnettii
LQGTVTFKDVAINFTQEEWKQLDPAQRNLYRNVMLENYKNLIIVGCPFTKPDVIFKLEQEEEPWVLEEEVLRRHCPGEIWG

SEQ ID NO: 20354 - protein, 81 aa, Otolemur garnettii
QGSVSFKDVAIDFSREEWQHLDPSQRNLYWDVMLETYSHLLSVGYQLPKGEAGMLEQGKEPWALQGENPHQSCPGEKLLDH

SEQ ID NO: 20355 - protein, 81 aa, Otolemur garnettii
MYFSQEEWELLDPTQKALYNDVMQENYETIISLALFVLPKPKVISCLEQGEDPWVQVSLEFKDSAGESSTGLMLQNDTENH

SEQ ID NO: 20356 - protein, 81 aa, Vulpes vulpes
MAAAAALGDPAQEEWGLLDEAQRLLYCDVMLENFALIASLGLTSFRSYIVAQLQMGAEPWVPDRVDMTSAMARGAYSGPIS

SEQ ID NO: 20357 - protein, 81 aa, Otolemur garnettii
QESVSFEDVTVEFTQEEWQHLGPAQRTLYRDVMLENYSHLVSLGYCITKPKVIFKLEQGEEPWSLEDEFLSQKYPGYYKID

SEQ ID NO: 20358 - protein, 81 aa, Pan troglodytes
QEGVNFKIVTVDFTQEEQGTWNPAQRTLDRDVILENHRDLVSWDLATAVGKKDSTSKQRIFDEEPANGVKIERFTRDDPWL

SEQ ID NO: 20359 - protein, 81 aa, Pan troglodytes
PQVSLTFEDVAVLFTRDEWRKLAPSQRNLYRDVMLENYRNLVSLGLPFTKPKVISLLQQGEDPWEVEKDSSGVSSLGSKSS

SEQ ID NO: 20360 - protein, 81 aa, Pan troglodytes
QDSVTFDDVAVDFTPEEWALLDTTEKYLYRDVMLENYMNLASVDFFFCLTSEWEIQPRTKRSSLQQGFLKNQIFSGIQMTR

SEQ ID NO: 20361 - protein, 81 aa, Pan troglodytes
EKGPLTFRDVAIEFSLEEWQCLDSAQQSLYRKVMLENYRNLVFLAGIALTKPDLITCLEQGKEPWNIKRHEMVAKPPVICS

SEQ ID NO: 20362 - protein, 81 aa, Myotis davidii
CGESLSFKDIVMGFTWEEWQLLDPAQKCLYRDVILENYRNLVSIGYHGTKPDLIFKLEQGEEPWIGNAKSSHQSCPEDWKE

SEQ ID NO: 20363 - protein, 81 aa, Myotis davidii
VIFEDIALYFSREEWSLLDEGQRQLYLNVMLENFEIISSLGCCCRAGNVEAQLEENIAVRVSQAKNPKLALSSQKSHHPCE

SEQ ID NO: 20364 - protein, 81 aa, Myotis davidii
VTFEDIALYFSREEWSLLDEGQRQLYLDVMLENFELLSSLGCCCGGESVEETTEQKVSVRLSQTRNPKLALSSQKSHPCES

SEQ ID NO: 20365 - protein, 81 aa, Cercocebus atys
PQGLLTFRDVAIEFSQEEWKCLDPAQRTLYRDVMLENYRNLVSLEFQSVTQAKVQCDLGSLQPPLPRFKQFSCLSLPSSWD

SEQ ID NO: 20366 - protein, 81 aa, Cercocebus atys
DSVTFDDVAVDFTQEEWTLLDPTQRSLYSDVMLENYKNLAIVGWEMQLETQWSALQQDSLTGQTSIGMQLEGKHNGGELCD

SEQ ID NO: 20367 - protein, 81 aa, Myotis davidii
AVTFQDVAVVFTEEELGLLDPSQRKLYQDVMLENFRNLVSVGYRNQNEIETLQQVGLRDLFQEDLVCWPIWEQIMSKLTRN

SEQ ID NO: 20368 - protein, 81 aa, Cercocebus atys
MGPLTFRDVTVEFSLEEWQCLDTAQRNLYRDVMLENYRNLVFLGIAVSKPDLITCLEQGKEPWNMKRHEMVDKPPVMCSHI

SEQ ID NO: 20369 - protein, 81 aa, Cercocebus atys
QGRLTFRDVAIEFSLAEWKCLNPAQRALYREVMLENYRNLESVDISSKCMMKEILSTGQGNTEVLHTGTLQRHESHHIGDF

SEQ ID NO: 20370 - protein, 81 aa, Cercocebus atys
LQELLTLEDVTVEFTWEEWQLLDPFQKDLYRDVMLEIYSNLVSMGYQVSKPDALSRLERGEEPWTMEDERHSQICPENNKV

SEQ ID NO: 20371 - protein, 81 aa, Leptonychotes weddellii
HGSPPFSNVTVAFTQDGWRHLIPAPRGTPRFKEGIPENARNLVLLGLPVSQPGMNSQLEQREEGPWMLEGGGLRSTCPDWK

SEQ ID NO: 20372 - protein, 81 aa, Leptonychotes weddellii
AQISVTFDDVAVTFTQEEWGQLDPAQRTLYQEVMLENCGLLVSLGCPVPRPELIYQLEHGQELWTVKRDLSQITYPGDKGK

SEQ ID NO: 20373 - protein, 81 aa, Felis catus
REESLTLEDVAVDFTWEEWRLLAPAQKDLYWNVMLENYRNLVSLGYQARQPDSLSELEQEEPPWIFKDEVQSQTHPEIERV

SEQ ID NO: 20374 - protein, 81 aa, Felis catus
MLVTFDDVAVTFTQEEWGQLDAAQRTLYQEVMLETCRLLVSLGCSLPKPEQIYPLERSPELWTLQRGLSSSNCPGDNIKPE

SEQ ID NO: 20375 - protein, 81 aa, Felis catus
APDSMSFEDVAVYFSWEEWRLLDEAQRCLYHDVMLENFALISSLGCCCGAEDAEAPLEQSVSVGVSQASTPKAALSSRKTH

SEQ ID NO: 20376 - protein, 81 aa, Felis catus
MVQESVTFKDVVVLFTQDEWAQLSPTQRALYRDVMLENYSNLVSLGLLGSQPDVLSQLGKGEEWMLEDTSAGFCLDWMTMP

SEQ ID NO: 20377 - protein, 81 aa, Felis catus
GRLTFRDVAIEFSQEEWECLDPCSEGLYRDVMLENYRNLVSLGIPSDGFAIKELSPTEDINKGEFYHLVILERNESYGIKD

SEQ ID NO: 20378 - protein, 81 aa, Neomonachus schauinslandi
SQESVTFQDVAVDFTEKEWPLLDSSQRKLYKDVMLENYSNLASVGYQVGKPSLISHLEQEEELRTEERALHRATSPDWETP

SEQ ID NO: 20379 - protein, 81 aa, Neomonachus schauinslandi
MAHLMMFRDVAVDFSQEEWECLGLEQRHLYRDVMLENYSNMISLGLCIYQPDVFSLLEKGKEPWMVLQDETRGPCPDMQSR

SEQ ID NO: 20380 - protein, 81 aa, Neomonachus schauinslandi
MYFTREEWNKLERAQKDLYRDVMLENYRNMILLGFQFPKPEVICLLEQWEEPWILDLPRAGTRKASSSACPGSEARCKTKK

SEQ ID NO: 20381 - protein, 81 aa, Neomonachus schauinslandi
AGRPAEMAVSEPGGSAAEWEQLDPAQRNLYKDVMLENYSNLASMGYQAPKPDMISKLEKGEEPWLGKGKRPRQGGPSEIAR

SEQ ID NO: 20382 - protein, 81 aa, Neomonachus schauinslandi
MFRDVAIDFSQEEWEYLDSAQRDLYRDVMLENYSNLVSLVDLPSRSANKDLSPKKDTYETELSQWEMSARLENCDLEESSS

SEQ ID NO: 20383 - protein, 81 aa, Neomonachus schauinslandi
TARSQASVTFKDVAMDFTPEEWGKLDPAQREVMLENYRNLVSLWLPVSKPENYNLENGKEPLMLERKAPKSSYSDLETKPE

SEQ ID NO: 20384 - protein, 81 aa, Neomonachus schauinslandi
MDSVVFEDVVVDFTQEEWALLNPAQRKLYKDVMLETFRNLVSVDDETQLKTNGSISQQDIFGEKLSNEQKIAMFTKNDFWT

SEQ ID NO: 20385 - protein, 81 aa, Neomonachus schauinslandi
FQESVTFKDVIVDFTQEEWKQLDPVQRDLFRDVTLENYTHLVSIGLQVSKPDVISQLEQGTEPWIVEPGIPVGASGDCETR

SEQ ID NO: 20386 - protein, 81 aa, Neomonachus schauinslandi
MFKETVTFKDVAVAFTEEELGLLDSAQRKLYQDVMLENFRNLVSVGHQPFKQDQWHIEREERLWLMKTATQIERNVGGNNQ

SEQ ID NO: 20387 - protein, 81 aa, Neomonachus schauinslandi
SLDSVTFTDVAIDFSQDEWEWLNLAQRSLYKKVMLENYRNLLSLGLCISKPDVIALLEQGKEPWMMKGEMTGGLCPDLEYI

SEQ ID NO: 20388 - protein, 81 aa, Monodelphis domestica
QVPVTFEDLAVRFSAEEWHLLEEWQREFHRDVMRENYEMLVSLGTAQLLPLSAFLSLTEPQEDMGDNGCSDGEWERPGGGL

SEQ ID NO: 20389 - protein, 81 aa, Monodelphis domestica
MLQRTIRMNTEKKSSGIPVSKPNVITLLEQGKEPWILEKELPRDTSAGLPIPKPKLISRTEQGKEPRMLEKEVPGSTSADI

SEQ ID NO: 20390 - protein, 81 aa, Camelus dromedarius
MLLQISFEDVAVDFTLEEWQLLNPTQKNLYREVTLENYSNLMFLGYQIFKPDAIFRLEREKPWVADEETLSQGFSALTQDE

SEQ ID NO: 20391 - protein, 81 aa, Camelus dromedarius
PQGRVTFEDVAVYFSWDEWGLLDETQRLLYRSVMLENFALMASLGFTSSRTCEITELERWEEPFLPPPGVRAAAVPRDHPV

SEQ ID NO: 20392 - protein, 81 aa, Cercocebus atys
TCDEAVTFKDVAVVFTEEELELLDPAQRKLYQDVMLENFRNLLSVGHQPFHGDTFHFLREEKFWVMETTSQREGTPGTILL

SEQ ID NO: 20393 - protein, 81 aa, Cercocebus atys
FQGMVTFKDVAVVFTREELGLLDLAQRKLYQDVMLENFRNLLSVGYHPFKLDVILQLGREDKLWLTETEIQGDGCSGENHA

SEQ ID NO: 20394 - protein, 81 aa, Cercocebus atys
GGLLTFRDVAIEFSQEEWKCLDPAQRTLYRDVMLENYRNLVSLDVSSKCMLKTLSSTGRGNTEVILIGTLQTQASHHTGEF

SEQ ID NO: 20395 - protein, 81 aa, Cercocebus atys
MESVTLEDVAVEFIQEWALLDSARRSLCTYGMLDQCRTLTSRGTPPCKPSRVSQLGPRAEPRATERGILHATGVAWESQLK

SEQ ID NO: 20396 - protein, 81 aa, Cercocebus atys
PQGLLTFRDVAIEFSQEEWKCLDSAQRTLYREVMLENYRNLVSLDISSKCMMEFLSTAQSNREVIHTGTLERHESHHIGDF

SEQ ID NO: 20397 - protein, 81 aa, Cercocebus atys
MEGLVMFQDLFIDFSQEEWECLDTAQKDLYRDVMMENYSSLVSLGLCIPKPDVISLLEQGKEPWMVSRDVLGGWCPDSEFR

SEQ ID NO: 20398 - protein, 81 aa, Leptonychotes weddellii
PQDLMTFEDVAVEFTQWEWGQLDLAQKDLYRAVMLENFKNLASLGLPVSKPYVISQMEEGKEPYVLEGEISTEWEQGCDLW

SEQ ID NO: 20399 - protein, 81 aa, Felis catus
MLENYGTLVSLGIPSSTPKVICRLQQGKDPCVVERETPQDACLGFKTWPEMEASPPRQDISIEETSQGIIKKKSIKFGHWD

SEQ ID NO: 20400 - protein, 81 aa, Leptonychotes weddellii
AQASVSFKDVTVEFTQEEWRQMNSAQRALYRDVMLENYSHLVSVGYCFTKPELIFTLEQGEDPWLLKKEFLRKSSPEDSQP

SEQ ID NO: 20401 - protein, 81 aa, Leptonychotes weddellii
AREPVTYEDVAVDFTQEEWQHLDPAQKTLHRDVMLEIYSHLVSVGCSGIKPGIIFKLEHEEDPWIIKSELSRWIHSDREKS

SEQ ID NO: 20402 - protein, 81 aa, Leptonychotes weddellii
SQSPVTFEDVAVYFSKEEWGLLDETQRRLYHHVMLENFELMTSLGCWHGVEDEGAHSKQNTSVEGMSQVRIPSANPSTQKA

SEQ ID NO: 20403 - protein, 81 aa, Felis catus
TQVSVTFDDVAVTFTQEEWGQLDPAQRTLYQEVMLENCGLLVSLGCPVPRPELICQLERGQEPWTAKRGLSQNIYPGDKDK

SEQ ID NO: 20404 - protein, 81 aa, Felis catus
PHWLVTFRDVAIDFSQEEWECLNSTQRDLYRDVMLENYSNLISLAGCAIPKPDVFSLLEQGKDPWMVTRAMTRRWSSDLES

SEQ ID NO: 20405 - protein, 81 aa, Neomonachus schauinslandi
GQGSVSFKDVTVDFTQDEWLQLTGTQRTLYRDVMLENYSHLVSVGCHLTKPDVIFRLEQGEELWPSEGEFPDQGDQGEKPS

SEQ ID NO: 20406 - protein, 81 aa, Neomonachus schauinslandi
MLENYRNLVSVGYMASKPDALSRLEQGELWTTEHEIPSRIRPEIKKDDGHLQGHLQNQRCPKRMKQCHEHNAFGNVIHQSK

SEQ ID NO: 20407 - protein, 81 aa, Neomonachus schauinslandi
AQVPLTFSDVAIDFSQEEWECLNSDQRDLYRDVMLENYTNLVSLDIDFTTETNKLSSEKSSYEVNSYHRETMKKSKTFNLM

SEQ ID NO: 20408 - protein, 81 aa, Neomonachus schauinslandi
QGSVTFEDVVVYFSWEEWGLLDETQRCLYHDVMLENFALVISLGCWYGMEDEEAVSVQEMALSKTPSPDSSVWRAQPCEKC

SEQ ID NO: 20409 - protein, 81 aa, Neomonachus schauinslandi
PQEPVTFEDVAVYFTQNQWASLDPTQRALYREVMLENYASVASLVFPFPKPDLVSQLERGEAPWGPDPWEAEVLRGICPGG

SEQ ID NO: 20410 - protein, 81 aa, Monodelphis domestica
SQASVTFQDVAVNFSRDEWKRLNEAQRALYKEVMLENYQNMVSLGLPVSEEEVKVLFERAEAPRRSKRRASGTLTPDSISQ

SEQ ID NO: 20411 - protein, 81 aa, Monodelphis domestica
AQEVVSFKDVAVDFTREEWRLLSPPQKELYKEVMLENARNLLSVGLPAPSEEVISYLEQREAPWILEQEGLRNCCSEGEIR

SEQ ID NO: 20412 - protein, 81 aa, Monodelphis domestica
FQASLMFEDLAVYFSREECVSLDPSQNSLYWESVPKNCKDLSPFGDNSEKEEENFHQENGELEAVSSEWYKRDISLLPKLG

SEQ ID NO: 20413 - protein, 81 aa, Monodelphis domestica
PQRPVTFGDVSVDFSRDEWRRLSPAQRLLYRDVMLENFGNLVLLGLAVSKPELIRRLERGEAPWLPGRGASRAASPGSARS

SEQ ID NO: 20414 - protein, 81 aa, Physeter macrocephalus
QVSMAFQDLAVRFSKDEWRLLGQGQRALYLDVMRENYETLASLGTVELLPLSAFLSPSEPGGAMGGGSCAGDGQEPPRGGG

SEQ ID NO: 20415 - protein, 81 aa, Monodelphis domestica
SVTFKDVAVNFTQEEWQQLNPAQRDLYRDVMLENYRNLISLGKESKPEAQGSTPKQKISEEVESSGMLMERFTREVPVSED

SEQ ID NO: 20416 - protein, 81 aa, Monodelphis domestica
RQESMTFKDVAVEFTWEEWRYLNPSQKKLYRDVMLENYRNLVFLGFAISKPEVIHHLERKEAFWRPESDIPRNNCPESKEF

SEQ ID NO: 20417 - protein, 81 aa, Physeter macrocephalus
NFWVLRLPPGSKGEAPKEWGKLDECQRELYKHVMRGNYETLVSLDYAISKPEVLSQIEQGKEACSWRRAGPKVPDVPVDPS

SEQ ID NO: 20418 - protein, 81 aa, Monodelphis domestica
MAVMLENAQNFFFLGLLFPRESNISCFQPGEAPWMQESEGPRNSCPEIKFKVKEMGTKLSIFAEESHHEKSIGHASCDFSL

SEQ ID NO: 20419 - protein, 81 aa, Monodelphis domestica
PAQEVVTFQDVAVDFTRGEWRLLSPPQKELYKEVMLENAWNLLSVGLAVPRDVISYVEPREAPWRLEQEGLRSCSPGEIRP

SEQ ID NO: 20420 - protein, 81 aa, Monodelphis domestica
AQEVVTFKDVAVNFTREEWRLLTPPQKRLFKEVMLENAQNLLSVGLPGPPEEVISYLEQREAPWMLEQEDPRSPEGEIRLE

SEQ ID NO: 20421 - protein, 81 aa, Monodelphis domestica
PGQVVTFKDVAVDFTWEEWCLLSPPQKELYKEVMLENAHNLLSVGLPAPPEGVLSYLEQREAPWMLEQEGLRSCCPEGEIR

SEQ ID NO: 20422 - protein, 81 aa, Monodelphis domestica
FQGFITFKDVTVDFTQEEWHLLDHSQKDLYREVMLENVQNLLSVGLPVSREDFISSFQRREGTWLLEQKRLKSSYPGAQTN

SEQ ID NO: 20423 - protein, 81 aa, Physeter macrocephalus
YQGLVSFEDVAVNFTWEEWQDLDAAQRTLYRDVMLENYSSLVSLGHCITKPEVIIKLEQGAAPWTVKETPDQGSPDVQIVD

SEQ ID NO: 20424 - protein, 81 aa, Monodelphis domestica
QVVTFKDVAVEFTREEWCLLSPPQKELYKEVMLENSQNLLSMGEIIPEMKVNPTEMIPPVEEMDIQRFMSVGPNIFASREF

SEQ ID NO: 20425 - protein, 81 aa, Monodelphis domestica
FITFKDVTVDFMQEEWCLLDHSQKDFYGEVMLENVQNLLSVGLKEEEINYLNNPISEKEIEQAIKELPKEKKPQIQMDSQR

SEQ ID NO: 20426 - protein, 81 aa, Monodelphis domestica
PAQVVTFKDVAMEFTREEWCLLSPPQKELYKEVMLENARNLLSIGLPVPSEDILSYLEQREAPWMLEQEGLRCFCPGEIIP

SEQ ID NO: 20427 - protein, 81 aa, Monodelphis domestica
VVTFQDVAVDFTREEWRLLSPPQKELYKEVMLENVRNLLSVEGEIRPEMKVNPTEVILPVEDMNLQRFMSDGPDKFASKEF

SEQ ID NO: 20428 - protein, 81 aa, Physeter macrocephalus
EEDSVTCEDVAVNFTLEDWALLNPTQKKLYRDMMQETFRNWVCILGTKWDDDDIEEQYKNQGGKPRNHMVVRFSERKDHSP

SEQ ID NO: 20429 - protein, 81 aa, Monodelphis domestica
AQEVVTFKDVSVEFTREEWHLLSPPQKELYKEVILENAWNLLSVGFPVPSEDILSYLEQKEAPWMLEQKGLRSCCPGEEGE

SEQ ID NO: 20430 - protein, 81 aa, Monodelphis domestica
SQGSITFKDVAVDFTQEEWCLLDHSQKALHLEVMLENVQNLLSVGLPVPRENFISCFQQGKAPYLLQQNDPKSSSPEAETN

SEQ ID NO: 20431 - protein, 81 aa, Monodelphis domestica
AQEVVTFKDVAVEFTREEWCLLSPPQKELYKEVMLENVQNLHSVGLPAPPEDMIYYVEQRDSSWMLEQEGLRSCCPGKIRR

SEQ ID NO: 20432 - protein, 81 aa, Papio anubis
AQESVTFRDVAVFFSQDEWLHLDSAQRALYREVMLENYSSLVSLGIPFSMPKLIHQLQQGEDPCLEEREVPSDTCVGFKTW

SEQ ID NO: 20433 - protein, 81 aa, Aotus trivirgatus
METLTFRDVAIEFSLEEWQCLNPAQQNLYRNVMLENYRNLVFLAGIAVSKQNPITCLEKGKEPWNMKRYEIMAKPTAMCSY

SEQ ID NO: 20434 - protein, 81 aa, Aotus trivirgatus
PQGLLTFRDVAIEFSPEEWRCLDPAQRTLYRDVMLENYRNLVSLGKDNFPPEAGTCPCVCSYFPLLPPGSHILAGLKWKPY

SEQ ID NO: 20435 - protein, 81 aa, Camelus dromedarius
ELVTFRDVVISFSQEEWEYLDSAQRDLYWDVMMENYSNLVSLDLESKYDTKTLPIEKDIIEKNDFQWEVIESSTSAGLENS

SEQ ID NO: 20436 - protein, 81 aa, Camelus dromedarius
AQLTVAFDDVALYFLEQVWDILEKWQKEMYQQEMKTNYETLDSLGCAFSKPNLITWMEQGRMLFIRDQERLEKTRVTLRPS

SEQ ID NO: 20437 - protein, 81 aa, Camelus dromedarius
PQGPVTFGDVAVHFTQEEGARLHPGQRALYRDVMLETYRNLASLGGPGSKPDLISQLEQGKEPWGLEMLETKERETPGDPG

SEQ ID NO: 20438 - protein, 81 aa, Camelus dromedarius
NQDPVTFQEVAVDFSQEEWALLAPAQKILHRDVMLENYRNLASVGYHLRKPSLLTPEDLRAKKGRVLQDTCADQTSQLKTQ

SEQ ID NO: 20439 - protein, 81 aa, Myotis davidii
SMGSDLFRDVAVVFSREEWERLAPAQRDLYRDVMLETYSHLRSLDLAISKPDVIAFLEQGEEPWRAEEAARDGLCPVDWEC

SEQ ID NO: 20440 - protein, 81 aa, Myotis davidii
RDSVSFEDVAVNFSLEEWALLDSSQKKLYRDVMRETFWNLASIGNKWEDLDMEDQYKNQKRKQRSRMLERACDGKMVSQCG

SEQ ID NO: 20441 - protein, 81 aa, Myotis davidii
VNFEDVAIAFSEEEWVMLDEAQRLLYYDVMLEVFALVSSVGCWHKMEDEEACSDQHVCIQGESQVRTSKTALATHKNHLCK

SEQ ID NO: 20442 - protein, 81 aa, Cercocebus atys
KSLESVSFKDVTVDFSRDEWQQLDLAQKSLYREVMLENYFNLISVGCQVPKPEVIFSLEQEEPCMLDGEISSQSHPDGDIG

SEQ ID NO: 20443 - protein, 81 aa, Cercocebus atys
GTVTFEDVAVNFSQEEWSLLSEAQRCLYHDVMLENLALISSLGCWYGAKDETPSKQTLSIQQESPLRTHWTGVCTKKVHLW

SEQ ID NO: 20444 - protein, 81 aa, Cercocebus atys
EALPAKDSAWPWEGKPRYLGPVTFEDVAVLFTEAEWKRLNLEQRNLFKEVMLENLRNLVSLRLGSLRSGLLHLDMNLDLWL

SEQ ID NO: 20445 - protein, 81 aa, Cercocebus atys
KSLVTFEDVAVYFSQEEWELLDAAQRHLYHSVMLENLELVTSLGCWHGVEGEEAHPKQNISVEEVLPVRIPNTDSSTKKAN

SEQ ID NO: 20446 - protein, 81 aa, Cercocebus atys
MEHLTFRDVAIEFSPEEWKCLDPAQQNLYRDVMLENYRNLVSLGVAISNPDLVTFLQRKEPYNVKIHETVAKHPAMCSHFT

SEQ ID NO: 20447 - protein, 81 aa, Cercocebus atys
MNKAGYSMDVIVEFTKEEWKLLTFAQRTLYKDVMLENYSHLVSVGYHVNKPTAVFKLKQGKEPWILEVEFPHRVLPYLWSI

SEQ ID NO: 20448 - protein, 81 aa, Cercocebus atys
SQGSVSFKDVTVDFTQEEWQQLDPAQKALYRDVMLENYCHFVSVGFHMTKPDMIRKLEQGEELWTQRIFPSYSYLAEDGKT

SEQ ID NO: 20449 - protein, 81 aa, Cercocebus atys
LVTFRDVAIDFSQEEWECLDPAQRDLYRDVMLENYSNLISLDLESSRATKELSPEKEIYEMESLQWENMGELINHHLQYNG

SEQ ID NO: 20450 - protein, 81 aa, Leptonychotes weddellii
PLTFRDVAVVFTEEELRLLDRTQRKLYRDVMLENFRNLLSVGDKNEKEMEYIQERELKCLSSRELSYWKIWEQVTGELTGS

SEQ ID NO: 20451 - protein, 81 aa, Felis catus
SQGSLSFKDVTVGFTQEEWQCLDSSQRSLYRDVMLENYSHLVSVGSCATKPEVIFRLEQGEEPWISEEEFPSQSLPEDIEE

SEQ ID NO: 20452 - protein, 81 aa, Leptonychotes weddellii
SQGPVSFKDVAVDFTQEEWQYLDLPQRDLYRDVMLENYINLISVGYQTTKPSVIHKLEQGEEPWMVEREIPNWNYAEEVWQ

SEQ ID NO: 20453 - protein, 81 aa, Leptonychotes weddellii
LLQGLLTFRDVAIEFSQEEQGCLNHTQRELYRDVMLENYGHLLFLDLVVSKPDLVTFLEQKKELWDVKRKESIATHPGRWK

SEQ ID NO: 20454 - protein, 81 aa, Felis catus
RLGCVTFEDVAVRFSWEEWGLLDEAQRLLYRDVMLENFALMASLGLASSRSHEITQLEWWRQPSLPPRGVMTAAMPRGTWR

SEQ ID NO: 20455 - protein, 81 aa, Felis catus
SRGPLSFVDVFVDFTWEEWRLLDPAQKHLYRSVMLENYSHLVSLGYQDAKPDIIFKLEQGEELWMLQAQMPSQGHPEKVLE

SEQ ID NO: 20456 - protein, 81 aa, Leptonychotes weddellii
SYEGSVSFRDVAVDFSRDEWQHLDLAQRNLYRDVMLETYSHLLSVGYEVPQPEVFMLEQGKEPWALQGESPHQSCPGEKLW

SEQ ID NO: 20457 - protein, 81 aa, Felis catus
GSGTLLTFRDVAIEFSQEEWGCLNHSQRELYRDVMLETYGHLLFLGLTVSKPDLVIVLKQEKELWGVKRKETVASHSGRWK

SEQ ID NO: 20458 - protein, 81 aa, Felis catus
ESLSFEDVAVYVTREEWDKLDWAQKDLYRDVMLENYRNMILLGSEARWKMKKPTPGQKIFKDLESCKTSAIKQQAANGPSE

SEQ ID NO: 20459 - protein, 81 aa, Leptonychotes weddellii
QGPMLFEDLAVYFSQEEYVSLHPAQRSLSRDTTQECFEDMALMGGEGKTEISQQLNLESAGFEELAPENSSITVPLIYYPE

SEQ ID NO: 20460 - protein, 81 aa, Neomonachus schauinslandi
MTFRDVAIDFSQQEWEYLDSLQKNLYRDVMMENYDNLVSLGHSISKPDVITLLEQGKDPWMVVREDTRRWCTDLESRYEII

SEQ ID NO: 20461 - protein, 81 aa, Neomonachus schauinslandi
FEESVTFEDVAVYFSENEWTGLAPAQRVLYRDVMLENYGAVASLAFPFPKPALISQLERGEAPWCKAPQGALDGGGPRGIS

SEQ ID NO: 20462 - protein, 81 aa, Neomonachus schauinslandi
VQGSMSFEDVIVEFTQDEWQYMSPAQRILYRDVMLENYSHLISVGYCTTKPEMIFKLEQGEEPWSLEEEFLNQRYPGYFSV

SEQ ID NO: 20463 - protein, 81 aa, Neomonachus schauinslandi
DNVTLEDVAVYFSWEEWGLLDEAQRRLYHDVMLENLALITSLDCLCGIENEEVPSGQNVSLGRMPQIRSSEPNPSTEKVHF

SEQ ID NO: 20464 - protein, 81 aa, Neomonachus schauinslandi
GQGCVTFEDVTIYFSQEEWGLLDEAQRLLYCDVMLENFALIASLGLTSFRSHIVAQLQIGAEPWVPDRVDMTSAMARGAYS

SEQ ID NO: 20465 - protein, 81 aa, Monodelphis domestica
AQEVVAFKDVAVDFTKEEWCLLTPPQKELYKEVMLENAQNLLSVGLAVSRGDVISYFEQREAPWMLEQEDLGIGCPEGKIR

SEQ ID NO: 20466 - protein, 81 aa, Monodelphis domestica
CRESVTFQDVAVEFTWEEWGHLNPSQKKLYRDVMLENYKNLVSLGFAVSKPDVIYQLERNEASWTPEADISRSHCPENKEF

SEQ ID NO: 20467 - protein, 81 aa, Monodelphis domestica
AQEGLTFKDVAVDFTREEWCLLSPPQKELYKEVMLENAQNLLSVGLPGPPEDVISYLKQRKDPWMLEQEGLRSCCPEGEIR

SEQ ID NO: 20468 - protein, 81 aa, Monodelphis domestica
AQEVVTFQDVAVDFTRGEWRLLSPPQKELYKEVMLENAWNLLSVGLPALPEDVISYLEQREAPWMLEREGPRSCCPVCLEC

SEQ ID NO: 20469 - protein, 81 aa, Monodelphis domestica
GVLAARFQDVAVEFTWEEWRHLDPAQRTLHRNVMLENYENLVSIGIPISKLDLLFLLKREDVQNQEGEAGTGTCIEGKIRL

SEQ ID NO: 20470 - protein, 81 aa, Monodelphis domestica
SQESVTFKDVAVNFTQEEWQRLSPAQRDLYRDVMLENYRNLISLGLPISKPDMIFQLEQGEEPWRLDLQGNEEKAGPRNIS

SEQ ID NO: 20471 - protein, 81 aa, Physeter macrocephalus
ARMLVTYEDVAVTFTQEEWGQLDPAQRTLYQEVMLETCGLLVSLGYPLPKPELIHPLEHSPELQTSKRGLSPSSCPVRESG

SEQ ID NO: 20472 - protein, 81 aa, Monodelphis domestica
SQGSITFKDVAVDFTQEEWYLLDRSQKELYLGVMLENVQNLLSVEAELNFDVKDITKLSLFVEGYNPQRCMNEGPHDFILR

SEQ ID NO: 20473 - protein, 81 aa, Monodelphis domestica
GQVLVTFKDVAVDFTQEEWRLLDHSQKELYREVMLENAWNLHSVGLPISRDHVISRFEQGEAPWILEREGPSSSCPDGETR

SEQ ID NO: 20474 - protein, 81 aa, Monodelphis domestica
SQELITFKDVVLDFTKEESYLLDCSYKDLCMEVMLENVQNLLSVGLAVPRENFITSLQKGESPWLPEKKGQWSFYKEAETN

SEQ ID NO: 20475 - protein, 81 aa, Monodelphis domestica
GSITFKDVAVDFTQEEWCLLDPSQKELYRRVMLENVQNLLSVEAETNFEVKMSPKLSLLVERSDLPRGMNKDPCDFFLREI

SEQ ID NO: 20476 - protein, 81 aa, Monodelphis domestica
RQESIRFKDVAVYFTKSVWQLLDPSRKKLYKDVMLDNFRTLVSLGLEDDDTAVIDSLERGDALWIPEEEKRGIRCRDNEWR

SEQ ID NO: 20477 - protein, 81 aa, Monodelphis domestica
SQGSITLKDVAVDFTQEEWGLLDHSQKDLCLEVMLENIQNLLSVGLPMLREKFISCFQQGEAPWLLDKKDPRSSCSEAETT

SEQ ID NO: 20478 - protein, 81 aa, Aotus trivirgatus
SLESVSFKDVTVDFSRDEWQQLNVAQKSLYRDVMLENYFNLISVGCQVPKPEVIFNLEQEEPCMLNGGNSSQSCPDGKIGF

SEQ ID NO: 20479 - protein, 81 aa, Camelus dromedarius
FQESVTFEDVAIYFSENEWTGLAPAQRALYRDVMLENYGAVASLGYPFLKPAGVSHLEEVEEPLKRKLQGEGPSLICTEGV

SEQ ID NO: 20480 - protein, 81 aa, Camelus dromedarius
LSQAEVTFEDVAVLLSREEWGRLGPAQKGLYRDVMLETYRNLVSLGEAPCWDAAQGTALGTEGSAGAGLGASPPVPRDGHP

SEQ ID NO: 20481 - protein, 81 aa, Myotis davidii
MLENISHLVSLGYWICKSDVTFQLEQGEELWSEGTGFLQGQSAGYRICTSGVTFQLKPGEELRSEGTGFLQGQTAGMRDPF

SEQ ID NO: 20482 - protein, 81 aa, Myotis davidii
LQALVTFKDVLVNFTREEWRLLDAAQQVMYRDVMLENYRNLVSLGHRLPKPDVILQLEKGEEPWLVERGTRQDAHPDWDTA

SEQ ID NO: 20483 - protein, 81 aa, Cercocebus atys
KDVAVVFSEEELRLLNLAQRKLYRDVMLENFRNVVSVGEDRHSLTEHCKNLKEMETLQEVGLRYLSHEEFFCSQIWQQITR

SEQ ID NO: 20484 - protein, 81 aa, Cercocebus atys
FQGSISFKDVTVDFSQEEWQHLNPSQRALYRDVMLENYSNLVSVGYCVHKPEVISRLEQGEEPWRLEEEFPSQSFSEVWTA

SEQ ID NO: 20485 - protein, 81 aa, Cercocebus atys
EEALMAFRDVAVAFTRKEWKLLSSAQRTLYREVMLENYSHLVSLGIAFSKPKLIEQLEQGNEPWREENEHLLDLCPAQTAS

SEQ ID NO: 20486 - protein, 81 aa, Cercocebus atys
SHELLTFKDISVDFTQEEWGQLAPAYQNLYREVMLENYSNLVSVGYQLSKPSVISQLEKGEEPWMTEKEGPGDPSSDLKSK

SEQ ID NO: 20487 - protein, 81 aa, Cercocebus atys
RVTFKDVAVVFTKEELALLDKAQINLYQDVMLENFRNLISVGDGIKNNILNLQEKGLSYLSQEVLCCWQIWKQRIRDLTVS

SEQ ID NO: 20488 - protein, 81 aa, Cercocebus atys
MAQVTFSDVAIDFSHEEWAWLDSAQRDLYKDVMVQNYENLVSVGLSVTKPYVITLLEDGKEPWMVEKKLSKGMIPDWESRW

SEQ ID NO: 20489 - protein, 81 aa, Cercocebus atys
MLETYNHLVSLEIPSSKPKLIAQLERGEEPWREERKYSLDLCPDGVSLCCLGWSAVVLSRLTATSTSWVQAVLCLSLPRSW

SEQ ID NO: 20490 - protein, 81 aa, Leptonychotes weddellii
PQKSVTFEDVAVYFTQTEWDGLSPAQRALYRDVMLENYGNVASLGFSLLKPAVISQLEGADIDVQTDNNLIKEMYEEKHNT

SEQ ID NO: 20491 - protein, 81 aa, Leptonychotes weddellii
SVMFEDVAIDFTKEEWALLDISQQKLFRDVMLENISHLNSSPYTLFPPQTWNKICKRSFQLEQGKELWSEGQDFSKARVQH

SEQ ID NO: 20492 - protein, 81 aa, Leptonychotes weddellii
SSQGLLTFRDVAIEFSQEEWGCLNHTQRELYRDVMLENYGHLLFLGLIVWKPDLVIFLEQEKQLWDVKRKETVAFYPGRWE

SEQ ID NO: 20493 - protein, 81 aa, Leptonychotes weddellii
VSVAFQDLAVRFSEEEWQLLGEGQRTLYRDVMRENYETLRSLAAVTVETCPLQGLLGCLPNTPTGWPHLATTSSSGSSSSS

SEQ ID NO: 20494 - protein, 81 aa, Leptonychotes weddellii
FQETVTFKDVAVVFSEEELGLLDSTQRKLYRDVMLENFRNLVSVGHSSSKPDMISQLEREEKLCMKEIHTERGGRNQNEVE

SEQ ID NO: 20495 - protein, 81 aa, Felis catus
AQELLTLEDVAVDFSREEWQLLAPAQKDLYRDVMLENYRNLVSVGCQATKRDALSVLEHRDEAWMKAEDEIQDRTHAGIGK

SEQ ID NO: 20496 - protein, 81 aa, Neomonachus schauinslandi
YKGSVVFSDVSIDFSQEEWECLDPGQRALYRDVMLENYGNLLSMGLYIPKPQVISLLEQGKEPWMVGRELTRGLCSDLESM

SEQ ID NO: 20497 - protein, 81 aa, Neomonachus schauinslandi
VRMPVTFDDVAVTFTQEEWGQLDPAQRTLYQEVMLETCGLLVSLGCPLPKPELFYPLDHSPELQTLKRGLSPDSCPGDSTK

SEQ ID NO: 20498 - protein, 81 aa, Monodelphis domestica
PKVPVTFDDVSIYFSTPEWEKLEEWQKELYKNIMKGNYESLISMDYAMTQPEVLSQTQPEVEHNTENQVRPDGSEMTAEPS

SEQ ID NO: 20499 - protein, 81 aa, Monodelphis domestica
HKENQGPIPASVTFRVVVVDFSHHEWRRLGVAQRNVYRDGMLENYKNLVSLGKPTICRTLGKSPHLVCPHFFICEMSWRKK

SEQ ID NO: 20500 - protein, 81 aa, Physeter macrocephalus
AQEPVTFKDVAVDFTQEEWGQLDPVQRTLYRDVMLETYGHLLSVGNQIAKPEVISLLEQGEEPWSVEQAYPPQGTCPEWMR

SEQ ID NO: 20501 - protein, 81 aa, Monodelphis domestica
SQGSIAFKDVAVDFTQEEWCLLNHSQKTLYLEVMLENVQNLLSVGVPVPTENVISCFQQGKAPWLQEQKGPRTSYPEAETN

SEQ ID NO: 20502 - protein, 81 aa, Monodelphis domestica
SQGSIAFKDVAVDFTQEEWCLLDHSQKELYLEVMLENVQNLLSVGLPVPRENFISHIQQRKTSWLLEQKGPRSSSLDFEVK

SEQ ID NO: 20503 - protein, 81 aa, Physeter macrocephalus
VLLTFRDVAIEFSQEEWEWLDPAQRALYRDVMLETYRNLLSLDISTRCVIKELSPKENINKGELFRTLMLGRHKRNDIKDF

SEQ ID NO: 20504 - protein, 81 aa, Monodelphis domestica
AQEVVTFKDVAVDFTREEWCLLSPPQKGLYKEVMLENTRNLLSVGLLALPEKVISYLEQMDVPWMLDQEGLRIWYPAGEIS

SEQ ID NO: 20505 - protein, 81 aa, Monodelphis domestica
MLENYKNLVSLGLQTIKPDVISRLEQGEVPWIPTSHVPKDSSHHKTISRTKKSAPKQDLSVRESSKKRVTKDDSQKDSKLR

SEQ ID NO: 20506 - protein, 81 aa, Monodelphis domestica
FQESVTFRDVAVDFTQEEWRCLEPAQRALYMDVMLENYKNLISLGIPVSNLDVVSLLEKRAAVWTQDGEDPRDTCLDFFRE

SEQ ID NO: 20507 - protein, 81 aa, Physeter macrocephalus
CWGLSSFKDISMEFTWEEWQLLDSAQKHLYRDVTLENYNNLVSLGYHGTKPDLIFKLEQGEEPWIINAEVSHQSCPEGWKE

SEQ ID NO: 20508 - protein, 81 aa, Monodelphis domestica
SQGSITFKDVAVDFTREEWRLLDHSQKELYMEVMLENVQNLLSVGLLVPGEDLLPSFQQGESPWLLEQKGTRSSCSDAETN

SEQ ID NO: 20509 - protein, 81 aa, Monodelphis domestica
SQGFITFKDVTVDFTQEEWCLLDHSQKDLYREVMLENVQNLLSVGLPVSREDFISSFQRREGTWLLEQKGSKNSCPGAQTN

SEQ ID NO: 20510 - protein, 81 aa, Papio anubis
NCYQDSVTFDDVAVDFTQEEWTLLDPSQRDLYRDVMLENYENLASVEWRLKTKGPALWQDRSWFRTSNETQTARSHNGGQL

SEQ ID NO: 20511 - protein, 81 aa, Otolemur garnettii
QALLTFRDVSIEFSVDEWACLDPAQRNLYRDVMLETYKNLVFLETGLAVSKPDLITCLEQRKEPWKVKTHQTVVKHPVYSE

SEQ ID NO: 20512 - protein, 81 aa, Otolemur garnettii
EAVTFKDVAVVFTKEELGLLDPAQRKLYQDVMLENFRNLLSVGYQPFKLDTLLQLEREEKLWMMETETQGDGCSGHQNQNE

SEQ ID NO: 20513 - protein, 81 aa, Otolemur garnettii
KLQESLTLEDVALEFTWEEWQLLGPTQKDLYRDVMLENYSNLVSVGYQASKSDPFSKLERGELWTVTDEIHNQIYPEIKKV

SEQ ID NO: 20514 - protein, 81 aa, Vulpes vulpes
CQESVTFEDVAVIFTDEEWRHLVPIQRDLYKEVMLENYRSIVSLGLPVPRPEVIFQLKRGDEPWIVDLHGSEERECPENIS

SEQ ID NO: 20515 - protein, 81 aa, Vulpes vulpes
NHTAEGLPSPATDGLQEKEGKPQMLVPVTLRDVAVVFTDAEWKGLSSEQRNLYKEVLLENYRNLLSLDCGQEQQDAAAHRL

SEQ ID NO: 20516 - protein, 81 aa, Vulpes vulpes
MLENYRNLVSLGLCVSKPDMISSLEQRKEPWMVKRKLTRGRCPDLKAVLETKELPAKKDISKEKLSQAVIVERLTNYSLEC

SEQ ID NO: 20517 - protein, 81 aa, Myotis davidii
QMLLTFRDVDTEICQQEWECLNPAQRGLVQGVMLENSGACAPGGGYLCRCVAHELSPKEESNKGRFSQTVMGRHKSNDIKD

SEQ ID NO: 20518 - protein, 81 aa, Cercocebus atys
WLQEPMTFKDVAVEFTQDEWMMLDSAQRSLYRDVMLENYRNLTSVEYQLCKLTVISPLDQEEIRNMEKRIPRGICPDQKIL

SEQ ID NO: 20519 - protein, 81 aa, Cercocebus atys
MAQVTFSDVAIDFSHEEWGWLDSAQRDLYKDVMVQNYENLVSVGLSVTKPYVITLLEDGKEPWMVEKKLSKGMIPDWESRW

SEQ ID NO: 20520 - protein, 81 aa, Cercocebus atys
EMGLLTFRDVAIEFSLGEWQCLDGAQQNLYRDVMLENYKNLVSLGIAVSKSDLITHLEQNKEPRNIKKNEMLAKHPVMCSH

SEQ ID NO: 20521 - protein, 81 aa, Leptonychotes weddellii
SQGPVSFRDVAVDFTQEEWQQLEPDEKTTYRDVMLENYSHLVSVGYDSTKPKVILKLEQGEEPWIAEGDLPCQSHPEIVWK

SEQ ID NO: 20522 - protein, 81 aa, Leptonychotes weddellii
MLENYSSLVSLGYEVMKPDVIFKLEQGEEPWIGDGEVPSSDRPEQVLQVDGHMTWHQDNQEKLRNMKQDHECDTFGKKFNL

SEQ ID NO: 20523 - protein, 81 aa, Leptonychotes weddellii
PKVPVSFEDVSVYFTKTEWKLLDLRQRILYKRVMLENYRHLVSLGFLSSKPHLVSWLEQGEGPRAADTCRTRAAAGMQTGD

SEQ ID NO: 20524 - protein, 81 aa, Leptonychotes weddellii
FQESVTFKDVAVDFTQEEWGQLDSPQRALYRDVMLENYQNLLSLGPPVCKPDVISHLERGEEPWQMPREVPGGACSEGEPG

SEQ ID NO: 20525 - protein, 81 aa, Leptonychotes weddellii
MMWTWASETEWTRLECPEKALYTDVTLKNYGNAMALRFSVYKTEVISHLESGEALCIWAGQRTIARVWRVVQEGKGEKEVH

SEQ ID NO: 20526 - protein, 81 aa, Leptonychotes weddellii
APLPLTFEDVAIYFSEQEWQNLEAWQKELYKHVMRTNYEILVSLDDGLPKPELISWIEQGKEFFKNWGESQKSGNIICSSA

SEQ ID NO: 20527 - protein, 81 aa, Felis catus
MWLWISPKRSGSNWTPAQRTLYRDVMLENFSHVISLGYPVSKPDVISKLEQGEDPWIIKRDVSNWIYTDENQADGRQDRKS

SEQ ID NO: 20528 - protein, 81 aa, Leptonychotes weddellii
AQDSVTFEDVAVSFSWEEWGLLDEAQRRLYLNVMLENLALVTALGCWHGAEDGKAPSEQAASIGVSQVRTHHAGPYPQKAP

SEQ ID NO: 20529 - protein, 81 aa, Leptonychotes weddellii
SQVLLTFRDVAIEFSQEEWECLDPAQRALYKDVMLENYRNLVSLGEDNVDLNVISILEQGTEPRAVEGEVKVEKKPSGWDY

SEQ ID NO: 20530 - protein, 81 aa, Felis catus
SQHLVTFEYVAVDFTQEEWTLLDQTQIALYRDVMLENYQNLITLAGYKSCKPDPSSALEGAELLRTGGRGVLQGEKQCGKT

SEQ ID NO: 20531 - protein, 81 aa, Neomonachus schauinslandi
TRNIVTFEDVCIYFSPEEWELLDEAQKRLYCNVILENFLLVTSLGLAISRYHLIPQPLPVREPVVPANVAIAPAGAAMVLG

SEQ ID NO: 20532 - protein, 81 aa, Neomonachus schauinslandi
MWEAVTFKDVAVVFTEEELGLLDPAQRKLYGDVMLENFRNLLSVGHQPFTPDVILQFEREEKLRMIKTATQGHCASGDKNL

SEQ ID NO: 20533 - protein, 81 aa, Monodelphis domestica
DQEVVTFKDVSVEFTQEEWRLLSPPQKELYKEVMLENARNLLSVGFPVPSEDILSYLEQKEAPWMLEQKGLRSCCPGEIIP

SEQ ID NO: 20534 - protein, 81 aa, Neomonachus schauinslandi
RHAFVAFRDVAVDFTQEEWRLLSPAQRTLHREVMLETYNHLVSLEIPFSKPKLISQLEQGEEPWIKERQHPLGFCPAGSKL

SEQ ID NO: 20535 - protein, 81 aa, Monodelphis domestica
LKESVTFKDVTVDFTQEEWKHLDPSQKELYRDVMLENYRNLVFLGYPVSKPDVISQLEQRKTPWMLEREDSRNPCMDWETK

SEQ ID NO: 20536 - protein, 81 aa, Monodelphis domestica
SQGLITFKDVAVDLNLEEWCLLDHSQKELYLEVMLENVQNLLSVGLPVPREDFLSCFQQGEARWLLEQKGPMGSCPETNLE

SEQ ID NO: 20537 - protein, 81 aa, Monodelphis domestica
SQHPVTFKDVAVDFTREEWRHLGPAQRDLYRDVMLENYHNFASLGLPVFKPDVISQLERGEGPWMPEAEVPQVTFPESLIQ

SEQ ID NO: 20538 - protein, 81 aa, Physeter macrocephalus
QGHVIFEDVAVSFSQEEWGLLNDAQRLLYCDVMLENLSLIASLGCWRAVGTEEASSDQCVSVELVTQDRNPNPDPSILKTL

SEQ ID NO: 20539 - protein, 81 aa, Monodelphis domestica
ESIRFKDVAVYFTKSVWQLLDPSRKKLYKDVMLDNFRTLVSLDNEWREEGSQNDQLRNDERNSGERSYQCNECGRSFVSKW

SEQ ID NO: 20540 - protein, 81 aa, Monodelphis domestica
RQEVVTFQDVAVDFTREEWRLLSPPQKELYKEVMLENAQNLHSVGLPTPPEDVFSSLEQREVPWILEQEALRNCCPEGEIR

SEQ ID NO: 20541 - protein, 81 aa, Monodelphis domestica
PKESVTFKDVAVDFTWEEWEQLDIGQRVLYRDVMLENYRNIISLGTQVSKPELIFLLEQGKEPWMVKREISKDSCPGERHN

SEQ ID NO: 20542 - protein, 81 aa, Monodelphis domestica
FQASVTFKDVAVDFTWEEWRLLDPPQKELFWEVMLENYRNLVCLGLADSNKDVRISELELREPHWIPTGGVLRSCWPGWEL

SEQ ID NO: 20543 - protein, 81 aa, Physeter macrocephalus
EEGRVTFEDVAVYFSQEEWGLLDEAQRLLYRSVMLENFSLMASLGLTSSRTHEVTQLEQWGEPFVPACGVVITATPRGCWC

SEQ ID NO: 20544 - protein, 81 aa, Monodelphis domestica
GQEEVTFKDVAVDFTQEEWCLLSSPQKELYKEVMLENAQNLLSVGLPAPPQDMISYLEQMEAPWMLEKEGLRHYCPEGVIR

SEQ ID NO: 20545 - protein, 81 aa, Monodelphis domestica
LITFKDVAVDFTQEEWCLLDHAEKELFLEVMQENVQNLLFVEAEVNFELKGISSKLSLFVEESGPQRVINEDPCDFILREI

SEQ ID NO: 20546 - protein, 81 aa, Monodelphis domestica
PQAAMTFQDVAVDFTREEWRLLEPPQKELYWEVMLENYRNLVCLGLTVSKPDVISQLEQGEAPWRLEGGSARGRCLDWGMR

SEQ ID NO: 20547 - protein, 81 aa, Monodelphis domestica
RNKLPSQESITFKDVDSQKELCKEVMPENVQNLLSVGLTVPRENFITCFQQGESPPRLEKKGQWSSCPEAETNFEVKEICA

SEQ ID NO: 20548 - protein, 81 aa, Monodelphis domestica
MDVAVDFTQEEWCLLDHSQKELYLEVLLENVQNLLSVGLPVPRENFISCFQQGKTPCLVEEKDPRSFFPVEDVEVKEMSIK

SEQ ID NO: 20549 - protein, 81 aa, Physeter macrocephalus
SVTFEDIAVYFSWEEWRLLDETQRRLYLDVMLENFALISSLGCCCGAEDAEAPFEQIASLGVSQARTPKAALSSQNTHPCE

SEQ ID NO: 20550 - protein, 81 aa, Papio anubis
ALALVSFEDVVVTFTGEEWGHLDLAQRTLYQEVMLETCRLLASLGHPVPKPELIYLLEHGQDLWTVKRGLCQSTCAGEKAK

SEQ ID NO: 20551 - protein, 81 aa, Papio anubis
DSVTFEDVAVDFTQEEWTLLDQTQRNLYRDVMLENYKNLVAVDWESHVNTKWSAPQQNCLQGKTSSVVEMERNHFGEELFD

SEQ ID NO: 20552 - protein, 81 aa, Camelus dromedarius
PQDLVSFKDVAVDFSQEEWEWLSPAQRRLYRRMMMENYQNLLSLGLCTSKPYVISLLEQGKEPWGMKSEVRNSFSDTCSTT

SEQ ID NO: 20553 - protein, 81 aa, Myotis davidii
MYFTREEWNKLDWAQKDLYRDVMLENYRNMILLGFQIPKPEVICQLEQWEDPWILDLPKAGTRRASSSACPVGWLISRALS

SEQ ID NO: 20554 - protein, 81 aa, Myotis davidii
QSLLTFEEVAVYFSPEEWELLDPSQKALYHDVMQENYETVISLGKGSPLCVEVEWGQMLNAGAALWWSVSSHMEKLCSAIS

SEQ ID NO: 20555 - protein, 81 aa, Cercocebus atys
RGTVTFEDVAVHFSWEEWGLLDEAQRCLYRDVMLENLALLTSLDVHHWKQHLGEKHFRSNVGTALFVKTCTFHVSGEPSTC

SEQ ID NO: 20556 - protein, 81 aa, Cercocebus atys
DRNLLGPLTFMDVAIEFSLKEWQCLDTAQQSLYRDVMLENYRNLVFLGIAFSKPDLITYLEQGKEPWNMKRHETVAKPLGM

SEQ ID NO: 20557 - protein, 81 aa, Cercocebus atys
MGPLTFRDVTVEFSLEEWQCLDIAQQNLYRDVMLENYRNLVFLGIAVSKPDLITCLEQEKEPWEPMRRHEMVAKPSVMCSH

SEQ ID NO: 20558 - protein, 81 aa, Cercocebus atys
SLNKVTFEDVAIDFTQEEWAMMDTSKRKLYRDVMLENVCHLVSLGYQISKSYITLQLEQGKELWREGREFLQGQNLGKEQG

SEQ ID NO: 20559 - protein, 81 aa, Cercocebus atys
MEREVTFSDVAIDFSHEEWGWLDSAQRDLYKDVMVQNYENLVSVAGLSVTKPYVITLLEDGKEPWMVEKKLSKGMIPDWES

SEQ ID NO: 20560 - protein, 81 aa, Leptonychotes weddellii
SQGLVSFKDVAVDFTQEEWQQLDPAQRTLYRDVMLENFSHLVSMGYPVSKPDVISKLEQGEDPWIIKRDIPNWILPDENQA

SEQ ID NO: 20561 - protein, 81 aa, Felis catus
SQGLVTFRDVALDFSQEEWEWLDPSQKDLYRDVMLENYRNLVWLGLSISKPNMISLLEQGKEPWMVEKEVSDGQYADWESW

SEQ ID NO: 20562 - protein, 81 aa, Felis catus
MLENYGHLLLLGLMSKPDLVNFLEQKKEAWDVNGKGTEATLHSAVSSHGTLSFLPKSCIEASFQNKSMGRCKHSTLENLHL

SEQ ID NO: 20563 - protein, 81 aa, Felis catus
GLGSVSFKDVTVDFTRDEWLQLTGTQRTLYRDVMLENYSHLVSVGYDSTKPKVILKLEQGEEPWVVEGDLPCRSRPEVWKV

SEQ ID NO: 20564 - protein, 81 aa, Felis catus
PAPGLLTFRDVAIEFSQEEWGCLNQSQELYRDVMLETYGHLLFLGLVSKPDLVIVLEQKKELWGVKRKETVASHPGRKMDL

SEQ ID NO: 20565 - protein, 81 aa, Neomonachus schauinslandi
AQASVSFKDVTVEFTQEEWRQMDSAQRTLYRDVMLENYSHLVSVGYCFTKPELIFTLEQGEDPWLLKKEFLRKSSPEDSQP

SEQ ID NO: 20566 - protein, 81 aa, Neomonachus schauinslandi
HQALLTFRDVAIEFSQEEWGCLNHTQRELYRDVMLENYGHLLFLGLIVSKPDLVIFLEQKKEPWDVKRKKTVAIHRGNHYE

SEQ ID NO: 20567 - protein, 81 aa, Neomonachus schauinslandi
PKVPVTFDDVAVYFSEPEWGKLDNWQKELYKHVMRGNYETLVSLDYAISKPDILTRMERGEEPCPEGPWGQEEGSKREAAH

SEQ ID NO: 20568 - protein, 81 aa, Monodelphis domestica
AQEVVTFKDVAVEFTQEEWCLLSPPQKELYKEVMLENVQNLHSVGLPAPPEDMIYYVEQRDSSWMLEQEGLRSCCPGKIRR

SEQ ID NO: 20569 - protein, 81 aa, Monodelphis domestica
MAEPLTFRDVSVDFTPEEWAQLDPAQRALYRDVMLENYENLLFLGLPVAKPDVVCQLERGEAPSFPEQPEFFAGACPDSLA

SEQ ID NO: 20570 - protein, 81 aa, Monodelphis domestica
SITFKDVAVDFTQEEWCLLDPSQKELYREVVLENVQNLLFVEAETNVEVKEMSTKLSLFVEGSGPPRGMSKDPCDFILSKI

SEQ ID NO: 20571 - protein, 81 aa, Monodelphis domestica
FQESVTFRDVAVDFTPEEWGFLAPFQRELYREVMLENFWNLVCLGFEVSKPDVIYQLERGEAPQIPKAVPGSCSQDWGAGP

SEQ ID NO: 20572 - protein, 81 aa, Monodelphis domestica
PQELVTFQDVAVYFTPEEVRYLDSYQKALYKDVMLENYGNMASLGFPLSKPVLISQLERGEEPWAMDPLVAKERKTRRGTS

SEQ ID NO: 20573 - protein, 81 aa, Monodelphis domestica
GWVPALFDEVAIYFSDEEWEVLTEQQKALYREVMRMNYETVLSLEFPFPKPDVISQLEAEEGPWVPYPQNSEEWKLQGGSF

SEQ ID NO: 20574 - protein, 81 aa, Physeter macrocephalus
PQGSVTFEDVAVYFSWEEWCLLDEVQIHLYLDVMLENFAVVCMLGSFSAVEDEEMPSEQSVSAGVSQMRTSRAGSSPAKAQ

SEQ ID NO: 20575 - protein, 81 aa, Monodelphis domestica
QLSNMDVAVDFTREEWCLLSPPQKELYKEVMLENAQNLVIYVYSCCIYFSVHTAEKYSESNQCRKMFMHSISLAGYQRIHT

SEQ ID NO: 20576 - protein, 81 aa, Monodelphis domestica
AQEAVTFKDVAVDFTREEWRLLSPPQKELYKEVMLENAQNLLTVGLPAPPENVISALGAEGSPVDARGRRPEGACCPGEII

SEQ ID NO: 20577 - protein, 81 aa, Monodelphis domestica
PKALVTFVDVAVNLTQEEWHLLGPDQRSLYRDVMLENYGNIVSLGFQVTKPDVISQLERGEEPWILDTQGAEEKKVLRGDC

SEQ ID NO: 20578 - protein, 81 aa, Monodelphis domestica
MLENVQNLLSVGIPAAPEDMISYLEQREALWTLEQEGLRSYCPEGENRPKIKANPTEVNLPVDEMDLPRFMSDDPDNIAFR

SEQ ID NO: 20579 - protein, 81 aa, Physeter macrocephalus
AQSLVTFEDVAVHFSKEEWGLLDAAQRQLYHSVMLENLELMTSLGCWHGVEDEEVRSKQDASVDVVSQVRIFSAHPSTQKA

SEQ ID NO: 20580 - protein, 81 aa, Monodelphis domestica
FQEPVTFKDVAVEFTWEEWRQLDPTQRALFRDVMLENYRNLVSLGLAVTKPDVIFQLESGEVPWMLEREVPRSSPTECLNL

SEQ ID NO: 20581 - protein, 81 aa, Monodelphis domestica
SQGSIAFKDIVVDFTQEEWCLLDHSQKVLYLKVMLENVQNLLSVGLPVPRKNFIFCFQQGKAPWLLEQKGSRSSCPEAETN

SEQ ID NO: 20582 - protein, 81 aa, Monodelphis domestica
MLENAQNLLSVGIPAAPEDMISYLEQREALWTLEQEGLRSYCPEGENRPKIKANPTEVNLPVDEMDLPRFMSDDPDNIAFR

SEQ ID NO: 20583 - protein, 81 aa, Monodelphis domestica
SLEVVTFRDVAVDFTQEEWGCLEPWQKQLYREVTLDNYRNLLSLAGLPGPGADVISQVERGETPGELPGGGTDWEARPETI

SEQ ID NO: 20584 - protein, 81 aa, Physeter macrocephalus
KPQGLMTFEDVAVDFTQEEWQYLNPPQRNLYRDVMLETYSNLVSVGQQVTKPDLILKLEVEEPCLPEGKIPIWSFPEEACQ

SEQ ID NO: 20585 - protein, 81 aa, Monodelphis domestica
LQASVTFEDVAVDFSAEEWRRLRPLQRELYREVMLENYRSLAWLGLAASKPGVICRLERGEAPREPDPDGPQSGWADCGTG

SEQ ID NO: 20586 - protein, 81 aa, Monodelphis domestica
MLEISQSLLSLGLPVPKANVISQVDQAETPWMLKQVDSRSSSPDGESKPKTRETTQKLSISCDLKSRQILDSDIRLGKKQD

SEQ ID NO: 20587 - protein, 81 aa, Monodelphis domestica
SITFKDVTVDFTQEEWYLLDHAQKKLYREVMLENVQNLIFVEAETNFEAEMSIKKLNFFIEGYGPPKAMNKGPCDSILREI

SEQ ID NO: 20588 - protein, 81 aa, Monodelphis domestica
PHASVTFKDVAVDFTWEEWRLLDPPQKELFWEVMLENYRNLVCLGLADSNKDVRISELESGEPHWIPTGGVLRSCWPGWES

SEQ ID NO: 20589 - protein, 81 aa, Physeter macrocephalus
QGFVSFKDVTVDFTQEEWQQLDSAQRNLYKDVMLENYSNLVSVEFEIRTKMKELAPQKSISEEVILHNMIVYSVFEAWKLE

SEQ ID NO: 20590 - protein, 81 aa, Monodelphis domestica
AQESVTFKDVAVNFTQEEWEQLNPAQRNLYKDVMLENYQNLISLGLPISKPDVIFKLEQGKEPWILNLQEAREREVPRNFS

SEQ ID NO: 20591 - protein, 81 aa, Papio anubis
FREMVTFKDVAVVFTREELGLLDLAQRKLYQDVMLENFRNWLSVGYHPFKLDVILQLGREDKLWLTETEIQGDGCSGHRNQ

SEQ ID NO: 20592 - protein, 81 aa, Aotus trivirgatus
QGHLTFKDVAVEFSLEEWKCLTPAQRALYREVMSENYRNLQFVDISSKYNMKELLSTARGDTEVFYAGILDRRESHHFGDF

SEQ ID NO: 20593 - protein, 81 aa, Papio anubis
QQGYVTFEDVAVYFSQEEWRLLDETQRLLYRNVMLENFSLLASLGLASSKTHDITQLESWEEPFMPASEVVTSAIPRGCWH

SEQ ID NO: 20594 - protein, 81 aa, Papio anubis
PRSWDYRDVAIEFSQEEWKCLDPAQRTLYRAVMLENYRNLVSLAISSKCMMKEFSSTAQGNREVLHTGTLQRHESHHIGDF

SEQ ID NO: 20595 - protein, 81 aa, Aotus trivirgatus
MLFHSKTPGPPGSLEMGPLTFRDVQNLYRNVMLENYGNQVFLGKIRSKPDLITCLEQENEPWNMKRHEMVDKPPGRLLEFS

SEQ ID NO: 20596 - protein, 81 aa, Pan troglodytes
EMGPLTFRDVAIEFSLEEWQCLNTAQRNLYRKVMFENYRNLVFLGIAVSKPHLITCLEQGKEPWNRKRQEMVAKPPVIYSY

SEQ ID NO: 20597 - protein, 81 aa, Camelus dromedarius
ESVTFEDVAVDFTQEEWALLDTSQRKLFRDVMLENISHLVSVVISDREDDLKKQEMISMQRINKKDAPLIRTVVSFMGVNV

SEQ ID NO: 20598 - protein, 81 aa, Camelus dromedarius
QAVSKGSMMFKDVSVNFSQEEWECLDSGQMNLYKEVMLENFSNLVSVGLSNSKPAVISLLEQGKEPWMVDRELTRGLCSGK

SEQ ID NO: 20599 - protein, 81 aa, Camelus dromedarius
PQVLVSFEDVAVLLSREEWGHLGPAQKGLYRDVMLETYRNLVSLGLQGSKPDVISRLEQGEEPWAPHSPRFEGSWVWRHRS

SEQ ID NO: 20600 - protein, 81 aa, Camelus dromedarius
LQEAVTFKDVAVVFTEEELGLLDSAQRELYQDVMLENFRNLVSVGHLPFKPNMVSQLEAEEELWMTERETQRNGCSGENRA

SEQ ID NO: 20601 - protein, 81 aa, Myotis davidii
MDFEDVAIVFSEEEWGLLDEPQRLLYCDVMLEVFALVSSAGCWHKTDDEEACSEQSECVQGESQVRASETEPETQGTHVCK

SEQ ID NO: 20602 - protein, 81 aa, Myotis davidii
MNFEDVAIVFSEEEWGILDEAQKLLYCDVMLQVFTLVSSAGCWHKTDDEEACSEQNVFARGESQVRASKTEPATQTTHVCK

SEQ ID NO: 20603 - protein, 81 aa, Cercocebus atys
MAFEDVAVYFSQEEWGLLDTAQRALYRRVMLENFTLVTSLGLSTSRPHVVIQLERGEEPWVPSGKDMTLARNTYRRLNAGE

SEQ ID NO: 20604 - protein, 81 aa, Cercocebus atys
MFKEAVTFNDVAVAFTEEELGLLGPAQRKLYRDVMVENFRNLLSVGHQPFKQDVSPLERNEQLWIVTTATQRQRNLGEKNQ

SEQ ID NO: 20605 - protein, 81 aa, Cercocebus atys
TVTFEDVAVNFSQEEWSLLSEVQRCLYRDVMLENLALISSLDCWCGSKDKEAPSKQSISVQRESQNRTPRAVVSPKKAHPC

SEQ ID NO: 20606 - protein, 81 aa, Cercocebus atys
ASVALGDVAVNFTREEWALLGPCQKNLYRDVMQETIRNLDCVGMKWKDQLLFKDQIEDQYKYPRKNLRCRMLERFGESKDG

SEQ ID NO: 20607 - protein, 81 aa, Cercocebus atys
HGSVTFRDVAIDFSQEEWEFLDPAQRDLYRDVMWENYSNFISLAGPSISKPDVITLLDEEGKEPGMVVREGTRRYCPDLES

SEQ ID NO: 20608 - protein, 81 aa, Leptonychotes weddellii
AQESLTLEDVAVDFTWEEWQLLAPAQKDLYRDVMLENYSNLVSVGYQASKPDALSKLERGEEPWAKQEEVPSGTRPEPSKV

SEQ ID NO: 20609 - protein, 81 aa, Leptonychotes weddellii
SRVSVTFEDVAVLFTRDEWRKLDPSQRNVYQEVMLENYSNLVSLGLLFSKPKVISLLQQGEDPWRVEKESPGGPSLGCKSS

SEQ ID NO: 20610 - protein, 81 aa, Leptonychotes weddellii
AQESVVFSDVSIDFSQEEWECLNDDQRDLYRDVMLENYSHLVSMGHSVSKPDVISVLEQGKEPWLVDRELTREQWPVLESR

SEQ ID NO: 20611 - protein, 81 aa, Leptonychotes weddellii
NSQGFVSLKDVTVDFTWEEWQYLDSAQRNLYRDVMLENYSNLVSVGCQSLKSDVISLKRGEPWMKEEEISSWAYSELKSEV

SEQ ID NO: 20612 - protein, 81 aa, Leptonychotes weddellii
AQVLVTFKDVAVTFTQEEWGQLDLDQRALYQEVMLETCGLLVSLGHPVPKPELTHLLEHGQELWTGKRGLSRSTCSGDGAK

SEQ ID NO: 20613 - protein, 80 aa, Leptonychotes weddellii
MMKAQESLTLEDVAVDFTWEEWQLLAPAQEELYWDVMLENYRNLVSVGYQASQPDALSELEQGEPLWILEDEVQSQTHPH

SEQ ID NO: 20614 - protein, 81 aa, Felis catus
SQVLLTFRDVAIEFSQEEWECLDPAQRALYREVMLENYRNLVSLGVDKVRPDVGICPNISVRSVIKELSTKEDINKEELFQ

SEQ ID NO: 20615 - protein, 81 aa, Neomonachus schauinslandi
RTALITFKDVAVTFTGEEWRHLDLAQRTLYREVMLETCGLLVSLGYPVPKPELTYLVEHGQELWTVKRGLSKSTYTGEKAK

SEQ ID NO: 20616 - protein, 81 aa, Neomonachus schauinslandi
AAGSVTFKDVTMAFTQKEWEQLDPAQRNLYKDVMLENYSNLASMGYQAPKPDMISKLEKGEEPWLGKGKRPRQGGPSEIAR

SEQ ID NO: 20617 - protein, 81 aa, Neomonachus schauinslandi
MKPAQRNLYRDVMLENYSNLVTVGYQVTKPDVIFKLEQEEEPWVVEEEMLGRHCPEVWEVDEQIKKQQETLVRKVTSISKK

SEQ ID NO: 20618 - protein, 81 aa, Neomonachus schauinslandi
ARASLSFEDVAVGFSWEEWQLLAPSQKDLYREVMLENYRNLVSVGYQASKPDSLFQLEQGEPPWTVVGAAQSQTCQEEIWE

SEQ ID NO: 20619 - protein, 81 aa, Neomonachus schauinslandi
VVESLTFDDVAVDFTWEEWQLLAPAQKDLYRDMMLENYRNLVSVGYQASKPDALSKLEQGEELWMIEDEIHSRICPEIRKV

SEQ ID NO: 20620 - protein, 81 aa, Monodelphis domestica
RGSITFKDVAVDFTQEEWCLLDPSQKELYREVMLENVQNLLSVEAETNFEVKEMITKLSRRTKLSLRKCFPEEVRLTELPK

SEQ ID NO: 20621 - protein, 81 aa, Monodelphis domestica
AQGLLTFEDVAVIFSQDEWKHLDCAQRALYKDVMWENYQNLESVGFSFPKPELILCLERGEEPWLPDCLGSPERRRILFFC

SEQ ID NO: 20622 - protein, 81 aa, Monodelphis domestica
MEVITFKDVAVDFTREEWHLLAPPQKELYKEVMLENAWNLLSVGLAVSREDVISYFEQREAAWMLEEIDLRNSCQEKEMKP

SEQ ID NO: 20623 - protein, 81 aa, Monodelphis domestica
AQEVVTFQDVAVDFTREEWCLLSPPQKELYREVMLENVRNLLSVGLPAPPKDVLSYLEQRDAPRMLEQESLRSCHPEGEVK

SEQ ID NO: 20624 - protein, 81 aa, Monodelphis domestica
HQESMTFKNVAVAFGQEEWGQLDPTQKDVYRDVILEKYRHLVSMGLPISKPDVISQLERKEDPWMLEREVSRDAYPDWETK

SEQ ID NO: 20625 - protein, 81 aa, Monodelphis domestica
SLESVTFQDVTIDFTQREWRQLTHAQKSLYREVMLENYENFVSVGFPGSKPELISQLECGKGPWMLLEEEVRSRCRGCHRN

SEQ ID NO: 20626 - protein, 81 aa, Monodelphis domestica
FKESITFKDVAVNFTQEEWCLLDHSQKELYLEVVLENMQNLFSVGLPVSMEHFISCFQQGKAPWLLEQKGPRSSCPGLRDI

SEQ ID NO: 20627 - protein, 81 aa, Physeter macrocephalus
CEGSVSFEDVTIDFSREEWQQLDPAQRRLYQDVMLEIYSHLFSVGCHIPDPEIIFRMEKGKEQWMAEAELPRQRYHEGEFG

SEQ ID NO: 20628 - protein, 81 aa, Monodelphis domestica
FQGLVTFQDVAVIFSLDEWGHLDPAQRELYREVMLENYQTLACLGLAVSKPDVIAQLEQGGAPWKLEKDIPASPCPGEQYV

SEQ ID NO: 20629 - protein, 81 aa, Monodelphis domestica
GQETVTFKDVAVDFTREEWRLLSPSQKELYKEVMLENAQNLLSVGLPASPEDMLSYLEQRDALWILEQEGLWSCCAGEIRP

SEQ ID NO: 20630 - protein, 81 aa, Monodelphis domestica
TAAPVTLRDVAVEFTWEEWRHMEPAQRDLYRDVMLDNYENLVFIGIPVSKLDIISLLVRGEAPWMPARKGHRIFYEDSLSV

SEQ ID NO: 20631 - protein, 81 aa, Physeter macrocephalus
AHVSLSFRDVAIDLSQEEWECLDPVQRALYRDVMLENYSNLVSLGCSSPKPDVITLLEQEKEPWTVMREGTRSWYTDLESK

SEQ ID NO: 20632 - protein, 81 aa, Physeter macrocephalus
QESVTFKDVAVDFTLEEWGQLGPGQRELYRDVMLENYQNLLSLGAGLPGSKPDVISRLERGEEPRMETRAAPRVTCSDLET

SEQ ID NO: 20633 - protein, 81 aa, Monodelphis domestica
VVTFKDVAVEFTREEWHLLSSPQKELFKEVMLENAWNLLFVEGEIRPEMKVNPTEVSFSLEEMNLQCFMSDCPNFAFREFC

SEQ ID NO: 20634 - protein, 81 aa, Monodelphis domestica
AQEAVTFKEVAVDFTWEEWRLLSPPQKELYKEVMLENARNLLSVGLPASREDMHSYLEQREAPWMLEQECLRSCCSEGEIR

SEQ ID NO: 20635 - protein, 81 aa, Physeter macrocephalus
QEPVVFEDVAVDFTQEEWALLDLAQRNLYRDVMLENLQNLASLGFETQLKTNELVASQDIYGEKISSEQNVVRFKRSASSL

SEQ ID NO: 20636 - protein, 81 aa, Physeter macrocephalus
LQGSVTFQDVAVDFTLEEWQLLGCAQRKLYWDVMLENFRNLISVEVICLLDDELEGQEGEGSKDNFLNQGMFTFKKTLTNE

SEQ ID NO: 20637 - protein, 81 aa, Monodelphis domestica
SQGSITVKDVTVDFTQEEWALLDHSQQQLYLEVMLENVQNLLSVGLLVPRENVISCFQQGEAPCLLEQDCPRSSCPEAKTC

SEQ ID NO: 20638 - protein, 81 aa, Monodelphis domestica
SEKSLTFQDVAVDFTREEWGQLDPAQKNMYRDVMLENYENFISLGLPVPKADVISHLEKREASWTLRGKFLKNPSLDSLVL

SEQ ID NO: 20639 - protein, 81 aa, Physeter macrocephalus
AAVSFSDVAVYFSLEEWGCLRPAQRALYRDVMRETYGHLGALGDTPNKKEEEPERGPGAKGSKKTPRKERPEELVKNNLDS

SEQ ID NO: 20640 - protein, 81 aa, Monodelphis domestica
EERSGEEARDKHRRQNVLDRLVNKQEENRKGTSPDRGENKRLPISKPDVIFKLEQGKEPWILNLQEAREREVPRNFSPGWE

SEQ ID NO: 20641 - protein, 81 aa, Physeter macrocephalus
SDSVVFEDVAVNFTVEEWALLDPAQRKLYRDVMLETFRNLASVGFCSQVKTSRSSAHWDILETGLCSEEKVVRFTRNDSRS

SEQ ID NO: 20642 - protein, 81 aa, Monodelphis domestica
GPQGSVTFRDVAVDFSPDEWECLGPAQRELYQEVMLENYRSLAWLGLAVSCPEVVCQLERGPWVPEPEVVAGPAGWETKAP

SEQ ID NO: 20643 - protein, 81 aa, Papio anubis
GRLTFRDVAIEFSLAEWKCLDPVQRALYTAVMLENYRNLEFVDSFLKFVMEFSSTGHSNTREGFHTGTLERHKSYPIGDFC

SEQ ID NO: 20644 - protein, 81 aa, Pan troglodytes
MLENYRNLVFLGIAAFKPDLIIFLEQGKEPWNMKRHDMVEEPPVICSHFSQEFWPEQGIEDSFQKMILRRYDKCGHENLHL

SEQ ID NO: 20645 - protein, 81 aa, Pan troglodytes
KEALMAFWDVAVAFTQKEWKLLSSAQRTLYREVMLENYSHLVSLGIAFSKPKLIEQLEQGDEPWREENEHLLDLCPGEWEA

SEQ ID NO: 20646 - protein, 81 aa, Pan troglodytes
MAKPREWRHLDPSQRNLYRDVMLETYSHLLSVGYQVPEAEVVMLQQGKEPWALQGERPRHSCPGEKLWDHNQCRKILSYKQ

SEQ ID NO: 20647 - protein, 81 aa, Pan troglodytes
MEPLTFKDVAIEFSLEEWQCLDTAQRDLYRNVLLENYRNLVFLGIAVSKPDLITCLEQGKEPCNMKRHAMVAKPPVVCSHF

SEQ ID NO: 20648 - protein, 81 aa, Camelus dromedarius
AHGSLTFSDVAIGFSQQEWECLDPVQKTLYRDVMMENYDNLVSLGHSISKPDIITLLEQGKDPWMVVMEEKRNWCTEWLAS

SEQ ID NO: 20649 - protein, 81 aa, Camelus dromedarius
EQLTFEDVAITFSQEEWECLVPAQRTLYRDVMLETCRNLLSVDMSHILVIKKLQVKANMDKKLLQTVITERHVRTERKQFD

SEQ ID NO: 20650 - protein, 81 aa, Camelus dromedarius
SQGLVTFEDVAVYFSLEEWERLDMEQRALYKEVMQENYGILVSLGYPIPKPDLIFRLEQGEEPWVPDSPRPEEGDIVTGVY

SEQ ID NO: 20651 - protein, 81 aa, Camelus dromedarius
ELREQVSFRDVCVDFTQEEWYLLDPTQKILYRDVILENYSHLVSVGNCITKPEVIFKIEQGEEPWIPEERFPKQYLSDIFY

SEQ ID NO: 20652 - protein, 81 aa, Myotis davidii
GLVSFKDVTVDFTQEEWQHLDPAQKTLYMDVMLENYCHLISVGCHMAKPDVILKLERGEEPWTSLTGQTCLEKKWKAEDFI

SEQ ID NO: 20653 - protein, 81 aa, Myotis davidii
RQDPVTFDDVAVYFSRRQWRLLDEAQRRQYHEVMLENLALASSLGGCCGAEDADAPCEQSVSGGVSPSSPSKASLSSVKTH

SEQ ID NO: 20654 - protein, 81 aa, Cercocebus atys
FQELVTFRDVAIDFSQQEWEYLDPNQKDLYRDVMLENYRNLVSLGGHSISKPVVVDLLEQGKEPWMILREETQFTDLDLQC

SEQ ID NO: 20655 - protein, 81 aa, Cercocebus atys
MGPLTFTDVAIEFSLEEWQCLDTAQQNLYRNVMLENYRNLVFLGITVSKPDLITCLEKEKEPWNMKRHEMVDEPPGGVSLL

SEQ ID NO: 20656 - protein, 81 aa, Cercocebus atys
MLENYSNLVFLGIVVSKPDLITRLEQGKKPLTMKRHEMVAKSPVVCSHFAQDLWPEQNMKDSFQKMIPRRYEKRGHGNVQL

SEQ ID NO: 20657 - protein, 81 aa, Cercocebus atys
EKGPLTFRDVVIEFSQEEWQCLDTAQQDLYRKVMLENFRNLVFLGIDVSKPDLITCLEQGKDPWNMKRHSMAATPPGVFFV

SEQ ID NO: 20658 - protein, 81 aa, Cercocebus atys
VTLRDVVINFSQEEWEYLDSAQRNLYWDVMMENYSNLLSLDLESRSETKHLSVGKDIIKNTGSQWEVMECSKLRGLESSIC

SEQ ID NO: 20659 - protein, 81 aa, Cercocebus atys
AATLRLSAQGTVTFEDVAVKFTQEEWKLLSEAQRCLYRDVMLENLALISSLDPALDGSADNTQTSNLGQSVLPSHPEQKTV

SEQ ID NO: 20660 - protein, 81 aa, Cercocebus atys
PQGLVTFGDVAVDFSQEEWEWLNPNQRNLYRKVMLENYRNLASLGLCVSKPDVISSLEQGKEPWTVKRKMTRAWCPDLKIV

SEQ ID NO: 20661 - protein, 81 aa, Felis catus
MGSFGLLTFRDVAIEFSQEERGFLNHSQWALYRDVMLETYGHLLFLGLVVSKPDLVIFLEQKESWNVKGKETVATHPDRWE

SEQ ID NO: 20662 - protein, 81 aa, Leptonychotes weddellii
LQEAIVFEDVAVYFTRIEWSCLAPHQRALYRDVMLENYGHMASLGFLVAKPALISLLEQGEEPGALILQGTEEQGSTASLC

SEQ ID NO: 20663 - protein, 81 aa, Felis catus
MTKPDMIRKLEQGEELWTTERIFPSQSYLEEDGKAEDVLVKFKEYQDRHSRSVIFNHKRLIKERSNIFGKTLTIGKNRIIS

SEQ ID NO: 20664 - protein, 81 aa, Felis catus
GGAARAGFPELLTFRDVAIEFSQEERECLDPAQRAWYRDVMLENYRTLVSLGEDSFPAEVGKCSRLPLCFFWEALESPCPV

SEQ ID NO: 20665 - protein, 81 aa, Felis catus
SQGLVSFKDVAVDFTQEEWQQLDPSQRTLYRDVMLENFSHVISLGYPVSKPDVISKLEQGEDPWIIKRDVSNWIYTDENQA

SEQ ID NO: 20666 - protein, 81 aa, Leptonychotes weddellii
SQEPVTFEDVAVYFTQNQWASLDPMQRALYLEVMLENYANITSLALPFPKPDLILQLEQGEAPWDLDPWTPLEGEALEGVH

SEQ ID NO: 20667 - protein, 81 aa, Leptonychotes weddellii
VKIEDVADVAVSFILEEWGHLDQSQKSLYRDDRKENYGSITSMDYESGHDNVELAVKQISNDAEPHWMTSGSPERNVPQSQ

SEQ ID NO: 20668 - protein, 81 aa, Felis catus
FQESVTFEDVAVDFTQEEWALLDASQRKLFRDVMLENIRHLVSLGYQHCQSDVIFQLEQGEELWAEGSGALQSQGPGGESA

SEQ ID NO: 20669 - protein, 81 aa, Leptonychotes weddellii
VQDPVTFQDVAVEFTQEEWEHLGTAQRALYREVMLENYRSLASLGCQDFKPDVISRLEQGGSAWMAWRDIPRDPSPDQETR

SEQ ID NO: 20670 - protein, 81 aa, Leptonychotes weddellii
SLDSVTFTDVAIDFSQDEWEWLNLAQRTLYKKVMLENYRNLLSLGLCISKPDVIALLEQGKEPWMMKGEMTGGLCPDLEYT

SEQ ID NO: 20671 - protein, 81 aa, Felis catus
MDFTPEEWGKLDPAQREVMLENYRNLVSLWLPVSKSENYSLESGKEPLMLERKAPKSSYSDLEAKPEGKDSTSAQDISKEE

SEQ ID NO: 20672 - protein, 81 aa, Felis catus
SISFEDVTVNFTQEEWGQLDPDQRTLYRDVMLENYGIFISLGKQSFSEQQHHACPSVVTKLEQEASWILEEEFASQCYLRE

SEQ ID NO: 20673 - protein, 81 aa, Felis catus
FQEAVTFKDVAVVFTEEELGLLDPPQRKLYREVMLENFRNLVSVGHSSSKPDVISQLEREEKLCVKEIHTQRGRHSGGRNQ

SEQ ID NO: 20674 - protein, 81 aa, Neomonachus schauinslandi
SYGSLSFEDVTVGFTQEEWQHLDPAQRILYRDVMLENYSHLVSVGCCIPKPEVILKLEQGEQPWILEEESPSQSYPEVCKV

SEQ ID NO: 20675 - protein, 81 aa, Ovis aries
QTELTVEDVDIKFTPEEWECLDPAQRALYQDMVEETYRNLLSVDMSQIHMVKKLQAKRNSAKREITQKVMFGRAESHEIKD

SEQ ID NO: 20676 - protein, 81 aa, Otolemur garnettii
LQESLTFKDVFVDFTLEEWQQLDSAQKNLYRDVMLENYSHLVSVGYLVTKPDGIFRLGPGEESWVTNRETPMRSCPGELLP

SEQ ID NO: 20677 - protein, 81 aa, Otolemur garnettii
FQGVLTFKNMSIEFSVEEWACLDPAQQHLYWEVMLETYRTLVFLDLAVSKPDFITYLEQSKEPWKVKTHQTLVKPPELPSH

SEQ ID NO: 20678 - protein, 81 aa, Pan troglodytes
SLELVSFEEVAVHFTWEEWQDLDDAQRTLYRDVMLETYSSLVSLGHCITKPEMIFKLEQGAEPWIVEETPNLRLSGGSRKQ

SEQ ID NO: 20679 - protein, 81 aa, Pan troglodytes
GPVSFKDVAVDFAQEEWQQLDPDEKTTYGDVMLENYSHLVSVGYDYHQAKHHHGVEVKEVEQGEEPWIMEGEFPCQHSPGK

SEQ ID NO: 20680 - protein, 81 aa, Pan troglodytes
ANVSLAFRDVSIDLSQEEWECLDTVQRDLYKDVMLENYSNLVSLGYTIPKPDVITLLEQEKEPWIVMREGTRNWFTESRSV

SEQ ID NO: 20681 - protein, 81 aa, Pan troglodytes
SVAFEDVAVTFTQEEWALLDPSQKNLYRDVMQETFRNLASIGKKWKPQNIYVEYENLRRNLRIVGERLFESKEGHQHGEIL

SEQ ID NO: 20682 - protein, 81 aa, Pan troglodytes
MFSDVSIDFSPEEWEYLDLEQKDLYRDVMLENYSNLVSLGCFISKPDVISSLEQGKEPWKVVRKGRRQYPDLETKYETKKL

SEQ ID NO: 20683 - protein, 81 aa, Pan troglodytes
RPGAVSFADVAVYFSPEEWECLRPAQRALYRDVMRETFGHLGALGFSGPKPAFISWVEGEVEAWSPEAQDPDGESSAAFSR

SEQ ID NO: 20684 - protein, 81 aa, Camelus dromedarius
FQESVKFRDVAVVFSPDQWVHLSPEERQLYMDVMLDNCDYLVSLGHWTYKAEVISSLKRGKEPWMVGREMTSAPCPACQPA

SEQ ID NO: 20685 - protein, 81 aa, Camelus dromedarius
SSQESLTFQDVAVNFTREEWDQLYPAQKNLYRDVMLENYRNLVALGHQLYKPEVITQLEQEEQWMMERDSPLDTHPEILFL

SEQ ID NO: 20686 - protein, 81 aa, Camelus dromedarius
LQGPVKDVCMARGFSYKKSVHQIPAPRDLYQDIRKESVGNMVSLGSTVSTSNKIARLEQRKEPWTIGVHSSNKRTVLQSNY

SEQ ID NO: 20687 - protein, 81 aa, Camelus dromedarius
VPVAFQDLAVRFSEDEWRLLGEKQRALFLDVMQENYETLVSLGGAPQHSLHLTALVQLVKEIPEFLFGEVSPQSGGAGLDG

SEQ ID NO: 20688 - protein, 81 aa, Camelus dromedarius
ALRDPPQGGVSFLDVAVRFSGKEWRLLDEAQRRLYLDVMLKNYALVSSLALVPAVLNPHGEGLEVSCLAVRLMDAPWFPFP

SEQ ID NO: 20689 - protein, 81 aa, Camelus dromedarius
MPQGSVSFKDVTVDFTQEEWQQLDSAQKALYRDVMLENYCHFVSVGFHMTKPDMIHKLEQGKELWTTGRIFPSRSYLGESV

SEQ ID NO: 20690 - protein, 81 aa, Camelus dromedarius
KVPVTFVDIAVYFSEDEWKNLDEWQKELYNNLVKENYKTLMSLDAEGPVPKPDAPSQAEPREEPCVWEQRDPEEREVLMDP

SEQ ID NO: 20691 - protein, 81 aa, Camelus dromedarius
MESVTLEDVAVGLMQEWALLDDARRKLCRYVLLDNCRTLAPRGTSPCKPSLVSQGALREELRAVERGILCTTGEDWESQLK

SEQ ID NO: 20692 - protein, 81 aa, Myotis davidii
MFQESLTFQDVAVDFTGEEWDQLCPAQKNLYRDVMLENYRNLVALGHQLYKPEVITQLEQEEQWMMERDGPLDTHPENKPE

SEQ ID NO: 20693 - protein, 81 aa, Cercocebus atys
YQDSVTFDDVAVEFTPEEWALLDTAEKYLYRDVMLENYMNLASVEWEIQPRIKGSSLQQGFLKNPIFNGIQMTRNYSGWKL

SEQ ID NO: 20694 - protein, 81 aa, Cercocebus atys
EKGPLTFRDVAIEFSLEEWQCLDTAQQDLYRKVMLENYRNLVFLAGIAVSNPDLITCLEQGKEPWNMKKHVMADEPPVIYS

SEQ ID NO: 20695 - protein, 81 aa, Leptonychotes weddellii
VLQGLSFKDVAVNFTEEEWRELDPAQRDLYRDVMLENYRNLVSLGFPFSKPDIISQLEQAGNPWMQEREVLRSSCTHLETR

SEQ ID NO: 20696 - protein, 81 aa, Felis catus
ILLPLTFEDVAIYFSEQEWQNLDAWQKELYKHVMRTNYEILVSLDDGLPKPELISRIEQGKEFFKNWGESQKSGNIICSSA

SEQ ID NO: 20697 - protein, 81 aa, Leptonychotes weddellii
AHHLVMFRDVAVDFSQEEWECLNSYQRNLYRDVILENYSNLVSVAGCSISKPDVITLLEQGKEPWMVVRDERRRRSLDLES

SEQ ID NO: 20698 - protein, 81 aa, Leptonychotes weddellii
VVFEDVAIYFSQEEWGLLDEAQRFLYHAVMLENFALLSSLGCWHGAQDEEAPSEQDVSVGGSQVRTPKPGPSIQKSQLWEM

SEQ ID NO: 20699 - protein, 81 aa, Enhydra lutris
TKGLVTFEDVAVDFTPEEWQYLNPPQKTLYREVMLETYSNLVSVAGPQGTKPDLILKLEVKEPCLGETKISFWSFPEAVCQ

SEQ ID NO: 20700 - protein, 81 aa, Enhydra lutris
VTFEDVAVYFPWKEWRLLDEAQRRLYHHVMLENFALVSSLGCCYGAEDEEAPFAQSASVGVSQTGTPRATLSSRKTHPCEM

SEQ ID NO: 20701 - protein, 81 aa, Enhydra lutris
AYGSLSFGDVAISFSQEEWEYLNPAQKALYRDVMLETYSNLVSLESSISKPDMITLLEQEKEPWMVLRRETSGWYPDLESN

SEQ ID NO: 20702 - protein, 81 aa, Enhydra lutris
TQVLVTFKDVAVTFTQEEWGHLDLDQRALYQEVMLETCRLLVSLGHPVPKAEFAHLLEHGQELWTGKGGLSRSTCSGDSVR

SEQ ID NO: 20703 - protein, 81 aa, Enhydra lutris
NFWILRLPPGSKGEAPKDWGKLDERQKELYKHVMRGNCETLVSLDYAISKPEVLSQTEPGKEPCSWRRPGPKVPDVPVDPS

SEQ ID NO: 20704 - protein, 81 aa, Enhydra lutris
SQGLVTFEDVAVYFSLEEWERLDADQRDLYKDVMQENYGILVSLGYPIPKPDLIFRLEQGEEPWVPDSPRPEEGDIVTGVY

SEQ ID NO: 20705 - protein, 81 aa, Enhydra lutris
SQGSISFEDVTVNFTQEEWGQLDSDQRTLYRDVMLENYNIFLSLEESKVDGIIESKENQDKHLWQHAFINNKKVTTEKENV

SEQ ID NO: 20706 - protein, 81 aa, Pongo abelii
IGVTVTFDDVALYFSEQEWEILEKWQKQMYKQEMKTNYETLDSLGYAFSKPDLITWMEQGRMLLISEHGCLAKTRRTSSPP

SEQ ID NO: 20707 - protein, 81 aa, Pongo abelii
AHALVTFRDVTIDFSQKEWECLDTTQRKLYRDVMLENYNNLVSLAGYSGSKPDVITLLEQGKEPCVAARDVTGRQYPGLLS

SEQ ID NO: 20708 - protein, 81 aa, Pongo abelii
EMGLLTFRDIAIEFSLEEWQCLDCAQRNLYRDVMLENYRNLVSLGIAVSKPDLITCLEQHKEFQNIKRNEMVVKHPVTCSH

SEQ ID NO: 20709 - protein, 81 aa, Pongo abelii
MGLLTFRDIAIEFSLEEWQCLDCAQRNLYRDVILENYRNLVSLGIAVTKPDFITCLEQNKESQNIKRNEMVAKHSVTCSHS

SEQ ID NO: 20710 - protein, 81 aa, Pongo abelii
QGTVTFEDVAVKFTQEEWNLLSEAQRCLYHDVTLENLALISSLGCWCGVEDEEAPSKQTIYIREIQVRTPMAGVSPKKAHP

SEQ ID NO: 20711 - protein, 81 aa, Pongo abelii
AGGSVSFSDVAVGFTQEEWQHLDPAQRTLYRDVMLENYSLLLSVGYCITKPEVVCKLERGEVLWILEEESPSQSHLDCCID

SEQ ID NO: 20712 - protein, 81 aa, Pongo abelii
VQEPVTFKDVAVDFTQEEWGQLDLVQRTLYRDVMLETYGHLLSVGNQIAKPEVISLLEQGEEPWSVEQACPQRTCSEWVRN

SEQ ID NO: 20713 - protein, 81 aa, Pongo abelii
SQGSVSFRDVTMGFTQEEWQHLDPAQRTLYRNVMLENYSHLVSVGYCIPKPEVILKLEKELINTSRNYSRMKFNEFNKGGK

SEQ ID NO: 20714 - protein, 81 aa, Pongo abelii
LVTFTDVAVNFTKEEWTLLDPAQRNLYRDVMLENSRNLAFIDWATPCKTKDATPQPDILPKRTFPEANRVCLKSISSQLST

SEQ ID NO: 20715 - protein, 81 aa, Pongo abelii
EPGAVSFADVAVYFCREEWGCLRPAQRALYRDVMRETYGHLSALGIGGNKPALISWVEEEAELWDPAAQDPEVAKCQTEAD

SEQ ID NO: 20716 - protein, 81 aa, Pongo abelii
PQASVCFEDVAMAFTQEEWEQLDLAQRTLYREVTLETWEHIVSLGLFLSKSDVISQLEQEEDLCRAEQDAPRDWKATLEEN

SEQ ID NO: 20717 - protein, 81 aa, Pongo abelii
GRPLEMAVSEPEASAAKEWKQLDPAQRNLYNDVMLENYSNQASMGCQAPKPDMISKLEKGEAPWLGKGKRPSQGCPSKIAR

SEQ ID NO: 20718 - protein, 81 aa, Pongo abelii
MFKEAVTFKDVAVAFTEEELGLLGPAQRKLYRDVMVENFRNLLSVGHQPFKQDVSPIERNQQLWIVTTATRRQGNLGEKNQ

SEQ ID NO: 20719 - protein, 81 aa, Pongo abelii
AQVSVTFEDVAVTFTQEEWGQLDAAQRTLYQEVMLETCGLLVSLGCPLFKPELIYQLDHRQELWMVTKDLSQSSYPGDNTK

SEQ ID NO: 20720 - protein, 81 aa, Pongo abelii
CEASVSFEDVTVDFSREEWQQLDPAQRRLYQDVMLELYSHLFSVGYHIPNPDVIFRMLKEKEPRVEEAELSHQRCQEGEFG

SEQ ID NO: 20721 - protein, 81 aa, Pongo abelii
MEPLTFRDVAIEFSPEEWKCLDPAQQNLYRDVMLENYRNLVSLAMCSHFTQDHWPVQGIEDSFHKLILRRYEKCGHDNLQL

SEQ ID NO: 20722 - protein, 81 aa, unidentified
  REGION 1..81: note = Bos indicus x Bos taurus
HSEGRLTFQDVAIDFTQEEWECLDLDQRELYRDVMLQNYGNLASLGLVSKVDLVTFLELLKDPRNMRRMETTAIYPAMSPQ

SEQ ID NO: 20723 - protein, 81 aa, Pan troglodytes
QYREDGLLTFRDVAIEFSPEEWQCLDTAQQNLYRNVMLENYRNLAFLPDLITCLEQGKEPWNMKQHEMVDEPTGSLLMSLS

SEQ ID NO: 20724 - protein, 81 aa, Pan troglodytes
SQKSLTFKDVFVDFTLEEWQQLDSAQKNLYRDVMLENYGHLVSVGHLVGKPDVIFRLGPGEESWMADGGTPVRTCAVEMGF

SEQ ID NO: 20725 - protein, 81 aa, Pan troglodytes
QDSVAFEDVAVNFTHEEWALLSPSQKNLYRDVMRETIRNLNCIGMKWENQNIDDQYQNLRRNPRCDVVERFGKSKDGSQCG

SEQ ID NO: 20726 - protein, 81 aa, Pan troglodytes
IGGDVTFNDVAIDFSHEEWGWLNSAQRDLYKDVMVQNYENLVSVAGLSITKPYVITLLEDGKEPWMMEKKLSKGMIPHWES

SEQ ID NO: 20727 - protein, 81 aa, Pan troglodytes
GQLTFKDVAIEFSQEEWTCLDPAQKTLYRDVMLENYRNLVSLDISCKCVNTDLPPKGKNNMGEAFYTVKLERLESCDIAGL

SEQ ID NO: 20728 - protein, 81 aa, Camelus dromedarius
FKGSVTLQDVAVEFTPEEWQLLDCDQRTLYWDVMLENFRNLISVGCPDTKTKVIFKVEQGQEPWMVEGENPRWRTPGESAK

SEQ ID NO: 20729 - protein, 81 aa, Myotis davidii
TDGLVTFSDVAIHFSQEEWECLSPTQRDLYMDVMLENYSNLISLGIKSETWACALTRNQTDDLSVHGTTLNQLSHTSQGTD

SEQ ID NO: 20730 - protein, 81 aa, Cercocebus atys
GSVTFEDVAIYFSQEEWGLLDEAQRLLYRDVMLENFALITALVCCHGMEDEETPEQSVSVERVPQVRTPEASPSTQKTQSC

SEQ ID NO: 20731 - protein, 81 aa, Leptonychotes weddellii
GLVTFRDVAIDFSQEEWECLDPAQRDLYMDVMLENYSNLVSLDLESTYETKNTISEKDIFEINFSQWEMKERSKTLGLEAS

SEQ ID NO: 20732 - protein, 81 aa, Leptonychotes weddellii
AQGFVTFRDVAIEFSQEEWKCLEPAQRDLYRDVTLENFSNLVSLGLSISKPDVISLLEQGREPWMITNGMTGPWCPELESR

SEQ ID NO: 20733 - protein, 81 aa, Felis catus
WKESLSFEDVAVYVTREEWDKLDWAQKDLYRDVMLENYRNMILLGFQFPKPEVICLLEQWEEPWILDLPRTGTRKASSSAC

SEQ ID NO: 20734 - protein, 81 aa, Leptonychotes weddellii
VRMPVTFNDVAVTFTQEEWGQLDPAQRTLYQEVMLETCGLLVSLGCPLPKPELFYPLDHSPELQTLKRGLSPDSCPGDSTK

SEQ ID NO: 20735 - protein, 81 aa, Leptonychotes weddellii
DSVAFEDVTVKFTMEEWALLDPSQKKLYRDVMQETFRNLASIEKKWKDHDTEDRYNTQGRRLRSHMVEKRCESKEGHQCGE

SEQ ID NO: 20736 - protein, 81 aa, Felis catus
ALALVSFEDVAVTFTGEEWRQLDLAQRTLYQEVMLETCGLLVSLGHPVPKPELIYPLEPGQELWTGKRGVSKSTCTGEKAK

SEQ ID NO: 20737 - protein, 81 aa, Pongo abelii
AAVSVTFKHVTMAFTQKEWKQLDPAQRNLYNDVMLENYSNQASMGCQAPKPDMISKLEKGEAPWLGKGKRPSQGCPSKIAR

SEQ ID NO: 20738 - protein, 81 aa, Pongo abelii
DSVAFEDVAVNFTLEEWALLDPSQKNLYRDVMRETFRNLASIGKQWEDQNIEDPFKIPRRNISHIPERLCESKEGGQGEET

SEQ ID NO: 20739 - protein, 81 aa, Pongo abelii
KTGLLAFSDVVIEFSPEEWACLDPAQRNLYRNVMFENYRNLVSLAILSYSIQDLLPEQDMKDLCQKVTLTRHRSWGLDNLH

SEQ ID NO: 20740 - protein, 81 aa, Pongo abelii
MGVLTFRDVAVEFSPEEWECLDSAQQDLYRDVMLENYGNLVSLGLAIFMPDLMTCLEQRKEPWKVKRQKTVAKHPRIHTGE

SEQ ID NO: 20741 - protein, 81 aa, Pongo abelii
KVPVTFVDIAVYFSEDEWKNLDEWQKELYNNLVKENYKTLMSLDAEGSVPKPDAPAQAEPREEPCVWEQRHPEEREIPMDP

SEQ ID NO: 20742 - protein, 81 aa, Pongo abelii
MLETCRLLVSLGHPVPKPELIYLLEHGQELWTVKRGLSQSTCAGEKAKPKTTEPTASQLAFSEESSFKELLAQRSSRDYRL

SEQ ID NO: 20743 - protein, 81 aa, Pongo abelii
MLVTFKDVAVTFTREEWRQLDLAQRTLYREVMLETCGLLVSLGDRAQVHTREPTTYLPVLSERAFLRGSLTLESLTSSDSR

SEQ ID NO: 20744 - protein, 81 aa, Pongo abelii
SLGLVSFEDVAVHFTWEEWQDLDDVQRTLYRDVMLETCSSLVSLGHCITKPEMIFKLEQGAEPWIVEEAPNLRLSAVQILD

SEQ ID NO: 20745 - protein, 81 aa, Pan troglodytes
EMGPLTFRDVAIEFSLEEWQCLDTAQQDLYRKVMLENYRNLVFLAGIAVSKPDLVTCLEQGKDPWNMKRHSTVVKPPGFLP

SEQ ID NO: 20746 - protein, 81 aa, Pan troglodytes
QGLLTFRDVAIEFSQEEWKCLDPAQRTLYRDVMLENYRNLVSLGEDNFPPEMEFCSCCPGWSAVAQSRLTTTSASRVQLEL

SEQ ID NO: 20747 - protein, 81 aa, Pan troglodytes
PHLLVTFRDVAIDFSQEEWECLDPAQRDLYRDVMLENYSNLISLEPARTHEEQHNLPVPKAGSVNLAAGFGHSRSQTGCGS

SEQ ID NO: 20748 - protein, 81 aa, Pan troglodytes
SVAFEDVAVNFTHEEWALLSPSQKNLYRDVMRETIRNLNCIGMKWENQNIDDQYQNLRRNPRLSETWLQNFILIHYGHLVA

SEQ ID NO: 20749 - protein, 81 aa, Pan troglodytes
MWLSWNTAQKDLYQDVMVENPNHLVSLGYQTSKPDALSKLAHGWEPLKTDAKVQNKNCPGIRKVDSHLQEHSPNHMQQCSG

SEQ ID NO: 20750 - protein, 81 aa, Pan troglodytes
SVAFEDVAVNFTPDEWALLDPSQKNLYREVMQETLRNLASIGKKWKDQNTEKEYKNPRSNLRGLMEERLFESEGHQHGEIL

SEQ ID NO: 20751 - protein, 81 aa, Myotis davidii
EEGQLSFRDVAIDFSQEEWECLDPVQQKLYMDVMLENYSNLVSLATLSEDKQAMLQKAEMEDLFPKIILGPLTFRDVAIDF

SEQ ID NO: 20752 - protein, 81 aa, Cercocebus atys
KKKPVTFEDVAVNFTQEEWDCLDASQRVLYQDVMSEIFKNLASVARILLHKPERITKLEQQEEQWREFVHLPNTEGLSEGK

SEQ ID NO: 20753 - protein, 81 aa, Leptonychotes weddellii
KSQGSLSFKDVAVVFTWEEWQLLDPVQKNLYQDVMLENYSNLVSVGYQVTKADAFYQLEHGTPWITEEEIQSQIHPEDTWQ

SEQ ID NO: 20754 - protein, 81 aa, Leptonychotes weddellii
KVPVTFDDVAVHFSEQEWGNLSEWQKELYKNVMRGNYESLVSMAKASSLEKMNKTMSEGGHRAQWRVGHHADYKTAAKTSC

SEQ ID NO: 20755 - protein, 81 aa, Leptonychotes weddellii
NQESLTFDDVAVDFTWEEWQLLAPAQKDLYRDVMLDNYRNLVSVGFHTSKPDVLSKFDEGEPTWTVEDGIPCQTRSGIKEV

SEQ ID NO: 20756 - protein, 81 aa, Leptonychotes weddellii
HAMALSFQELMAFQDVVVDFSQEEWGQLSPGQKALYWDVMLENYRNLVSLGICSFENFISDWGTGPNNRTPSKHNISEKSP

SEQ ID NO: 20757 - protein, 81 aa, Leptonychotes weddellii
MLRNYSNLVSLGLPDCKPDVISKLEQWEDPWTVKRDVPRGPDSEPEPRAAWLPLEKGALSQGQMTVGLSGQDFWHTIQKEV

SEQ ID NO: 20758 - protein, 81 aa, Felis catus
PRSLENDGGCFSEQEWENLEDWQKELYRNVMKSNYEALVSLKVLGPPEEEAELGTGMLGDLEEEGPGDVLPAEGVMIKQEI

SEQ ID NO: 20759 - protein, 81 aa, Leptonychotes weddellii
TQDSVVFEDVAVDFTQEEWALLDFAQRSLYRDVMLENFQNLASLGYPLHTPYLISRWKQEEDLETVESGPIQGEHQEGFEI

SEQ ID NO: 20760 - protein, 81 aa, Enhydra lutris
FQGSLSFGDVTVDFSQEEWQHLDPAQRTLYRDVMLENYHNFVSVGYPIKKPEVIFKLEEGKEPWILEEEFLYQNYPVWSAD

SEQ ID NO: 20761 - protein, 81 aa, Pongo abelii
EEAQKRKAKESGMALPQGHLTFMDVAIEFSQEEWKSLDPGQRALYRDVMLENYRNLVSLGICLPDRSIISMLRQRREPLVL

SEQ ID NO: 20762 - protein, 81 aa, Pongo abelii
VSLTFDDVAVLFTRDEWRKLAPSQRNLYRDVMLENYRNLVSLALRNLLELPVSTTTCKRLGSHHPYPYKKKLVKLKISDFY

SEQ ID NO: 20763 - protein, 81 aa, Pongo abelii
MNSVAFEDVAVNFTQEEWALLDPSQKNLYRDVMQETFRNLASIGNKGEDQSIEDQYKNSSRNLSSFQIHQRNHTGEKPYEC

SEQ ID NO: 20764 - protein, 81 aa, Pongo abelii
RRGHLTFRDVAIEFSQEEWKCLDPVQKALYRDVMLENYRNLVSLGICLPDLSIFSMMNQRTEPWTVENEMKVANNPDRWEG

SEQ ID NO: 20765 - protein, 81 aa, unidentified
  REGION 1..81: note = Bos indicus x Bos taurus
DLMTFEDVAVEFTWWEWGQLDPTQKDLYWEVMLENFKNLASLDWERRPQAKKPMLSQGLSKEELFQRASVEKHIRDEFRSS

SEQ ID NO: 20766 - protein, 81 aa, unidentified
  REGION 1..81: note = Bos indicus x Bos taurus
AQLTFKDVFIDFTPEEWECLDPAQRTLYKDVMVETLGNLLSVDMSQIDMIKKLQAKADSGKGEIFQRVMFERAESLESKDF

SEQ ID NO: 20767 - protein, 81 aa, unidentified
  REGION 1..81: note = Bos indicus x Bos taurus
HSEGRLMFQDVAIDFTQEEWECLDPGQRKLYRDVMVENYRNLASLGLVSKVDLVTFLELLKDPRNMRRMETTAIYPAMSPQ

SEQ ID NO: 20768 - protein, 81 aa, unidentified
  REGION 1..81: note = Bos indicus x Bos taurus
SQGRLMFQDVTIDFTLEEWECLDLDQQELYRNVMLENYGNLASLGLVVSKPDLVTFLEQMKNPWDIRRTDTTNSGLISVAV

SEQ ID NO: 20769 - protein, 81 aa, unidentified
  REGION 1..81: note = Bos indicus x Bos taurus
AAPMTFEDVAVDFTQEEWSLLDKSQKNLFRNVMLETVSHLVSVGESVNRDVPAPVSILFIHSLNKHLEQLPCVPLSCFLIL

SEQ ID NO: 20770 - protein, 81 aa, Pan troglodytes
MVPLTFSDVAIDFSQEEDLYRDVMLENYTNLVSLEFDFTTESDKLSSEKRNYEVNAYHQETWKRNKTFNLMRFIFRTDPQY

SEQ ID NO: 20771 - protein, 81 aa, Pan troglodytes
RRGHLTFRDVAIEFSQEEWKCLDPAQRTLYREVMVENYRNLVFLGICLPDLSVISMLEQRRDPRNLQSEVKIANNPGSCSV

SEQ ID NO: 20772 - protein, 81 aa, Pan troglodytes
AGRPLEMAVSEPEASAAEWKQLDPAPRNLYNDVMLENYSNQASMGCQAPKPDMISKLEKGEAPWLGKGKRPSQGCPSKIAR

SEQ ID NO: 20773 - protein, 81 aa, Pan troglodytes
SLKKVTFEDVAIDFTQEEWAMMDTSKRKLYRDVMLENISHLLSLGYQISKSYIILQLEQGEELWREGREFLQDQNPDRESA

SEQ ID NO: 20774 - protein, 81 aa, Pan troglodytes
SQDSVTFEDVAVDFTQEEWTLLDQTQRNLYRDVMLENYKNLVAVSSVVEMSLTVSPRLECSGTISAHCSFHLPGSSSSCAS

SEQ ID NO: 20775 - protein, 81 aa, Pan troglodytes
DSVTFEDVAVDFTQEEWTLLDQTQRNLYRDVMLENYKNLVAVGKERNHFGEELFDFNQCEKALSEHSCLKTHRRTYFRKKT

SEQ ID NO: 20776 - protein, 81 aa, Pan troglodytes
QGRLTFRDVAIEFSLAEWKFLNPAQRALYREVMLENYRNLEAVDISSKRMMREVLSTGQGNTEVIHTGMLQRHESYHTGDF

SEQ ID NO: 20777 - protein, 81 aa, Pan troglodytes
MLENYRNLVFLGVGVSKPDLITCLEQGEEPWKRHKMVSKPPVVCSHFAQDLWPEQGIKDSFQKVILRSYGKYGHDNLQLRK

SEQ ID NO: 20778 - protein, 81 aa, Pan troglodytes
VVFEDVAVDFTLEEWALLDSAQRDLYRDVMLETFRNLASVGCEMWERANGSVSLQDMYGQEKSKEQTIPNFTGNNSCAYTL

SEQ ID NO: 20779 - protein, 81 aa, Pan troglodytes
AQESLTLEDVAVDFTWEEWQFLSPAQKDLYRDVMLENYSNLVSVGYQASKPDAFSKLERGEETCTTEDEIYSRICSDSGGA

SEQ ID NO: 20780 - protein, 81 aa, Myotis davidii
MAIRGRSCTRLQVSKPDVISQLEQGTEPWTVDSGIPVGGSGDWVAGPETNMSVPEPDTSEEPSPEAEVEKHKSDESWSSNS

SEQ ID NO: 20781 - protein, 81 aa, Cercocebus atys
EQGYVTFEDVAVYFSQEEWRLLDETQRLLCRNVMLENFSLLASLGLASSKTHDITQLESWEEPFMPAWEVVTSGLPKGCWH

SEQ ID NO: 20782 - protein, 81 aa, Cercocebus atys
QDTVAYEDLCVDYTQKKWKCPALSQRALQWNMMPENDHSMASLGRNMMESSELIPKQEIFKGSESSNSTSGGLFGVVPGAA

SEQ ID NO: 20783 - protein, 81 aa, Cercocebus atys
MTEEFVTLKDVGMDFTLEDWEQLGLEQGDMFWDTALDNCQDLLLLDPPRPNLTSHPDGGEDLEPLPGGSPEATGSDATETK

SEQ ID NO: 20784 - protein, 81 aa, Cercocebus atys
KTGLLAFSDVVIEFSPEEWTCLDPAQRNLYRDVMFENYRNLVSLAILSYAIQDLLPEQDMKDLCQKVTLTRHRSWSLDNLH

SEQ ID NO: 20785 - protein, 81 aa, Leptonychotes weddellii
AHGSVMFNDVSIVFSQEEWEYLDLEQRDLYRDVMLENYSNLVSLGCFISKPDVISLLEQGKEPWKVVRKGRRRYPDLETRY

SEQ ID NO: 20786 - protein, 81 aa, Leptonychotes weddellii
MLENYSNLLSMGLYIPKPQVISLLEQGKEPWMVGRELTRGLCSDLESMCETKLLSLKKEVYEIESCQREIMGLTKHGLEYS

SEQ ID NO: 20787 - protein, 81 aa, Leptonychotes weddellii
QAEVTFEDVAVLFSREEWGRLGPAQRGLYRDVMLETYRNLVSLGAGPAGPKPGVITQLEQGDEPWVLDAQGAKGKERLRVS

SEQ ID NO: 20788 - protein, 81 aa, Pongo abelii
RRGHLTFRDVAIEFSQEEWKCLDPAQRTLYREVMLENYRNLVFLGICLPDLSIISMLEQRRDPRNLQSEMKMANNPGGREC

SEQ ID NO: 20789 - protein, 81 aa, Pongo abelii
MLETYSSLVSLGHHITKPEMIFKLEQGAEPWIVEAPDLRLSAVQILDDLIERSHESHDRFFWQIVITNSNTSTQERVELGK

SEQ ID NO: 20790 - protein, 81 aa, Pongo abelii
QESVTFQDVAVDFTEKEWPLLDSSQRKLYKDVMLENYSNLTSLDWETPSKTKWSLLMEDIFGKETPSGVTMERASLGEKST

SEQ ID NO: 20791 - protein, 81 aa, Pongo abelii
QGLLTFRDVAIEFSQEEWKCLDPAQRTLYRDVMLENFRNLVSLDISFKCMVKEFSSIGKGNTEVFHTRTLQRLASHHIGEC

SEQ ID NO: 20792 - protein, 81 aa, Pongo abelii
GHLTFRDVAIEFSLEEWKCLDTAQRALYRAVMLENYRNLHSVDISSKCMMKKFSSTGQGNIEVDTGTLERHESHHIGDFCF

SEQ ID NO: 20793 - protein, 81 aa, Pongo abelii
SVYEKGPLTFRDVAIEFSLEEWQCLDTAQQDLYRKVMLENYRNLVFLGIAVSKPDLITCLEQGKEPWNMKRHAMVDEPPGR

SEQ ID NO: 20794 - protein, 81 aa, unidentified
  REGION 1..81: note = Bos indicus x Bos taurus
WLQGPMSFKDVAVEFTQEEWMMLDSAQRSMYRDVMLENYINLTLVEYQLCKPVISLSGQEDIRTVKSRIRQGTCPDWEIQF

SEQ ID NO: 20795 - protein, 81 aa, unidentified
  REGION 1..81: note = Bos indicus x Bos taurus
MGRLTFQDVAIDFTQEEWECLDLGQRELYRDVMLENYGNLASLGLVSKLDLVTFLEQLKDSRNIRRMETTAIYPAMSPQDT

SEQ ID NO: 20796 - protein, 81 aa, unidentified
  REGION 1..81: note = Bos indicus x Bos taurus
FPPSWQGSVTFEDVVVYFSWEEWGLLDENQRCLYHDVMLENFALVTSLGKALTPAPVPCTQLCSLQTQVLPPFPSCLAGRH

SEQ ID NO: 20797 - protein, 81 aa, unidentified
  REGION 1..81: note = Bos indicus x Bos taurus
PLESVTFGDVAIDFTQEEWSLLDKSQKNLFRNVMLETVTHLVSVGYQISKSDVVFQLEQGKELWTQAAGGFQGQSPGSESL

SEQ ID NO: 20798 - protein, 81 aa, unidentified
  REGION 1..81: note = Bos indicus x Bos taurus
VFQGRLTFQDVAIDFTQEEWECLDPGQRKLYRDVMVENYRNLASLGLVSKVDLVTFLELLKDPRNMRRMETTAIYPAMSPQ

SEQ ID NO: 20799 - protein, 81 aa, unidentified
  REGION 1..81: note = Bos indicus x Bos taurus
MYFSWEEWCLLDEAQIQLYLDVMLENFALVCMLGSWHGVQDEETPSEQSKSARVSQFCTPRTCLSPEKTQPCKMCIPVLRD

SEQ ID NO: 20800 - protein, 81 aa, Pan troglodytes
PQVSLTFEDVAVLFTWDEWRKLAPSQRNLYRDVMLENYRNLVSLGLPFTKPKVISLLQQGEDPWEVEKDSSGVSSLGSKSS

SEQ ID NO: 20801 - protein, 81 aa, Pan troglodytes
PQASVCFEDVAMAFTQEEWEHLDLAQRTLYREVTLETWEHIVSLGLFLSKSDVISQLEQEEDLCRAEQEAPRDGISLLLPR

SEQ ID NO: 20802 - protein, 81 aa, Pan troglodytes
MLETYNHLVSLEIPSSKPKLIAQLEQGEEPWREERKCPLDLCPDRALLCRQAGIQWCYIGSLQPLPPGFKQFLCLSLLSSW

SEQ ID NO: 20803 - protein, 81 aa, Cercocebus atys
KGPLTFRDVAIEFSLEEWQCLDTAQQDLYRKVMLENYRNLVFLVIYSHFAQDLWPEQGIKDSFQEVILRRYGKCGHEDLQL

SEQ ID NO: 20804 - protein, 81 aa, Cercocebus atys
RLESVTFEDVAVYFTQNQWASLDPAQRALYGEVMLENYANVASLVAFPFPKPALISHLERGEAPWGPDPWDTKIPRGISQG

SEQ ID NO: 20805 - protein, 81 aa, Leptonychotes weddellii
ARDSVTFEDVAVHFSSGEWQCLTRAQRHLYADVMLENYGNVISVGFAVPKPPLISHLEQGNEPCVQDLQDGGFLSCSFPVS

SEQ ID NO: 20806 - protein, 81 aa, Felis catus
ISFEDVAVDFTLEEWRLLNPTQKNLYRDVMLENYSNLVFLEVWLDNNLKMWHQDNQDELRSMERGDECDVFRKIFHSSINF

SEQ ID NO: 20807 - protein, 81 aa, Felis catus
FQDLVTFGDVAVDFSQEEWEWLNPAQRNLYRKVMLENYRSLVSLGVSVSKPDVISLLEQGKEPWMMKKEGTRGTYPDWEYA

SEQ ID NO: 20808 - protein, 81 aa, Leptonychotes weddellii
SQHLVTFEDVAVNFTQEEWTLLDQTQRDLYRDVMLENYQNLIILGYESCKPDLNSSMGGAGELRTGGRGILQELDLQLKTK

SEQ ID NO: 20809 - protein, 81 aa, Leptonychotes weddellii
FQGSVSFKDVTVDFTQEEWQHLDPAQRSLYRDVMLENYSNLVSLGYCVTKPEVIFRLEQGEEPWILEEEFPSQSFPEIWKT

SEQ ID NO: 20810 - protein, 81 aa, Leptonychotes weddellii
QLTFRDVAIEFSQEEWECLDPAQRELYKGVMLENYKNLVSLDVSLTHVIKKLAPKENSNTGEVFQTVMLERHEGLEIKDFY

SEQ ID NO: 20811 - protein, 81 aa, Leptonychotes weddellii
SKVPVTFGDLAIYFSQEEWEWLSPIQKDLYEDVMLENYQNLVSLGLCFRRPNVITSLEKGKAPWIVEPVRKRRGVDSGSKS

SEQ ID NO: 20812 - protein, 81 aa, Enhydra lutris
QEPVTFADVAVLFTPEEWMFLDSAQRSLYRDVMLENYRNLASVGAGDQLGKPSMLSLSEPGEELWAPERRTFPGTRPEPQH

SEQ ID NO: 20813 - protein, 81 aa, Enhydra lutris
QQCRVVLEDVAICFSQEEWGLLDEAQRFLYHAVMLETCALLSSMGCWHGAQDEESPSEQGDSVGGSQVRTLNPGPPTQKSQ

SEQ ID NO: 20814 - protein, 81 aa, Enhydra lutris
TFKEVVTFKDVAVVFTEEELGLLDPFQRKLYRDVMLENFRNLVSVGHQPSKRDGVHLVREEKFWMMKLATQRKGILGYKVQ

SEQ ID NO: 20815 - protein, 81 aa, Enhydra lutris
TVTFRDVAVVFTEEELALLDRAQINLYQDVMLENFRNVVSVGYRIKNNTSPLQGKVLSYLSQGVLYCWQSLKQTINELTVS

SEQ ID NO: 20816 - protein, 81 aa, Pongo abelii
SQELVTFEDVAVYFIRKEWKRLEHAQRDLYRDVMLENYGNVFSLDHETRTENDQEICEDTRSHGVLLGRFQKDISQGLKFK

SEQ ID NO: 20817 - protein, 81 aa, Pongo abelii
EMGLLTFRDIAIEFSLAEWQCLDHAQRNLYRDVMLENYRNLVSLGIAVSKPDLITCLEQNKEPRNIKRNEMVAKHPGREKS

SEQ ID NO: 20818 - protein, 81 aa, Pongo abelii
PLSFKDVAVVFTEEELELLDSTQRQLYQDVMQENFRNLLSVGDKNGKDMEYIQDEELRFFSHKELSSWKIWEEVAGELPGS

SEQ ID NO: 20819 - protein, 81 aa, Pan troglodytes
EMGLLTFRDIAIEFSLEEWQCLDCAQRNLYRDVMLENYRNLVSLGIAVSKPDLITCLEQNKESQNIKRNKMVAKHPVMHSH

SEQ ID NO: 20820 - protein, 81 aa, Pan troglodytes
QESITLEDVAVDFTWEEWQFLSPAQKDLYRDVMLENYSNLVAVGYQASKPDALFKLEQGEQPWTIEDGIHSGACSDIWKVD

SEQ ID NO: 20821 - protein, 81 aa, Camelus dromedarius
KGQESVTFRDVAVDFTLEEWGRLGPGQRELYRDVMLENYQNLLSLGAGFPGSKPDVISRLERGEEPRMEAREDWQVTCSGG

SEQ ID NO: 20822 - protein, 81 aa, Camelus dromedarius
LPNSFAFEDLSVDFTQKEWQLLEPNQKDLYRDVMLENYSSLVSLGYRVTKPGVILKLERGEEPWVGDGGAPRTDAVGECEN

SEQ ID NO: 20823 - protein, 81 aa, Camelus dromedarius
MLENLSHLVSVGYQHCKSDVIFQLEQGEELWTEGGGFLQSHSPGIEGALRKEVLATQHIRREDMSTVIPGKQVSHSPEGPF

SEQ ID NO: 20824 - protein, 81 aa, Cercocebus atys
VGVSLTFEDVAVLFTRDEWRKLAPSQRNLYRDVMLENYRNLVALGLPFTKPKVISLLQKDLGQGNRSKSSHKTTKSTQTQD

SEQ ID NO: 20825 - protein, 81 aa, Cercocebus atys
MCGPLQFRDVAIEFSLEEWHCLDTAQRNLYKNVMLENYSNLVFLGIVVSKPDLITRLEQGKKPLTMKRHEMVAKSPVVCSH

SEQ ID NO: 20826 - protein, 81 aa, Cercocebus atys
QGRLTFRDVAIEFSLAEWKCLNPAQRALYREVMLENYRNLESVDISSKCMMKEVLSTGQGNTEVFYPGTLQRPESHHIGDF

SEQ ID NO: 20827 - protein, 81 aa, Cercocebus atys
EDVAVDFTLEEWALLDSAQRDLYRDVISVSRFEMWERTKTQFKANGSVSQQDTYREEKSKEQTIPNFTRNNSCAYTLEKTC

SEQ ID NO: 20828 - protein, 81 aa, Cercocebus atys
FQKPVTFEDVAVNFTQEEWDCLDASQRVLYQDVMSEIFKNLASVARILLHKPERITKLEQQEEQWRETQVLQASQARPPFF

SEQ ID NO: 20829 - protein, 81 aa, Leptonychotes weddellii
SHGPLSFEDVAIAFTKEEWQQLDPAQRTLYRDVMLENFSHLVSLGHPVSKPDVISKLEQGEEPWIIKRDISNWICPERETR

SEQ ID NO: 20830 - protein, 81 aa, Felis catus
SCSDFSGFCASPIEEPHGLLISSCNSRTMTDGLVTFRDVAIDFSQEEWECLDPAQRDLYVDVMLENYSNLVSLGKVICLKY

SEQ ID NO: 20831 - protein, 81 aa, Felis catus
TGQCDFGGRGRVFSWEEWGLLDEVQRRLYHNVMLENLALITSLGCQHGAENEEAPSEQSVSIEGVSHVRTPKAGLSPQKAS

SEQ ID NO: 20832 - protein, 81 aa, Leptonychotes weddellii
MDHELVTFRDVVINFSQEEWEYLDSAQRDLYWDVMMENYSNLVSLDLESKYDTKTRRDITGSQWKVTESKFIGLESSIFRN

SEQ ID NO: 20833 - protein, 81 aa, Otolemur garnettii
QALLTFRDVSIEFSMDEWACLDPAQQNLYRDVMLETYRHLVFLDLITCLEQRKEPWKVKTHQAVVKRQGSLVFSDVLSSLH

SEQ ID NO: 20834 - protein, 81 aa, Otolemur garnettii
GWVPALFDEVAIYFSDEEWEVLTEQQKALYREVMRMNYETVLSLEFPFPKPDMITRLEGEEESQNSDEWQLQGGGTFAENE

SEQ ID NO: 20835 - protein, 81 aa, Otolemur garnettii
PKGSVSFEDVAVDFTRQEWYRLDPAQRTMHKDVMLETYSNLASVGFCMAKPEMIFKLERGEELWILEEESSSHGYSGDKQM

SEQ ID NO: 20836 - protein, 81 aa, Otolemur garnettii
KKELLTFKDVTIEFSPEEWACLNPTQRDLYRDVTLENYRNLFTLGLTLSKPDLITCLEQRKEPWKVKTQQTVAEQPGRNMG

SEQ ID NO: 20837 - protein, 81 aa, Otolemur garnettii
FQGMVTFSDVAIDFSQEEWACLDSAQRDLYWDVMLENYSNLVSLDLESATYEAKGLATEKNIPGRNFPKKNSDEKSKSLGL

SEQ ID NO: 20838 - protein, 81 aa, Vulpes vulpes
PCRLVLFKDVAVDFSQEEWECLDLEQKDLYRDVMLENYSNLVSLAGFSISKADVLSLLKQGKEPWKVVQEVTRSQSSALVT

SEQ ID NO: 20839 - protein, 81 aa, Otolemur garnettii
LPDSLTFTDVAIDFSQDEWEWLSLAQRSLYRKVMLENYMNLVSVGLCISKPDVISLLEQEKEPWMVTEQITRGLCADLEYM

SEQ ID NO: 20840 - protein, 81 aa, Vulpes vulpes
RPGVVSFADVAVYFSPEEWGCLRPAQRALYRDVMQKTYGLLGALGFSGPKPAFISWVEREVEAWSPEAQDPEAVIRDRGKI

SEQ ID NO: 20841 - protein, 81 aa, Otolemur garnettii
FQESLTLDDVAVEFTWEEWQLLGPAQKDLYRDVMLENYSNLVSVGCEASKPDALSKLKQGEPQWTREDEIHCAARSEIGRV

SEQ ID NO: 20842 - protein, 81 aa, Otolemur garnettii
QESVTFNDVVVDFTLEEWGQLEPGQRELYRDVMLENYQNLLSLRAGLLRSKPDIISRLERGEAPKMEEREAQRVTCPGEEW

SEQ ID NO: 20843 - protein, 81 aa, Vulpes vulpes
KPRAVSFADVAVYFSPEEWGCLQAAQRALYRDVMRETYGHLGALGFPGPKPALISWMEQESEAWSPAAQDPEEGESLGGAL

SEQ ID NO: 20844 - protein, 81 aa, Enhydra lutris
VVFADVAVNFTPEEWALLDRGQRRLYRDVMLETCRNLASLVDTSQDKRSASRTQRNVQNELPSEGKTVLLARNDSCSVFGA

SEQ ID NO: 20845 - protein, 81 aa, Pan troglodytes
KPGAVSFADVAVYFSREEWGCLRPAHRALYRDVMRETYGHLGALGVGGSKPALISWVEEKAELWDPAAQDPEVAKCPTEAD

SEQ ID NO: 20846 - protein, 81 aa, Pan troglodytes
MLETYSSLVSLGHCITKPEMIFKLEQGAEPWIVEEAPNLRLSAVQIIDDLIERSHESHDGFFWQIVITNSNKSTQERVELG

SEQ ID NO: 20847 - protein, 80 aa, Pan troglodytes
MCGPLQFRDVAIEFSLEEWHCLDTAQRNLYKDVMLENYRNLIFLGITVSKPDLITCLEQGRKPLTMKRNEMIAKPSGRCE

SEQ ID NO: 20848 - protein, 81 aa, Pan troglodytes
PRLPLTFEDVAIYFSEQEWQDLEAWQKELYKHVMRSNYETLVSLDDGLPKPELISWIEHGGEPFRKWRESQKSGNTICSSV

SEQ ID NO: 20849 - protein, 81 aa, Camelus dromedarius
GRVVFEDVAIFFSQEEWGLLDEAQRHLYHAVMTENLALLSSLVVVEVLMTYTDEQTMSQLLSHPSGHPDDLGTPGCVVFED

SEQ ID NO: 20850 - protein, 81 aa, Camelus dromedarius
ILWRVTFSDVAIDFSHEEWGWLDSAQRDLYKDVMVQNYENLVSLAGLSIPKPYVIALLEEGKDPWMVERKLSTGFSGLSAA

SEQ ID NO: 20851 - protein, 80 aa, Camelus dromedarius
MILWRVTFSDVAIDFSHEEWGWLDSAQRDLYKDVMVQNYENLVSLGLSIPKPYVIALLEEGKDPWMVERKLSTGMFPGKS

SEQ ID NO: 20852 - protein, 81 aa, Camelus dromedarius
FQDSVVFEDVAVDFTVEEWALLDSAQKELYRDVMLENFRNLASVETLWWRDSVKVLTSVGKASVSKLRSDGIISTLVDFQH

SEQ ID NO: 20853 - protein, 81 aa, Camelus dromedarius
MSVTFEDVAVLFTRDEWRKLGPSQRSLYQDVMLENYSNLLSLGLPFSKPKVISLLQQGEDPWKVERDSPGGASLVKAELEA

SEQ ID NO: 20854 - protein, 81 aa, Myotis davidii
QAEDMDFEDVAIAFSQEEWGLLDEAQRLLYCKVMLENFALVASVGCWHKSEDEETSSKQSVSVTAESLVKASKIALPTQKT

SEQ ID NO: 20855 - protein, 81 aa, Myotis davidii
MNFEDVAIAFSQEEWGLLDDAQRHLYCDVMLEVFALVSFVGHWHKMDDVEAYSEHSVSVGDSLVRASKTAAATQRTHLCKP

SEQ ID NO: 20856 - protein, 81 aa, Myotis davidii
VGVSFEDIALYFSREEWSLLDEGQRQLYLNVMRENFELISSQAFMNMEKSLTNAVNVGNLLRRCIAFIVIRDFTLEKGLMS

SEQ ID NO: 20857 - protein, 81 aa, Myotis davidii
SAEDMNFEDMAVAFSEDEWGLLDEPQRLLYCDVMLEVFALVSSAGCWHKTDDAEACSEQSVSEQEESQDSASKTEPATQRS

SEQ ID NO: 20858 - protein, 81 aa, Myotis davidii
MKFEDVAIAFSQEQWVLLEVQRLLYHDVMLEVFTLVSIYRENMQDGLKGGLALLKATWGESCWHKMDDEESNSDQSVSVQG

SEQ ID NO: 20859 - protein, 81 aa, Myotis davidii
MLENYSHLISVGYHLVKPEVIIKLEQGEEPWRVEEVLLHSRPEVWKVDLIERVQESEDKHSRQTLSINNKTLIEERGDVLG

SEQ ID NO: 20860 - protein, 81 aa, Cercocebus atys
SQASVSFEDVTIEFTQEEWQQMAPVQKNLYRDVMLENYSNLVSVGYCHFKPEVIFKLEQGEEPWFSEEEFSNQSHPKDYRG

SEQ ID NO: 20861 - protein, 81 aa, Cercocebus atys
AQTLLTFRDVAIEFSLEEWKCLDPAQQNLYRDVMLENYRNLFSIGLTVSKPGLITCLEQREEPWNVKRQEAVDGHPALSSH

SEQ ID NO: 20862 - protein, 81 aa, Cercocebus atys
IMEEAVTFKDVAVFFTEEELGLLDPAQRKLYRDVMLENFRNLLSAGHQPFHQETFHFLREEKFWMMETVTQREGNSGGKIQ

SEQ ID NO: 20863 - protein, 81 aa, Cercocebus atys
QGPLTFRDVAIEFSQEEWKSLDPVQKALYWDVMLENYRNLVFLGKHNFALEVKICPCAFLCFLSWEPFHHLTETEALLTHR

SEQ ID NO: 20864 - protein, 81 aa, Leptonychotes weddellii
AQESLTFDDVAVDFTWEEWQLLAPAQKDLYRDMMLENYRNLVSVGCQTSKPDALSKLERGEELWMIEDEIHSRICPEIRKV

SEQ ID NO: 20865 - protein, 81 aa, Leptonychotes weddellii
MPLAGCPVPRPELIYQLEHGQELWMVKRDLSQSACPGDKGKPKTTELSPCAPALSEGALFQELGQGDPGNFQLGQTKDQSG

SEQ ID NO: 20866 - protein, 81 aa, Leptonychotes weddellii
MFPVTFSDVAIDFSHEEWGWLDSAQRDLYKDVMVQNYENLVSLGLSIPKPYVISLLEDGKEPWMVEKKLSKGMFPDWESRW

SEQ ID NO: 20867 - protein, 81 aa, Leptonychotes weddellii
TQDSVAFEDVTVKFTMEEWALLDPSQKKLYRDVMQETFRNLASIVCISEEKWEIHDSEDQNENRGTDLSSQMVERLCKSKE

SEQ ID NO: 20868 - protein, 81 aa, Callithrix jacchus
LTFRDVAIEFSLEECQCLDTAQQNLYRNVMLENYRNLAFLGRQATSSSSSQTPQPGKSTKMEKNKHKKDETIKDQNTSSPS

SEQ ID NO: 20869 - protein, 81 aa, Macaca mulatta
RNLLVYSFYEKGPLTFRDVVIEFSQEEWQCLDTAQQDLYRKVMLENFRNLVFLGIDVSKPDLITCLEQGKDPWNMKRHSMV

SEQ ID NO: 20870 - protein, 81 aa, Monodon monoceros
RQAEAEAEDADAEAVVAEERSPASGTQERLSCGGDAESPGLQEKGYPIPKPDLIFRLEQGEEPWVPDSPRPEEGDIVTGVY

SEQ ID NO: 20871 - protein, 81 aa, Macaca mulatta
PLQFRDVAIEFSLEEWHCLDTAQRNLYKNVMLENYSNLVFLVMCSHFAQDLWPEQNMKDSFQKMIPRRYEKRGHENVQLIK

SEQ ID NO: 20872 - protein, 81 aa, Ovis aries
MGMAGLISEGFVPRCHVGELQELGLSISKPNMISLLEQGKEPWMVEREMSDSQHADWESWCEIKALSPKWYTDEEEMSQGV

SEQ ID NO: 20873 - protein, 81 aa, Ovis aries
SKGCVTFEDVAIYFSQEEWGLLDEAQRHLYHKVMLENFALTASMVCLHETETKETSSEQNVSLEALSQIRIPKVGPVTENA

SEQ ID NO: 20874 - protein, 81 aa, Ovis aries
AQLTFKDVAIQFSPEEWECLDPAQKTLYRDVMVETLKNLLSVAIFHIHMIKKSQLKSNIDIGERFQIVMLENHESHEIKHF

SEQ ID NO: 20875 - protein, 81 aa, Ovis aries
QGSLSFRDVAVGFTRKEWQELDPTQRTLYRDVMLENYSHLVSVGKADVTVTPSAYLARRRFEYDAQGNLFLYSKLDAPHAG

SEQ ID NO: 20876 - protein, 81 aa, Ovis aries
GSVTFEDVAVYFSWEEWSLLDDAQRCLYHNVMLENLALIISLGCWHGAEDEEAPSEQNISVHGMSQVRIPKAGMFSQKAHF

SEQ ID NO: 20877 - protein, 81 aa, Ovis aries
NVSGLALSQTQLTVEDVDIKFTPEEWECLDPAQRALYWDVMEETYRNLLSVDSSDQVKTHIYPEGQSKIFIIHVPLLPQSI

SEQ ID NO: 20878 - protein, 81 aa, Otolemur garnettii
FQGLLTFKDVSIEFSMDEWACLDPAQQHLYREVMLETYRNLVFLVLPFFEPDLITCLEQSKEPRKVKTQQTLLKHPVSWQL

SEQ ID NO: 20879 - protein, 81 aa, Otolemur garnettii
QGPVTLKDVTVEFTKEEWKLLTPAQKTLYKDVMLENYGHLVSIGYRANKSNAFLKLKQGKEPWILELEFPRRNLPVSWGTD

SEQ ID NO: 20880 - protein, 81 aa, Vulpes vulpes
AQESVTFRDVAVFFSQDEWLHLDSAQRMLYREVMLENYGTLVSLGILFSKPKVIFQLQQGEDPWMVENGVSQSPCVGWENL

SEQ ID NO: 20881 - protein, 81 aa, Otolemur garnettii
LQEALTFKDVAVVFTKEELRLLDSVERKLYRDVMRENFRNLLLVGHKAFHQDALHFIKEEKFWTMKTAIQREENSGGKVQT

SEQ ID NO: 20882 - protein, 81 aa, Otolemur garnettii
AHVSLAFRDVAIDLSQEEWECLDPAQRDLYKDVMLENYNNLISLGYTIPKPDVITLLEQDKEPWVVMREGTRSWYTDLECK

SEQ ID NO: 20883 - protein, 81 aa, Vulpes vulpes
FQESVTFRDVAIDFSQEEWEWLQPAQRDLYRHVMLENYSHLVSLGLNISKPYVVSLLEQGKGPWLEKGDLRRDLFSESHGE

SEQ ID NO: 20884 - protein, 81 aa, Otolemur garnettii
LQESVTFQDVAVDFTLEEWQLLDCAKRTLYWDVMLENYRNLISVGCPVTKTKVIFKVEQGQEPWRAERGKPHWSHPEADYL

SEQ ID NO: 20885 - protein, 81 aa, Pan troglodytes
GTVTFEDVAVNFSQEEWSLLSEAQRCLYHDVMLENLTLISSLGCWYEAKDETPSKQTLSIQQESPLRTHWTGVCTKKVHLW

SEQ ID NO: 20886 - protein, 81 aa, Myotis davidii
DETDMDFEDVAIVFSEEEWGLLDEAQRLLYCNVMLEVFALVSSVGCWHKTTDEEEVCPEQIVSVQGESQFRAPKTAPATQR

SEQ ID NO: 20887 - protein, 81 aa, Myotis davidii
RRWGPVTFEDVALHFSREEWRLLAEAQRRLYLDVMLENFALVSSQGCCCGTKNVEAPSEQARTSRESQSSQKTHPCEMCGP

SEQ ID NO: 20888 - protein, 81 aa, Cercocebus atys
GPLQFRDVAIEFSLEEWHCLDTAQRNLYRNVMLENYKNLVFLGIPVSKPDLITCLEQGKKPLTMKRHEMVAKSPVIYSHFA

SEQ ID NO: 20889 - protein, 81 aa, Cercocebus atys
YQDSVTFDDVAVDFTQEEWTLLDPSQRDLYRDVMLENYENLASVGHDLFKPSVICWLEEELRAEQRGVLQEWRLKTKGPAL

SEQ ID NO: 20890 - protein, 81 aa, Cercocebus atys
AQGVVTFEDVAVYFSWKEWGLLDEAQKCLYHDVMLENLTLTTSLGGCGAGDEEASYQQSTSSQWVSQVRLPKAVPSPQKTN

SEQ ID NO: 20891 - protein, 81 aa, Cercocebus atys
MDSVVFEDVAVDFTLEEWALLDSAQRDLYRDVMLETFQNLASVDDETQFKASGSVSQEDIYGEKIPKESKIAAFTRNVSWA

SEQ ID NO: 20892 - protein, 81 aa, Cercocebus atys
IYFSQEEWELLEYTQKALYNDVMQENYETVISLALFVLPKPKVISCLEQGEEPWVQVSREFKDSAGKSPTGLKLKNDTENH

SEQ ID NO: 20893 - protein, 81 aa, Cercocebus atys
GRLTFRDVAIEFSLAEWKCLDPVQRALYTAVMLENYRNLEFVDSFLKFMMEFSSTGHSNTREGFHTGTLERRKSHPIGDFC

SEQ ID NO: 20894 - protein, 81 aa, Leptonychotes weddellii
WVTFQGQVTFDDVAVDFTQEEWGLLGPAQRTLYHDVMLETLRHPVPVGPWNLKPDIVAHLELGVEQRMMDRGLSQDSCLAL

SEQ ID NO: 20895 - protein, 81 aa, Enhydra lutris
KLKSVTFEDVAVYFTQTEWDGLSPAQRALYRDVMLENYGNVASLGFSLLKPAVISQLEGAEIDIQTDNNLTKEVYEEKHNT

SEQ ID NO: 20896 - protein, 81 aa, Enhydra lutris
RKGLLTFRDVAIEFSEEEWGCLTHTQRQLYLDMMLENYGHLLFLGLLLSKPDLIMFLEQEKQLWDVKRKETGGFHSAVSSH

SEQ ID NO: 20897 - protein, 81 aa, Enhydra lutris
QERLTFRDVAIEFSREEWECLNPAQRALYRDVMVENYRNLISLGEDSFPTEDNISTRCMNKELPPKDNINNGELFQTLILK

SEQ ID NO: 20898 - protein, 81 aa, Enhydra lutris
MQGSLTFGDVAVTFTQFEWKHLDTTQQTLYRDVMLENYGNLVSVGLLSSKPKLITQLEQGAEPWMEVQQIPSNTCSVQEYC

SEQ ID NO: 20899 - protein, 81 aa, Enhydra lutris
AYGSLSFGDVAISFSQEEWEYLNPAQKALYRDVMLETYSNLVSLAESSISKPDMITLLEQEKEPWMVLRRETSGWYPDLES

SEQ ID NO: 20900 - protein, 81 aa, Enhydra lutris
STEPVIFRDVAMYFTQKEWQLLKPAQKDLYKEVMLENYGNLASLGYRFFKPKLITRLEQGDEPCVKERDVPQEPQHSSAGV

SEQ ID NO: 20901 - protein, 81 aa, Enhydra lutris
AEDHVTFEDVAVHFSWEEWGLLDEAQRLLYRDVMLENFALMASLGLASSSAHAVTQLQWWREPFVPPCAVLTAVAPRGWRH

SEQ ID NO: 20902 - protein, 81 aa, Pongo abelii
MEPLTFRDVAIEFSPEEWKCLDPAQQNLYRDVMLENYRNLVSLAMCSHFTQDHWPVQGIEDSFHKLILRRYEKFSLLVSSC

SEQ ID NO: 20903 - protein, 81 aa, Pongo abelii
FQESVTFKDVSIDFSWEEWIQADSAQRMTVYEEVMLENYRNLVSLGNHLSKPSGTSQLEREELSLTQKEPPEGGFRDFLGY

SEQ ID NO: 20904 - protein, 81 aa, unidentified
  REGION 1..81: note = Bos indicus x Bos taurus
QESVTFQDVAVDFTEKEWPLLDSTQRKLYKDVMLENYSNLASVDWAMPSKTKWSILMEDIFGKETSNGVTVEKVLGEESAE

SEQ ID NO: 20905 - protein, 81 aa, unidentified
  REGION 1..81: note = Bos indicus x Bos taurus
MLDNYRSLVSLGVSVSKPDVISLLEQGKEPWMVKEEGPRGACPGWEYTFKNKEFPSKQVIYEESSKVMMMGRSHLSYNLNC

SEQ ID NO: 20906 - protein, 81 aa, Pan troglodytes
LVMFQDLSIDFSQEEWECLDAAQKDLYRDVMMENYSSLVSLDSEFRCKTKDSCLPKEIYEVTSSQWVRMEKCHSLVGSSVR

SEQ ID NO: 20907 - protein, 81 aa, Pan troglodytes
ELTSSCGSKTMANVSLAFRDVSIDLSQEEWECLDTVQRDLYKDVMLENYSNLVSLGYTIPKPDVITLLEQEKEPWIVMREG

SEQ ID NO: 20908 - protein, 81 aa, Pan troglodytes
NCYQDTVTFDDVAVDFTQEEWTLLDPSQRDLYRDVMLENYENLASVEWRLKTKGPALRQDGSWFRASNETQMARSHNGGQL

SEQ ID NO: 20909 - protein, 81 aa, Pan troglodytes
PMPGPQEAVVLEDVAVYFTRIEWSCLAPDQQALYRDVMLENYGNLASLALISLLEQGEEPGALILQVAEQSVAKASLCTDS

SEQ ID NO: 20910 - protein, 81 aa, Pan troglodytes
TQVRLTFRDVAIEFSQEEWKCLGPAQRILYRDVMLENYWNLVSLGLCHFDMNIISMLEEGKEPWTVKSCVKIARKPRMQEC

SEQ ID NO: 20911 - protein, 81 aa, Pan troglodytes
EKETLTFRDVAIEFSLEEWECLNPAQQNLYMNVMLENYKNLVFLGVAVSKQDPVTCLEQEKEPWNMKRHEMVDEPSAMCSY

SEQ ID NO: 20912 - protein, 81 aa, Pan troglodytes
ARGCVVFEDVFVYFSREEWELLDDAQRLLYHDVMLENFALLASLGIAFSRSRAVMKLQRGEEPWVYDQVDMTSATEREAQR

SEQ ID NO: 20913 - protein, 81 aa, Pan troglodytes
PQEAVVLEDVAVYFTRIEWSCLAPDQQALYRDVMLENYGNLASLGFLVAKPALISLLEQGEEPGALILQVAEQSVAKASLC

SEQ ID NO: 20914 - protein, 81 aa, Camelus dromedarius
PQDLMTFEDVAVEFTWWEWGQLDAAQKDLYREVMLENFRNLASLGFPVSKPHVICQLEKGEEPCMMEREVSTGAHPGHLWS

SEQ ID NO: 20915 - protein, 81 aa, Cercocebus atys
AQGLVTFADVAIDFSQEEWACLNSAQRDLYWDVMLENYSNLVSLDLESAYENKSLPTEKNIHELRASKRNSDRRSKSLGRN

SEQ ID NO: 20916 - protein, 81 aa, Cercocebus atys
PQGLLTFRDVAIEFSQEEWKCLDPAQRTLYRDVMLENYRNLVSLDISSKCMMNTLSSTGQGNTEVFHTGTLQRQASYHIGA

SEQ ID NO: 20917 - protein, 81 aa, Cercocebus atys
GCLTFRDVAIEFSFMEWKCLNPAQRALYREVMLENYRNLEFVDSSLKSMMEFSSHEHSNTGEGFYTGTLERHKSYHIGDFC

SEQ ID NO: 20918 - protein, 81 aa, Cercocebus atys
GTVTFEDVAVKFTQEEWKLLSEAQRCLYRDVMLENLALISSLGCWCGVEDEEAPSKQSIYIQRETQVRIPMAGVSLKKAHP

SEQ ID NO: 20919 - protein, 81 aa, Cercocebus atys
VHGSVTFRDVAIDFSQEEWECLQPDQRTLYRDVMLENYSNLISLGSSISKPDVITLLEQEKEPWIVVRKETSRWYPDLESK

SEQ ID NO: 20920 - protein, 81 aa, Leptonychotes weddellii
HGGSLSFEDVTVGFTQEEWQRLDPAQRILYRDVMLENYSHLVSVGCCIPKPEVILKLEQGEQPWILEEESPSQSYPEVCKV

SEQ ID NO: 20921 - protein, 81 aa, Camelus dromedarius
VQGLMAFEDVAVYFSREEWGLLDAAQRALYRRVMLENFALLASLGLSVSRPRVVIQLERGEEPWVLSATDVTLARSAQRRP

SEQ ID NO: 20922 - protein, 81 aa, Camelus dromedarius
QVLVTFKDVAVTFTQEEWGQLDLDQRTLYREVMLETCGLLVSLGAVDDGLASSSQSRADAPAGAWAKGMDSHEGPLMEHMS

SEQ ID NO: 20923 - protein, 81 aa, Camelus dromedarius
EICLIWTLKFSSREVLKRTDQFLKFKTMAHGSVTFRDVAIDFSQEEWEFLDSAQRDLYRDVMWENYSNFISLGKAVYPKLY

SEQ ID NO: 20924 - protein, 81 aa, Myotis davidii
SQGLVTFEDVAVYFSLEEWERLAAAQRALYREVMQENYGILVSLGYPIPKPDLIFRLEQGEDPWVPDSPRPEEGDIVTGVY

SEQ ID NO: 20925 - protein, 81 aa, Myotis davidii
MNFEDVAIAFSQEEWGLLDEAQRHLYCDVMLEVFALVSFVDCWHKMDDEEACSEHSESVQGESQVRASETEPGTQRTHVCK

SEQ ID NO: 20926 - protein, 81 aa, Myotis davidii
LVTKESMTFRDVAVDITQEDWELMRPVQKELYKTVTLQNYWNMVSLGLTVYRPTVIPILEEPWMVMKEILEGPTPGWETEA

SEQ ID NO: 20927 - protein, 81 aa, Myotis davidii
MNFEAVAIGFSQDEWGILDEAQRHLYCDVMLEVFALVSSVGCRHKTDEEACCEQSVSEQEESHGRVPKTEPATQSTHLCKW

SEQ ID NO: 20928 - protein, 81 aa, Myotis davidii
PPDAVTFPDVAVDFSRAEWECLNLAQRTLYRKVMLENYRTLVSVGLCVSKPDVISLLEQGEEPWVTDGERAGGLCPRENWK

SEQ ID NO: 20929 - protein, 81 aa, Myotis davidii
AASQGPLTFRDVAIDFSEEERECLDPAQQKLYMDVILENYSNLVSVAMSPEDAQAFLPKPRIQDLFSEIILSTYNGNTSYQ

SEQ ID NO: 20930 - protein, 81 aa, Cercocebus atys
EMGPLTFRDVAIEFSLEEWQCLDSAQQDLYRKVMLENYRNLVLAGIDVSKPNLITCLEQGKDPWNMKRHSMVVKPPVICSH

SEQ ID NO: 20931 - protein, 81 aa, Cercocebus atys
LTFRDVAIEFSQEEWKCLDPAQRTLYRDVMLENYRNLVSLAISSKCMMKKFSSTGQGNTEVIHTGTLQRQASHHIGESCFQ

SEQ ID NO: 20932 - protein, 81 aa, Cercocebus atys
GRVTFEDVTVNFTKGEWQRLNLEQRNLYRDVMLENYSNLVFVGREETTKPDVILSLEQGKEPWLVEEEVPGSGRPEKNGDV

SEQ ID NO: 20933 - protein, 81 aa, Leptonychotes weddellii
LQESLTFRDVFVDFTLEEWQQLDSAQKNLYRDVTLENYSHLVSVGYLVASPDEVLRSGRGEEARRAEGGPSAWNYPVSPSG

SEQ ID NO: 20934 - protein, 81 aa, Leptonychotes weddellii
MDFTEEEWGQLDPVQRALYKEVMLEIYGNLVLVGKKLYDCAACGKSFSRSTDPRYHQRIHTGEKPFICDTCDKAFSYNTNL

SEQ ID NO: 20935 - protein, 81 aa, Leptonychotes weddellii
MVQNYENLVSLAGLSIPKPYVISLLEDGKEPWMVEKKLSKGMFPDWESRWGNKKLLTKEDIYDEDSPQTVIIEKIIKQSHE

SEQ ID NO: 20936 - protein, 81 aa, Leptonychotes weddellii
MHKDVMLENYSNLASVGLCVAKPEMIFKLERGEELWILEEESSGHGYPGSLSMLCGNNSVGGNAVRHDNDLRHQRIQTLDQ

SEQ ID NO: 20937 - protein, 81 aa, Leptonychotes weddellii
KEAFVAFRDVAVDFTQEEWRLLSPAQRTLHREVMLETYNHLVSLEIPFSKPKLISQLEQGEEPWIKERQHPLGLCPAGSKL

SEQ ID NO: 20938 - protein, 81 aa, Leptonychotes weddellii
PGELVTFKDVAVDFAQEEWEHLDASQSHLYGEVMLENYENLISLAGHLLSKPEMIFYFEQEDGVWMEEEMPRSSYSGVRDE

SEQ ID NO: 20939 - protein, 81 aa, Leptonychotes weddellii
QGSAAYQFLSVDYTERKWKGPALSQRAVYRSIVPENYCSMASLAGETRMRRSELPAKQEVSKGSASSDGTSGGLCGVVSGE

SEQ ID NO: 20940 - protein, 81 aa, Felis catus
HQELVTFEDVAIYFTGTEWTGLSPGQKALYRSVMLENYGNLTSLGYQVPRPALISLLEAGNLPWGLEAQDNLSAERTKDIC

SEQ ID NO: 20941 - protein, 81 aa, Leptonychotes weddellii
DPVTFEDVAVEFTQEAWILLDQTQRRLCRDVMLENYKSLAAIDWEICLNTKWSAPQQNILQGKTPSVVEMERSHTGEELFN

SEQ ID NO: 20942 - protein, 81 aa, Felis catus
SQGSVTFRDVAIDFSQEEWEWLQPTQRDLYRHVMLENYSHLVSLGYQDAKPDIIFKLEQGEELWMLQAQMPSQGHPEKVLE

SEQ ID NO: 20943 - protein, 81 aa, Neomonachus schauinslandi
SPGAVSFADVAVYFSPEEWGCLRPTQRALYRDVMRETYGLLGALGFSGPKPAFISWVEGEVEAWSSEAQDPEGETPAAVIR

SEQ ID NO: 20944 - protein, 81 aa, Neomonachus schauinslandi
EQESVTFKDVAIDLTQEEWTLMDRSQRKMYIDVMLENITHLVSVGCQFFQSDVISQWEQGGVLWREDRGLAQGWSPGLENS

SEQ ID NO: 20945 - protein, 81 aa, Neomonachus schauinslandi
MDFTLEDWEHLELDQGDLFWDTALDNYQNLFLLNPSKPKLTSHPDGTEELKVLVRESPESAGPDTAEVKNCLLAHDFLEEG

SEQ ID NO: 20946 - protein, 81 aa, Neomonachus schauinslandi
AQVLVTFKDVAVTFTQEEWGQLDLDQRALYQEVMLETCGLLVSLGHPIPKPELTHLLEHGRELWTGKRGLFRSTCSGDSAK

SEQ ID NO: 20947 - protein, 81 aa, Monodelphis domestica
LAEPLKFRDVAVEFTQEEWGQLNSSQKNLFRDVMLENYKNFVYLGLPVSMPAMILLLERGEASWMSEEEAPGGILSDSISH

SEQ ID NO: 20948 - protein, 81 aa, Physeter macrocephalus
VTFDDVAVTFTQEEWRQLDPAQRTLYQEVMLENCRLLVSLVAVAGQTMPSIPTMRRLTIDDFEIGRPLGKGKFGNVYLARL

SEQ ID NO: 20949 - protein, 81 aa, Monodelphis domestica
AQEAVTFKDVAVDFTREEWRLLSPPQKELYKEVMLENAQNLLSVGLPAPPKDVMSYLEQRKTPWMLEQESLRNCCPEREIR

SEQ ID NO: 20950 - protein, 81 aa, Monodelphis domestica
GQEEVTFKDVAVDFTQEEWCLLSPPQKELYKEVMLENARNLLSVGLPVPPEDVISYLEQREASWMQEQEGLKSFCPEGENR

SEQ ID NO: 20951 - protein, 81 aa, Monodelphis domestica
SQGSITFKDVAVDFTQEEWCLLDHSQKELYLEVMLENVQNLLSVGLPVPRENFISCFQQGKTPCLVEEKDPRSFFPVEDVE

SEQ ID NO: 20952 - protein, 81 aa, Monodelphis domestica
QKSLVTFKDVAVDFTKEEWRNLDPSQKELYRDVMLENYRNLVFLGLTVWKPDVISHLEEGEAPWMPDRELPKSNYSGWKTR

SEQ ID NO: 20953 - protein, 81 aa, Monodelphis domestica
RAPEVVTFQDVAVDFTRGEWRLLSPPQKELYREVMLENARNLLSVGLAVPRDVISYVEPREAPWRLEQEGLRSCSPGEIRP

SEQ ID NO: 20954 - protein, 81 aa, Physeter macrocephalus
ELVTFRDVVISFSQEEWEYLDSAQRDLYWDVMMENYSNLVSLDLESKYDKKTLFTEKYIIEKNDSQWEVIESSKLVGLENS

SEQ ID NO: 20955 - protein, 81 aa, Physeter macrocephalus
MPEKSRNLVLLGLPVSQPGMNSQLEQREGSWMLEREGLRSTCPDWKIVSESPPEQDISEESFQDPSVEMPSGESDHRNSEL

SEQ ID NO: 20956 - protein, 81 aa, Physeter macrocephalus
SQESVTFKDVAVDFTQEEWALLDTSQRKLFRDVMLENISHLVSVGNQLDKSDVISHLEQGEQLSRGGLGFLQGQSPVISGR

SEQ ID NO: 20957 - protein, 81 aa, Monodelphis domestica
TRARQEPVTFQDVAVVFTPEQWASLDPSQKELYRDVMLETFSNLLCLGLAVSKPRVIHQLERGEAPWRPEGRVPGSSHPGE

SEQ ID NO: 20958 - protein, 81 aa, Monodelphis domestica
GYQRPLTFGDVAVDLSLEEWRRLSPAQRGLYREVMLENYEHLVCVGLSGSKPSVISRLEQAAPWVPEGECPGGPPPDSFHQ

SEQ ID NO: 20959 - protein, 81 aa, Papio anubis
MLENYSYLVSVGYCIPKPEVILKLEKGEEPWILEEKFPSQRHLELINTSRNYSRMKFNEFNKGGKCLCDEKHEIIHSEEEP

SEQ ID NO: 20960 - protein, 81 aa, Papio anubis
WSQNSVTFQEVAVDFSQEEWALLDPAQKNLYKDVMLENFRNLASVGYQLCRHSLISKVDQEELKTDDRGILQGDCADWETQ

SEQ ID NO: 20961 - protein, 81 aa, Papio anubis
DGLVTFRDVAIYFSQEEWECLDPAQRDLYVDVMLENYSNLVSLDLESTTYETKKIFSEKDIFEINFSQWEMKEKSKTLGLE

SEQ ID NO: 20962 - protein, 81 aa, Aotus trivirgatus
AQKVLTFRDVAIEFSLEEWKFLDPAQQNLYRDVMLENYRNLFSIGLTVSKPGLITCLEQRKAPWNLKRREAVDGHIFFAEY

SEQ ID NO: 20963 - protein, 81 aa, Aotus trivirgatus
WWGLLSFKDISMEFTWDEWQLLDSTQKYLYREVTLENYHNLISVGYHGAKPDLIFKLEQGEDPWIINAKISRESCPDGWEE

SEQ ID NO: 20964 - protein, 81 aa, Pan troglodytes
FLVFKPELISRLEQGEEPWVLDLQGAEGTEAPRTSKTDSTIRTENEQACEDMDILESESYGTVVRISPQDFPQNPGFGDVS

SEQ ID NO: 20965 - protein, 81 aa, Camelus dromedarius
PESVTFEDVAIYFSENEWTGLAPAQRALYRDVMLENYGAVASLEGVLKSKKKDFILKNIFEEAQDHMVLSSGPQWYDSQEF

SEQ ID NO: 20966 - protein, 81 aa, Camelus dromedarius
FWPPVSFKDVAVTFTWEEWGQLDPAQRTLYRDVTLETCSHLVSLGLLLSKPDVICRLEQGEDPWRVQRGPPRDVTFWPTCT

SEQ ID NO: 20967 - protein, 81 aa, Cercocebus atys
AQVSVTFDDVAVTFTQEEWGQLDLAQRTLYQEVMLENCGLLVSLGCPIPRPELIYHLEHGQEPWTRKEDLSQDTCPGDKAK

SEQ ID NO: 20968 - protein, 81 aa, Cercocebus atys
PRGSTFFGSVTVAFAQEGWRCLVSTPRERYKEGIPEKSRNLVLLGLPVSQPGMNSQLEQREGTWMLEGKDVRSPSPGWKIV

SEQ ID NO: 20969 - protein, 81 aa, Cercocebus atys
TDVAIEFSLEEWQCLDTAQQNLYRNVMLENYRNLVFLGITVSKPDLITCLEKEKEPWNMKRHEMVDEPPVICSHFAEDFWP

SEQ ID NO: 20970 - protein, 81 aa, Cercocebus atys
MEFTWDEWQLLDSTQKYLYRDVILENYHNLLSVGYHGTKPDLIFKLEQGEDPWIINAKISRQSCPDGWDEWYQNNQDELES

SEQ ID NO: 20971 - protein, 81 aa, Cercocebus atys
EMETLTFRDVAIEFSLEEWECLNPAQQNLYRDVMLENYKNLVFLAGIDISKQDPITSLEQEKEPWNMKRHEMVDESPAMCS

SEQ ID NO: 20972 - protein, 81 aa, Leptonychotes weddellii
MLENYGAVASLAFPFPKPALISQLERGEAPWCKAPQGALDGGGPRGISSGCPFLKPAGISHLEQVEEPLNLKLRGEGPSLS

SEQ ID NO: 20973 - protein, 81 aa, Leptonychotes weddellii
RSFENDGVCFSEQEWENLEDWQKELYRNVMKSNYETLVSLILVFSFSAAEGVMIKQEIQYAQEGSADLPGEFSGIAEEQAF

SEQ ID NO: 20974 - protein, 81 aa, Leptonychotes weddellii
TEQAVMFRDVAVDFSQEEWEFLDLKQRNLYRDVMLENYSHLVSLGLSLPKPTLISFLEQDNEPWIVEKESPKSLYPDVKSQ

SEQ ID NO: 20975 - protein, 81 aa, Leptonychotes weddellii
MLETYSSLVSVGPQVTKPDLILKLEVEEPCLAETKISFWSFPEAACQIDEQIERQHQDDQDRYLLMQAGFPDKKTILTKTG

SEQ ID NO: 20976 - protein, 81 aa, Felis catus
MFSDVSIDFSQEEWECLNDDQKDLYRDVMLENYSHLVSMGHSVSKPDVISFLEQGKEPWLVDRDLTRDQWPGKDCTFEVLS

SEQ ID NO: 20977 - protein, 81 aa, Neomonachus schauinslandi
TFKETVTFKDVAVVFTEEELGLLDPAQRKLYRDVMLENFGNLVSVGHQPFKRDVAHLVREEKFWMVKLATQRKGSSGEKVQ

SEQ ID NO: 20978 - protein, 81 aa, Monodelphis domestica
MQGSLTFKDVAVDFTQEEWCLLDHSQKELYLEVMLENVQNLLSVGLPVPREYLTSCFQQGEAPWLLEQEVPRSSCPEAETN

SEQ ID NO: 20979 - protein, 81 aa, Physeter macrocephalus
AHGSLTFSDVAIGFSQQEWECLDLIQKTLYRDVMMENYGNLVSLGHSISKPNVITLLEQGKEPWMVMREKTRSWCTDLDSR

SEQ ID NO: 20980 - protein, 81 aa, Monodelphis domestica
MTFKDVAVDFTRAEWEHLDSAQKDLYRDVMLENYKNLVSLGRLCQKIRGKSKDTTPKQCNYISSKKRLTVNSNECAEALRK

SEQ ID NO: 20981 - protein, 81 aa, Physeter macrocephalus
LQEPVTFRDVAVDFTQEEWGQLGPAQRTLYRDVMLETFGHLLSVGPELPKPEVISQLEQGAELWVAERGIAQGCCPGWEPG

SEQ ID NO: 20982 - protein, 81 aa, Monodelphis domestica
SQESITFKDVAVDFNQEEWCLLDHSQKELYMEVMLENVQSLLSVGLPIPRENVLSCFQQGEAPWLLEQKDPRSFCPETENN

SEQ ID NO: 20983 - protein, 81 aa, Monodelphis domestica
SLTFKDVAVDFTQAEWCLLDHSQKELYLEVMLENVQNLLSVEAETNFEVKEMSTKLRIFVQESDPKRWMNDGSHDFVLREI

SEQ ID NO: 20984 - protein, 81 aa, Monodelphis domestica
QGSITFKDVAVDFTQEEWWLLDHSQKELYREVMLENVQNLLSVEAETNFEVKEMSTKLNLFLEGSGPQSGLNQGSCDFILR

SEQ ID NO: 20985 - protein, 81 aa, Monodelphis domestica
AQEAVMFQDVAVDFTREEWRLLSPPQKELYKEVMLENARNLLFVGLPAPPQEVISYLEQREVQCMLKPEGLQSCCPEGEIR

SEQ ID NO: 20986 - protein, 81 aa, Monodelphis domestica
TQEVVTFKDVAVDFTREEWRLLSPPQKELYKEVMLENAWNLLSVGLPAPPEDVISSLEQREAPWMLEQEGLRSCCPGEGGK

SEQ ID NO: 20987 - protein, 81 aa, Monodelphis domestica
MLENARNLLSVGLQAPPEDVISSLEQRATLWMLEQEDPGSSFPEREIKLEMKANPTDMSPSVLEMGLQRFISDGPDNFAFG

SEQ ID NO: 20988 - protein, 81 aa, Monodelphis domestica
FQGSVTFRDVAVDFTWEEWRRLGPAQKELYREVMLETYRTLVCLGLAASKPDVISQLERRDAPWVATEFEMLPETREPTLK

SEQ ID NO: 20989 - protein, 81 aa, Physeter macrocephalus
CEVSVSFEDVTVNFSREEWEQLDSAQRRLYQDVMLENYSHLLSLGCEIPKPEVIFKLEQGEEPWTLEEETTHQSCSDGKFG

SEQ ID NO: 20990 - protein, 81 aa, Monodelphis domestica
AQEAVTFHDVAVDFTREEWRLLTPPQKELFKEVMLDNAWNLLSAGLAVSRGDVISYFEQREAPWMLEQEDLGIGCPGEIRP

SEQ ID NO: 20991 - protein, 81 aa, Monodelphis domestica
SQKSLTFQDVAVEFTQEEWGLLEPAQKDLFREVMLENYENFVSLGLPVSKPDVTCHLERRETFRPPEEEVPRSTYLDFLRE

SEQ ID NO: 20992 - protein, 81 aa, Monodelphis domestica
PQGPITFKDVAVNFTQEEWRLLDPAQRDHYREVMLENYRNLVSLGLVLVKPKVISRLERWGEPWRPDGGGRSSGASEMKTA

SEQ ID NO: 20993 - protein, 81 aa, Physeter macrocephalus
EQLTFKDIDIEFSQEEWECLEPAQRALYRDVMLETYRNLLSLDISHIHVIKKLQLKVNTGRGEVLQTVMLGRHERNKMKHF

SEQ ID NO: 20994 - protein, 81 aa, Monodelphis domestica
FKELVTFRDVAVDFTREEWRLLSPSQKELYREVMLENVRNLLSVGKEPLPEDVISSLEQREAPWMLEQEDLRSCSPGEIRP

SEQ ID NO: 20995 - protein, 81 aa, Monodelphis domestica
APAFLTFDDVAVYFSEQEWGNLEKWQKEIYKHVMRTNYETLVSLDHAIPKPDLISWIEQGKEPFIKDQMDLEEREIVVICG

SEQ ID NO: 20996 - protein, 81 aa, Papio anubis
MGPLTFRDVTVEFSLEEWQCLDTAQQNLYRDVMLENYRNLVFLGIAVSKPDLITCLEQGKEPWNMNRHEMVAKPPAFYLMG

SEQ ID NO: 20997 - protein, 81 aa, Papio anubis
FQGSVSFKDVTVGFSQEEWQHLDPSQRALYRDVMLENYSNLVSVGYCVHKPEVIFRLEQGEEPWRLEEEFPSQSFPEVWTA

SEQ ID NO: 20998 - protein, 81 aa, Papio anubis
ADVSLAFRDVSIDLSQEEWECLDPAQRDLYKDVMLENYSNLVSLGYTIPKPDVITLLEQQQEPWIVMREGTRSWYTDLEYK

SEQ ID NO: 20999 - protein, 81 aa, Papio anubis
FQGSVSFRDVTVGFTQEKWQHLDPAQRTLYRDVMLENYSYLVSVGYCIPKPEVILKLEKGEEPWILEEKFPSQRHLELINT

SEQ ID NO: 21000 - protein, 81 aa, Aotus trivirgatus
EQGYVTFEDVAVYFSQEEWRLLDEAQRLLYRNVMLENFSLMASLGLASSKTHEITQLESWEEPFVPAWDVMTSAIPRGCWH

SEQ ID NO: 21001 - protein, 81 aa, Aotus trivirgatus
VVFEDVAVDFTLEEWALLDSAQRDLYRDVMLETFRNLASVDDETPCKADRSVSQQDMYGAKISQEQTIPNFTRNNSCAYAL

SEQ ID NO: 21002 - protein, 81 aa, Aotus trivirgatus
MEFTWDEWQLLDSTQKYLYREVTLENYHNLISVGYHGAKPDLIFKLEQGEDPWIINAKISRESCPDGWEEWYQKNQDELES

SEQ ID NO: 21003 - protein, 81 aa, Papio anubis
QDSVTFDDVAVDFTPEEWALLDTAEKYLYRDVMLENYMNLASVDKSNITLLEWEIQPRIKGSSLQQGFLKNPIFSGIQMQT

SEQ ID NO: 21004 - protein, 81 aa, Aotus trivirgatus
MASVALEDVAVNFTREEWALLGPCQKNLYKDVMQETIRNLDCVGMKWKDQNIEDCYMLERFGESKGGGSQCGETSSQIQDS

SEQ ID NO: 21005 - protein, 81 aa, Aotus trivirgatus
RSQNSVTFQEVAVDFSQEEWALLDLAQKNLYKDVMLENFRNLTSVGYQLCRHNLISKVDQEELKTDERGILQSDCAEWETQ

SEQ ID NO: 21006 - protein, 81 aa, Papio anubis
PQASVCFEDVAMAFTQEEWEQLDLAQRTLYREVTLETWEHIVSLGLFLSKSDVISQLEQEEDLCRAEQVAPRGVRSSKEQR

SEQ ID NO: 21007 - protein, 81 aa, Aotus trivirgatus
LTFRDVAIEFSQEEWRCLDPAQRTLYRDVMLENYRNLVSLDLSHNAVIKELAPKQKSNMGEVFHTVALEQHQTPDMQEFCF

SEQ ID NO: 21008 - protein, 81 aa, Aotus trivirgatus
DSVAFEDVAINFTCEEWALLGPSQKSLYRDVMQETIRNLDCIGMKWQNLDVEEDKYKNPGRNLRCYMVERSCEIKDNSQCG

SEQ ID NO: 21009 - protein, 81 aa, Aotus trivirgatus
MHGPLTFRDVTVEFSLEEWQFLDAAQQNLYKDVMLENYRNLVFLNIVVSKPDMICLEQGIEPWNIKRHEMVAKAPVMCSHF

SEQ ID NO: 21010 - protein, 81 aa, Leptonychotes weddellii
QMPVTFEDVALYLSREEWGRLDHAQQSFYRDVLQKRNGLSLGATELGKEEPAPSLASLAALGDVKSFRSRVGRAQGDILQC

SEQ ID NO: 21011 - protein, 81 aa, Leptonychotes weddellii
VVFADVAVYFTPEEWALLDRGQRRLYREVMLETCRNLASLVCLSQDKRSASRTQQNILQNELPSEEKIVIFARNDSCSVFG

SEQ ID NO: 21012 - protein, 81 aa, Felis catus
RFTLLTFRDVAIEFSQEEWGCLNHSQRELYRDVMLETYGHLLFLDYLSPLPLPLHCLHDLSFTVSSQCTQNFLPKPCLEPS

SEQ ID NO: 21013 - protein, 81 aa, Felis catus
THGSMPFSSVTVAFTQDGWRHLIPAPKDRFKEGIPENTRNLVLLGLPVSQPGMNSQLEQREEGPWMLEGGGLRSTCTDWKI

SEQ ID NO: 21014 - protein, 81 aa, Neomonachus schauinslandi
AQGHVTFEDVAVYFSWEEWGLLDEAQRLLYRDVMLENFSLMASLGLASSMTHEITQLEWWREPFLPPCGVMTAAMPRDGRQ

SEQ ID NO: 21015 - protein, 81 aa, Neomonachus schauinslandi
LQDTFSFEDLSVDFTQKEWQLLDPSQKDLYKDVMLENYSSLVSLGYEVMKPDVIFKLEQGEEPWIRDGEVPSSDHPEQVLQ

SEQ ID NO: 21016 - protein, 81 aa, Neomonachus schauinslandi
WLQVPVTFRDVAVAFTQEEWMMLDSGQRRIYRDVMLENYMTLTSMEYQLWKPTVISPLGQEEIRTMKRRLLAGTYPDWEIQ

SEQ ID NO: 21017 - protein, 81 aa, Monodelphis domestica
PQGSVTFRDVAVNFSQDEWGRLDPSQKELYREVMLENYHNLVCLGLAASKPDVIDQLERGEAPWMPGIGCPDQKIRSDTQE

SEQ ID NO: 21018 - protein, 81 aa, Physeter macrocephalus
SQEWLNFKDVVIEFSQEEWECLDPAQRALYRDVMLETYRNLISVGISFSDLNIISIFGARGRAQDSDICLIHVVKQLQPKG

SEQ ID NO: 21019 - protein, 81 aa, Monodelphis domestica
ERVVVTFKDVAVDFTQEEWRLLTPPQKELYREVMLENVRNLLSVGLAVPRVDVISYLERREAPWMLEEEGLRSSCTEDEIR

SEQ ID NO: 21020 - protein, 81 aa, Monodelphis domestica
GQEEVTFKDVSVDFTWEEWRLLSPPQKELYKEVMVENARNLLSVGLPAPPQDMISYLEQMEAPWMLEKEGLRHYCPEGVIR

SEQ ID NO: 21021 - protein, 81 aa, Physeter macrocephalus
GSVSFTDVTVDFTQEEWEQLDPSQRILYMDVMLENYSNLLSVEVWKADDQMERDHRNPDEQARPFIVFKNQTPVEERDNLF

SEQ ID NO: 21022 - protein, 81 aa, Papio anubis
QGRVTFRDVAIEFSLAEWKCLNPAQRALYREVMLENYRNLESVDISSKCMMKEILSTGQGNTEVFHTGTLQRHESHHIGDF

SEQ ID NO: 21023 - protein, 81 aa, Papio anubis
GLTFRDVAIEFSQEEWKCLNSTQRTLYRDVMLENYRNLVSLDLSRNCMIKELAPQRESDREEVFHTVTLEQHEKHDIEEFC

SEQ ID NO: 21024 - protein, 81 aa, Aotus trivirgatus
SCEPVTFEDVTLGFNPEEWGLLDLKQKSLYREVMLENYRNLVSVEHQLSKPDVVSQLEEAEDFWPVEKGIPQDTIPEYSEL

SEQ ID NO: 21025 - protein, 81 aa, Papio anubis
PAQGMTFEDVAIYFSQEEWELLDESQRFLYCDVMLENFAHVTSLGYCHGMENEVIASEQSVSTQVRTSKGDTPTQKSLSEI

SEQ ID NO: 21026 - protein, 81 aa, Aotus trivirgatus
MAPVQRNLYRDVMLENYSHLVSVGYCLFKPEVIFKLEQGAEPWFSEEEFSNKSHPKDYRGDDLIKQNKNIKDKPLQQVICI

SEQ ID NO: 21027 - protein, 81 aa, Papio anubis
VTFSDVAIDFSHEEWAWLDSAQRDLYKDVMVQNYENLVSVAGLSVTKPYVIMLLEDGKEPWMVEKKLSKDWESRWENKELS

SEQ ID NO: 21028 - protein, 81 aa, Aotus trivirgatus
PLGLVTFEDVAVAFTQEEWQYLNPLQRTLYRDVMLETYSNLVFVGQQVTKPDLILKLEVEECPVEGKLPFWSFPEVCQVNE

SEQ ID NO: 21029 - protein, 81 aa, Aotus trivirgatus
MKLLTFRDVTIEFSPEEWKCLDPAQQNLYRDVMLENYRNLVSLGVAISNPDLVTSLEQRKEPYNVKMHKTVARPPALCSSF

SEQ ID NO: 21030 - protein, 81 aa, Aotus trivirgatus
GEGSLSLEDVAVDFTREEWQFLDLSQKVLYKEVMLENYRTLVSVGYQGTKPVEGAAHSQTCPGFVIQSRRYAGKYCDAFGG

SEQ ID NO: 21031 - protein, 81 aa, Aotus trivirgatus
MLENYRNLVFLGIVVSKPDLITCLEQGKKPLTMKKHGMIAKPPVMCSHLAQDLWPEQSIKDSFQKVRLRRYEKYEHDNLQF

SEQ ID NO: 21032 - protein, 81 aa, Papio anubis
EMGLLRFRDVAIEFSLAEWQCLDRAQQNLYRDVMLENYKNLVSLGIAVSKPDLITHLEQNKEPRNIKKNEMLAKHPVMCSH

SEQ ID NO: 21033 - protein, 81 aa, Sarcophilus harrisii
PQASVTFEDVAVYFTQKEWESLAPNQRALYRDVMLENYGNLISLAFLFPKPAIISQLEKGEEPWVLDPQRPLDKKGTCYKG

SEQ ID NO: 21034 - protein, 81 aa, Sarcophilus harrisii
LVTFKDIVVDFTEEEWGLLDLSQKELYKEVTLENVQNLLCLGTETGLEVNKMTTKLSILVEECGLQRFMIDDPSDFNWREI

SEQ ID NO: 21035 - protein, 81 aa, Pan paniscus
MTVSKPDLIACLEQNKEPQNIKRNEMAAKHPVTCSHFNQDLQPEQGIKDSLQKVIPRTYGKCGHENLQLKKCCKRVDECEV

SEQ ID NO: 21036 - protein, 81 aa, Felis catus
QVSVTFDDVAVTFTQEEWGQLDPAQRTLYQEVMLENCGLLVSLGPGSSAGTREAVRVVLLGGWQCCPQEPFGIVCGHSGLS

SEQ ID NO: 21037 - protein, 81 aa, Leptonychotes weddellii
SQGPVKDVHMARGFSYKKSVHQIPAHRDLYRDIRKESVGNMVSLGSTVSVSNKIARLEQRKEPWTLGLHSSNKRNIILRSH

SEQ ID NO: 21038 - protein, 81 aa, Leptonychotes weddellii
LQGGVTFEDIAVYFSWKEWRLLDEAQRRLYHHVMLENFTLISSLGCCCGAEDEEAPFAQSTSVGVSQTRTPKAAQSSRKTH

SEQ ID NO: 21039 - protein, 81 aa, Neomonachus schauinslandi
FQEAVTFGDVAVHFSREEWQCLDPGQRALYKEVMLENHSSVAGLGFLVFKPELISRLEQGQEPWVIDLKGVEGREGARTCL

SEQ ID NO: 21040 - protein, 81 aa, Neomonachus schauinslandi
MLENYGNVISVGFAVPKPPLISHLEQGNEPCVQDLQDGGFLSCSFPVSVDRTWPGTEKASSEQEVFESGEVCWVHVKSLLK

SEQ ID NO: 21041 - protein, 81 aa, Neomonachus schauinslandi
VLQGLSFKDVAVNFTEEEWRELDPAQRDLYRDVMLENYRNLVSLGFPFSKPDIISQLEQAGNPWMQEREVGVGTQHGEKPY

SEQ ID NO: 21042 - protein, 81 aa, Neomonachus schauinslandi
SKVPVTFGDLAIYFSQEEWEWLSPIQKDLYEDVMLENYQNLVSLGLCFRRPNVITLLEKGKAPWIVEPVRKRRGVDSGSKS

SEQ ID NO: 21043 - protein, 81 aa, Monodelphis domestica
SQGSITFKDVAVDFTQEEWCLLDHSQKALHLEVMLENVQNLLSLGIPVPRENFISCFQQGTAPYLLERNGPSSCCPEAETN

SEQ ID NO: 21044 - protein, 81 aa, Monodelphis domestica
SQGSIAFKDVAVDFTQEEWCLLDHSQKELYLEVMLENVQNLLSVGLPVTREHLISCFQQGKAPWLLEQKDPRSSSPDFEVK

SEQ ID NO: 21045 - protein, 81 aa, Physeter macrocephalus
MLQNYRSLVSLGVSVSKPDVISLLEQGKEPWMVKKEGTRGACPDWEYAFKNNEFSSKQVIYEESSKVRTMGRSHLSYNLDC

SEQ ID NO: 21046 - protein, 81 aa, Physeter macrocephalus
FQEAVTFKDVAVAFTEEELGLLDSAQRKLYQDVMVENFRNLVSVAARKRDSCIFRTFHLLLESLEQLSEEAVTFKDVAVTF

SEQ ID NO: 21047 - protein, 81 aa, Physeter macrocephalus
PHSLVSFKDVAIDFSQEEWECLDLEQKHLYRDVMLENYSNLVSLGFSISKPDVLSLLEQGKDPWKVVWDVTRGLSPDWESR

SEQ ID NO: 21048 - protein, 81 aa, Monodelphis domestica
SQGSVKFKDIAVDFTKEEWGLLDYSQKELYKEVMLENVQNLLFAGLPVPRENFIFCFLQRKSPCLLEQKSPRSFCPDGITK

SEQ ID NO: 21049 - protein, 81 aa, Monodelphis domestica
AQVVVTFKDVAVDFTQEEWRLLTPPQKVLYREVMLENAQNLLSVGLALPRADVISYLEQKEAPWMLEEEGLKSSCTEEEIR

SEQ ID NO: 21050 - protein, 81 aa, Monodelphis domestica
IQESVTFKDVSVDFTWEEWRHLDPAQRDLYRNVMLENYENLVSVGISVSTVDMISLLEKRDGPWMPEGEVSGAICPDSLNE

SEQ ID NO: 21051 - protein, 81 aa, Monodelphis domestica
AQVLVTFQDVAVDFTQEEWRLLDPGQKELYKEVMLENVQNVLSLGLPVPREDWISHFDQGRAPWMLEGEGPSNSCLGRERR

SEQ ID NO: 21052 - protein, 81 aa, Monodelphis domestica
QEMVTFQDVAVEFTWEEWHLLSPPQKELYKDVMLENARNLLSVEGEFRPEMKENPTEMSLSVEEMELQRFMSDSPSKFPFR

SEQ ID NO: 21053 - protein, 81 aa, Monodelphis domestica
LAQESITFKDVDSQKELCKEVMPENVQNLLSVGLTVPRENFITCFQQGESPPRLEKKGQWMKEICANPKKFSQYSVLNQNM

SEQ ID NO: 21054 - protein, 81 aa, Monodelphis domestica
CQQLMTFKDVTVDFTQEEWDHLGPAQRDLYKDVMLENYQNFLFLGFPISKPEVISQLEIDEARWLMLVKEIPRNFSPDPLC

SEQ ID NO: 21055 - protein, 81 aa, Monodelphis domestica
QVLTFKDVAVEFTREEWRLLSPPQKELYKEVMLENAGNLLSVGEIIPEMKVNPTEVSPPVEEMDLQRFMSVSPNNFASREF

SEQ ID NO: 21056 - protein, 81 aa, Monodelphis domestica
EVVKFQDVAVDFTQEEWHLLSPPQKELYKEVMLENARNLLSVGEIRPEMKVNPTEVSLSLEEMDLQRFMSDGLDNFASVKF

SEQ ID NO: 21057 - protein, 81 aa, Papio anubis
EKETLTFRDVAIEFSLEEWECLNPAQQNLYRNVMLENYKNLVFLGIDISKQGPLTSLEQEKEPWNMKRHEMVDESPAMCSY

SEQ ID NO: 21058 - protein, 81 aa, Papio anubis
RVQSCVTFEDVFVYFSREEWELLEEAQRFLYRDVMLENFALVATLAFIFPVPCSCPVGGGRKPWVPDRADTTAATVKETYR

SEQ ID NO: 21059 - protein, 81 aa, Papio anubis
SVTFEDVAVVFTDEEWSHLVPIQRDLYKEVMLENYNSIVSLETKPEIHDASDEKSEGSLRECLGRQSPLCPKFEVYAPNGR

SEQ ID NO: 21060 - protein, 81 aa, Papio anubis
TVTFDDVALYFSEQEWEILEKWQKQMYKQEMKTNYQTLDSLGKMDKTRRTTSPPTDEQLDMKDTGKLPCFDHEGTLRTKEE

SEQ ID NO: 21061 - protein, 81 aa, Papio anubis
MEPLTFKDVAIEFSLEEWQCLDTAQRDLYRNVLLENYRNLVFLVMSFHFAQDLWPKQNIKDSFQKVTLRRYGRCEYENLQL

SEQ ID NO: 21062 - protein, 81 aa, Aotus trivirgatus
MAFGDVTVDFTPKEWRLLSPAQRALYREVTLENYSHLISLGILHSKPELIRRLEQGDAPWGEERRRQPGPHAGIYAECVLP

SEQ ID NO: 21063 - protein, 81 aa, Papio anubis
MEPLKFRDVAIEFSLEEWQCLDTIQQNLYRNVMLENYRNLVFLGIAVSKPDLITCLEQEKEPWTRKRHRMVAKPVTCSHFA

SEQ ID NO: 21064 - protein, 81 aa, Aotus trivirgatus
GRLTFKDVSIEFSLAEWKCLTPAQRALCREVMLENYRNLESVDSFLKSMLKFSPAGQGSTREGFHTGTLEKYTSHHIGDSC

SEQ ID NO: 21065 - protein, 81 aa, Aotus trivirgatus
VMFRDVAIDFSQEEWECLDAAQRDLYRDVMLENYSNLVSLDLPSRCARKDLSPEKNTYETELPQWEMSDRLEKCDLEESNS

SEQ ID NO: 21066 - protein, 81 aa, Aotus trivirgatus
MGVLTFRDVAIKFSPEEWECLDSAQQCLYRDVMLENYRNLVFLGLAVTKPDLITHLEQEKELWNVKRQETVAKYPEILPKQ

SEQ ID NO: 21067 - protein, 81 aa, Aotus trivirgatus
SGAFVAFRDVAVDFTQEEWRLLSPAQRTLHREVMLETYNHLVSLEIPSSKPKLIAQLERGEEPWREERKCSLDLRPGSKPE

SEQ ID NO: 21068 - protein, 81 aa, Aotus trivirgatus
KSEEAVTFKDVAVVFSDEELRLLDLTQRKLYRDVMLENFRNVVSVGHQSIPGGLPQSEREEKLWMMKTATQRDNSSGGKHL

SEQ ID NO: 21069 - protein, 81 aa, Sarcophilus harrisii
FQESLTFKDVAVDFTYEEWQQLNPDQRYLYRDVMLENYKNLVFLGHQISKPDVISQLEQGKEPWPIEREIFTYSCRDWETK

SEQ ID NO: 21070 - protein, 81 aa, Camelus dromedarius
MTEQFSTLKDTAMDFTLDDWEQLGLDQGDLFWDTALDNYQSLFLLDPLRPNLVSHPEAGEALESLVKGSPESTAPDMAEAK

SEQ ID NO: 21071 - protein, 81 aa, Myotis davidii
SQELVTFEDVAVYFIRKEWKRLEPAQRDLYRDVMLENYGNVFSLDGETRTEHDQDISEDTESDGVLLGRFQKDISQGLKFE

SEQ ID NO: 21072 - protein, 81 aa, Myotis davidii
LQEPVSFRDVAVDFTQEEWQQLGPEQKTTYRDVMLENYSHLISVGYDSTKPSVIVRLEQGEEPWVAEGGSPCQGCPEKIKK

SEQ ID NO: 21073 - protein, 81 aa, Myotis davidii
MFSDVSIDFSQEEWECLNDDQRDLYRDVMLENYNNLVSMGHSISKPDVISFLEQGKEPWLVDREVTGSQYPDLTRHQRIHT

SEQ ID NO: 21074 - protein, 81 aa, Cercocebus atys
QDSVTFDDVAVEFTPEEWALLDTAEKYLYRDVMLENYMNLASVGKSNITLLEWEIQPRIKGSSLQQGFLKNPIFNGIQMQT

SEQ ID NO: 21075 - protein, 81 aa, Cercocebus atys
FQGSVTFTDVAIDFSQEEWRWLQPAQRDLYRCVMLENYGHLVSLGLSISKPDVVSLLEQGKEPWLGKRNVNRDLFSVSESR

SEQ ID NO: 21076 - protein, 81 aa, Leptonychotes weddellii
MLLDDSQRLLYQDVMLENFALLASLGIVSSRSHAVTQLEQKEDPQMPDQVAMTPVTEREARRGPGLGGWCAVEDEAPSPEQ

SEQ ID NO: 21077 - protein, 81 aa, Leptonychotes weddellii
GSVSFTDVTVDFTQEEWEQLDPSQRILYMDVMLENYSNLLSVEVWKADDQTEKDHSNPDEQARPFIIFKNQTPIEERGNLF

SEQ ID NO: 21078 - protein, 81 aa, Leptonychotes weddellii
IQGQVNFEDVAVYFSQEEWGLLDEAQRLLYRDVMLENLALMASLGYESSMSHGVASLELGSKPWGSDWADVTPGGTREAQG

SEQ ID NO: 21079 - protein, 81 aa, Leptonychotes weddellii
CEVSVSFEDVTVDFSREEWQHLDPAQRRLYRDVTLENYSHLRSVGYEVPKPEVIFKLEQGEEPWILERKTPHQSCSDGRFG

SEQ ID NO: 21080 - protein, 81 aa, Leptonychotes weddellii
PDWGTFEDVAVYFSREEWELLDETQRHLYHNVMLENLALVASLGCWCGVEEAPLEQSVSVEGALHFRTPKACPSTQKANTC

SEQ ID NO: 21081 - protein, 81 aa, Leptonychotes weddellii
SRGSLSFGDVAISFSQGEWECLDPAQRALYRDVMLETYSNLVSLGSSISKPDVITLLEQEKEPWVVVRRETSRCFPGLTKI

SEQ ID NO: 21082 - protein, 81 aa, Felis catus
FQRSVTFGDVAIHFSQQEWEYLDSVQKNLYRDVMMENYDNLVSLAEHSISKPDVITLLEQRKEPWMVVREDTKRWCTDLES

SEQ ID NO: 21083 - protein, 81 aa, Monodelphis domestica
LALERVTFQDVAVDFTEEEWRLLGHSQKELYKEVMLENVQNLLSVGLPVAREDMIYFQEGETPWILEQKGPRNSHPVAVTS

SEQ ID NO: 21084 - protein, 81 aa, Monodelphis domestica
QAQEAVTFQDVAVDFTRGEWRLLSPPQKELYKEVMLENARNLLSVGLAVPRDVISYVEQREAPWRLEQEGLRSCSPGEIRP

SEQ ID NO: 21085 - protein, 81 aa, Monodelphis domestica
AGLAVNKPGIIFHLERGGPSWILKRSVLGGTFPEHLSPGTRCATTETTAEFPISVGETFQNPGDAKFAEVWEYNSNLEQQT

SEQ ID NO: 21086 - protein, 81 aa, Monodelphis domestica
SQGSITFKDVAVDFTQEEWCLLGHSQKELYLEVMLENVQNLLSVGLPVPRKYCTSCFQQGNAPWLLEQKGPRTSCPEAEAN

SEQ ID NO: 21087 - protein, 81 aa, Monodelphis domestica
SQGLMNFKDVAVDFTEEEWCLLDHSQKELHLEVMLENMQNLLSVGLLVPREDIVSCFQQGEAPWLLEQRGPRSSCPEAETN

SEQ ID NO: 21088 - protein, 81 aa, Monodelphis domestica
SITFKDVAVDFTQEEWWLLDHSQKELYREVMLENVQNLLSVVYKEEISPPRGSHPPVRPQSDPSRDPGVRGNCFWDLEAPI

SEQ ID NO: 21089 - protein, 81 aa, Monodelphis domestica
SQGPITFKDVAVDFTHEEWCLLDHFQKQLYLEVMLENVQTLLSVGLPVPRENFISYFQQGESPWLLEQKGPRNSCPEAEAN

SEQ ID NO: 21090 - protein, 81 aa, Monodelphis domestica
AQEMVTFQDVAVDFTREEWCLLSPPQKELYKEVMLENAWNLLSVGLPAPPEYVISYLEKREAPWMLEREGPRSCCPEGEIR

SEQ ID NO: 21091 - protein, 81 aa, Monodelphis domestica
MMWLGTSGRSGLSGPCPENPLQGCHPAGLEEWALNGISRPSVISQLEQKEEPWVLDLQSLEEGEILREAHTDFENQVEKLN

SEQ ID NO: 21092 - protein, 81 aa, Physeter macrocephalus
PKVPVTFDDISIYFSTPEWEKLEEWQKELYKNIMKGNYESLISMDYAMNQPDVLSQIQPEGDHNTEDRAGPEESEIPTDPS

SEQ ID NO: 21093 - protein, 81 aa, Monodelphis domestica
LFGSITVKDVTVDITQEEWVLLDHSQQQLYLEVMLENVQNLLSVGLLVPRENFISCFQQGEAPCLLEQDCPRSFCPEAKTH

SEQ ID NO: 21094 - protein, 81 aa, Monodelphis domestica
QSQILTFQDVTVDFTWEEWRLLDSFQKDLFRDVMLENYENFAFLAGHPVFKPKVISQLERIETPWKPEEEATFFFEDSFIQ

SEQ ID NO: 21095 - protein, 81 aa, Physeter macrocephalus
SQSLVTFGDVAVEFSPEEWEWLDSAQRSLYRSVMLENYRSLVSLGLCVSKPKMISSLEQRKEPWAAKRTLTRGGCSDSRAL

SEQ ID NO: 21096 - protein, 81 aa, Monodelphis domestica
FQKSLTFQDVAVDFTQEEWGLLEPAQKDMYRDVMLENYENFISLGLMEPKASTISLLERGEAPPGLSEGRAPRSIFVDFLH

SEQ ID NO: 21097 - protein, 81 aa, Physeter macrocephalus
WKGLLSFEDVALYFTREEWDTLDWARKDLYRDVMLDNYRNVLSLGVQFPKPEVICQLEQWEEPWIPDLPRAGATRASGGAS

SEQ ID NO: 21098 - protein, 81 aa, Papio anubis
MGLLTFRDVAIEFSLEEWQRLDTAQQNLYRNVMLENYRNLAFLGIAVSKPDLITCLEQGKEPWNMERHEMVAKPPGMCCYF

SEQ ID NO: 21099 - protein, 81 aa, Aotus trivirgatus
MATSQESVIHVFVDFTLEEWQQLDSNYSHLVSVGYLVAKSDVIFRLGPEEESWMAHGGILVQTCAEVWQADEQIDCCKKGQ

SEQ ID NO: 21100 - protein, 81 aa, Papio anubis
SVAFEDVAVNFTQEEWILLDSSQKILCREVMQETCRNLASYRDCVKAKKVVNMMDKLTFLLDENNVNAVFVEKSLYVIPSL

SEQ ID NO: 21101 - protein, 81 aa, Aotus trivirgatus
VAFEDVDVNFTQDEWALLDPSQKNLYRDVMQETFRNLASVGKKWKDQKIEDEYKNPRSNLRGLMGERLLESKKDHQLEEIL

SEQ ID NO: 21102 - protein, 81 aa, Papio anubis
GTVTFEDVAVKFTQEEWNLLSEAQRCLYRDVTLENLALISSLGCWCGVEDEAPSKQSIYIQRETQVRIPMAGVSPKKAHPC

SEQ ID NO: 21103 - protein, 81 aa, Aotus trivirgatus
AQGPVSFRDVTVGFTQEEWQHLDPAQRTLYRDVMIENYSHLVSVGYCIPKPEVILKLEKGEEPWISEEKFPSQSHLELINA

SEQ ID NO: 21104 - protein, 81 aa, Aotus trivirgatus
MTTVSSTARPQEWAIMVPDQRALYRDVMLENYEAVAFVAVPPTSKPALVSHLEQGKEPCFTQPQGVLSRRDWRAAFIGRSE

SEQ ID NO: 21105 - protein, 81 aa, Leptonychotes weddellii
QELVTFKDVAVDFTQEEWQQREPAQRDLYRDVMLETLQNLSSLGSRACRSVPGLALEELGGSRLWRSGAGEAQGPPGGAPA

SEQ ID NO: 21106 - protein, 81 aa, Leptonychotes weddellii
MAQESVVFSDVSIDFSQEEWECLNDDQRDLYRDVMLENYSHLVSMDVISVLEQGKEPWLVDRELTREQWPVLESRCETKKL

SEQ ID NO: 21107 - protein, 81 aa, Leptonychotes weddellii
SQPPVSFKDVAVTFTQEEWGQLDLAQRRLYRNVTLETCSHLVSLGLLLSKPDVISWLEQGQDPWRAGQGPPRDWKNTFEKK

SEQ ID NO: 21108 - protein, 81 aa, Leptonychotes weddellii
AEGHVTFEDVAVYFSWEEWGLLDEAQRLLYRDVMLENFSLMASLGLASSRTHEITQLEWWREPFLPPCGVMTAAMPRGWWR

SEQ ID NO: 21109 - protein, 81 aa, Felis catus
RCLTDYSQDLVIHEDVAVEFTQEEWTLLDPTQRNLYRDVMLGNHKNLVAVDWEICLNTKWSAPQQNILQGKTPNVEMNSRQ

SEQ ID NO: 21110 - protein, 81 aa, Leptonychotes weddellii
GLLSFKDISMEFTWEEWQLLDSTQKYLYRDVILENYSHLVSVEGWKEWYQKNQDEFENIEGSYTFGAFGKRHLSRTHVPSR

SEQ ID NO: 21111 - protein, 81 aa, Leptonychotes weddellii
QDAVVFADVAVYFTPEEWALLDRGQRRLYREVMLETCRNLASLDCCIQVKPCGSGTQLNILENELSSEDKIVRLIRNDSWA

SEQ ID NO: 21112 - protein, 81 aa, Leptonychotes weddellii
NSQGLLTFRDVAIEFSQEEWGCLNLVQRELYRDVMLENYGNLLFLGLVVSKPDLVIFLEQKRELWDVKGKETVAIHPGRWE

SEQ ID NO: 21113 - protein, 81 aa, Felis catus
QAQESLTFEDVAVGFSREEWRLLVPAQKDLYRDVMLENFRNLVSVGYLASKPDALSKLEGGELWTTEDEIDSRICPEIRKV

SEQ ID NO: 21114 - protein, 81 aa, Felis catus
SVAFQDLAVRFSEDEWQLLGEGQRALYQDVMRENYETLLSLGTAELLPLSAFLSPTEPAGTMEGRSYAVEGQEPPQGGGPL

SEQ ID NO: 21115 - protein, 81 aa, Neomonachus schauinslandi
GRPAEMAVSEPGGSAAKEWEQLDPAQRNLYKDVMLENYSNLASMGYQAPKPDMISKLEKGEEPWLGKGKRPRQGGPSEIAR

SEQ ID NO: 21116 - protein, 81 aa, Monodelphis domestica
MLETFENLVSLGLPMSKPQVICQLERGEAPCLPETEAPDPLYSRTKYEINDWIPKPGLFMGASFKESTMTKNGSWHSKMVE

SEQ ID NO: 21117 - protein, 81 aa, Monodelphis domestica
AQVLVTFQDVAVDFTQEEWRLLDPGQKELYKEVMLDNAQNMLFLGLPVPREDWFSHFHEGGASWMLEGEDPSNSGLDGERR

SEQ ID NO: 21118 - protein, 81 aa, Monodelphis domestica
SQGPVRFEDVAIYLSKKEWELMDSTQKRLYRQVMLETYENVLSVGTPHDKPAMIVHLEQEETAWSPALQRPRKKKKKKKKK

SEQ ID NO: 21119 - protein, 81 aa, Monodelphis domestica
AQVLVTFQDVAVDFTQEEWRLLDPGQKELYKEVMVENAQNVFSLGLPVLREDWISYFDQGETVWILDGEGPSNSCLDGERR

SEQ ID NO: 21120 - protein, 81 aa, Monodelphis domestica
PQGLVTFRDVAVDFTREEWRLLSPRQKELYKEVMLENAGNLLSLGLPVPREDVISYFEQKDVPWMLEQKALRSFCPGGPVK

SEQ ID NO: 21121 - protein, 81 aa, Physeter macrocephalus
SQDPVTFQEVAVDFSQEEWALLAPAQKILYRHVMLENYRNLASVGYHLRKPSLLTQEELRTKKRRILQDACAGKKILYLRS

SEQ ID NO: 21122 - protein, 81 aa, Monodelphis domestica
IQGSLTFRDVTVDFTQEEWCLLDHSQKELYVEVMLENVQNLLSVGLPVPREYYTSYFQQEKAPWLLVQKGPRNSSPEAETN

SEQ ID NO: 21123 - protein, 81 aa, Monodelphis domestica
GLAARFQDVAVEFTWEEWRHLDSAQRALHRNVMLENVCCLFLSEGKIRLEMKEMTAELSLSGDETQRQRCIGDGACDSTWR

SEQ ID NO: 21124 - protein, 81 aa, Monodelphis domestica
MLENVQNLRSVGLPVPRENFISCFQKRESLWLLEQKGPEAETNFEVKEISTKLSLFVEGSGPQRCMNEDPHDVLLRKIHVS

SEQ ID NO: 21125 - protein, 81 aa, Monodelphis domestica
FQDLVTFKNVAVHFTAEEWQLLELSQKELYQQVMLENFRNLVWLGLVVSKPDVIYQLEQGEASWKLGGEGQRSNCSDWETL

SEQ ID NO: 21126 - protein, 81 aa, Monodelphis domestica
MLENYQNLFCLGLAATKPEVIYQLERGEAPWRPEERGTEGSHPDWESRPETYKLTPNLDISAGQVLQDRLTKGGLWISYLR

SEQ ID NO: 21127 - protein, 81 aa, Monodelphis domestica
MYFSQEEWEILGPIQKDLYKDVMQETYGNMISVALFMIPKPELISCLEQEKEPCVTNSKESKEIPKDSNTEMTDSSICPNG

SEQ ID NO: 21128 - protein, 81 aa, Physeter macrocephalus
APLPLTFEDVAVYFSEQEWRNLEAWQKELYKQVMRTNYEILVSLDDGLPKPELISWLEQGRELFKNWGESQKSGNIICFSA

SEQ ID NO: 21129 - protein, 81 aa, Monodelphis domestica
IQGSLTFKDVTVDFTEEEWCHLDHSQKELYLEVMLENVQNLLSVGLPVPREYCTSYFQQEKARWLLEQKCPRSSSPEAETN

SEQ ID NO: 21130 - protein, 81 aa, Physeter macrocephalus
RVVFEDVAVYFSQEEWGLLDEAQRHLYHAVMTENFALVTSLGCWHGAQYEEAPSEQSVSVGMSEVGTPKPDPSTKKAQPYE

SEQ ID NO: 21131 - protein, 81 aa, Monodelphis domestica
PQAPVTFRDVAVDFTAEEWRRLGPAQKELYREVMLENYRSLVCLGLVASRPAVIGQLLRGEAPWMAAPELRAASGPDEDTR

SEQ ID NO: 21132 - protein, 81 aa, Monodelphis domestica
FQESLAFKDVAVEFTCEEWRRLEPAQRDLYRQVMMENYKSFVSLGLPVSKLDVMSLLERGEAPWMPKGEVLRRYSRGSCTQ

SEQ ID NO: 21133 - protein, 81 aa, Papio anubis
LKGLVTFEDVAVEFTQEEWALLDPAQRTLYRDVMLENFRNVASLGDQVDKPGLIAQLEQEDKVMTEERGILPDVENPLKAK

SEQ ID NO: 21134 - protein, 81 aa, Papio anubis
MDSVAFEDVAVNFTHEEWALLGPSQKNLYRDVMRETIRNLNCVGMKWENQNIDDQYQNLRRNPRCDVGERFGKSKDGSQCE

SEQ ID NO: 21135 - protein, 81 aa, Papio anubis
MENLKSGVYPLKEANGCPGAERNLLVYSFYEKGIAVSNPDLITCLEQGKEPWNMKRHVMADEPPVIYSHFAQDLWPEQGIK

SEQ ID NO: 21136 - protein, 81 aa, Papio anubis
EEALMAFRDVAVAFTQKEWKLLSSAQRTLYREVMLENYSHLVSLGIAFSKPKLIEQLEQGNEPWREENEHLLDPCPAQTPS

SEQ ID NO: 21137 - protein, 81 aa, Aotus trivirgatus
IKGSLTFRDVAIEFSLEEWQCLDTAQQDLYRQVMLENYTNLAFLGIAVSKADLITCLQQEKDPWNMKRHSIVAKPPVLCSH

SEQ ID NO: 21138 - protein, 81 aa, Papio anubis
AQESVTFEDVAVNFTNREWQSLTYAQRHLYKHVMLENYGNMVSLGFPFPKPPLISHLERGVEPCVQDPQDRESLSYSYPVS

SEQ ID NO: 21139 - protein, 81 aa, Papio anubis
AQESLTLRDVAVEFTWEEWQLLGPAQKHLYQDVMLENYSNLVSVGFQASKPDALTKLEQGEPLWALEDEIHSPTHPEIEKA

SEQ ID NO: 21140 - protein, 81 aa, Papio anubis
VTFKDVAVTFTQEEWRQLDLTQRTLYREVMLETCGLLVSLGDRTQVHTREPTTYPPVLSEQAFVRGSLTVESSTSSDSRLG

SEQ ID NO: 21141 - protein, 81 aa, Aotus trivirgatus
SQGLVTFGDVAIDFSQEEWEWLSPIQRNLYRKVMLENYRNLASLGLCVSKPDVISLLEQGKEPWTVKRKMTRAGCPDLKAV

SEQ ID NO: 21142 - protein, 81 aa, Sarcophilus harrisii
HPESVTFKDIVVEFTRTEWQYLTSSQKELYRDVMLENYGNLVYLGLAVSKPDVISQLEQREAPWMPGGAQKSNCPDWEATP

SEQ ID NO: 21143 - protein, 81 aa, Camelus dromedarius
AQESVTFEDVAVNFSNGEWQCLTHAQRHLYKDVMLENYGNVVSLGFPFPKPPLISRLEQGAEPWVLDPQDGEFLSCPSPDS

SEQ ID NO: 21144 - protein, 81 aa, Camelus dromedarius
LQASVSFKDVTVELTQEEWQQMGPVQKTLYRDVMLENYNNLVSVVNCIFKPEVIFKLEKGEEPWFSEEEVSNQSHRDYRDN

SEQ ID NO: 21145 - protein, 81 aa, Camelus dromedarius
EQLTFEDVAITFLQEEWECLVPAQRALYRDVMLETCRNLLSVDMSRIHVMKKLQLKANIDRELSQTVITERHVRTERKQFD

SEQ ID NO: 21146 - protein, 81 aa, Myotis davidii
LHGLVAFEDVSLGFDPEEWELLDPEQKSLYRQVVLENYRNLASVEYQLSKPEVVSRLEEEEELWSVERGVPQDTFSGRPEA

SEQ ID NO: 21147 - protein, 81 aa, Myotis davidii
MDTVTFEDVALNFTKEEWALLAPEQRALYQDVMLENIRNLASVGEVFGQKTEDAASGQDILAENTVREADRVCLRSNNPTP

SEQ ID NO: 21148 - protein, 81 aa, Cercocebus atys
MAFTQEEWEQLDLAQRTLYREVTLETWEHIVSLGLFLSKSDVISQLEQEEDLCRAEQVAPRDWKTTLEENRLNSEKDRARE

SEQ ID NO: 21149 - protein, 81 aa, Cercocebus atys
PKVPMTFDDVAVYFSEQEWGKLEDWQKELYKHVMRGNYETLVSLDYAISKPDILTRIERGEEPCLDGWGQEKQNEVEVGHS

SEQ ID NO: 21150 - protein, 81 aa, Cercocebus atys
RVQSCVTFEDVFVYFSREEWELLEEAQRFLYRDVMLENFALVATLAFIFPVPRSCPVGGGRKPWAPDRADTTAATVKETYR

SEQ ID NO: 21151 - protein, 81 aa, Cercocebus atys
CYQDSVTFDDLAVDFTPEEWTLLDPTQRNLYRDVMLENYKNLATVGCQLFKPSLISWLEQEESRTVQRGDFQASERKVQLK

SEQ ID NO: 21152 - protein, 81 aa, Leptonychotes weddellii
SSQGLLTFRDVAIEFSQEEWGCLNHTQRESYRDVMLENYGNLLFLGLIVSKPDLVSFLEQKKDPWDAKRKKTVAFHPDRWE

SEQ ID NO: 21153 - protein, 81 aa, Leptonychotes weddellii
MRRKWKHILNVVPSQEEWGQLDLAQRRLYRNVTLETCSHLVSLGLLLSKPDVISWLEQGQDPWRAGQGPPRDWKNTFEKKE

SEQ ID NO: 21154 - protein, 81 aa, Felis catus
AEGGVTFEDIAIYFSWKEWRLLDEAQRRLYYDVMLENFTLISSLGCCCGAEDAEAPLEQSISVGVSQASVPKAALSSRKTH

SEQ ID NO: 21155 - protein, 81 aa, Leptonychotes weddellii
AHHLVMFRDVAVDFSQEEWECLNSYQRNLYRDVILENYSNLVSVGCSISKPDVITLLEQGKEPWMVVRDERRRRSLDLESR

SEQ ID NO: 21156 - protein, 81 aa, Leptonychotes weddellii
SPGAVSFADVAVYFSPEEWGCLRPAQRALYRDVMRETYGLLGALGFSGPKPAFISWVEGEVEAWSAEAQDPEGETPAAVIR

SEQ ID NO: 21157 - protein, 81 aa, Felis catus
AQESLTLEDVAVDFSREEWRLLAPAQKDLYRDVMLENYRNLVSVGHQASKPDVLARLERGEEPWAIEEEVRSGTSPETGKV

SEQ ID NO: 21158 - protein, 81 aa, Leptonychotes weddellii
PQEPVTFEDVAVYFTQNQWASLDPTQRALYREVMLENYASVASLVFPFPKPDLVSQLEREEAPWGPDPWEAEVLRGICPGG

SEQ ID NO: 21159 - protein, 81 aa, Felis catus
GHGLLTFRDVAIEFSQKELRCLNHSQWELYRDVMLENYGHLLFLGLVVSKPDLVIFLEHKKDVWTVKRKETVATHPGRILL

SEQ ID NO: 21160 - protein, 81 aa, Neomonachus schauinslandi
MFRDVAVDFSQEEWEFLDLKQRNLYRDVMLENYSHLVSLGLSLPKPTLISFLEQDNEPWIVEKESPKSLYPDVKSQCATKE

SEQ ID NO: 21161 - protein, 81 aa, Neomonachus schauinslandi
AQESLTLEDVAVDFTWEEWQLLDPAQKDLYRDVMLENYSNLVSVGCQATKPDALSKLEYRDEPWITEDEIQNRTHLGFGKL

SEQ ID NO: 21162 - protein, 81 aa, Monodelphis domestica
SLATLTFQDVAVAFSQEEWRCLDPVQKSLYREVMLENYRHLVFLGLPVSKPELISQLECGEGPWMLLEEELRSRCPDQNNS

SEQ ID NO: 21163 - protein, 81 aa, Physeter macrocephalus
TQVSVTFDDVAVTFTQEEWRQLDPAQRTLYQEVMLENCRLLVSLGCPVPRLELIYQLEQGQKLWTVKKDLSRSTCPVAVAG

SEQ ID NO: 21164 - protein, 81 aa, Monodelphis domestica
ELEAVTFKDVTVDFTQEEWCLLSPPQKELYKEVMLENAQNLISVEREIRPEMKVNPIEMNLPLEKMDLERFVSDGPDNFDF

SEQ ID NO: 21165 - protein, 81 aa, Monodelphis domestica
MEVVTFKDVAVDFTREEWHLLAPPQKELYKEVMLENAWNLLSVGFPTSPEDVISYLEQREAQWMLEQEGLRSCCPEGKIRP

SEQ ID NO: 21166 - protein, 81 aa, Monodelphis domestica
SQGSITFKDVAVDFTQEEWCLLDHSQKALHLEVMLENVQNLLSVGLPVPRENFISCFQQGKAPYLLQRNGPKSSSPEAENN

SEQ ID NO: 21167 - protein, 81 aa, Monodelphis domestica
SVTFKDVAVDFTQEEWCLLDHSQKELYKEVVLENVQNLLFVEAETNFEVKEMSTKMRLFVEGSNSPRGMKRNPCDFLFREI

SEQ ID NO: 21168 - protein, 81 aa, Physeter macrocephalus
YEELVTFKDVAVDFTQEEWGQLDSPQRALYRDVMLENYQNLLALGPPVCKPDVISHLERGEEPWWAPRAVPGRAGPEPELE

SEQ ID NO: 21169 - protein, 81 aa, Monodelphis domestica
PGQVVTFKDVAVDFTQEEWRLLSPPQKELYNEVMLENAQNLLSVGLPVPPEDMISYSEQREAPWMLEPEGLSTCCPEGEIR

SEQ ID NO: 21170 - protein, 81 aa, Monodelphis domestica
SQGLITFKDVAMNFTQEEWCLLDHSQKELYTEVMLENVQNLHSVGLPVPREDFISCFQQREAPWLLEKKVPRNSCPEAETN

SEQ ID NO: 21171 - protein, 81 aa, Monodelphis domestica
SQGSITLRDVVVDFTQEEWRLLDHSQKELYKEVMLENVQNLQSVGVRVPREKFGTCFQQGQSPSLLEQKDQWGCCPEAETN

SEQ ID NO: 21172 - protein, 81 aa, Physeter macrocephalus
KEAFVAFGDVAVDFTQEEWRLLSPAQRTLHREVMLETYNHLVSLEIPFSKPKLISQLERGEEPWIEERQRPLGLCPASRPT

SEQ ID NO: 21173 - protein, 81 aa, Monodelphis domestica
PQELVTFHDVAVDFTPEQWGLLDHPQKLLYKEVMLENAQNLLSLGLPVPREYLLSCFEQEGLKNSCQDAETRFGVKKISEK

SEQ ID NO: 21174 - protein, 81 aa, Monodelphis domestica
AQELVTFQDVAVDFTQEEWHLLDHSKKELYMEVMLENAQNSLLLGLLVPRESLISCFQPGEAPWMQESEGPRNSCPEVKFK

SEQ ID NO: 21175 - protein, 81 aa, Monodelphis domestica
MQGSLTFKDIAVDFTQEEWCLLDHTQKELYLEVMLENVQNLFSVGLPVPREYCTSCFQQGKVPWQLEPKGPRSSCPEAETN

SEQ ID NO: 21176 - protein, 81 aa, Monodelphis domestica
FQESVTFQDVAVEFTWEEWRYLNPSQKKLYKDVMLENYQSLISLGFEVSKPDVIHQLERKETSWMPEADVSQSSYPGDYIK

SEQ ID NO: 21177 - protein, 81 aa, Monodelphis domestica
AQKLVTFQDVAVDFTQEEWGLLDHSHKELYMEVMLENAQNSLFLGLLVPRHSLISCFQQGESQWIRESKGPRNSCPEIKFN

SEQ ID NO: 21178 - protein, 81 aa, Monodelphis domestica
SQESVTFKDVAVNFTREEWGQLDPSQRDLYRDVMLENYGNLVSIGLPVSKPDVISQLERGNAPWIPEEEFARSTCLDSFSL

SEQ ID NO: 21179 - protein, 81 aa, Monodelphis domestica
FQTPVIFEDVAVYLTRGEWDCLDPAQKSLYRDVMLENYENMISLGFPVSKPDVISQLERGEEPWIVHTQEKVTLKGDCSGE

SEQ ID NO: 21180 - protein, 81 aa, Aotus trivirgatus
WLQEPMTFKDVAVEFTQEEWIMLDSAQRSLYKDVMLENYRNLTSVEYQLCRHTVISPLHQEEIRNMKKRNPQGICPDQKIQ

SEQ ID NO: 21181 - protein, 81 aa, Felis catus
EHESVTFKDIAVDFTQEEWALLDASQRKLYRDVMLENIGHLVSVGESVNTDKFIQQVSSFHLIPPLSALIQILSWFLTLFG

SEQ ID NO: 21182 - protein, 81 aa, Leptonychotes weddellii
TRNIITFEDVCIYFSPEEWELLDEAQKRLYCNVILENFLLVTSLGLAISRYHLIPQPLPVREPVVPANVAIAPAGAAMVLG

SEQ ID NO: 21183 - protein, 81 aa, Neomonachus schauinslandi
MQENYGLLISVGYRVKKPNAVFKLKQGKEPWILEVEFPHRNYPEDLWKIHDLGAKYQESRAENSRNGELTEHQQTQAREKI

SEQ ID NO: 21184 - protein, 81 aa, Neomonachus schauinslandi
MVHLVTFEDVAVNFTQEEWTLLDQTQRDLYRDVMLENYQNLIILAGYESCKPDLNSSMGGAEELRTGGRGILQELDLQLKT

SEQ ID NO: 21185 - protein, 81 aa, Neomonachus schauinslandi
SQGLVTFEDVAVYFSLEEWERLDTDQRDLYKDVMQENYGILVSLGYPIPRPDLIFRLEQGEEPWVPDSPRPDEGDIVTGVY

SEQ ID NO: 21186 - protein, 81 aa, Neomonachus schauinslandi
SLESDVFTDVAIVFSQEEWEQLAPAQRDLYRDVMLETYSNLVSLGLAIAKPDVISFLEEGKEPWVVEKTSRGGLCPVLESR

SEQ ID NO: 21187 - protein, 81 aa, Monodelphis domestica
VQDVVTFKDVAVEFTQEEWCLLSPPQKELYKEVMLENVQNLYSVGLPAPPEDMTSYMEQRESSWMLEQEVLRSCCPGKIRR

SEQ ID NO: 21188 - protein, 81 aa, Monodelphis domestica
APVPMTFDDVTLYFTEQEWRTLEEWQKELYKDVVKNNFETLVSLGYAIPKPDLITQIEQGEEPFIRDQGPLKTLKLAIGSS

SEQ ID NO: 21189 - protein, 81 aa, Monodelphis domestica
SQDLLTFKDIAVDFTQEEWCLLDHSQKELYLEVMLENVQNLLSVGLPVPREYCAFCFQQGKAPWQLEPKGPRSSCPEAETN

SEQ ID NO: 21190 - protein, 81 aa, Monodelphis domestica
MESVTFQDVAVDFTHEEWGRLEPAQKDLYRDVMLENYQNFVSLGGLPAPKPHVISQLERGETPCLAEREAPRVISICQDSF

SEQ ID NO: 21191 - protein, 81 aa, Physeter macrocephalus
PHGLLTFGDVAVHFTQEEGARLDPGQRALYRDVMLETYRNLASLGVPGSKPDLISQLEQGKEPWGSDLLRAQEGETAGDPS

SEQ ID NO: 21192 - protein, 81 aa, Physeter macrocephalus
QAQLTFKDVAIEFSQEEWECLDPAQRALYRDVMLETYRNLLSLDICHIYVMKKLQPKVNSDGGEVFQTVMVETRESREIRD

SEQ ID NO: 21193 - protein, 81 aa, Monodelphis domestica
SREWMTFKDVAVDFTREEWRLLDHSQKELYREVMLENVQNLLSVGLPVPREDLISSFLQGEAPWLLEPKSPRSSCPGAETR

SEQ ID NO: 21194 - protein, 81 aa, Monodelphis domestica
PQASVTFKDVAVDFTWEEWRLLDPPQKELYWEVMLENYRNLVCLGLAVSNLNMISQLESGESHWIPRGSILRTIWPDEFMS

SEQ ID NO: 21195 - protein, 81 aa, Monodelphis domestica
QRPLTFGDVAVDLSLEEWRRLSPAQRGLYREVMLENYENLVSVAAGLPVTKPDVISQLERGETPWTLEAELPRAIYPDSPQ

SEQ ID NO: 21196 - protein, 81 aa, Physeter macrocephalus
RESGKAPVTFDDITVYLLQEEWTLLSQQQKEICGSDELVAPLGPTIANPELFYKFERGPEPWLASVQGQRKLLSLHRGKNR

SEQ ID NO: 21197 - protein, 81 aa, Monodelphis domestica
ARSHELVTFKDVAMDFTPEEWGQLDPAQRDVMLENYRNLVSLWLPVSKPDGSSNFDQGENQWMMERKVPRGTRPDWDTRSE

SEQ ID NO: 21198 - protein, 81 aa, Monodelphis domestica
SSSSLTFKDVAVDFTQEEWCLLDHSQKELYLKVMLENVQNLFSVGLPVPREYFTSCFQQGKATWLLEQKSLRNSCPEAETN

SEQ ID NO: 21199 - protein, 81 aa, Physeter macrocephalus
MFQVTFSDVAIDFSHEEWGWLDPAQRNLYKDVMVQNYENLVSLGLSIPKPYVIALLEDGKEPWMVEKKLSKSLFPDWKSRW

SEQ ID NO: 21200 - protein, 81 aa, Monodelphis domestica
AQVLVTFQDVAVDFTQEEWRLLDPGQKELYKEVMQENAQNMLSLGLPVPREDLISHFDQGRAPWMLEGEGPSNSCLDGEKS

SEQ ID NO: 21201 - protein, 81 aa, Monodelphis domestica
PKEMVTLQDVAVDFTREEWRLLSPPQKELYREVMLENARNLLSVGLPAPLEDVLSYLEQRKGPWMLEQKRLRSCCPGEIRL

SEQ ID NO: 21202 - protein, 81 aa, Papio anubis
EMGLLTFRDIAIEFSLAEWQCLDRAQRNLYRDVMLENYRNLVSLGITVPKLDLITSLEQNKEPQNMKRSEMVAKHPVTCSH

SEQ ID NO: 21203 - protein, 81 aa, Papio anubis
GFMEFVTLKDVGMDFTLEDWEQLGLEQGDMFWDTALDKCQDILLLDPPRPNLTSHPDGGEDLEPLPGGSPEATGSDATETK

SEQ ID NO: 21204 - protein, 81 aa, Aotus trivirgatus
VAGARAVSFADVACYFSPEEWAVCGRRRGLYRDVMRETYGHLARFGPKPALISWMEQRGEGWSRVPLYPNWFSRAFKAPME

SEQ ID NO: 21205 - protein, 81 aa, Aotus trivirgatus
MGPLTFRDVKIEFSLEEWQCLDTAQRNLYRDVMLENYRNLVFLDLITWLEQGKEPWNMKSHEMVAKPPAMCSHFTQNCWLE

SEQ ID NO: 21206 - protein, 81 aa, Papio anubis
PLVMAETDPTQGRVVFEDVAIYFSQEEWGHLDEAQRLLYRDVMLENLALLSSLGKALTLAQCPGLGCVIPFYPKAALRFPQ

SEQ ID NO: 21207 - protein, 81 aa, Papio anubis
RRGHLTFRDVAIEFSQEEWKCLDPAQRTLYREVMLENYRNLVFLGICLPDLSIISMLEQRRDPRNLQSEVKIADNPDGREC

SEQ ID NO: 21208 - protein, 81 aa, Sarcophilus harrisii
AQELVSFRDVAIYFTQEEWSYLHSTQKHLYWDVMLENYENFISLGLPVSKLDMLSLLKREKSSWKPGEDNLQVSCPDSFSE

SEQ ID NO: 21209 - protein, 81 aa, Sarcophilus harrisii
SQELVTFEDVAVYFIRKEWKRLDPAQRDLYRDVMLENYGNVFSLGFPFPNPEIISHLDGEEEPWVLDLNRAESQGLQSASC

SEQ ID NO: 21210 - protein, 81 aa, Felis catus
LQGLVTFEDVAVYFSREEWGLLNLTQRSLYRDVMLENFALIGSLGFASSRCHVVAQLESEEEFWVPSMVDLTLVSRVEARR

SEQ ID NO: 21211 - protein, 81 aa, Neomonachus schauinslandi
FQGSVTFRDVAIDFSQEEWEWLQPAQRDLYRHVMLENYGHLVSLGLNISKPYVVSLLEQGREPWLEKGDVRRDLFSESNGD

SEQ ID NO: 21212 - protein, 81 aa, Neomonachus schauinslandi
PQVPVAAAAPTDPAQVPMNSEVTMDPIQGQVNFEDVAVYFSQEEWGLLDEAQRLLYRDVMLENLALMASLGKIIILSDPFL

SEQ ID NO: 21213 - protein, 81 aa, Monodelphis domestica
MVTFQDVAVDFTREEWCLLSPPQKELYKEVMLENAWNLLSVGLPALPEDVISYLEQREAPWMLEREGPRSCCPGEILLEMK

SEQ ID NO: 21214 - protein, 81 aa, Monodelphis domestica
TCHPVTFRDVSVDFSLEEWRCLSPAQRALHREVMLENYEHLVSVGLTASKPDVISLLERGEAPWMALAGVLRSPYPDCPNC

SEQ ID NO: 21215 - protein, 81 aa, Monodelphis domestica
QESLTFKDVAVEFTWEEWRHLDPAQRALHRNVMLENYENLVSIEGKIRLEMKEMTAELSLSGEETQRQRCIADGACDSTWR

SEQ ID NO: 21216 - protein, 81 aa, Monodelphis domestica
AQVLVTFQDVAVDFTQEEWRLLDSGQKELYKEVMVENAQNVLSLGLPVPREDWISHFDQGRAPWMLEGEGPSNSCLGRERR

SEQ ID NO: 21217 - protein, 81 aa, Monodelphis domestica
AQEVVTFQDVAVDFTREEWRLLSPPQKELYKEVMLENARNLLSVGLPAPPDDVVSYLEQREGPSMLDQEDLRTCGPEGEIR

SEQ ID NO: 21218 - protein, 81 aa, Physeter macrocephalus
SHTLVTFKDILVNFTREEWKLLDPAQQLMYKDVMLENYRNLMSLGHQLPKPEVILQLEKGEEPWLVERGIHQETHSGEDQT

SEQ ID NO: 21219 - protein, 81 aa, Physeter macrocephalus
QGSVTFEDVALYFSWEEWALLDEAQRCLYHDVMLENFALTSSLGCWHEVEDKETCPEQSISVEGVSQIRTLKAISSPQKAQ

SEQ ID NO: 21220 - protein, 81 aa, Physeter macrocephalus
TSETSVSFKDVTVEFTLEEWQCMSSAERTLYRDVMLENYSHLVSLGYYFTKPDVIIKLEQDDPLLLEEEFLNKSHADSKLG

SEQ ID NO: 21221 - protein, 81 aa, Monodelphis domestica
QGPMTFEDMAMYLTREEWRPLDPTQRDLYRDVMQENYGNVVSLDFDIRSENETNPKVISEDIEFGNISGRPLESAHQNPEC

SEQ ID NO: 21222 - protein, 81 aa, Physeter macrocephalus
MGSVSFKDVTVDFSREEWQQLDLAQKSLYRNVMLENYFNLISVGCQVPKPEVIFNLEWEEEPCMLDGEISSQSYLDQGIGF

SEQ ID NO: 21223 - protein, 81 aa, Physeter macrocephalus
QDHVIFEDVAVSFSQEEWGLLNDAQRLLYCDVMLENLSLIASLGCWHGVEAEEAVSEQCVSVELVTEDRNPNLEPSILKPL

SEQ ID NO: 21224 - protein, 81 aa, Monodelphis domestica
MQENVQNLLSVGLPVTREHLISCFQEGKAPWLPEQKGPKSSSPDFEVNVMCTNLSLFVEGSGPQRCMKEVSHDFILREICD

SEQ ID NO: 21225 - protein, 81 aa, Monodelphis domestica
GQEEVTFKDVAVDFTQEEWRLLSPPQKELYKEVMLENAQNLLSVGLPAPPEVVLSYLEQSEAPWMLEEEGLRTYCPGKGRE

SEQ ID NO: 21226 - protein, 81 aa, Monodelphis domestica
IQGSLTFKDVAVDFTQEEWCLLDHSQKELYLEVMLENVQNLLSVGLPVPREYCTSYFQQEKARWLLEQKCPRSSSPEAETN

SEQ ID NO: 21227 - protein, 81 aa, Monodelphis domestica
SQKSTEFRDVAVDFTLEEWDLLDSAQRDLYRDVMLENYRNLVSLGLSIPKPDVVTQLEQSQAPVMLEKEVSRCSSPDKKTP

SEQ ID NO: 21228 - protein, 81 aa, Physeter macrocephalus
QIQGSLTFGDVAVAFTQIEGRYADAAQRALYRDVLLENYGNLVFVGLLSSKPKLITQLDAEEPWMEVAEVPSGTYAVQEYI

SEQ ID NO: 21229 - protein, 81 aa, Physeter macrocephalus
SLGSDLFRDVAVVFSQEEWERLVPAQRDLYRDVMLEIYSNLVSLGFAMSKPDVISFLEQGREPWMVEKVATGGQCPELQGN

SEQ ID NO: 21230 - protein, 81 aa, Physeter macrocephalus
GTQGPVMAAAPTHQTQEEWRQLDPAQRTLYQEVMLENCRLLVSLGCPVPRLELIYQLEQGQKLWTVKKDLSRSTCPGKRYR

SEQ ID NO: 21231 - protein, 81 aa, Monodelphis domestica
QVVTFKDVAVEFTKEEWCLLSPPQKLLYKEVMLENAQNLLSIGEIIPEMKVNPREVNPPVEMDPQRFMSVRPNNFASREFC

SEQ ID NO: 21232 - protein, 81 aa, Physeter macrocephalus
TVTFKDVAVVFTEEELALLDSTQINLYQDVMLENFRNLVSVGDRIKNNISNLQEKGLTYLSPEVLYFWQIWKRRISELSVS

SEQ ID NO: 21233 - protein, 81 aa, Monodelphis domestica
VQEVVTFQDVAVDFTREEWRLLSPSQKELYKEVMLENARNLLTVGLSAPPEKVVSYLEQRDVLWMLEQEGLRIWYPGENRP

SEQ ID NO: 21234 - protein, 81 aa, Monodelphis domestica
SQESIAFKDVAVDFTQEEWCLLDHSQKELYLEVMLENVQNLLSVGLPVPTETFISCFQQRKAPCLVEQKVPRNFFPVEDFE

SEQ ID NO: 21235 - protein, 81 aa, Physeter macrocephalus
VLLQVSFEDVTVDFSREEWQHLDPAQKLLYRDVTLENYSHLRSVGYQVPKPEVIFKLEQGEGPWTLEEETPHQSCSDEDNG

SEQ ID NO: 21236 - protein, 81 aa, Monodelphis domestica
WEQSVTFKDVAVDFTQEEWDYLDPSQKELYREVMQENYKNLVCLGLAVSQPDVIYHLEQGRVPWRAEEGILRWSCPVLITK

SEQ ID NO: 21237 - protein, 81 aa, Monodelphis domestica
PQESVTFEDVAVYFTQKEWEGLAPAQRALYRDVMLENYGNLVSLAFLFPKPAVISQLEQGEKPWIQTPQRPLDKKKTYKGC

SEQ ID NO: 21238 - protein, 81 aa, Monodelphis domestica
VTFKDMAVDFTWEEWCLLTPPQKELYKEVMLENARNLLSVVFLSGEIRPEMRVTPIDTSLYVEESDRQRFMNDGPDKLCWR

SEQ ID NO: 21239 - protein, 81 aa, Monodelphis domestica
SQGSITFKDVAVDFTQEEWCLLDPSQKELYREVMLENVQNLLFVETNFEVKEISTKQSLFVEGSGPPRGKNKGPCDFLLRE

SEQ ID NO: 21240 - protein, 81 aa, Papio anubis
KKKPVTFEDVAVNFTEEEWDCLDASQRVLYQDVMSEIFKNLASVARIFLHKPERITQLEQQEEQWREFVHLPNTEGPSEGK

SEQ ID NO: 21241 - protein, 81 aa, Papio anubis
MEGLVMFQDLFIDFSQEEWECLDADQKDLYRDVMMENYSSLVSLGLCIPKPDVISLLEQGKEPWMVSRDVLGGWCPDRLKK

SEQ ID NO: 21242 - protein, 81 aa, Papio anubis
ARGCVVFEDVFVYFSREEWELLDDAQRLLYHDVMLENFALLASLGIALSRSCAVIKLEQAEEPWVYDQVDMTSATEREAQS

SEQ ID NO: 21243 - protein, 81 aa, Aotus trivirgatus
MAHLMLFRDVAVDFSQEEWEGLDLKQRDLYRDVMLENYSNMVSLGLCIYQPDVFSLLEKGKEPWKILRDETRGPCPDVQSR

SEQ ID NO: 21244 - protein, 81 aa, Monodelphis domestica
SQGSITLKDVTVDFTQEEWVLLDHSQQGLYLEVMLENVQNLHSVGLLVPREKFISCFQQRETPCLLEQECPRSPYPGAKSN

SEQ ID NO: 21245 - protein, 81 aa, Monodelphis domestica
GRFQESVTFEDVAVEFTWEEWRHLDPAQRALHRNVMLENYENLVSIGIPVSKTNLIFWFKSEYVQNQGGEVGTSTCPNSFT

SEQ ID NO: 21246 - protein, 81 aa, Monodelphis domestica
NLEAVTFQDVAVEFTCEEWRHLAPPQKELYRDVMLENYKNLVRLGLAVSKPDVISQLERREAPWMPGGIQRSRCPDWEASC

SEQ ID NO: 21247 - protein, 81 aa, Monodelphis domestica
QGSITFKDVAVDFTQEEWCLLDHAEKELFLEVMLENVQNLLFVEAETNFEVKEISSKLRLFVEESGPQRFINGGPCDFNLR

SEQ ID NO: 21248 - protein, 81 aa, Monodelphis domestica
ASQELVTLKDVAVDFTQEEWRVLNPSQKELYREVMLENVLNMLSVGLPVLRDFISSFQQMEALWMAEHEPPGSSCPVNTSS

SEQ ID NO: 21249 - protein, 81 aa, Physeter macrocephalus
RSQGPVSFEDATMDFTQEEWQPLDPAQRTLDRDVALENYSHLISVGYCVTKPEVVAQQGEEPWMLEEESQSQSHRDFCIVD

SEQ ID NO: 21250 - protein, 81 aa, Monodelphis domestica
SKELITFKDVVVDFTKEEWCLLDCSQKELCKEVMLENVQNLLSVGLTLPREYFITCLQQGESPWLPEKKCQWSFCLEEETN

SEQ ID NO: 21251 - protein, 81 aa, Monodelphis domestica
EPDLITFKDVVVDFTKEEWCLLDCSQKELCKEVMLENVQNLLSVGLTFPKENFITCFQQGESPWLPEKKGQWSFCPEAEDI

SEQ ID NO: 21252 - protein, 81 aa, Monodelphis domestica
SQGSIKFKDVAVDFTQEEWGLLDYSQKELFREVMLENVQNLLSVGLPVPREIFISCFQPGKTPWLLEQKGPRNSCAEAETN

SEQ ID NO: 21253 - protein, 81 aa, Monodelphis domestica
FQGLITFKDVAVDFTQEEWCLLDHSQKELYLEVMLENVQNVLSVGLPVPRENLIYCFQPGKTPWLLEQKGPRISHSEAETN

SEQ ID NO: 21254 - protein, 81 aa, Physeter macrocephalus
PQGSTPFSSVTVAFTQKGWRQLAPTPRDRFKEGMPEKSRNLVLLGLPVSQPGMNSQLEQREGSWMLEREGLRSTCPDWKIV

SEQ ID NO: 21255 - protein, 81 aa, Monodelphis domestica
AQEAVMFQDVAVDFTREEWRLLSPPQKELYKEVMLENARNLLFVGLPAPPQEVISYLEQREVQCMLKPEGLQSRCPEGEIR

SEQ ID NO: 21256 - protein, 81 aa, Physeter macrocephalus
QLTLNDVVIEFSPEEWECLDPAQRALYRDVMLETYRNLISVDISHIHVIRKLQLKSNIDKGGVFQTVILGRHEIQEIKPFY

SEQ ID NO: 21257 - protein, 81 aa, Monodelphis domestica
LREAVTFGDVAVDFDQEEWGYLRPPQKELYREVMLENYRNLVSLGHLHPKPDLISWLEEREEPWSQGLQEGTSRRARVREE

SEQ ID NO: 21258 - protein, 81 aa, Physeter macrocephalus
VQESLLFEDVAVEFTREEWRLLDPAQKNLYQDVMLENYSNLLSVGYQSPKPIQIFKLKQRDKPWLEKENIHGQNFPVGEIG

SEQ ID NO: 21259 - protein, 81 aa, Monodelphis domestica
SQGSITFKDVAVDFTQEEWCLLDHSQKELYLEVMLENVQNLLSVGLPVPRENFISCLQQGKAPWLLAQKDSRNSCLEAKTN

SEQ ID NO: 21260 - protein, 81 aa, Monodelphis domestica
KEELVRFKDVSVDFTQEEWHLLDHSQKELYKDVMLENAQNLLSLGLPVPSEYLISFEQEGLRNSCPDTRSDVKKAAAKLKM

SEQ ID NO: 21261 - protein, 81 aa, Physeter macrocephalus
AQGSVSFKDVTVDFSQEEWQHLDPAQKMLYMDVMLENYCHLVSVGCHMTKPDVILKLERGEEPWTSFTGHTCLEKWKAEDF

SEQ ID NO: 21262 - protein, 81 aa, Monodelphis domestica
HTESVTFKAVAVDFTQEEWGRLDSDKWDLYLTVLLENYRNLVFLGLPVSKPELIFHMDQREEPRILERQVSKGGSNYLSQR

SEQ ID NO: 21263 - protein, 81 aa, Monodelphis domestica
AEEVVTFQDVAVDFTWEEWSLLSPPQKELYREVMLENARNLLSVEREMRPEMKLTTTEVSLSVEEMNLQRFMSDCPDNFAF

SEQ ID NO: 21264 - protein, 81 aa, Monodelphis domestica
RGSITFKDVAVDFTQEEWCLLDHSQKELYREVMLENVQNLLSVEAETNFEKPPEFPLYQGNLRAMSFDSRLDLIRHPKCKS

SEQ ID NO: 21265 - protein, 81 aa, Monodelphis domestica
MAFKDVAVDFTQEEWCLLDHSQKALYLEVMLENVQNLLSVGLPVPRENLISCFQQGESPWLLEQKDPRRSCSEAETNFEVK

SEQ ID NO: 21266 - protein, 81 aa, Monodelphis domestica
AQEVVTFKDVAVDFTREEWRLLSPPQKELYKEVMLENARNLLSVGLPAPPEDMITSLEQTEDPWMLEQESLRTCCPDGEIR

SEQ ID NO: 21267 - protein, 81 aa, Physeter macrocephalus
QAQETLTFEDVAVDFTWEEWQLLAPPQKDLYRDVMLENYSNLLSVGFQASKPNVLSKLGQGEPWTMEDEIHCQTHSEIWKV

SEQ ID NO: 21268 - protein, 81 aa, Monodelphis domestica
PAQVLVTFQDVAVDFTQEEWRLLDPGQKELYKEVILENAQNVLSLGLPVPRDLVSHFKQVEAPWMLEEEGSSNSCLDGERR

SEQ ID NO: 21269 - protein, 81 aa, Monodelphis domestica
SQGSITLRDVVMDFTQEEWCLLDHAQKELYREVMLENVWNLQSVGVRVPREKFGTCFQQGQSPSLLEQKDQWGCCPEAETN

SEQ ID NO: 21270 - protein, 81 aa, Monodelphis domestica
IQGSLTFKDVAVDFTQDEWCLLDNSQKELYLEVMLENVQNLLSVGLPVPREYLTSCFQQGEAPWLLEQEVPRSSCPEAETN

SEQ ID NO: 21271 - protein, 81 aa, Monodelphis domestica
SLQRPLTFGDVAVIFSGEEWRRLSPAQRDLYREVMLENYEHLVCVGLSGSKPSVISRLEQAAPWVPEGECPGGPPPDSFHQ

SEQ ID NO: 21272 - protein, 81 aa, Papio anubis
SVVFEDVAVDFTLEEWALLDSAQRNLYRDVMLETFRNLASVDKTQFKANGSVSQQDTYRKEKSKEQTIPNFTRNNSCAYTL

SEQ ID NO: 21273 - protein, 81 aa, Aotus trivirgatus
DHELVTFRDVLINFSQEEWEYLDSAQRNLYWDVMMENYSNLLSLDLESKYETKLLSVETDIIKNTCSQWEVMESSNLCGLE

SEQ ID NO: 21274 - protein, 81 aa, Aotus trivirgatus
CQETVTFRDVAVYFTKTEWTGLSPAQRALYRSVMLENYGNLTAVGYPVPKPALISLLEGGDMAWGLEAQDDPLAEGTKNIC

SEQ ID NO: 21275 - protein, 81 aa, Aotus trivirgatus
SREMNSVAFEDVAVNFTQEEWALLDLSQKNLYRDVMQETFRNLASIGNKGEDQRFEDRYKKSWRNLRHIISHSGNNPHRCE

SEQ ID NO: 21276 - protein, 81 aa, Papio anubis
FLLWLCSFQPFPRAAENEQVPGYHVNKPNAVFKLKQGREPWILEVEYPHRGFPEDLWSIHDLEARYRESQAGNSRNGELTK

SEQ ID NO: 21277 - protein, 81 aa, Aotus trivirgatus
MEPLTFKDVAIEFSLEEWQCLDTAQQNLYRNVMLENYRNLVFLGIAVSKPDLITCLEQGKVPWIMKRHEMVAKPPALYVIG

SEQ ID NO: 21278 - protein, 81 aa, Aotus trivirgatus
AQESLTLEDVTVEFTWEEWQLLDPFQKDLYRDVMLEIYSNLVSMGFQVSKPDALSKLEQGEEPWTIEDERHSRICPENNKV

SEQ ID NO: 21279 - protein, 81 aa, Aotus trivirgatus
ASVTVTFDDVALYFSEQEWEILEKWQKQMYKQEMKTNYETLDSLGYAFSKPDLITWMEQGRMLLISDQGCLHKTKRTTGPP

SEQ ID NO: 21280 - protein, 81 aa, Sarcophilus harrisii
QESVMFADMAIYLTPEEWGQSDPTEGALYRDMMLESCGNDVLLGDGSETENMESLSNLEASEDVESEEKLSSEFPIALPQG

SEQ ID NO: 21281 - protein, 81 aa, Pan paniscus
EMGVLTFRDVAIEFSLEEWHCLDTAQQNLYRNVMLENYRNLVFLGIAASKPDLITCLEQGKEPWNVKRHEMVAEPPVVYFT

SEQ ID NO: 21282 - protein, 81 aa, Camelus dromedarius
NMLFQGPVTFKDITVEFTREEWQLLDAAQRTLYREVMQENYRHLISVGYRVNRPNAVFKLKQGKEPWILEVEFPRRNYPGK

SEQ ID NO: 21283 - protein, 81 aa, Camelus dromedarius
FQEPVTFEDVAVYFTQDQWVSLAPAQQALYREVMLENYANVVSLAAFPFPKPDLVFQLERGGAPWGLDAWTAIRAEALRGV

SEQ ID NO: 21284 - protein, 81 aa, Camelus dromedarius
GEGLVLFKDVSIDFSQEEWECLDSDQRDLYRNVILENYNNLVSVGLSIPKPDVVSLLEEGEDPWMVDRELTRDLLPGDWEC

SEQ ID NO: 21285 - protein, 81 aa, Camelus dromedarius
WSQMPVTFEDVALYLSREEWGQLDHTQQSFYRDVLQKRNGLSFGFPFSRPFWACQVQGKGEASSSSRQTGDEERRGAMEVG

SEQ ID NO: 21286 - protein, 81 aa, Camelus dromedarius
SHALVTFQDILVHFTREEWELLDAAQQLMYRDVMLENCRNLVSLGHQLPKPDVILRLEKGEEPWLLERGVHPEAHPGETRL

SEQ ID NO: 21287 - protein, 81 aa, Camelus dromedarius
TMAHGSVTFRDVAIDFSQEEWEFLDSAQRDLYRDVMWENYSNFISLAGPSVSKPDEITLLDEGKEPWMVVREGTRRLHRGE

SEQ ID NO: 21288 - protein, 81 aa, Camelus dromedarius
LQEATVFKDVAVYFTRIEWSCLAPDQRALYRDMMLENCRHVASLGFLVAKPALISLLEQGEEPGALILQVAEERGTKASLA

SEQ ID NO: 21289 - protein, 81 aa, Cercocebus atys
NCYQDSVTFDDVAVDFTQEEWTLLDPSQRDLYRDVMLENYENLASVEWRLKTKGPALRQDRSWLRTSNETQTARSHNGGQL

SEQ ID NO: 21290 - protein, 81 aa, Cercocebus atys
EKGPLTFRDVAIEFSLEEWQCLDTAQQGLYRKVMLENYRNLVSLAGIAVTKPDLITCLEQGKEPWNIKRHEMVAKPSVICS

SEQ ID NO: 21291 - protein, 81 aa, Cercocebus atys
PGMAVPQGCLTFRDVAIEFSFMEWKCLNPAQRALYREVMLENYRNLEFVGEENVPSDVRNLLLSILALSGFICSFEILTCF

SEQ ID NO: 21292 - protein, 81 aa, Cercocebus atys
ERNLLGPLTFQDVTIEFSLEEWQCLDTAQQTLYRDVMLENYRNLVFLGIAVSKLDLIACLKQGKEPWNMKRHEMVTKPPGM

SEQ ID NO: 21293 - protein, 81 aa, Leptonychotes weddellii
AMALNACYQEVVTFKDVAVYFTQTEWAGLSPAQRALYREVMLTNHGNLTSLGAKTPKPSGPEDIRQGWREKSEDTQFADLP

SEQ ID NO: 21294 - protein, 81 aa, Leptonychotes weddellii
QQIAVTFQDVAVDFTQEEWLLLDLTQRNLYRNVMLENYQNLVAVEYQLSKPKLIAWLEQQELRTVEKGVFQEWETQPQTKG

SEQ ID NO: 21295 - protein, 81 aa, Felis catus
MILLKDCPRNGHSISKPDVVDLLEQGKEPWMILREETQRQYTDLDLHCEVISYVEMPTYEKDVSSTQHQSIYNREKLYEYK

SEQ ID NO: 21296 - protein, 81 aa, Leptonychotes weddellii
VTFTDVAVNFTREEWALLDSAQRILYRDVMLENCRNLASVDLVTQHKMKNSTPQQDILAKKTPDEANRVCAVSHSSQPSPL

SEQ ID NO: 21297 - protein, 81 aa, Leptonychotes weddellii
RESGKAPVTFDDITVYLLQEEWMLLSQQQREICGSDKLVAPLGPAAAKPDLISKLERRAAPWIKDPNGPKWGKGRPPGKKK

SEQ ID NO: 21298 - protein, 81 aa, Neomonachus schauinslandi
FQGFVLFRDVSIDFSQEEWECLDSTQRNLYKYVMLENYSNLVSVGLCIPKPDVISLLEQGKEPWSVFDSELTRGLYLEYKS

SEQ ID NO: 21299 - protein, 81 aa, Neomonachus schauinslandi
SQGLVTFRDVALDFSQEEWEWLDPSQKDLYRDVMLENYRNLVWLGLSISKPNMISLLEQGKEPWMVEKEMSDGQCADWESW

SEQ ID NO: 21300 - protein, 81 aa, Neomonachus schauinslandi
CQGRMTFRDVAIEFSQEEWECLNPAQRALYRDVMVENYRNLVSLGIPLPDLNIIFILEQGKEPQTVESKVKTVKKPILPLQ

SEQ ID NO: 21301 - protein, 81 aa, Neomonachus schauinslandi
MDSVTFEDVAVNFSLEEWALLDSSQKKLYRDVMRETFRNLASIGKDDDILTKLRQLENKSHMVEKRCESKEGHQCGETITQ

SEQ ID NO: 21302 - protein, 81 aa, Neomonachus schauinslandi
WGAWLEKPVTFDDVAVNFTQEEWVCLDASQRVLYQDVMSETFRNLMSVDLIIELEQEEKQWRAELQLRSPNGEGLPSGGRK

SEQ ID NO: 21303 - protein, 81 aa, Neomonachus schauinslandi
MVMFKDVAIDVSQEEWECLNPTQRNLYKDVMLENYSNLVSLDLVSRCEAKKLSPKRDIYETETSRWAIMEQFKSHNPEKSI

SEQ ID NO: 21304 - protein, 81 aa, Neomonachus schauinslandi
AGSMPQRSPPVWGLVAWGWKVGATLQSAEAPRALHKDMKWGKPAGFLVFKPELISRLEQGQEPWVIDLKGVEGREGARTCL

SEQ ID NO: 21305 - protein, 81 aa, Monodelphis domestica
VVTFKDVAVDFTREEWCLLSPPQKGLYKEVMLENTRNLLSVAGEISPEIQVNPTEVSFPVEEMNLQKSISDGPDNFASTEF

SEQ ID NO: 21306 - protein, 81 aa, Monodelphis domestica
MLENYENVVSLGFPVSKPDLISQLEQGEVPCLPDLPRTEVPEIHGARSSVTEKETSIPQQEVGEEVKTQGILSAGSPQGIH

SEQ ID NO: 21307 - protein, 81 aa, Physeter macrocephalus
AQGSVMFSDVSIDFSQEEWEFLDPAQRDLYRDVMLENYSNLVSVGLYIPKPQVISLLEQGKEPWMIGRELTRGLCSDLESM

SEQ ID NO: 21308 - protein, 81 aa, Monodelphis domestica
MLENVQNLLSVGLRIPRENFISSFQQGKAQWLLEQEDPRRSCSEAETNFEVKELSTRLRLMDGSGREGNMNEASHDFILRD

SEQ ID NO: 21309 - protein, 81 aa, Monodelphis domestica
QQEAVTFKDVAVDLTWEEWCLLSSPQKELYKEVMLENARNLLSLGVPTPQEDVLSHLEQREALCMVEQEGLRSCCPEGEIR

SEQ ID NO: 21310 - protein, 81 aa, Monodelphis domestica
TPELVTFKDVAVEFTQEEWGHLKLAQRALYRDVMLENYENLVSLGLPVSKLDVISLLVRGEALWRPEGGGPKSSYKGTLSQ

SEQ ID NO: 21311 - protein, 81 aa, Monodelphis domestica
MLENYRSLAWLGLEVCKPHVIQRLECGEAPWTPQGGVPGSCAPDWEATLETMDSYRKLDLSREDSFPERLRRDGVAAFKLR

SEQ ID NO: 21312 - protein, 81 aa, Monodelphis domestica
AQASVTFKDVAVDFTWEEWRLLDPPQKELYWEVMLENYRNLVCLGLADSNKDVMISELESGEPHWNPTGVVLRSCWPGWES

SEQ ID NO: 21313 - protein, 81 aa, Monodelphis domestica
FQESLTFKDVAVDFTQEEWGQLDHDQRYLYKDVMLENYRNLVSVGKCVYKPNLISQLEQGEEPWIVDGEVPRDAFPGKLIW

SEQ ID NO: 21314 - protein, 81 aa, Monodelphis domestica
DQEVMTFKDVAVDFTREEWCLLSPPQKELYREVMLENAWNLLFVGLPASPEDILSYLEQRDAPWMLKQEGLKNCCPEGEIR

SEQ ID NO: 21315 - protein, 81 aa, Monodelphis domestica
DRGSVTFRDVAVDFSPDEWGRLGPAQRELYREVMLENYRSLAWLGLAGSCPEVVCQLERGAGPWLLEGDGLASGGPEGPES

SEQ ID NO: 21316 - protein, 81 aa, Monodelphis domestica
FQESLTFKDVAVDFTQEEWGKLDSGQKYLYRDVMLENYRNLVSLGHQGSKPYVISQLEQGQEPWIVEREISRNDHKDWGTR

SEQ ID NO: 21317 - protein, 81 aa, Physeter macrocephalus
SQASVSFKDITVELTQEEWQQMGPIQKTLYRDVMLENYNNLVSVGYCIFKPEVIFKLEQGEEPWFLEEEFSNQSHKEDYRD

SEQ ID NO: 21318 - protein, 81 aa, Monodelphis domestica
LPAQMTFKDVAVEFTQEEWRLLSPPQKELYKEVMLENVQNLYCVGLPAPPEDMISYMEQRDSSWMLEQEVLRSCCPEGKIR

SEQ ID NO: 21319 - protein, 81 aa, Aotus trivirgatus
PQVSLTFEDVAVLFTRDEWRKLAPSQRNLYRDVMLENYRNLVSLGLPFTKPKVISLLQQGEDPWKVEKDCSGGSSPGCKSN

SEQ ID NO: 21320 - protein, 81 aa, Pan troglodytes
TDVAIEFSLEEWQCLDTAQQNLYRNVMLENYRNLVFLGIAVSKPDLITCLEKEKEPCKMKRHEMVDEPPVVCSHFAEDFWP

SEQ ID NO: 21321 - protein, 81 aa, Camelus dromedarius
VQGKVNFEDVFVYFSQEEWGLLDEAQRLLYREVMLENFALMVSLGYVSSMPHGVAPRELGSEPWGSDWADMTPAVTREAQG

SEQ ID NO: 21322 - protein, 81 aa, Camelus dromedarius
VKELVTFKDVAIDFTLEEWRLMDPTQRNLHKDVMLENYRNLVSLGLAVSKPDMISHLEDGKGPWVVVREISRTPYPELETK

SEQ ID NO: 21323 - protein, 81 aa, Myotis davidii
VQEPLTFHDVAVEFTWEEWQLLDPEQKDLYRDVMMETYSHLVSLGYQASKPDALSKLERGEELWTVQRGRHCPVSPEFKKV

SEQ ID NO: 21324 - protein, 81 aa, Cercocebus atys
CVTFEDVFVYFSREEWELLEEAQRFLYRDVMLENFALVATLGFWCEAENEEAPSEQSVSVEGVSQVRTAEPGLFQKAPPCE

SEQ ID NO: 21325 - protein, 81 aa, Cercocebus atys
RNMIPQDNENPPQQGEANQNDSMTFEDVAVNFTPEEWALLDPSQKNLYQEVMQETLRNLASIEVLWKRDYLKVKVISVEKF

SEQ ID NO: 21326 - protein, 81 aa, Cercocebus atys
KPTPLGLLTFRDVAIEFSVEEWQCLDTAQQNLYRNVMLENYRNLVFLGIAASKPDLITCLEQGKEPWNVKRHETVAKHPGR

SEQ ID NO: 21327 - protein, 81 aa, Leptonychotes weddellii
VTESVTFRDVAVFFSQDEWLRLDSAQRTLYREVMLENYGTLVSLGIPFSRPKVICQLQEGEDPCLVDGELPRDACLGTSVS

SEQ ID NO: 21328 - protein, 81 aa, Felis catus
LGLLDPTQRKLYREVMLENFGNLVSVGHQPFKRDMVHLVREGKFWMMKLATQGKGNSGKIQTIPKVEPHEELSCWQIWQHI

SEQ ID NO: 21329 - protein, 81 aa, Neomonachus schauinslandi
FQETVTFKDVAVVFSEEELGLLDSTQRKLYRDVMLENFRNLVSVGHSSSKPDMISQLEREEKLCMKEIHTERGRHSGGRNQ

SEQ ID NO: 21330 - protein, 81 aa, Neomonachus schauinslandi
QSRGPLSFVDVFVDFTWEEWQLLDPTQKHLYRTVTLENYSNLVSLGYQDSKPDIIFKLEQEELWMMQAQIPSQGHPEKVWE

SEQ ID NO: 21331 - protein, 81 aa, Neomonachus schauinslandi
SQGSVLFEEISVDFSQKEWQLLDPAQRLLYREVMLENHRLLVSLGCCVTKPELIRKLEQEEEPWAPKRELPGQSHPGELLC

SEQ ID NO: 21332 - protein, 81 aa, Neomonachus schauinslandi
MEPVTFRDVAVDFTQEEWGQLGPAQRTLYRDVMLETFGHLLSVGPELPKPEVISQLEQGAELWAAERGIGQGYCPGWEPGP

SEQ ID NO: 21333 - protein, 81 aa, Monodelphis domestica
MVTFHDVTVDITRKEWHLLSPPQKELYKEVMLENARNLLSVGLPAPSEEVISYLEQREAPWILEQEGLRNCCSEGEIRPEM

SEQ ID NO: 21334 - protein, 81 aa, Monodelphis domestica
FVESVTFKDVAIDFTQEEWVHLDFAQKEFYRDVMLENYRNLVCLGLASSKPYVICQLERREAPWIPEGDIQRISHPDWETK

SEQ ID NO: 21335 - protein, 81 aa, Physeter macrocephalus
QGSVTFEDVVVYFSWEEWGLLDEAQRCLYHDVMLENFALVTSLGCWYGMEDEEAFSVQSVSVEQMSLGKTPTPDPSIQKTH

SEQ ID NO: 21336 - protein, 81 aa, Monodelphis domestica
PQVLVTFKDVAVDFTQEEWRLLDHSQKELYKEVMLENVQNLLSVGLPAPKEELISHFEQGKVPWMLEREDPRKSCPDGETR

SEQ ID NO: 21337 - protein, 81 aa, Physeter macrocephalus
PQEAVTFEDVAVNFSKEEWQCLTHAQRHLYKDVMLENYGNVVSLGFPFPKPPLISHLEQEAELCVQDRQDREFLNCSYPVS

SEQ ID NO: 21338 - protein, 81 aa, Physeter macrocephalus
EEVPVVFEDVAVYFTREEWAALDKRQKELYRDVMRTNYELLASLGPAAAKPDLISKLERRAAPWIRDPDGPEWGKGRPPGK

SEQ ID NO: 21339 - protein, 81 aa, Monodelphis domestica
VVTFQDVAVDFTREEWRLLSPPQKELYREVMLENVRNLLSVEGEIRPEMKVNPTEVILPVEDMNLQRFMSDGPDKFASKEF

SEQ ID NO: 21340 - protein, 81 aa, Physeter macrocephalus
FQELVSFKDVTVGFTQEEWQHLDPTQRSLYRDVMLENYSNLVSVGYCVTKPEVIFRLEQGEEPWILEEEFPRQSFPEVWKI

SEQ ID NO: 21341 - protein, 81 aa, Monodelphis domestica
QQGAVTFRDVTVDFSPDEWGHLGPAQKELYCKVMLENYQTLVCLELKVCKPHVIQQLECGEAPWMPQGGVPGSCGIRGTWS

SEQ ID NO: 21342 - protein, 81 aa, Physeter macrocephalus
MAFRDVAVDFTQEEWMLLSPAQRSLYREVMLENYSNLVSLGIPFSKPKLITQLEQGKETWREERKCPPANGPPEPKPELHL

SEQ ID NO: 21343 - protein, 81 aa, Monodelphis domestica
AQEVVTFKDVVVEFTQEEWCLLSPAQKELFKEVMLENAWNLHSLGLPAPPEDMISYLELKETPWMLEQEDLKSFCPEGEIR

SEQ ID NO: 21344 - protein, 81 aa, Monodelphis domestica
SWEAVTFKEVTVDFTREEWEHLDPLQRDLYRDVMLENYRNLVSLGLMDSKPVMISWLEDWEELQQGNEKEIILTGINPDWE

SEQ ID NO: 21345 - protein, 81 aa, Papio anubis
LQELLTLEDITVEFTWEEWQLLDPFQKDLYRDVMLEIYSNLVSMGYQVSKPDALSRLERGEEPWTMEGERHSQICPENNKV

SEQ ID NO: 21346 - protein, 81 aa, Papio anubis
SQGLVTFRDVALDFSPEEWEWLKPSQKDLYRDVMLENYRNLVWLGLSISKPNMISLLEQGKEPWMVERKMSQGHCADWESW

SEQ ID NO: 21347 - protein, 81 aa, Aotus trivirgatus
EPGTVSFGDVAVYFSREEWGCLRPAQRALYRDVMRETYSHLGALGVGGSKPALISWVEEEAELWGPAAQDPEVAKRPTEAD

SEQ ID NO: 21348 - protein, 81 aa, Pan troglodytes
KSQESLALEDVAVEFTWEEWQLLGPAQKDLYRDVMLENYSNLVSVGYQASKPDALFKLEQGEPWTVENEIHSQICPEIKKV

SEQ ID NO: 21349 - protein, 81 aa, Pan troglodytes
EKGPLTFKDVAIEFSLEEWQCLDTAQQDLYRKVMLENYRNLVSLAGIAVSKPDLITCLEQGKEPWNMKRHAMVDEPPESVF

SEQ ID NO: 21350 - protein, 81 aa, Pan troglodytes
QGRLTFRDVAIEFSLAEWKFLNPSQRALYREVMLENYRNLEAVDISSKRMMKEVLSTGQGNTEVIHTGTLQRHRSYHIGDF

SEQ ID NO: 21351 - protein, 81 aa, Cercocebus atys
FLNKVTFEDVAIDFTQEEWAMMDTSKRKLYRDVMLENNSHLVSLGYQISKSYITLQLEQGKELWREGREFLQGQNLDKESA

SEQ ID NO: 21352 - protein, 81 aa, Cercocebus atys
FQGSVSFKDVTVGFTQEKWQHLDPAQRTLSRDVMLENYSHFVSVGYCIPKPEVILKLEKGEEPWILEEKFPFQSHLELINT

SEQ ID NO: 21353 - protein, 81 aa, Leptonychotes weddellii
FQEAVTFKDVAVVFTMEELGLLDSTQRKLYRDVMVENFKNLVSVGHLPFKPDMVSQLEAEEELWMMEGEPQRNGYSREDHV

SEQ ID NO: 21354 - protein, 81 aa, Leptonychotes weddellii
MTFDDVALYFSEQEWEILEKWQKEMYQQVMKTNYETLDSLGGVFSKPDLISWIEQGRMLLIRDQGPLEKNMTLSPSTDEQW

SEQ ID NO: 21355 - protein, 81 aa, Felis catus
AQAPLSFEDVAVSFSREEWRLLVPAQKDLYRDVMLENYRNLVSVGYQASEPGSLFQLEHAGPLRAVEGAAPRPPCPEEIWE

SEQ ID NO: 21356 - protein, 81 aa, Felis catus
KEEEMASSQGLLTFRDVAIEFSQEEWGCLNHSQREVYRDVMLENYGHLLFLGEDNSFQTSQTTLGVLFLPLKTVSWNFLFA

SEQ ID NO: 21357 - protein, 81 aa, Monodelphis domestica
LNKTPVTFKDVTVDFTEEEWRQLNPTQKQLYRDVMLENYRNLLFLGLPVFKPVSSCLERGEEPWTVERKVPGSPRADWEIN

SEQ ID NO: 21358 - protein, 81 aa, Monodelphis domestica
SQESVTFKDVSVDFTQGEWGQLDLSQKNLYRDVMLENYRNLVSLGLQVFKPEVICRLERGEAPWVLEREISRGPSLDWPET

SEQ ID NO: 21359 - protein, 81 aa, Monodelphis domestica
QVFLTFEDVAITFSQEEWGMLAAWQQKLYWDVMKENYESLSSLSAAGRLGALPDLFWTLGQVFETWEDQQNSLRRDNSESS

SEQ ID NO: 21360 - protein, 81 aa, Monodelphis domestica
PGQEVVTFKDMAVDFTWEEWCLLTPPQKELYKEVMLENARNLLSVGLAVPRDVISYLEQREAPWLLEQEGLRSCSPVFLSG

SEQ ID NO: 21361 - protein, 81 aa, Monodelphis domestica
AQEAVTFKEVAVDFTQEEWRLLSPPQKELYKEVMLENARNLLSVGLPGTPEDMISSLEQREAPWILEQEGLRNCCPEGEIR

SEQ ID NO: 21362 - protein, 81 aa, Monodelphis domestica
AVTFKDVAVNFSQEEWMCLDSSQKEFYRDVMLENYRNLVFLDWETQEESKEPTPKLSISMEQSSKEILQRDSLLFSPLRES

SEQ ID NO: 21363 - protein, 81 aa, Monodelphis domestica
SQGSITFRDVVVNFIKEEWCLLDHSQKEPYKEVMLENVQNLQSVGLTVPRENFVTYFQQGELPWLLEQKGQWKCTVWKGFH

SEQ ID NO: 21364 - protein, 81 aa, Monodelphis domestica
AQVLVTFQDVAVDFTQEEWRLLDPGQKTLYKEVMVENAQNVFSLGLPVLREDWISYFDQGETVWILDGEGPSNSCLDGERR

SEQ ID NO: 21365 - protein, 81 aa, Monodelphis domestica
AQASVTFKDVAVDFTWEEWRLLDPPQKELYWEVMLENYRNLVCLGLADSNKDVMISELESGEPHWIPTGVVLRSCWPGWES

SEQ ID NO: 21366 - protein, 81 aa, Monodelphis domestica
SLTFEDVAVEFTQEEWGHLDSAQRNLFRDVMLENYRNLVSLDCPSWEPRYEATEEVPLWGISMGQSSKKRLKKDCSRNSKL

SEQ ID NO: 21367 - protein, 81 aa, Monodelphis domestica
QKELVTFKDVAVEFTQEEWGSLDPFQKKLYKDVMLENYRNLVFLGLTVWKPAVISQLEEGEAPWTEDREVPKAISPNLETR

SEQ ID NO: 21368 - protein, 81 aa, Physeter macrocephalus
MRPVQKELYKTVTLQNYWNMVSLGLTVYRPTVIPILEEPWMVIKEILEGPSPEWETEAQECTPVENVSKLTKDGTKTIKLE

SEQ ID NO: 21369 - protein, 81 aa, Physeter macrocephalus
NFWILRLPPGSKGEAPKEWGKLDECQRELYKHVMRGNYETLVSLDYAISKPDILTRMERGEEPCPEGPRGREEGSDREEAR

SEQ ID NO: 21370 - protein, 81 aa, Monodelphis domestica
KFQIQNFEAVTFKDVAVEFTQEEWHLLTPYQKELYKEVILENAWNLLPVGIPAPPEELFSYLKQTEAWWMLEQEGLRSYCP

SEQ ID NO: 21371 - protein, 81 aa, Physeter macrocephalus
LQELVTFQDVAVDFTQEEWEHLDPSQRHLYREVMLENYGNLISLGHLLSKPEMISHFEQGDDVWMEEKIPRSSYLGDKPYR

SEQ ID NO: 21372 - protein, 81 aa, Monodelphis domestica
MLFQELVTFKDVAVDFTQEEWKCLAPSQKELYREVMLENYRNLVSLGRAVSKPELIHQLERGETPWRPKGDGWRNSLRPGE

SEQ ID NO: 21373 - protein, 81 aa, Monodelphis domestica
GQEEVAFKDVAVDFTREEWRLLSPPQKELYKEVMLENIRNLLSVGLPAPPEDMISYLEQREAPWMLEQEGLRSYSPGEEIR

SEQ ID NO: 21374 - protein, 81 aa, Monodelphis domestica
PKVPVTFDDVAVYFSEKEWGNLDKWQKELYKHVMTGNYEMLVSLDYALSKPEFLTRIEQGEEPCTQNQLDSEETEIAANPD

SEQ ID NO: 21375 - protein, 81 aa, Physeter macrocephalus
LGPVTFEDVAVYFSHEECRLLGEAQRLLYHDVTLETSALVASLGCWYGVEVKETPSEQNDSVEVPQINTSKTNLSTQKGCP

SEQ ID NO: 21376 - protein, 81 aa, Pan troglodytes
ASGSVTFEDVAVYFSWEEWDLLDEAQKHLYFDVMLENFALTSSLGLTLSWSHVVAQLGLGEVPSVLHRMFMTPASARWDQR

SEQ ID NO: 21377 - protein, 81 aa, Camelus dromedarius
RAYGEPVTFEDVAVDFTQEVWQQLDLAQKTLHRDVMLEICSHLVSVGIKPDIISKLEHGEDKWIMENREESPDSSQQIISG

SEQ ID NO: 21378 - protein, 81 aa, Camelus dromedarius
PKVPMTFDDMAMYFSEQEWGKLDEWQKELYKHVMRGNYETLVSLDYAISKPEVLSQIEQGKEPCSWRRPGPKVPDVPVDPS

SEQ ID NO: 21379 - protein, 81 aa, Camelus dromedarius
SQESVTFQDVAVDFTEKEWPLLDSSQRKLYKDVMLENYSNLASVGCQVGKPSLISHLEQEEELRTEERELHRGTCPDWEPP

SEQ ID NO: 21380 - protein, 81 aa, Camelus dromedarius
SQGSLSFRDVAVDFTWEEWQLLDTVQKNLFRDVMLENYSNLLSLGYQVSKPEALVPLEEGREQGIVEREFPSQCSPGECNQ

SEQ ID NO: 21381 - protein, 81 aa, Myotis davidii
YQESVTFMDVAVTFTDEEWRHLIPIQRDLYKEVMLENYQSIISVGLPVPQPDVIFQFNREDKPWIIDLHGPDEGRWPENIS

SEQ ID NO: 21382 - protein, 81 aa, Myotis davidii
FQLPVSFKDVLVSFTHEEWGQLDLVQRTLYHDVTLETCDHLVSLGLLLPTVDVISCLERGAGPWRAEQEPPPGEWKTSLEK

SEQ ID NO: 21383 - protein, 81 aa, Myotis davidii
APQGQLTFSDVAIEFSQEEWACLDPAQRKLFRDVMLQNYRNLVFLGLTVSKPDLTFLEQMEETWELEEEKTVVIHPAISSQ

SEQ ID NO: 21384 - protein, 81 aa, Cercocebus atys
AQESVTFEDVAVNFTNREWQSLTYAQRHLYKHVMLENYGNMVSLGFPFPKPPLISHLEQGVEPCVQDPQNRESLSCSYPVS

SEQ ID NO: 21385 - protein, 81 aa, Cercocebus atys
MFQESLTFQDVAVDFTKEEWDQLYPAQKNLYRDVMLENYRNLVALGYQLYKPEVIAQLELEEEWVIEGDSLLDTHPDGENR

SEQ ID NO: 21386 - protein, 81 aa, Leptonychotes weddellii
GRGHARNPAQIPMTREALTDCGKGCVTFEDIAVYFSREEWGLLDEAQRHLNCTMMLENLALIASLAPAKAPLSSLLAWDGG

SEQ ID NO: 21387 - protein, 81 aa, Leptonychotes weddellii
PQKSVTFEDVAVYFTQTEWDGLSPAQRALYRDVMLENYGNVASLGFSLLKPAVISQLEGAVDIDVQTDNNLIKEMYEEKHN

SEQ ID NO: 21388 - protein, 81 aa, Leptonychotes weddellii
MLENYGHLLFLGLVVWKPDLVIFLEQEKQLWDVKRKETVAFHPAVSSNGTQSFLPTLCIEASFQNVAVRRYKHTALENLHF

SEQ ID NO: 21389 - protein, 81 aa, Leptonychotes weddellii
MYKDVMLENYKNLISLGHQLPKPDVILQLEKGEEPWLVERGIHRETHPDLETAVEIKSSISSKSISKNKQSYGIKMEGIAK

SEQ ID NO: 21390 - protein, 81 aa, Felis catus
SYEGSVSFRDVAVDFSREEWQHLDLAQRNLYRDVMLETYSHLLSVGYEVPQPEVFMLEQGKEPWALQGESPHRSCSGEKLW

SEQ ID NO: 21391 - protein, 81 aa, Leptonychotes weddellii
CWGLLSFKDISMEFTWEEWQLLDSTQKYLYRDVILENYSHLVSVGYHGTKPDLIFKLEQGEEPWIINAKVSRQSCPEGWKE

SEQ ID NO: 21392 - protein, 81 aa, Neomonachus schauinslandi
LPELVTFKDVAVYFTGTEWAGLSPAQKALYRSVMLENYGNLTSLGYPVPKPALISLLEGGNLPWGLEAQDNPSAERTKDIC

SEQ ID NO: 21393 - protein, 81 aa, Monodelphis domestica
LLELLTFKDVAVDFTQEEWCLLDHSQKELYKEVMLENSHNLLSLGIPVLKEDLISHFEEREASWILDQKSLRNSCPGAVTK

SEQ ID NO: 21394 - protein, 81 aa, Physeter macrocephalus
FREPVTFEDVTLGFTPDEWGMLDLEQKSLYREVLLENYRNLVSVEHQLSKPDVVSQLEEEEELWSVERGIPQDTFSECPEA

SEQ ID NO: 21395 - protein, 81 aa, Monodelphis domestica
SQGSITIKDVTVDFTQEEWMLLDHSQQELYLEVMLENVQNLHSVGLLVPRENFISCFQQGEAPWLLEQDCPRRSCPEAKTN

SEQ ID NO: 21396 - protein, 81 aa, Physeter macrocephalus
SYESLSFEDVTLDFTQEEWQQLDPAQRTLYRDVMLENYSHLVSVGYCIPKPELIFRLEQGEQPWVLEEESPSQSYPEVCKV

SEQ ID NO: 21397 - protein, 81 aa, Monodelphis domestica
GQEEVTFKDVAVDFTREEWRLLSPPQKELYKEVMVENARNLLSVGLPAPTKDVLSYLKKRGAPVMLEQEGLRNYFPEGEIR

SEQ ID NO: 21398 - protein, 81 aa, Monodelphis domestica
LWVSITFHDVAVGFTQEEWDLLDDSQKELYLEVLLDNVQNLLSVGLPVPREIFISCFQPGKTPWLLEQKGPRNSCAEAETN

SEQ ID NO: 21399 - protein, 81 aa, Monodelphis domestica
FQESVTFKDVTVNFTQEEWEQLNPAQRELYRDVMLENYRNLISLGLPISKPDVIFQLEQGQEPWMLDVQGTERQAVPRSTS

SEQ ID NO: 21400 - protein, 81 aa, Physeter macrocephalus
EQSESVTFEDVAIYFSENEWTGLTPSQRALYRNVMLEDYGAVASLAFPFPKPALIFKLADEAPWSLAPQGALDGEGPRGIS

SEQ ID NO: 21401 - protein, 81 aa, Physeter macrocephalus
MLETYGNLVSLGLQGSKPDVISKLEQGEEPWAPHSPRIEGSWIWRHRHAGYVSRKEKKELTPKQEISEEMESQRTKLEEHV

SEQ ID NO: 21402 - protein, 81 aa, Physeter macrocephalus
AHGLVMFKDVAIDVSQEEWECLNPAQRNLYKDVMLENYSNLVSLGLSISKPAVISSLEQGKEPWMVMREVIGEQFPDLVSK

SEQ ID NO: 21403 - protein, 81 aa, Aotus trivirgatus
VTFEDVAVVFTDEEWSHLIPIQRDLYKEVMLENYKSVVSLDWETKPEIYDASEEKAERSLRESLGRQSPLCPKFEVRAPDG

SEQ ID NO: 21404 - protein, 81 aa, Papio anubis
EMGLLTFRDVAIEFSLEEWQHLDIAQQNLYRNVMLENYRNLAFLGIAVSKPDLITCLEQGKEPWNMTRHEMVDESPGICPL

SEQ ID NO: 21405 - protein, 81 aa, Papio anubis
QGRVTFRDVAIEFSLAEWKCLNPAQRALYREVMLENYRNLESVDISSKCIMKEFSSTGQCNTEVFHTGTLQRHESHHIRDF

SEQ ID NO: 21406 - protein, 81 aa, Aotus trivirgatus
FQGSISFKDVTVGFTQEEWQHLDLSQRALYRDVMLENYSNLVSVGYCLHKPEVIFRLEQGEEPWRLEEEFPCQSFPEVWTA

SEQ ID NO: 21407 - protein, 81 aa, Aotus trivirgatus
AHALVTFRDVAIDFSQKEWECLDPTQRKLYRDVMLENYSNLVSLGYSGSKPDVITLLEQGKEPCMAVRDMTGRQYPGLLSR

SEQ ID NO: 21408 - protein, 81 aa, Aotus trivirgatus
VQGLVMFEDVAVYFSREEWGLLNVTQKGLYRDVMLENFALLSSLGLAPSRSPVFTQLVDDEQSFVPSWVDVTLVSRTEASR

SEQ ID NO: 21409 - protein, 81 aa, Aotus trivirgatus
MTSFQEAMTFKDVTVVFTEEELGLLDLLYRDVMLENFRNLLSVGHQLFHQDVFHFLREEKFWVMETATQREGNSGGKIQTE

SEQ ID NO: 21410 - protein, 81 aa, Aotus trivirgatus
LQGPVSFKDVAVDFTQEEWQQLDPDEKITYRDVMLENYSHLVSVGCDITKPNVIIKLEQGEEPWIMEDEFPCQHSPEVWKV

SEQ ID NO: 21411 - protein, 81 aa, Aotus trivirgatus
RPQESVAFDDVAVYFTKKEWAMMVPDRRAVYRDVMLENYEAVAAPPTSKPAWVSHLEQGKEPCFTQPQGVLSRRDWRAAKA

SEQ ID NO: 21412 - protein, 81 aa, Aotus trivirgatus
VAFEDVAVNFTQEEWALLDPSQKNLYREVMQETLRNLASIGQRWSNQNAEDKHQNPRRNLRRLIGERLFQSKESHQHVEVL

SEQ ID NO: 21413 - protein, 81 aa, Aotus trivirgatus
TKGCVTFEDIAIYFSQEEWGRLDEAQRLLYLEVMLENFALVASLGCGHGTEDEKTPSEQNVSIGVSQSKAGSSTQKTQPCE

SEQ ID NO: 21414 - protein, 81 aa, Camelus dromedarius
QGRVVFEDVAIFFSQEEWGLLDEAQRHLYHAVMTENLALLSSLGKVPTLTPRAGLALFFPFSQGRFRPPVMRPQVLLPVLV

SEQ ID NO: 21415 - protein, 81 aa, Camelus dromedarius
SHGLVSFKDVAVDFTQEEWQQLDPAQRTLYRDVMLENYSHLLSVGHPVSKPDVISKLEQGEDPWIIKRNMPNWVYPGENQA

SEQ ID NO: 21416 - protein, 81 aa, Myotis davidii
MVFEDVAVYFSREEWGLLDSAQRALYRQVMLENFALVASLGLSASRPRIVLQLERGEEPWVLSGLDVALARDAQRRPGPGE

SEQ ID NO: 21417 - protein, 81 aa, Myotis davidii
FQEPVTFRDVAVDFSPEEWGRLGPAQRTLYRDVMLETFGHLLSVGPELPKPEVISQLERGAELWVVEHGLAQGCCPGWDPG

SEQ ID NO: 21418 - protein, 81 aa, Cercocebus atys
EELPVVFEDVAVYFTREEWGMLDKRQKELYRDVMRMNYELLASLGPAAAKPDLISKLERRAAPWIKDPNGPKWGKGRPPGN

SEQ ID NO: 21419 - protein, 81 aa, Cercocebus atys
SVAFEDVAVNFTQEDWALLSPSQKNLYRDVMLETFRNLASVGIQWKDQDTENLYQNLGIKLRSLVERLCGRKEGSEHRETF

SEQ ID NO: 21420 - protein, 81 aa, Cercocebus atys
VAFEDVAIHFSQEEWELLDEMQRLLYHDVMLENFAVMASLGCWCGAEDEGAPSAESISVAELSQGRTPKADTSTDKSHPCE

SEQ ID NO: 21421 - protein, 81 aa, Cercocebus atys
FQELLTFRDVAIEFSPEEWKCLDPAQQNLYKDVMLENYRNLVSLGFVISNPDLVTCLEQIKEPYNLKLHETAAKPPAMCSP

SEQ ID NO: 21422 - protein, 81 aa, Leptonychotes weddellii
LREPVTFADVAVLFTPEEWMFLDSAQRSLYRDVMLENYRNLASVGDQLGKPSTFSHLEPGEELWPPERRSFPGTCPEPQHQ

SEQ ID NO: 21423 - protein, 81 aa, Neomonachus schauinslandi
FQGSVSFKDVTVGFTQEEWQHLDPAQRSLYRDVMLENYSNLVSLGYCVTKPEVIFRLEQGEEPWILEEEFPSQSFPEIWKT

SEQ ID NO: 21424 - protein, 81 aa, Neomonachus schauinslandi
FQETVTFKDVAVVFTREELRLLDSTQRKLYRDVMLENFRNLLSVGYEPFRLDTTLPLGREEKLWMMETQTPGDGRSGLRNQ

SEQ ID NO: 21425 - protein, 81 aa, Monodelphis domestica
QESLTFKDVAVEFTWEEWRHLDPAQRALHRNVMLENYENLVSIEGKIRLEMKEMTAELSLSGEETQKQRCIGDGACDSTWR

SEQ ID NO: 21426 - protein, 81 aa, Physeter macrocephalus
TGDWEMAAALLAAGSQEEWRSLDPSQTDFYGEYVMQENCGIVVSLRFPIPKLDMLSQLEGGEEQWVPDPQDLEERDILKVT

SEQ ID NO: 21427 - protein, 81 aa, Monodelphis domestica
QGSITFKDVTVDITQEEWCLLDHAEKELFLEVMLENVQNLLFVEAGTNFDVKEISSKLRLFVEESGPQRFINEGPCDFILG

SEQ ID NO: 21428 - protein, 81 aa, Monodelphis domestica
SPKFQESLMFKDVAVDFTPEEWRHLDPTQRTLFRDVMLENYENLVSLGLPVSKLDVISLLERGEAPWRLEERGSQCFCPGE

SEQ ID NO: 21429 - protein, 81 aa, Physeter macrocephalus
QGHVIFEDVAVSFSQEEWGLLNDAQRLLYCDVMLENLSLIASLGCWRAVGTEEATSEQCVSVEQVTQDRNPNPDLSILKTL

SEQ ID NO: 21430 - protein, 81 aa, Physeter macrocephalus
SVTFEDVAVYFSQEEWRLLDEAQRFLYRDVMLETFALVASLGCWHGAEVKETPSEQNVFVEVPRINTSKTKLSTQEAYPWE

SEQ ID NO: 21431 - protein, 81 aa, Monodelphis domestica
SQGSITFKDVAVDFTQEEWRLLEPSQKEQYREVMLENAWNLHSVGLPVPREDILSSFQQGESPWLLEEKSPRNSCPVFSWV

SEQ ID NO: 21432 - protein, 81 aa, Monodelphis domestica
QELVTFEDVAVYFTEEEWDRLHPAQRTLYRDVMLENYVNVTSLGDGIKMENEEEPIPKPEMSEEVASQWTLLAGFPWAIPQ

SEQ ID NO: 21433 - protein, 81 aa, Monodelphis domestica
AQEVMTFKDVAVDFTREEWRLLSPPQKELYKEVMLENAWNLLFVGLPAPPEDVISSLEQREVPLMLVQEDLRSCCPEEEIR

SEQ ID NO: 21434 - protein, 81 aa, Monodelphis domestica
SLKSLTFQDVAVDFTQEEWRLLDPAQKDMYRDVMLENYENFVSLGLPDSKADVISQLERRERPGLPEGEVPRSPSLGSQGE

SEQ ID NO: 21435 - protein, 81 aa, Monodelphis domestica
SQGSITFKDVAVDFTQEEWYLLDHSQKELYLEVMLENVQNLLSVGLPVPGENFISCFQQGKALCLVEQKDPRSFFQVEDFE

SEQ ID NO: 21436 - protein, 81 aa, Physeter macrocephalus
MRESGGALSLCGLPDSKPDVIPKLEQWEDPWTVERDVPRGPEKEALCAETWCHQVQLFRNCVSLLSFSMKTLLKSAATVMP

SEQ ID NO: 21437 - protein, 81 aa, Physeter macrocephalus
FQEPVTFEDVAVYFTQNQWASLEPVQKALYREVMLENYANVASLALPFPTPVLISQLERGEAPWGPDPWEAEILRGICPGG

SEQ ID NO: 21438 - protein, 81 aa, Monodelphis domestica
FQETLTFKDVAVEFTWEEWRHLDPAQRALHRNVMLENYENLVSIGIPVSKLDLLFLLKREDVQNQEGESGTGTCIGELLKN

SEQ ID NO: 21439 - protein, 81 aa, Monodelphis domestica
GPGSVTFRDVAVDFTWEEWRRLGPAQKELYREVMLETYRTLVCLGLAVPKPGVSAQLDGGERRASARGRPGWKNRSDTEES

SEQ ID NO: 21440 - protein, 81 aa, Physeter macrocephalus
VTFEDVAINFTQEEWALLDTSQKTLFRNVMLENITHLVSVGESVYMDVSHTQRDPVGWTDLSDEFTPRSSPQHSPIPLRRK

SEQ ID NO: 21441 - protein, 81 aa, Aotus trivirgatus
SNETLTFRDVAIEFSLEEWQCLNPAQQNLYRNVMLENYRNLVFLADIAVSKQNPITCLEQKKEPCNIKRHEMVARPNAMCS

SEQ ID NO: 21442 - protein, 81 aa, Papio anubis
QDSVTFDDVAVEFTPEEWVLLDTTQKYLYRDVMLENYMNLASVDFFFCLTSEWEIQPRTKRSSLQQGFLKNQIFTGIQMTR

SEQ ID NO: 21443 - protein, 81 aa, Aotus trivirgatus
QVTFSDVAIDFSHEEWGWLDSAQRDLYKDVMVQNYENLVSLAGLSITKPYVITLLEDGKEPWMNAFHILFLIVSFFCILFY

SEQ ID NO: 21444 - protein, 81 aa, Aotus trivirgatus
VKESVTFKDVAIDFTLEEWRLMDPTQRNLHKDVMLENYRNLVFVGLAVSKPDMISHLENGKGPWVTVREISRISYPDLETK

SEQ ID NO: 21445 - protein, 81 aa, Sarcophilus harrisii
QVLVTFKDIVVDFTEEEWGLLNHSQKELYKEVMLDNVQNLLSLVVETRIEVNEMSRKLRILMEESNVQRFLSDPFSDFTLS

SEQ ID NO: 21446 - protein, 81 aa, Sarcophilus harrisii
MVDFTEEEWGLLDPSQKKLYKEVILENVQNLLFLDVKTGFTVNEISKKLEIFMEEHDLQRFIDDDPFDFNLKELHDFILKE

SEQ ID NO: 21447 - protein, 81 aa, Camelus dromedarius
PVTFEDVAVYFSQEEWGLLSDAQRLLYHDVMLDTLSLLASLGFSNMMHFIYCTCLCVMFFERCMFTYVVLKHWVARDAAMA

SEQ ID NO: 21448 - protein, 81 aa, Camelus dromedarius
FQKSVTFEDVAVYFTQTEWDGLSPAQRALYRDVMLENYGNVASLGFPLLKPAVISQLEGGGELGGPSPLASGTGTGPQGLW

SEQ ID NO: 21449 - protein, 81 aa, Camelus dromedarius
VQGRVVFEDVAIFFSQEEWGLLDEAQRHLYHAVMTENLALLSSLGKVPTLTPRAGLALFFPFSQGRFRPPGCVVFEDVAVH

SEQ ID NO: 21450 - protein, 81 aa, Camelus dromedarius
WKESLSFEDVALYFTREEWSRLDWAQKDLYRDVMLENYRNMIVLGFQFPKPEVICQLEQWEEPWILDLPRAGTRKASGSAC

SEQ ID NO: 21451 - protein, 81 aa, Camelus dromedarius
ARQVPVAFQDLAVRFSEDEWRLLGEKQRALFLDVMQENYETLVSLGTAELPPLSAFLSPTEPGGPMEDGSCSGDRQERPRG

SEQ ID NO: 21452 - protein, 81 aa, Myotis davidii
AEVGVTYEDIALYFSREEWSLLDEGQRQLYLNVMLENFELPSSLGCCCGAENVEALTEQNVSVKVSQARNVKVALSSQKSH

SEQ ID NO: 21453 - protein, 81 aa, Myotis davidii
SQDLVTFGDVAIDFSQDEWEWLNLAQRNLYRKVMLENYRNLESLGVSVSKPEVISLLEQGREPWMATKARTEGTCSDWEYA

SEQ ID NO: 21454 - protein, 81 aa, Myotis davidii
YQEFVTFEDVAVHLTREEWGCLDPVQRDLYREVMLENYGNVVSLGFPIFKPDGISQLEQDLQVFDLETKNREVLRDDCSDG

SEQ ID NO: 21455 - protein, 81 aa, Myotis davidii
MLENYSHLLSVGYEVPKPEVIFKLEQGEEPWILEGETPHQSCSDGKFGIKTSQKRISGKASFHSEMEGEDIRDDSLYSILE

SEQ ID NO: 21456 - protein, 81 aa, Cercocebus atys
PQGLLTFRDVAIEFSQEEWKCLDPAQRTLYRDVMLENYRNLVSLAISSKCMMKMFSSTGQGNTEVIHTGTLQRQASHHIGD

SEQ ID NO: 21457 - protein, 81 aa, Cercocebus atys
VLFQISFEDVAVDFTLEEWQLLNPTQKNLYRDVMLENYSNLIFLEVWLDNPKMCSEIIQDNLKSMERGMRSHNVAQEKKFE

SEQ ID NO: 21458 - protein, 81 aa, Leptonychotes weddellii
MDFTPEEWGKLDPAQREVMLENYRNLVSLWLPVSKPENYNLENGKEPLMLERKAPKSSYSDLETKPEGKDSTSVQGISKEE

SEQ ID NO: 21459 - protein, 81 aa, Leptonychotes weddellii
MDFTLEDWEHLGLDQGDLFWDTALDNYQNLFLLNPSKPKLTSHPDGTEELKVLVRESPESAGPDTAEVKNCLLAHDFLEEG

SEQ ID NO: 21460 - protein, 81 aa, Leptonychotes weddellii
WLVTFKDVAIDFSQEEWECLNSTQRDLYRDVMLENYSNLISLDLESSCETKKSSPEKGAYEMESLQWESMRKPISHNLDYS

SEQ ID NO: 21461 - protein, 81 aa, Leptonychotes weddellii
MLENYSNLVSVGLCIPKPDVISLLEQGKEPWSVFDSELTRGLYLEYKSRCENKKLSLKKGNYKIDSSQWVIMEGCTKHGLK

SEQ ID NO: 21462 - protein, 81 aa, Felis catus
IQGSLTFGDVAVAFTQIEWKHLDAAQRALYKDVMLENYGNLVSVGLLSSKPKLITQLEQGSEPWMEVQQVPSGTCSVQEYW

SEQ ID NO: 21463 - protein, 81 aa, Felis catus
PQASVSFKDITVEFTQEEWRQMDSAQRTLYRDVMLENYSHLVSVEEYQPNQLSEKSLENQGKYLWQVLFTNRSLTTEEEFS

SEQ ID NO: 21464 - protein, 81 aa, Felis catus
VEDVAIEFSQEEWGCLNHSQRELYRDVMLETYGHLLFLGLVSKPDLVIVLEQKKELWGVKRKETVASHPAVSSQCTQNFLP

SEQ ID NO: 21465 - protein, 81 aa, Felis catus
MFSISMKDCIWPLKLRFLCSSKALKPMGLAQLPCRFPFTGCCVPKPDVIFRLEQGQQPWLIEEESLDQSCPEVCKVDNQLE

SEQ ID NO: 21466 - protein, 81 aa, Neomonachus schauinslandi
CEGSVSFEDVTMDFSREEWQQLDPAQRCLYWDVMLEIYSHLLSVGYHIPNPEIISRMEKGEKSWVRGAQLPHQRHREGVFG

SEQ ID NO: 21467 - protein, 81 aa, Neomonachus schauinslandi
QGTVTFEDVAVYFSWEEWGLLDEAQRCLYHDVMLENLALITSLGKHHKQQIEEKHFRSNMGRASLLEKCKFHMSEKPFTYE

SEQ ID NO: 21468 - protein, 81 aa, Neomonachus schauinslandi
MDAVVFADVAVDFTPEEWALLDRGQRRLYRDVMLETCRNLASLDCCIQVKPCGSGTQLNILENELSSEDKIVRFTRNDSWA

SEQ ID NO: 21469 - protein, 81 aa, Monodelphis domestica
TEEVLTFKDVAVDFTREEWHLLSPLKKELYKEVMLENTRNLLSMGLLAHPEALLFYLEQREAPQMLEEEDLRSCCPGGEIR

SEQ ID NO: 21470 - protein, 81 aa, Monodelphis domestica
CQETVTFQDVAVEFTWEEWGHLNPSQKKLYSDVMLENYKNLVSLESKEHPEEKPYKCSKCGKAFKNKTQLIMHQRIHSGKI

SEQ ID NO: 21471 - protein, 81 aa, Monodelphis domestica
AQEAVMFKDVAVDFTREEWRLLSPPQKLLYKEVMLENARNLLSVGLPGPPEDVISSLEQREAPWILEQEGLRSCCPGEIIP

SEQ ID NO: 21472 - protein, 81 aa, Monodelphis domestica
LVTFKDVAVDFTQEEWRLLDHSQKELYREVMLENAWNLHSVDGETRLEMWPTTAKLSSSVKESEQQRLMTGGHFNLNLGEI

SEQ ID NO: 21473 - protein, 81 aa, Monodelphis domestica
TAQVVTFKDVAVEFTKEEWCLLSPPQKLLYKEVMLENAQNLLSIGLPVPSEDILSYLEQREAPWMLEQEGLRCFCPGEIIP

SEQ ID NO: 21474 - protein, 81 aa, Aotus trivirgatus
TQVRLTFRDVAVEFSQEEWKCLEPTQRALYRDVMLENYWSLVSLGLCHFDMNIISMLEEGKEPWTVKSCMKIARKPRMRQC

SEQ ID NO: 21475 - protein, 81 aa, Aotus trivirgatus
PVTFRDVTVIFTEAEWKRLSPEQRNLYKEVRITGIFSHWAWQQNILCPKTREKSPAALLRTVGKSSKMLPHIDYRMRCILQ

SEQ ID NO: 21476 - protein, 81 aa, Aotus trivirgatus
FQVSVTFEDVAVTFTQEEWGQLDATQRTLYQEVMLEICGLLVSLGCPLSKPELIYQLDHRQELWMAKKDLSQSSYPGDSTK

SEQ ID NO: 21477 - protein, 81 aa, Aotus trivirgatus
IQGQVNFEDVFVYFSQEEWVLLDEAQRLLYRDVMLENFALMASLGHTSFTSHTVASLVMGPDWVDVTPAVATGTLSGSGPG

SEQ ID NO: 21478 - protein, 81 aa, Papio anubis
MELLTFRDVTIEFSLEEWEFLKPAQQNLYRKVTLENYRNLVSLGLTVSKPELISCLEQRQEPWNVKRHETIAKPSAVSSSH

SEQ ID NO: 21479 - protein, 81 aa, Papio anubis
PQETLTFRDVAIEFSLEEWECLNPAQQNLYMNVMLENYKNLVFLAGIAVSKQDPVTCLEQEKEPWNMKRHEMVDEPPAMCS

SEQ ID NO: 21480 - protein, 81 aa, Aotus trivirgatus
MFENYSNLVSLGYTIPKPDVITLLEQEKEPWIVMREGTRSWYTDLEYKYITKNLLPEKNVCKTYLSQLQTGEKSKNTIHED

SEQ ID NO: 21481 - protein, 81 aa, Aotus trivirgatus
TVTFKDVAIDFTQEEWKRLDPAQRNLYRNVMLENYNNLITVGEIWGIDEHQKSQDRLLRQVEEKFQKTVTEEKGNECYKKF

SEQ ID NO: 21482 - protein, 81 aa, Aotus trivirgatus
MLENYRNLVFLGIAVCKPDLITWLEQGKEPWNMKRHAMVAKPPVICSHFAQDLWPEESIKDSFQKGILRTYGKYGHESLQL

SEQ ID NO: 21483 - protein, 81 aa, Aotus trivirgatus
SYEGSVSFRDVAINFSREEWRHLDLSQRNLYRDVMLETYSHLLSVGYQFPKPEVVMLEQGKEPWTLQGERPRHSCPGEKLW

SEQ ID NO: 21484 - protein, 81 aa, Pan troglodytes
GQVNFEDVFVYFSQEEWVLLDEAQRLLYRDVMLENFALMASLGCWHGMEDEEIPFEPSFSIGMSQIRIPKGGPSTQKAYPC

SEQ ID NO: 21485 - protein, 81 aa, Pan troglodytes
TQGHLTFRDVAIEFSQEEWKCLDPVQKALYRDVMLENYRNLVSLGICLPDLSIISMMKQRTEPWAVENEMKVAKNPDRWEG

SEQ ID NO: 21486 - protein, 81 aa, Pan troglodytes
MLDNFSSVAALGFCSPRPDLVSRLEQWEEPWVEDRERPELQAVRRGPRPGARKSADPKRHCDHPAWAHKKTHVRRERAREG

SEQ ID NO: 21487 - protein, 81 aa, Myotis davidii
MDFEDVAIAFSEEEWGLLDEAQRLLYCDVMLEVFALVSSVGCWHKMDDAEACSEESLSVQGESQVRASKTEPATQRTHLCK

SEQ ID NO: 21488 - protein, 81 aa, Myotis davidii
RNDSVAFEDVAVNFTQEEWALLNPSQKKLHRDVMRETFRNVAFLGKKWEDDDIEENEGRKQKSLMLEKLGEGENGSQCGEN

SEQ ID NO: 21489 - protein, 81 aa, Myotis davidii
QELPLVFEEVAVYFTREEWGVLGQPQKELYRDVMRVNYELLASLGPVATKPDLISKLEHRAAPWIKDPKGAKWGKGRFPGK

SEQ ID NO: 21490 - protein, 81 aa, Myotis davidii
AQGRVVFEDVAVRFSREEWGLLDEAQRCLYHNVMLENVALLCSVGSWHGARGEETPLEQGGSVGESQVRTPKPDPSTHKAR

SEQ ID NO: 21491 - protein, 81 aa, Cercocebus atys
AAVSVTFKHVTMTFTQKEWKQLDPAQRNVYHDVMLENYSNQASVGYQAPKPDLISKLEKGEAPWLGKGKRPSQGCPSKIAR

SEQ ID NO: 21492 - protein, 81 aa, Cercocebus atys
RPRALKFVDVAVYFSPEEWGCLRPAQRALYRDVMRETYGHLGALGVGGSKPALISWVEEEAELWDPAARDPEVTKCPTETD

SEQ ID NO: 21493 - protein, 81 aa, Cercocebus atys
GEACMGGDVTFSDVAIDFSHEEDLYKDVMVQNYKNLVSVTGLSVTKPYVITLLEDGREPWMVEKKLSFDWESRWENKELST

SEQ ID NO: 21494 - protein, 81 aa, Cercocebus atys
SQESVAFEDVAVYFTTKEWAIMVPAERALYRDVMLENYEAVAFVVPPTSKPALISHLEQGKESCFIRPQGVLSRSDWRAGL

SEQ ID NO: 21495 - protein, 81 aa, Leptonychotes weddellii
MLENYGHLLFLGLIVSKPDLVIYLEQKKEPWDVKRKKTVAIHRAISSHDIQSFMPKPSIEASFQKVSMGRHKNSDIEDLHL

SEQ ID NO: 21496 - protein, 81 aa, Leptonychotes weddellii
PCRLVLFKDVAVDFSQEEWECLDLEQKDLYRDVMLENYSNLVSLAGFSISKADVLSLLKQGKETWKVVQDVTRSQSSDWES

SEQ ID NO: 21497 - protein, 81 aa, Leptonychotes weddellii
PKVPVTFDDVAVYFSEPEWGKLDNWQKELYKHVMQGNYETLVSLDYAISKPDILTRMERGEEPCPEGPWGQEEGSKREAAR

SEQ ID NO: 21498 - protein, 81 aa, Leptonychotes weddellii
MLENIRHLVSLGYQHCKSDVIFPLEQGEELWREGTGFLQGQSPGRESALKEQELIATQHISRKDTSTIMPVQKSHTPEDPF

SEQ ID NO: 21499 - protein, 81 aa, Neomonachus schauinslandi
MAQESVVFSDVSIDFSQEEWECLNDDQRDLYRDVMLENYSHLVSMDVISFLEQGKEPWLVDRELTREQWPVLESRCETKKL

SEQ ID NO: 21500 - protein, 81 aa, Neomonachus schauinslandi
MDHELVTFRDVVINFSQEEWEYLDSAQRDLYWDVMMENYSNLVSLDLESKYDTKTRKDITGSQWKVTESKFIGLESSIFRN

SEQ ID NO: 21501 - protein, 81 aa, Neomonachus schauinslandi
GLEVVTFEDVAVYFTRTEWAGLSPAQRALYREVMLTNHGNLTSLGYPVCRLALTSLLEGGDLPWGLEPQDDLPAGNTSDVS

SEQ ID NO: 21502 - protein, 81 aa, Neomonachus schauinslandi
MGPIQRTLYRDVMLENYNNLVSVGNCIFKPAVIFKLEQGEEPWFLEEEISNQSHREDYRDDDLMKRNKKIQDKHLQEIIFI

SEQ ID NO: 21503 - protein, 81 aa, Neomonachus schauinslandi
QPREAVTFKDVEVTFSQDEWGWLDPAQRNLYRDVMLENYGNVVSLVGPFTKPVLISWLEAREPWGLNVQGAQPKGKPGVAP

SEQ ID NO: 21504 - protein, 81 aa, Neomonachus schauinslandi
VSRSFENDGVCFSEQEWENLEDWQKELYRNVMKSNYETLVSLKVLGQTEGEAELGAGMLGDLEEEGPGDVHPAEGVMIKQE

SEQ ID NO: 21505 - protein, 81 aa, Monodelphis domestica
AQEMVTFQDVAVDFTQEEWRLLEPPQKELYREVMLDNARNLLSLGLPVPREDLISYLEQREAPWMLGQEGLRSCCAEGKIR

SEQ ID NO: 21506 - protein, 81 aa, Monodelphis domestica
TTRGSVTFRDVAVDFSPDEWGRLGPAQRELYREVMLENYRSLAWLGEARRPPVVCQLERGAGPWLLEGDGLASGGPEAGES

SEQ ID NO: 21507 - protein, 81 aa, Monodelphis domestica
FQQLMAFEDVAVVFTQEEWGQLDSVQRELYRDVMLENYENFLSLGFPVPKPDIISQLERRKEAWIQDIQGPEEREFIQNAY

SEQ ID NO: 21508 - protein, 81 aa, Monodelphis domestica
AQVLVTFQDVAVDFTQEEWRLLDPGQKELYKEVMLENAENMLFLGLPVPREDWFFHFHEGGDPWMLEGKGPSISRLDEERH

SEQ ID NO: 21509 - protein, 81 aa, Monodelphis domestica
FQKSLTFKDVAVDFTQEEWQQLNSDQRYLYRDVMLENYRNLVSLGHQFSKPNVISQLEQGEEPWIVEKEVSAHSFLEWETR

SEQ ID NO: 21510 - protein, 81 aa, Monodelphis domestica
AGLTFADVTVSFSWEEWRHLEPRQKELYRDVLWESYGHLGALGLTRNNLKKKENGGLSKRKGAKGGAARRKGREFRETGIP

SEQ ID NO: 21511 - protein, 81 aa, Monodelphis domestica
CRESVTFKDVAVEFTWEEWIYLNPSQKKLYKDVMLENYRNLISLGFALSKPDVIYHLERKEASWMPEADVPRSSCSESKEF

SEQ ID NO: 21512 - protein, 81 aa, Monodelphis domestica
SQKSLTFKDMAVEFSQEEWEQLDPAQRNLYRDVMLERYRNLVLLGLPISKPDVISQLERGKEPWLLEREDSKGGCLDWGIR

SEQ ID NO: 21513 - protein, 81 aa, Camelus dromedarius
FQMPVTYEDVAVTFTREEWGHLDPAQKTLYQEVMLETCGLLASLGCSLPKPELVYPLEHSPGSRTSKTGLSPGLCAALLYR

SEQ ID NO: 21514 - protein, 81 aa, Camelus dromedarius
FQESVTFKDVIVDFTREEWKQLDPVQRDLFRDVTLENYTHLVSIAGLQVSKPDVISQLEQGTEPWIVEPSIPVGTFGGFIP

SEQ ID NO: 21515 - protein, 81 aa, Camelus dromedarius
DSVVLEDVAVAFSPEEWALLDVAQRSLYRDVMLETFRNLASIGEGHRSFTSSAERKYPQAAERVSGLGLNGGNLLLRKADR

SEQ ID NO: 21516 - protein, 81 aa, Cercocebus atys
MGSSVTFEDVAVNFSLEEWSLLNEAQRCLYHDVMLETLTLISSLGGVPPHRLPPTGACGPQVPSSRIRPSPGHCPRPSLYL

SEQ ID NO: 21517 - protein, 81 aa, Cercocebus atys
GLLTFRDVAIEFSQEEWKCLDPAQRTLYRNVMLENYRNLVSLGIFSKYEIKELPTKKESNTGEIFQTVMLERHESHDIEDF

SEQ ID NO: 21518 - protein, 81 aa, Cercocebus atys
MELLTFRDVTIEFSLEEWEFLKPAQQNLYRKVTLENYRNLVSLGLTVSKPELISCLEQRQEPWKVKRHETIAKPSDYSLTI

SEQ ID NO: 21519 - protein, 81 aa, Leptonychotes weddellii
SQPPVSFKDVAVTFTQEEWGQLDLAQRRLYRNVTLETCSHLVSLGLLLSKPDVISWLEQGQDPWRAGQGPPRASSIWMGAK

SEQ ID NO: 21520 - protein, 81 aa, Felis catus
YVGLPSQGSVTFRDVAVAFSQQKWESLNSAQRDLYRDVMLENCSNLVSLGHSLSKPHVLTLSEWKEPWMIVREDQRGPRTG

SEQ ID NO: 21521 - protein, 81 aa, Neomonachus schauinslandi
LQVSVSFEDVTVDFSREEWLHLDPAQRRLYRDVTLENYSHLRSVGYEVPKPEVIFKLEQGEEPWILERKTPHQSCSGEFGI

SEQ ID NO: 21522 - protein, 81 aa, Neomonachus schauinslandi
AREPVTYEDVAVDFTQEEWQHLDPAQKTLHRDVMLEIYSHLVSVGCSGIKPGIILKLEHEEDPWIIKSELSRWIHSDREKS

SEQ ID NO: 21523 - protein, 81 aa, Monodelphis domestica
AHGVLTFKDVAMDFTQEEEHLLTPPQKELYREVMLQNTQNLLSVRLPAPLQDAVSYLEQREAQWMLEQEGLRSCCPEGEIT

SEQ ID NO: 21524 - protein, 81 aa, Monodelphis domestica
SQGSITFKDVTVDLTQEEWCLLDHSQKELYLEVMLEMVQNLLSVGLPVPREYCTSCFQQGKTPWLREQKDSCPEPNFEVKE

SEQ ID NO: 21525 - protein, 81 aa, Monodelphis domestica
AQESLTFEDVAVEFTQEEWGHLDSAQRNLFRDVMLENYRNLVSLGLTVTKPDLLFHLERGEAPWAPQRQVPGGGASDCPSW

SEQ ID NO: 21526 - protein, 81 aa, Physeter macrocephalus
PALGSVTFEDVAVYFSQEEWKLLDEAQRFLYRDVMLETFALVASLGLSSSRSHVVQLELRGEPRVHDRVDMTPDRARGAQI

SEQ ID NO: 21527 - protein, 81 aa, Monodelphis domestica
AQEVVTFKDVAVDFTQKEWRLLSPAQKELYKEVMLENAQNLLSMGLPGPPEDMISYLEQKEFPWMLEHEDLRSFCPEGEIR

SEQ ID NO: 21528 - protein, 81 aa, Physeter macrocephalus
SQGLVTFEDVAVYFSLEEWERLDADQRELYKEVMQENYGILVSLGYPIPKPDLIFRLEQGEEPWVPDGPRPEEGDIVTGVY

SEQ ID NO: 21529 - protein, 81 aa, Monodelphis domestica
AQEVVTFKDVAVDFTKEEWCLLTPPQKVLYKEVMLENARNLVSVGLAVSRGDVISYFEQREAPWMLEQEDLGIGCPDSEIR

SEQ ID NO: 21530 - protein, 81 aa, Monodelphis domestica
PKEAVTFKEVAVDFTWEEWRLLSPPQKELYKEVMLENAQNLLSVGLPGPPEDVISSLEQREAPWILEQESLRSCCPEGEIR

SEQ ID NO: 21531 - protein, 81 aa, Monodelphis domestica
QCVRTVPGRRPSSSEFCLFPRKNYQRERNGYCVPDNQSSGLPISKPDVIFKLEQGKEPWILNLQEAREREVPRNFSPGWES

SEQ ID NO: 21532 - protein, 81 aa, Physeter macrocephalus
AQGLVLFEDVSVDFTQKEWQLLDRTQRLLYRDVMLENYGHLVSLGHCVSKPELILKLEQEEEPWILKGQLASESHPEVQRT

SEQ ID NO: 21533 - protein, 81 aa, Monodelphis domestica
QEPVTFRDVAVDFSREEWQHLTPAQRGLYRAVMLENYEHLVSLGLSVHVSKLDLISLLERGGSLLGPAGGDPDNTCPVVCY

SEQ ID NO: 21534 - protein, 81 aa, Monodelphis domestica
WGELVAFKDMTVDFTPEEWGHLHPSQKELYRDMMLENYQNLVWMGLAVSKPDMIYQLEFIYALLIKTLPGKHYLLFKKLIY

SEQ ID NO: 21535 - protein, 81 aa, Monodelphis domestica
FWGSITFHDVAVDFTEEEWDLLDHSQKELYREVMLENVQNLLSMGLLVPGENFIPCFQQGEAPWLLEQKGPRNSCPETETN

SEQ ID NO: 21536 - protein, 81 aa, Monodelphis domestica
EIKESLTFKDVAVEFTWEEWRHLDPTQRALYRDVMLENYENLVSIGIPVSRPDLTFLLKRKDIWNQEEEVRTGISPDSLIE

SEQ ID NO: 21537 - protein, 81 aa, Physeter macrocephalus
MDFTPEEWGRLDPAQRDVMLENYRNLVSLWLPVSKPENHNLENGKEPLMLERRAPKSSCSDSETRPGSRDSTSVQDFSKEE

SEQ ID NO: 21538 - protein, 81 aa, Physeter macrocephalus
PQACVTFEDVAIYFSQEEWGLLDEAQRFLYHDVMLENFALTTSLDCQCGAEDEEIPSEQSVSGGESQVRTSQSFPSTQKTH

SEQ ID NO: 21539 - protein, 81 aa, Pan troglodytes
AQVSVTFDDVAVTFTQEEWGQLDLAQRTLYQEVMLENCGLLVSLGCPVPRPELICHLEHEQEPWTRKEDLSQGTCPGDKGK

SEQ ID NO: 21540 - protein, 81 aa, Pan troglodytes
VTLKDVGMDFTLGDWEQLGLEQGDTFWDTALDNCQDLFLLGEFPHGSPLWETFALALSDVTETKNSPLMEDFFEEGFSQEI

SEQ ID NO: 21541 - protein, 81 aa, Pan troglodytes
YQDSVTFEDTAVDFTQEEWTLLDPVQRNLYRDVMLENYENVAKVGFQLLKPSVISWLEEEELRTLQQGVLQDWAIKHQTSV

SEQ ID NO: 21542 - protein, 81 aa, Camelus dromedarius
ALGTVTFEEVAVYFSQDEWRLLDEAQRLLYRDVMLENFVLVASLGLASSRSHVVVQLELGGEPWVHGRVDMTPGTARGAQS

SEQ ID NO: 21543 - protein, 81 aa, Camelus dromedarius
SVTLEDVAVGLMQEWALLDDARRKLCRYVLLDNCRTLAPRGFDVHWLPRDNSSMDFTMQTQSGLPGGTERRAEGSGTRHSL

SEQ ID NO: 21544 - protein, 81 aa, Camelus dromedarius
AQGSVSFKDVTVDFSQEEWQHLDPAQKTLYMDVMLENYCHLISVGCHMTKPDVILKLERGEEPWTSCTGHTCLEESWKAED

SEQ ID NO: 21545 - protein, 81 aa, Camelus dromedarius
PKVPVTFDDVAVYFSEPEWGKLDEWQKELYKHVMRGNYEMLVSLDYAISKPDILTRMERGEEPCPEGPWGQEEGNEREEAC

SEQ ID NO: 21546 - protein, 81 aa, Camelus dromedarius
MAFRDVSVDFTQEEWRLLSPAQRTLYRDVMLENYRNLVSLGIPFSKPKLITQLEQGRETWKEERKGPPGPCPEEPVQPGSL

SEQ ID NO: 21547 - protein, 81 aa, Myotis davidii
MLENCRLLASLGCPVPRPELICQPEPGWELWMVKTDLSRGTCPGDKEKFKTTESTACEPALSERFSVQEQLTQKVPADFQG

SEQ ID NO: 21548 - protein, 81 aa, Myotis davidii
DMNFEDLAIAFSQEEWNLLDEDQRLLYCEEMLEVFALVSSVGCWHKMDEEEVPPEQRVSVGESQVGASKTAPATQKTYLCK

SEQ ID NO: 21549 - protein, 81 aa, Myotis davidii
RQEDMNFEDVAIAFSQEEWGLLDEDQRHLYCDVMLEVFALVSSVGCWHKTEKEDACSAESVSVQGESKFMASKTATATQRT

SEQ ID NO: 21550 - protein, 81 aa, Myotis davidii
SLTSVTLKDVAVTFTQDEWEQLDLAQRTLYREVMLEICRLLVSLGYPVPKSELVHLTEHRQELWIVKRGLSQSACAGAREK

SEQ ID NO: 21551 - protein, 81 aa, Myotis davidii
VQEPLTFHDVAVDFTWEEWQLLDPEQKDLYRDVMMETYGHLVSVGYEASKPDILSKLDHGEAPWTVAGEIHCVTRSGGGAE

SEQ ID NO: 21552 - protein, 81 aa, Cercocebus atys
MLFIFNKAGIDISKQDPITSLEQEKEPWNMKRHEMVDESPAMCSYFTKDLWPEQDIKDSFQQVILRRYGKCEHENLQLRKG

SEQ ID NO: 21553 - protein, 81 aa, Cercocebus atys
DGGLLTFRDVAIEFSQEEWKCLDPAQRTLYRDVMLENYRNLVSLDISSKCMMKTLSSTRQGNTEVIHKGTLQRQASHHIGE

SEQ ID NO: 21554 - protein, 81 aa, Felis catus
QVVTFEDVVVDFTQEEWGQLEPAQRTLYRDVMLETFRLLVSVGKATLDWDRSSLGRLKVEQMGGREGVGNTNVYSAGLPLG

SEQ ID NO: 21555 - protein, 81 aa, Physeter macrocephalus
LLTFRDVAIEFSQEEWEWLDPAQRALYKDVMLETYRNLLSLGEDNAPPEVGICPNISISFMTKELLKKKNINNRELYQPMV

SEQ ID NO: 21556 - protein, 81 aa, Monodelphis domestica
RLGSITFKDVVMDFTKEEWCLLDISEKELYKEVMLENVQNLLSVGLIVPKENFITCFQQGESPWLLKQKGQWSSCPEAETN

SEQ ID NO: 21557 - protein, 81 aa, Monodelphis domestica
QRELVTFKDVTVDFTQEEWGNLDTSQKELYRDVMLENYKNLVFLGLTVWKPDVISHLEEGEAPWMPDRELPKSNYSGWKTR

SEQ ID NO: 21558 - protein, 81 aa, Monodelphis domestica
VPKVPGTFENDGVYFSEQEWENLDDWQKELYRNVMKSNFETLVSLDCAISNPEILAHQEEESGTEELGDLAGVSPGGPHLA

SEQ ID NO: 21559 - protein, 81 aa, Monodelphis domestica
FQGLITFKDVAVNFNQEEWCLLDHSQKELYVEIILENVQNLLSVGLPVPREDFLTCFQQGEAWCLLEQKGPRSSYPETEIN

SEQ ID NO: 21560 - protein, 81 aa, Monodelphis domestica
VKEVVTLQDVAVDFTWEEWRLLSPPQKELYREVMLENAQNLLSVGLPAPLEDVLSYLEQRKGPWMLEQKRLRSCCPGEIRL

SEQ ID NO: 21561 - protein, 81 aa, Aotus trivirgatus
QDSVAFEDVAVNFTHEEWALLGPSQKNLYRDVMQETIRNLNCIGMKWENQNADDQYQNLRRNLRCDVVERFGKSKDGSQCG

SEQ ID NO: 21562 - protein, 81 aa, Aotus trivirgatus
EMETLTFRDVAIEFSLEEWQCLNPAQQNLYRNVMLENYRNLVFLAGIAVSKADLITCLQQGKDPWNMKRHSIVAKPPVLCS

SEQ ID NO: 21563 - protein, 81 aa, Aotus trivirgatus
EYTPVSFKDVVVGFTQEEWHRLNPTQRALYRDVMLETYSNLVSVGYEGTKPDVILRLEQEEAPWIGEAACLGCHCWGKCDK

SEQ ID NO: 21564 - protein, 81 aa, Aotus trivirgatus
MSQVTFSDVAIDFSHEEWGWLDSAQRDLYKDVMVQNYENLVSLGLSITKPYVITLLEDGKEPWMVEEKLSKGVTPDWDSRW

SEQ ID NO: 21565 - protein, 81 aa, Aotus trivirgatus
SQDSMTLEDIVVDFTREEWALLDTSQRKLFRDVMLENISHLVSIGNQFCKSVVFSHLEQVEKVSTQGISLLQGKEGDIKHQ

SEQ ID NO: 21566 - protein, 81 aa, Aotus trivirgatus
TIKEAVTFKDVAVVFTEEELELLDPAQRKLYRDIMLENFRNLLSIGNQPFHQDTFHFLRKKKFWMMKTTSQREGNLGGKIQ

SEQ ID NO: 21567 - protein, 81 aa, Papio anubis
AGRPLEMAVSEPEASAAEWKQLDPAQRNLYHDVMLENYSNQASMGYQAPKPDLISKLEKGEAPWLGKGKRPSQGCPSKIAR

SEQ ID NO: 21568 - protein, 81 aa, Sarcophilus harrisii
GWVPALFDEVAIYFSDEEWEVLTEQQKALYREVMRMNYETVLSLEFPFPKPDMISQLEAEESPWVPYPQNSEEWKLQGGSF

SEQ ID NO: 21569 - protein, 81 aa, Pan troglodytes
EMGLLTFRDIAIEFSLAEWQCLDLAQQNLYRDVMLENYRNLVSLGIAVSKPDLITCLEQNKEPQNIKRNEMVAKHPVTCSH

SEQ ID NO: 21570 - protein, 81 aa, Pan troglodytes
LELLDYTQKALYNDVMQENCKTVISLALFVLPKPKVISCLEQGEEPWVQVSPEFKDSAGKSPTGLKLKNDTENRQPVSLSD

SEQ ID NO: 21571 - protein, 81 aa, Camelus dromedarius
TVTFKDVAVVFTEEELALLDKAQINLYQDVMLENFQNLVSVGDRIKNNISNLQEKGLSYLSQEVLYFWQIWKQRISEFTVS

SEQ ID NO: 21572 - protein, 81 aa, Camelus dromedarius
MGPVSFKDVAVDFTQEEWQQLDSNEKTTYRDVMLENYSHLVSVGYDSTKPNVIVKLEQGEEPWTVAGELPRPAHPGTLVGA

SEQ ID NO: 21573 - protein, 81 aa, Myotis davidii
MDFEDVAVAFSEEEWGLLDEAQRLLYCDVMLEVFALLSSVGCWHETDEEACFEQSISIQGESQVRTSKTEPATQRAHLCER

SEQ ID NO: 21574 - protein, 81 aa, Myotis davidii
SQGLVSFKDVAVDFTQEEWQQLDPAQRTLYRDVMLENYSHLVSMGHPVSKPDVISKLEQGEDPWIIKRDISNWIYPDRKSN

SEQ ID NO: 21575 - protein, 81 aa, Cercocebus atys
FQEAVTFKDVAVVFSREELRLLDLTQRKLYRDVMVENFKNLVAVGHLPFQPDMVSQLEAEEKLWMMETETQKSSKHQNKME

SEQ ID NO: 21576 - protein, 81 aa, Cercocebus atys
TQGHLTFRDVAIEFSQEEWKCLDPVQKALYRDVMLENYRNLVSLGICLPDLSIISMMKQRTEPWTVENEMKVAKNAVRWEG

SEQ ID NO: 21577 - protein, 81 aa, Leptonychotes weddellii
MFPVTFSDVAIDFSHEEWGWLDSAQRDLYKDVMVQNYENLVSLAGLSIPKPYVISLLEDGKEPWMVEKKLSKDWESRWGNK

SEQ ID NO: 21578 - protein, 81 aa, Leptonychotes weddellii
LQEPVTFWDVAVDFTQEEWGQLGPAQRTLYRDVMLETFGHLLSVGPELPKPEVISQLEQGAELWAAERGIGQGYCPGEMLP

SEQ ID NO: 21579 - protein, 81 aa, Leptonychotes weddellii
QVSVAFQDLAVRFSEEEWQLLGEGQRTLYRDVMRENYETLRSLGTDELLPLSAFLSPTEPGGAMEGRNYAGEGQEPPRGGG

SEQ ID NO: 21580 - protein, 81 aa, Leptonychotes weddellii
SQGLLTFKDVSVDFTQEEWGQLAPAHRNLYREVMLENYGNLVSVGYQLSKPGVISQLEKGEEPWLIEREISGSPSSDLENK

SEQ ID NO: 21581 - protein, 81 aa, Neomonachus schauinslandi
SSQALLTFRDVAIEFSQEEWGCLNLVQRELYRDVMLENYGHLLFLGLIVSKPDLVSFLEQKKDPWDVKRKKTVAFHPGRWE

SEQ ID NO: 21582 - protein, 81 aa, Neomonachus schauinslandi
MTLFQISFEDVAVGFTSEEWQLLNPSQKSLYREVMLENYSNLVFLGYQIIKPDAIFKLEHEEPWIIDEEVLNQNFSEVWLD

SEQ ID NO: 21583 - protein, 81 aa, Neomonachus schauinslandi
LPDLVTFEDVAVEFTQEEWALLDPSQRTLYRDVMRENCRNLASLGDQVDKPGLVSELEQEDKVITEEIRILPGNCPDLETL

SEQ ID NO: 21584 - protein, 81 aa, Neomonachus schauinslandi
LQVSVSFEDVTVDFSREEWQHLDPAQRRLYRDVTLENYSHLHSVGYQVPKPEVIFKLEQGEGPWTLEGETPHQGCSDEAIG

SEQ ID NO: 21585 - protein, 81 aa, Monodelphis domestica
AQEVVTFKDVAVEFTQEEWCLLSPPQKELYKEVMLENVQNLHSVGLPAPPEDMTSYMEQRESSWMLEQEVLRSCCPGKIRR

SEQ ID NO: 21586 - protein, 81 aa, Monodelphis domestica
SVTFKDVAVDFTQEEWCLLDHSQKELYKEVVLENVQNLLFVEAETYFEVKEMSTKMRLFVEGSNSPRGMNKSPCDFFLRDS

SEQ ID NO: 21587 - protein, 81 aa, Monodelphis domestica
SIAFKDIVVDFTQEEWCLLDHSQKVLYLKVMLENVQNLLSVEAETNFEVKEMSTKLSLLVEESGPQGCMNEDPCDFILREI

SEQ ID NO: 21588 - protein, 81 aa, Monodelphis domestica
MQGSLTFKDVAVDFTQEEWCLLDHSQKELYLEVMLENVQNLLCVGLPVPREYFTSCFQQGKAPWLLEQKSLRSSCPEAETN

SEQ ID NO: 21589 - protein, 81 aa, Physeter macrocephalus
MESVVFEDVAVDFTPEEWALLDPAQRNLYRDVMLETFRNLASVGENWKCRSIEDQHKNQGTYLRWCVVEIPSENNESSQCG

SEQ ID NO: 21590 - protein, 81 aa, Monodelphis domestica
APQELVTFQDVAVDFTPEEWGCLALPQKELYREVMLENYGNLVCLGLEIKPDMIGRLERREAPWRPGREESGGSWADWETR

SEQ ID NO: 21591 - protein, 81 aa, Monodelphis domestica
FQASVTFKDVAVDFTWEEWRLLDPPQKELFWEVMLENYRNLVCLGLADSNKDVMISELESGEPHWIPTGGVLRSCWPGWES

SEQ ID NO: 21592 - protein, 81 aa, Physeter macrocephalus
GCVTFADVAVNFSAEEWGLLDEAQRCLYHDVMLEDLALTTSLGCWHAEEDGEALSEQSVSDQGSPQIRIVKAGLSPQKANL

SEQ ID NO: 21593 - protein, 81 aa, Monodelphis domestica
SQGSITFKDVAVDFSQEEWCLLDHSQKALYLEVMLENVQNLLSVGLPVPRENFISCFQQGKAPWLLEQKDTRNSCLEAETN

SEQ ID NO: 21594 - protein, 81 aa, Physeter macrocephalus
LQGTLTFRDVTVDFNLEEWQQLDATQRNLCRDVMLENYSHLVSVGFLMAQPVRIFRLGQGEEEARMAAGESPTRRCPGEPA

SEQ ID NO: 21595 - protein, 81 aa, Monodelphis domestica
SQGALTFKDVAVDFTQEEWCLLDHSQKELYLEVMLENVQNLLSVGLQVPRENFISSFHQGKAPWLLEQKGPKSSFPETETN

SEQ ID NO: 21596 - protein, 81 aa, Physeter macrocephalus
SQESVTFQDVAVDFTEKEWPLLDSSQRKLYKDVMLENYSNLASVGCQVGKPSLISHLEQEEELRTEEQELHQGPCPDWETP

SEQ ID NO: 21597 - protein, 81 aa, Monodelphis domestica
QGSITFKDVAVDFTQEEWRLLDPSQKELFREVMLENVQNLLSVDAETNFEAKEMSTKLNFFVEGSGFPRGMNKGPCDFLLR

SEQ ID NO: 21598 - protein, 81 aa, Monodelphis domestica
AQEAVTFKEVAVDFTWEEWRLLSPPQKELYKEVMLENAQNLLSVGLPGPPEDVISSLEQREAPWILEQEGLRSCCPGEIIP

SEQ ID NO: 21599 - protein, 81 aa, Monodelphis domestica
QEEVVTFQDVAVDFTGEEWRLLSPPQKELYKEVMLENARNLLSVGLPGPPEEVISSLEQKETPWILEQEDLRSCCSEMRPE

SEQ ID NO: 21600 - protein, 81 aa, Pan troglodytes
VTFEDVAVYLSREEWGRLGPAQRGLYRDVMLETYGNLVSLALGTRTEYKELTSQETFGEEDPQGSEPVEACDHIRKSEGSL

SEQ ID NO: 21601 - protein, 81 aa, Pan troglodytes
YQDTVTFDDVAVDFTQEEWTLLDPSQRDLYRDVMLENYENLASVGHHLFKPSVIYWLEQEEELRAGWRAVLQEWRLKTKGP

SEQ ID NO: 21602 - protein, 81 aa, Pan troglodytes
GFLVFKPELISRLEQGEEPWVLDLQGAEGTEAPRTSKTDSTIRTENEQACEDMDILESESYGTVVRISPQDFPQNPGFGDV

SEQ ID NO: 21603 - protein, 81 aa, Pan troglodytes
EKGPLTFRDVAIEFSLEEWQCLDSAQQSLYRKVMLENYRNLVFLGIALTKPDLITCLEQGKEPWNIKRHEMVAKPPVICSH

SEQ ID NO: 21604 - protein, 81 aa, Pan troglodytes
GTVTFEDVAVNFTWEEWNLLSEAQRCLYRDVTLENLALISSLGCWCGVEDEAAPSKQSIYIQRETQVRTPMTGVSPKKAHP

SEQ ID NO: 21605 - protein, 81 aa, Pan troglodytes
QDSVTFDDVAVEFTPEEWALLDTTEKCLYRDVMLENYVNLASVGKSNIILLEWEIQPRTKWSSLQLGFLRNPIFNRIQMQT

SEQ ID NO: 21606 - protein, 81 aa, Camelus dromedarius
QGSVTFEDVAVYFSWEEWDLLDEAQRCLYHNVMLENLALITSLALAYVTLLLKAFQERLQGFVVLIYSLDAVTSCRRYCIV

SEQ ID NO: 21607 - protein, 81 aa, Camelus dromedarius
GQESVSFKDVTVDFTWDEWLQLTGMQRTLYRDVMLENYSHLVSVGCCITKPEVIFKLEQGEEPWPREGELPGRRDPDRSQE

SEQ ID NO: 21608 - protein, 81 aa, Camelus dromedarius
AVSSLQNLVTFEDVAVRFCKEEWGLLDAAQRHLYHSVMLENLELVTSLGNEPPPRWWKALRDVQFGPGKMHVPHGHRKLCM

SEQ ID NO: 21609 - protein, 81 aa, Camelus dromedarius
FQGSVTFQDVAMDFTLEEWQLLGCAQRKLYWDVMLENFRNCISVGCPDTKTKVIFKVEQGQEPWMVEGENPRWRTPGESAK

SEQ ID NO: 21610 - protein, 81 aa, Myotis davidii
PQGSVSFKDVTVDFTQEEWQQLDTDQKALYRDVMLENYYHLISVGFHMTKPDMIRKLEEGKELWTTERIFSSQSYLEEDGK

SEQ ID NO: 21611 - protein, 81 aa, Cercocebus atys
HLKKKEKNIEFSQAEKKNKKTAQRALYKKKIKKNYRNLKKMILFLQTGKKIKKLNINSMLEKKKKNWSGESEVKKKKKTDG

SEQ ID NO: 21612 - protein, 81 aa, Felis catus
FQESVTFEDVAVYFSENEWIGLAPAQRVLYRDVMLENYGVVASLAFPFPKPALISQLERGEAPWCKAPQGAVDGECPRGVS

SEQ ID NO: 21613 - protein, 81 aa, Leptonychotes weddellii
AQVPLTFSDVAIDFSQEEWECLNSDQRDLYRDVMLENYTNLVSLDIDFTTETNKLSSEKSSYEVNSYHRETMKRSKTFNLT

SEQ ID NO: 21614 - protein, 81 aa, Leptonychotes weddellii
GWVPALFDEVAIYFSDEEWEVLTEQQKALYREVMRMNYETVLSLEFPFPKPDMITRLEGDEESQNSDEWQLQGGTFAENEE

SEQ ID NO: 21615 - protein, 81 aa, Felis catus
QSCVTFEDVAVYFSQEEWGLLDEAQRFLYHDVMLETFALATSLDCWCGAENEEVPSEQSVSVERVSQVRTSKTGSSIQKTH

SEQ ID NO: 21616 - protein, 81 aa, Felis catus
WSSHDGYIDFFQGLAVFKDVAIDFTQGEWNYLGAAQKDLSRDVMLENYHNLVSVGKDVYLQIIRYLPCGISASFHVDFWIV

SEQ ID NO: 21617 - protein, 81 aa, Neomonachus schauinslandi
AVTFKDVAVVFTEEELALLDKAQINLYQDVMLENFRNLVSVGDRIKNNISHLQGKGLSYRSQEVLYCWQIWKQRISELTVS

SEQ ID NO: 21618 - protein, 81 aa, Neomonachus schauinslandi
LFQGSLSFKDVAVVFTWEEWQLLDPVQKNLYQDVMLENYSSLVSVGYQVTKADAFYQLEHGTPWITEEEIQSQIHPAQRSH

SEQ ID NO: 21619 - protein, 81 aa, Monodelphis domestica
APVPVTFDDVTMYFTAQEWGILEEWQKELYKHVVMTNYETLFSLGYSIPKPDLITQIERGEEPFIRDQGPLKTLELAIGSS

SEQ ID NO: 21620 - protein, 81 aa, Physeter macrocephalus
ELALVSFEDVAVTFTGEEWRHLDLAQRTLYQEVMLETCGLLVSLGHPVPKPELIPLLEHGQELRTVKRGLSRSTCTGEKAK

SEQ ID NO: 21621 - protein, 81 aa, Monodelphis domestica
SKGSITFKEVAVDFNQEEWCLLDHSQKELYLEVMLDNVQNLLSVGFPVPREDFISCFQQGKAPWLLEQKGPRISCPEAETN

SEQ ID NO: 21622 - protein, 81 aa, Monodelphis domestica
ERQIQEPLTFQDVAVYFTQEEWCLLEPPQKELYKEVMLENALNLLSLGLPVPREDLISYLEQREAPWMLGQEEFPTAQQIC

SEQ ID NO: 21623 - protein, 81 aa, Monodelphis domestica
YQESVTFSDVAVDFTQEEWRYLGPSEKKLYRDVMLENYGHLVDLGLTVSKPDVICHLEQGEPLWRPENQVTRTSFPGTLHE

SEQ ID NO: 21624 - protein, 81 aa, Monodelphis domestica
SQGFITFKDVVVDFTQEEWCLLEHSQKELYREVMLENVQNLLSLGLLVPKEDFISSFQQGDGSWLLQQKDSKTKNKQKGSR

SEQ ID NO: 21625 - protein, 81 aa, Vulpes vulpes
FQEAVTFKDVAVVFSEEELGLLDPTQRKLYRDVMLENFRNLVSLGHSSSKPDVISQLEREEKLCTKEFHTQGGGRNQKEME

SEQ ID NO: 21626 - protein, 81 aa, Otolemur garnettii
QGVLTFKDVAIEFSMEEWACLDPAQQHLYREVMLETYRNLVFLGLAVSKPDLITCLEQSKEPWKVKTQQTLLKPPALSNHS

SEQ ID NO: 21627 - protein, 81 aa, Otolemur garnettii
SCVTFEDVAIYFSQDEWDLLDEAQRLLYFNVMLENFALTASLGKALTPSSVSWSLSLLFTLKGSIWVAEVLQSAEWISPSS

SEQ ID NO: 21628 - protein, 81 aa, Otolemur garnettii
QGLVTFRDVAIEFSQEEWKCLEPAQRDLYRDVTLENFSNLVSLETGLSISKPDVISLLEQGKEPWMIANDMTGPWCSDLES

SEQ ID NO: 21629 - protein, 81 aa, Otolemur garnettii
QAPLTFRDVSIEFSMDEWAYLDPAQQNLYRDVMLETYRHLVFLETGLAVSKPDLITCLEQSKEPWKVKTQQTVVKHPVISN

SEQ ID NO: 21630 - protein, 81 aa, Vulpes vulpes
SQSLLTFEEVAMYFSQEEWELLDPTQKALYNDVMRENYETVISLALFVLPKPKVISYLEQEEEPWVQGPLEFKDNPGELPT

SEQ ID NO: 21631 - protein, 81 aa, Pongo abelii
AHGSVTFRDVAIDFSQEEWEFLDPAQRDLYRDVMWENYSNFISLGPSISKPDVITLLDEERKEPEMVVREGTRRYCPDLES

SEQ ID NO: 21632 - protein, 81 aa, Pongo abelii
THSLKKVTFEDVAIDFTQEDWAMMDTSRRKLYRNVMLENISHLVSLQISKYCITLLEQGKELWQEGREFLQDQNPDRESAL

SEQ ID NO: 21633 - protein, 81 aa, Pongo abelii
QGLLTFRDVAIEFSQEEWKCLDPAQRTLYRDVMLENYRNLVSLDISSKCTMKEFSSTAQGNREVFHAGTLQRHESHHIGDF

SEQ ID NO: 21634 - protein, 81 aa, Pan troglodytes
SSFKKRPLTFRDVAIEFSLEEWQCLNTAQQNLYRNVMLENYGNLVFLGIAVSKPDLITCLEKEKYPWNMKRHKMVDESPGR

SEQ ID NO: 21635 - protein, 81 aa, Pan troglodytes
MLETYSSLVSLGHCITKPEMIFKLEQGAEPWIVEETPNLRLSAVQIIDDLIERSHESHDRFFWQIVITNSNTSTQERVELG

SEQ ID NO: 21636 - protein, 81 aa, Pan troglodytes
KRKGKEPGMALPQGRLTFRDVAIEFSLAEWKFLNPAQRALYREVMLENYRNLEAVESHFVTQAGVQWCDPGSLQPLPPRFK

SEQ ID NO: 21637 - protein, 81 aa, Pan troglodytes
MVHSSISKPDVITLLEQEKEPWIVVSKETSRWYPDLESKYGPEKISPENDIFEINLPKHVIKQISKTLGLKAFYFRNDSEY

SEQ ID NO: 21638 - protein, 81 aa, Pan troglodytes
FQEPVTFEDVAVYFTQNEWASLHPMQRALHREVMLENYANVTSLSAFPFPKPDLIFQLEQGEAAWGPDPWTLAGGETLRGM

SEQ ID NO: 21639 - protein, 81 aa, Myotis davidii
TWGRVSFEDVVLYFSWEEWGLLDETQRCLYHDVMLENFALVTSLGCWYRAEAEAEAAAEEEEQEQEQEEEDEEEPSVQGVT

SEQ ID NO: 21640 - protein, 81 aa, Myotis davidii
PNALVTFQDVFVDFSPEELASLSAAQRRLHREVTLENYRNLVSLGYQFPRPDIITQLEEEESSAMEEDSNTKTGPDWETGP

SEQ ID NO: 21641 - protein, 81 aa, Cercocebus atys
GPLVMAETDPTQGRVVFEDVAIYFSQEEWGHLDEAQRLLYRDVMLENLALLSSLGKALTLAQCPLGCVVPFYPNAALRFPQ

SEQ ID NO: 21642 - protein, 81 aa, Cercocebus atys
VTFKDVAVTFTQEEWRQLDLTQRTLYREVMLETCGLLVSLGDRTQVHTREPTTYPPVLSERAFVRGSLTVESSTSSDSRLG

SEQ ID NO: 21643 - protein, 81 aa, Cercocebus atys
SQHLVTFEDVAVDFTQEEWTLLDQTQRDLYRDVMLENYKNLIILAGSELCKPSLMSGLEQMEELRTGVTGVLQERSNTVEK

SEQ ID NO: 21644 - protein, 81 aa, Cercocebus atys
MAKPIREEWRHLDPSQRNLYRDVMLETYSHLLSVGYQVPEAEVVMLEQGKEPWALQGERPRQSCPGEKLWDHNQCRKILTY

SEQ ID NO: 21645 - protein, 81 aa, Felis catus
TLESLTLEDVAVDFTQEEWRLLAPAQKDLYRDVMLENFRNLVSVGHQASKPDVLARLERGEEPWAIEEEVRSGTSPETGKV

SEQ ID NO: 21646 - protein, 81 aa, Leptonychotes weddellii
VKDSVTFKDVAIDFTLEEWRLMDPSQRNLHKDVMLENYRNLVSLGLAVSKPDMISHLEDGKGPWVVVREIARTPYPELETK

SEQ ID NO: 21647 - protein, 81 aa, Monodelphis domestica
TPVLVSFADVAVYFSPEEWGRLRPEQRALYRDVMRETYGHLGALGFPGPKPALISWMEEAAWDSEASFPEEPVIKRLEDVG

SEQ ID NO: 21648 - protein, 81 aa, Monodelphis domestica
PGQEVVTFKDMAVDFTREEWRLLTPPQKELYKEVMLENARNLLSVGFAVPGDVISYLEQREAPWLLEQEGLRSCSPGDISP

SEQ ID NO: 21649 - protein, 81 aa, Pan troglodytes
GPVSFKDVAVDFTQEEWQQLDPDEKIAYGDVMLENYSHLVSVGYDYHQAKHHHGVEVKEVEQGEEPWIMEGEFPCQHSPGK

SEQ ID NO: 21650 - protein, 81 aa, Pan troglodytes
SQHLVTFEDVAVDFTQEEWTLLDQAQRDLYRDVMLENYKNLIILGSELFKRSLMSGLEQMEELRTGVTGVLQELDLQLKTK

SEQ ID NO: 21651 - protein, 81 aa, Pan troglodytes
QDSVTFDDVAVEFTPEEWALLDTTQKYLYRDVMLENYMNLASVDFFFCLTSEWEIQPRTKRSSLQQGFLKNQIFSGIQMTR

SEQ ID NO: 21652 - protein, 81 aa, Pan troglodytes
GTVTFEDVAVKFTQEEWNLLSEAQRCLYRDVTLENLALMSSLGCWCGVEDEVAPSKQSIYIQRETQVRTPMASVSPKKAHP

SEQ ID NO: 21653 - protein, 81 aa, Pan troglodytes
VVFEDVDVNFTQEEWALLDPSQKNLYRDVMQETFRNLASVGKKWKDQKIEDEYKNPRRNLRGLMGERLLESKKDHQHGEIL

SEQ ID NO: 21654 - protein, 81 aa, Myotis davidii
CKRQVGVTFEDIALYFSREEWSLLDEGQRQLYLNVMLENFELISSLGKTLTVTSDLDLALRFPRAQPPMCALSSHVDCGTA

SEQ ID NO: 21655 - protein, 81 aa, Myotis davidii
SALGQLTFSDVAIEFSQEEWACLDPAQRKLFRDVMLQNYRNLVFLGVSKPDLLTFLEHMKEPWELKRKKKIPIQPGRWESR

SEQ ID NO: 21656 - protein, 81 aa, Cercocebus atys
FQASVSFKDVTVEFTQEEWQHMGPVERTLYRDVMLENYSHLVSVGYCHFKPEVIFKLEQGEEPWFSEEEFSNQSHPKDYRG

SEQ ID NO: 21657 - protein, 81 aa, Cercocebus atys
MLENYRNLVSLGIAVSKPDLITCLEQRNEPWNVKKLETIGRHPAVSSHFTQDLLPEHGIKDSFQKVILERYGSCGTENLDL

SEQ ID NO: 21658 - protein, 80 aa, Felis catus
LAVSFLGRLTFKDVAIEFSQEEWECLDPTQRALYRDVMLENYRNLVSLGEDNVCSEVGICPWVSLHFSLVCLLGAPALLA

SEQ ID NO: 21659 - protein, 81 aa, Felis catus
WLVTFRDVAIDFSQEEWECLNSTQRDLYRDVMLENYSNLISLDLESSCETKKSSPEKGAYEMESLQWENRRKPISHNFDYN

SEQ ID NO: 21660 - protein, 81 aa, Neomonachus schauinslandi
FQETVTFKDVAVVFSEEELGLLDSTQRKLYRDVMLENFRNLVSVGNQPFKPELIFQLEREEKLLMMETETQRDGKSQHIME

SEQ ID NO: 21661 - protein, 81 aa, Neomonachus schauinslandi
AQESLTFDDVAVDFTWEEWQLLAPAQKDLYRDVMLDNYRNLVSVGFHISKQDVLSKLDQREPTWTVEEDIPCQTHSETWKL

SEQ ID NO: 21662 - protein, 81 aa, Neomonachus schauinslandi
VTFEDVAVYFSWEEWGLLDEAQRLLYRDVMLENFSLMASLGKCCAHGAEVEEAPHEQSVYIEGVLKAKVQHQKLHCGEKPL

SEQ ID NO: 21663 - protein, 81 aa, Neomonachus schauinslandi
MDFSREEWQQLDPAQRCLYWDVMLEIYSHLLSVGYHIPNPEIISRMEKGEKSWVRGAQLPHQRHREGVFGLKTSQQKIFEK

SEQ ID NO: 21664 - protein, 81 aa, Neomonachus schauinslandi
GSVSFTDVTVDFTQEEWEQLDPSQRILYMDVMLENYSNLLSVEVWKADDQTERDHSNPDEQARPFIIFKNQTPIEERGNLF

SEQ ID NO: 21665 - protein, 81 aa, Neomonachus schauinslandi
QMGYVTFEDVAVSFSWEEWGLLDEAQRRLYLNVMLENLALVASLGCWHGAEDGKAPSEQAASIGVSQHQKVHTGERPYNCN

SEQ ID NO: 21666 - protein, 81 aa, Monodelphis domestica
APAPVSFRDVAVDFTRQEWQLLAPAQRALYREVMLENYRNVASLGHPVSKPNVIFQLEQSEAPWMPEGEAARSLPPDWEAR

SEQ ID NO: 21667 - protein, 81 aa, Monodelphis domestica
SITFKDVVVDFTQEEWCLLDPSQKELYREVMLENVQNLFFVEAETNFEVKEMSTKMRLFVEGSNSPRGMKRNPCDFLFREI

SEQ ID NO: 21668 - protein, 81 aa, Monodelphis domestica
IQGSLTFKDVAVDFTQDEWCLLDNSQKELYLEVMLENVQNLLSVGLPVPRKYCTSCFQQGNAPWLLEQKGPRTSCPEAEAN

SEQ ID NO: 21669 - protein, 81 aa, unidentified
  REGION 1..81: note = Bos indicus x Bos taurus
MLENYANVASLVSPFPRPDLISQLERGEAPWDPDPWEAEDLRGICPGGERGIKTEEPAVAQQASEGTEAHSRPVGGLLTNV

SEQ ID NO: 21670 - protein, 81 aa, unidentified
  REGION 1..81: note = Bos indicus x Bos taurus
MLENISHLVSVGNQLYKSDVISHLEQGEQLSREGLGFLQGQSPVISDREDDPKKQEMLSMQHICKKDAPLISAMQWSHTQE

SEQ ID NO: 21671 - protein, 81 aa, unidentified
  REGION 1..81: note = Bos indicus x Bos taurus
SLDAVTFTDVAVNFSQDEWEWLTLAQRTLYKKVMLENYSSLASLGLCISKPDVISLLEQDKEPWMMKGELTRALCPDLEYV

SEQ ID NO: 21672 - protein, 81 aa, unidentified
  REGION 1..81: note = Bos indicus x Bos taurus
MLENYSHLVSVGYLVAQPHGIFRLGQGEEEARIAAGESVIWSCPEFWKVNDQTDNHKESQDKLLWQAASINKETLKDKSGQ

SEQ ID NO: 21673 - protein, 81 aa, unidentified
  REGION 1..81: note = Bos indicus x Bos taurus
SLGPVTFEDVAVYFSQEEWRLIDEVQRLLYHDVMLENFALVASLGCWHAAEDEQTPSEQNVSVEVPQRNTKKTDLSSQKVC

SEQ ID NO: 21674 - protein, 81 aa, Pan troglodytes
ALRSVMFSDVSIDFSPEEWEYLDLEQKDLYRDVMLENYSNLVSLAGCFISKPDVISSLEQGKEPWKVVRKGRRQYPDLETK

SEQ ID NO: 21675 - protein, 81 aa, Myotis davidii
MNFEDVAVAFSQEESGLLDEVQRHLYCDVMLEVFALVASVGCCHKMDNEEAYSDQSVSVQGESRVRASKTAPATQKSHSST

SEQ ID NO: 21676 - protein, 81 aa, Myotis davidii
VVFEDVALDFSQEEWALLDAAQRELYRDVMLETFRNLASVEDETQFRSNGSVSQQDLYVNKMSEEDKIAEFTRQSWASILG

SEQ ID NO: 21677 - protein, 81 aa, Myotis davidii
MDFEDVAIVFSQEEWGLLDEAQRHLYCDVMLEVFALVSSVGCWHQTDDEEACSEQSVSEQGESQVGASETEPATQRTHVCK

SEQ ID NO: 21678 - protein, 81 aa, Cercocebus atys
GCASVAFRDVAVDFTQEEWRLLSPAQRTLHRDVMLETYNHLVSLEIPSSKPKLIAQLERGEEPWREERKYSLDLCPESKPE

SEQ ID NO: 21679 - protein, 81 aa, Cercocebus atys
QGRLTFRDVAIEFSQEEWKCLDPAQRALYRDVMLENYRNLVSLDISSKCTMKEFSSTAQGNTEVIHRETMQRHERHHIGDF

SEQ ID NO: 21680 - protein, 81 aa, Neomonachus schauinslandi
LPDLVTFEDVAVEFTQEEWALLDPSQRTLYRDVMRENCRNLASLGYHIGKPSLISHLEQEDKVMTEERGILPGTCPDLETV

SEQ ID NO: 21681 - protein, 81 aa, Neomonachus schauinslandi
LQGSVTFPDVAVDFTPEEWQLLDCEQRTLYWDVMLENFRNLISVGGPVTQTKAIFKAEQGQEPWMGEGENPRWRHPEVICL

SEQ ID NO: 21682 - protein, 81 aa, Neomonachus schauinslandi
MAVTFEDVTVIFTWEEWKFLDSSQKKLYREVMWENYTNVMSVGNWKESYKLQEERFRYLEHENLPCWQAWKNASAQIYENR

SEQ ID NO: 21683 - protein, 81 aa, Neomonachus schauinslandi
HGSTPFSNVTVAFTQDGWRHLIPAPRGTPRFKEGIPENARNLVLLGLPVSQPGMNSQLEQREEGPWMLEGGGLRSTCPDWK

SEQ ID NO: 21684 - protein, 81 aa, Monodelphis domestica
SQEVVTFKDVAVDFTWEEWCLLAPPQKEMYKEVMLENAWNLLFVGLAVSREDVISYFEQREAAWMLEEIDLRNSCQEKEMK

SEQ ID NO: 21685 - protein, 81 aa, Monodelphis domestica
FQASMMFEDIAVYLTQEEWGLLEPAQRNLYRNVMMENYRNIVSLGFLVPKPDVISRLEQGEEPWVLDMQELEGTKTLRANP

SEQ ID NO: 21686 - protein, 81 aa, Physeter macrocephalus
FRGPVTFKDVTVEFTQEEWQLLDAAQRTLYREVMQENYRHLISVGYCVNKPNAVFKLKQGKQPWILEVEFPRRNYPEDLWN

SEQ ID NO: 21687 - protein, 81 aa, Monodelphis domestica
AQDLVTFQDVTVDFTQEEWSLLDQSQKELYMEVMLENAQNSLFLGLLVPRHSLISCFQQGESQWIRESKGPRNSCPEIKFN

SEQ ID NO: 21688 - protein, 81 aa, Pan troglodytes
MGLLIFRDVAIEFSPEEWSYLDPAQQNLYRDVMLENYRNLVSLGIAVSKPDLITCLEQRNEPWNVKKHETVARHPAVSSHF

SEQ ID NO: 21689 - protein, 81 aa, Pan troglodytes
QDTVAYEDLSEDYTQKKWKGLTLSQRALHWNMMLENDRSMASLGRNMMESSELTPKQEIFKGSESSNSTSGGLFGVVPGGT

SEQ ID NO: 21690 - protein, 81 aa, Camelus dromedarius
LDVGALAQANPCGCLKDPVDFEDVAVNFTAEEWALLDPAQRRLYRDVMLETFRNLASVGEAGVTPPPSLQGTDTLTVVLSY

SEQ ID NO: 21691 - protein, 81 aa, Myotis davidii
MSFEDVTIAFSQEEWGLLDAAERLLYCEVMLEICTLVASVGYWHKPAEEEAPCEQTVSVEAESQVGASEPAPAAEKTHSCE

SEQ ID NO: 21692 - protein, 81 aa, Cercocebus atys
MLENYGNVASLGFPLLKPAVISQLEGGDELGGPSPLAAGTGLWGLRTGKEVDIQTDNDLTKEMYEGKEKVSFELQRDFSQE

SEQ ID NO: 21693 - protein, 81 aa, Cercocebus atys
TQGCVTFEDIAIYFSQEEWGLLDEAQRRLYLEVMLENFALVASLGCSHGTEDEETPSEQNVSVRVSQSKAGSSTQKTQSCE

SEQ ID NO: 21694 - protein, 81 aa, Cercocebus atys
LYEAVTFKDVAVVFTEEELELLDPAQRKLYQDVMLENFRNLLSVGKIQTEMETVPEAGTHEEFSCKQIWEQIASDLTRSQD

SEQ ID NO: 21695 - protein, 81 aa, Cercocebus atys
EKGPLTFRDVAIEFSLEEWQCLDTAQQDLYRKVMLENYRNLVFLGIAVSNPDLITCLEQGKEPWNMKKHVMADEPPVIYSH

SEQ ID NO: 21696 - protein, 81 aa, Cercocebus atys
VAFEDVDVNFTQDEWALLDPSQKNLYRDVMQETFRNLASVGKKWKDQKIEDEYKNPRRNLRGLMGERLLESKKDHQHGEVL

SEQ ID NO: 21697 - protein, 81 aa, Leptonychotes weddellii
QGSVTFRDVAIDFSQEEWEWLQPAQRDLYRHVMLENYGHLVSLGKLLSLFVLSLIEKARSGFTLVNTGRKKKFALFFLFSE

SEQ ID NO: 21698 - protein, 81 aa, Leptonychotes weddellii
LLTFRDVAIEFSQEEWECLDPAQRALYKDVMLENYRNLVSLDISVRSMIKELSPKEDINKEELFQTLMLERHKRNDIKDLG

SEQ ID NO: 21699 - protein, 81 aa, Leptonychotes weddellii
LLTFEDVAVSFSEEEWKLLDPTQKILYNDVMQENYETVISLGLKLKNDTGNDQPISLSALEIQASGCKVLRKARMKVAQKT

SEQ ID NO: 21700 - protein, 81 aa, Felis catus
MLENYHNFVSLGFLINKPEVIFRLEEGEEPWIVKEEFLYQNHPEDNKAHYLTERIQENQDKYLPQVAFKNKTLASEKVHAL

SEQ ID NO: 21701 - protein, 81 aa, Felis catus
GSVSFTDVTVDFTQEEWEQLDPSQRILYMDVMLENYSNLLSVEVWKADDQMEQDPSNPDEQARPFIIFKNQTPIEERGNLF

SEQ ID NO: 21702 - protein, 81 aa, Neomonachus schauinslandi
SHVVFEDVAIYFSQEEWGLLDEAQRFLYHAVMLENFALLSSLGCWHGAQDEEAPSEQDVSVGESQVRTPKPGPSIRKSQLW

SEQ ID NO: 21703 - protein, 81 aa, Monodelphis domestica
QRELVTFKDVTVDFTQEEWGNLDTSQKELYRDVMLENYKNLVFLGLTVWKPDVISHLEEGETPWIQDPEVPWSTCPDWDTG

SEQ ID NO: 21704 - protein, 81 aa, Monodelphis domestica
QESVMFEDMAMYLTPEEWGQADPTQRTLYRDMMLESYRNDISLDDESETENMESLSNLEASDNAESGEKLSSEFPVALPQG

SEQ ID NO: 21705 - protein, 81 aa, Monodelphis domestica
SRKSMSFKDVSVDFTQGEWGQLDPSQRDLYRDVMLENYRNLVSLELQVIKPEVISRLERGEAPCMLEREGLIGSCPDNDTR

SEQ ID NO: 21706 - protein, 81 aa, Physeter macrocephalus
DPAQVPMVAAFMVPGQGHVIFEDVAVSFSQEEWGLLNDAQRLLYCDVMLENLSLIASLDAGKASLLREQIHIWAFASIPHL

SEQ ID NO: 21707 - protein, 81 aa, Monodelphis domestica
SQGSITLRDVVMDFTQEEWCLLDHAQKELYREVMLENVWNLQSVGLTVPRENFVTCFQQWESPWLLGQKEQRSSCLEAETN

SEQ ID NO: 21708 - protein, 81 aa, Monodelphis domestica
SRAPVTFKDVAVDFTQDEWGQLDPSQRSLYRDVMLENYENLVSLGLPVSKPDVISQLERGRGPWRLAGDFPRALRADSFIQ

SEQ ID NO: 21709 - protein, 81 aa, Monodelphis domestica
MLENVQNLLAVGLPVPRENFISCFQQGEAPWLLKQECARSSCPEADTNFEVKEMSKKPNHFVEGCDPQRFMTEFPWDFILK

SEQ ID NO: 21710 - protein, 81 aa, Monodelphis domestica
ASQGSITFQDVTVAFTQEEWRLLQPSQKELYREVMLEISQSLLSVGLPVAREDLIYFQEGKAPWILEQKGPRNSYSDAVTR

SEQ ID NO: 21711 - protein, 81 aa, Physeter macrocephalus
QGSVTFEDVAVYFSWEEWCLLDEVQIHLYLDVMLENFALVCMLGSWHRVEDEETPSEQSVSPEGVSQIRTPSAGSSPEKAQ

SEQ ID NO: 21712 - protein, 81 aa, Monodelphis domestica
AQEAVTFQDVAVEFTWEEWCLLSPPQKELYKEVMLENTRNLHSVGLPAPPEDMISYMEQREFSWMLEQDGLSSCCPEGKIR

SEQ ID NO: 21713 - protein, 81 aa, Physeter macrocephalus
PGVPSLSLLPARAVGPQGRGEDVVRTESGAEMDSVVFEDVAVNFTAEEWALLDPAQRKLYRDVMLETFRNLASVDTETTTR

SEQ ID NO: 21714 - protein, 81 aa, Monodelphis domestica
ALQESLTFRDVAVLFTWDEWRRLGPAQRSLYREVMLETFEHLVALGEAQHPPRGDLGREGESAWGGGSQEPGKVSAHPGGV

SEQ ID NO: 21715 - protein, 81 aa, Monodelphis domestica
KCLPFLKRNVAVSLTLEERVQLDLHQKDLYRNVMLENYENSVLLGLSFPKPAIISHMEQRKDLWLLDIPGAEKRESWENSS

SEQ ID NO: 21716 - protein, 81 aa, Monodelphis domestica
SQGSITFKDVAVNFTQEEWCLLDHSQKELYREVMLENVQNLLSMELPVHREDFISCFQQKESLWLLEHKGPKSSCPEAEAN

SEQ ID NO: 21717 - protein, 81 aa, Monodelphis domestica
QGSITFKDVAVDFTQEEWRLLDHSQKELYREVMLENVQNLLSVEAETYFEMKEMSTKLSLFVEGSGPPRGMNRSTCNFILR

SEQ ID NO: 21718 - protein, 81 aa, Pan troglodytes
KKKPVTFEDVAVNFTQEEWDCLDASQRVLYQDVMSETFKNLISVARIFLHKPELITKLEQEEEQWREFVHLPNTEGLSEGK

SEQ ID NO: 21719 - protein, 81 aa, Camelus dromedarius
WLTFKDVAIEFSPEEWECLDPAQRTLYRDVMLETYRNLISVDTAPKCVIKEPPPKESHNTGETLHTASLESQEHRATQEDG

SEQ ID NO: 21720 - protein, 81 aa, Camelus dromedarius
CEESVTFKDVAVDFTQEEWGQLDSPQRALYRDVMLENYQNLLALGPPVCKPDVISHLERGEEPWRVPREVPGGVRPERGPR

SEQ ID NO: 21721 - protein, 81 aa, Myotis davidii
GLLTFEDVAVFFTQEEWDYLDPAQRSLYKDVMMENYGNLVSLDVLNRDKDEEPTVKQEIEEIEEEMESKGIIVTRIKSETD

SEQ ID NO: 21722 - protein, 81 aa, Myotis davidii
MDFTLEGWEQLGLDQGDLFWDTALDNYQNLFLLNPLRPNQAAAAAAAAAAAAREILERGSPEVTGPDTAEAKISPLPQEFS

SEQ ID NO: 21723 - protein, 81 aa, Cercocebus atys
MGPLTFTDVAIEFSLEEWQCLDTAQQNLYRNVMLENYRNLVFLVICSHFAEDFWPEQDIKDSFKKVTLRRYDKCGPENLQL

SEQ ID NO: 21724 - protein, 81 aa, Cercocebus atys
KRNVPLQEIMTFNRTWFGVQQLDSAQRTSTRMFMPENYSHLGVCGYLVAKPDFDDSLHFLLEVWQIDEQTDHYKESQDKLL

SEQ ID NO: 21725 - protein, 81 aa, Felis catus
MSERYHFLPFSGYQVPRPALISLLEAGNLPWGLEAQDNLSAERTKDICEDTETNINSESTSTQGISEERDVMLSHGLQKSV

SEQ ID NO: 21726 - protein, 81 aa, Felis catus
LQGCVISEDVFVYFSWEEWMLLDDSQRLLYQDVMLENFALLASLGIAPSTSRLVTQPKQREDPWVPDQVDVTPATEREAPK

SEQ ID NO: 21727 - protein, 81 aa, Neomonachus schauinslandi
AQGFVTFRDVAIEFSQEEWKCLEPAQRDLYRDVTLENFSNLVSLGLSISKPDVISLLEQGREPWMITNDMTGPWYPELESR

SEQ ID NO: 21728 - protein, 81 aa, Neomonachus schauinslandi
VFEELPVVFEDVAVYFTREEWGMLVKRQKELYRDVMRMNYELLASLGKKKMVAIREADTQALAVESAVLPATSMETCSSYC

SEQ ID NO: 21729 - protein, 81 aa, Neomonachus schauinslandi
SSQALLTFRDVAIEFSQEEWGCLNHTQRELYRDVMLENYGHLLFLGLIVWKPDLVIFLEQEKQLWDVKRKETVAIHPGRWE

SEQ ID NO: 21730 - protein, 81 aa, Monodelphis domestica
SLESVTFQDVAVDFTHEEWGRLEPAQKDLYRDVMLENYQNFVSLDFFILKTSFKTKESVANKSISMGNLSKKKFSRNGFWN

SEQ ID NO: 21731 - protein, 81 aa, Monodelphis domestica
GARVLVSFADVAVYFSPEEWGRLRPEQRALYRDVMRETYGHLGALGFPGPKPALISWMEEAAWDSEAKPVIKRLEDVGQPP

SEQ ID NO: 21732 - protein, 81 aa, Monodelphis domestica
LQTSLMFKDVAVYLTREEWDCLGPAQRSLYRDVMLENYRNLVSLDCETKTKKTELSSIQKISEKMELQGIMLGRFKGPEFG

SEQ ID NO: 21733 - protein, 81 aa, Monodelphis domestica
SQGSITFKDVAVDFTQEEWHLLEPSQKEQYREVMLENAWNLHSVGLPVPREDILSSFQQGESPWLLEEKSPRNSCPGAHRG

SEQ ID NO: 21734 - protein, 81 aa, Physeter macrocephalus
MLENFRNLISMGCPVTKTKVIFKVEQGQEPWMMEGENARWHSPEVICLLDDELEGQEGEGSKDNFLNQGMFTFKKTLTNET

SEQ ID NO: 21735 - protein, 81 aa, Physeter macrocephalus
SVTFRDVTVDFTQEEWQQLEPAQKDLYRDVMLENLQNLVSLDLEMRPEMKEPDLKEEISEDRPSGAWGTAVDGARTQGDRV

SEQ ID NO: 21736 - protein, 81 aa, Physeter macrocephalus
VTFRDVAVFFSRDEWLHLDSAQRTLYQEVMLENYSTLFSLGWESLFETTVSEEENQEVMNQLIGDGPFDFKLGEIYINEEK

SEQ ID NO: 21737 - protein, 81 aa, Physeter macrocephalus
AQVLVTFKDVAVTFTREEWGQLDLDQRTLYQEVMLEICGLLVSLGHPVPKPELIRLLEHGQELWMGMRGLPRSTCPGDRAK

SEQ ID NO: 21738 - protein, 81 aa, Monodelphis domestica
MQGSLSFKDVAVDFTQEEWCLLDHSQKEFYLEVMLENVQNLLSVGLPVPREYFTSCFQQGKAPLLLEQKGPRSCCPEAETN

SEQ ID NO: 21739 - protein, 81 aa, Monodelphis domestica
PQESVTFRDVAVSFSQEEWRELDAAQRDLYWDVMLENYENLVFLAGLPVPKPGALAHLERGGAPWMPDAQFPGGLFPDSLS

SEQ ID NO: 21740 - protein, 81 aa, Monodelphis domestica
PCQESVTFKDVAVDFTQEEWCLLDPSQKALYKDVMLETSQNLLSLGLPGAKADLISQLNQEEAWMLKEEDPRNSSLCGETR

SEQ ID NO: 21741 - protein, 81 aa, Monodelphis domestica
AKEAMTFKDVAVDFTREEWRLLSPPQKELYKEVMLENAQNLLSVGLPAPPEDVMSYLEQRKTPWMLEQESLRSCCPEREIR

SEQ ID NO: 21742 - protein, 81 aa, Physeter macrocephalus
DPEQVTFEDVVVEFTWEEWGQLEPAQRTLYRDVMLETFGLLASVGHWLPKPDVISLLEHEAELWVVDKGAPRGVCTDFETR

SEQ ID NO: 21743 - protein, 81 aa, Monodelphis domestica
MLENAWNLLSVGIMDQLRNRIGTNEDLLSRPVEEAETPQMKSSQGLTVAREDVISYFEQREVPWMLEQEDLRNCGPEGGIR

SEQ ID NO: 21744 - protein, 81 aa, Monodelphis domestica
RQERVTFGDVAVDFTLDEWVCLDSAQKALYRDVMLENYGHLVCLGLAGAKPAVIQRLERGEAAWCPGVPGSRLPDWETRLE

SEQ ID NO: 21745 - protein, 81 aa, Physeter macrocephalus
MLEIYGNLTSLGYPVPKPALVSLLERGELPWGLETRDDPPAQGTKDICKNARTNVDDELTPTWGVSEERDMMMSHGPQKNV

SEQ ID NO: 21746 - protein, 81 aa, Monodelphis domestica
GQEVVTFKDVAVDFTQEEWHLLSPDEKELYKEVMLENAQNLLSVGIPAAPEDMISYLEQRKALWMLEQEGLRSCCPEGENR

SEQ ID NO: 21747 - protein, 81 aa, Camelus dromedarius
SQAPVTFEDMAMYLTREEWRPLDPTQRDLYRDVMQENYGNVVSLDFEIRSDNEVNPKQEISEDVEFGTASERPVGNTEENP

SEQ ID NO: 21748 - protein, 81 aa, Camelus dromedarius
PKVPVTFDDVAVHFSEQEWGNLSEWQKELYKNVMRGNYESLVSMDYAISKPDLMSQMERGERPVMQEQEDSEEGETPADPS

SEQ ID NO: 21749 - protein, 81 aa, Camelus dromedarius
PLETVTFGDVVLDFTQEEWALLDTSQKKLFRDVMLENIHHLVSVGYQISKSDVILQLEQGKELWREGEGRPQGRGPGSESP

SEQ ID NO: 21750 - protein, 81 aa, Camelus dromedarius
VQESVTFRDVAVLFTQEEWAELSPAQRALHRDVMLETCSNLVSLGLLGPKPDTLSQLGRGEEWTLEDSLGGFCLELNSLWF

SEQ ID NO: 21751 - protein, 81 aa, Cercocebus atys
SVAFEDVAVTFTQEEWALLDPSQKTLYRDVMQETFRNLASVGKKWKAQNIYVEYENLKRNLRTFVGERLFESKEGHQHGEI

SEQ ID NO: 21752 - protein, 81 aa, Cercocebus atys
SLGSVTFTDVAIDFSQDEWEWLNLAQRSLYKKVMLENYRNLVSVGLCLSKPDVISLLEQEKDPWVVKGEMTRSLCPNLECV

SEQ ID NO: 21753 - protein, 81 aa, Cercocebus atys
YQDLLIFEDTAVDFTQEEWTLLDPVQRNLYRDVMLENYENVAKVGFQLLKPSVISWLEEEELRTLQQGVLQDWAMKHQTSV

SEQ ID NO: 21754 - protein, 81 aa, Cercocebus atys
QEPLSFKDVAVVFTEEELGLLDSTQRQLYRDVMLENFRNLLSVGERNPLGDKNGRDMEYIQDEELRLFSHEELSSCKIWEE

SEQ ID NO: 21755 - protein, 81 aa, Felis catus
NIRRLTFRDVAIEFSQEEWECLDPAQRALYKDVMLENYRNLVSVGEDNLPPEVGNYFLSVCCAFSIESPCFDHKSSNSLFL

SEQ ID NO: 21756 - protein, 81 aa, Leptonychotes weddellii
PQGSAAYQFLSVDYTERKWKGPALSQRAVYRSIVPENYCSMASLGETRMRRSELPAKQEVSKGSASSDGTSGGLCGVVSGE

SEQ ID NO: 21757 - protein, 81 aa, Neomonachus schauinslandi
LLQALLTFRDVAIEFSQEEWGCLNLVQRELYRDVMLENYGHLLFLGLILSKPDLIMFLEQEKQLWDVKRTETVAFHPGRWE

SEQ ID NO: 21758 - protein, 81 aa, Neomonachus schauinslandi
TQDSVVFEDVAVDFTQEEWALLDFAQRSLYRDVMLENFQNLASLGYPLHTPYLISRWKQEEDLETVERGPIQGEHQEGFEI

SEQ ID NO: 21759 - protein, 81 aa, Neomonachus schauinslandi
ALYRDVMVENYRNLVSLAISSKYVIKELPPKETSNTGEVLQTVILERHKSRDTDDYAFRAIQKNIPDFECQWGDGERNYKA

SEQ ID NO: 21760 - protein, 81 aa, Monodelphis domestica
LQESLTFRDVAVDFTQEEWRRLAPAQRALFRDVMLDNYENLVSLGLPASRLDVVSLLKRGQAPWRSEGGGWHDSLSWHSVF

SEQ ID NO: 21761 - protein, 81 aa, Monodelphis domestica
SQKRLTFKDVAVDFTQEEWKQLNVAQRELYRDVMLENYKNLVLLGLLVFQPDVIHQLENGEVPWIPEGELTRSPHSDSLVQ

SEQ ID NO: 21762 - protein, 81 aa, Monodelphis domestica
VKVSVTFDDVAVYFSKNEWKKLEWSQKELYKYVMRTNYETLVSLDYTIPKPDLICQIEQGKEPVFKNLANLETSVRIIQSG

SEQ ID NO: 21763 - protein, 81 aa, Physeter macrocephalus
AQGSVTFEDVAVYFSCEEWCLLDEVQIHLYLDVMLENFALVCMLGSWRGVDEETSSEENICVEGVSQIRTPRAGSSPEKAQ

SEQ ID NO: 21764 - protein, 81 aa, Enhydra lutris
SQSLLTFEEVAMYFSQEEWELLDPTQKALYNDVMRENYETVISLALFVLPKPKVISYLEHGEEPWVQGSLEFKNSPGELPS

SEQ ID NO: 21765 - protein, 81 aa, Enhydra lutris
ALALVSFQDVAMTFTGEEWRHLDLAQGTLYREVMLETCGLLVSLRRPVPKAELISLVEQGQELWAVKRGLSKSAYTGEKAK

SEQ ID NO: 21766 - protein, 81 aa, Enhydra lutris
SCESLSFADVTVGFTQEEWQHLDPAQRTLYREVMLENYSHLVSVGCCIPKPEVILKLEQGEQPWMLEEESPGQSYPEVCKV

SEQ ID NO: 21767 - protein, 81 aa, Enhydra lutris
KSQGLLSFSDVAVDFTWEEWQLLDTVQRNLYRDVMLENYSNLMSLGYQVTRPEAMVHLEKEQGVLEREFPSPSGPERPRQC

SEQ ID NO: 21768 - protein, 81 aa, Enhydra lutris
RSQGLLTFRDVAIEFSQEEWGRLTHTQRELYRDVMLENYGHLLFLGLVVWKPDLVIFLEQEKQLWDVKRKESVAFHPGMWE

SEQ ID NO: 21769 - protein, 81 aa, Enhydra lutris
AHGLVMFKDVAVDVSQEEWECLNPTQRNLYKDVMLENYSNLVSLGLSISKPAVISSLEQGKEPWMVVREVTGRWCPELVSR

SEQ ID NO: 21770 - protein, 80 aa, Pongo abelii
RDVAIEFSQEEWKCLDPAQRTLYRDVMLENYRNLVSLGICLPDLSVTSMLEQNKDPWTLQSEEKIANNPDGRECIKGVNT

SEQ ID NO: 21771 - protein, 81 aa, Pongo abelii
IQSQISFEDVAVDFTLEEWQLLNPTQKNLYRDVMLENYSNLVFLEVWLDNPKMWLRDNQDNLKNMERGHKYDVFGKIFNSS

SEQ ID NO: 21772 - protein, 81 aa, Pongo abelii
YSGPLKFRDVAIEFSQEEWKCLDPAQRTLYRDVMLENYRNLVSLGICLPDLSVNSMLEQNKDPWTLQSEEKIANNPDGREC

SEQ ID NO: 21773 - protein, 81 aa, Pongo abelii
TLFSCLSLLSSWDCSSGFSGFCASPIEESHGALISSCNSRTMTDGLVTFRDVAIDFSQEEWECLDPAQRDFFLHWKLQGCL

SEQ ID NO: 21774 - protein, 81 aa, Pongo abelii
VQESVTFRDVAVFFSQDEWLHLDSAQRALYREVMLENYSILVSLGILFSKPKVISQLEQGEDAWMVESGVPQGAHLGWESL

SEQ ID NO: 21775 - protein, 81 aa, Pongo abelii
SLGLVSFEDVAVHFTWEEWQDLDDVQRTLYWDVMLETYSSLVSLGHCITKPEMIFKLEQGAEPWIVEEAPNLRLSAVQILD

SEQ ID NO: 21776 - protein, 81 aa, Pongo abelii
EMGLLTFRDIAIEFSLEEWQCLDCAQQNLYRDVMLENYRNLVSLGIAVSKPDLITCLEQHKEFQNIKRNEMVVKHPVTCSH

SEQ ID NO: 21777 - protein, 80 aa, Pongo abelii
MELLTFRDVAIEFSPEEWKCLDPAQQNLYRDVMLENYRNLVSLGFVISNPDLVTCLEQIKEPCDLKIHETAAKPPVVQHF

SEQ ID NO: 21778 - protein, 81 aa, Pongo abelii
QQGYVTFEDVAVYFSQEEWRLLDEAQRLLYCNVMLENFSLLASLGLASSKTHEITQLESWEKPFMPTWEVVTSATWRGCWH

SEQ ID NO: 21779 - protein, 81 aa, Pongo abelii
RKRKAKESGMALPQGLLTFRDVSIEFSQEEWKCLDPAQRTLYRDVMLENYRNLVSLDISSKCMMQMFSSTGQGNTEVIHTG

SEQ ID NO: 21780 - protein, 81 aa, Pongo abelii
YQASVSFQDVTVEFTQEEWQHLGPVERTLYRDVMLENYSHLISVGYCITKPKVISKLEKGEEPWSLEDEFLNQRYPGYFKV

SEQ ID NO: 21781 - protein, 81 aa, Pan troglodytes
EEAQKRKAKESGMALPQGHLTFMDVAIEFSQEEWKSLDPGQRALYRDVMLENYRNLVFLGICLPDLSIISMLKQRREPLIL

SEQ ID NO: 21782 - protein, 81 aa, Pan troglodytes
AVLTDRAQVSVTFDDVAVTFTKEEWGQLDLAQRTLYQEVMLENCGLLVSLAPSQTHPGSVRCILQSNQVDTLIKIPEHTEH

SEQ ID NO: 21783 - protein, 81 aa, Pan troglodytes
LEWLFISQEQPKITKSWEWQLLDPAQKCLYRSVMLENYSNLVSLGYQHTKPDIIFKLEQGEELCMVQAQVPNQTCPILKAG

SEQ ID NO: 21784 - protein, 81 aa, Pan troglodytes
QDTVAYEDLSVDYTQKKWKGLTLSQRALQWNMMPENHHSMASLGENMMKGSELTPKQEIFKGSESSNRTSGGLFGVVPGAA

SEQ ID NO: 21785 - protein, 81 aa, Pan troglodytes
DSMTFEDIIVDFTQEEWALLDTSQRKLFQDVMLENISHLVSIGREVGIKHQEIPFIQHIYQKGTSTISTMRSHTQEDPFLC

SEQ ID NO: 21786 - protein, 81 aa, Camelus dromedarius
MWLTFEDVAIEFSQEEWECLDPAQRALYRDVMLETCRNLLSLDMSEVHVIKKLQLKASTDRGELFQTAMLAGHERNKIKHF

SEQ ID NO: 21787 - protein, 81 aa, Camelus dromedarius
FQESVTFEDVAIYFSENEWTGLAPAQRALYRDVMLENYGAVASLAAFPFPKPALIFQLEQGEAPWSSAPQGALDGEGPRGI

SEQ ID NO: 21788 - protein, 81 aa, Camelus dromedarius
DVSVDFTQKDWQLLDPAQRLLYRDVMLDNCQHLVSLRHCVTKPELILKLEQGEEPWTLEGKLPSSSHPSELMRSHVRKNTD

SEQ ID NO: 21789 - protein, 81 aa, Myotis davidii
QIPNHNEKKETPTEVPVAFEDVAVNFSLEEWALLEPSQKKLYRDVMRETFRNLASIVTFEDVAVNFTLEEWALMDTSQKKL

SEQ ID NO: 21790 - protein, 81 aa, Myotis davidii
MDRVTFDDVAVYFSREEWGLLDDLDEAQRRQYHEVMLEDLALASSLGPCCGAEDADAPCEQSASVGGSPSSPSKAAVSSLK

SEQ ID NO: 21791 - protein, 81 aa, Leptonychotes weddellii
MRENCRNLASLGYHIGKPSLISHLEQEDKVMTEERGILPGTCPDLETVLKAKWLTPKKHDFRKEHSNGIKAERNHLGVKLN

SEQ ID NO: 21792 - protein, 81 aa, Neomonachus schauinslandi
TQGTVIFEDIAVSFSWEEWDLLDEAQRRLYQDVMLENWALITSLGCWHGAEDEEAPSEQNVSVVSHVRTPKTGLFPQKANP

SEQ ID NO: 21793 - protein, 81 aa, Neomonachus schauinslandi
AYGSLSFGDVAISFSQGEWECLDPAQRALYRDVMLETYSNLVSLDLESNYGAEKLSPENDIHEINLPKQSIKQISKTLDLK

SEQ ID NO: 21794 - protein, 81 aa, Ovis aries
RPRAVKFGDVALYFSREEWGCLRPAQRALYRDVMQETYGHLGALGFPGPKPALISWMEQESEAWSPAAQDPEEGESLGGAL

SEQ ID NO: 21795 - protein, 81 aa, Otolemur garnettii
QGLLSFRDVAIEFSPEEWEYLDTAQRNLYGDVMSEISRHLDFVVFLFLKSFLIVFFRYGSFSWRRKGKRMISKLPIILCLH

SEQ ID NO: 21796 - protein, 81 aa, Otolemur garnettii
EEVLMAFRDVAVAFTLKEWKLLSPAQRSLYREVMLENYSHLVSLGIAFSKPKLIIQLEQGDEPWREDFPVLWLCEGIHIGE

SEQ ID NO: 21797 - protein, 81 aa, Otolemur garnettii
QGLLTFKDVSIEFSMDEWACLDPAQQHLYREVMLETYRHLVFLGLAVSKPDLIIFLEQSKEPWKVKTQQTLLKPPALSNHS

SEQ ID NO: 21798 - protein, 81 aa, Vulpes vulpes
MLENYSHLLSVGYEVPKPEIIFKLEQGEEPWILERKTPHQSCSDGRFGIKTPQKRISGKASFHNEMEGEDTRDDSLYSILE

SEQ ID NO: 21799 - protein, 81 aa, Pongo abelii
YVNRVSPFKDMILCFSEEDWSLLDPAQTGFYGEFIIGEDYGVSMPPNDLAAQPDLSQGEENEPRVPELQDLQGKEVPQVSY

SEQ ID NO: 21800 - protein, 81 aa, Pongo abelii
AQEPVMFRDVAVFFSQDEWLHLDSAQRALYREVMLENYSSLVSLGIPFSMPKLIHQLQQGEDPCMMEREVPADTCLGFKTW

SEQ ID NO: 21801 - protein, 81 aa, Pongo abelii
AATLRLSAQGTVTFEDVAVNFTWEEWNLLSEAQRCLYRDVTLENLALISSLDPALDGSADNTQTGNLGQSVLPAHPEQKTA

SEQ ID NO: 21802 - protein, 81 aa, Pongo abelii
QLTFRDVAIEFSQDEWKCLNSTQRTLYRDVMLENYRNLVSLDLSRNCVIKELAPQQESNTGEVFQTVTLEQHEKHDIEEFC

SEQ ID NO: 21803 - protein, 81 aa, Pongo abelii
AQGSVSFNDVTVDFTQEEWQHLDHAQKTLYMDVMLENYCHLISVGCHMTKPDVILKLERGEEPWTSFAGHICLEENWKAED

SEQ ID NO: 21804 - protein, 81 aa, Pongo abelii
SQTLVTFKDVFVDFTREEWKLLDTAQQIVYRNVMLENYKNLVSLGYQLTKPDVIIRLEKGEEPWLVERGIHQETHPDSETA

SEQ ID NO: 21805 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPGWTTMM

SEQ ID NO: 21806 - protein, 81 aa, unidentified
  REGION 1..81: note = Bos indicus x Bos taurus
GIALSQLTFKDVFIDCTPEEWECLDPAQRTLYKDVMVETLRILLWVRITSFRSGGILWGTSACSLCVSWEPLFFLLRSKPC

SEQ ID NO: 21807 - protein, 81 aa, unidentified
  REGION 1..81: note = Bos indicus x Bos taurus
VTFEDVAVSFSQEEWGLLGEAQRLLYYDVMLENLSLIASLGCWHGGDTEEARSDQCVSVERVTRDRNPQVDSSVLKAVTPT

SEQ ID NO: 21808 - protein, 81 aa, unidentified
  REGION 1..81: note = Bos indicus x Bos taurus
PQGLMTFEDVAVDFTQEEWQYLNPPQRTLYRDVMLETYSNLVSVGHHVTKPDLILKLEVEEKCLPEGKIPIWSFPEEACQV

SEQ ID NO: 21809 - protein, 81 aa, unidentified
  REGION 1..81: note = Bos indicus x Bos taurus
GVTFPDIAVRFSQREWRLLDETQRLLYLDVMLENYTLISSLGCCCGTENAEAPSERITSLQVSQARTPKAALSTQKMNPCE

SEQ ID NO: 21810 - protein, 81 aa, unidentified
  REGION 1..81: note = Bos indicus x Bos taurus
QLTFKDVAVEFSQEEWECLDPAQRAFYMDVMVETLRNLISVGEDHFASEIGICPWVSLHFFCAPWEPLFCLIDLKSLLIQT

SEQ ID NO: 21811 - protein, 81 aa, Pan troglodytes
RRGHLTFRDVAIEFSQEEWKCLDPAQRTLYREVMVENYRNLVFLGICLPDLSVISMLEQRRDPWNLQSEVKIANNPGGREC

SEQ ID NO: 21812 - protein, 81 aa, Pan troglodytes
CALHWEEWQDLDDAQRKLYRDVMLETYSSLVSLGHCITKPEMIFKLEQGAEPWIVEEAPNLRLSAVQIIDDLIERSHESHD

SEQ ID NO: 21813 - protein, 81 aa, Pan troglodytes
GEGSLSFEDVAVGFTREEWQFLDQSQKVLYREVMLENYSNLVSIGYQGTKPDSLFKLEQGEPPGIVEGAAHSQICPDADFL

SEQ ID NO: 21814 - protein, 81 aa, Pan troglodytes
QGTVTFEDVAVHFSWEEWGLLDEAQRCLYHEVMLENLALLTSLDVHHQKQHLGEKHFRSNVGRALFVKTCTFHVSGEPSTC

SEQ ID NO: 21815 - protein, 81 aa, Pan troglodytes
VTFEDVAVKFTQEEWNLLSEAQRCLYRDVTLENLALMSSLGNGTEPRHTKTNCVRKGPKKPNHLCECSWPIQYQGTHHKQK

SEQ ID NO: 21816 - protein, 81 aa, Pan troglodytes
AQVPLTFSDVAIDFSQEEWEYLNSDQRDLYRDVMLENYTNLVSLEFDFTTESDKLSSEKRNYEVNAYHQETWKRNKTFNLM

SEQ ID NO: 21817 - protein, 81 aa, Pan troglodytes
DVAIDFSHEEWACLDSAQRDLYKDVMVQNYENLVSVAGLSVTKPYVIMLLEDGKEPWMMEKKLSKAYPFPLSHSVPASVNF

SEQ ID NO: 21818 - protein, 81 aa, Pan troglodytes
GKELLSFEDVAMYFTREEWGHLNWGQKDLYRDVMLENYRNMVLLGFQFPKPEMICQLENWDEQWILDLPRAGNRKASGSAC

SEQ ID NO: 21819 - protein, 81 aa, Camelus dromedarius
SQDAVTFGDVAVNFTQEEWTLLDLSQRNLYRDVMLENYKNLITTGYKSFKPALISWLEQGEFRTVERGALQEWEMNQKVKD

SEQ ID NO: 21820 - protein, 81 aa, Enhydra lutris
EGSVTFEDVVVYFSWEEWGLLDETQRCLYHDVMLENFALVISLGCWYGMEEEEEALSVQQVSMGRTSSPAPSVWRAQPCDK

SEQ ID NO: 21821 - protein, 81 aa, Enhydra lutris
PDEAVTFKDVAVVFSEEELGLLDPAQRKLYRDVMLENFRNLVSVGNQPFKPDLIFQLEREEKLLMMETETQRDGYLGAKSQ

SEQ ID NO: 21822 - protein, 81 aa, Enhydra lutris
ERLTFRDVAIEFSREEWECLDPAQSALYRDVMVENYQNLEPDSSARFMIKELLPKKEIDNRELCQPVVLGRHESHGLEDFD

SEQ ID NO: 21823 - protein, 81 aa, Enhydra lutris
FKEAVTFKDVAVVFTEEELGLLDPAQRKLYGDVMLENFRNLLSVGHQPFTPHVILQCERGEKLQMRKTATQGRGIAGDKNL

SEQ ID NO: 21824 - protein, 81 aa, Pongo abelii
SQHLVTFEDVAVDFTQEEWTLLDQTQRDLYRDVMLENYKNLIILAGSELCKPSLMSGLEQMEELRTGVTGVLQELDLQLKT

SEQ ID NO: 21825 - protein, 81 aa, Pongo abelii
VAFEDVDVNFTQDEWALLDPSQKNLYRDVMQETFRNLASVGKKWKDQKIEDEYKNPRRNLRGLMGERLLESKKDHQHGEIL

SEQ ID NO: 21826 - protein, 81 aa, Pongo abelii
SVAFEDVAVNFTPEEWALLDPSQKNLYREVMQETLRNLASIGKKWKDQNIENEYKNPRSNLRGLMEERLFESEGHQHGEIL

SEQ ID NO: 21827 - protein, 81 aa, unidentified
  REGION 1..81: note = Bos indicus x Bos taurus
RLTSEDVAIEFTQEEWEFLDPAQRALYRDVMLETYRNLLSVDISPTHVIKHLQPKGNSYKRETFQTLMLGRPESCDIKHFH

SEQ ID NO: 21828 - protein, 81 aa, unidentified
  REGION 1..81: note = Bos indicus x Bos taurus
FQGRLMFQDVTIDFTLEEWECLDLDQRELYRNVMLENYGNLASLGLVVSKPDLVTFLEQMKNPWDIRRTDTTGYFNVSLFF

SEQ ID NO: 21829 - protein, 81 aa, unidentified
  REGION 1..81: note = Bos indicus x Bos taurus
VQDSVTFADVAVNFTQEEWTLLNRFQRKLYRDVMLENYKNLTTAGYQVFKPTLISWLEEEELSTVERGVLQGDTYYPGEEN

SEQ ID NO: 21830 - protein, 81 aa, unidentified
  REGION 1..81: note = Bos indicus x Bos taurus
FQGRLTFQDVAIDFTQEEWECLDLDQQELYRDVMLENYRNLASLGLVVSKLDLVTFLEQMKNPWDVRSLESPAIYTGRCEW

SEQ ID NO: 21831 - protein, 81 aa, Pan troglodytes
MLDTFRLLVSVGHWLPKPNVISLLEQEAELWAVDSGLPQGVYPDLETRPKVKLSVLKQGISEEISNNVILVERFLWDGLWY

SEQ ID NO: 21832 - protein, 81 aa, Pan troglodytes
RLIRDQDLGASLLPAAPQWRHLDSTQKEQYWDLMLETYGKMVSGGISHPKSDLTNSIEFGEELAGLYLHVNEKIPRPTCIG

SEQ ID NO: 21833 - protein, 81 aa, Pan troglodytes
EMGPLTFRDVAIEFSLEEWQCLDTAQQDLYRKVMLENYRNLVFLGIAVSKPDLVTCLEQGKDPWNMKRHSTVVKPPGFLPP

SEQ ID NO: 21834 - protein, 81 aa, Pan troglodytes
VTLRDVVINFSQEEWEYLDSAQRNLYWDVMMENYSNLLSLDLESRNETKHLSVGKDIKNTGSQWEVMESSKLCGLEGSIFR

SEQ ID NO: 21835 - protein, 81 aa, Pan troglodytes
GTVTFEDVAVNFSQEEWSLLSEAQRCLYHDVMLENLTLISSLGCWYEAKDETPSKQTLSIQQKSPLRTHWTGVCTKKVHLW

SEQ ID NO: 21836 - protein, 81 aa, Callithrix jacchus
PQDLMTFEDVAVEFTQWEWGQLNPAQKDLYREVMLENFRNLTLLGLLVSKPYVICQLEEGGEPFMVKREISIGVHSDWERR

SEQ ID NO: 21837 - protein, 81 aa, Callithrix jacchus
ASGTLTFDDVALYFSEQEWEILEKWQKQMYKQEMKTNYETLDSLGYAFSKPDLITWMEKGRMLLISDQGRLHKTKRTAGPP

SEQ ID NO: 21838 - protein, 81 aa, Bos taurus
TGRLTFQDVAIDFTQEEWECLDPGQRKLYRDVMVENYRNLASLGEDICLPESLIYPLQLCQPLLSVSSRDSSQLQSSISAE

SEQ ID NO: 21839 - protein, 81 aa, Bos taurus
YALSFLFDVTIDFTLEEWECLDLDQRELYRNVMLENYGNLASLGGFLTTGPPGKLLCMFHFPIYSLINSQSICDVSHMIWG

SEQ ID NO: 21840 - protein, 81 aa, Bos taurus
MSYMDVAIHFSQQEWECLNPVQKNLYQDVMMENYDNLVSLGHSISKPDVITLLEQGKEPWMVVREETRRWCAGQYKQVKLW

SEQ ID NO: 21841 - protein, 81 aa, Ovis aries
MLENYRNLASLGLVVSKPDLVTFLEQMKTPWDVTRLKTPAVYTGWKPFKYTECGNTSKQNSELSQDQQIHTGKKPYECKEC

SEQ ID NO: 21842 - protein, 81 aa, Ovis aries
MTFEDVAVDFTQEEWQYLNPPQRTLYRDVMLETYSNLVSVAGYHVTKPDLILKLEVEEQCLPEGKIPIWSFPEEACQVDEQ

SEQ ID NO: 21843 - protein, 81 aa, Ovis aries
TRVPVTYEDVAVTFTQEEWGHLGPVQRMLYWEVMLETCRLLVSLGCPLPEPELISPAEPSPESQTSRRGPTPGSCSGDNTK

SEQ ID NO: 21844 - protein, 81 aa, Ovis aries
VQDCVVFEDVAVYFSQEEWGLLDEAQRHLYHAVMTENLALVTSLGCWHGAPGEEASSEQGVSIGMSEVRTAKPDPASRKAQ

SEQ ID NO: 21845 - protein, 81 aa, Ovis aries
LQEALTFKDVAVTFTEEELGLLDLAQRKLYRDVMLENFRNLLSVGHQSSKPDMISQLEREEKFWTIEIQPQRGGRSGGWNH

SEQ ID NO: 21846 - protein, 81 aa, Ovis aries
SQGLLTFEEVAIYFSQEEWELLNPTQKALYNDVMHENYETVISLAVFVLPKPKVISYLEQGKDPYIQGSPVFKDNPEELLS

SEQ ID NO: 21847 - protein, 81 aa, Ovis aries
SQERLTSEDVAIEFTQEEWEFLDPTQRALYRDVMLETYRNLLSLGILQFTRYSVQFPELYDISPTHVMKHLQPKANSDKRE

SEQ ID NO: 21848 - protein, 81 aa, Ovis aries
QAQSTFKDVFLDFTPEKWECLDPAQRTLYKDMIVETLRNLLSVAGISDSDLNYNSIFVAKKDPWIVDNEVLIAENQMSGKG

SEQ ID NO: 21849 - protein, 81 aa, Ovis aries
HQEVVTFEDVAVYFTQTEWAGLSPAQRALYRSVMLEIYGNLTSLGYPVPKPALVSLLERGDLPVGLETQDNPPAQGTRDIY

SEQ ID NO: 21850 - protein, 81 aa, Ovis aries
AHGSVTFRDVAIDFSQEEWEFLDSAQRDLYRDVMWENYSNFISLAGPSMSKPDVITLLDEGKEPWMVVREGIGRHHPDLES

SEQ ID NO: 21851 - protein, 81 aa, Ovis aries
EQGLMAFEDVAVHFSQEEWGLLDTAQRALYRRVMLENFALLASLGALSVSRPRVVTQLERGDEPWVLSGADVTLARDAQRR

SEQ ID NO: 21852 - protein, 81 aa, Otolemur garnettii
EILTFRDVAIEFTPGEWACLDPAQRSLYRDVMLENYRNLVSLELAISKLDLITFMKLVEEPWNVKREETVARHPEHKASPF

SEQ ID NO: 21853 - protein, 81 aa, Otolemur garnettii
SQESVTFQDVAVDFTEKEWPLLDSSQRKLYKDVMLENYSNLTSLGYQVGKPSLISHLEQEEELRMEEMGTQQGPGPDWETP

SEQ ID NO: 21854 - protein, 81 aa, Enhydra lutris
SQALVSFKDVAVDFTQEEWQQLDPAQRTLYRDVMLENFSHLVSMGYPVSKPDVISKLEQGEDPWIIKRDIPNWIYPDENQA

SEQ ID NO: 21855 - protein, 81 aa, Enhydra lutris
WETWLQEPVTFDDVAVNFTQEEWVCLDTSQRLLYQNVMAETFRNLLSVDLIIKLEQEEKQWRAELPLRPPSGEGLPSGSGK

SEQ ID NO: 21856 - protein, 81 aa, Enhydra lutris
GPKVSRSLENDGVCFSEQEWENLEDWQKELYRNVMKSNYETLVSLKVLGQPEEEAELGAGMLGDLEEEGPGDVHPEGVMIK

SEQ ID NO: 21857 - protein, 81 aa, Enhydra lutris
CEVSVSFEDVTVDFSKEEWQQLDPAQRRLYRDVTLENYSHLRSVGYEVPKPEVIFKLEQGEEPWILERKTPHQSHTDGKFG

SEQ ID NO: 21858 - protein, 81 aa, Enhydra lutris
WSQMPVTFEDVALYLSREEWGRLDHAQQSFYRDVLQKRNGLSLAGFPFSRPLWGSQGQGKGEASSSCQQMGDDKEKAGAIE

SEQ ID NO: 21859 - protein, 81 aa, Enhydra lutris
FQELVTFRDVAIDFSRQEWECLDPIQRDLYRDVMLENYRNLVSLAGHSVSKPDVVDLLEQGKEPWIILREETQRQYTDLDL

SEQ ID NO: 21860 - protein, 81 aa, Enhydra lutris
AQESVTFRDVAVFFSQDEWLRLDSTQRTLYREVMLENYGTLVSLGILFSKPKVIFQLQQGEDPWMVENGVSQGPCVGWERL

SEQ ID NO: 21861 - protein, 81 aa, Enhydra lutris
HQGLLTFRDVAVEFSLEEWGRLTHTQRQLYRDVMLENYGHLLFLGLIVSKPDLVSFLEQKKEPWNLKRKKTVAFHPAISSH

SEQ ID NO: 21862 - protein, 81 aa, Enhydra lutris
CQESVTFEDVAVIFTDEEWRHLVPNQRDLYKEVMLENYKIIVSLGLPVPQPDVIFQLKRGDEPWVVDLHGSEERECPENVS

SEQ ID NO: 21863 - protein, 81 aa, Pongo abelii
GKELLSFEDVAMYFTREEWGHLSWGQKDLYRDVMLENYRNMVLLGFQFPKPEVICQLENWDEQWILDLPRAGNRKASGSAC

SEQ ID NO: 21864 - protein, 81 aa, Pongo abelii
ARGCVVFEDVFVYFSQEEWELLDDAQRLLYHDVMLENFALLASLGIAFSRSRAVMQLERGEEPWVYDQVDMTSATEREAQR

SEQ ID NO: 21865 - protein, 81 aa, Pongo abelii
SLGLVSFEDVAVHFTWEEWQDLDDVQRTLYRDVMLETCSSLVSLGHCITKPEMIFKLEQGAEPWIVEEAPNLRLSDGVSLL

SEQ ID NO: 21866 - protein, 81 aa, Pongo abelii
GPLQFRDVAIEFSLEESHCLDTEQRNLYKDVMLENYRNLIFLGITVSKPDLITCLEQGKKPLTMKRNEMIAKPSVSFLQVH

SEQ ID NO: 21867 - protein, 81 aa, Pongo abelii
VTFEDVAVNFTWEEWNLLSEAQRCLYRDVTLENLALISSLGMRFLHVCQALVSLPQVIPTLASQSAGITESHSVVQVRVRW

SEQ ID NO: 21868 - protein, 81 aa, Pongo abelii
FQGSVSFKDVTVGFTQEEWQHLDPSQRALYRDVMLENYSNLVSVGYCAHKPEVIFRLEQGEEPWRLEEEFPSWSFPEVWTA

SEQ ID NO: 21869 - protein, 81 aa, unidentified
  REGION 1..81: note = Bos indicus x Bos taurus
LQPTVSFKDVAVTFTWVKWGHVDLAQRTVYREVVLETCSRLVSLVKAVATHHQTQGVAHFRHAWTAPEEKGILPGNFAGFL

SEQ ID NO: 21870 - protein, 81 aa, unidentified
  REGION 1..81: note = Bos indicus x Bos taurus
DRVVVTFKDVAVTFTSEEWGQLDLGQRTLFREVMLETCGLLVSLGHPIPKPELIHLLEHGQKLWTGTRGLPHSTSPGDRPK

SEQ ID NO: 21871 - protein, 81 aa, unidentified
  REGION 1..81: note = Bos indicus x Bos taurus
MLENYSNLVSVAPAQFSGTKSSIISHKRYRVSKSDVLFKLEQGEERWMTEDEIHSHTWPETGNIGNHLQVDWENKKMLKGI

SEQ ID NO: 21872 - protein, 81 aa, Callithrix jacchus
GTVTFEDVAVHFSWEEWGLLDEAQRCLYRDVMLENLALLTSLDVHYQKENLGEKHFRSNVDQALFVNTCIFHVSGETSTCV

SEQ ID NO: 21873 - protein, 81 aa, Macaca mulatta
VMFSDVSIDFSQEEWECLNDDQRDLYRDVMLENYSNLVSMVLESRCETKKLFLKKEIYEIESTQWEIMEKLTRHDFQCSSF

SEQ ID NO: 21874 - protein, 81 aa, Macaca mulatta
VAFEDVAVNFTREEWALLDIFQKNLYREVMLETFRNLTSIGKSWKDQNIEYEYQNPRRNFRSLIEEKVNEIKEDSHCGETF

SEQ ID NO: 21875 - protein, 81 aa, Bos taurus
MKPAQRNLYRDVMLENYSNLVTVGCQVTKPDVIFKLEHEEEPWVVEEEMLGRHCPEVWKVDEQIKKQQETLVRNVTSISKK

SEQ ID NO: 21876 - protein, 81 aa, Bos taurus
AGYQVSKPEVIFKLEQGEEPWIAEGEIQRPVCPDWKTRPEAKSSHLQQSISKVSLSTDELSHTTGEDAWDLSGQLERHKEN

SEQ ID NO: 21877 - protein, 81 aa, Ovis aries
FTFKDVAIEFSQEEWECLAPSERALYRDVMLETYRNLVSLGDDNFSPEAGILSAGFAINKLSPRENTNLGELYGNENHGIK

SEQ ID NO: 21878 - protein, 81 aa, Vulpes vulpes
MEFTWEEWQLLDSAQKYLYRDVILENYSHLVSLGYHGTKPDLIFKLEQGEEPWMINARVSRQSYPEGWKEWYQKSQDEFEN

SEQ ID NO: 21879 - protein, 81 aa, Otolemur garnettii
PLQDSVSFRDVAVDFSREEWQHLDPSQRNLYWDVMLETYSHLLSVGYHGPKEEVVMLEQGKEPWTLPDESLHQSCLGDLRI

SEQ ID NO: 21880 - protein, 81 aa, Vulpes vulpes
WKESVTFKDVIVDFTQEEWKQLDPFQRDLFRDVTLENYTHLVSIGLQVSKPDVISQLEQGTEPWIVEPGIPIGTFGDCETR

SEQ ID NO: 21881 - protein, 81 aa, Vulpes vulpes
KEAFVAFRDVAVDFTQEEWRLLSPAQRTLHREVMLETYNHLVSLEIPFSKPKLISQLEQGEEPWIEERQHPLGLCPGSKLN

SEQ ID NO: 21882 - protein, 81 aa, Otolemur garnettii
MDSVTFEDMAVNFTLDKWACWILPNKRKSVYRNVMQETFRNLATIKSYERDSLKVWRNLQRNSRTHPNKKTSPGVNPCESS

SEQ ID NO: 21883 - protein, 81 aa, Enhydra lutris
IQEPVTFKDVAVDFTQEEWGQLDPVQRTLYRDVMLETYGHLLSVGNHIAKPEVISLLEQGEEPWSVEQAYPQSTCPAVDTE

SEQ ID NO: 21884 - protein, 81 aa, Enhydra lutris
FQGSVSFKDVTVGFTQEEWQHLDSAQRSLYRDVMLENYSNLVSLGCCVTKPEVIFRLERGEEPWILEEEFPSQSFPEIWKT

SEQ ID NO: 21885 - protein, 81 aa, Enhydra lutris
RPGAVSFADVAVYFSPEEWGCLRPAQRALYRDVMRETYGHLGALGFAGSKPALISWLERKKEVWSPEAEDPEDGARHPGSG

SEQ ID NO: 21886 - protein, 81 aa, Enhydra lutris
SQESVTFEDVAVDFTQEEWTLLDRSQRKLFRDVMLENISHLVSIGRQLYKSDTISHLEPGEHLSQEGLGLLQCQSPIISDR

SEQ ID NO: 21887 - protein, 81 aa, Enhydra lutris
PKVPVTFDDVAVYFSEPEWDKLDEWQKELYKHVMRGNYETLVSLDYAISKPDILTRMERGEEPCAGGPWGQEEGSRREAAQ

SEQ ID NO: 21888 - protein, 81 aa, Enhydra lutris
LQEQVSFKDVCVDFTQEEWYLLDPAQKTLYRDVILENYSHFVSVGYCITKPEVVFKIEQGEEPWILEAGFPSHCHQEDWKV

SEQ ID NO: 21889 - protein, 81 aa, Pongo abelii
LTFRDVAIEFSQEEWKCLDPAQRTLYRDVMLENYRNLVSLEFCNSPASAFQVAGTTDISSKCMLKTLSSTGQGNTEVFCAP

SEQ ID NO: 21890 - protein, 81 aa, Pongo abelii
MGPLTFRDVAIEFSQEEWQCLDTAQQDLYRKVMLENYRNLVFLAGIAVSKPDLVTCLEQGKDPWNMKRHSMVVKPPVICSH

SEQ ID NO: 21891 - protein, 81 aa, Pongo abelii
SKAPVTFGDLAIYFSQEEWEWLSPIQKDLYEDVMLENYRNLVSLGLSFRRPNVITLLEKGKAPWMVEPVRRRRAPELTEAS

SEQ ID NO: 21892 - protein, 81 aa, Pongo abelii
AVTFKDVAVVFSREELRLLDLTQRKLYRDVMVENFKNLVAVGSKHQNKMEALQKFALKYLSNQELSCWEIWKQVASELTRC

SEQ ID NO: 21893 - protein, 81 aa, Pongo abelii
CYQDSVTFDDVAVDFTQEEWTLLDSTQRSLYSDVMLENYKNLATVGGQIIKPSLISWLEQEESKTVQGGVLQGRKTQWRGT

SEQ ID NO: 21894 - protein, 81 aa, Pongo abelii
FREAVTFKDVAVAFTEEELGLLDSAQKKLYRDVMLENFRNLVSVGHQSFKPVMISQLEMEEKLWMKELQTQRGDRNQNEMA

SEQ ID NO: 21895 - protein, 81 aa, Pongo abelii
FINVDQSARTRGRCVCGKTSSCGDRKSCVNSSFVTWYCFTKPELIFTLEQGEDPWLLEKEKGFLSRNSPEDSQPDEISEKS

SEQ ID NO: 21896 - protein, 81 aa, Pongo abelii
QGLLTFRDVAIEFSQEEWKCLDPAQRTLYRDVMLENYRNLVSLVGVSLLLPKLECNGTILAHQNFCLPGSSDSPASASKVA

SEQ ID NO: 21897 - protein, 81 aa, Callithrix jacchus
MFKEAVTFKDVAVAFTEEELGLLGPAQRKLYQEVMVENFRNLLSVGHQPFKRDVSPIERKEQLCIMKTATQRQRNLGKNTV

SEQ ID NO: 21898 - protein, 81 aa, Macaca mulatta
QGLLTFKDVAIEFSQEEWKCLDPAQRTLYRDVMLENYRNLVSLDISSKCMLKTLSSTGQGNTEVILIGTLQRQASHHTGEF

SEQ ID NO: 21899 - protein, 81 aa, Macaca mulatta
EMGLLAFRDVALEFSPEEWECLDPAQRNLYRDVMLENYRNLFSLGLAMSKPELIIYLEARKEPWNVNTEKTAKHSALSSYL

SEQ ID NO: 21900 - protein, 81 aa, Macaca mulatta
MLENYSHLISLGSSISKPDVITLLEQEKEPWIVVRKETSRWYPDLESKHGPEKISPENDIFEINLPKRVIKQISKTLGLEA

SEQ ID NO: 21901 - protein, 81 aa, Macaca mulatta
MLENYRNLVSLGLAIFKPDLMTCLEQRKEPWKVKRQEAVVKHPAGSFHFTAEILPEHDIKDSFQKVILRKYGSCDLNNLHL

SEQ ID NO: 21902 - protein, 81 aa, Bos taurus
EIATLKDIAMDFTSENWEQLGQGQGDLFWDMALDNYWNLFLLNPPGPNLTFHPDGGEKLEALVKESPESTDTAETSPLPQD

SEQ ID NO: 21903 - protein, 81 aa, Bos taurus
HQGSVTFEDVAMYFSWEEWCLLDEAQIQLYLDVMLENFALVCMLGSWRGVRDKETPSEEIKPAGVLQFRTPRAGLSPEKTQ

SEQ ID NO: 21904 - protein, 81 aa, Bos taurus
EEGQVTFEDVAVYFSWEEWGLLDEAQRLLYCGVMLETFSLMASLGLTPSRTHAITQLEQRGEPCVPTGGVSTTATPAGCWC

SEQ ID NO: 21905 - protein, 81 aa, Bos taurus
QGLFTFKDVAVEFTQEEWECLDPIQRALYRDVMLETYRNQLSLGSYSATFAVKELSSPKEDISKGELCHLMTLEKNETYGI

SEQ ID NO: 21906 - protein, 81 aa, Ovis aries
MAHLTIFRDVAVDFSQEEWECLDLEQRHQYRDVMLENYSNLVSLGLCIYQPEVFFLLEKGREPWMALKKNSMNLSSYLSDM

SEQ ID NO: 21907 - protein, 81 aa, Ovis aries
FQGSVSFKDVTVGFTQEEWQHLNSTQRSLYRDVMLENYRNLVSVGYCITKPEVIFRLEQGEEPWILEEEFPSQSFSEVWKT

SEQ ID NO: 21908 - protein, 80 aa, Ovis aries
MMKFQEPVSFRDVAVVFTEEELGLLDSAQRKLYQEVMLENFRNLLSVGNQPFKPELIFQLEREERLMMETQRDGCSALTS

SEQ ID NO: 21909 - protein, 81 aa, Ovis aries
HAEGRLTFQDVAIDFTQEEWECLDLGQRELYRDVMLENYRNLASLGLVSMLDLVTFLEQLKDPRNIRRMETTAIYPAVSPQ

SEQ ID NO: 21910 - protein, 81 aa, Ovis aries
MKRKKRQLMFQDVTTEEWECLDLGQQELYRDVMLENYRNLATLGLVVSKPDLVTFLEQMKEPRNKRRMKTVAIYPALSPHD

SEQ ID NO: 21911 - protein, 81 aa, Vulpes vulpes
GLLSFKDISMEFTWEEWQLLDSAQKYLYRDVILENYSHLVSLEGWKEWYQKSQDEFENVERNYACGAFGKRHLSRIHVSSR

SEQ ID NO: 21912 - protein, 81 aa, Vulpes vulpes
PKVPVTFDDISIYFSTPEWEKLEEWQKELYKNIMKGNYESLISMDYAMNQPDVLSQIQPEREHTTEDQAGPEESEIPTDPS

SEQ ID NO: 21913 - protein, 81 aa, Vulpes vulpes
AHGSLTFSDVAIGFSQQEWECLDPVQKSLYRDVMMENYGNLVSLGYSISKPDIITLLEQGKEPWMVLREETKRWDTDLESR

SEQ ID NO: 21914 - protein, 81 aa, Enhydra lutris
MLENYSHLISVGCHIIKPEVIIKLEQGEEPWIVEGEFLPQSYPEEVWKADVLGERVQENESKYSRQAVSINNKTLIEERGN

SEQ ID NO: 21915 - protein, 80 aa, Enhydra lutris
MNKAAELVSFEDVAVNFSWEEWQDLDDAQRTLYRAVMLETYSSLVSLGHCISKPEVIVKLEQGAEPWAVGEAPTQRLPGQ

SEQ ID NO: 21916 - protein, 81 aa, Enhydra lutris
GSVTFEDVALYFSWEEWDLLDEDQRCLYHDVMLENFALTSSLDANLQQYRGQRTGEIPFRNSVDRASFIKNYTVQVSGKPF

SEQ ID NO: 21917 - protein, 81 aa, Enhydra lutris
MFKSQISFEDVAVDFTSEEWQLLNPTQKSLYRDVMLENYSNLVFLGYQIIRPDAVFKPEPEEPWVIEAAPRRTSAEEVWLD

SEQ ID NO: 21918 - protein, 81 aa, Enhydra lutris
TARSQASVTFKDVAMDFTPEEWGKLDPAQREVMLENYKNLVSLWLPVSKPENYNLENGKEPLVLERKAPKSSYSGELAKWG

SEQ ID NO: 21919 - protein, 81 aa, Enhydra lutris
SQSLVTFGDVAVDFSREEWEWLSSAQRTLYRTVMLENYRNLVSLGLCISKPDMISSLEQRKEPWMAKRKLTRGRCPDLKIV

SEQ ID NO: 21920 - protein, 81 aa, Enhydra lutris
TWVPLTFSDVAIDFSQEEWECLNSDQRDLYRDVMLENYTNLVSLDFDFTTETNKLSSEKSSYQVNSYHRETMKRSRTFNLT

SEQ ID NO: 21921 - protein, 81 aa, Enhydra lutris
PLDSVTFTDVAIDFSQDEWEWLNLAQRALYKKVMLENYRNLLSLGLCLSKPDVISLLEQGREPWMMEGEMTRGLCSDLEYV

SEQ ID NO: 21922 - protein, 81 aa, Enhydra lutris
AAGSVTFKDVTMAFTQKEWEQLDPAQRDLYKDVMLENYSNLASMGFQAPKPDMISKLEKGEEPWLGKGKRPRQGGPSEIGR

SEQ ID NO: 21923 - protein, 81 aa, Enhydra lutris
PRDSVTFEDVAVRFSGGEWRRLTRAQRRLYAAVMLDNYGLVVSLGFAGPKPPLISCLERGAEPRVRDLQDWGLLSCSFPVS

SEQ ID NO: 21924 - protein, 81 aa, Pongo abelii
QGSLTFRDVTIEFSLEEWQCLDTAQQNLYRDVMLENYRNMVFLGITVSKLDLITCLKQGKEPWNMKRHEMVTKPSVISSHF

SEQ ID NO: 21925 - protein, 81 aa, unidentified
  REGION 1..81: note = Bos indicus x Bos taurus
VQDSVTFADVAVNFTQEEWTLLNRFQRKLYRDVMLENYKNLTTAGYQVFKPTLISWLEEEKLSTVERGVLQGDTYYPGEEN

SEQ ID NO: 21926 - protein, 81 aa, Macaca mulatta
AGRPLEMAVSEPETSAAEWKQLDPAQRNVYHDVMLENYSNQASMGYQAPKPDLISKLEKGEAPWLGKGKRPSQGCPSKIAR

SEQ ID NO: 21927 - protein, 81 aa, Macaca mulatta
MLLIFNKTGIAVSKPDLVTCLEQGKEPWNMKRHEMVAKTPVMCSHIAEDLWPERDIKDFFQKVILRRYDKCGRDNLQLRLG

SEQ ID NO: 21928 - protein, 81 aa, Callithrix jacchus
SKGSVMFRDVSIDFSQEEWECLDSGQMNLYKEVMLENFSNLVSVGLSSSKPAVISLLEQGREPWMVDRELTRGLCSDLESM

SEQ ID NO: 21929 - protein, 81 aa, Macaca mulatta
MAFTQEEWEQLDLAQRTLYREVTLETWEHIVSLGLFLSKSDVISQLEQEEDLCRAEQVVPRDWKTTLEENRLNSEKDQARE

SEQ ID NO: 21930 - protein, 81 aa, Ovis aries
AKAPVTFGDLAIYFSQEEWEWLSPIQKDLYEDVMLENYQNLVSLGLSFRRPNVISLLEKGKAPWMVDPVKRRRGLALGMIL

SEQ ID NO: 21931 - protein, 81 aa, Ovis aries
PLESVTFEDVAIDFTQEEWSLLDKSQKNLFRNVMLETVTHLVSVGYQISKSDVISQLEQGKELWPEAAGGLQSQSPGKKVS

SEQ ID NO: 21932 - protein, 81 aa, Ovis aries
QEGVNFKIVTVDFTQEEEGTLNSAQRTLDRDVILENHRDSWDSATALGRRESRLKQSIFDDKLSHSVKIEKLTRDDPWLSS

SEQ ID NO: 21933 - protein, 81 aa, Ovis aries
PHRLVLFKDVAIDFSQEEWAYLDLEQKDLYRDVMLENYSNLVSVGVSISKLDVLSLLEQGKEPWKVVQDVTRDLSPDWESR

SEQ ID NO: 21934 - protein, 81 aa, Vulpes vulpes
SQGLLTFRDVAIEFSQEEWGCLNHTQRELYRDVMLENYGHLLFLGLVVWKPDLVIFLEQEKELWDVKRKETVDFHPAVSSS

SEQ ID NO: 21935 - protein, 81 aa, Vulpes vulpes
AQSLMAFEDVAVYFSQEEWELLDAAQRALYCHVMLENFALVASLGLSASRPRVVMQLERGEEPWVLSGTVVMPARNAQRKA

SEQ ID NO: 21936 - protein, 81 aa, Vulpes vulpes
AQGCVTFEDVTIYFSQEEWGLLDEAQRLLYCDVMLENFALIASLGLTSFRSYIVAQLQMGAEPWVPDRVDMTSAMARGAYS

SEQ ID NO: 21937 - protein, 81 aa, Vulpes vulpes
CELSVSFEDVTVDFSREEWQQLDSTQRRLYQDVMLENYSHLLSVGYEVPKPEIIFKLEQGEEPWILERKTPHQSCSDGRFG

SEQ ID NO: 21938 - protein, 81 aa, Vulpes vulpes
QSPVTFEDVAVYFSKEEWKLLDAGQRHLYYSVMLENFELMTSLGCWYGVEDEGARSKQNASVEGMSQVRIPSVNRSTQKAD

SEQ ID NO: 21939 - protein, 81 aa, Enhydra lutris
YQGPVTFKDVTVEFSREEWQLMNDAQRTLYREVMQENYGLLVSVGYRVNKSNAVFKLKQGKEPWILEVEFPHRNYPDLWKI

SEQ ID NO: 21940 - protein, 81 aa, Pongo abelii
VTLRDVVINFSQEEWEYLDSAQRNLYWDVMMENYSNLLSLDLESRNETKHLSVGKDIIKNTGSQWEVMESSKLHGLESSIF

SEQ ID NO: 21941 - protein, 81 aa, Pongo abelii
LEWLFVSQEQPKITKSWEWQLLDPAQKCLYRSVMLENYSNLVSLGYQHTKPDIIFKLEQGEELCMVQAQVPNQSCPILKAG

SEQ ID NO: 21942 - protein, 81 aa, Pongo abelii
ACGSITFRDVAIDFSHQEWEYLNLVQKTLYQEVMMENYDNLVLLGHSKSKPDLITLLEQGKEPWMIVREETRGECTAELQS

SEQ ID NO: 21943 - protein, 81 aa, Pongo abelii
RQVSITFKDLAVRFSEEEWRLLEEGQREFYRDVMRENYETLVSVGTAELLPLSAFLSPSEPGRAVGGGSHADEGQEPAGCG

SEQ ID NO: 21944 - protein, 81 aa, Pongo abelii
PQGHLTFRDVAIEFSQAEWKCLDPSQRALYKDVMLENYRNLVSLGISLPDLNINSMLEQRREPWSGESEVKIAKNSDEREC

SEQ ID NO: 21945 - protein, 81 aa, Pongo abelii
SQGLVSFKDVAVDFTQEEWQQLDPSQRTLYRDVMLENYSHLVSMGYPVSKPDVISRLEQGEEPWIIKGDISTWIYPDDYQA

SEQ ID NO: 21946 - protein, 81 aa, Pongo abelii
GCVTFEDVAIYFSQEEWGLLDEAQRLLYRDVMLENFALITALVCWHGMEDEETPEQSVSVEGVPQVRTPEASPSTQKTQSC

SEQ ID NO: 21947 - protein, 81 aa, Pongo abelii
FQRPVSFQDLTVNFTQEEWQQLDPAQRLLYRDVMLENYSNLVSVGYHVSKPDVIFKLEQGEAPWIVEEFSNQNYPEVDAAL

SEQ ID NO: 21948 - protein, 81 aa, unidentified
  REGION 1..81: note = Bos indicus x Bos taurus
DQPKAKKSWGPLSFMDVFVDFTWEEWQLLDSAQKHLYRSVMLENFRNLVSLGYQYTKPSIIFQLEQEELWMMHSPSQGHSE

SEQ ID NO: 21949 - protein, 81 aa, unidentified
  REGION 1..81: note = Bos indicus x Bos taurus
DPVAFEDVAVNFTLEEWALLGPSQKKLYRDVMRETLSNLALIRDEWEDHNTEDQYKNQERNLRSHILQRLCESKEGSQGGE

SEQ ID NO: 21950 - protein, 81 aa, unidentified
  REGION 1..81: note = Bos indicus x Bos taurus
MAASQGWLTFQDIAIDFTQEEWECLDLGQRELYRDTMLENYGNLASLGLVSKPDLVTFLERMKDSRNISSMETTPIYPGMS

SEQ ID NO: 21951 - protein, 81 aa, unidentified
  REGION 1..81: note = Bos indicus x Bos taurus
VVFEDVAIYFSQEEWGLLDEAQRLLYCQVMVQNIALLSSVGCRHATQDEEALSEQHDVAARSQVKTPKPGPCIQKPHPSKT

SEQ ID NO: 21952 - protein, 81 aa, Pan troglodytes
FQGSLSFGDVAVGFTRKEWQQLDLEQRALYQDVMLENYSHLLSVGCQVSKPAVISSLEQGKEPWMEEEEIRTWSFPEEVWQ

SEQ ID NO: 21953 - protein, 81 aa, Callithrix jacchus
LFQVTFSDVAIDFSHEEWEWLDSAQRDLYKDVMVQNYENLASLGLSITKPHVITLLEDGKEPWMVEEKMSKDWESRLGNKE

SEQ ID NO: 21954 - protein, 81 aa, Macaca mulatta
QEEWKCLDPVQKALYRDVMLENYRNLVSLGICLPDLSIISMMKQRTEPWTVENEMKVAKNPVRWEGIKDINTGRCCAMRSK

SEQ ID NO: 21955 - protein, 81 aa, Bos taurus
RLTFKDVAIEFTPEEWECLDLAQRALYREVMVETLRNLLSVDTSPKRVLKGSAPKQSSHTGGILQTMLSGRHKSHDTKDQG

SEQ ID NO: 21956 - protein, 81 aa, Ovis aries
MGLLDLAQRKLYQEVMLENFQNLLSVGHQSFTPDVPSQLEREEKLQMIKTAAQSCCSSGNQNLNGIETLQEVGLRYLPHEE

SEQ ID NO: 21957 - protein, 81 aa, Ovis aries
PKVPVSFEDVAMYFTKTEWKLLDHRQRKLYKQVMLENYHHLVSLGFSFAKPQLVIQLEQGEKPWVADVHRMRITTGMQAER

SEQ ID NO: 21958 - protein, 81 aa, Ovis aries
VKKPVTFEDVAVNFTQEEWKCLDASQKVLYQDVISETVRNLMSVDGIFLSNLDLIAKLEQEEKQWEADLCSPNGEGFHSGG

SEQ ID NO: 21959 - protein, 81 aa, Ovis aries
SLAFEDVAVNFTLDEWVLLDSSQRKLYRDVMRENFRNIVSVEAKQEDHDIEDQDKNQERKLRNPKAERHSEKKDINSSEES

SEQ ID NO: 21960 - protein, 81 aa, Ovis aries
AQLTFKDVFLDFTPEEWECLDPAQRTLYKDVMVEILRNLLSVDMSHIHMVKKLQAKANSGKGEIFQRVMFGRAEILEIKDF

SEQ ID NO: 21961 - protein, 81 aa, Pongo abelii
VAFEDVAVNFTQEEWTLLDISQKNLFREVMLETFWNLTSIGKKWKDQNIEYEYQNPRRSFRSLIEEKVSEIKDNSHCGETF

SEQ ID NO: 21962 - protein, 81 aa, Pongo abelii
PRGSTFFSSVTVAFAQEGWRCLVSTPQDRFKEGIPGKSRNLVLLGLPVSQPGMNSQLEQREGAWMLEGEDLRSPSPGWKII

SEQ ID NO: 21963 - protein, 81 aa, Pongo abelii
LEEHVTFEDMVVDFSQEEWRQLEPAQRTLYHDVILDTFRLLVSVGHWLPKPNITSLLEQEAEPWAVDSGVPQGMYLGEVAE

SEQ ID NO: 21964 - protein, 81 aa, Pongo abelii
RNMIPQDNENPPQQGEANQNDSVAFEDVAVNFTPEEWALLDPSQKNLYREVMQETLRNLASIEVLWKRDSLKVKVISMEKF

SEQ ID NO: 21965 - protein, 81 aa, Pongo abelii
VMFRDVAIDFSQEEWECLDSAQRDLYRDVMLENYSNLVSLDLPSRCANKDLSPEKNTYETELSQWEMSDRLENCDLEESNS

SEQ ID NO: 21966 - protein, 81 aa, Pongo abelii
QGPLTFMDVAIEFSLEEWQCLDTAQQNLYRNVMLENYRNLAFLGIAVSKPDLITCLEQGKEPWNMERHEMVAKPPGMCCYF

SEQ ID NO: 21967 - protein, 81 aa, Pongo abelii
WLQEPMTFKDVAVEFTQEEWMLLDSAQRSLYRDVMLENYRNLTSVEYQLCGLTVTSPLDQEEIRNMKKRIPQAICPDQKIQ

SEQ ID NO: 21968 - protein, 81 aa, unidentified
  REGION 1..81: note = Bos indicus x Bos taurus
QVSIAFQDLAVRFSEDEWRLLGEGQRALYLDVMRENYDTLASLGTAEPLPLSAFLSPSEPGGAVGARSRAGGRQEPPQGGG

SEQ ID NO: 21969 - protein, 81 aa, unidentified
  REGION 1..81: note = Bos indicus x Bos taurus
GRLMFQDVTIDFTLEEWECLDLDQRELYRNVMLENYGNLASLGEDNCLVVSKPDLVTFLEQMKNPWDIRRTDTTATYPCRC

SEQ ID NO: 21970 - protein, 81 aa, unidentified
  REGION 1..81: note = Bos indicus x Bos taurus
HQEVVTFEDVAVYFTRTEWAGLSPAQRALYRSVMLEIYGSLTSLGYPVPKPALISLLERGDLPVGLETQDNPPAQGTRDIY

SEQ ID NO: 21971 - protein, 81 aa, Pan troglodytes
LKGLVTFEDVAVEFTQEEWALLDPAQRTLYRDVMLENCRNLASLGCRVNKPSLISQLEQDKRVITEERGILPSTCPDLETL

SEQ ID NO: 21972 - protein, 81 aa, Odocoileus virginianus
FQGLLTFEDVAVHFTQEEGARLDAGQRTLYRDVMLETYRNLVSLEVPGSKPDLISQLEQGREPWGSDLLGAQEAETVGDAG

SEQ ID NO: 21973 - protein, 81 aa, Cebus imitator
PKVPVTFDDVAVYFSEQEWGKLEDWQKELYKHVMRGNYETLVSLDYAISKPDILTQIERGEEPCLDQWSQKKGSEVEVAHS

SEQ ID NO: 21974 - protein, 81 aa, Cebus imitator
MKPEVISHAPDTVVPAAFPFPKPDLIFRLEQGEAAWGPDPWTLAGEEALRGLCTGGKTKTKTEEQTARLNIFKESESHRLI

SEQ ID NO: 21975 - protein, 81 aa, Callithrix jacchus
LSQTSDFKDVAVEFSLAEWKCLTPAQRAVYRDVMLENYRNLESVDSFLKSMMEFSSTGQGSTREGIHTGTLGKCTSHHIGD

SEQ ID NO: 21976 - protein, 81 aa, Callithrix jacchus
GLLTFRDVAIEFSQEEWRCLDPAQKTLHRDVMLENYRNLVSLDISSICMMKEFSSTGPGNTDVFHTGTLQRHEIHQTGDFC

SEQ ID NO: 21977 - protein, 81 aa, Macaca mulatta
RLTFRDVAIEFSQEEWKCLDPAQRTLYRDVMLENYWNLVSLDIPPKCTTKDLLPEEKSSTEAVFHTVMLERHESPDIEDFS

SEQ ID NO: 21978 - protein, 81 aa, Callithrix jacchus
PLTFRDVTIQFSQEEWRCLDPAQKALYKDVMLENYRNLVFLGIIPKCTTKELPPTGNSNTGEKFRTMTLERHECCDIEDIY

SEQ ID NO: 21979 - protein, 81 aa, Callithrix jacchus
MDTVALEDVAVNFTQEEWVLLGPSQKKLYRDVMQETIRNLDCIKMISEDQNIEDQYKNPKKNLRCRMAERLSESKDNSQCG

SEQ ID NO: 21980 - protein, 81 aa, Macaca mulatta
SLGPVSFKDVAVDFTQEEWQQLDPEQKITYRDVMLENYSNLVSVDEVWQADDLIERIQEGENKPSRQTVFTETLIEERGNV

SEQ ID NO: 21981 - protein, 81 aa, Enhydra lutris
QGQLTFRDVAIEFSEEEWGRLTHTQRQLYRDVMLENYGHLLFLAVSSHDTKSFLLQWSIEGSFQNGSMQRYKDSAFEILHL

SEQ ID NO: 21982 - protein, 81 aa, Enhydra lutris
SQDLVTFKDVAIDFSQEEWEWLNPAQRNLYKNMMLENYQNLVSLGLCISKPYVISLLEQGKEPCEMKTEMTRSPCSNSGSI

SEQ ID NO: 21983 - protein, 81 aa, Enhydra lutris
MLETYSHLVSLDVPFSKPKLISQLEQGEEPWKEERQHPLGLCPAEAKQNIPPCPHCPLAFASQQGLSQHVWFCHFPQLFSS

SEQ ID NO: 21984 - protein, 81 aa, Enhydra lutris
LQSPVTFEDVAVYFSREEWGILNVSQRHLYHSVMLENFELMTSLGCWHGVEDEGAHSKQNTSVEGMSQVRIPSANPSTQKA

SEQ ID NO: 21985 - protein, 81 aa, unidentified
  REGION 1..81: note = Bos indicus x Bos taurus
AAGSVTFNDVTMAFTRKEWEQLDPAQKSLYKDVMLENYSNLASMGYQALKPDMISKLEKGEEPWLGKGKRCRQGGSSEIAR

SEQ ID NO: 21986 - protein, 81 aa, Vulpes vulpes
FQGSVSFKDVTVGFTLEEWQHLDSTQRSLYRDVMLENYSNLVSLGYCVTKPEVIFRLEQGEEPWILEEEFPSQSFPESWET

SEQ ID NO: 21987 - protein, 81 aa, Vulpes vulpes
LQGPVTFTDVAVEFTHEEWMMLDSSQRRIYRDVVLENYINLTSVEHQLWKTIVISLLGQEELGSKLAFSKRVSTSKHCHKC

SEQ ID NO: 21988 - protein, 81 aa, Vulpes vulpes
MGMAGSISEGFIQRRHVGELQELGLSISKPNMISLLEQGKEPWMVEKEMSDDWESWYEIKELSPKWYIDEEEISQGMVMER

SEQ ID NO: 21989 - protein, 81 aa, Otolemur garnettii
ESVTFKDVAMDFSQEEWELLDPAQRNLYREVMLENYRNLVSLDWETKLKNQESTSKKVVLGEEPTSVKKYIYTQRDKDWTE

SEQ ID NO: 21990 - protein, 81 aa, Otolemur garnettii
VSFKDVTVDFTQEEWQHLDPAQKTLYMDVMLENYCHLISVGCHMTKPDVILRLERGEEPWASFAGHTCLDLCSVPSPSSHF

SEQ ID NO: 21991 - protein, 81 aa, Otolemur garnettii
SWAHMAFRDVAVDFSQEEWRLLSPAQRTLYREVMLENYSNLLSLGIPFSKPKLITQLEQGKETWREEKKCLPATCPVVICK

SEQ ID NO: 21992 - protein, 81 aa, Vulpes vulpes
MLENYGNLVSVGYQLSKPGVISQLEKGEEPWLIEREISGSPSSDLENKTETSESSLKNGISWEGLHHGLMMEQSTRGNTLY

SEQ ID NO: 21993 - protein, 81 aa, Otolemur garnettii
SVMFNDISIVFSQEEWEYLDLEQKDLYKDVMLENYGNLVSLGCFIAKPDVISLLEQGKEPWKVIRKGRRGYPDLETRYETK

SEQ ID NO: 21994 - protein, 81 aa, Enhydra lutris
SQESVTFQDVAVDFTEKEWPLLDSSQRKLYKDVMLENYSNLTSVGYQVGKPSLISHLEQEEEPRTEERTLHRASSPDWETP

SEQ ID NO: 21995 - protein, 81 aa, Enhydra lutris
LQEAFSFEDLSVDFTQKEWQLLDPSQKDLYKDVMLENYSSLVSLGYEVVKPEVIFKLEQGEEPWIGDGEVPSSDGPEQVLQ

SEQ ID NO: 21996 - protein, 81 aa, Enhydra lutris
SHTLVTFRDILVNFTREEWKLLDSAQQIMYKDVMLENYKNLVSLGHQLPKPHVILQLEKGEEPWLVERGIHRETQPDLETA

SEQ ID NO: 21997 - protein, 81 aa, Enhydra lutris
PQDLMTFEDVAVEFTQWEWGQLDPAQKDLYRVVMLENFKNLASLGFPVAKPYVISQLEKGKEPCVLEGEISTGNLRVPDEP

SEQ ID NO: 21998 - protein, 81 aa, Pongo abelii
PQDLVTFKDVAIDFSQEEWQWMNPAQKCLYRSMMLENYQSLVSLGLCISKPYVISLLEQGREPWEMTSEMTRSPFSEFILV

SEQ ID NO: 21999 - protein, 81 aa, Pongo abelii
SVAFEDVAVNFTHEEWALLGPSQKNLYRDVMRETIRNLNFIGMKWENQNIDDQYQNLRRNSRLSETWLQNFILIHYGHLVA

SEQ ID NO: 22000 - protein, 81 aa, Pongo abelii
MDVAIEFSLEEWQCLDTSQQNLYRHVMLENYRNLVFLGIAISKPDLITCLEQGKEPWNMKRHEMVVAKHSALCSHFAQDLW

SEQ ID NO: 22001 - protein, 81 aa, unidentified
  REGION 1..81: note = Bos indicus x Bos taurus
HSEGRLMFQDVAIDFTQEEWECLDPGQRKLYRDVMVENYRNLASLGLVSKVDLVTFLELLKDPRNIKRMKTTAIYPAVSPQ

SEQ ID NO: 22002 - protein, 81 aa, unidentified
  REGION 1..81: note = Bos indicus x Bos taurus
PQEAAELEFLSVNYTLKNWKGTALSQRALYWNIMLENCCSLAPLGENRMASSQLSPKQDISEESKSADRTSGILCGLILRG

SEQ ID NO: 22003 - protein, 81 aa, Pan troglodytes
GRPLEMAVSEPEASAAKEWKQLDPAPRNLYNDVMLENYSNQASMGCQAPKPDMISKLEKGEAPWLGKGKRPSQGCPSKIAR

SEQ ID NO: 22004 - protein, 81 aa, Otolemur garnettii
MAITFEDVTIIFTWEEWKFLDLSQKKLYREVMWENYTNVMSVGNWNVSFKPQEERFRYLEYENFSCWKGWRNADTPIYEDQ

SEQ ID NO: 22005 - protein, 81 aa, Otolemur garnettii
QGVLTFKDVSIEFSMDEWACLDPAQQHLYREVMLETYRHLVFLVSSMTEYQVLVSMENATGAEPFITLSCVRMSKNSRFIK

SEQ ID NO: 22006 - protein, 81 aa, Vulpes vulpes
AWVPLTFSDVAIDFSQEEWECLNSDQRDLYRDVMLENYTNLVSLDIDFTTETNKLSSGESSYEVNSYHRETMKRSKTFNLM

SEQ ID NO: 22007 - protein, 81 aa, Otolemur garnettii
RLGLLTFKDVSIEFSMDEWACLDSAQRNLYWDVMFKNYRNLVFLSFAVSKPDLITCLEQSKEPWKVKTHETVVKHPGLQPS

SEQ ID NO: 22008 - protein, 81 aa, Otolemur garnettii
FQEMLTFRDVTIELSLEEWACLNPAQRNLYRDVTLENYRNLVSLGLAASKPDLITYLEQWKKSWNVKRHETVAKHPDMLPC

SEQ ID NO: 22009 - protein, 81 aa, Vulpes vulpes
APLPLTFEDVAIYFSEHEWPNLDAWQKELYKHVMRTNYEILVSLDGRLPKPELISWIEQGREFFKNWGESQKSGNIICPSA

SEQ ID NO: 22010 - protein, 81 aa, Otolemur garnettii
SQEPVTFADVAVVFTPEEWAFLDSTQKSLYRDVMLENYRNLASVASEQLYKPCTLSHLEQRDELWTKERGVISDTCPDPQL

SEQ ID NO: 22011 - protein, 81 aa, Otolemur garnettii
WLQEPVTFRDVAVDFTQEEWVMLDSAQRSLYQDVMLENYRNLTSVEYQLCKLTVMSSLDQEDLRTMKKKIAQGIFPDQKIL

SEQ ID NO: 22012 - protein, 81 aa, Enhydra lutris
ARDWGTFEDMAMYFFQEEWELLDETQRRLYHNVRLETLALVASMGCWCGVEEAPLEQGVSVEGAYHFRTPKAYPSTLKANT

SEQ ID NO: 22013 - protein, 81 aa, Enhydra lutris
AREPVTYEDVAVDFTQEEWQHLDAAQKTLHRDVMLEIYGHLVSVGCSSIKPGIIFKLEHEEDPWIIKSELSTWIHSDREKS

SEQ ID NO: 22014 - protein, 81 aa, Enhydra lutris
TKGLVTFEDVAVDFTPEEWQYLNPPQKTLYREVMLETYSNLVSVGPQGTKPDLILKLEVKEPCLGETKISFWSFPAVCQIG

SEQ ID NO: 22015 - protein, 81 aa, Enhydra lutris
QSRGPLSFVDVFVDFTWEEWRLLDPSQKHLYRSVMLENYSNLVSLGYQDSKPDIIFTLEQEEPWMMLAQIPSQGHPEKVGE

SEQ ID NO: 22016 - protein, 81 aa, Enhydra lutris
AQGLMAFEDVAVYFSQEEWELLDAAQKALYCHVMLENFALVASLGLSASRPRVVIQLERGEEPWVLSGTVVTPVRNAPRKP

SEQ ID NO: 22017 - protein, 81 aa, Pongo abelii
AHALVTFRDVTIDFSQKEWECLDTTQRKLYRDVMLENYNNLVSLGLLSRHKTKKLSSEKDIHDISLSKGSKIEKSKTLHLK

SEQ ID NO: 22018 - protein, 81 aa, Pseudorca crassidens
MLENYGNVVSLGFPFPKPPLISHLDQEAELCVQDGQDREFLSCPHPVSAAKTRPENEKASSEQAVFENGEVCWVKFKSLLK

SEQ ID NO: 22019 - protein, 81 aa, Pongo abelii
EMGLLTFRDIAIEFSPEEWQCLDCAQRNLYRDVMLENYRNLVSLGIAVSKPDLITCLEQNKESQNIKRNEMVAKHPVMHSH

SEQ ID NO: 22020 - protein, 81 aa, Pongo abelii
GQLTFRDVAIEFSQEEWTCLNPAQKTLYRDVMLENYRNLVSLDISCKCINKDLPPKGKNNMGEAFYMVKLERLESHDTEGL

SEQ ID NO: 22021 - protein, 81 aa, Pongo abelii
SRSLENDGVCFTEQEWENLEDWQKELYRNVMESNYETLVSLSSSDSPASASRVAEITEVLGQTEGEAELGTQMLGDLEEEG

SEQ ID NO: 22022 - protein, 81 aa, Pongo abelii
QDTVVYEDLSVDYTQKKWKGLTLSQRALQWNMMPENDHSMASLGENMMKGSELTPKQKIFKGSESSNRTSGGLFGVVPGAA

SEQ ID NO: 22023 - protein, 81 aa, Pongo abelii
DSVAFKDVSVSFSQEEWALLAPSQKKLYRDVMQETFKNLASIATWEAEVGESLEAGRWRLQSHMGERLCEGKEGSQCAETF

SEQ ID NO: 22024 - protein, 81 aa, unidentified
  REGION 1..81: note = Bos indicus x Bos taurus
AQAQLTFKDLAIEFFQEEWECLDLAQRALYRHVMVEISCGIYTCQFLKNRKSFVKNLLKIKNVEKSIKTCSSILSLQRFPP

SEQ ID NO: 22025 - protein, 81 aa, unidentified
  REGION 1..81: note = Bos indicus x Bos taurus
MTLKDVAVTFSRGEWRKLEPSQKEIYKEVLLENYKNLELLGFPVSKLDLVSQLKWAGLPRLLQKEVSKGCRPECELGGGLK

SEQ ID NO: 22026 - protein, 81 aa, unidentified
  REGION 1..81: note = Bos indicus x Bos taurus
FQEPVTFEDVAVYFTQNQWASLDSAQRALYREVMLENYKNVASLVSPFPRPDLISQLERGEAPWDPDPWEAEDLRGICPGG

SEQ ID NO: 22027 - protein, 81 aa, unidentified
  REGION 1..81: note = Bos indicus x Bos taurus
MLETYRNLVSLGAGLAGPKPEVIAQLEQGDELWVLDMHGAEQPSVDGSAHGTRTENQEVTSGEMLFGRELDPLRGSVLRGP

SEQ ID NO: 22028 - protein, 81 aa, Pan troglodytes
QLSFSDVAIEFSQEEWKCLDPGQKALYRDVMLENYRNLISLDFSPLAWDARVSRVEAWRASGGAEEPTDPNFVGNDSPLPS

SEQ ID NO: 22029 - protein, 81 aa, Vulpes vulpes
WAGSVTFRDVAIDFSQEEWEFLDSAQRDLYRDVMWENYSNFISLEPSISKPDVITLLDEGKEPWMVVREETKRHCSDLDSR

SEQ ID NO: 22030 - protein, 81 aa, Otolemur garnettii
SQVSLMFEDVAVLFSRDEWRKLDPSQRNLYRDVMLENYSNLVSLAGLPFTKPKVISLLQQGEDPWMVEKESPTGSSLGWKN

SEQ ID NO: 22031 - protein, 80 aa, Otolemur garnettii
IVLLQESLTFKDVFVDFTLEEWQQLDSAQKNLYRDVMLENYSHLVSVGYLVTKPDGIFRLGPEESGMTDRGTPVLSCPGE

SEQ ID NO: 22032 - protein, 81 aa, Otolemur garnettii
MVTFKDVAVVFTEEELGLLDSAQRRLYRDVMLENFKNLLLVAHQPFKPDLIAQLENLKGNKNQQKMESIQEVRLSCLSPKE

SEQ ID NO: 22033 - protein, 81 aa, Vulpes vulpes
KSQELVAFEDVLVDFTPEEWQYLNSSQKTLYREVMLETYSNLVSVGQQDTKPDLILKLELEGPCLAERKISVWSFPEEACQ

SEQ ID NO: 22034 - protein, 81 aa, Otolemur garnettii
LTFQDVSIDFSVDEWACLDPAQQTLYRDVMLENYRHLVFLGLTLSKPDLITCLEQSKEPWKGKAHQTVVKHPDFMCTHTTI

SEQ ID NO: 22035 - protein, 81 aa, Otolemur garnettii
AQGCVTFEDVTIYFSQEEWGLLDEAQRLLYCDVMLENFALIASLGLTSFRSHVVAQLEMGKEPWVPDCVDMTSAMTRGACG

SEQ ID NO: 22036 - protein, 81 aa, Otolemur garnettii
MVENFKNLVAVGHLPFKPDMVSQLEVEEKLWVTETETQRNGGKNQDNMETFQKFALKYLSHEELSCWQIWKQVANELTKCL

SEQ ID NO: 22037 - protein, 81 aa, Otolemur garnettii
EHAPVTFRDVAVIFTEAEWKRLSMEQKNLYKEVMLENYSNLLSLGLDPAAPALVRALSELPKGKPKPTSQQIFLGLCADHH

SEQ ID NO: 22038 - protein, 81 aa, Vulpes vulpes
WLTFRDVAIEFSEEEWECLDPAQRALYRDVMLENYRNLVSLAITPKCMIKELPPQDNSNIGEVLQAVILERHKSCDTEDYI

SEQ ID NO: 22039 - protein, 81 aa, Otolemur garnettii
GTVVFSDVSVDFSQEEWECLDPVQRDLYREVMLENYSNLVSVGAGPYIPKPQVISLLEQGKEPWMVGRELTRGLCSDLESM

SEQ ID NO: 22040 - protein, 81 aa, Otolemur garnettii
FQASVSFKDVTVGFSQEEWQHLDPTQKTLYRDVMLENYSNLVSVGYCVAKPEVIFRLEQGEEPWIMEEESPHQSHPDIWKA

SEQ ID NO: 22041 - protein, 81 aa, Enhydra lutris
GWVPALFDEVAIYFSDEEWEVLTEQQKALYREVMRMNYETVLSLEFPFPKPDMITRLEGDKESQNSDEWQLQGGPLAETEE

SEQ ID NO: 22042 - protein, 81 aa, Enhydra lutris
MLENYGHLCFLGLLLSKPDLIMFLEQEKQLWDVKRKETGGFHPAVSSHDTQSFLLKQSIEDSFQTVSVHRYKHSAVEILHL

SEQ ID NO: 22043 - protein, 81 aa, Enhydra lutris
QGPVLFEDLAVYFSQEEYVSLHPAQRSLSRDTTQECFKDMVLMGGEGKTETSQQLNLESTGFEELAAENSSIPVPLVYYPE

SEQ ID NO: 22044 - protein, 81 aa, Enhydra lutris
GAPEQVTFEDVVVDFTREEWGQLEPAQRTLYRDVMLETFRLLVSVECWLPRPDVISPLEQEELWVADAGVPQHVYPNLETR

SEQ ID NO: 22045 - protein, 81 aa, Enhydra lutris
MGMAGPVSEGFVPRCHVGELQELGLSISKPNMISLLEQGKEPWMVEKEMSDGQYADWESWYEIKELSPKWYIGEEEISQGM

SEQ ID NO: 22046 - protein, 81 aa, Enhydra lutris
GCPAEMAVPKPTGSAAKEWEQLDPAQRDLYKDVMLENYSNLASMGFQAPKPDMISKLEKGEEPWLGKGKRPRQGGPSEIGR

SEQ ID NO: 22047 - protein, 81 aa, Enhydra lutris
PKVPVTFDDISIYFSTPEWEKLEEWQKELYKNIMKGNYESLISMDYAMNQPDVLSQIQPEGEHNTEEQPGPEESEIPTDPS

SEQ ID NO: 22048 - protein, 81 aa, Pongo abelii
EMGPLTFRDVTIEFSLEEWQCLDMAQQNLYRDVMLENYRNLVFLGIAVFKPDLITCLKQGKEPWNMKRHEMVTKPPVMHSH

SEQ ID NO: 22049 - protein, 81 aa, Pongo abelii
GEGSLSFEDVAVGFTREEWQFLDQSQKVLYKEVMLENYSNLVSVGYQGTKPDSLFKLEQGEPPWIVEGAAHSQICPGFVIQ

SEQ ID NO: 22050 - protein, 81 aa, unidentified
  REGION 1..81: note = Bos indicus x Bos taurus
MLETYSHLVSLDILFSKLELICQLEQGEEPWIKERQRSLGLCPASPHPACVVQSSPSVILKLRCRKSSPFRETLFRRSQTA

SEQ ID NO: 22051 - protein, 81 aa, unidentified
  REGION 1..81: note = Bos indicus x Bos taurus
VVFEDVAIYFSQEEWGLLDEAQRLLYCQVMVQNVALLSSVGCRHATQDEEALSEQHDVAARSQVKTPKPGPCIQKPHPSKT

SEQ ID NO: 22052 - protein, 81 aa, Pan troglodytes
GLLTFRDVAIEFSQEEWKCLDPAQRTLYRDVMLENYRNLVSLGHDLILFFLFLRWSFALVAQAGVQWHNLGSPQPPPPGFK

SEQ ID NO: 22053 - protein, 81 aa, Pan troglodytes
PPTGDILIQGTVTFEDVAVNFTWEEWNLLSEAQRCLYRDVTLENLALISSLDPALDGSADNTQTGNLGQSLLPSHPQQKTA

SEQ ID NO: 22054 - protein, 81 aa, Zalophus californianus
FQESVTFKDVIVDFTQEEWKQLDPVQRDLFRDVTLENYTHLVSIGLQVSKPDVISQLEQGTEPWIVEPGIPVGSLGDCETR

SEQ ID NO: 22055 - protein, 81 aa, Zalophus californianus
SKDLVTFGDVAVDFSQEEWEWLNPAQRNLYRKVMLENYRSLVSLAGVSVSKPDVISLLEQGKEPWMVKKEGTRGTCPDWEY

SEQ ID NO: 22056 - protein, 81 aa, Zalophus californianus
AQESLTFRDVFVDFTLEEWQQLDSAQKSLYRDVTLENYSHLVSVGYLVAGPDEVSRLGRGEEARRADRGPSAPNFPEFWQV

SEQ ID NO: 22057 - protein, 81 aa, Callithrix jacchus
CQETVTFEDVAVHFTKTEWTGLSPAQRALYRSVMLENYGNLTAMGYLVPKPALISLLEGGDMAWGLEAQDDPLAEGTKNIC

SEQ ID NO: 22058 - protein, 81 aa, Saimiri boliviensis
SQGSVLFEDVYVYFTQKEWQLLDPAQRLLYRDVMLENYRHVVSLGHCVTKPELIVKLEQGDEPWILKRDPPSQSHSEVQKA

SEQ ID NO: 22059 - protein, 81 aa, Balaenoptera acutorostrata
MYKDVMLENYRNLMSLGHQLPKPEVILQLEKGEEPWLVERGIHQETHPGEDQTARSGQESLARVVTSSPHFEDLETAVEVK

SEQ ID NO: 22060 - protein, 81 aa, Ovis aries
ELVTFRDVVISFSQEEWEYLDSVQRDLYWDVMMENYSNLVSLDLESKYDTKTLSVEDILEKNNSQWEVIENSKLVGLQNSI

SEQ ID NO: 22061 - protein, 81 aa, Callorhinus ursinus
AYGSLSFGEVAISFSQEEWECLDPAQRALYRDVMLETYSNLVSLGSSISKPDVITLLEQEKEPWVVVRRETSRWYPDLESN

SEQ ID NO: 22062 - protein, 81 aa, Rhinolophus ferrumequinum
PHGSMPFSTMTVAFTHEEWSYSGPALRDRSKEGRPDKARNLVLLGLPVSQPGMNSQLEQREGPWMLEGKGLRSTCPDWKTV

SEQ ID NO: 22063 - protein, 81 aa, Ursus maritimus
SQGPVSFRDVAVDFTQEEWQQLEPDEKTTYRDVMLENYSHLVSVGYDSTKPKVILKLEQGEEPWVAEGELPCQNHPEEVWK

SEQ ID NO: 22064 - protein, 81 aa, Ursus maritimus
VQESVTFKDVVVLFTRDEWAQLSAAQRALYRDVMLENYSHLVSLGLLGSQPDVFSQLGKGEDWMLEDASGGLCLDWMTMLV

SEQ ID NO: 22065 - protein, 81 aa, Rhinopithecus roxellana
MEGLVMFQDLFIDFSQEEWECLDAAQKDLYRDVMMENYSSLVSLGLCSPKPDVISLLEQGKEPWMVSRDVLGGWCPDSEFR

SEQ ID NO: 22066 - protein, 81 aa, Rhinopithecus roxellana
MLENYKNLATVGCQLFKPSLISWLEQEESRTVQRGDFQASEWKVQLKTKESALQQDFLGEPNSSGIQMIGSHNEGEVNDVK

SEQ ID NO: 22067 - protein, 81 aa, Rhinopithecus roxellana
NFWILRLPPGSKGEAPKEWGKLEDWQKELYKHVMRGNYETLVSLDYAISKPEVLSQIEQGKEPCNWRRPGPKIPDVPVDPS

SEQ ID NO: 22068 - protein, 81 aa, Rhinopithecus roxellana
AQSSVTFEDVAVNFSLEEWSLLNEAQRCLYRDVMLETLTLISSLGCWHGGEDEAAPSKQSTCLHINKDQGGHSGERPYECG

SEQ ID NO: 22069 - protein, 81 aa, Rhinopithecus roxellana
TQGQVTFKDVAIEFSQEEWTCLDPAQRTLYRDVMLENYRNLASLAGISCFDLSIISMLEQGKEPFTVESQVQIARNPDGWE

SEQ ID NO: 22070 - protein, 81 aa, Rhinopithecus roxellana
GPLTFRDVAIEFSQEEWQCLDPVQKALYWDVMLENYRNLVFLGILPKCMTKELPPIGNSNTGEKFQTVMLERHECYDIENF

SEQ ID NO: 22071 - protein, 81 aa, Rhinopithecus roxellana
PVTFRDVAVIFTEAEWKRLSPEQRNLYKEVMLENYRNLLSLAEPKPETYPCSSCLLAFSCQQFLSQHVLQIFLGLCAENHF

SEQ ID NO: 22072 - protein, 81 aa, Callithrix jacchus
MGSLTFRDVAIEFSLEEWQCLDTAQQDLYRKVMLENYANLAFLGIAVSKADLITFLEQGKDLWNIKRHSIVAKPPVLCSHF

SEQ ID NO: 22073 - protein, 81 aa, Macaca mulatta
QGSVTFEDVAVYFSWEEWDLLDEAQKHLYFDVMLENFALTSSLGKALILTLVPCTRLCVSPFPQEQLCPHIWTIGTASFPS

SEQ ID NO: 22074 - protein, 81 aa, Callithrix jacchus
TLKETVTFKDVAVVFTEEELRLLDPAQKKLYQDVMLENFRNLLSVGHQPFHGDTFHFPREEKFWMVETATQREGNLGGKIQ

SEQ ID NO: 22075 - protein, 81 aa, Macaca mulatta
KPGAVSFADVAVYFSPEEWGCLRPAQRALYRDVMRETYGHLGALGVGGSKPALISWVEEEAELWDPAARDPEVTKCPTETD

SEQ ID NO: 22076 - protein, 81 aa, Macaca mulatta
EKGPLTFRDVVIEFSQEEWQCLDTAQQDLYRKVMLENFRNLVFLAGIDVSKPNLITCLEQGKYPWNMKRHSMVVKPPVICS

SEQ ID NO: 22077 - protein, 81 aa, Monodon monoceros
FQEAAVFEFLSVDYTQQKWKGLALSQRALYWNIMLENCCSLASLGENRMESSELPPKQELSKVLKSSDRTSVVLCGMIPGG

SEQ ID NO: 22078 - protein, 81 aa, Callithrix jacchus
DGLVTFRDVAIDFSQEEWECLDPAQRDLYVDVMLENYSNLVSLDLESTTYDAKKIFSEKDIFEINFSQWEMKEKSKIPGRE

SEQ ID NO: 22079 - protein, 81 aa, Macaca mulatta
YLGPVTFEDVAVLFTEAEWKRLNLEQRNLFKEVMLENLRNLVSLAILGARPGSPFSFGKGSSVNLPRGDTTHCPVGGLRDG

SEQ ID NO: 22080 - protein, 81 aa, Ovis aries
AQGSVTFPDVAVYFSWEEWRLLDEAQRRLYLDVMLENYALISSLGFWSGEEKVETSFAQSVSVAVSQARTSKEASSSQKTH

SEQ ID NO: 22081 - protein, 81 aa, Ovis aries
GLVTFGDVAIDFSQEEWEFLNPAQRDLYVDVMLENYSNLVSLDLESTYETKNTFSKKDIFEINFSQWKIKERSKTIELEAS

SEQ ID NO: 22082 - protein, 81 aa, Ovis aries
PQGGVTFEDIALSFSWKEWKLLDAAQRRLYHDVMLENYALISSLGFWSGEEKVETSFAQSVSVAVSQARTSKEASSSQKTH

SEQ ID NO: 22083 - protein, 81 aa, Ovis aries
QGHLTFKDVAIEFSQEEWECLDPAQRALYRDVMLETYRNLLSVGGFLTTGPPGKLLCMFLFSNMFSTVLSLTFVNKFSKHM

SEQ ID NO: 22084 - protein, 81 aa, Ovis aries
REGLVSFEDVTMDFSREEWQQLDPAQRHLYQDVMLEIYSHFFSVGYHIPNPEIIFRIEEGKEPWMRETEVPCQRYHEGEFG

SEQ ID NO: 22085 - protein, 81 aa, Ovis aries
WQACVTFEDVAIYFFQDWRLLNETQRFLYCDVMLENFALITSLDCSCEMEEDEVIPSEQSLSVGESQVRTSRSGPSTQKSH

SEQ ID NO: 22086 - protein, 81 aa, Ovis aries
PKVPVTFDDISIYFSTPEWEKLEEWQKELYKNIMKGNYESLISMVDYAMNQPDVLSQIQPEGDRNTEDQAGPEESGIPTDP

SEQ ID NO: 22087 - protein, 81 aa, Otolemur garnettii
DSVAFEDVAVNFTQEEWALLDHHQKKLYRDVMQETFINLASIGKNEIISLLSQLENKFGMWKGNAFINKSDIIAAQHRRKK

SEQ ID NO: 22088 - protein, 81 aa, Otolemur garnettii
QALLTFRDVSVEFSMDEWAYLDPAQQNLYRDVMLETYGNLVFLETGLDVSKPDLITCLEQRKEPWKVKTHKTVVKHPVILN

SEQ ID NO: 22089 - protein, 81 aa, Vulpes vulpes
AQDSVTFEDIAVYFSWEEWRLLDEAQRFLYHDVMLENFALISSLGCCCGAEDVEAPCEQSISVGVSQDRTPRAALTFRKTH

SEQ ID NO: 22090 - protein, 81 aa, Vulpes vulpes
FKETVTFKDVAVVFTEEELGLLDPAQRKLYGDVMLENFRNLISVGGKIQSKMKTVLEAEPPEEHSCWRIWQQIASDLSRCQ

SEQ ID NO: 22091 - protein, 81 aa, Otolemur garnettii
TSVSFKDLTVDFTQEEWQHLDPAQRFLYRDVMLENYSYLVTIQFPFQCLRPTLLSQKSYFPFPFQFMQVLEFLCHCQKLNR

SEQ ID NO: 22092 - protein, 81 aa, Vulpes vulpes
VSTFSQDPQKMNTPQASVSFKDVTVEFTQEEWRQMDSAQRTLYRDVMLENYSHLVSVGEQTLLCDSLLTACSSFSFFFLKC

SEQ ID NO: 22093 - protein, 81 aa, Otolemur garnettii
QVSVTFDDIAVTFTKEEWGQLDPAQRTLYQEVMLENCRLLMSLGCPIPRPVLIYQLEHGQTPWTVRKDLFQGPCSGEKEKL

SEQ ID NO: 22094 - protein, 81 aa, Pan troglodytes
EPGAVSFADVAVYFCREEWGCLRPAQRALYRDVMRETFGHLGALGFSGPKPAFISWVEGEVEAWSPEAQDPDGESSAAFSR

SEQ ID NO: 22095 - protein, 81 aa, Camelus dromedarius
FRRSFAFEDVYISFTGEEWEILDENQKRLYCNLMMETFAQVMSLGLAVSRNRIMSQREPEREPVIPNRADMAPTEADVIRE

SEQ ID NO: 22096 - protein, 81 aa, Camelus dromedarius
LALVSFEDVAITFTGEEWRHLDLAQRTLYQEVMLETCGLLVSLGKASSLFQGVPSASFIPPSLSAWLVEKTPGTCLPFSPQ

SEQ ID NO: 22097 - protein, 81 aa, Camelus dromedarius
RPRAVKFADVAVYFSPEEWECLRPAQRALYRDVMQETYGHLGALGCAGPKPALISWLERNTDDWELAALDPQECPRQITVQ

SEQ ID NO: 22098 - protein, 81 aa, Camelus dromedarius
MAAADPSSEHLYRSVMLENYNNLASLGHQHTNPSAIFQLEQEELWMKQIPSQGHAGGEQDTECFSSVPRPGLSSDVTLPSG

SEQ ID NO: 22099 - protein, 81 aa, Camelus dromedarius
GLLSFTDVSMEFTWEEWQLLDSTQKHLYRDVTLENYSNLLSVDANECFPVVAPDPSVPKKVGKNGTRKMMNLKVLREAMLV

SEQ ID NO: 22100 - protein, 81 aa, Camelus dromedarius
FTSFQGLVTFGDVAVDFSQEEWEWLSPSQRTLYRRVMLENYRSLVSLGVSVSKPDVISLLEQGKEPWKVKKEWTGGTRPGE

SEQ ID NO: 22101 - protein, 81 aa, Pongo abelii
KSLVTFEDVAVYFSQEEWELLDAAQRHLYHRVMLENLELVTSLGCWHGVEGEEAHPKQNVSVEVLQVRIPNADPSTKKANS

SEQ ID NO: 22102 - protein, 81 aa, Pongo abelii
QEVLTFRDVAIEFSLEEWQCQDTAQQNLYRNMMLENYRNLVFLGIAASKPDLITCLEQGKEPWNVKRHEMVAEPPVVWSYF

SEQ ID NO: 22103 - protein, 81 aa, Pongo abelii
GPVSFKDAAVDFTQEEWRQLDPDEKITYGDVMLENYSHLVSMGEDSLLSECSQPNVIIKLEQGEEPWIMGGEFPCQHSPEP

SEQ ID NO: 22104 - protein, 81 aa, Pongo abelii
RTKEAVTFKDVAVVFTEEELGLLDPAQRKLYRDVMLENFRNLLSVGHQPFHGDTFHFLREEKFWVMETTSQREGNSGGKIQ

SEQ ID NO: 22105 - protein, 81 aa, Pongo abelii
SPPESVSFKDVTVDFSRDEWQQLDLAQKSLYREVMLENYFNLISVGCQVPKPEVIFSLEQEEPCMLDGEIPSQSLPDGDIG

SEQ ID NO: 22106 - protein, 81 aa, unidentified
  REGION 1..81: note = Bos indicus x Bos taurus
QLTFKDVAVEFSQEEWECLDPAQRAFYMDVMVETLRNLISVGEDHFASEIRISPWVSLHFFCAPWEPLFCLIDLKSLLIQT

SEQ ID NO: 22107 - protein, 81 aa, unidentified
  REGION 1..81: note = Bos indicus x Bos taurus
QACVTFEDVAIYFSQDEWRLLNETQRFLYCDVMLENFALTTSLGCWHGVDKEEAASEQSVSVAVSHIHASRADSLTQMAHP

SEQ ID NO: 22108 - protein, 81 aa, unidentified
  REGION 1..81: note = Bos indicus x Bos taurus
RSCSGFSGLCASPIEELYGALISSWDSRTMTDGMVTFRDVAIDFSQEEWEFLDPAQRDLYVDVMLENYSNLVSLGKVICLK

SEQ ID NO: 22109 - protein, 81 aa, unidentified
  REGION 1..81: note = Bos indicus x Bos taurus
FQGRLTFQDVAIDFTQEEWECLDLDQQELYRDVMLENYRNLASLGLVVSKLDLVTFLEQMKNPWDVRRLEPPAIYTGRCEW

SEQ ID NO: 22110 - protein, 81 aa, unidentified
  REGION 1..81: note = Bos indicus x Bos taurus
LQGGVTFPDIAVRFSQREWRLLDETQRLLYLDVMLENYTLISSLGFWSGEEKVETSFEQSVSVAVSQARTSKEPSSSQKTH

SEQ ID NO: 22111 - protein, 81 aa, unidentified
  REGION 1..81: note = Bos indicus x Bos taurus
HSEGRLTFQDVAIDFTQEEWECLDLDQRELYRDVMLQNYGNLASLGLVSKLDLVTFLEQLKDSRNIRRMETTAIYPAVSPQ

SEQ ID NO: 22112 - protein, 81 aa, Camelus dromedarius
TEKESGMALSQGQLTFEDVAIKFSQEEWECLDAAQRALYRDVMLETYRNLLSLAEQRAGIPEKTQYFAFLPSDEQEFLFLI

SEQ ID NO: 22113 - protein, 81 aa, Camelus dromedarius
CPQDSVTFADVAVGFTQEEWTLLDSFQRNLYRDVMLENCKNLTTAGYQWFKPTLISWLEQEELRTEERGAVQGISVRTLVR

SEQ ID NO: 22114 - protein, 81 aa, Myotis davidii
FEESLTFDDVAVEFTSEEWQLLDPDQKDLYRDVMMENYSHLMALGYQAPKPDVLSKLERGEELWIVQDELHCPVFPELNQV

SEQ ID NO: 22115 - protein, 81 aa, Myotis davidii
VTFGDVAVDFSQEEWDCLNSSQRHLYSNVMLENYRILVSLGWESVCESEELTPKQDICEAQSSQKIIVKFKSCGLEYSNLR

SEQ ID NO: 22116 - protein, 81 aa, Myotis davidii
VSFEDVAVNFSLEEWALLDPSQKKLYRDVMLETFRNLVSIVIFEYMKQLTLKRNPMNVRNAERPSDLTVPYNHTEEFTKER

SEQ ID NO: 22117 - protein, 81 aa, Myotis davidii
EESAVTFGDVDVAFSPEEWGRLSCAQKALYRDVMLENYRNLVSLGLCCSKPEVISSLEQRTEPCMAESGLTGGQHPGQQSV

SEQ ID NO: 22118 - protein, 81 aa, Cercocebus atys
FEELVTFEDVFVDFSPEELSSLSAAQRNLYREVMLENYRNLVSLRYQFSKPDIISRLEAEESRAMETDSRHTVICQGEAHD

SEQ ID NO: 22119 - protein, 81 aa, Cercocebus atys
YDSVAFEDVAVNFTREEWALLGPSQKTLYRDVMWETIRNLDCIGMKWEDTDVEDQHKNPRRSLRCLIVERFSESNQIPGST

SEQ ID NO: 22120 - protein, 81 aa, Cercocebus atys
PQELVMFEEVSVCFTSEEWACLGPIQRALYWDVMLENYGNVTSLEWETMTENEEVTSKPSSSQRADSHKGTSKRLQGSVPQ

SEQ ID NO: 22121 - protein, 81 aa, Enhydra lutris
PQDLMTFEDVAVEFTQWEWGQLDPAQKDLYRVVMLENFKNLASLGFPVAKPYVISQLEKGKEPCVLEGEISTDWEKRPKAK

SEQ ID NO: 22122 - protein, 81 aa, Pongo abelii
MEGLVMFQDLSIDFSQEEWECLDTAQKDLYRDVMMENYSSLVSLGLSISKPDVISLLEQGKEPWMVSRDVLGGWCPGYFSD

SEQ ID NO: 22123 - protein, 81 aa, Pongo abelii
QGLLTFRDVAIEFSQEEWKCLDPAQRTLYRDVMLENYRNLVSLDTGFLLFHLADLKLPPSGDPPTSASETAAITDISSKCM

SEQ ID NO: 22124 - protein, 81 aa, Pongo abelii
MFKEAVTFKDVAVVFTEEELGLLDLAQRKLYRDVMLENFRNLLSVGHQTSHRDAFHFRREEKFWMMETATQREGNSGGKIQ

SEQ ID NO: 22125 - protein, 81 aa, Pongo abelii
PKPGPQEAVVFEDVAVYFTRIEWSCLAPDQQALYRDVMLENYGNLASLALISLLEQGEEPGALILQGAEQSVAKASLCTDS

SEQ ID NO: 22126 - protein, 81 aa, Pongo abelii
MDSVAFKDVSVSFSQEEWALLAPSQKKLYRDVMQETFKNLASISHMGERLCEGKEGSQCAETFSPNLSVTKKTAGVKPYEC

SEQ ID NO: 22127 - protein, 81 aa, Pongo abelii
VHGSVTFRDVAIDFSQEEWECLQPNQRTLYRDVMLENYSHLISLAGSSISKPDVITLLEQEKEPWIVIWSQNMDLRKYLQK

SEQ ID NO: 22128 - protein, 81 aa, unidentified
  REGION 1..81: note = Bos indicus x Bos taurus
THELLTFEDVAVDFTQEEWSLLDKSQKNLFRNVMMETIHHLVSVGESISKSDVISLLEQGKELWSKAAGGFQGQRPGEHQG

SEQ ID NO: 22129 - protein, 81 aa, Pan troglodytes
MGALTFRDVAIEFSLEEWQCLDTEQQNLYRNVMLENYRNLVFLGIAVSKPDLITCLEQEKEPWNLKTHDMVAKPPVICSHI

SEQ ID NO: 22130 - protein, 81 aa, Pan troglodytes
AQMLVTFKDVAVTFTREEWRQLDLAQRTLYREVMLETCGLLVSVGHRVPKPELVHLLEHGQELWIVKRGLSHATCAGQEPR

SEQ ID NO: 22131 - protein, 81 aa, Pan troglodytes
MAFEDVAVYFSQEEWGLLDTTQRALYRHVMLENFTLVTSLGLSTSRPHVVIQLERGEEPWVPSGKDMTLARNTYGRLNSGS

SEQ ID NO: 22132 - protein, 81 aa, Pan troglodytes
QVTFNDVAIDFTHEEWGWLNSAQRGLYKDVMVQNYENLVSVAGLSITKPYVITLLEDGKEPWTVEKKLSKVSFFSYTVLSI

SEQ ID NO: 22133 - protein, 81 aa, Camelus dromedarius
NVDFVISEDTAHSVAHLDIDCHSEQLIFEDVAIRFSQEEWECLVPAQRALYRDVMLETYRNLLSVVESSLGKQKFIFVENS

SEQ ID NO: 22134 - protein, 81 aa, Camelus dromedarius
TPEPVRFADVAVYFSLEEWGCLQPAQRALYRDVMRETYGHLGALGFRGTKPALISWVEKEAELWGPDARDPEVGECLTEAD

SEQ ID NO: 22135 - protein, 81 aa, Camelus dromedarius
PQGLVTFGDVAVDFSQEEWEWLDCAQRTLYRSVMLENYRSLVSLGLCVSKPEMISSLEQRKEPWTVKRKCTRGQCPDSEAV

SEQ ID NO: 22136 - protein, 81 aa, Myotis davidii
NLVGVTFEDVALYFSGTEWQLLDEAQRGLYLDVMLENFALLSSLGCCCGTRDLEASLEQNVSVRVSQAKKTKIPLSSQNSH

SEQ ID NO: 22137 - protein, 81 aa, Cercocebus atys
QGHVTFEDIAVYFSQEEWGLLDEAQRCLYHDVMLENFSLMASVAQLSESNHKDSCSQQKVTVSLNNCVAQCSPDDGHYTPK

SEQ ID NO: 22138 - protein, 81 aa, Cercocebus atys
EMGLLTFRDVAIEFSLEEWQHLDIAQRNLYRNVMLENYRNLAFLGIAVSKPDLITCLEQGKEPWNMTRHEMVDESPGICPL

SEQ ID NO: 22139 - protein, 81 aa, Enhydra lutris
QVSVAFQDLAVRFSEEEWQLLGEGQRALYRDVMRENYETLRSLGTDGLLPLSAFLSPAEPGGAMEGRRYAGEGQETPRGGG

SEQ ID NO: 22140 - protein, 81 aa, Enhydra lutris
SQDLVTFKDVAIDFSQEEWEWLNPAQRNLYKNMMLENYQNLVSLDSGSIYETQELFLKQFMYDDVLMERITDYGLECSTYR

SEQ ID NO: 22141 - protein, 81 aa, Enhydra lutris
MFQVTFSDVAIDFSHEEWGWLDSAQRDLYKDVMIQNYENLVSLAGLSIPKPYVITLLEDGKEPWMVEKKDWESRWENKELV

SEQ ID NO: 22142 - protein, 81 aa, Enhydra lutris
TGCPAEMAVPKPTGSAAEWEQLDPAQRDLYKDVMLENYSNLASMGFQAPKPDMISKLEKGEEPWLGKGKRPRQGGPSEIGR

SEQ ID NO: 22143 - protein, 81 aa, Enhydra lutris
VFQGSLSFEDVTVDFSREEWRLLDLAQKSLYRDVMLENYFNLISVGCQVPKQEVLFSLEQEEPRMLDGEISSHNCLGGDIG

SEQ ID NO: 22144 - protein, 81 aa, Enhydra lutris
PKVPVTFDDVAVHFSEQEWGNLSEWQKELYKNVMRGNYESLVSMDYAISKPDLMSQMERGERPTVQEQEDSEEGETPADPS

SEQ ID NO: 22145 - protein, 81 aa, Enhydra lutris
FTALFVLPKPKVISCLEQGEEPWVQGPLEFKNSSGELPSGLKVKSDTENHQPVCLSDLEIQVPGDIVSKKTRVKVPQKTTG

SEQ ID NO: 22146 - protein, 81 aa, Pongo abelii
RSQESLTFQDVAVDFTREEWDQLYPAQKNLYRDVMLENYRNLVALGYQLYKPEVIAQLELEEEWVIERDSLLDTHLDGENR

SEQ ID NO: 22147 - protein, 81 aa, Pongo abelii
LLTFRDVAIEFSQEEWKCLDPAQRTLYRDVMLENYRNLVSLVRRSEVCCIDIWAEVIVADISSKCMLKTLSSTGQGNTEVF

SEQ ID NO: 22148 - protein, 81 aa, Pongo abelii
FQELVTFRDVAIDFSRQEWEYLDPNQRDLYRDVMLENYRNLVSLGGHSISKPVVVDLLERGKEPWMILREETQFTEMGVSL

SEQ ID NO: 22149 - protein, 81 aa, Pongo abelii
SQGLVTFRDVAIDFSQEEWKWLQPAQRDLYRCVMLENYGHLVSLAGLSISKPDVVSLLEQGKEPWLGKREVKRDLFSVRVK

SEQ ID NO: 22150 - protein, 81 aa, Pongo abelii
VTFSDVAMDFFHKEWGWLDSAQRDLYKDVMVQNYKNLVSVAGLSVTKPHVITLLEDGKEPWMMEKKLSKGMIPEWESRWEK

SEQ ID NO: 22151 - protein, 81 aa, Pongo abelii
FQESVTFQDVAVDFTVEEWQLLDCAERTLYWDVMLENYRNLISVGFPITKTKVILKVEQGQEPWMVEGVNPHQSSPESRSV

SEQ ID NO: 22152 - protein, 81 aa, Pongo abelii
MGPLQFRDVAIEFSLEEWHCLDTAQRNLYRDVMLENYRNLVFLGIVVSKPDLITCLEQGKKPLIMKKHEMVANPSGPVLHI

SEQ ID NO: 22153 - protein, 81 aa, Pan troglodytes
QGLLTFRDVAIEFSQEEWKCLDPAQRTLYRDVMLENYRNLVSLDISSKCMMKEVLSTAQGNREVIHTGTLQRHESHHTGDF

SEQ ID NO: 22154 - protein, 81 aa, Pan troglodytes
YQDSVTFDDVAVEFTPEEWALLDTTQKYLYRDVMLENYTNLASVEWEIQPRTKRSSLQQGFLKNQIFTGIQMQTRSYSGWK

SEQ ID NO: 22155 - protein, 81 aa, Pan troglodytes
SLEKVTFEDVAIDFTQEEWAMMDTSKRKLYRDVMLENISHLVPLGYQISKSYIILQLEQGKELWREGREFLQDQNPDRESA

SEQ ID NO: 22156 - protein, 81 aa, Camelus dromedarius
EEEEEEIQSRELEDGPTDMQKVRICSEGGWVPALFDEVAIYFSDEEWEVLTEQQKALYREVMRMNYETVLSLGKALFSFVS

SEQ ID NO: 22157 - protein, 81 aa, Camelus dromedarius
VTVKDEEMDFTHVEEEQLNSAQRFVGMDMKVENCGSLVFWDSDAIPETKVSLSKQDAYEEIPPEQELIIQRLEKDDAWECG

SEQ ID NO: 22158 - protein, 81 aa, Myotis davidii
LGDPVAIEDVAVNFTLEEWALLDPPQKKLYRDVMKETFRNLDSIGQNWEDHYIEDLYKSQGRKLRCVTRKTSAAKSPQLGS

SEQ ID NO: 22159 - protein, 81 aa, Cercocebus atys
TGGDVTFSDVAIDFSHEEWAWLDSAQRDLYKDVMVQNYENLVSVGLSVTKPYVIMLLEDGKEPWMVEKKLSKDWESRWENK

SEQ ID NO: 22160 - protein, 81 aa, Cercocebus atys
PQGHLTFMDVAIEFSQEEWKCLDPGQRALYRDVMLENYRNLVSLGICLPDLSIISMLKQRREPLTVQSEVKIVKNPDGREC

SEQ ID NO: 22161 - protein, 81 aa, Cercocebus atys
KSLVTFEDVAVYFSQEEWELLDAAQRHLYHSVMLENLELVTSLGNTLSQHGDDQLMPCNISVEEVLPVRIPNTDSSTKKAN

SEQ ID NO: 22162 - protein, 81 aa, Cercocebus atys
VLGLQGSLTFRDVAVEFSLEEWQFLDTAQQNLYRNVMLENYRNLVFLGIAVSKPDLIIFLEQGKEPWNMKRHEMAEEPPGR

SEQ ID NO: 22163 - protein, 81 aa, Cercocebus atys
NCSGLKFKDVVIYFSQKEWECLQSAQKDLYQDVMLENYSNLVLLGLSDTKPNVISLLEQKSEPWLVKRNETKEWCPDWEFG

SEQ ID NO: 22164 - protein, 81 aa, Vulpes vulpes
LLTFRDVAIEFSEEEWECLDAAQRALYRDVMLENYRNLVSLDFSTRCMSKELPPKDDINNGELFQTLILERHRSHDFDLRE

SEQ ID NO: 22165 - protein, 81 aa, Vulpes vulpes
SEESVTFEDVAIYFSENEWTGLAPAQRVLYRDVMLENYGAVAALGYPFLKPAGISHFEQVEEPLNLKLQGEGPSLTCTEGV

SEQ ID NO: 22166 - protein, 81 aa, Otolemur garnettii
LQESVTFQDVAMDFTLEEWQLLDCAKRTLYWDVMLENYRNLISVGCPVTKTKVIFKVEQGQEPWRAERGKPHWSHPEADYL

SEQ ID NO: 22167 - protein, 81 aa, Otolemur garnettii
LQGSVTFKDVTMAFTQKEWERLDPTQKNLYKDVMLENYSNLASMAGFQAPKPDMISKLEKGEEPWLGKGKRPNQGHSNKIA

SEQ ID NO: 22168 - protein, 81 aa, Otolemur garnettii
WSQMPVTFEDVALYLSREEWGRLDHTQQNFYRDILQRRNGLSLGFPFSRPFWAAQVQGKDEASSSSQQTGDEPAERGMSTG

SEQ ID NO: 22169 - protein, 81 aa, Otolemur garnettii
FLELLTFQDVSIEFSVDEWACLDPAQQTLYQDVMLENYRHLVFLAGLTLSKPDIITCLEQSKEPWKVKAQQTVVKPPVQPS

SEQ ID NO: 22170 - protein, 81 aa, Vulpes vulpes
SQGLLTFRDVTIEFSQEEWGCLNHTQRELYRDVMLENYGNLLFLGLVVSKPDLIIFLEQKRELWDVKGKETVAFHPDLVVS

SEQ ID NO: 22171 - protein, 81 aa, Otolemur garnettii
YQDSVTFNDVAVDFTQEEWVLLAQTQKILHKDVMLENYKNLATVGYQLIKPSLISWLEQEEELRTVQGGDLQDWEILLKTN

SEQ ID NO: 22172 - protein, 81 aa, unidentified
  REGION 1..81: note = Bos indicus x Bos taurus
PTVSFKDVAVTFTWVKWGHVDLAQRTVYREVVLETYPHHLCLSLFPGPELPKPDVISQLEQGAELWVAERGLAQGCRPGES

SEQ ID NO: 22173 - protein, 81 aa, Pan troglodytes
VTFDDVAVDFTPEEWALLDTTEKYLYRDVMLENYMNLASVDFFFCLTSEWEIQPRTKRSSLQQGFLKNQIFTGIQMQTRSY

SEQ ID NO: 22174 - protein, 81 aa, Pan troglodytes
AQESVMFSDVSVDFSQEEWECLNDDQRDLYRDVMLENYSNLVSMAGHSISKPNVISYLEQGKEPWLVDRELTRGQWPVLES

SEQ ID NO: 22175 - protein, 81 aa, Pan troglodytes
SQGRVTFEDVTVNFTQGEWQRLNPEQRNLYRDVMLENYSNLVSVGQRETTKPDVILRLEQGKEPWSEEEEVLGSGRAEKNG

SEQ ID NO: 22176 - protein, 81 aa, Camelus dromedarius
AQGCVTFEDVTIYFSQEEWGLLDEAQRLLYCDVMLENFALIASLGLTSFRSHIVAQLEMGAEPWVPDQVDMTSAMARGAYK

SEQ ID NO: 22177 - protein, 81 aa, Camelus dromedarius
TQGPVVFEDVAVDFTQEEWALLDLAQRNLYRDVMLENFQNLVSLGYPLHTPSLISQWKQEEEPVTVKKGPTQEEHQEGFET

SEQ ID NO: 22178 - protein, 81 aa, Camelus dromedarius
APLPLTFEDVAIYFSEQEWRGLEAWQKELYKQVMRTNYEILVSLDDGLPKPELISWIEQGRELFRNWGESQRSGNVICPSA

SEQ ID NO: 22179 - protein, 81 aa, Myotis davidii
MAEALVQWRQLNPPQADVPQKHRNLVLLGLPISKPDVISQLESGEKPEREASKTTSPDGEIRPEGKELTREQDVSEEESAP

SEQ ID NO: 22180 - protein, 81 aa, Cercocebus atys
MESVTLEDVAVEFIQEWALLDSARRSLCTYGMLDQCRTLTSRGAGAVPEDAAGALYRSEGDATDSRGPASSPGAALVSGMH

SEQ ID NO: 22181 - protein, 81 aa, Cercocebus atys
LVMFQDLFIDFSQEEWECLDTAQKDLYRDVMMENYSSLVSLDSEFRCKTKDSCLPKEIYEVTSSQWVRMEKCHSLVGSSVR

SEQ ID NO: 22182 - protein, 81 aa, Otolemur garnettii
SVMFKDVAIDFSQEEWEYLDSAQRDLYRDVMLENYNNLVSLDLPLMYANKDLSPKKDIYEIELSQWEMSNRLENSDIEEPN

SEQ ID NO: 22183 - protein, 81 aa, Otolemur garnettii
SLGSELFRDVAILFSQEEWQWLVPAQRDLYRDVMLETYSNLVSLGLPISKPDVISFLEQGKEPWIVERVTTGDLCPVLESG

SEQ ID NO: 22184 - protein, 81 aa, Otolemur garnettii
QSFVTFEDVAIYFSQEEWELLDDVQRHRYQHVMQENLALIAFQVCWCLVIVPEPGAALSFPQLAPGVRDPKAHPSNLKTLL

SEQ ID NO: 22185 - protein, 81 aa, Otolemur garnettii
QGHVVFEDVAIYFSQEEWGHLDEAQRSLYRDVMLENMALLSSLGCWQETPGAEAPSEQGVSVVLSQVITPVPCVSSQKIQP

SEQ ID NO: 22186 - protein, 81 aa, Enhydra lutris
VQGQVNFEDVAVYFSQEEWGLLDEAQRRLYRDVMLETFALVASLRDESSMSHGVPSLELGSKPWGSDWADVTPARTREAQG

SEQ ID NO: 22187 - protein, 81 aa, Enhydra lutris
GLVSFEDVAMDFSREEWQQLDPAQRSLYRDVMLEIYSHLLSVERALGLKTSQQKIFEKASFHNKESEVTRGGPWCSISEDL

SEQ ID NO: 22188 - protein, 81 aa, Enhydra lutris
QESLTFKDVAVDFTLEEWGQLGPGQRELYRDVMLENYRNLLSLGAGPPGSKPDVISRLERGEEPRMEKREAQLAACPALDT

SEQ ID NO: 22189 - protein, 81 aa, Enhydra lutris
AGSQGQLTFRDVAIEFSLEEWGRLTHMQQELYRDVMLENYRHLLFLGLVSKPDLVTFLEQKKEPWEVKRKESIATHPGRWE

SEQ ID NO: 22190 - protein, 81 aa, Pongo abelii
VTFEDVAVVFTDEEWSHLVPTQRDLYKEVMLENYNSIVSLDWETKPEIHDASNEKSEGSLRECLGRQSPLCPKFEVHTPDG

SEQ ID NO: 22191 - protein, 81 aa, Pongo abelii
MGPLTFMDVAIEFSLEEWQCLDPAQQNLYRHVMLENYRNLVFLGIAVSKPDLITCLEQGKEPWNMKRHEMVAKHLVMFYYF

SEQ ID NO: 22192 - protein, 81 aa, Pongo abelii
RQAFLAFGDVTVDFTQKEWRLLSPTQRALYREVTLENYSHLVSLGILHSKPELIRRLEQGEAPWGEERRRRPGPCTGIYAE

SEQ ID NO: 22193 - protein, 81 aa, Pongo abelii
MFKEAVTFKDVAVAFTEEELGLLGPAQRKLYRDVMVENFRNLLSVGHQPFKQDVSPIERNEQLWIVTTATRRQRNLGEKNQ

SEQ ID NO: 22194 - protein, 81 aa, Pongo abelii
PQVSLTFDDVAVLFTRDEWRKLAPSQRNLYRDVMLENYRNLVLTRLSFTKPKVISLLQQGEDPWKVEKDSSGNSSLGSKSS

SEQ ID NO: 22195 - protein, 81 aa, Pongo abelii
YLGPVTFEDVAVLFNEAEWKRLSLEQRNLYKEVMLENLRNLVSLESKPEVHTCPSCPLAFGSQQFLSQDELHNHPIPGFHA

SEQ ID NO: 22196 - protein, 81 aa, Pongo abelii
QGHVTFEDIAVYFSQEEWGLLDEAQRCLYHDVMLENFLLMASVAGLSQSNHKDSCSQQKVPVSLNNCAAQCSPDDGHYTPT

SEQ ID NO: 22197 - protein, 81 aa, Pongo abelii
QGLVTFRDVALDFSQEEWEWLKPSQKDLYRDVMLENYRNLVWLGDGCSCHSTLRTTATAEASSSSSSIQASFHSLALPLMS

SEQ ID NO: 22198 - protein, 81 aa, Pongo abelii
EKGPLTFRDVVIEFSQEEWQCLDRDQQDLYRKVMLENFRNLVFLGIDVSKPDLITCLEQGKDPWNMKRHSMVATPPGVFFV

SEQ ID NO: 22199 - protein, 81 aa, Pongo abelii
MKPGVISHAPDSVVPAAFPFPKPDLIFQLEQGEAAWGPDPWTLDGGEALRGMCTGGKTKTKNEEQTAQLNISKESESHRLI

SEQ ID NO: 22200 - protein, 81 aa, Pongo abelii
SYEGSVSFRDVAIDFSREEWRHLDPSQRNLYRDVMLETYSHLLSVGYQVPKPEVVMLEQGKEPWALQGERPRHSCPGEKLW

SEQ ID NO: 22201 - protein, 81 aa, unidentified
  REGION 1..81: note = Bos indicus x Bos taurus
DPVAFEDVAVNFTLEEWALLGPSQKKLYRDVMRETLTNLALIRDEWEDHNTEDQYKNQERNLRSHILQRLCESKEGSQGGE

SEQ ID NO: 22202 - protein, 81 aa, unidentified
  REGION 1..81: note = Bos indicus x Bos taurus
LCLQVSVSFEDMTVDFRREEWQHLDSAQRFLYQDMTLKTTATSSHWVWNQVPKPEVIFKLEQGEGPWTLEEETPHQSCSDV

SEQ ID NO: 22203 - protein, 81 aa, unidentified
  REGION 1..81: note = Bos indicus x Bos taurus
LTPLSSSVFCDNKNSSHGPFLKCVSLLEQLTFKDVAIEFTQEEWECLDPAQRALYRDMMWEIYRNLVSVVGTPIRMLQYNY

SEQ ID NO: 22204 - protein, 81 aa, Pan troglodytes
AAVSVTFKHVTMAFTQKEWKQLDPAPRNLYNDVMLENYSNQASMGCQAPKPDMISKLEKGEAPWLGKGKRPSQGCPSKIAR

SEQ ID NO: 22205 - protein, 81 aa, Pan troglodytes
QGLLTFRDVAIEFSQEEWKCLDPAQRTLYRDVMLENYRNLVSLGISSKCTMKEFSSTAQGNREVIHTGTLQRHESHHIGDF

SEQ ID NO: 22206 - protein, 81 aa, Pan troglodytes
PQGLLTFRDVAIEFSQEEWKCLDPAQRTLYRDVMLENYRNLVSLDISSKCMMKEFSSIGKGNTEVIHTGTLQRLASHHIGE

SEQ ID NO: 22207 - protein, 81 aa, Camelus dromedarius
AAGSVTFKDVTMAFTKKEWEQLDPAQRSLYKDVMLENYSNLASMVGYQALKPDMICKLEKGEELWLGKGKSPKRGGLSETA

SEQ ID NO: 22208 - protein, 81 aa, Camelus dromedarius
MFSDVSIDFSQEEWECLNDDQRDLYRDVMLENYSNLVSMGHCISKPDVISFLEQGKEPWLVDREPTRYQWPVNFYGLYEIK

SEQ ID NO: 22209 - protein, 81 aa, Camelus dromedarius
KVMSQGLVTFKDVALDFSQEEWEWLDSSQKDLYRDVMLENYRNLVWLGLSISKPNMISLLEQGKEPWLVEREMSDDQYAGE

SEQ ID NO: 22210 - protein, 81 aa, Myotis davidii
ERESVTFKDVAVDFTQEEWHHMAPAQRRLYRDVMLENYSNLVSLAGYQVSKPEVIFKLEQGEEPWLSEGEIQRSVCPDWKT

SEQ ID NO: 22211 - protein, 81 aa, Myotis davidii
QDSVVFEDVAVDFSQEEWTLLDRAQRSLYREVMLENFRNLASLGLETQLKSNESVTSQDIYGEKASNQQRKEKLKKDDSWS

SEQ ID NO: 22212 - protein, 81 aa, Myotis davidii
VQEPVTFADVTVLFTPEEWMFLDSAQRSLYRDVMLENYRNLASVEPQPQPQESILNQDTFAKIVSIGIERCERIYAGGNCP

SEQ ID NO: 22213 - protein, 81 aa, Myotis davidii
EPVTFKDVAVVFSEEELGLLDSVQRKLYRDVTLENFRNLVSVGHLFSKPDVISQLEREEQLWMTEIQTQRGGHSAENCAAR

SEQ ID NO: 22214 - protein, 81 aa, Enhydra lutris
VLQGLSFKDVAVNFTEEEWRELDPAQRDLYRDVMLENYRNLVSLGFPFSKPDIISQLEKAENRWMQEREVPRSSCIYLETR

SEQ ID NO: 22215 - protein, 81 aa, Enhydra lutris
SQGLVTFKDVAVCFSQDQWSDLDPAQKEFYGEYVLEEDCGIVVSLSFPIPRLDEISHVREEEPLVPDIPEPQEPQEPEILS

SEQ ID NO: 22216 - protein, 81 aa, Enhydra lutris
SYEGSVSFRDVAVDFSREEWQHLDLAQRNLYRDVMLETYSHLLSVGYEVPQPEVFMLEQGQEPWALQRDPHESCPEELWQI

SEQ ID NO: 22217 - protein, 81 aa, Enhydra lutris
DSVTFEDIAVYFSWEEWRLLDEAQRCLYHDVMLENFTLVSSLGCCCGAEDEEAPFAQSASVGVSQTWTPRAALSSRKTHPC

SEQ ID NO: 22218 - protein, 81 aa, Enhydra lutris
PQAKVTFEDVAVLLSQEEWDRLGPAQRGLYRHVMMETYGNVVSLGLPGSKPNVISQLERGEEPWVLDGQGAEETRGLGSGR

SEQ ID NO: 22219 - protein, 81 aa, Enhydra lutris
GQGSVSFRDVTVDFTRDEWLQLTGTQRTLYRDVMLENYSHLVSVGCHLTKPEVISRLEQGEELWPSEAEFPDQGDQDRNQE

SEQ ID NO: 22220 - protein, 81 aa, Pongo abelii
LTFRDVAIEFSQEEWKSLDPVQKALYWDVMLENYRNLVFLGKDNFALEVKICPCVFLYFLCCLSWEPFHYLTETEVLLTHR

SEQ ID NO: 22221 - protein, 81 aa, Pongo abelii
THARVVFEDVAIYFSQEEWGHLDEAQRLLYRDVMLENLALLSSLGSWHGAEDEEAPSQQGFSVGVSEVTTSRPCLSSQKVH

SEQ ID NO: 22222 - protein, 81 aa, Pongo abelii
QAMVKIEDMAVSLILEEWGCQNLARRNLSRDNKQENYGSAFPQGGENRNENEESTSKAETAEDSASHGETAGRFQKEFGEK

SEQ ID NO: 22223 - protein, 81 aa, Pongo abelii
IAVSKPDLITSLEQGKEPWNMKRHEMVDEPSGIYPHFAQDLWPEQGMEDSFQKAILRRYEKYGHENLQLRKGCKSVDECKV

SEQ ID NO: 22224 - protein, 81 aa, Pongo abelii
AQVSVTFDDVAVTFTKEEWGQLDLAQRTLYQEVMLENCGLLVSLGCPVPRPELIYHLEHEQETWTRKEDLSQGTCPGDKGK

SEQ ID NO: 22225 - protein, 81 aa, Pongo abelii
VTFEDVAVYFIRKEWKRLEPAQRDLYRDVMLENYGNVFSLDWTHVSLTTQKVMLAWLTGTLSVGKGLCSSELASVEPPDTF

SEQ ID NO: 22226 - protein, 81 aa, Pongo abelii
PAQGIVTFEDVAVYFSWKEWGLLDEAQKCLYHDVMLENLTLTTSLGGSGAGDEEACYQQSTSPQRMSQVRIPKALPSPQKT

SEQ ID NO: 22227 - protein, 81 aa, Pongo abelii
SQGLLIFRDVAIEFSPEEWSYLDPAQQNLYRDVMLENYRNLVSLGIAVSKPDLITCLEQRNEPWDVKKHETVARHPAVSSH

SEQ ID NO: 22228 - protein, 81 aa, Pan troglodytes
LPAKDSAWPWEEKPRYLGPVTFEDVAVLFTEAEWKRLSLEQRNLYKEVMLENLRNLVSLVLELGSPRSGLLPLDLNLDLWL

SEQ ID NO: 22229 - protein, 81 aa, Pan troglodytes
LLTFRDVAIEFSQEEWKCLDPAQRTLYRDVMLENYRNLVSLVLRSEVCCTDIWAEVIVADISSKCMLKTLSSTGQGNTEVI

SEQ ID NO: 22230 - protein, 81 aa, Pan troglodytes
QGRLTFRDVAIEFSLAEWKCLNPSQRALYREVMLENYRNLEAVDISSKRMMKEVLSTGQGNTEVIHTGTLQRHQSYHIGDF

SEQ ID NO: 22231 - protein, 81 aa, Camelus dromedarius
LQALMAFRDVAVAFTQKEWKLLSPAQRILYRDVMLENYSHMVSLGIAFPKPKLITQLEQGDEPWREESEYLPDLCPGENIS

SEQ ID NO: 22232 - protein, 81 aa, Camelus dromedarius
SLSFEDVAVDFTRQEWHRLDPAQRTMHKDVMLENYSNLASVEALKLRQLGPRPVPFPINRPLRGQTRDDLQVGTRGRTVDI

SEQ ID NO: 22233 - protein, 81 aa, Vulpes vulpes
WSQMPVTFEDVALYLSREEWGRLDHTQQSFYRDILQKRNGLALGFPFSRPFWTSQGQGKGEASSSCQQMGDEEEEKTGAFE

SEQ ID NO: 22234 - protein, 81 aa, Otolemur garnettii
QQGQVNFEDVFVYFSEDEWVLLDDTQRLLYRDVMLENFALTASLGCQGMEPEKISFEQTVSVEGLSQMRPPKGDPSGKVHS

SEQ ID NO: 22235 - protein, 81 aa, Vulpes vulpes
SLELVSFEDVAVNFTWEEWQDLDHAQRTLCKVVMLETYSSLASLDVQTANDLMETQQEHQSRRLWQFGFSNQETSTEERTD

SEQ ID NO: 22236 - protein, 81 aa, Otolemur garnettii
EELVTFKDVAVDFTQEEWGQLDSPQRALYRDVMLENYQNLLALGAGPPVCKPDVISHLERGEEPWQVQTEVPGGPCPEWEP

SEQ ID NO: 22237 - protein, 81 aa, Otolemur garnettii
QKLLTFQDVAIEFSPEEWTLLDPAQRNLYRNVMIENYRNLVSLGLAASKPDLITCLEQSKEPWNMKREEVTAKHPEMSSHY

SEQ ID NO: 22238 - protein, 81 aa, Vulpes vulpes
LYLELVILRDVAMDFTLEDWEHLGLDQGDLFWDTALDNYQNLFLLNPSKPKLTSCPDGGEKLEVLVGASPESECPGTAGAK

SEQ ID NO: 22239 - protein, 81 aa, Otolemur garnettii
KPGAVSFADVAVYFSPEEWGCLRPAQRTLYRDVMRETYGHLGALGVGGTKPALISWVEEEAELWGPDAQDPEVARCTTDAD

SEQ ID NO: 22240 - protein, 81 aa, Pongo abelii
SLELVSFEEVAVHFIWEEWQDLDDTQRTLYRDVMLETYSSLVSLGHHITKPEMIFKLEQGAEPWIVEAPDLRLSAVQILDD

SEQ ID NO: 22241 - protein, 81 aa, Pongo abelii
SASQVAKTTGNHPHSRDLVTFTDVAVNFTKEEWTLLDPAQRNLYRDVMLENSRNLAFIDWATPCKTKDATPQPDILPKRTF

SEQ ID NO: 22242 - protein, 81 aa, unidentified
  REGION 1..81: note = Bos indicus x Bos taurus
MLENYGNLASLGLVSKLDLVTFLEQLEDPRNIRRMGTTAIYPAMSPQDTQDLMPKNPALEGLFPKANVRIYQTFHLGNLNL

SEQ ID NO: 22243 - protein, 81 aa, unidentified
  REGION 1..81: note = Bos indicus x Bos taurus
SQGPVTFEDVAVYFSQEEWRILDETQRRLYSYVMLETFALVASLGLASSRSYVVVPLELGGEPWVQDRVDMTPGTARGAQS

SEQ ID NO: 22244 - protein, 81 aa, unidentified
  REGION 1..81: note = Bos indicus x Bos taurus
LQGPVTFEDVAVYFSLEEWGLLNLTQKSLYRDVMLENFGLIGSLGFAPSRSSKVAQMEGEEEAWVPNMVDSVVSRAEARKG

SEQ ID NO: 22245 - protein, 81 aa, unidentified
  REGION 1..81: note = Bos indicus x Bos taurus
MFQDVAIDFTQEEWECLDLSQRELYRDVMLENYGNLASLGLVSKVDLVTFLELLKDPRNMRRMETTAIYPAMSPQDTQDLM

SEQ ID NO: 22246 - protein, 81 aa, Pan troglodytes
LSFSHFLDVAIEFSQEEWKCLDPAQRTLYRDVMLENYRNLVSLDISSKCTMKEFLSTAQGNREVFHAGTLQIHESHHNGDF

SEQ ID NO: 22247 - protein, 81 aa, Camelus dromedarius
QEVVTFEDVAVYFSWEEWELLDPAQRRLYRDVMQETCRNLASVAQAERPLGHAALARAQRAVRGPWHAPLRSAVPVRRRRA

SEQ ID NO: 22248 - protein, 81 aa, Camelus dromedarius
FQGSLSFEDVTVGFTQEEWQQLDPAQRTLYRDVMLENYSHLISVGYCISKPELIFKLEQGEQPWMLEKESPSQDYPDKTGL

SEQ ID NO: 22249 - protein, 81 aa, Camelus dromedarius
AALRDPPQDVFVYFSQEEWGLLDEAQRRLYWDVMLESLALLASLSITSSNSHSVTQLQQGGEPWVPGQLNLIPATEKEAQP

SEQ ID NO: 22250 - protein, 81 aa, Camelus dromedarius
LQGPVSFKDVAVDFTQEEWQQLDPEQKTTYRDVMLENYSHLVSIGCHVIKPEVITKLEQGEEPWMVEGGFLLQSYPGVLMR

SEQ ID NO: 22251 - protein, 81 aa, Camelus dromedarius
VKKPVSFEDVAVNFTQEEWECLNASQRVLYQDVMSETFRNLVSVARIFLSNPDLITKLEQEEKQWRADLCPSNGGLHSGGK

SEQ ID NO: 22252 - protein, 81 aa, Camelus dromedarius
REQLTFEDVAITFSQEEWECLVPAQRALYRDVMLETCRNLLSVDMSHIHVIKKLQLKANIDRELFQTVMTEIHERTERKHF

SEQ ID NO: 22253 - protein, 81 aa, Camelus dromedarius
TDLSRCLQGCVVFEDVAVHFSQEEWGLLDEVQRLLYRDVMLQNIALLSSVDIVGLDTTFYSLLTGHQQPGLVESHLQRRKL

SEQ ID NO: 22254 - protein, 81 aa, Myotis davidii
FQGSVTFRDVAIDFSPEEWEFLDSAQRDLYRDVMWENYRNFISLAGHSISAPDVITLLDDGKEPWMLMRERIRRHYLEKDI

SEQ ID NO: 22255 - protein, 81 aa, Myotis davidii
SLLDMNFEDVAIAFPQEEWGLLDDAQRRLYCDFKGGGVVCSSRSPDGCLGRQEVESRVVHGSTAESAKPTLERSGRGYGYT

SEQ ID NO: 22256 - protein, 81 aa, Vulpes vulpes
MLENYSNLISLGYQATRPEAMVYLEEGEQGVVEREFLSQCSPERPLQCFSRGECLKQKSDSKFQSKNYAEMNSDQSNGHGK

SEQ ID NO: 22257 - protein, 81 aa, Vulpes vulpes
MLETYNHLVSLEIPFSKPKLISQLEQGEEPWIEERQHPLGLCPGSKLNIQLCPHCPLAFTSQQGLSQHMWFSHLPQLFSSL

SEQ ID NO: 22258 - protein, 81 aa, Otolemur garnettii
QESLTFQDVAVDFTREEWDQLYPAQKSLYRDVMLENYRNLVALGIGHQLYKPEVIAQLEQEEQWMLEKNSPLDTHPDGKNQ

SEQ ID NO: 22259 - protein, 81 aa, Otolemur garnettii
LQVPVSFEDVTVDFSQEEWQQLDSTQRRLYQDVMLENYSHLLSVGFEVPKPEVIFKLEQGEEPWMLEEGAPHQSSSDGKFG

SEQ ID NO: 22260 - protein, 81 aa, Otolemur garnettii
FQGSVSFKDVAVNFTEEEWKELNPAQRVLYRDVMLENYRNLVSLVGFPFSKPNIISQLEQVVNPQRQTEEEELPRSSCCPS

SEQ ID NO: 22261 - protein, 81 aa, Enhydra lutris
DRVPLSFEDVAVGFSWEEWQLLAPSQKDLYRDVMLENYRNLVSVGYQASKPDSLFQSLQGEPPWTVEGAARSQSCPEEIWE

SEQ ID NO: 22262 - protein, 81 aa, Enhydra lutris
FQGSVTFRDVAIDFSQEEWEWLQPAQRDLYRHVMLENYSHLVSLGLNISKPYVVSLLEQGRDPWLEKGDVRRDLFLESKGE

SEQ ID NO: 22263 - protein, 81 aa, Enhydra lutris
SQGSLTFEDVAVNFTREEWNQLYPAQKILYRDVMLENYRNLVALGHQLYKPEVISQLEKEEQRGMESYSTLDAHADGESRP

SEQ ID NO: 22264 - protein, 81 aa, Pongo abelii
RLIRDQDLGASLLPAAPQWRHLDSTQKEQYWDLMLETYGKMVSGGISHPKSDLTNSIEFGDEPAGLYLHVNEKIPRPTCIG

SEQ ID NO: 22265 - protein, 81 aa, Pongo abelii
YEEMVTFEDVAVHFTKTEWTGLSPAQRALYRSVMLENFGNLTALGYPVPKPALISLLEGGDMAWGLEAQDDPLAEMTKNVC

SEQ ID NO: 22266 - protein, 81 aa, Pongo abelii
QDSVTFDDVAVDFTQEEWTLLDPSQRDLYRDVMLENYENLASVGHHLFKPSVIYWLEEEEEMRAGWRVLQEWRLKTKGPAL

SEQ ID NO: 22267 - protein, 81 aa, Pongo abelii
DSVTFEDVAVDFTQEEWTLLDQTQRNLYRDVMLENYKNLVAVDWESHINTKWSAPQQNFLQGKTSSVVEMSLTLSPRLECS

SEQ ID NO: 22268 - protein, 81 aa, Pongo abelii
QGLLIFRDVAIEFCPEECQYLDAAQQNLYNDVMLENYRNPVFLGIVFSKPDVVTCLEQRKKPWSMKHPGHVANLCSHFTQD

SEQ ID NO: 22269 - protein, 81 aa, Pongo abelii
RPGAVSFADVAVYFSPEEWGCLRPAQRALYRDVMRETFGHLGALGFSGPKPAFISWVEGEVEAWSPEAQDPDGESSAAFSR

SEQ ID NO: 22270 - protein, 81 aa, unidentified
  REGION 1..81: note = Bos indicus x Bos taurus
TFKEAVTFTDVAVTFTEEEFRLLDSAQKKLYQDVMLENFRNLVSVGCHPFRHDIFHLEKEKRLWVVKTATQREGKSEEKIQ

SEQ ID NO: 22271 - protein, 81 aa, unidentified
  REGION 1..81: note = Bos indicus x Bos taurus
MTFEDVAVEFTWWEWGQLDPTQKDLYWEVMLENFKNLASLGFPVSKPYMICLEEGEEPCILEREISTGVHSDWERRPQAKK

SEQ ID NO: 22272 - protein, 81 aa, Pan troglodytes
SAQGTVTFEDVAVNFTWEEWNLLSEAQRCLYRDVTLENLALISSLGMTFLHVCQALDSLRQVIPTSASQSAGITGVSHCAW

SEQ ID NO: 22273 - protein, 81 aa, Pan troglodytes
GPVSFKDVAVDFTQEEWQQLDPDEKIAYGDVMLENYSHLVSVGYDYHQAKHHHGVEVKEVEQGEEPWIMESEFPCQHSPAF

SEQ ID NO: 22274 - protein, 81 aa, Pan troglodytes
AHALVTFRDVAIDFSQKEWECLDTTQRKLYRDVMLENYNNLVSLAGYSGSKPDVITLLEQGKEPCVAAKDVTGRQCPGLLS

SEQ ID NO: 22275 - protein, 81 aa, Camelus dromedarius
ALALVSFEDVAITFTGEEWRHLDLAQRTLYQEVMLETCGLLVSLGHPVPKPELIHLPEHGQELWTVKRGLSRSTYSGEKAK

SEQ ID NO: 22276 - protein, 81 aa, Camelus dromedarius
CQDPVTFEDVAVVFTDEEWRRLVPIQRDLYKEVMLENYKSVVSLGLPVPGPDVIFQLKRGDAPWIMELHGSEGTECAENVC

SEQ ID NO: 22277 - protein, 81 aa, Camelus dromedarius
SQGLLSFTDVSMEFTWEEWQLLDSTQKHLYRDVTLENYSNLLSVGYHGSKPDLIFKLEQGEEPWIINARLSRQSCPEGWKE

SEQ ID NO: 22278 - protein, 81 aa, Callithrix jacchus
GWLTNYSQDSVTFEDVAVDFTPEEWTLLDQTQRNLYGDVMLENYKNLIAVDWESHINTKWTAPQQNFFQEKTFSMVEMNSE

SEQ ID NO: 22279 - protein, 81 aa, Monodon monoceros
FPVAFDDVALYFLEREWEILEKWQKDMYQQEMKTNYESLDSLGCISSKPDLITWMEQGRMLLIRDQGHLEKTQMILSLSGD

SEQ ID NO: 22280 - protein, 81 aa, Callithrix jacchus
MEPLGFRDVAIEFSLEEWHCLDTAQRNLYWDVMLENYRNLVFLGIFVSNQDLMNCVEQEKKSLTVKSHEMIATSPVMHSHF

SEQ ID NO: 22281 - protein, 81 aa, Macaca mulatta
VTFEDVAVLFTEAEWKRLNLEQRNLFKEVMLENLRNLVSLEWLRSARESTRRRAKLSQSTGAQDSAIGWGVRHLPLHTVSP

SEQ ID NO: 22282 - protein, 81 aa, Callithrix jacchus
LTFRDVTIEFSQEEWRCLDPAQKTLYRDVMLENYRNLFVSISSKCMMKAFSCTGPGNTDVFHTGSLERYESHHIGDFCLQE

SEQ ID NO: 22283 - protein, 81 aa, Monodon monoceros
FSISKPDVLSLLEQGKDPWKVVRDVTRGLSPDWESRCETKKLSSKREIYELEASQWEIVEQLTSRKWECKSFQDDKECRDQ

SEQ ID NO: 22284 - protein, 81 aa, Bos taurus
WDRLGPAQRGLYRHVMMETYGNVVSVGSKPEVISQLERGEEPWVLDKQGNEQLRGWGISRSYEPEQSFCPSPSPARPLEGQ

SEQ ID NO: 22285 - protein, 81 aa, Bos taurus
ALALISFEDVAITFTGEEWRHLDLAQRTLYQEVMLETCGLLVSLGNPVPKAELIHLLEYGPELWTVKRGLSRNTCTGMRRS

SEQ ID NO: 22286 - protein, 81 aa, Ovis aries
VVFEDVAVDFTQEEWALLNLTQRNLYRDVMLENFRNLASLGFEIQLKINESVAPQDTYGKISNEQDVVGFKRSDSSLSILH

SEQ ID NO: 22287 - protein, 81 aa, Ovis aries
SEDLVTFGDVAVNFSQEEWEWLNPAQRSLYRTVMLDNYRSLVSLGVSVSKPDVISLLEQGKAPWMVEEEEPRGACPDWEYA

SEQ ID NO: 22288 - protein, 81 aa, Ovis aries
MDPMQRDLHKDVMLENYRNLVSLGLAISKPDMISHLEDGKGPWVVVREISRTSFSELETKPTTKNIIPTEDFSKKHLSQNA

SEQ ID NO: 22289 - protein, 81 aa, Ovis aries
QLTIEDVAIEFTPEEWECLAPAQRTLYWDVMLETYRNLLSVDISPIHIIKNLQPKENTNSTDTFQTVILGRHESPGVKDFY

SEQ ID NO: 22290 - protein, 81 aa, Ovis aries
LSQERLTSEDVAIEFTQEEWEFLDPAQRALYRDVMLETYRNLLSVGEDDFLPELPLGICIFPVCPLGGPDVFNLRVLVTQP

SEQ ID NO: 22291 - protein, 81 aa, Vulpes vulpes
AQGQVNFEDVAVYFSPEEWGLLDEAQRLLYHDVMLENLALMASLGYESSMSHGFASLELGSKPWGSDWADVTPARTRDTQG

SEQ ID NO: 22292 - protein, 81 aa, Otolemur garnettii
FQVEVTFEDVAVLLSQEEWDRLGPAQRGLYRNVMMETYGNVVSLAGLPGAKPEVISQLERGEEPWVLDRKGAKSQGLGSGH

SEQ ID NO: 22293 - protein, 81 aa, Otolemur garnettii
LQGPVSFKDVAVHFTREEWQCLDAPQRELYREVMLENYINLISVGCQTTKPAIIHKLEQGEEPWIKEKETSRRSNPGELGS

SEQ ID NO: 22294 - protein, 81 aa, Otolemur garnettii
GLLSFMDVSVEFTWEEWQLLDPTQKYLYRDVILENYNNLVSVGYHDTKPDLVFKLEQGEEPWIVNTKVSCQSCPEGWEEWY

SEQ ID NO: 22295 - protein, 81 aa, Pan troglodytes
MMTFRDVAIDFSQEEWKWLQPAQRDLYRCVMLENYGHLVSLGLSISKPDVVSLLEQGKEPWLGKREVKRDLFSVSESSGEI

SEQ ID NO: 22296 - protein, 81 aa, Pan troglodytes
VIFKDMAVVFTKEELALLDKAQINLYQDVMLENFRNLMSVSEDGIKNNILNLQEKGLSYLLQEVLHCWQILKQRIQDLTGS

SEQ ID NO: 22297 - protein, 81 aa, Pan troglodytes
QGLLTFRDVAIEFSQEEWKCLDPAQRTLYRDVMLENYRNLVSLGISSKCTMKEFSSTAQGNTEVIHTGTLQRHESHHIGDF

SEQ ID NO: 22298 - protein, 81 aa, Monodelphis domestica
APVPVKFDDVAIYFSEQEWNILDDWQKDLYKHVMRANYSTLVSLDYTIPKPDLIFQIELGEVLFDGNWGDLEQAEIGVSLS

SEQ ID NO: 22299 - protein, 81 aa, Monodelphis domestica
AQEMVTFQDVAVDFTREEWCLLSPPQKELYKEVMLENARNLLSVGLPALPEDVISYLEQREAPWMLEREGPRSCCPGEILL

SEQ ID NO: 22300 - protein, 81 aa, Monodelphis domestica
PLWVLVSFADVAVYFSPEEWGRLRPEQRALYRDVMRETYGHLGALGFPGPKPALISWMEEAAWDSEASFPEGEKEKRAINF

SEQ ID NO: 22301 - protein, 81 aa, Monodelphis domestica
EELPVVFEDVAVYFTREEWAMLDKRQKELYRDVMRMNYELLASLGPAAPKPDLILKLERRAAPWIKDPNGPKWGKGRPPGK

SEQ ID NO: 22302 - protein, 81 aa, Physeter macrocephalus
MTFEDVAVEFTRWEWGQLDPTQKDVYREVMLENFKNLASLGFPMSKPYVICRLEEGEEPCILEREISTGAPADWERRRQAK

SEQ ID NO: 22303 - protein, 81 aa, Monodelphis domestica
RQAAVSFRDVVVDFTEEEWGRLSPAQWQLYKEVMLENYRNLVSLGLIEDKPGLIFRLEQGEEPPASDTQGEAPKSPHTWEG

SEQ ID NO: 22304 - protein, 81 aa, Monodelphis domestica
GQESVSFEEVAVDFSQEEWCFLNAAQKELYKEVMLENYRNLVSLGLPVCKPDVIAQLEQGEAPWMLEREGPPRASLADWEP

SEQ ID NO: 22305 - protein, 81 aa, Physeter macrocephalus
SQGPVSFTDVAVDFTQEEWQQLDPDEKTTYRDVMLENYSHLVSVGYDSTKPNVILKLEQGEEPWAADGEFPRQSHPEEVWK

SEQ ID NO: 22306 - protein, 81 aa, Monodelphis domestica
VVTFQDVAVDFTREEWRLLSPPQKKLYKEVMLENAQNLLSVEGEIRPEMKATPTEMVPLVEETDQQRLMSDIPHNTACREF

SEQ ID NO: 22307 - protein, 81 aa, Monodelphis domestica
MLENAQNMLFVGLPGPPEDMISYLEQKEFPWMLEHEDLRSFCPEGEIRLEMKANPTEVSLPVEEMDLQSFMNDGLDNFAFR

SEQ ID NO: 22308 - protein, 81 aa, Physeter macrocephalus
MLENYGHLVSLAGLNISKPDVVSLLEQGKEPWLGKDASRGLFSASESNGEIKEFSPKNVIYEDDSSQYLIMERFLSQGLEY

SEQ ID NO: 22309 - protein, 81 aa, Physeter macrocephalus
KAWVKKPVTSEDVAVNFNQEEWECLDASQRVLYQDVMSETFRNLMSVAVDLIAKFEQEEKQWRADLRPPNGEGLHSGGKRE

SEQ ID NO: 22310 - protein, 81 aa, Monodelphis domestica
SGSVTFQDVTMDFTQEEWRLLDHSQKELYLEVMLENVQNLLSVEAKTDFEVKDMSTKLSLFVEGSGSQRCVNEGLCHFILK

SEQ ID NO: 22311 - protein, 81 aa, Physeter macrocephalus
KSQGSLSFKDVAVVFTWEEWQLLDRVQRNLYQDVMLENYINLVSVGYQVTKADAFYRLEQETPWIIEEESQSQIHPEDTWQ

SEQ ID NO: 22312 - protein, 81 aa, Physeter macrocephalus
AQGSLTLKDVAVDFTWEEWQLLAPDQKDLYRDVMLENYSNLLSVGYQVSKPDILSKLEQGEPLWTLEDEVHSHPHPEIEKV

SEQ ID NO: 22313 - protein, 81 aa, Monodelphis domestica
AQEVVTFKDVVVEFTQEEWCLLSPAQKELFKEVMLENAWNLHSLGLPAPLEDMISYLKLKEPPWMLEQEGLRSFFPEGKIR

SEQ ID NO: 22314 - protein, 81 aa, Physeter macrocephalus
SQDSVTFADVAVDFTQEEWTLLDPIQRKLYRDVMLENYKNLTTAGYQLLKPTLISWLEQEDDLRTVERRGVLQGSAIQQDN

SEQ ID NO: 22315 - protein, 81 aa, Physeter macrocephalus
RPEPVTFEDVAMYFTQNEWVILDPAQRALYREVLLENYANVASLAFSFTRPVLVSQLEPGELPWGLDPWEPVGREALRGVC

SEQ ID NO: 22316 - protein, 81 aa, Monodelphis domestica
GQEVVTFKDVAVDFTWEEWRLLSPPQKLLYKEVMLENTRTLLSVGLPAPPEDMISYLEQREAPWMLDQEDLRRCYPEGKLT

SEQ ID NO: 22317 - protein, 81 aa, Monodelphis domestica
VQEAVMFKDVSVDFTREEWCLLSPPQKELYKEVMLENARNLLSVGLPAPHEDVISSLEQREGPWMLKQEGLRSCCLEREIS

SEQ ID NO: 22318 - protein, 81 aa, Monodelphis domestica
IQGSLTFKDVAMNFTQEEWCLLDHSQKELYLEVMLENVQNLLSVGLPVPREYYTSYFQQEKAPWLLVQKGPRNSSPEAETN

SEQ ID NO: 22319 - protein, 81 aa, Papio anubis
REDPGTSESQEMEEWALLDIFQKNLYREVMLETFRNLTSIGKSWKDQNIEYEYQNPRRNFRSLIEEKVNEIKEDSHCGETF

SEQ ID NO: 22320 - protein, 81 aa, Papio anubis
PQGLLTFRDVAIEFSQEEWKCLNPAQRTLYRDVMLENYRNLVSLAISSKCRMKMFSSTGQGNTEVIHTGTLQRQASHHIGD

SEQ ID NO: 22321 - protein, 81 aa, Papio anubis
IDVAIEFSLEEWHCLDTAQRNLYRNVMLENYKNLVFLGIPVSKPDLITCLEQGKKSWTMKRHEMVAKSPVIYSHFAQDLWP

SEQ ID NO: 22322 - protein, 81 aa, Papio anubis
ASVALGDVAVNFTREEWALLGPCQKNLYKDVMQETIRNLDCVGMKWKDQFLFKDQIEHQYKYPRKNLRCRMLERFGESKDG

SEQ ID NO: 22323 - protein, 81 aa, Aotus trivirgatus
RPGLVAGARAVSFADVACYFSPEEWAVCGRRRGLYRDVMRETYGHLARFGPKPALISWMEQRGEGWSRVPLYPNWPHFQHP

SEQ ID NO: 22324 - protein, 81 aa, Papio anubis
AATLRLSAQGTVTFEDVAVKFTQEEWNLLSEAQRCLYRDVTLENLALISSLDPALDGSADNTQTGNLGQSVLPSHPEQKTA

SEQ ID NO: 22325 - protein, 81 aa, Aotus trivirgatus
VREMLTFRDVAIGFCPEEWECLDSSQQHLYRDVMLENYRNLVFLGLGDSKPELITHLEQGKDPWNVKRQETVVKHPEVLPK

SEQ ID NO: 22326 - protein, 81 aa, Aotus trivirgatus
MGLLTFRDVAIEFSLEEWEHLDSDQKNLYGDVMLENYRNLVCLDIFSYDTQALLRKKRIEASFQKVILDGYGSCGLQNLHL

SEQ ID NO: 22327 - protein, 81 aa, Aotus trivirgatus
MGPLAFMDVAIEFSLEEWQCLDTAQQNLYRDVMLENYRNLVFLGAAFSKPDLITYPEPGKEPWNMKRHETVAKILAMCSCF

SEQ ID NO: 22328 - protein, 81 aa, Aotus trivirgatus
AQESLTLEDVAVDFTWEEWQLLGPAQKDLYRDVMLENYSNLVAVGYQASKPDALFKLEQGQPPWTIKDGIHSGACSEIWKF

SEQ ID NO: 22329 - protein, 81 aa, Pan paniscus
IGGDVTFNDVAIDFTHEEWGWLNSAQRGLYKDVMVQNYENLVSVAGLSITKPYVITLLEDGKEPWMVEKKLSKGMIPGEWE

SEQ ID NO: 22330 - protein, 81 aa, Lipotes vexillifer
MLENFNNLLSLGYQATKPDTLSKLEHGKEPCIIENKIQNRTRPGIRKVDSHLPEHSQDQRFPKSLQQCSEQNAFRNSVHLS

SEQ ID NO: 22331 - protein, 81 aa, Lipotes vexillifer
KTWGPLSFMDVFVDFTWEEWQLLDPAQKHLYRSVMLENYSNLVSLGYQHTKPSIIFQLEQEELWMMQIPSEGHMDEVWEID

SEQ ID NO: 22332 - protein, 81 aa, Leptonychotes weddellii
ALALITFKDVAVTFTGEEWRHLDLAQKTLYREVMLETCGLLVSLGYPVPKPELTYLVEHGQELWTVKRGLSKSTYTASSSG

SEQ ID NO: 22333 - protein, 81 aa, Leptonychotes weddellii
FQGSVSFTDVTVDFTQEEWEQLDPSQRILYMDVMLENYSNLLSVGKDLFRRCGRLTTRRRRTTATQMSRRGHLSFLRTKPQ

SEQ ID NO: 22334 - protein, 81 aa, Monodelphis domestica
SQGSITLRDVAVDFTQEEWRLLDHAQKELYREVMLENVWNLQSVGLMVSRENFVTCFQQEESPWPMVKRKDGQWSFCPEAE

SEQ ID NO: 22335 - protein, 81 aa, Monodelphis domestica
SQASITFKDVAVDFTQEEWCLLDHSQKALHQKVMLENVQNLLSVGIPVSRGNVISCFQQGKAPWLLEQKGPRSSCPEAEIN

SEQ ID NO: 22336 - protein, 81 aa, Physeter macrocephalus
FQEAVTFKDVAVTFTEEELGLLDSAQRKLYQDVMVENFQNLVSVGHLPFKPDMVSQLETEEKLWMMERETQRNGHSSENRK

SEQ ID NO: 22337 - protein, 81 aa, Monodelphis domestica
PPRQERVTFGDVAVDFTLDEWVCLDSAQKALYRDVMLENYGHLVCLGLAGAKPAVIQRLERGEAAWCPGVPGSRLPGLFFF

SEQ ID NO: 22338 - protein, 81 aa, Monodelphis domestica
FQESVTFKDVAVDFTQEEWKQLDPAQRDLYRDVMLENYRNLVSLGLPVFKPDVISQLERGEAPWIPEVPRSICQGEVVRTR

SEQ ID NO: 22339 - protein, 81 aa, Monodelphis domestica
GSITFKDVAVDFTQEEWCLLDPSQKELYREVMLENVQNLLSVEAKTNFDVKMSTKLSFFVEGSGPIGGMNKDPCDFILRET

SEQ ID NO: 22340 - protein, 81 aa, Monodelphis domestica
ARFQESLTFKDVAVEFTWEDWRHLDPAQRALHRNVMLENYENLVSIGIPVSKLDLLFLFKRGDVQNEEGEAGTGACIGELL

SEQ ID NO: 22341 - protein, 81 aa, Monodelphis domestica
SQGLITLKDVTVDFTQEEWVLLDHSQKELYLEIMLENVQNLLSVGLLVPRENCISCFQQWEAPWLLDQEFPRSSCPEGKSN

SEQ ID NO: 22342 - protein, 81 aa, Monodelphis domestica
SQESITFKDVAVDFSQEEWCLLDHSQKELYVEVMMANVKNLLSVGLPVSRVDFLSCFQQGEAQCLLEQKGPRSSCPETETN

SEQ ID NO: 22343 - protein, 81 aa, Physeter macrocephalus
QLTFRDVAIEFSQEEWEWLDPAQRALYRDVMLETYRNLLSLDMSTRCEIKEFSPKEDINNGDLFQTLVFERLVSHDFDDFD

SEQ ID NO: 22344 - protein, 81 aa, Monodelphis domestica
PQELVAFKDVAVDFTQDEWGLLDHSQKELYKDVMLENVQNFISLGLPVLREYLVSHYEQEGLRSSFPETGFDVKKFPAMLK

SEQ ID NO: 22345 - protein, 81 aa, Physeter macrocephalus
QAMVKIEDMAVSLILEEWGCQNLARRNLNRDTRQENYGNVISQGCENRNENEESTSKAEIAEDSASHGETTGKFQKDFGEK

SEQ ID NO: 22346 - protein, 81 aa, Monodelphis domestica
FPVVTFRDVAVDFTQAEWALLAPPQKELYKEVMQENAQNLLSVGKEENSQIIKYPSQIHTGEKPYECRQCGKAFNRIYNLT

SEQ ID NO: 22347 - protein, 81 aa, Papio anubis
MELLTFRDVAIEFSPEEWKCLDPSQQNLYKDVMLENYRNLVSLAMCSPFSQDLSPVQGIEDSFQKLVLRRYEKCGYENLQL

SEQ ID NO: 22348 - protein, 81 aa, Aotus trivirgatus
EKGPLTFRDVAIEFSLEEWQCLDTAQQDLYRKVMLENYRNLAFLAGIAVSKPDLITCLEQGKEPWNMKRQEMVDETPVIYS

SEQ ID NO: 22349 - protein, 81 aa, Papio anubis
MGPLTFRDVKIEFSLEEWQCLDTAQRNLYRDVMLENYRNLVFLGIAVSKPDLITWLEQEKEPWNMKRREMVDKTPVMCSHF

SEQ ID NO: 22350 - protein, 81 aa, Papio anubis
TVTFEDVAVKFSQEEWSLLSEVQRCLYRDVMLENLALISSLDCWCGSKDKEAPSKQSISVQRESQNRTPRAVVSPKKAHPC

SEQ ID NO: 22351 - protein, 81 aa, Aotus trivirgatus
METLTFRDVAIEFSLEEWQCLDIAQQDLYRKVMLENYRNLAFLGIALTKPDLITCLEQRKVPWNMKRHEMADEPPVLCSNF

SEQ ID NO: 22352 - protein, 81 aa, Papio anubis
GEGSLSFEDVAVDFTREEWQFLDWSQKVLYKEVMLENYSNLVSVGYQGTKPDSLFKLEQGEPPWIVEGAAPSQTCPGFVIR

SEQ ID NO: 22353 - protein, 81 aa, Aotus trivirgatus
SVGFEDVAVNFTQEEWALLSPSRKQLYRDVMLETCRNLASVGIQWKDQDIENLYQHLGIKLRSLVERLCGRKEGSDHRETF

SEQ ID NO: 22354 - protein, 81 aa, Aotus trivirgatus
LFQVTFSDVILLRDLYKDVMVQNYENLVSLAGLSITNNVITLLEDGKEPWMVEQKLSKGVTPDWESKLENKELSTKKDIYE

SEQ ID NO: 22355 - protein, 81 aa, Aotus trivirgatus
ALALISFEDVVVTFTGEEWGHLDLAQRTLYQEVMLETCRLLISLGHPVPKPELIYLLEHGQEPWTVKRGLSQSTCAASFSL

SEQ ID NO: 22356 - protein, 81 aa, Pan paniscus
VTFEDVTIIFTWEEWKFLDSSQKRLYREVMWENYTNVMSVENWNESYKSQEEKFRYLEYENFSCWQGWWNAGAQMYENQND

SEQ ID NO: 22357 - protein, 81 aa, Physeter macrocephalus
MLENYSNLVSLGLPFSKPEVISLLQQGEDPWKVEKESPGGSSVGCKSSPKTTKSTQTQDSSFWGPVRKRLKKNEPWNFISE

SEQ ID NO: 22358 - protein, 81 aa, Physeter macrocephalus
MAEDLKFRDVAIYFTQKEWECLHSAQKDLYRGVMLENYNTLISLGFSDSKPDVIFLLEQGKEPWMVNSKETKEWCPDWESR

SEQ ID NO: 22359 - protein, 81 aa, Monodelphis domestica
PQASVTFKDVAVDFTWEEWRLLDPSQKELFWEVMLENYRNLVCLGLADSNKDVRISELESGEPHWIPTGGVLRSCWPGWES

SEQ ID NO: 22360 - protein, 81 aa, Monodelphis domestica
GESGQMLVTFDDITVYLLQEEWMLLGEQQKEICGSDNLVSPLGSPIANPELFCKLEREVEPWLGDASGQRKPLNRHLGKNK

SEQ ID NO: 22361 - protein, 81 aa, Monodelphis domestica
PAQVLVTFKDVAVDFTQEEWRLLDPHQKELYKEVTLENAWNMLSMGLPVPRDLVSHFKQVEAPWMLEEEGSSNSCLDGERR

SEQ ID NO: 22362 - protein, 81 aa, Monodelphis domestica
APEVVTFQDVAVDFTRGEWRLLSPPQKELYKEVMLENAWNLLSVGLPASPEDVLSSLEQREGPWMLEQEGLRSFSPVLSLN

SEQ ID NO: 22363 - protein, 81 aa, Monodelphis domestica
VVKFQDVAVDFTWEEWSLMSPPQKELYREVMLENARNLLTVEREIRPEMKLTATDLSLSVEEMNLQRFMSDCPDNFAFREF

SEQ ID NO: 22364 - protein, 81 aa, Physeter macrocephalus
AHGSVIFRDMAISFSQEEWEHLDPAQRDLYRDVMLENYLTLVSLGSSTSKPDVITLLKQEKEPWIVVRKEISGWYTDLESN

SEQ ID NO: 22365 - protein, 81 aa, Monodelphis domestica
CSIQESLTFKDVAVEFTWEEWRHLDPAQRTLHRNVMLENYENLVSIGIPISKLDLLFLLKREDVQNQEGEAGTGTCIDSQA

SEQ ID NO: 22366 - protein, 81 aa, Monodelphis domestica
LQTSLMFKDVAVYLTREEWDCLGPAQRSLYRDVMLENYRNLVSLGFSVSKPDVISHLEKGEEPWVLDKQGAREREILKSDF

SEQ ID NO: 22367 - protein, 81 aa, Monodelphis domestica
SQGSITYKDVTVDFTQEEWCLLNHFQKALYLEVMLENVKNLRSVGLPVPRENFISCFKQGRASGLLEQKDPRSSCPAVDFE

SEQ ID NO: 22368 - protein, 81 aa, Monodelphis domestica
SQGSITFKDVAVNFTQEEWCLLDHSQKALHLEVMLENVQNLRSVGLPVPRENFISCFQQGKAPWLLEQKGPRSSCPEAETK

SEQ ID NO: 22369 - protein, 81 aa, Monodelphis domestica
SRGSITFKDVAVDFTREEWRLLDHSQKELYTEVMLENVQNLLSVGLPVLRENFISCFQQGEAPWQLEQKDPRSSCPESETT

SEQ ID NO: 22370 - protein, 81 aa, Monodelphis domestica
MLENVQNLLSVGLPVPRENFISCFQQGESSWLLEQKGLRHSCPEAETNFEVKEMTTKLSLIVEGSGPQKCMSEGLYDFIVR

SEQ ID NO: 22371 - protein, 81 aa, Monodelphis domestica
SQESLTFKDMSVNFTQDEWGHLDSAQKGLYRDVMLENYRNLASLGHPGSKPDVISQLEHGKSPWVKKGIPKSRCLGTPLVK

SEQ ID NO: 22372 - protein, 81 aa, Physeter macrocephalus
SQGLLSFNDVAVDFTWEEWQLLDIVQKNLYRDVMLENYSNLMSLGYQVTKPEQVMHLEKGKEKEKAAVEREFPSQCGPERP

SEQ ID NO: 22373 - protein, 81 aa, Monodelphis domestica
PPSEGPITFQDVAVDLTQEEWRLLDHSQRGLYLEVMLENAQNVLSVAAREDLISHFQQEAAPWMADPKGTRSFCPDAETSF

SEQ ID NO: 22374 - protein, 81 aa, Monodelphis domestica
FQASVTFKDVAVDFTWEEWRLLDPPQKELFWEVMLENYRNLVCLGLADSNKDVMMSKLESGEPHWIPTGGVLRSCWPGWES

SEQ ID NO: 22375 - protein, 81 aa, Physeter macrocephalus
SQDSVTFEEVAVDFSQEEWALLDPAQKILYRDVMLENFRNLASVEYHLCKHSLITEVEQEELRPEQRGILQCAYRDRDTQL

SEQ ID NO: 22376 - protein, 81 aa, Monodelphis domestica
GQEVMTFKDVAVDLTWEEWRLLSPPQKELYKEVMLENARNLLSVGLPAPPEDVLTYLEQREALLMLKQKGLRSYYPDGKIR

SEQ ID NO: 22377 - protein, 81 aa, Physeter macrocephalus
AQGLMAFEDVAVYFSREEWALLDAAQRALYRRVMLENFTLLASLGLSVSRPRVVIQLECGEEPWVLNGTDVTLARNAQRRP

SEQ ID NO: 22378 - protein, 81 aa, Papio anubis
MGPLTFRDVAIEFSLKEWQCLDTAQRNLYRNVMLENYRNLVFLVIYSHFAQDLWPEQNVKDSFQKATLKRYGTCRHENLPL

SEQ ID NO: 22379 - protein, 81 aa, Papio anubis
GWLTSYSQDSVTFEDVAVDFTQEEWTLLDQTQRNLYRDVMLENYKNLVAVDWESHVNTKWSAPQQNCLQGKTSSVVEMNSE

SEQ ID NO: 22380 - protein, 81 aa, Aotus trivirgatus
LQEAVVFEDVAVYFTRIEWSCLAPEQQVLYRDVMLENYRNLASLGFLVAKPALISLLEQGEEPGALILQVAEQRGAKTSLC

SEQ ID NO: 22381 - protein, 81 aa, Aotus trivirgatus
LLDQMAFEDVAVYFSQEEWGLLDTAQRALYRRVMLDNFALVASLGLSTSRPRVVIQLEHGEEPWVPSGTDMTMSRNTHRRC

SEQ ID NO: 22382 - protein, 81 aa, Aotus trivirgatus
MDPVAFEDVDVNFTQEEWTLLSPSQKQLYRDVMLETFKKLASVDHRETFSQIPDCHLNKKSDTAVKPRKCSVCEKVFLHYS

SEQ ID NO: 22383 - protein, 81 aa, Aotus trivirgatus
SYTGSVSFRDVAIDFSREEWRHLDLSQRNLYRDVMLETYSHLLSVGYQVPEAEVVMLEQGNEPWSLQGERPHQSCPGEKLW

SEQ ID NO: 22384 - protein, 81 aa, Aotus trivirgatus
AGWLTNYSQDSVTFEDVAVDFTPEEWTLLDQTQRNLYRDVMLENYKNLVAVDEIHISTKWTAPQQNFFQEKTSSMVKMNSE

SEQ ID NO: 22385 - protein, 81 aa, Papio anubis
LFQVTFSDVAIDFSHEEDLYKDVMVQNYKNLVSVTGLSVTKPYVITLLEDGREPWMVEKKLSKGVIPDWESRWESKELSTK

SEQ ID NO: 22386 - protein, 81 aa, Aotus trivirgatus
VTFEDVAIYFSQEEWGLLDEAQRLLYRDVMLENFALLTSLVCWHGMEDEETPEQSVSVKGVPQGRTPEASPSIQKTQACDT

SEQ ID NO: 22387 - protein, 81 aa, Aotus trivirgatus
PGSVTFEDVAVYFSWEEWDLLDETQKHLYFDVMLENFVLTSSLGKDLTSSWSHVVAQLGLGEVSSVLHRMFMTPASREEAP

SEQ ID NO: 22388 - protein, 81 aa, Aotus trivirgatus
KESVSFKDVAVDFTQEEWGQLDSPQRALYWDVMLENYQNLLALGAGPPLHKPDVISHLERGEEPWCVQRDVPGGPCPEWEM

SEQ ID NO: 22389 - protein, 81 aa, Aotus trivirgatus
ERHLLGPLTFMDVAIEFSLEEWQCLDTAQQNLYRNVMLENYRNFVFLGIAVSNLDLITCLEQGKEPWKMKTHEMVAKSPGR

SEQ ID NO: 22390 - protein, 81 aa, Aotus trivirgatus
KPGAVSFADVAVYFSPEEWGCLRPAQRALYRDVMRETYGHLGALGFPGPKPALISWMEQESEAWSSAAQDPEKGENLGGAR

SEQ ID NO: 22391 - protein, 81 aa, Sarcophilus harrisii
PVTFRDVAVDFTLEEWGRLGPAQKQLYRDVMLETYRNLVSLGWETRNKTQEKGSKGNVPAEEATRERTVESLGACAHHSVL

SEQ ID NO: 22392 - protein, 81 aa, Sarcophilus harrisii
FQESVTFKDVAVEFTWEEWKHLDPAQRNLFRDVMLENYGNLVSLGLAVTKPDVIFQLERGDAPWRLEIEVPRSTPTECLNL

SEQ ID NO: 22393 - protein, 80 aa, Pan paniscus
MCLITLNNSYRMFESCSGFSGFCASPIEESHGALISSRSSRTMTDGLVTFRDVAIDFSQEEWECLDPAQRDFRDEVSPCW

SEQ ID NO: 22394 - protein, 81 aa, Felis catus
SQGLLTFRDVAIEFSQKELRCLNHSQWELYRDVMLENYRHLLFLGLVVSKPDLVIFLEQKKDVWAVKRKETVATHPGRWEG

SEQ ID NO: 22395 - protein, 81 aa, Felis catus
VTFKDVAVVFTEEELGLLDPAQKKLYGDVMLENFRNLLSLEHRLFKHDTFRLEKVTLWMMLASHRREKSGKSQAGGSPRRC

SEQ ID NO: 22396 - protein, 81 aa, Felis catus
SQGSLSFRDVAVGFTHKEWQHLDAAQRTLYRDVMLENYSHLVSVGCQVTKPAVISRLERGQEPWMEEEELVRWSFPGERGA

SEQ ID NO: 22397 - protein, 81 aa, Neomonachus schauinslandi
MLENYQNLLSLGVGPLGCKPDVISRLERGEEPRMEKKEARQATCPALHTSSAAPWESFLKKRVSEEATSPETVCGGRGLGC

SEQ ID NO: 22398 - protein, 81 aa, Neomonachus schauinslandi
PLTFRDVAVVFTEEELRLLDRAQRKLYRDVMLENFRNLLFVGDKNEKEMEYIQERELKCLSSRELSYWKIWEQVTGELTGS

SEQ ID NO: 22399 - protein, 81 aa, Neomonachus schauinslandi
SQGLLTFRDVAIEFSQEEWGCLNLVQRELYRDVMLENYGHLLFLGLIVSKPDLIMFLEQEKQLWDVKRKETVAFHPVISSH

SEQ ID NO: 22400 - protein, 81 aa, Monodelphis domestica
AVTFKDVAVDFTREEWRLLAPPQKELYKEVMLENVWNLLSVEGEIRPDMKVTPTEVSFSVEETEKQKFMSDGPDNLTWREF

SEQ ID NO: 22401 - protein, 81 aa, Monodelphis domestica
PQELVTFRDVAVDFTPEEWGQLGPAQKELYQEVMLENYRNLVCLGLTVSKPDVISQLEQGEAPWRLEGGSARGRCLDWGMR

SEQ ID NO: 22402 - protein, 81 aa, Monodelphis domestica
EVVTFRDVAVDFTQEEWSLLSPPQKELYKDVMLENVRNLLSVVETRSEMKVNPTEVSLLLEEMDLQRFKSDGLDKFASGQF

SEQ ID NO: 22403 - protein, 81 aa, Physeter macrocephalus
FQGLVTFRDVAIEFSQEEWKWLEPAQKDLYKDVTLENFSNLVSLGLSLSKPDVVSLLEQGKEPWMVVNDMTGPWCPDLESR

SEQ ID NO: 22404 - protein, 81 aa, Physeter macrocephalus
VTESVTFRDIAVLFSRNEWLHLDSAQRTLYREVMLENYSTLVSLGIPFSMPKLICQLQHGEDPCMVERESPQDTYLGFKTW

SEQ ID NO: 22405 - protein, 81 aa, Monodelphis domestica
PQEAVTFKDVAVNFSQEEWMCLDSSQKEFYRDVMLENYRNLVFLGLAFSKPYVIYQLERRETPWMPEGDIPRIRHADWETQ

SEQ ID NO: 22406 - protein, 81 aa, Monodelphis domestica
SPMRSGLVTFQDVAVIFSLDEWGHLDPAQRELYREVMLENYQTLACLGLAISKPDVISQLEQGEAPWMPKREGLRLFCGND

SEQ ID NO: 22407 - protein, 81 aa, Monodelphis domestica
SQGSITFKDVAVDFTQEEWYLLDRSQKELYLGVMLENVQNLLSVGLPVPRENFISCFQQGESPWLLEQKGLWSSYPEAELN

SEQ ID NO: 22408 - protein, 81 aa, Monodelphis domestica
SPTPLMFQDVAVDFTWEEWGLLEPSQKDMYWDVMLENYENFVSLGSLPISIPDVISQMERIEAPWMAEKGVLISTFLDSLS

SEQ ID NO: 22409 - protein, 81 aa, Monodelphis domestica
FQVSVTFEDVAVEFTWEEWRYLDLGQRTLYRDVMLENYENLVSIGIPVSKPDLLFLLKRDVQNQEGKVRSGIYSDPVFEEN

SEQ ID NO: 22410 - protein, 81 aa, Monodelphis domestica
MISKLQQGEEPWIMEREIPKGTSPDWETSSGIKKATIKQEEELTQEAMVGKFTRNSLWYSKLGKPFEWVNQLGWHKESQEK

SEQ ID NO: 22411 - protein, 81 aa, Monodelphis domestica
CQETLTFKDVAVDFTREEWGQLGPAQRDLYKEVMLDNYRNLISLGLQGSKPDVIFWLERGQSPWTLKRRKSRDCCPEFHLH

SEQ ID NO: 22412 - protein, 81 aa, Aotus trivirgatus
MDVAIEFSLEEWQCLDTAQQNLYRDVMLENYRNLVFLGTAFSKPDLITYLEQGKEPWNMKRHETVAKPPAICSYFAQDLWP

SEQ ID NO: 22413 - protein, 81 aa, Aotus trivirgatus
PKVPVTFDDVAVYFSELEWGKLEDWQKELYKHVMRGNYETLVSLDYAISKPDILTRIERGEEPCLDQWGQEKGSEVEVAHS

SEQ ID NO: 22414 - protein, 81 aa, Aotus trivirgatus
CEASMSFEDVTMDFSREEWQQLDPAQKRLYQDVMLELYSHLFSVGYQIPNPDVIFRRLKEKEPCMEEAELSHRRCEEGEFG

SEQ ID NO: 22415 - protein, 81 aa, Papio anubis
MGLLTFMDVAVEFSLEEWQCLDTAQQNLYRNVMLENYRNLVFLALCSHFAKDLRPEQYIKNSFQQVILRRYGKCGYQNLQL

SEQ ID NO: 22416 - protein, 81 aa, Papio anubis
MLENFRNLVFLAGIDVSKPDLITCLEQGKDPWNMKRDSMVATPPVKCSHFAQDLWPQPGIKDSFQKAILREYGKYGHKDLQ

SEQ ID NO: 22417 - protein, 81 aa, Aotus trivirgatus
MGPLTFRDVKIEFSLEEWQCLDTAQRNLYRDVMLENYRNLVFLGIAVCKPDLITWLEQGKEPWNMKRHAMVAKPPVICSHF

SEQ ID NO: 22418 - protein, 81 aa, Aotus trivirgatus
VKIEDMAVSLILEEWGCQNLARRNLSRDNRQENYGSAFPQGGENRNENEESTSKAETVKDSASRGETAGRFQKEFGEKRDQ

SEQ ID NO: 22419 - protein, 81 aa, Aotus trivirgatus
PQGHLTFTDVAIEFSQEEWKCLDPAQRALYKDVMLENYRNLVSLGISLPDLNINSMLEQRRELWSGESEVRIAKSADRRER

SEQ ID NO: 22420 - protein, 81 aa, Papio anubis
RLTFRDVAIEFSQEEWKCLNSTQRTLYRDVMLENYRNLVSLGEDYFLPEHRKEPWTMESQVQIARKPKGWEWIKGVKIAQS

SEQ ID NO: 22421 - protein, 81 aa, Papio anubis
GAIEMGVLTFRDVAIEFSLEEWQCLDTAQQNLYRDVMLENYRNLVFLGIAVSKPDLITCLEQGKEPWNVKRHEMGAEPPGR

SEQ ID NO: 22422 - protein, 81 aa, Sarcophilus harrisii
SQEPVTFQDVAVDFSQEEWGQLDPAQRDLYRDVMLENYGNLVSLGLVVSDPSVIYHLEQKKEPWKLDLQGTDKTKVLRGTW

SEQ ID NO: 22423 - protein, 81 aa, Pan paniscus
ELLTFRDVAIEFSPEEWKCLDPDQQNLYRDVMLENYRNLVSLGVAISNPDLVIYLEQRKEPYKVKIHETVAKHPVISLQVY

SEQ ID NO: 22424 - protein, 81 aa, Pan paniscus
SAQGTVTFEDVAVNFTWEEWNLLSEAQRCLYRDVTLENLALISSLGMTFLHVCQALDSLRQVPPTSASQNAGITGVSHCAW

SEQ ID NO: 22425 - protein, 81 aa, Lipotes vexillifer
VPAFSDKDSLGDEMLAAALLKAKAQELVTFEDVAVYFIRKEWKRLEPAQRDLYRDVMLENYGNVFSLGFPFLNFDMISGLQ

SEQ ID NO: 22426 - protein, 81 aa, Pan paniscus
QEPLSFKDVAVVFTEEELELLDSTQRQLYQDVMQENFRNLLSVGERNPLGDKNGKDMEYIQDEELRFFSHKGLSSCKIWEE

SEQ ID NO: 22427 - protein, 81 aa, Lipotes vexillifer
DSLAIEDVVVNFTLEEWALLDPSQKKLYRDVMQEIFWNLASVGKTWEYHDIGDQYRNQGGNLRSPMVERLSERKDSSSCGE

SEQ ID NO: 22428 - protein, 81 aa, Monodelphis domestica
QESLTFKDVAVEFTWEEWRHLDPAQRALHRNVMLENYENLVSIEGKIRLEMKEMTAELSLSGEETQRQRCIGDGACDSTWR

SEQ ID NO: 22429 - protein, 81 aa, Monodelphis domestica
PQERMTFKDVAVDFTREEWRLLDHSQKELYREVMLENVQNLISLGFSVPRAHLISNLQQREAPWLLEQKSPRSSFSETRFE

SEQ ID NO: 22430 - protein, 81 aa, Monodelphis domestica
MLENAQNLLSLGLPVPREIFLSCFQQGEAPWLLEQKGPRSSCPKAETTFDVEMSTKLSLFVEGCGPQRCMNEGPCDFISRE

SEQ ID NO: 22431 - protein, 81 aa, Monodelphis domestica
PQELVTFEDVAVYLTKEEWEHLGPAQRRLYRDVMLENYENVVSLGFPVSKPDLISQLEQGEVPCLPDLPRTEVPEIHGGPL

SEQ ID NO: 22432 - protein, 81 aa, Monodelphis domestica
MLENARNLLSVGLQAPQEDVISSLEQREAPWMLEQEGLMSCCPGEIIPEMKENPTEMSPSLEEMELQRFINDSPNKFAFRE

SEQ ID NO: 22433 - protein, 81 aa, Monodelphis domestica
LWGSLTFKDVAVEFTQDEWCLLDHSQKELYLEVMLENAQNLLSVGLPVPREYCASYFQQGKAPWLLELKGPRSSFPEAETN

SEQ ID NO: 22434 - protein, 81 aa, Monodelphis domestica
SQGSITFKDVAVDFTQEEWCLLDHSQKELYLEVMQENMQNLLSVGLPVPRENFMSCFQQGKAPWLLEQKGPRSSCPEAKTI

SEQ ID NO: 22435 - protein, 81 aa, Monodelphis domestica
SQEAVTFRDVALDFTWEEWRCLSLAQRELYRDVMLENYRNLVSLGLLGPKPDLISWLEQREETEIWDPLGWATVGTCSCEG

SEQ ID NO: 22436 - protein, 81 aa, Monodelphis domestica
SQESVTFKDVAVNFTREEWCLLDHSQKELYTEVMLENVQNLLSVETSFEAKKISTKLSLFLEGSAHQKFMNESSYDLILRE

SEQ ID NO: 22437 - protein, 81 aa, Monodelphis domestica
SQGLVTFEDVAVYFSLEEWGRLNESQKDLYREVMQENYGILVSLGYPIPKPDVISRMERGEELWVPESPGPEEGDILTGVY

SEQ ID NO: 22438 - protein, 81 aa, Physeter macrocephalus
SRGSVTFRDVAVDFSREEWEWLQPAQRDLYRHVMLENYGHLVSLGLNISKPDVVSLLEQGKEPWLGKDASRGLFSASESNG

SEQ ID NO: 22439 - protein, 81 aa, Monodelphis domestica
NFWILRLPPSSKGEVPKEWGKLDEWQKDLYKHVMRGNYETLVSLDYAISKPEVLSRIEQGKEPCGWRRAGPKNPDIHTDPN

SEQ ID NO: 22440 - protein, 81 aa, Physeter macrocephalus
GQGSVSFKDVTVDFTWDEWLQLTCMQRTLYRDVMLENYSHLVSVGYCISKPEVIFKLEQGEEPWPLERAFPCRSDPVTLLK

SEQ ID NO: 22441 - protein, 81 aa, Monodelphis domestica
SITFKDMAVDFTQEEWCLLDPSQKELYREVMLESVQNLLSLEAETNLEVKEISPKLSIFVKGSRPQRGINKGCCDFILREI

SEQ ID NO: 22442 - protein, 81 aa, Monodelphis domestica
DSQGSLTFKDVTVDFTQEEWYLLDHSQKELYLEVMLENVQNLLSVGLPVPREYFTSCFQQGKAPWLLKKESLRSSCGVGEM

SEQ ID NO: 22443 - protein, 81 aa, Monodelphis domestica
SQELVTFEDVAVYFIRKEWKRLDPAQRDLYRDVMLENYGNVFSLGFPFPNPEIISHMDGEEESWVLDLKAAESQELQSGSC

SEQ ID NO: 22444 - protein, 81 aa, Papio anubis
MAKPVREEWRHLDPSQRNLYRDVMLETYSHLLSVGYQVPEAEVDMLEQGKEPWALQGERPRQSCPGEKLWDHNQCRKILTY

SEQ ID NO: 22445 - protein, 81 aa, Papio anubis
RDVAIEFSLEEWHCLDTAQRNLYKNVMLENYSNLVFLGIVVSKPDLITRLEQGKKPLTMKRHEMVAKPPVMCSHFAQDLWP

SEQ ID NO: 22446 - protein, 81 aa, Aotus trivirgatus
QVASVSFQDVAVEFTQEEWQHLGPVEWTLYRDVMLENYRHLVSVGYCITKPKVISQLEQGEEPWSLEDEFLNQKYPGHFEV

SEQ ID NO: 22447 - protein, 81 aa, Papio anubis
FQGSVTFRDVAIDFSQEEWKWLQPAQRDLYRCVMLENYGHLVSLGLSISKPDVVSLLEQGKEPWLGKRNVNRDLQALCIPI

SEQ ID NO: 22448 - protein, 81 aa, Papio anubis
KSLVTFEDVAVYFSQEEWELLDAAQRHLYHSVMLENLKLVTSLGNTLSQHGDDQLMPCNISVEEVLPVRIPNADSSTKKAN

SEQ ID NO: 22449 - protein, 81 aa, Aotus trivirgatus
MFKEAVTFKDVAVVFTEEELGLLGPAQRKLYRDVMLENFRNLLSVGHQPFHRDTFHLQTEEKFWMMETATRREGNSGGKIQ

SEQ ID NO: 22450 - protein, 81 aa, Aotus trivirgatus
TLKEALTFKDVAVVFTEEELGLLDPAQRKLYRDVMLENFRNLLSVGHQPLHGDTFHFPREEKFWMVKTATQREGNLGPAFQ

SEQ ID NO: 22451 - protein, 81 aa, Pan paniscus
MGLLTFRDVAIEFSLEEWQCLDTAQKNLYRNVMLENYRNLAFLGIAVSKPDLLICLEKEKEPWNMKRDEMVDEPPGICPHF

SEQ ID NO: 22452 - protein, 81 aa, Pan paniscus
VDESVTFRDVAVFFSQDEWLHLDSAQRALYREVMLENYSILVSLGILFSKPKVISQLEQGEDPWMVESGVPQGTHLGWESL

SEQ ID NO: 22453 - protein, 81 aa, Pan paniscus
PQASVCFEDVAMAFTQEEWEHLDLAQRTLYREVTLETWEHIVSLGLFLSKSDVISQLEQEEDLCRAEQEAPREKGMLPGSF

SEQ ID NO: 22454 - protein, 81 aa, Lipotes vexillifer
WFQGPVSFEDVTVEFTQEEWVMLDSAQRSMYRDVMLENYMNLTLVEYQLCKPVISLSGQEDIRTVKRRIPQSTCLDWEIQL

SEQ ID NO: 22455 - protein, 81 aa, Lipotes vexillifer
FQEPVSFKDVAVTFTKEELGLLNSTQRKLYQDVMLENFWNLVSVGYLPVKLDMILQLGRKKKLWVMEPVAQGAGCSGHGNQ

SEQ ID NO: 22456 - protein, 81 aa, Monodelphis domestica
DRSSASPGAGPSPGKEPRAGRRNGLCRPVRESPGFPVFKPDVISQLERGEGPWTSETEVPQVICPDSIIDKRRCENLDWIP

SEQ ID NO: 22457 - protein, 81 aa, Monodelphis domestica
NKESLTFKDVAVHFTYEEWKHLDPSQKDLYREVMLENYRNVVFLGIPVSKPNVITLLEQGKEPWILEKELPRDTSAGLPIP

SEQ ID NO: 22458 - protein, 81 aa, Monodelphis domestica
SALHLDPPVPMRVTFADMAVYFGDVMWESYRNLISLGFPIPKPELITHLEQEAEPWGPGPQESEERDPRDPYPSVRTKEEE

SEQ ID NO: 22459 - protein, 81 aa, Monodelphis domestica
RETQGSVTFQDVAVDFTQEEWRLLDHSQKELYLEVMLENVQNLLSMGLPVPREIFISCFQQEEALEQKGLRSSYPEAETNF

SEQ ID NO: 22460 - protein, 81 aa, Physeter macrocephalus
GVTFEDIAVYFSWEEWRLLDEAQIRLYLDVMLESYALISSLGCCCGAEDAEAPFEQIASLGVSQARTPKAALSSQKTHPCE

SEQ ID NO: 22461 - protein, 81 aa, Monodelphis domestica
PAHVVTFKDVAVDFTREEWCLLSPPQKELYKEVMLENAWNLLSVGLPVPPKDILSYLKQREAPWILEQEVLRSCCPEGEIR

SEQ ID NO: 22462 - protein, 81 aa, Physeter macrocephalus
VMESVTLEDVAVGLIQEWALLDDAQRNLCRYVLLDNCRTLAPWAGTPPCKACLVSQVGPREELVTAERGILCATGVDWESQ

SEQ ID NO: 22463 - protein, 81 aa, Monodelphis domestica
QGSITFKDVAVDFTQEEWRLLEPSQKEQYREVMLENAWNLHSVEVETNFEVKEMSTNLTLFVEECGSQRCMNEGLFDFIFR

SEQ ID NO: 22464 - protein, 81 aa, Monodelphis domestica
GQEEVTFKDVAVDFTREEWCLLSPPQKELFKEVMLENIRNLLSVGVPAPPQDVLSFLEQREAPWMLDQEVLRSYYPGEIRP

SEQ ID NO: 22465 - protein, 81 aa, Physeter macrocephalus
MLENYSNLLSVGYQARKPDILSKLDQGEPWTMEDEIHCRTHSGYQASKPDAVSRLERGELWPVEDDSHVQICPEIRKVDDL

SEQ ID NO: 22466 - protein, 81 aa, Monodelphis domestica
CQASVTFKDVAIDFTPEEWRRLDASQKELYREVMLENYSNLVCLGLAASRPALISRLKQGKAPWAAKKHLQAGLWPGIPQA

SEQ ID NO: 22467 - protein, 81 aa, Papio anubis
MDVAIEFSLEEWQFLDTAQQNLYRNVMLENYRNLVFLGIAVSKPDLITCLEQEKEPWEPMRRHEMVAKPSVMCSHVAPDFW

SEQ ID NO: 22468 - protein, 81 aa, Papio anubis
MHESVTLEDVAVEFIQEWALLDSARRSLCRYGMLDRCRTLTSRGTPPCKPSRVSQLGPRAEPRATERGILHATGVAWESQL

SEQ ID NO: 22469 - protein, 81 aa, Aotus trivirgatus
AQVSVTFDDVAVTFTKEEWGQLDLGQRTLYQEVMLENCGLLVSLGCPVPRPELIYHLEHGQEPWTRKEDLSQGTRPGDKGK

SEQ ID NO: 22470 - protein, 81 aa, Aotus trivirgatus
FQESVTFKDVIVDFTQEEWKQLDPGQRDLFRDVTLENYTHLVSIGLQVSKPDVISQLEQGTEPWIMEPGIPVGTSADWKTR

SEQ ID NO: 22471 - protein, 81 aa, Aotus trivirgatus
ACRSITFRDVAIDFSHQEWEYLNLVQKTLYQEVMMENYDNLVSLAGHSISKPDLITLLEQGKEPWMIVREDTRGEYTDLDS

SEQ ID NO: 22472 - protein, 81 aa, Aotus trivirgatus
ISFEDVAVDFTLEEWQLLSPTQKSLYRDVMLENYSNLVFLEVWLDNPKMWLQDNQDNLKSMERGHKYGVFGKIFKSSINFV

SEQ ID NO: 22473 - protein, 81 aa, Aotus trivirgatus
RPQESVAFDDVAVYFTKKEWAMLVPDRRAVYRDVMLENYEAVAAPPTSKPAWVSHLEQGKEPCFTQPQGVLSRRDWRAAKA

SEQ ID NO: 22474 - protein, 81 aa, Aotus trivirgatus
MELLTFRDVAIEFSLEEWQCLDTAQQNLYRNVMLENYRNLVFLGIAVSKPDLITCLEKEKEPWNMKRYEMVDEPPGLCLHF

SEQ ID NO: 22475 - protein, 81 aa, Aotus trivirgatus
MGPLTFRDVAIEFSLEEWQCLDTAQRNLYRNVMLENYRNLVFLGIAVCKPELIICLEQEKEVWSRKRQEIMVAKPPVMHSH

SEQ ID NO: 22476 - protein, 81 aa, Papio anubis
QDTVAYEDLCVDYTQKKWKCPALSQRALQWNMMPENDRSMASLGENMMKGSELTPKQEIFKGSESSNKTSGGLFGMVPGGA

SEQ ID NO: 22477 - protein, 81 aa, Papio anubis
AQMLVTFKDVAVTFTQEEWRQLDLTQRTLYREVMLETCGLLVSLGHRVPKPELVHLLEHGQELWTVKRGLSDPTCAGDRTQ

SEQ ID NO: 22478 - protein, 81 aa, Felis catus
SQGSVTFRDVAIDFSQEEWEWLQPTQRDLYRHVMLENYSHLVSLGLNISKPYVVSLLEQGKEPWLEKRGVRRDLFSVLKEA

SEQ ID NO: 22479 - protein, 81 aa, Leptonychotes weddellii
MAVTFEDVTVIFTWEEWKFLDSSQKKLYREVMWENYTNVMSVGNWKESYKPQEERFRYLEHENLPCWQAWKNASAQIYENR

SEQ ID NO: 22480 - protein, 81 aa, Neomonachus schauinslandi
APEQVTFEDVVVDFTQEEWGQLEPAQRTLYRDVMLETFRLLVSVAGCWLPELDVISLLEQEEELWAVDEGVPRGVCSDLET

SEQ ID NO: 22481 - protein, 81 aa, Neomonachus schauinslandi
MEFTWEEWQLLDSTQKYLYRDVILENYSHLVSVGYHGTKPDLIFKLEQGEEPWIINAKVSRQSCPGWKEWYQKNQDEFENI

SEQ ID NO: 22482 - protein, 81 aa, Neomonachus schauinslandi
SMGSLSFRDVTVGFTQEEWQHLDPAQRTLYRDVMLENYSHLVSVGCSIPKPEVILKLEQGEEPWILEEEIPSQSDPGLGLK

SEQ ID NO: 22483 - protein, 81 aa, Neomonachus schauinslandi
KVPVTFVDIAVYFSEDEWKNLDEWQKELYNNLVKENYKTLMSLDMEGAVPKPDAPSQVEPREEPCVWEQRDPEEREILMDP

SEQ ID NO: 22484 - protein, 81 aa, Neomonachus schauinslandi
FQGSVTFRDVAVAFSQPEWESANPAQRHLHRDVMLENYSNLVSLAGHSISKPHLITLLEQWKEPWMIVRKDQRRQYTDFQL

SEQ ID NO: 22485 - protein, 81 aa, Monodelphis domestica
MLENARNLLTVGLSAPPEKVVSYLEQRDVLWMLEQEGLRIWYPGENRPEIMVNPTEVSFPVEEVNLQRSISDGPDNFASRE

SEQ ID NO: 22486 - protein, 81 aa, Monodelphis domestica
AQEVVTFKDVAVDFTREEWRLLSPPQKELYKEVMLENAQNLLSVGLLAPPAYVLSYLEQREAPWMVEQKGLRNCCPEGEIR

SEQ ID NO: 22487 - protein, 81 aa, Monodelphis domestica
GQEAVTFQDVAVDFTREEWRLLSPPQKELYREVMLENAWNLLSVGLPASPEDVLSSLEQREAPWMLEQEGLRSCCPEGEIR

SEQ ID NO: 22488 - protein, 81 aa, Monodelphis domestica
IQSSLTFKDVAVDFTQEEWCLLDHSQKELYLEVMLENVQNLFSVGLPVPREYCTSCFQQGKVPWQLEPKSPRSSCPEAETN

SEQ ID NO: 22489 - protein, 81 aa, Monodelphis domestica
AQEAVTFKDVAVDFTQEEWCLLTSPQKELYKEVMLENAWNLLSVGLAVPREDVISSSEQRAAPWILEQEGLRNCHPEGEIR

SEQ ID NO: 22490 - protein, 81 aa, Monodelphis domestica
SITFKDVAVDFTKEEWCLLDYSQKELYREIMLENVQNLLFVEAETDFEVKKMSTKLSLFVEGSGPPGGINKGCCDFILREI

SEQ ID NO: 22491 - protein, 81 aa, Physeter macrocephalus
TQGQLTFEDVAITFSHEEWECLDPAQRALYRDVMLETYGNLRSLVRISVSVVTIISILEQGKELWALESEVKNSKKSNEWE

SEQ ID NO: 22492 - protein, 81 aa, Monodelphis domestica
LQGLVTIKDVSLCFSQEEWRSLDPSQTDFYGEYIMEENCGIVVSLKFPIPKVDMISQLEGEEQWVPDPTQDLEERDIPRIT

SEQ ID NO: 22493 - protein, 81 aa, Physeter macrocephalus
SEESVTFEDVAINFTQKEWALLDTSQKTLFRNVMLENITHLVSVGYQISKSEVISQLEQGKELWSEVTGCLLGQSPDGENP

SEQ ID NO: 22494 - protein, 81 aa, Monodelphis domestica
MELVTFEDVAVYFTRKEWGWLDPAQRDLYRDVMLENYGNFVSMGLPFSKPDVISQLEQGEESWVEDLQECEEGEFSPVVHS

SEQ ID NO: 22495 - protein, 81 aa, Monodelphis domestica
PEGSVMFRDVAVLFSPDEWGRLGQGQRELYWEVMLENYQTLVWLGLAVTKPDVISLLERGRTPWMPAPGGPRSSCPDWNTR

SEQ ID NO: 22496 - protein, 81 aa, Physeter macrocephalus
FKEAVTFKDVAVVFTEEELGLLDSAQKKLYQEVMLENFQNLVSVGHQSFTPDVISQLKREEKLWMIKIATQSRRSSGDKNL

SEQ ID NO: 22497 - protein, 81 aa, Physeter macrocephalus
VAAFMVPGQGHVIFEDVAVSFSQEEWGLLNDAQRLLYCDVMLENLSLIASLDTVSALTDAGKASLLREQIHIWAFASIPHL

SEQ ID NO: 22498 - protein, 81 aa, Monodelphis domestica
IQGSLTFKDVAMNFTQEEWCLLDHSQKELYLEVMLENVQNLLSVGLPVPREYCASYFQQGKAPWLLELKGPRSSFPEAETN

SEQ ID NO: 22499 - protein, 81 aa, Monodelphis domestica
AWEVVTFQDVAVDFTREEWRLLSPPQKELYKEVMLENVRNLLSVGLPAPPDDVVSYLEQREGPSMLDQEDLRTCGPEGEIR

SEQ ID NO: 22500 - protein, 81 aa, Aotus trivirgatus
ELKLLTFRDVTIEFSPEEWKCLDPAQQNLYRDVMLENYRNLVSLGVAISNPDLVTSLEQRKEPYNVKMHKTVNFFHIHANK

SEQ ID NO: 22501 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPASSFHF

SEQ ID NO: 22502 - protein, 81 aa, Aotus trivirgatus
YQESVTFEDVSVDFTQEEWTLLDPLQRNFYRDVMLENYENLAKVGFQLLKPSLISWLEEEEELRTLQQEVLQEWAIKLHTN

SEQ ID NO: 22503 - protein, 81 aa, Papio anubis
DSISLEDVAVNFTLEEWALLDPGQRNIYRDVMRATFKNLACIGEKWKDQDVEDDPKNQGRKPSSPVVETLCENKEDRPCGK

SEQ ID NO: 22504 - protein, 81 aa, Aotus trivirgatus
VVFEDVAVDFTREEWALLDSAQRDLYRDVMLETFQNLASVDDETPCKADRSVSQQDMYGAKISQEQTIPNFTRNNSCAYAL

SEQ ID NO: 22505 - protein, 81 aa, Pan paniscus
SQGRLTFRDVAIEFSQEEWKYLDSAQRALYRDVMLENYRNLVSLGEDNAPPEAGICSAVSLHVPCVPLGSPCIAQLRLKLC

SEQ ID NO: 22506 - protein, 81 aa, Lipotes vexillifer
VKESVTFKDVAIDFTLEEWRLMDPTQRKLHKDVMLENYRNLVSLGLAVSKPDMISHLEDGKGPWVVVRETSKNPYSELETK

SEQ ID NO: 22507 - protein, 81 aa, Monodelphis domestica
MAFKDVAVDFTREEWCLLSPPQKELYKEVMLENARNLFSVGLAVSRGDVISYFEQREAPWMLEQEDLGIGCPGEGITKKPL

SEQ ID NO: 22508 - protein, 81 aa, Physeter macrocephalus
EPLMDTALGSVTFEDVAVYFSQEEWRLLDEAQRFLYRDVMLETFALVASLGLAFSRSHVVQEELGGEPWVYDSRHNMRGSK

SEQ ID NO: 22509 - protein, 81 aa, Monodelphis domestica
MFEDVAVYFRKEEWAGLAPTQRALYKDVMLENYGNVASLVPCPKPRVISKLEQSGDLQGSLFRGHRIPRVGGKARLEKEKV

SEQ ID NO: 22510 - protein, 81 aa, Monodelphis domestica
QLGSVAFEDVAVDFTQEEWGYLAPAQRDLHREVMLENYRNLVFLGLVASKPDVICHLEQRKEPWSLRGIEKRKALRGTCPD

SEQ ID NO: 22511 - protein, 81 aa, Monodelphis domestica
AQVLVTFQDVAVDFTQEEWRLLDPGQKELYKEVMLENVQNVLSLGLPVPREDWFFHFHEGGDPWMLEGKGPSISRLDEERH

SEQ ID NO: 22512 - protein, 81 aa, Monodelphis domestica
PAQEVVTFRDVAVDFTREEWRLLSPPQKELYKEVMLENVRNLLSVGLPAPPKDMILEQREAPWMLEQEGLRCYCPGEIRSE

SEQ ID NO: 22513 - protein, 81 aa, Monodelphis domestica
AQEVVTFKDVVVEFTREEWCLLSPAQKELFKEVMLENAWNLHSLGLPAPLEDMISYLKLKEPPWMLEQEGLRSFFPEGKIR

SEQ ID NO: 22514 - protein, 81 aa, Monodelphis domestica
SQVSLTFRDVAVDFSQEEWGLLEPAQKDMYRDVMLENYENFLSLGLPISKPNMISQLKRREAPSWIAEGKVSLSTYLGTLR

SEQ ID NO: 22515 - protein, 81 aa, Monodelphis domestica
SQESLTFKDVAVDFTQEEWRQLDPGQRYLYRDVMLENYSNLVSLGHQISKPDVISQLEQGEEPWLVKGEIPRDTFPDWETM

SEQ ID NO: 22516 - protein, 81 aa, Physeter macrocephalus
FQEPVSFKDVSVVFTEEELGLLDSAQRKLYRDVMLENFQNLLSVGNQPFKPELIFQLEREEELLMMETETQRDGCSGTKSQ

SEQ ID NO: 22517 - protein, 81 aa, Monodelphis domestica
SQGSITFKDVAVDFTQEEWCLLDHSQKELYLEVMLENVQNLFSVGLPVPRENFISFFQQGESSWLLEQKGLWSSCPEAEAN

SEQ ID NO: 22518 - protein, 81 aa, Physeter macrocephalus
PLTFKDVAIEFSREEWECLDPAQKAFYVDVMLETYSNLLSLDISHIHVIKKLQPRANSDRGEVFQTVMLERQESHEMKHFY

SEQ ID NO: 22519 - protein, 81 aa, Papio anubis
SVTFRDVAIDFSQEEWEFLDPAQRDLYRDVMWENYSNFISLGKFPGMVVRACSPNLESRYRTNTLSPEKDIYEIYSFQWDI

SEQ ID NO: 22520 - protein, 81 aa, Papio anubis
DSMTFEDIVVDFTREEWALLDTSQRKLFQDVMLENISHLVSIGGEGDIKHQEIPFIQHTYQKGTSTISTMRSHTQEDPFLC

SEQ ID NO: 22521 - protein, 81 aa, Papio anubis
ERNFLGPLTFTDVAIEFSLEEWQCLDTAQQNLYRNVMLENYRNLVFLGITVSKPDLITCLEKEKESWNMKRHEMVDEPPGR

SEQ ID NO: 22522 - protein, 81 aa, Aotus trivirgatus
EMETLTFRDVAIEFSLEEWQCLNPAQQNLYRNVMLENYRNLVFLGIAVSKADLITCLQQEKDPWNMKRHSIVAKPPVLCSH

SEQ ID NO: 22523 - protein, 81 aa, Sarcophilus harrisii
AKESITFKDVSMDFTREEWGQLNPAQKNLYRDVMLENYRNLVSLGLQVFKPDVIARLERAEAPWTLENKVLRHSCSDWEMK

SEQ ID NO: 22524 - protein, 81 aa, Lipotes vexillifer
PKVPVTFDDVAVYFSEPEWGKLDEWQKELYKHVMRGNYETLVSLDYAISKPDILTRMERGEEPCPEGPRGQEEGSDREEAR

SEQ ID NO: 22525 - protein, 81 aa, Lipotes vexillifer
SLGSDLFRDVAVVFSQEEWEQLAPAQRDLYRDVMLEIYSNLVSLGFAISKPDVISFLEQGREPWMVEKVVTGGQCPVLESR

SEQ ID NO: 22526 - protein, 81 aa, Lipotes vexillifer
AQESLTYDDVTMKFTWEEWQLLDPDQKDLYRDVMLENYSNLLSVGYQASKPDALFRLERGEQLWPVEDDSHGRICPEIRKV

SEQ ID NO: 22527 - protein, 81 aa, Pongo abelii
GLLTFRDVAIEFSQEEWKCLDPAQRTLYRDVMLENYRNLVSLEFRSVTQAKVQWCHLSSLQPPLPRFKQFSCLSLPSSWDY

SEQ ID NO: 22528 - protein, 81 aa, Pongo abelii
KRKGKEPSMALPQGRLTFRDVAIEFSLAEWKFLNPAQRALYREVMLENYRNLEAVESHFVTQAGVQWCDLGSLQPLPPKFK

SEQ ID NO: 22529 - protein, 81 aa, Pongo abelii
EMGPLQFRDVAIEFSLEEWHCLDTTQRNLYRDVMLENYRNLVFLGIVVSKPDLITCLEQGIKPLTMKRHEMIANTPGPGMV

SEQ ID NO: 22530 - protein, 81 aa, unidentified
  REGION 1..81: note = Bos indicus x Bos taurus
YEFDVTIDFTLEEWECLDLDQQELYRNVMLENYGNLASLGLVVSKPDLVTFLEQMKNPWDIRRTDTTATYPCRCEWLELMT

SEQ ID NO: 22531 - protein, 81 aa, unidentified
  REGION 1..81: note = Bos indicus x Bos taurus
MESVTLEDVAMELIQEWTLLDDAGRNLCRHVLQDNCRTPAPRGTPPCKASLVSQVEPREELKAAEHGVLCATGVDWESQFT

SEQ ID NO: 22532 - protein, 81 aa, Pan troglodytes
VQGLLTFRDVAIEFSQEEWKCLDPAQRTLYRDVMLENYRNLVSLEFWSVTPAKVQWCHLRSLQPLLPRFKQFSCLSLPSTW

SEQ ID NO: 22533 - protein, 81 aa, Pan troglodytes
HLVTFEDVAVDFTQEEWTLLDQAQRDLYRDVMLENYKNLIILELDLQLKTKGFPLLQDISAERSPNGVQLERSNTAEKLYD

SEQ ID NO: 22534 - protein, 81 aa, Pan troglodytes
EMGLLTFRDIAIEFSLEEWQCLDCAQQNLYRDVMLENYRNLVSLGIAVSKPDLITCLEQNKESQNIKRNEMVAKHPVTRSH

SEQ ID NO: 22535 - protein, 81 aa, Pan troglodytes
QGRLTFRDVAIEFSLAEWKFLNPAQRALYREVMLENYRNLEAVDISSKHMMKEVLSTGQGNTEVIHTGTLQRHQSYHIGDF

SEQ ID NO: 22536 - protein, 81 aa, Monodelphis domestica
IQGSLTFKDVAVDFTQAEWCLLDHSQKELYLEVMLENVQNLLSVGLPVPREYCASCFQQGKTPWLLEQKGLRSACPEAETN

SEQ ID NO: 22537 - protein, 81 aa, Monodelphis domestica
FQESLTFKDVAVEFTWEEWRHLGPAQRALHTNVMLENYENLVSIGIPVSKLDLLLLLKREDVQIQEGEAGTGTSTEGKIRL

SEQ ID NO: 22538 - protein, 81 aa, Monodelphis domestica
AQKSLTFKDVAVDFTKEEWRQLNPSQRDMYRDVMLENYKNLVFLGLLGSQPDVISQLEKGEVPWMPEGEISRNPSLDSIIQ

SEQ ID NO: 22539 - protein, 81 aa, Monodelphis domestica
VVTFQDVAVNFTREEWRLLSPPQKELYREVMLENARNLLSVEEDIRLEIKAIPTEESLSVKERDQQRFMRGGPYNCVVSQN

SEQ ID NO: 22540 - protein, 81 aa, Physeter macrocephalus
MDSVTFEDVSVKFTTEEWALLDLSQKKLYRDVMQETFKNLTSIGEKWEDPETEDQYENPGTNLRHMTSRTTPKPREYQEYE

SEQ ID NO: 22541 - protein, 81 aa, Monodelphis domestica
APEESVTFNDVAVDFTQDEWRHLDPSQKELYRDVMLENYKNLVSLGLPISKPDVISQLEQGETPWILENERFKSSYPVAMQ

SEQ ID NO: 22542 - protein, 81 aa, Monodelphis domestica
VLTARFQDVAVEFTWEDWRHLDPAQRALHRNVMLENYENLVSIEGKIRLEMKEMTAELSLSGEETQKQRCIGDGACDSTWK

SEQ ID NO: 22543 - protein, 81 aa, Monodelphis domestica
SEETVTFKDVAVDFTWEEWKQLTPVQRDLYRDVMLENYQNLVSLGLPVFQSDLISQLERGEVPWIPEGETFRGPCPGSINQ

SEQ ID NO: 22544 - protein, 81 aa, Monodelphis domestica
SQGSITFKDVAVDFTQEEWCLLDHSQKELYLEVLLENVQNLLSVGLPVPRENFISHIQQRKTSWLLEQKGPRSSSLDFEVK

SEQ ID NO: 22545 - protein, 81 aa, Physeter macrocephalus
MDVFVDFTWEEWQLLDPAQKHLYRSVMLENYSNLVSLGYQHTKPNIIFQLEQEELWMMQIPSEGHLDEVWEIDGRMEWHKE

SEQ ID NO: 22546 - protein, 81 aa, Monodelphis domestica
MESVTFQDVAVDFTHDEWGRLEPAQKDLYRDVMLENYQNFVSLGGLPAPKPHVISQLERGETPCPAEREAPRAICQDSIIW

SEQ ID NO: 22547 - protein, 81 aa, Monodelphis domestica
MLENVRNLLSVGLQAPQEDVISSLEQREAPWMLEQEGLMSCCPGEIIPEMKENPTEMSPSLEEMELQRFINDSPNKFAFRE

SEQ ID NO: 22548 - protein, 81 aa, Monodelphis domestica
GSVTFRDVAVDFSGDEWGFLSPAQRELYWDMMLENSGAFRALPHGTHRECCFRRQWTRLCHTGSSDFPWSRNSTQRWRMWE

SEQ ID NO: 22549 - protein, 81 aa, Physeter macrocephalus
MITSQEEWQHLDSAQRTLYRDVMLENYSHLISVGFCIPKPEVILKLEQGEEPWILEEESPSQCVPELINSSRNYSRKKFDE

SEQ ID NO: 22550 - protein, 81 aa, Aotus trivirgatus
MQRPLQFRDVAIEFSLEEWHCLDAAQRNLYRDVMLENYRNLVFLGIVVSEPDLITCLEKGKKPLTVKRHEMIATPPVMCSH

SEQ ID NO: 22551 - protein, 81 aa, Aotus trivirgatus
AHVSLAFRDVSIDLSQEEWECLDPAQRDLYKDVMFENYSNLVSLGYTIPKPDVITLLEQEKEPWIVMREGTRSWYTDLEYK

SEQ ID NO: 22552 - protein, 81 aa, Papio anubis
MDVAIEFSQEEWKCLEPAQRTLYRDVMLENYRNLVSLGEDNVASEQKKDPWILQSEEKIANNPDGRECIKGVNTEPSLCPQ

SEQ ID NO: 22553 - protein, 81 aa, Aotus trivirgatus
LEPRAPVTFDDITVYLLQEEWVLLSKQQKELCGSDKLVPPLGPTVANPELFCKFGRGPEPWLGSMQGQRSLLEHQPGKKQM

SEQ ID NO: 22554 - protein, 81 aa, Aotus trivirgatus
GLSFQGLVMFQDLSIDFSQEEWECLNPTQKDLYRDVMMENYSNLLSLGLSIPKPDVISLLEQGKEPWMVSRDVLGGWCPGE

SEQ ID NO: 22555 - protein, 81 aa, Aotus trivirgatus
VHGSVTFRDVAIDFSQEEWECLQPAQRTLYRDVMLENYSHLISLGSSISKPDVITLLEQEKEPWMVIRKETNRWYPDLESK

SEQ ID NO: 22556 - protein, 81 aa, Pan paniscus
PKPPKGLLTFRDVAIEFSLEEWQYLDTAQKNLYRKMMLENYRNLAFLGIAFSKPDLITCLEQGKEPWNMKRHVMVDEPPGR

SEQ ID NO: 22557 - protein, 81 aa, Lipotes vexillifer
VLLQVSFKDVTVDFSREEWQHLDPAQRLLYRDVTLENYSHLCSVGYQVPKPEVIFKLEQGEGPWTLEEETPHQSCSDEDNG

SEQ ID NO: 22558 - protein, 81 aa, Lipotes vexillifer
RSQGPASFEDVSMGFTQEAWQHLDPAQRTLYREVMLENYSHLISVGYSVIKPEVIFKLPQEEPWMLEEKSQSQSHPDFCIV

SEQ ID NO: 22559 - protein, 81 aa, Pan paniscus
AQESLTLEDVAVDFTWEEWQFLSPAQKDLYQDVMLENYSNLVAVGYQASKPDAFSKLERGEETCTTEDEIYSRICSEIRKI

SEQ ID NO: 22560 - protein, 81 aa, Callithrix jacchus
GSVTFEDVAVYFSWEEWDLLDETQKHLYFDVMLENFVLTSSLGYWCGLEHEEAPSLQRISLKGAPQFRTSKEGSSSQNAYS

SEQ ID NO: 22561 - protein, 81 aa, Callithrix jacchus
RNVLLENYRNLVFLGIAVSKPYLITCLEQKKEPWNMKRCEMVAKPPVMCFHFAQDLWSEQNMKDSFQNVTLRRCGKCGHEN

SEQ ID NO: 22562 - protein, 81 aa, Bos taurus
TTGPMTFEDVALGFTPDEWGKLDLEQKSLYREVMLENYRNLVSVEHQLSKPDVVSQLEEEEELWSVERGIPQDTFSECPEA

SEQ ID NO: 22563 - protein, 81 aa, Ovis aries
MLENFALIASLGLASFRSHIVAQLEMGAEPWVPDRVDMTSAMARGMYRGLGSDFYCGTEGEKSPAELSVSVEVSQNMKSKA

SEQ ID NO: 22564 - protein, 81 aa, Ovis aries
SQTQLTVEDVDIKFTPEEWECLDPAQRALYWDVMEETYRNLLSVVFCLSVMSITSWLTKEEKKSERFMEIGFQRKKSQRNY

SEQ ID NO: 22565 - protein, 81 aa, unidentified
  REGION 1..81: note = Bos indicus x Bos taurus
SQESVKFRDVAVVFSPDQWAHLSPEKRELYRDVMLDTCDHLVSLGHWAYKAEVMSSLRQGKEPWMLEKEVTSAPCPACQPA

SEQ ID NO: 22566 - protein, 81 aa, unidentified
  REGION 1..81: note = Bos indicus x Bos taurus
VTFEDVAMSFSQEEWGLLGEAQRLLYYDVMLENLSLIASLGKNCICTHRSFVVNTRLFFQDSPQGSPNKSFFPEACHFPEV

SEQ ID NO: 22567 - protein, 81 aa, unidentified
  REGION 1..81: note = Bos indicus x Bos taurus
MAASQGWLTFQDIAIDFTQEEWECLDLGQRELYRDMMLENYGNLASLGLVSKPDLVTFLEQRKDSRNIRRVETTPIYPGMS

SEQ ID NO: 22568 - protein, 81 aa, unidentified
  REGION 1..81: note = Bos indicus x Bos taurus
MSLYRDVMLENYRNLVSVGFCITKPEVIFRLEQGEEPWILEEEFLSQSFSEVWKTDHMKERSHENQPKHVWEVVLINNKRL

SEQ ID NO: 22569 - protein, 81 aa, Pan troglodytes
KPGAVSFADVAVYFSREEWGCLRPAHRALYRDVMRETYGHLGALGCAGPKPALISWLERNTDDWEPAALDPQEYPRGLTVQ

SEQ ID NO: 22570 - protein, 81 aa, Pan troglodytes
RKRKAKESGMALPQGLLTFRDVAIEFSQEEWKCLDPAQRTLYRDVMLENYRNLVFLDTSSKCMMKMFSSTGQGNTEVVHTG

SEQ ID NO: 22571 - protein, 81 aa, Pan troglodytes
AQGTVTFEDVAVNFTWEEWNLLSEAQRCLYRDVTLENLALISSLGMTFLHVCQALDSLRQVIPTSASQSAGITGSHSIPQA

SEQ ID NO: 22572 - protein, 81 aa, Pan troglodytes
SFYEKGPLTFKDVAIEFSLEEWQCLDTAQQDLYRKVMLENYRNLVSLGIAVSKPDLITCLEQGKEPWNMKRHAMVDEPPGR

SEQ ID NO: 22573 - protein, 81 aa, Callithrix jacchus
AHALVTFRDVAINFSQKEWECLDPTQRKLYRDVMLENYSNLVSLGYSGSKPDVITLLEQGKEPCVAVRDMTGRQYPGLLSR

SEQ ID NO: 22574 - protein, 81 aa, Callithrix jacchus
VTFEDVAVVFTDEEWSHLVPIQRDLYKEVMLENYKSVVSLDWETKPEIYDASEEKAEGSLRESLGKQSPLCPKFEVHAPDG

SEQ ID NO: 22575 - protein, 81 aa, Macaca mulatta
FRGMVTFKDVAVVFTREELGLLDLAQRKLYQDVMLENFRNLLSVGYHPFKLDVILQLGREDKLWLMETEIQRDGCSGHRNQ

SEQ ID NO: 22576 - protein, 81 aa, Monodon monoceros
PLESVTFKDVAIDFTWEEWRLMDPTQRKLHKDVMLENYRNLVSLGLAVSKPDMISHLEDGKGPWVVVRETSKTPYSELETK

SEQ ID NO: 22577 - protein, 81 aa, Macaca mulatta
MGPLQFRDVAIEFSLEEWHCLDTAQRNLYRDVMLENYRNLVFLGIVVSKPDLITRLEQGKKPLTVKRHEMVAKPPVMCSHF

SEQ ID NO: 22578 - protein, 81 aa, Monodon monoceros
SAALPSEDLCPLQDSFSRYEEEMEAYPQQILSQKIGITGVTSGLLLSKPDVIARLEQGEDPWRVEPGSPRDWKTTLEKKES

SEQ ID NO: 22579 - protein, 81 aa, Macaca mulatta
MQRALYREVMLENYANVTSLSAFPFSKPDLIFQLEQGEAAWGPDPWTLAGGEALRGMCTGGKTKTKNEEQTAQLNISKESE

SEQ ID NO: 22580 - protein, 81 aa, Callithrix jacchus
TEDRVVFEDVAIYFSQEEWGHLDEAQRLLYRDVMLENLALLSSLGCWHGAEDEVAPSQQGFSAGVSEVTTSESCMFTQKVY

SEQ ID NO: 22581 - protein, 81 aa, Bos taurus
STLAESVRASNYWLLILLGCPVPRPELIYQQEHGQELWTVKRDLSRSTCAVDEGKPKTTEPTSCEPTLSKGASLQELMQGG

SEQ ID NO: 22582 - protein, 81 aa, Bos taurus
MTTGKTIGWLTFQDVAIDFTQEEWECLDLGQRELYRDVMLENYGNLASLGEDNCLPESLIYPLGFSCVMSRMSSEMFCFLQ

SEQ ID NO: 22583 - protein, 81 aa, Ovis aries
PQGSTPFSSVTVDFTHGGWRQLAPAPRDRFEEGMPEKSRNLVLLGLPVSQPGMNSQLEQREGSWMLKGDGLRNACPDWKII

SEQ ID NO: 22584 - protein, 81 aa, Ovis aries
YGRWKQLLHIVKKERLTSEDVAIEFTQEEWEFLDPAQRALYRDVMLETYRNLLSVGAEYAKLLLSIVSLFARPVDYKSNKT

SEQ ID NO: 22585 - protein, 81 aa, Ovis aries
LMEAVTFGDVAVHFSREEWQCLDPGQRALYKEVMLENHSSVAGLGFLVFKPELISRLEQGQDPWVLDLQGAEGREAARTTR

SEQ ID NO: 22586 - protein, 81 aa, Ovis aries
SQGRLTFQDVAIDFTEEEWECLDLGQRELYRDVMLENYRNLASLGLVISKPDLVTFLEQMKNPWDVRRLETPAVYTGWKPF

SEQ ID NO: 22587 - protein, 81 aa, Ovis aries
EQVTSEDVAIEFTQEEWEFLDRAQRALYRDVMLETYRNLLSVGISPTLVIKHLQCKVNSDKQETFQTLMLGSPESCEIKRV

SEQ ID NO: 22588 - protein, 81 aa, Ovis aries
EEWECLDPAQRTLYRDVMLETYRNLLSVEMTILPVVKKLQLKTNSDRGEVFQLWILGRPERNEMDRFYLRVIQENIYNFQS

SEQ ID NO: 22589 - protein, 81 aa, Otolemur garnettii
LQVLVSFKDVTVGFNQEEWQHLDPDQKALYRDVMLENYSHLVSLGCCFTKPEVVFKLEQGQEPWIVEEESPYQSHPEFWNA

SEQ ID NO: 22590 - protein, 81 aa, Vulpes vulpes
QDSVVFEDVIVDFTREEWTLLNPAQRKLYKDVMLETFRNLVSIDDETQLKINGSISQQDIFGEKLSNEQKIARFIKNDSWT

SEQ ID NO: 22591 - protein, 81 aa, Otolemur garnettii
LQESLTFDDVSVKFTWEEWQLLGSAQKDLYRDIMLENYSNLVSVGTGYQASKSDILSKLEPGELWMTEDEIHRQICFEIRN

SEQ ID NO: 22592 - protein, 81 aa, Otolemur garnettii
FQGVMSFSDVAVDFTWEEWQLLDPLQKTLYRDVMLENYSNLLSLGYQATRPQIVVQLENREEGLIERDFSSQCSPEAVWQV

SEQ ID NO: 22593 - protein, 81 aa, Otolemur garnettii
DQNCVNLEDWFVHFTPEEWEILDERQKCMYCDVMQENFALVISLGPQAFAPRLVVNLLPDRMPILPVRVNTALAKGMMRGV

SEQ ID NO: 22594 - protein, 81 aa, Pan troglodytes
PVTSEDVAVLFIEAEWKRLRLEQRNLYKEVMLENLTESKPEVHTCPCCPLAFGSPQFLSQDELHNHPIPGFHAGNQLHPGN

SEQ ID NO: 22595 - protein, 81 aa, Pan troglodytes
QGLLTFRDVAIEFSQEEWKCLDPAQRTLYRDVMLENYRNLVSLDISSKCMMKTFFSTGQGNTEVIHTGTLQRQASHHTGDF

SEQ ID NO: 22596 - protein, 81 aa, Pan troglodytes
SMVTFEDVAVYFSQEEWELLDAAQRHLYHSVMLENLELVTSLGNALSQHVLLCSSVEADLPNCFPNWLHHFTSLSAVYKCS

SEQ ID NO: 22597 - protein, 81 aa, Otolemur garnettii
SLGPVSFKDVAVDFTQEEWQQLDPDEKITYRDVMLENYSNLVSVGYDITKPNVIIKLEQGEEPWIIEGELSCQSHLEEVWK

SEQ ID NO: 22598 - protein, 81 aa, Otolemur garnettii
PKVPVSFEDVSVYFTKSEWKLLDLRQRILYKRVMLENYSHLVSLGKISPQIPHSSQASLQTKPWVADNHRTGVTTRLHTGD

SEQ ID NO: 22599 - protein, 81 aa, Otolemur garnettii
FQGQLTFRDVAIEFSQEEWQCLDSAQRALYRAVMLENYRNLVSLAGLLLPDLTVLSMLEEGKAPWTVETEVKTPKNSNWEV

SEQ ID NO: 22600 - protein, 81 aa, Otolemur garnettii
SQELVTFEDVAVYFIRKEWKRLEPAQRDLYRDVMLENYGNVFSLDGETRTENDQEISEDTGSRGVLLERFQKDISQGLKFE

SEQ ID NO: 22601 - protein, 81 aa, Enhydra lutris
QAEVTFEDVAVLFSREEWGRLGPAQRGLYRDVMLETYRNLVSLGHGTRTEYKELSSGEMLDGEELDQLQKAVPQGPDPGET

SEQ ID NO: 22602 - protein, 81 aa, unidentified
  REGION 1..81: note = Bos indicus x Bos taurus
NKGSLSFEDVTVGSTQEEWQKLDPAQRTLYRDMMLENYSNLISVGYCIPKPELIFKLEQGEQPWVLEAESPSQSYPEVCRI

SEQ ID NO: 22603 - protein, 81 aa, unidentified
  REGION 1..81: note = Bos indicus x Bos taurus
FQPTVSFKDVAVTFTWVKWGHVDLAQRTVYREVVLETCSRLVSLVKAVATHHQTQGVAHFRHAWTGPEGAGNFETGNKKPY

SEQ ID NO: 22604 - protein, 81 aa, unidentified
  REGION 1..81: note = Bos indicus x Bos taurus
MLENYSNLVSLGLPFSKPEVISLLQQGEDPWKVEKESPGDSSLECKSSPKTTKATQTQDSSFSGLIRKTLKKDEPWNFISE

SEQ ID NO: 22605 - protein, 81 aa, Ovis aries
QEQLTSEDVAIKFTQEEWEFLDPAQRALYRDVMLETYRNLLSVDISPTHVMKHLQPTANSDKLETFHTLMLASPESCEIKL

SEQ ID NO: 22606 - protein, 81 aa, Ovis aries
MDFSREEWQQLDPAQRHLYQDVMLEIYSHFFSVGYHIPNPEIIFRIEEGKEPWMRETEVPCQRYHEGEFGLETPQQEISEE

SEQ ID NO: 22607 - protein, 81 aa, Ovis aries
SQGSVTFTDVSIDFSREEWEWLQPAQRDLYRHVMLENYGHLVSLAGLNISKPDVVSLLEQGKEPWLGNGDVSRELFPASKS

SEQ ID NO: 22608 - protein, 81 aa, Ovis aries
SLGWLTFWDVAIDFTQEEWECLDLGQRELYRDVMVENYRNLACLGLVVSKPDLVTFLEQMKDLRNIRRMETVGIYPAMSPQ

SEQ ID NO: 22609 - protein, 81 aa, Vulpes vulpes
RLRKASCWDISMEFTWEEWQLLDSAQKYLYRDVILENYSHLVSLGYHGTKPDLIFKLEQGEEPWMINARVSRQSYPEGWKE

SEQ ID NO: 22610 - protein, 81 aa, Vulpes vulpes
MFRDVAIDFSQEEWEYLDSAQRDLYRDVMLENYSNLVSLVDLPSRSVNKDLSPKKDIYETELSQWQMSARHQNCDFEESSS

SEQ ID NO: 22611 - protein, 81 aa, Otolemur garnettii
HLTFRDVAIEFSQEEWKFLDPAQRALYREVMLENYRNLVSLDIFPKCVIKKLPPTEKSRTGDTLHTLMLERHERHPSGDFC

SEQ ID NO: 22612 - protein, 81 aa, Vulpes vulpes
MIKSQISFEDVAVDFTLEEWQLLNPTQKNLYRDVMLENYSNLVFLGYHIIRPDAVFKREQEEPWMVEKEVLSQSFAEEVWL

SEQ ID NO: 22613 - protein, 81 aa, Otolemur garnettii
LQGSVSFKDVTVDFTQEEWQQLDPAQKALYRDVMLENYCHFVSVGFHMTKPDMIRRLEQGEELWTERIFPGQSYLEEDGKA

SEQ ID NO: 22614 - protein, 81 aa, Vulpes vulpes
EEVPVVFEDVAVYFTREEWGMLVKRQKELYRDVMRMNYELLASLGPAAAKPDLILKLERRAAPWIKDPDGPRWGQGRPPGK

SEQ ID NO: 22615 - protein, 81 aa, Otolemur garnettii
VQGSVSFKDVTVNFTRDEWLRLNGTQRTLYRDVMLENYSHLVSVGCCITKPDMIFKLEQGEEPWTLDGEFPGRGYPQVQKL

SEQ ID NO: 22616 - protein, 81 aa, Vulpes vulpes
VDVVNLLTGLCSEQGRGRLWVLQGGVTFEDIAVYFSWKEWRLLDEAQRRLYHHVMLENFTLISSLVPVPCVLNPEGDIGGQ

SEQ ID NO: 22617 - protein, 81 aa, Otolemur garnettii
CEGCLTFRDVAIEFSQEEWQCLAPAQRALYRAVMLENYRNLVSLGLLPPEVTVLSTLEEGKEPWTMKSEMNPAKNPNMGKW

SEQ ID NO: 22618 - protein, 81 aa, Otolemur garnettii
MQLLTLRDVSIEFSMDEWACLDPQQTLYRDVMLETYRNLVLLGLAVSKPDLITCLDQSNEPWKGKTHQTVVKHPAMHGEIY

SEQ ID NO: 22619 - protein, 81 aa, Otolemur garnettii
QDSLTFEDVTVNFTFTLEEWTLLDPSQKSLYRNVMQEIFRNLDTIGKPISESHRTSLECGKPFISLTGFRNHMVIHSGDGP

SEQ ID NO: 22620 - protein, 81 aa, Otolemur garnettii
QGWLTFRDVTIEFTPEEWECLDPVQRNLHRDVMLENYRNLVSVDFQVSFETLFQCLKKKKNTTNVPMGQGAVKEVSYISPS

SEQ ID NO: 22621 - protein, 81 aa, Otolemur garnettii
FQEFVTLKDVAMDFTLDDWKELGLDQGDLFWDTALDNYQNLFLLNPPRPNLTTHLGGKEELEALQPSLLFGGSGLYIVNQE

SEQ ID NO: 22622 - protein, 81 aa, unidentified
  REGION 1..81: note = Bos indicus x Bos taurus
TQVSVTFDDVAVTFTQEEWGHLDPAQRTLYREVMLETCRLLVSLGCPVPRPELIYRLEHGQELWTVKRDLSRSTCAVDEGK

SEQ ID NO: 22623 - protein, 81 aa, unidentified
  REGION 1..81: note = Bos indicus x Bos taurus
MHFSREEWELLDEAQRQLYHTVMLETLELVTSLGCWPVVEDEEVPSEKNASGEVVSQVKTPSVPPSMQKADSCDTCEPLLK

SEQ ID NO: 22624 - protein, 81 aa, unidentified
  REGION 1..81: note = Bos indicus x Bos taurus
ALSQLTFKDVFIDCTPEEWECLDPAQRTLYKDVMVETLRILLWIDDDISSCPGIISSNLELQSLKSHPRNGHTAWDVFPIE

SEQ ID NO: 22625 - protein, 81 aa, unidentified
  REGION 1..81: note = Bos indicus x Bos taurus
QESVTFQDVAVDFTEKEWPLLDSTQRKLYKDVMLENYSNLASVDWATPSKTKWSILMEDIFGKETSNGVTVEKVLGEESAE

SEQ ID NO: 22626 - protein, 81 aa, unidentified
  REGION 1..81: note = Bos indicus x Bos taurus
MLENYQNLLSLGAGFPGAKPDVISRLERGEEPRTERRETQQVTCPDLETSSATNQEMLLKKNISEEVASPMAKMEGILRAV

SEQ ID NO: 22627 - protein, 81 aa, Pan troglodytes
EPGAVSFADVAVYFSPEEWECLRPAQRALYRDVMRETYGHLGALGFPGPKPALISWMEQESEAWSPAAQDPEKGERLGGAR

SEQ ID NO: 22628 - protein, 81 aa, Callithrix jacchus
GPLTFRDVAIEFSLEEWQCLDTAQQDLYRKVMLENYRNLVFLDTGESILERSPTNVKNLLSSLQLLLHIREFTLERNPTNV

SEQ ID NO: 22629 - protein, 81 aa, Callithrix jacchus
QGLLTFRDVTIEFSQDEWRCLHPAQKTLYRDVMLENYRNLVSLDISSKYKMKGLLSTAQGDTDGFHTGILDRHESHHMGDF

SEQ ID NO: 22630 - protein, 81 aa, Ovis aries
FQGWLTFQDVAINFTQEEWECLDFSQRELYRDVMLENYRNLASLAGLVVSKPDLVTFLQIKNPWDVRRLETPAIYTAVSSH

SEQ ID NO: 22631 - protein, 81 aa, Ovis aries
LSQERLTSEDVAIEFTPEEWEFLDPAQRALYRDVMLETYRNLLSVGEDDFLPELPLGICIFPVCPLGGPDVFHVRVLVTGA

SEQ ID NO: 22632 - protein, 81 aa, Ovis aries
EQLTFKDVAVEFSQEEWECLDPAQRAFYMDVMVETLRNLISVDISHIHVVKKLQPIASSDRGDAFQTVTLERQESPEMKYF

SEQ ID NO: 22633 - protein, 81 aa, Ovis aries
VTECLRNCSQDSVTFADVAVNFTQEEWTLLNCFQRKLYRDVMLENYKNLTTAGYQVFKPTLISWLEEEELSTVEKGVLQGE

SEQ ID NO: 22634 - protein, 81 aa, Otolemur garnettii
VQDSVIFEDVAVNFTQEEWALLDISQKNLYRDVMLENFWNLASLGYPLHTSHLVSQWEQEEHLQTTKRGLIQDICTVEQQE

SEQ ID NO: 22635 - protein, 81 aa, Otolemur garnettii
FQGPVTFRDVAIDFSQEEWKWLQPAQRDLYRCVMLENYGHLVSLGLSISKPDVVSLLEQGKEPWLEQGDVRRNLFSVSQSN

SEQ ID NO: 22636 - protein, 81 aa, Otolemur garnettii
QTPVSFKDVVVGFTQEEWHGLNPAQRTLYRDVMLETYSNLVSVGYEGTKPDVILRLEQEEAPWICEVACPGCHCWEDIWQV

SEQ ID NO: 22637 - protein, 81 aa, Vulpes vulpes
AQVLVTFKDVAVTFTREEWGQLDLDQKALYQEVMLETYGLLVSLGHPVPKPELTHLLKCGQELWTGKRGLSRSTCSGDGTK

SEQ ID NO: 22638 - protein, 81 aa, Enhydra lutris
AQGCVTFEDVTIDFSQEEWGLLDEAQRLLYCDVMLENFALIASLGLTSFRSHIVAQLQMGAEPWVPDRVDMTSAMARGAYT

SEQ ID NO: 22639 - protein, 81 aa, Pan troglodytes
QGLLTFRDVAIEFSQEEWKCLDPAQRTLYRDVMLENYRNLVSLDTGFLLFCLANLKLLPSGDPSTSASKTAAITDISSKCM

SEQ ID NO: 22640 - protein, 81 aa, Pan troglodytes
AQVSVTFQDVAVTFTQEEWGQLDAAQRTLYQEVMLETCGLLMSLGCPLFKPELIYQLDHRQELWMATKDLSQSSYPGDNTK

SEQ ID NO: 22641 - protein, 81 aa, Pan troglodytes
PQASVCFEDVAMAFTQEEWEHLDLAQRTLYREVTLETWEHIVSLGLFLSKSDVISQLEQEEDLCRAEQEAPRGTRASKKQR

SEQ ID NO: 22642 - protein, 81 aa, Enhydra lutris
SQESVQLRDVAVTFSPEQWAYLSSEERQLYTDVMLDNLDYLVSLGHWTYKAEVVSALRQGKDLWMVEKEVTSAPCPACQPA

SEQ ID NO: 22643 - protein, 81 aa, Enhydra lutris
SKESVTFKDVAVDFTQEEWGQLDSPQRALYRDVMLENYQNLLALGPPVCKPDVISHLERGEEPWWMPREVPGGACPEGEPG

SEQ ID NO: 22644 - protein, 81 aa, Enhydra lutris
HQELVTFKDVAVYFTRTEWAGLSPTQKALYRSVMLENYGNLTSLGYPVPKPALISLLEGENLPWGLEAQENPSAEGTKDIC

SEQ ID NO: 22645 - protein, 81 aa, Pongo abelii
ALTQGQLSFRDVAIEFSQEEWKCLDPGQKALYRDVMLENYRNLVSLDFSLLAWDARVFRVEAWRTSGGAEEPTSPNFGGND

SEQ ID NO: 22646 - protein, 81 aa, Pongo abelii
IQGQVNFEDVFVYFSQEEWVLLDEAQRLLYRDVMLENFALMASLGHTSFMSHIGASLVMGSEPWVPDWVDMILAVATETPG

SEQ ID NO: 22647 - protein, 81 aa, Pongo abelii
EMELLTFRDIAIEFSLEEWQCLDHAQQNLYRDVMLENYRNLVSLGITVSKPDLITCLEQNKEPRNIKRNEMVAKHPVTCSH

SEQ ID NO: 22648 - protein, 81 aa, Pongo abelii
AQVSVTFDDVAVTFTQEEWGQLDLAQRTLYQEVMLENCGLLVSLGCPVPRPELIYHLEHEQETWTRKEDLSQGTCPGDKGK

SEQ ID NO: 22649 - protein, 81 aa, Pongo abelii
EKGPLTFRDVAIEFSLEEWQCLDTDQQGLYRKVMLENYRNLVFLAGIALTKPDLITCLEQGKEPWNIKRHEMVAKPPDGVS

SEQ ID NO: 22650 - protein, 81 aa, Pongo abelii
TVTFEDVAVNFSQEEWCLLSEAQRCLYRDVMLENLALISSLGCWCGSKDEEAPCKQRISLQRESQSRTPRTVISPKKAHPC

SEQ ID NO: 22651 - protein, 81 aa, unidentified
  REGION 1..81: note = Bos indicus x Bos taurus
MTQRPITYTDVIIEFFYMRGNSLTFVQKKLYPDVMMEKCSNLVSVDHSIPKPDIIVLKQGKEPWMVVREEKRSWSIDLDSR

SEQ ID NO: 22652 - protein, 81 aa, unidentified
  REGION 1..81: note = Bos indicus x Bos taurus
WHMNFVFQGWLTFQDVAIDFTQEEWECLDLGQRELYRDVMLEKYGNLASLGEDNCLPESLIHPPGYGSCISRMSPGIFCFL

SEQ ID NO: 22653 - protein, 81 aa, unidentified
  REGION 1..81: note = Bos indicus x Bos taurus
VRGWEVSWGPGESCCVWAQLSPLWQGGVTFEDVFMYFSREEWELLEEAQRLLYRDVMLENFAHVAALGESLLSRAWALLDP

SEQ ID NO: 22654 - protein, 81 aa, unidentified
  REGION 1..81: note = Bos indicus x Bos taurus
SQESVKFRDVAVVFSPDQWAHLSPEKRELYRDVMLDTCDHLVSLGRWAYKAEVMSSLRQGKEPWMLEKEVTSAPCPACQPA

SEQ ID NO: 22655 - protein, 81 aa, unidentified
  REGION 1..81: note = Bos indicus x Bos taurus
ASQGWMTFQDVAIDFTQEEWECLDLSQRELYRDVMLENYGNLASLGLVSKLDLVTFLEQLKDSRNIRRMETTAIYPAMSPQ

SEQ ID NO: 22656 - protein, 81 aa, Pan troglodytes
VGGSVSFSDVAVGFTQEEWQHLDPAQRTPYRDVMLENYSLLLSVGYCITKPEVFCKLEHGQVLWILEEESPSQSHLDCCID

SEQ ID NO: 22657 - protein, 81 aa, unidentified
  REGION 1..81: note = Bos indicus x Bos taurus
LSKGWLTFQDVAIDFTQEEWECLDLGQRELYRDVMLENYGNLASLGLVSKVDLVTFLELLKDPRNMRRMETTAIYPAMSPQ

SEQ ID NO: 22658 - protein, 81 aa, Pan troglodytes
VTFEDVAVYFIRKEWKRLEPAQRDLYRDVMLENYGNVFSLDWIHVSLTTQKVMLAWLTGTLSVAKGLCSSELASVEPPDTF

SEQ ID NO: 22659 - protein, 81 aa, Pan troglodytes
LTQGQLSFSDVAIEFSQEEWKCLDPGQKALYRDVMLENYRNLISLDFSPLAWDALARVSRVEAWRASGGAEEPTDPNFVGN

SEQ ID NO: 22660 - protein, 81 aa, Pan troglodytes
MTFEDVAVYFSQEEWGLLDTAQRALYRRVMLDNFALVASLGLSTSRPRVVIQLERGEEPWVPSGKDMTLARNTYGRLNSGS

SEQ ID NO: 22661 - protein, 81 aa, Pan troglodytes
VTFEDVAVVFTDEEWSRLVPIQRDLYKEVMLENYNSIVSLDWETKPEIHDASDKKSEGSLRECLGRQSPLCPKFEVHTPNG

SEQ ID NO: 22662 - protein, 81 aa, Pan troglodytes
KNGSLTFRDVTIEFSLEEWQCLDTAQQNLYRNVMLENYRNLYVFITFILYSSESSNSHFTQDFWPDQSIKYSFQEIILRTY

SEQ ID NO: 22663 - protein, 81 aa, Enhydra lutris
SQGPVSFRDVAVDFTQEEWQQLEPDEKTTYRDVMLENYSHLVSVGYDSTKPKVILKLEQGEEPWVAEGEVPCQSRPEEVWK

SEQ ID NO: 22664 - protein, 81 aa, Enhydra lutris
MVAGLLMDSSQEEWTLLDQTQRDLYRDVMLENYQNLIILGYESCKPDLNSLMGGAEELRTGGRGILQELDLLKTKGFTALQ

SEQ ID NO: 22665 - protein, 81 aa, Enhydra lutris
PKVPVSFEDVSVYFTKTEWKLLDVQQRILYKTVMLENYRHLVSLGFLSTKPHLVSWLEQGEGPWATDVWRTLATAEMQTGD

SEQ ID NO: 22666 - protein, 81 aa, Pongo abelii
AQESVMFSDVSVDFSQEEWECLNDDQRDLYRDVMLENYSNLVSMAGHSVSKPNVISYLEQGKEPWLVDRELTRGQWPVLES

SEQ ID NO: 22667 - protein, 81 aa, Pongo abelii
LVTFRDVAIDFTQEEWECLDPAQRDLYRDVMLENYSNLISLDLESSCATKKLSPEKEIYEMESLQWENMGNLINHHLQYGL

SEQ ID NO: 22668 - protein, 81 aa, Pongo abelii
SPDSMTFEDIVVDFTQEEWALLDTSQRKLFQDVMLENISHLVSIGKQLCKSVMLSHLEQVEKLSTQRISLLQGRQVDIKHQ

SEQ ID NO: 22669 - protein, 81 aa, Pongo abelii
PQGLLTFRDVSIEFSQEEWKCLDPAQRTLYRDVMLENYRNLVSLDISSKCMMQMFSSTGQGNTEVIHTGTLQIHASHHIGD

SEQ ID NO: 22670 - protein, 81 aa, Pongo abelii
TQGCVTFEDVAIYFSQEEWGLLDEAQRLLYRDVMLENFALITALEDQKHHRAEKPLESDTDKASFMQCCLFHESGMPFTSS

SEQ ID NO: 22671 - protein, 81 aa, Pan troglodytes
EMGVLTFRDVAIEFSLEEWHCLDTAQQNLYRNVMLENCRNLVFLGIAASKPDLITCLEQGKEPWNVKRHEMVAEPPVVLAQ

SEQ ID NO: 22672 - protein, 81 aa, Pan troglodytes
VTFKDVAVTFTREEWRQLDLAQRTLYREVMLETCGLLVSVGDRAQVHTREPTTFPPVLSERAFLRGSLTLESSTSSDSRLG

SEQ ID NO: 22673 - protein, 81 aa, Enhydra lutris
SQEPVTFEDVAMYFPQNQWASLDPTQRALYREVMLENYANITSLAALPFPKPDLILQLERGEAPWSLDPWTPLKGGALGGA

SEQ ID NO: 22674 - protein, 81 aa, Enhydra lutris
DLQGSLSLKDVAVVFTWEEWQLLDPVQKILYQDVMLENYSNLISVGYQVTKADAFYQLEHGTQWITEEEIQSRIHPAQRSR

SEQ ID NO: 22675 - protein, 81 aa, Enhydra lutris
AQGLVVFTDVAIHFSREEWGLLDEAQRSLYHSVMLETLALLSSLGCWHGAQDEKVPSEQGDSVGGSQVRTPKPGPPTEKSQ

SEQ ID NO: 22676 - protein, 81 aa, Enhydra lutris
TDGLVTFRDVAIDFSQEEWECLDPAQRDLYVDVMLENYSNLVSLDLESTYEIKNIISEKDIFEINFSQWEMKERSKTFGLE

SEQ ID NO: 22677 - protein, 81 aa, Enhydra lutris
QQIAVTFEDVAVDFTQEEWLLLDLTQRNLYRNVMLENYQNLVAVEYQLSKPKLIAWLEQQELRTVEKGVFQEWETQPQTKG

SEQ ID NO: 22678 - protein, 81 aa, Pongo abelii
MGPLTFMDVAIEFSLEEWQCLDTSQQNLYRHVMLENYRNLVFLGIAISKPDLITCLEQGKEPWNMKRHEMVVAKHSALCSH

SEQ ID NO: 22679 - protein, 81 aa, Pongo abelii
SQHLVTFEDVAVDFTQEEWTLLDQTQRDLYRDVMLENYKNLIILGSELCKPSLMSGLEQMEELRTGVTGVLQELDLQLKTK

SEQ ID NO: 22680 - protein, 81 aa, Pongo abelii
LPAKDSAWPWEEKPRYLGPVTFEDVAVLFNEAEWKRLSLEQRNLYKEVMLENLRNLVSLVLELGSPRLGLLPLDLNLDLWL

SEQ ID NO: 22681 - protein, 81 aa, Pongo abelii
VAFEDVAVNFTQEEWTLLDISQKNLFREVMLETFWNLTSIGKKWKDQNIEYEYQNPRRSFRSLIEEKVNEIKDNSHCGETF

SEQ ID NO: 22682 - protein, 81 aa, Pongo abelii
EMRLLTFRDIAIEFSLVEWQYLDHAQQNLYRDVMLENYRNLVSLGIADSKPDLITFLEQNKESWNIKRNEMVAKHPVTCSH

SEQ ID NO: 22683 - protein, 81 aa, Pongo abelii
AQEPVTFRDVAIYFSREEWACLEPSQRALYRDVMLDNFSSVAALEGFCSPRPDLVSRLEQWEEPWVEDRERPELQAVQRGP

SEQ ID NO: 22684 - protein, 81 aa, Pongo abelii
VALEDVAVNFTQEEWALLGPCQKNLYKDVMQETIRNLDCVGMKWKDQNIEDQYRYPRKNLRCRMLERFVESKHGSQCGETS

SEQ ID NO: 22685 - protein, 81 aa, unidentified
  REGION 1..81: note = Bos indicus x Bos taurus
PQDLVTFKDVAIDFSQEEWEWLSPAQRSLYRSMMLENYQSLVSLGLCISKPYVISLLEQGKEPWMVLENEMRSPFPDWESI

SEQ ID NO: 22686 - protein, 81 aa, unidentified
  REGION 1..81: note = Bos indicus x Bos taurus
MLENYSNLVSAGFQASTPEVVSKLDQGEPWMMDDETHCQTRSVWKFDDHLLEYLQNESMEKRLEQWHEQNPLENAVHQSIT

SEQ ID NO: 22687 - protein, 81 aa, Enhydra lutris
LPDLVTFEDVAVEFTQEEWALLDPSQRTLYRDVMRENCRNLASLGNEDDKPGLVSELEQEDKVTTEEITILPGNCPDLETL

SEQ ID NO: 22688 - protein, 81 aa, Enhydra lutris
MLETYSSLVSLGHCISKPEVIVKLEQGAEPWAVGEAPTQRLPDVQSAGDLIEACQEHQSRHVGQVGFSSNKRSATKRTALD

SEQ ID NO: 22689 - protein, 81 aa, Enhydra lutris
VWIPVTFDDVAVTFTREEWRQLDPAQRTLYQEVMLETCGLLVSLGCPLPKPELICALDHSPELRTLKRGLSPNSCPGDTTK

SEQ ID NO: 22690 - protein, 81 aa, Enhydra lutris
LQEPVTFADVAVLFTPEEWMFLDSAQRSLYRDVMLENYRNLASVGDQLGKPSMLSLSEPGEELWAPERRTFPGTRPEPQHQ

SEQ ID NO: 22691 - protein, 81 aa, Pongo abelii
RRESVTFEDVAVYFSENEWIGLGPAQRALYRDVMLENYGAVASLAFPFPKPALISQLERGETPWCSVPQGALDGEAPRGIS

SEQ ID NO: 22692 - protein, 81 aa, Pongo abelii
EGGWVPALFDEVAIYFSDEEWELTEQQKLYREVMRMNYEVLSLEFPFPKPDMITRLEGEEESQNSDEWQLQGGTSAENEES

SEQ ID NO: 22693 - protein, 81 aa, Pongo abelii
TFKEAMTFKDVAVVFTEEELGLLDLAQRKLYRDVMLENFRNLLSVGHQAFHRDTFHFLREEKFWMMETATQREGNLGGKIQ

SEQ ID NO: 22694 - protein, 81 aa, Pongo abelii
MVTFEDVAVHFTKTEWTGLSPAQRALYRSVMLENFGNLTALGYPVPKPALISLLEGGDMAWGLEAQDDPLAETTKNVCKDV

SEQ ID NO: 22695 - protein, 81 aa, Pongo abelii
VHGSVTFRDVAIDFSQEEWECLQPNQRTLYRDVMLENYSHLISLGSSISKPDVITLLEQEKEPWIVVSKETSRWYPDLESK

SEQ ID NO: 22696 - protein, 81 aa, Pongo abelii
MLENYRNLVFLGICLPDLSIISMLEQRRDPRNLQSEMKMANNPGGRECINGVNTESSSKLGSNAGNKSLKNQLGLTFQLHL

SEQ ID NO: 22697 - protein, 81 aa, Pongo abelii
LKSLVTFEDVAVYFSQEEWELLDAAQRHLYHRVMLENLELVTSLGNALSQHDVFTCSVGADLPNCFPNWLHHFTSLSAVYK

SEQ ID NO: 22698 - protein, 81 aa, Pongo abelii
ELTSSCGSKTMANVSLAFRDVSIDLSQEEWECLDPVQRDLYKDVMLENYSNLVSLGYTIPKPDVITLLEQEKEPWIVMREG

SEQ ID NO: 22699 - protein, 81 aa, unidentified
  REGION 1..81: note = Bos indicus x Bos taurus
MFQDVAIDFTQEEWECLDLSQRELYRDVMLENYGNLASLGLVSNLDLVTFLEPLKDPRNIRRMGTTVIYPAVSPQDTQDLM

SEQ ID NO: 22700 - protein, 81 aa, Pan troglodytes
FEELVTFEDVLVDFSPEELSSLSAAQRNLYREVMLENYRNLVSLGHQFSKPDVISRLEEEESHAMETDSRHTVICPGESHD

SEQ ID NO: 22701 - protein, 81 aa, Enhydra lutris
MASSQGQLAFRDVAIKFSEEEWGLLTHTQRQLYRDVMLENYGHLLFLGLIVSKPDLVSFLEQKKDPWDVTRKKTVVFDPGR

SEQ ID NO: 22702 - protein, 81 aa, Enhydra lutris
RPRAVKFADVAVYFSPEEWGCLRPAQRALYRDVMRETYGHLSALGCSGPKPALISWLERNTDDWEPAALDPQECPRGLTVQ

SEQ ID NO: 22703 - protein, 81 aa, Enhydra lutris
VKDPVTFKDVAIDFTLEEWRLMDPSQRKLHKDVMLENYRNLVSLGLAVSKPDMISHLEAGKGPWVVVREIARTPYPELETK

SEQ ID NO: 22704 - protein, 81 aa, Pongo abelii
SQMPVTFEDVALYLSREEWGRLDHTQQNFYRDVLQKKNGLSLGAVEVGQRVPTSSVAALGDVKPFRPRAGSVQGGVLQCAQ

SEQ ID NO: 22705 - protein, 81 aa, Pongo abelii
AQESLTLKDVAVDFTWEEWQLLGPAQKRLYRDVMLENYSNLVSVGYQASKPDALTKLEQGEPLWTLEDEIHSPAHPEIEKA

SEQ ID NO: 22706 - protein, 81 aa, Pongo abelii
AHASMTFRDVAIDFSQQEWECLDPVQKTLYRDVMMESCSNLLGSGHDFSKPDVITSLEQGKEPWMIVREEKGRWCTGSHSI

SEQ ID NO: 22707 - protein, 81 aa, unidentified
  REGION 1..81: note = Bos indicus x Bos taurus
PQEATELEFLSVNYTLKNWKGTALSQRALYWNIMLENCCSLAPLGENRMASSQLSPKQDISEESKSADRTSGILCGLILRG

SEQ ID NO: 22708 - protein, 81 aa, unidentified
  REGION 1..81: note = Bos indicus x Bos taurus
PHFPFDVAIEFTPEEWECLDLAQRALYREVMVETLRNLLSVDTSPKRVLKGSAPKQSSHTGGILQTMLSGRHKSHDTKDQG

SEQ ID NO: 22709 - protein, 81 aa, Pan troglodytes
PQASVCFEDVAMAFTQEEWEHLDLAQRTLYREVTLETWEHIVSLGLFLSKSDVISQLEQEEDLCRAEQEAPRDWKLTLEEN

SEQ ID NO: 22710 - protein, 81 aa, Pan troglodytes
PLSFKDVAVVFTEEELELLDSTQRQLYQDVMQENFRNLLSVGDKNGKDMEYIQDEELRFFSHKELSSCKIWEEVVGELPGS

SEQ ID NO: 22711 - protein, 81 aa, Pan troglodytes
LFQLLVTFRDVAIDFSQEEWECLDPAQRDLYRDVMLENYSNLISLDLESSCVTKKLSPEKEIYEMESLQWENMGKLTNHHL

SEQ ID NO: 22712 - protein, 81 aa, Pan troglodytes
AQESITLEDVAVDFTWEEWQFLSPAQKDLYRDVMLENYSNLVSVGYQASKPDAFSKLERGEETCTTEDEIYSRICSDSGGA

SEQ ID NO: 22713 - protein, 81 aa, Pan troglodytes
DSVAFEDVAVNFTLEEWALLDPSQKNLYRDVMRETFRNLASVGKQWEEQNIEDPFKIPRRNISHIPERLCESKEGGQGEET

SEQ ID NO: 22714 - protein, 81 aa, Zalophus californianus
SLESDLFRDVAIVFSQEEWEQLAPAQRDLYRDVMLETYSNLVSLGLAIAKPDVISFLEQGKEPWVVEKMSRGGLCPVLESR

SEQ ID NO: 22715 - protein, 81 aa, Zalophus californianus
GQGSVSFRDVTVDFTRDEWLQLTGTQRTLYRDVMLENYSHLVSVGCHLTKPEVIFRLEQGEELWPSGGEFPDQGDQDKSQE

SEQ ID NO: 22716 - protein, 81 aa, Carlito syrichta
SLGSELFRDVAIVFSQEEWQQLVPAQRDLYRDVMLETYSNLVSLGLAISKPDVISFLEQGREPWMVEEVVPGLCPVLESGC

SEQ ID NO: 22717 - protein, 81 aa, Saimiri boliviensis
FQEAVTFKDVAVAFTEEELGLLDSAQRKLYRDVMLENFRNLVSVGRQSFKPDMISQLEREEKLWMKEFQTQRDRHSGDRNQ

SEQ ID NO: 22718 - protein, 81 aa, Callorhinus ursinus
QAEVTFEDVAVLFSREEWGRLGPAQRGLYRDVMLETYRNLVSLGAGPAGPKPGVITQLERGDEPWVLDAQGAKGKERLRVS

SEQ ID NO: 22719 - protein, 81 aa, Rhinolophus ferrumequinum
SQGLVTFRDVALDFSQEEWEWLDPSQKDLYRDVMLENYRNLVCLGLSISKPNMISLLEQGKEPWMVQREMSDDPYTDWESW

SEQ ID NO: 22720 - protein, 81 aa, Ursus maritimus
SQGLLSFSDVAVDFTWEEWQLLDTVQRNLYWEVMLENYSNLMSLGYQATRPEATIHLEKEQRMVEREFPSQRSPERPLQCF

SEQ ID NO: 22721 - protein, 81 aa, Rhinopithecus roxellana
AQVSVTFEDVAVTFTQEEWAQLDAAQKTLYQEVMLETCGLLVSLGCPLFEPELIYQLDRREELWIVKKDLSQSSCPGDNTK

SEQ ID NO: 22722 - protein, 81 aa, Rhinopithecus roxellana
DGLVTFRDVAIDFSQEEWECLDPAQRDLYVDVMLENYSNLVSLDLESTTYETTKIFSEKDIFEINFSQWEMKEKSKTLGLE

SEQ ID NO: 22723 - protein, 81 aa, Rhinopithecus roxellana
IYFPQAEWELLEYTQKALYNDVMQENYETVISLALFVLPKPKVISCLEQGEEPWVQVSPEFKDTFVPFFKKSLNFSFYSWL

SEQ ID NO: 22724 - protein, 81 aa, unidentified
  REGION 1..81: note = Bos indicus x Bos taurus
MLENYRNLASLGLVSKVDLVTFLELLKDPRNIKRMKTTAIYPAVSPQDTQGLMPKNPALEDLFPKANEGMYQIFHLRNLNL

SEQ ID NO: 22725 - protein, 81 aa, Trichechus manatus
TQVSLELDDVAVKFTWEEWQLLNRAQKDLYWDVMLENYNNLVSLGYQVSKPDVLSRLERGEPPWSLEDEIHSGNFSELQKI

SEQ ID NO: 22726 - protein, 81 aa, Delphinapterus leucas
SQGLVTFRDVALNFSQEEWEWLDSSQKDLYRDVMLENYRNLVWLGLSISKPNMISLLEQGKDPCMVEREMSDGQYAEWDSL

SEQ ID NO: 22727 - protein, 81 aa, Zalophus californianus
VKIEDVADVAVSFILEEWGHLDQSQKSLYRDDRKENYGSITSVDYESGHDNVELAVKQISDDAEPHWMTSGSPERNVPQSQ

SEQ ID NO: 22728 - protein, 81 aa, Aotus trivirgatus
CEISVSFEDVTVDFSKEEWQHLDPAQRRLYWDVTLENYSHLLSVGYQVPKSEATFKLEQGEGPWTLEGEAPHQSYSGESIG

SEQ ID NO: 22729 - protein, 81 aa, Rhinolophus ferrumequinum
CKKPVSFAEVAVYFSPEEWGCLRPAQRALYRDVMRETYGHLGALGDAPNKKEEAPEKGPGAKGPRKTPGKARPGELIKRNP

SEQ ID NO: 22730 - protein, 81 aa, Ursus maritimus
WSQMPVTFEDVALYLSREEWGRLDHAQQNFYRDVLQKRNGLSLGFPFSRPFWASQGQGKGETSSSCRQMGDEEEMTGAIEV

SEQ ID NO: 22731 - protein, 81 aa, Acinonyx jubatus
DLVILEDVAVEFTQEEWTLLDPTQRNLYRDVMLENHRNLVAVDWEICLNTKWSALQQNILQGKTPNGQRRGSLNVIKLENF

SEQ ID NO: 22732 - protein, 81 aa, Rhinopithecus roxellana
EMVTFKDVAVVFTEEELGLLDSAQRKLYRDVMLENFRNLLLVAHQPFKPDLISQLEREEKLLMVEMETPKDGCSGRKNQQK

SEQ ID NO: 22733 - protein, 81 aa, Acinonyx jubatus
LQGPVTFKDVIVEFTREEWQLLDAAQRTLYKEVMRENYGHLVSVGYCVNKPNAVFKLKQGKEPWTLEVEFPRRNYPEDLWK

SEQ ID NO: 22734 - protein, 81 aa, Acinonyx jubatus
KLKSVTFEDVAVYFTQTEWNGLSPAQRALYRDVMLENYGNVASLGFSLLKPAVILQLEGADIESQTDNNLTKEIYKEKHNT

SEQ ID NO: 22735 - protein, 81 aa, Rhinopithecus roxellana
VQEPVTFKDVAVDFTQEEWGQLDLVQRTLYRDVMLETYGHLLSVGNQIAKPEVISLLEQGEEPWSMEQACPQRTCPEWMRN

SEQ ID NO: 22736 - protein, 81 aa, Rhinopithecus roxellana
QDSVMFDDVAVEFTPEEWVLLDTTQKYLYRDVMLENYMNLASVDFFFCLTSEWEIQPRTKRSSLQQGFLKNQIFTGIQMTR

SEQ ID NO: 22737 - protein, 81 aa, Rhinopithecus roxellana
SQHLVTFEDVAVDFTQEEWTLLDQTQRDLYRDVMLENYKNLIILAGSELCKPSLMSGLEQMEELRTGVTGVLQEQKQYCRE

SEQ ID NO: 22738 - protein, 81 aa, Rhinopithecus roxellana
MAQVTFSDVAIDFSHEEWAWLDSAQRDLYKDVMVQNYENLVSVAGLSVTKPYVIMLLEDGKEPWMVEKKLSKDWKSRWENK

SEQ ID NO: 22739 - protein, 81 aa, Rhinopithecus roxellana
PKVPVAFDDVSIYFSTPEWEKLEEWQKELYKNIMKGNYESLISMDYAINQPDVLSQIQPEGEHNTEDQTGPEESEIPADPS

SEQ ID NO: 22740 - protein, 81 aa, Bison bison
KDQGSLTLEDVAVDFTWEEWQLLAPPQKALYRDVMLENYSNLVSVGYQASKSAALSRLERGELWPVEDKVHSRICPEMRKD

SEQ ID NO: 22741 - protein, 81 aa, Vicugna pacos
SQVPLTFSDVAIDFSQEEWECLNSDQKNLYRDVMLENYTNLVSLDIDFTTESKGLSSEKSSYEVNSYHCEPMKRSKPSTFN

SEQ ID NO: 22742 - protein, 81 aa, Vicugna pacos
PHRLVLFKDVAIDFSREEWECLDLEQKDLYRDVMLENYNNLVSLAGISISKPDVLSLLEQGKEPWKVVQDETRGQSPDWES

SEQ ID NO: 22743 - protein, 81 aa, Vicugna pacos
DSWGPLSFMDVFVDFTWEEWRLLDPAQKHLYRSVMLENYNNLASLGHQHTKPSVVFQLEQEELWMMQIPSQGRADEVQEID

SEQ ID NO: 22744 - protein, 81 aa, Phascolarctos cinereus
ARESVTFKDVAVNFTQEEWGQLSPAQRNLYKDVMLENYRNLISLGFPISKPDVIFKLEQGKEPWMFSLQKAREREVPRNSP

SEQ ID NO: 22745 - protein, 81 aa, Monodelphis domestica
PAQEVVTFQDVAVDFTQEEWRLLSPLQKELYKEVMLENARNLLSVGLPAPPEDMILEQREAPWMLEQEGLRCYYPGEFRFE

SEQ ID NO: 22746 - protein, 81 aa, unidentified
  REGION 1..81: note = Bos indicus x Bos taurus
QTQLTFKDVFIDFTPEEWECLDPAQRTLYKDVMVETLRILLSVDISPTHVIKHLQLKANSEKLETFQTSMLGRPESCEIKH

SEQ ID NO: 22747 - protein, 81 aa, Trichechus manatus
VQASLTFSDVAVEFTWQEWQLLDTAQKDLYRDVMLENYGNLVSVGYEVSKPDALSRLERGEQPWTVLDESHSRTFSDMCKI

SEQ ID NO: 22748 - protein, 81 aa, Delphinapterus leucas
LHGSVTFQDVAVDFTLEEWQLLGYSQRKLYWDVMLENFRNLISVGCPVTKTKVIFKVEQGQEPWMVEGENPHWRSPEVICL

SEQ ID NO: 22749 - protein, 81 aa, Saimiri boliviensis
TQDRVVFEDVAIYFSQEEWGHLDEAQRLLYRDVMLENLALLSSLGCWHGPEDEVAPSRQGFSAGVSEVTTSPKSCMFTQKI

SEQ ID NO: 22750 - protein, 81 aa, Balaenoptera acutorostrata
SLETVTFKDVAVDLTQEEWQQMKPAQRDLYRDVMLENYSNLVTVGCQVTKPDVIFRLEQEEEPWVVEEEMLGRPCPEVWED

SEQ ID NO: 22751 - protein, 81 aa, Rhinopithecus bieti
TQVRLTFRDVAIEFSQEEWKCLDPAQRTLYRDVMLENYWNLVSLGLCHFDMNIISMLEEGKEPWTVKSCVKIVRKPRMREC

SEQ ID NO: 22752 - protein, 81 aa, Acinonyx jubatus
IQETVTFKDVAVDLTQEEWQQLKPAQRNLYRDVMLENYSNLVTVGYQVTKPDVIFKLEQEEEPWVIEDEMLGRHCPEVWEV

SEQ ID NO: 22753 - protein, 81 aa, Rhinopithecus roxellana
MESLTLRDVAVDFTWEEWQLLGPAQKHLYQDVMLENYSNLVSVGFQASKPDALTKLEQGEPLWALEDEIYSPTHPEIEKAD

SEQ ID NO: 22754 - protein, 81 aa, Delphinapterus leucas
QLTFEDVAITFSREEWECLDPAQRALYRDVMLETYGNLLSLAVSHIHVIKKLKPKANSDTGEVFQTVTLGRHESHEIRDFY

SEQ ID NO: 22755 - protein, 81 aa, Sapajus apella
SKAPITFGDLAIYFSQEEWEWLSPIQKDLYEDVMLENYQNLVSLGLSFRRPNVITLLEKGKAPWMVEPARRRRGPDSGSKV

SEQ ID NO: 22756 - protein, 81 aa, Zalophus californianus
MLENYRNLVALGHQLYKPEVISHLEQEEQWVMERESPLDTHTDGESRPEIKKSTPNQNISDENQNHDMIMERLTGDSFWYS

SEQ ID NO: 22757 - protein, 81 aa, Sapajus apella
CEVSVSFEDVTVDFSREEWQQLDSTQRRLYQDVMLENYSHLLSVGFEVPKPEVIFKLEQGEGPWTLEGETPHHSCSDGKFG

SEQ ID NO: 22758 - protein, 81 aa, Delphinapterus leucas
MVKSQVSFEDVAVDFTLEEWQLLDPTQKTLYRDVTLENYSNLVFLGYQMIKPEVIFKLEQEEPWILGEEILSQNFPEEVWL

SEQ ID NO: 22759 - protein, 81 aa, Balaenoptera acutorostrata
MAEEFATLKDVAMDFTLEDWEQLGLDQGDLFWDTALDNYQDLFLLNPPRPNLTSHPDDGEELAALAKGSPESTGPDTAEGK

SEQ ID NO: 22760 - protein, 81 aa, Rhinolophus ferrumequinum
FQESVTFEDVAVYFTQNQWASLEPVQRALYREVMLENYANVASLAAFPFSKPDLIFQLERGEAPRDLDPWTPGEAEALRSV

SEQ ID NO: 22761 - protein, 81 aa, Rhinolophus ferrumequinum
GQESLTFDDVAVDFTWEEWQLLVPEQKDLYRNVMLENYSHLVSLGYQACKPDMLSKLDRGESPWTMADEVHYWTRSEIWKD

SEQ ID NO: 22762 - protein, 81 aa, Rhinolophus ferrumequinum
SQGSVTFRDVAVDFSQEEWEWLQPAQRDLYRHVMLENYDHLVSLGLTISKPDVVSLLEQRKEPWLQRGDGRRDLFSVSESN

SEQ ID NO: 22763 - protein, 81 aa, Rhinolophus ferrumequinum
FQGSVTFQDVVVDFTPEEWQLLDCDQRTLYWDVMLENFRNLISVGGPVTKTKVIFKVQQGQEPHMVEGENPHWSHTEAECP

SEQ ID NO: 22764 - protein, 81 aa, Ursus maritimus
LLWESLTLEDVAVDFTWEEWQLLAPAQKNLYRDVMLENYRNLVSVGYVASKPDALSRLEQEELWTTEDEIHSRFHPELKKD

SEQ ID NO: 22765 - protein, 81 aa, Ursus maritimus
CQESVTFEDVAVIFTDEEWRHLVPIQRDLYKEVMLENYKIIVSLGLPVPRPDVIFQLKRGDEPWIVDLHRSEERECPENVS

SEQ ID NO: 22766 - protein, 81 aa, Phyllostomus discolor
MLENYGNVASLGFPILKPAVISQLEGGGELGIPSLLAAGVGSDPPGLWTVDIDIQTDNDITKELYKEKYNASFVLQENSFQ

SEQ ID NO: 22767 - protein, 81 aa, Phyllostomus discolor
KALGSVAFRDVIVDFTQEEWQQLKPAQKDLYRDVMMENYWNLVSLDLEARPDMKELDPQEDKWEDRPSVVVVVEGPKRNGA

SEQ ID NO: 22768 - protein, 81 aa, Phyllostomus discolor
REVSVSFEDVTVDFSREEWQQLDSTQRRLYQEVTLENYSHLLSVGYGVPKPEVIFKLEQGEDPWMLEGETPYESCSDGKFG

SEQ ID NO: 22769 - protein, 81 aa, Acinonyx jubatus
QDFVSFNDVSVNFTEEEWRELDPVQRVLYRDVMLENYRNLVSLDLETRKLSPKNVFSEEESYQGISMERNTEADASLKEAW

SEQ ID NO: 22770 - protein, 81 aa, Rhinopithecus roxellana
LYEAVTFKDVAVVFTEEELGLLDPAQRKLYQDVMLENFRNLLSVGKSQTEMETVPEAGTHEEFSCKQIWEQIASDLTRSQD

SEQ ID NO: 22771 - protein, 81 aa, Rhinopithecus roxellana
GRVVFEDVAIYFSQEEWGHLDEAQRLLYRDVMLENLALLSSLGCCHGAEDEEAPLEPCVSIGVSQVMAPKPCLSTQKTQPC

SEQ ID NO: 22772 - protein, 81 aa, Acinonyx jubatus
MLETCGLLVSLGHPVPKPELIYPLEPGQELWTGKRGVSKSTYTGEKAKPETTEFTASQLAFTEEAPFEEQMTQGASRDSRL

SEQ ID NO: 22773 - protein, 81 aa, Acinonyx jubatus
QGSAAYEFLSVDYTERKWKGPALSQRAVYRSLMPENYRRVASLANETRMECPDLPAKQEVSKGLGSSDGTSGGLCGVVSGE

SEQ ID NO: 22774 - protein, 81 aa, Bison bison
KKPVTFEDVAVNFTQEEWKCLDVSQRVLYQDVISETVRNLMSVGGKKEESQEQSQSLGDEGTVDDKKASLAHRGLGPTSPP

SEQ ID NO: 22775 - protein, 81 aa, Bison bison
QEGVNFKIVTVDFTQEEEGTLSSAQRTLDRDVILENHGDSWDSATALGRRESRLKQSIFDDKLSHSVKIEKLTRDDPWLSS

SEQ ID NO: 22776 - protein, 81 aa, Bison bison
EEEEEMAASQDVAIDFTQEEWECLDLGQRELYRDMMLEKYGNLASLARPGHLSGANEGFQEYKQHGDNTHIPRCMTLGLSC

SEQ ID NO: 22777 - protein, 81 aa, Callithrix jacchus
ALGIVTFEDVAVYFSWKEWSLLDEAQKCLYHDVMLENLTLTTSLGGCGTEDEEAPYQQSTSPQRGSQVRIPKALPSPQKTN

SEQ ID NO: 22778 - protein, 81 aa, Delphinapterus leucas
LQDLVTFEDVTVEFTQEEWALLDPSQRTLYRDVMLENCRNLASLGYHVDKPSLISQLEQEDKVMTEERGILPGTCPDLETV

SEQ ID NO: 22779 - protein, 81 aa, Sapajus apella
SQTLVTFKDIFVDFTREEWKLLDTAQQIVYRNVMLENYKNLVSLGYQITKPDVILRLEKGEEPWVVERGIHQETHPDSETA

SEQ ID NO: 22780 - protein, 81 aa, Sapajus apella
SQGSVLFEDVSVYFTQKEWQLLDPAQRLLYRDVMLENYRHLVSLGHCVTKPELIVKLKQGDEPWILKREPPSQSHSGELKS

SEQ ID NO: 22781 - protein, 81 aa, Saimiri boliviensis
SQAPVTFEDMAMYLTREEWRPLDPAQRDLYRDVMQENYGNVVSLDFEIRSESEVNPKQEISEDAQFGTTSERPVENAEENP

SEQ ID NO: 22782 - protein, 81 aa, Saimiri boliviensis
FQEQVSFKDVCVDFTQEEWYLLNPAQKMLYRDVILENYSNLVSVGYCIPKPEVIFKIEQGEEPWILEKGFPSQCNPERKWK

SEQ ID NO: 22783 - protein, 81 aa, Callorhinus ursinus
CQGPLTFRDVAVEFSPEEWECLDPAQRALYRDVMVENYRNLVSLGEDSFPPEVGICPKSSARFMIKELLPKKENNRKLCQL

SEQ ID NO: 22784 - protein, 81 aa, Callorhinus ursinus
SQEQVSFKDVCVDFTQEEWYLLDPAQKILYRDVILENYSHFVSVGYCITKPEVVFKIEQGEEPWILEAGFPSQCHPEDWKV

SEQ ID NO: 22785 - protein, 81 aa, Vulpes vulpes
SQSLLTFEEVAMYFSQEEWELLDPTQKALYNDVMRENYETVISLVVPVHQIPAFCEKTNTKDWTVTPELILSESQSLLTFE

SEQ ID NO: 22786 - protein, 81 aa, Ursus maritimus
PVTFKDVIVEFSREEWQLLNAAQRTLYREVMQENYGLLISVGEKNFPICYRVNKPNAVFKLKQGKEPWILEVEFPHRNYPE

SEQ ID NO: 22787 - protein, 81 aa, Acinonyx jubatus
LVIVKGCRDSLRAKTGVLVHAKEIKTVSVTFQDVAVDFTPEEWQLLDCDQRTLYWDVMLENFRNLTAVGTCYIQGCGHGLH

SEQ ID NO: 22788 - protein, 81 aa, Tursiops truncatus
SLGTVTFKDVAVDLTQEEWQQMKPAQRDLYRDVMLENYSNLVTVGCEVTKPDVIFKLEQEEEPWVIEEEMLGRPCPEVWED

SEQ ID NO: 22789 - protein, 81 aa, Tursiops truncatus
KSPGSVSFEDVTVNFTQEEWGQLDPDQRTLCRDVTLENYRILISLGHRIAKPEEIFKLEQEAPWILEEEFASHCYPGELKV

SEQ ID NO: 22790 - protein, 81 aa, Tursiops truncatus
KAQETLTFDDVAVDFTWEEWQFLAPPQKDLYRDVMLENYSNLLSVGFQASKPDILSKLDHGEPWMMEDEIHCRTHSEVWKV

SEQ ID NO: 22791 - protein, 81 aa, Acinonyx jubatus
MPQEEWQQLDPAQKTLYRDVMLENYCHLISVGFHMTKPDMIRKLEQGEELWTTERIFPSQSYLEEDGKAEDVLVKFKEYQD

SEQ ID NO: 22792 - protein, 81 aa, Leptonychotes weddellii
MLENCGLLVSLGCPVPRPELIYQLEHGQELWTVKRDLSQITYPGDKGKPKITESTASEPALSEGVSFQERLTQGVPGISQV

SEQ ID NO: 22793 - protein, 81 aa, Physeter macrocephalus
PQVFVSFEEVAVLLSQEEWGHLGPSQKGLYRDVMLETYGNLVSLGLQGSKPDVISKLEQGEEPWAPHSPRIEGSWIWRHRH

SEQ ID NO: 22794 - protein, 81 aa, unidentified
  REGION 1..81: note = Bos indicus x Bos taurus
MFKDVAIDVSQEEWECLNPAQRNLYKDVMLENYSNLVSLGLSISKPAVITSLEQGKEPWMVMREMTRERCPDLVSQCEPKK

SEQ ID NO: 22795 - protein, 81 aa, Trichechus manatus
RSQESVTFQDVAVDFTREEWDQLYPAQKSLYRDVMLENYRNLVALGHQLYKPEVITQLEQEEQWIMESKSLPDTHPDGENR

SEQ ID NO: 22796 - protein, 81 aa, Delphinapterus leucas
SVTFRDVTVDFTQEEWQQLEPSQKDLYRDVMLENLQNLVSLDLEMRPEMKEPDLKEEISEDKPSGAWGSAVDGARTQGDRV

SEQ ID NO: 22797 - protein, 81 aa, Zalophus californianus
PQESVTFKDIAVDFTQEEWALLDTSQRKLYRDVMLENISHLVSVGYHLCKSDVVSQLEQGVELWREGRGFPQGPNPDRKSG

SEQ ID NO: 22798 - protein, 81 aa, Phyllostomus discolor
CEGSVSVEDVTVDFSKAEWQQLNPAQRCLYLDVMLEIYSHLFSVGYHIPNPEVIFRMEKDKELWIGEAELPHQRHQEMKFV

SEQ ID NO: 22799 - protein, 81 aa, Rhinopithecus roxellana
SVAFEDVAVNFTQEEWALLSPSQKNLYRDVMLETFRNLASVGIQWKDQDTENLYQNLGIKLRSLVERLCGQKEGSEHRETF

SEQ ID NO: 22800 - protein, 81 aa, Panthera pardus
AQGSVVFSDVSVDFSQEEWECLDSGQRDLYRDVMLENYSNLLSMGFYIPKPPVISLLEQGKEPWMVGRELTKGLCSDLESM

SEQ ID NO: 22801 - protein, 81 aa, Panthera pardus
EQESVTYKDVAVDFTQEEWALMDTSQRTLYRDVTLENISHLVSVGCHFFRSDVISQWEQRGELWREERGPPQGWSPGMKNS

SEQ ID NO: 22802 - protein, 81 aa, Panthera pardus
ESCVTFEDVAVYFSQEEWGLLDEAQRFLYHDVMLETFVLTTSLDCWCGAENEEVPSEQSVSVERVSQVRTSKTGSSIQKTH

SEQ ID NO: 22803 - protein, 81 aa, Vicugna pacos
SKAPVTFGDLAIYFSQEEWEWLSPIQKDLYEDVMLENYQNLVSLGLSFRRPNVIALLEKGKAPWMVEPVKRRRGLDSGSKC

SEQ ID NO: 22804 - protein, 81 aa, Carlito syrichta
KEGVNFKIVTVDFTQEEQNTWNHAQRTLDRDLILENHRDLVSWDLATALGKRESPSNWSTFDEEPSHGVKIERFSRNDPWL

SEQ ID NO: 22805 - protein, 81 aa, Zalophus californianus
ARASLSFEDVAVGFSWEEWQLLAPSQKDLYRDVMLENYRNLVSVGYQASKPDSVFQLEQGEPPWMVEGAAQSQTCQGYPAT

SEQ ID NO: 22806 - protein, 81 aa, Ursus maritimus
VQSHVVFEDVAIYFSQEEWGLLDEAQRFLYHAVMLENFALLSSLGCWHGAQDEQALSEQGVSVGGSQVRTPKPAPSIQKSQ

SEQ ID NO: 22807 - protein, 81 aa, Ursus maritimus
IQGSLTFGDVAVSFTQFEWKHLDATQQALYRDVMLENYGNLVSVGLLSSKPKLITQLEQGAEPWMEVQQIPSDTCSVQEYW

SEQ ID NO: 22808 - protein, 81 aa, Acinonyx jubatus
HQISVTFDDVALDFTQEEWILLDLSQRNLYRNVMLENYQNLVTVEYQLSKPKLIAWLERQELRAVEQGILQEWETGLQTKG

SEQ ID NO: 22809 - protein, 81 aa, Acinonyx jubatus
TQGCVTFEDVAIDFSQEEWGLLDEAQRRLYHDAMLENLALIASLVCWHGMEDEGTPFEQSVSIEVLSQVRIPKASASIQKT

SEQ ID NO: 22810 - protein, 81 aa, Ovis aries
TQLTVEDVDIKFTPEEWECLDPAQRALYWDVMEETYRNLLSVDVSHIHMTKKLQAKANSGKGEILQTVMFGRAETHEIKDF

SEQ ID NO: 22811 - protein, 81 aa, Ovis aries
EQLTSEDVAIEFTQEEWEFLDPAQRALYRDVMLETYRNLLSVDISPTHVIKHLQPTANSDKLEKFQTLMLRSPESCEIKHV

SEQ ID NO: 22812 - protein, 81 aa, Callorhinus ursinus
CVTFEDVAVYFSQEEWGLLDEAQRLLYHSVMLENLAFNNIRGTCFIRVPFSYTTGSLGSTLLASQGEHGRMVSEEAWPCSV

SEQ ID NO: 22813 - protein, 81 aa, Ursus maritimus
FREPVTFEDVTLGFTSEEWGLLDLEQKSLYREMMLENYRNLVSVEHQLSKPDVVSQLEEEEALWSVERGIPQDTFSEYPTA

SEQ ID NO: 22814 - protein, 81 aa, Phyllostomus discolor
VTFEDVAVFFSRMEWPLLTEAQKHLYLEVMRENFALISSSGCCCGAENVEAPVEENVSVRASQAENPHVALSSQKSHPCER

SEQ ID NO: 22815 - protein, 81 aa, Rhinopithecus roxellana
GTVTFEDVAVNFSQEEWSLLSEAQRCLYHDVMLENLALISSLGCWYGAKDETPSKQTLSIQQESPLRTHWTSVCTKKVHLW

SEQ ID NO: 22816 - protein, 81 aa, Acinonyx jubatus
MAAAAALRDPAQEEWGLLDEAQRLLYCDVMLENFALIASLGLTSFRSHIVARLEMGAEPWVPDRVDMTSAMARGAYSGPGS

SEQ ID NO: 22817 - protein, 81 aa, Rhinopithecus roxellana
MEPLTFKDVAIEFSLEEWQCLDTEQRDLYRNVLLENYRNLVFLGIAVSKPYLITCLEQKKEPWNIKRHEMVARPPVMSFHF

SEQ ID NO: 22818 - protein, 81 aa, Rhinopithecus roxellana
LRGLVTFEDVAVEFTQEEWALLDPTQRTLYRDVMLENCRNLASLGCRVNKPSLISQLEQDKKVMTEERGILPSTCPDLETL

SEQ ID NO: 22819 - protein, 81 aa, Rhinopithecus roxellana
VAFEDVDVNFTQDEWALLDPSQKNLYRDVMQETFRNLASVGKKWKDQKIEDECKNPRRNLRGLMGERLLESKKDHQHGEIL

SEQ ID NO: 22820 - protein, 81 aa, Rhinopithecus roxellana
YVGLQFQGSVTFEDVAIAFSQQEWESLDCSQRGLYRDVMLENYRNLMSMGHSLSKPHVIALLEQWKEPEVTVRTDERRWCT

SEQ ID NO: 22821 - protein, 81 aa, Rhinopithecus roxellana
YLGPVTFEDVAVLFTEAEWKRLNLEQRNLFEEVMLENLRNLVSLESKPEVHTCPSCPLAFGSQQFLSQDELHDHPIPGFHL

SEQ ID NO: 22822 - protein, 81 aa, Rhinopithecus roxellana
MEPLTFKDVAIEFSLEEWQCLDTEQRDLYRNVLLENYRNLVFLVMSFHFAQDLWPEQNIKDSFQKVTLRRYGRCEYENLQL

SEQ ID NO: 22823 - protein, 81 aa, Rhinopithecus roxellana
VTLRDVVINFSQEEWEYLDSAQRNLYWDVMMENYSNLLSLDLESRNETKHLSVGKHSIKNTGSQWEVMESSRLHGLESSIF

SEQ ID NO: 22824 - protein, 81 aa, Rhinopithecus roxellana
TQGHLTFRDVAIEFSQEEWKCLDPVQKALYRDVMLENYRNLVSLGICLPDLSVISMLEQKKDPWILQSEEKIANNPDGREC

SEQ ID NO: 22825 - protein, 81 aa, Bison bison
LQGSVTFEDVAVYFSWEEWSLLDDAQRRLYHNVMLENLALTISLGCWHGAEDEEASSEQNISVHGMSQVRIPKAGMFSQKA

SEQ ID NO: 22826 - protein, 81 aa, Zalophus californianus
SQPPVSFKDVAVTFTQEEWGQLDLAQRRLYRSVTLETCSHLVSLGLLLSKPAVISWLEQGQDPWRAGQGPPRDWKNTFEKK

SEQ ID NO: 22827 - protein, 81 aa, Macaca mulatta
QGRVTFRDVAIEFSLAEWKCLNPAQRALYREVMLENYRNLESVDISSKCMMKEVLSTGQGNTEVFYPGTLQRPESHHIGDF

SEQ ID NO: 22828 - protein, 81 aa, Delphinapterus leucas
PGSISFEDVTVNFTQEEWGQLDPDQRTLCRDVTLENYRILISLDKQSFSKALHYQTGGDLQVRARSTMDIRGRICKPLLPR

SEQ ID NO: 22829 - protein, 81 aa, Sapajus apella
MLETYSNLVSVGYEGTKPDVILRLEQEEAPWIGEAACLGCHCWEDTWQVNIQRKRQQDMILRQGAAISKKTLAKEKSRDYS

SEQ ID NO: 22830 - protein, 81 aa, Zalophus californianus
MLENYINLISVGYQTTKPSVIHKLEQGEEPWMVEREIPNWNYAEVWQLDDPLERHQENQETLLKHVAFIDQETVTAEKGNK

SEQ ID NO: 22831 - protein, 81 aa, Muntiacus muntjak
FQDVAIDFTQEEWECLDLGQRDLYRDVMLETYGNLASLAGLVVSKPDLVTFLEQMKNPWDVRRTDTKSAFVLWLGKTCSSG

SEQ ID NO: 22832 - protein, 81 aa, Pan troglodytes
MVQESVTFKDVAILFTQEEWGQLSPAQRALYRDVMLENYSNLVSLGLLGPKPDTFSQLEKREAWMPEDTPGGFCLDWMTMP

SEQ ID NO: 22833 - protein, 81 aa, Balaenoptera acutorostrata
SQESVTFKDVAVDFTQEEWALLDTSQKKLFRDVMLENISHLVSVGNQLYKSDVISHLEQGEQLSREGLGFLQGQSPVISGR

SEQ ID NO: 22834 - protein, 81 aa, Ailuropoda melanoleuca
TMVTFNDILVDFTREEWKLLDTAQQIMYKDVMLENYKNLVSLGHQLPKPDVILQLEKGEEPWLVERGIHRETHAEEVWKCE

SEQ ID NO: 22835 - protein, 81 aa, Callorhinus ursinus
SHGPLSFEDVAIAFTKEEWQQLDPAQRTLYRDVMLENFSHLVSLGHPVSKPDIISKLEQGEEPWIIKRHISDWICPERETR

SEQ ID NO: 22836 - protein, 81 aa, Ursus maritimus
LQEALSFEDLSVDFTQKEWQLLDPGQKDLYKDVMLENYSSLVSLGYEVMKPDVIFKLEQGEEPWIGDGEVASSECPEQVLQ

SEQ ID NO: 22837 - protein, 81 aa, Ursus maritimus
VQGSMSFEDVIVEFTQDEWQYMSPAQRTLYRDVMLENYSHLISVGYCTTKPVMIFKLEQGEEPWSLEEEFLNQMYPGYFSV

SEQ ID NO: 22838 - protein, 81 aa, Phyllostomus discolor
FREAVTFMDVAVVFTEEELGLLDSVQRKLYRDVTLENFRNLVLVGHQSCKPDVISQLEREEKLWMTEIQTQRGRHSTESSA

SEQ ID NO: 22839 - protein, 81 aa, Acinonyx jubatus
LQGPVSFKDVAVNFTQEEWQYLDLPQRHLYKDVMLENYINLISVGYQTTKPSVIHKLEQGEKPWMVEREIPNWSYAEETWQ

SEQ ID NO: 22840 - protein, 81 aa, Rhinopithecus roxellana
PQGLLTFRDVAIEFSQEEWKCLDPAQRTLYRDVMLENYRNLVSLAISSKCRMKKFSSTGQGNTGVIHTGALQRQASHHIGE

SEQ ID NO: 22841 - protein, 81 aa, Rhinopithecus roxellana
EPGIVSFADVAVYFCREEWGCLRPAQRALYRDVMRETYGHLSALGIGGNKPALISWVEEEAELWGPAARDPEVMKCPTETD

SEQ ID NO: 22842 - protein, 81 aa, Acinonyx jubatus
VTFKDVAVDFTQEEWGQLDSPQRALYRDVMLENYQNLLALEGEPGHEVKDESCQQQGVHKEEPYQEPITEPLVKSSIHSPG

SEQ ID NO: 22843 - protein, 81 aa, Acinonyx jubatus
MFKDVAVVFSEEELGLLDPTQRKLYRDVMLENFRNLVSVGNQPFKPELISQLEREEKLLMMETETQRDGCLGAKSQHNMES

SEQ ID NO: 22844 - protein, 81 aa, Rhinopithecus roxellana
FQGGVTFEDVTVNFTKGEWQRLNPEQRNLYRDVMLENYSNLVSVGRVETTKPDVILRLEQGKEPWLVEEEVLRNGRPEKNG

SEQ ID NO: 22845 - protein, 81 aa, Rhinopithecus roxellana
ICNEAVTFKDVAVVFTEEELGLLDPAQRKLYQDVMLENFRNLLSVGHQPSYQDTFHFQREEKFWIVETATQRQGNSRGKIQ

SEQ ID NO: 22846 - protein, 81 aa, Rhinopithecus roxellana
MEFTWDEWQLLDSTQKYLYRDVILENYHNLLSVGYHGTKPDLIFKLEQGEDPWIINAKISRQSHPDGWEEWYQNNQDELES

SEQ ID NO: 22847 - protein, 81 aa, Rhinopithecus roxellana
QAEVTFEDVAVFLSREEWGRLGPAQRGLYRDVMLETYGNLVSLVLGIRTEYKELTSRETFGEEELGQPRGIFPRASEPVEA

SEQ ID NO: 22848 - protein, 81 aa, Rhinopithecus roxellana
QVLLTFRDVAIEFSQEEWKCLDPAQRTLYRDVMLENYRNLVSLDISSKCTMKEVLSTAQGNTEVFHTGTLQRHESHHFGDF

SEQ ID NO: 22849 - protein, 81 aa, Muntiacus reevesi
TSQGRLTFRDVAIDFTQEEWECLDLGQRELYTDVMLENYGNLASLGLVSKLELVAFLEQLKDPMNIRRMETTAIYPVFCIR

SEQ ID NO: 22850 - protein, 81 aa, Phascolarctos cinereus
SQESLTFKDVAVDFTKEEWGWLDPAQRGLYRDVMLENYGNLVSLGHQVSKPDMISQLEQGKEPWKVERKTSRDICSDLETV

SEQ ID NO: 22851 - protein, 81 aa, Phascolarctos cinereus
HQSSVTFRDVAVNFTPEEWGQLGPAQKELYREVMLENYQNLVCLGLAASKPDVIYQLERGEAPRMAGGDVVPRSDCPNWKA

SEQ ID NO: 22852 - protein, 81 aa, Pteropus vampyrus
PQDLVTFKDVAIDFSQEEWDWLNSAQRSLYRSMMLENYQSLVSLGLCISKPYVITLLEQGKEPWRMKSDMTSPFSDWESGC

SEQ ID NO: 22853 - protein, 81 aa, Pteropus vampyrus
SQELVTFEDVAVYFIRKEWKRLEPAQRDLYRDVMLENYGNVFSLDGETRTGHDQDISEETGSHGMLLGRFQKDISQDLKFE

SEQ ID NO: 22854 - protein, 81 aa, Pteropus vampyrus
MSVFQGFVLFKDMAVNFTEEEWRELDSAQRVLYRDVMLENYRNLVFLGFPFSKPDIVSQLEQVVNPQMQEGEVLSSSCTYE

SEQ ID NO: 22855 - protein, 81 aa, unidentified
  REGION 1..81: note = Bos indicus x Bos taurus
LSQKRLTSEDVAIEFTQEEWEFLDPAQRALYRDVMLETYRNLLSVGEDDFLPELPLGICIFPVCPLGGPDVFHLRVLVTWA

SEQ ID NO: 22856 - protein, 81 aa, Physeter macrocephalus
YQELVTFRDVAVDFSQEEWDCLNSSQRHLYSNVMLENYRILVSLGLCFSKPSVILLLEQGKEPWMVKTELTKDLCSDWESV

SEQ ID NO: 22857 - protein, 81 aa, Sapajus apella
GQGLLSFEDVAVDFTREEWQFLDPSQKVLYKEVMSENYRNLVSVGYQGTKPDSLFKLERGEPPWIVEGAAHCQTCLGFVIQ

SEQ ID NO: 22858 - protein, 81 aa, Zalophus californianus
SQEPVTFEDVAVYFTQNQWASLDPMQRALYLEVMLENYANITSLAALPFPKPDLILQLEQGGAPWGLDPWTPLEGEALGGV

SEQ ID NO: 22859 - protein, 81 aa, Sapajus apella
CQEMVTFEDVAVHFTKTEWTGLSPAQRALYRSVMLENYGNLTAMGYPVPKPALISLLEGGDMAWDLEAQDDPLAEGTKNIC

SEQ ID NO: 22860 - protein, 81 aa, Sapajus apella
LTFRDVAVEFSPEEWKCLDSAQRTLYRDVMLENYRNLVSLGISSKCMMKEFSSTGPGNTEVLHTGTLETHESHHIENFCFQ

SEQ ID NO: 22861 - protein, 81 aa, Pan paniscus
MLMMFRDVAVDFSQEEWECLDLEQRGLYRDVMLENYSNMVSLGLCIYQPEAFSLLEKGKEPWKILRDETRGPCPDMQSRCQ

SEQ ID NO: 22862 - protein, 81 aa, Vulpes vulpes
MTFEDVAVEFTQWEWGQLDPAQKDLYSEVMLENFKNLACLGLPVSKPYVISQLEEGKEPCVLEGEISTDWEKKSKVKESVL

SEQ ID NO: 22863 - protein, 81 aa, Callorhinus ursinus
AEGHVTFEDVAVYFSWEEWGLLDEAQRLLYRDVMLENLALMASLGLASSRTHEITQLEWWREPFLPPCGVVTAAMPRGWRR

SEQ ID NO: 22864 - protein, 81 aa, Rhinolophus ferrumequinum
EVVPLTFQDVAVYFSREEGQQLGPDQRALYRDVMLENYGHVASLGPPFPKPELISQLEQGEELWVLGLVGAEEPEALSSCG

SEQ ID NO: 22865 - protein, 81 aa, Acinonyx jubatus
PQASVSFKDITVEFTQEEWRQMDSAQRTLYRDVMLENYSHLVSLGYCFTKPELIFTLEQGEDPWLFKKEFPRKGSPEEYQP

SEQ ID NO: 22866 - protein, 81 aa, Rhinopithecus roxellana
RAQSCVTFEDVFVYFSREEWELLEEAQRFLYRDVMLENFALVATLAFIFPVPCSCPVGGGRKPWVPDRADITAATVKETCR

SEQ ID NO: 22867 - protein, 81 aa, Tursiops truncatus
GQVPLTFSDVAIDFSQEEWECLNSDQRNLYRDVMLENYTNLISLDIDFTSESNKLSSEKSSYEVTSYHRETMNRSKTFNVM

SEQ ID NO: 22868 - protein, 81 aa, Rhinopithecus roxellana
MCSEPLKQSYLAPVLCYFILTGYCITKPEVIFKIEQGEEPWILEKGFPSQCHPERKWKVDDMLESNQENEDDHFWELLFNN

SEQ ID NO: 22869 - protein, 81 aa, Sus scrofa
IKGSMTLQDVAVDFTPEEWQLLDCDQRTLYWDVMLENFRNLISVGCPVPKTKVIFRMEQGHDPWMVEGENPRWRCPEADYP

SEQ ID NO: 22870 - protein, 81 aa, Panthera pardus
ASGLLSFGDVTVGFTEEEWQRLDPAQRTLYRDVMLENYSHLVSVGLSIPKPEVILKLEQGEEPWILESPGQSDPELINSSR

SEQ ID NO: 22871 - protein, 81 aa, Sus scrofa
QGSLSFKDVAVVFTWEEWQLLDPIQKNLYQDVMLENYINLVSMEDAWQVDNHRDWHKGNHGNLETMENHQKENAFGKISSL

SEQ ID NO: 22872 - protein, 81 aa, Bison bison
SQGLLTFEEVAIYFSQEEWELLNPTQKALYNDVMHENYETVISLALFVLPKPKVMYLEQREEPYIQGSPVFKDNPGELLSE

SEQ ID NO: 22873 - protein, 81 aa, Sus scrofa
MDSVVFEDVAVDFTPEEWALLDLAQRNLYRDVMLETFRNLASVGENWKCHNTEEQHKNQGTHLRCHVMDISSESKETNQGG

SEQ ID NO: 22874 - protein, 81 aa, Ursus arctos
MAFEDVAVYFSQEEWELLDAAQGALYCHVMLENFALVASLGLSASRPRVVIQLERGEDPWVLSGTVVTPARNAHRKPSPGS

SEQ ID NO: 22875 - protein, 81 aa, Ursus arctos
PQDLMTFEDVAVEFTQWEWGQLDPAQQGLYREVMLENFKNLASLGLPVSKPYVITQLEEGKEPCVLDGEISTDWEKRPKAK

SEQ ID NO: 22876 - protein, 81 aa, Panthera pardus
KPGALSFADVAVYFSSEEWGCLRPAQRALYRDVMRETYGHLGALESKKKNEPSSRIRAKELEDPPVKNGPLMKARLVPGFR

SEQ ID NO: 22877 - protein, 81 aa, Capra hircus
AQLTFKDVFIDFTPEEWECLDPAQRTLYKDVMVEILRNLLSVDMSHIHMIKKLQAKANSGKGAIFQRVMFGRAEILEIKDF

SEQ ID NO: 22878 - protein, 81 aa, Panthera pardus
MLENYRNLVALGHQLYKPEVICQLEQEEQWMMERGSSGDIRAGGENRPDIKKSIPNQNISDENQNHDMIMERLTGDSFWYS

SEQ ID NO: 22879 - protein, 81 aa, Capra hircus
MARSQASVTFKDVAMDFTPEEWGRLDPTQRDVMLENYRNLVSLWLPVSKPENHSLENGKEPLLLERKAPRSSCSDSETSPR

SEQ ID NO: 22880 - protein, 81 aa, Macaca nemestrina
DSVAFEDVAINFTCEEWALLGPSQKSLYRDVMQETIRNLDCIGMIWQNHDIEEDQYKDLRRNLRCHMVERSCEIEDNSQCG

SEQ ID NO: 22881 - protein, 81 aa, Tursiops truncatus
QAEVTFEDVAVLLSREEWGRLGPVQKGLYRDVMLETYRNLVSLGAGPAGPKPEVITQLERGDEPWVPDVQGRERPTIDGSA

SEQ ID NO: 22882 - protein, 81 aa, Tursiops truncatus
EEVPVVFEDVAVYFTREEWGTLDKRQKELYRDVMRMNYELLASLGPAAAKPALISKLERRAAPWIQDPNGPKWGKGRPPGK

SEQ ID NO: 22883 - protein, 81 aa, Tursiops truncatus
SQASVSFKDITVELTQEEWQQMGPIQKTLYRDVMLENYNNLVSVGNCIFKPEVIFKLEQGEEPWFLEEEFSNQSHKEDYRD

SEQ ID NO: 22884 - protein, 81 aa, Rhinopithecus roxellana
VTFEDVTIIFTWEEWKFLDSSQKRLYREVMWENYTNVMSVENWNESYKSQEEKFRYLEYENFSCWQGWWNAGAQMCENQNY

SEQ ID NO: 22885 - protein, 81 aa, Bison bison
VEEDFRFKDVVIYFSWKEWECLHSAQKDLYQDVMLENYNNLISLGFANFKPDVISLLEQRKEPWMVKGKETEEWCPDWKSR

SEQ ID NO: 22886 - protein, 81 aa, Panthera pardus
MLENYGHVASLGFLVAKPALISLLEQGEEPGALILQVAEEQGTVANLCPDSRMEAGVKESSPGRVSSKQLGLLGTVWGRLP

SEQ ID NO: 22887 - protein, 81 aa, Acinonyx jubatus
PQVSVSFEDVAVLLSWEEWGCLGPAQKGLYRDVMLETYRNLVSLGLQRSKPDVISRLEKGEEPWAPRSLRIEESWIRNHRS

SEQ ID NO: 22888 - protein, 81 aa, Tursiops truncatus
MLENYGNLVSLGFPISKPDGISQLEQDLQVFDLETKNREVLRDDCSDGETREENKLLIPKQKIPEEVHSYKVRVGRLKKDI

SEQ ID NO: 22889 - protein, 81 aa, Acinonyx jubatus
LQGLLSFSDVAVDFTCEEWELLDTVQKNLYRDVMLENYSNLMSLGYHAPWPEATVPVEKGVQGLVEREFPSLCSPGRPLQC

SEQ ID NO: 22890 - protein, 81 aa, Sus scrofa
SQAPVTFEDMAMYLTREEWRPLDPTQRDLYRDVMQENYGNVVSLDFEIRSENEVNPKQEISEDVEFGTVSERPVGNTEENP

SEQ ID NO: 22891 - protein, 81 aa, Panthera pardus
FQEAVTFKDVAVVFTIEELGLLDSAQRKLYRDVMVENFENLLSVGHLPFKPDMMSQLEAEEKLWMMERETQRNGYSSENHV

SEQ ID NO: 22892 - protein, 81 aa, Capra hircus
FQEPVSFKDVAVVFTEEELGLLDSAQRKLYQEVMLENFRNLLSVGNQPFKPELIFQLEREERLMMETQRDGCSGTKSLHNM

SEQ ID NO: 22893 - protein, 81 aa, Tursiops truncatus
MLENYGNLVSVVGCQLSKPSVISQLEKGEAPWMTEKEGPGNPSSDLKSKTETAASTAKNDVLQEQFYHGMMMERFMRDDVI

SEQ ID NO: 22894 - protein, 81 aa, Tursiops truncatus
PWLPLTFEDVAVYFSEQEWRDLEPWQKELYKQVMRTNYEILVSLDDGLPKPELISWLEQGRELFRIWGESQKSGNIICTSA

SEQ ID NO: 22895 - protein, 81 aa, Enhydra lutris
DQESVTFKDVAIDLTQEEWTLMDRSQRKLYIDVMLENITHLVSVGCQFFQADVISQWEQGGELWREDRGLAQGWNPGLENS

SEQ ID NO: 22896 - protein, 81 aa, Acinonyx jubatus
AVTFTDVAVNFTKEEWALLDPAQRNLYRDVMLKKCRNLASVDSLNQRKTQNSTPRQDILAEKTPRGANRVCAVSRSSRPSP

SEQ ID NO: 22897 - protein, 81 aa, Acinonyx jubatus
MVQESVTFRDVVVLFTQDEWAQLSPTQRALYRDVMLENYSNLVSLGLLGPQPDVLSQLGKGEEWMLEDTSAGFCLDWMTMP

SEQ ID NO: 22898 - protein, 81 aa, Acinonyx jubatus
PQAKVTFEDVAVLLSQEEWDRLGPAQRGLYRHVMMETYGNVVSLGLPGSKPNVICQLERGEEPWVLEGQGAKETGGLGIGH

SEQ ID NO: 22899 - protein, 81 aa, Sus scrofa
ESVTFRDVTVDFTREEWRQLKPAQKDLYRDVMLENLRNLVSLDLETRPEMKEPDPKEEISGDKPSVEVVAEGHAGSAGWGS

SEQ ID NO: 22900 - protein, 81 aa, Sus scrofa
SQGLLTVEDVAIDFSPEEWECLDLGQRHLYRDVMLEICRHLVSLEYVISKPDLVRLLEQKTDPWDVKGMETVAIQPALSSH

SEQ ID NO: 22901 - protein, 81 aa, Ursus arctos
AQGSVTFEDVALYFSWEEWDLLDEDQRCLYHDVMLENFALTSSLGCRSSRSHKVAQLGLGEESPVLHRMDRIPVSTRWAQR

SEQ ID NO: 22902 - protein, 81 aa, Sus scrofa
MASPSPPTEPKEEWDYLDPAQRSLYKDVMMENYGNLVSLDVLNRDKDEAPTVKQEIEEIEEEVEPQSVIVTRIKSEIDQDP

SEQ ID NO: 22903 - protein, 81 aa, Acinonyx jubatus
YQEFVTFEDVAVHLTREEWGCLDPVQRNLYREVMLENYGNVVSVGFPFPKPDGISQLEQDLQVFDLETKNREVLRDDCSDG

SEQ ID NO: 22904 - protein, 81 aa, Panthera pardus
PQEPVTFEDVAVYFTQNQWASLDPMQRALYREVMLENYTNMASLAFPFPKPVLVSHLERGEAPWGPDPWEAEVLRGICPGG

SEQ ID NO: 22905 - protein, 81 aa, Panthera pardus
LFQGRLTFRDVAIEFSQEEWECLDPAQRALYRDVMLENYRNLVSLGEDNFPPEVILEAKCVKWIHSAVLRLDMPAVYFPQV

SEQ ID NO: 22906 - protein, 81 aa, Panthera pardus
MLENYSHLVAVGCCVPKPDVIFRLEQGQQPWIVEEESLDQSCPEVCKVDNQLEQNQEIQHRHFWQAPFINNKTLTVHRGNV

SEQ ID NO: 22907 - protein, 81 aa, Tursiops truncatus
FQVLVSFEEVAVLLSQEEWGHLGPAQKRLYRDVMLETYGNLVSLGLQGSKPDVISKLEQGEEPWTPHSPRIEGSWIRRRRP

SEQ ID NO: 22908 - protein, 81 aa, Enhydra lutris
MLENYGNVVSLGFPLSKPDGISLREQDLQVFDLETKNREVLRDDCSDGETREENKLLIPKQEILEEVHSYKVRVGRLKKDI

SEQ ID NO: 22909 - protein, 81 aa, Sus scrofa
DSVVFEDVAVNFTLEEWALLDLSQKKLYRDVMRETLRNLALVGRKWEGHAIEDEYKNPGRKPRNLVVRRLCENREGSPPGE

SEQ ID NO: 22910 - protein, 81 aa, Enhydra lutris
AQESLTFRDVFVDFTLEEWQQLDSAQRNLYRDVTLENYSHLVSVGYLIAKPDEVLRLGQVEEAMGAEGEPPARNHPEFWQV

SEQ ID NO: 22911 - protein, 81 aa, Sus scrofa
AQGSLSFRDVAVDFTWEEWQLLTPAQKDLFRDVTLENYRNLVAVAGYQVSKPAALAKLERREEPWTRAEEAPSGTCEETGK

SEQ ID NO: 22912 - protein, 81 aa, Vicugna pacos
SHALVTFQDILVHFTREEWELLDAAQQLMYRDVTLENCRNLVSLGHQLPKPDVILRLEKGEEPWLLERGVHPEAHPDLEAA

SEQ ID NO: 22913 - protein, 81 aa, Odocoileus virginianus
VTFEDVAVLLSQEEWGLLGPSQKGLYREVMLETYRNLLSLGPVSFPGAGLADPKPEVIVQLERGDELWVLDMHGAEQPSVD

SEQ ID NO: 22914 - protein, 81 aa, Odocoileus virginianus
KSWGHLSFMDVFVDFTWEEWQLLDSAQKHLYRSVMLENYRNLVSLGYQYTKPSIIFQLEQEELWMMHSPSQDHSDEVWEID

SEQ ID NO: 22915 - protein, 81 aa, Sus scrofa
PGSVTFEDVAVYFSQEEWKLLHEAQRLLYRDVMLETFALVASLGCWPGVDDKETLSEQTISVEGPHINPSKADLSTQKAYA

SEQ ID NO: 22916 - protein, 81 aa, Ursus arctos
LRSPVTFEDVAVYFSKEEWGLLDASQRHLYHNVMLENFELMTSLGCWHGVEDEGDHSKQNTSVEGMSQVRIPSANPSTQKA

SEQ ID NO: 22917 - protein, 81 aa, Ursus arctos
MDFTLEDWEHLGLDQGDLFWDTALDNYQNLFLLNPSKPKLTSHPDGTEEPKVLVRESPESAGPDTAEVKNCLLAPDFLEED

SEQ ID NO: 22918 - protein, 81 aa, Ursus arctos
GEEAVVFEDVAVYFTRIEWSCLAPDQRALYRDVMLENYGHVASLGFLVAKPALISLLEQGEEPGALILQVTEERGFAASLC

SEQ ID NO: 22919 - protein, 81 aa, Capra hircus
AQLTFKDVAIQFSPEEWECLDPAQKTLYRDVMLETLRNLLSVAISHIHMIKKSQLKSNIDIGERFQTVMLENHESHEIKHF

SEQ ID NO: 22920 - protein, 81 aa, Tursiops truncatus
FREPVIFEDVTLGFTPDEWGMLDLEQKSLYREVLLENYRNLVSVEHQLSKPDVVSQLEEEEELWSVERGIPRDTFSECPEA

SEQ ID NO: 22921 - protein, 81 aa, Tursiops truncatus
YQEFVTFEDVAVHLTREEWGCLDPVQRALYREVMLENYGNLVSLGFPISKPDGISQLEQDLQVFDLETKNREVLRDDCSDG

SEQ ID NO: 22922 - protein, 81 aa, Ursus arctos
WLTFRDVAIEFSPEEWECLDPAQRALYRDVMVENYRNLVSLAISSKCMIKELPPKENSNTGEVLQTVILERHKSCDNEDYA

SEQ ID NO: 22923 - protein, 81 aa, Sus scrofa
FQESVTFKDVIVDFTQEEWKQLDPVQRDLFRDVTLENYTHLVSIGLQVSKPDVISQLEQGTEPWIVEPSIPVGTFGDWETR

SEQ ID NO: 22924 - protein, 81 aa, Sus scrofa
SRSLESDGVCFSEQDWENLEGWQKELYANVMKSNYEALVSLKVLGQPEGEAELGTEMLGDLEEGEGPGGDHPAEGRLMKQE

SEQ ID NO: 22925 - protein, 81 aa, Sus scrofa
SQGLLTVEDVAIDFSPEEWECLDLGQRHLYRDVMLEICTHLVSLEYVISKPDLVRLLEQKKDPWDVKGMETVAIQPALSSH

SEQ ID NO: 22926 - protein, 81 aa, Leptonychotes weddellii
AQESVVFSDVSIDFSQEEWECLNDDQRDLYRDVMLENYSHLVSMAGHSVSKPDVISVLEQGKEPWLVDRELTREQWPVLES

SEQ ID NO: 22927 - protein, 81 aa, Panthera pardus
MLENYSKLVSVGCLTIKPDVISQLERGEEPWIIEVMFSSQSLPAIHSTFSILSQKEQKKNKSRGSISFEDVTVNFTQEEWG

SEQ ID NO: 22928 - protein, 81 aa, Acinonyx jubatus
FQGSVTFQDVAVDFTPEEWQLLDCDQRTLYWDVMLENFRNLTAVGGPITKTKVIFKEEQGQESWMVEGENPCWRYPEADWL

SEQ ID NO: 22929 - protein, 81 aa, Tursiops truncatus
MLENYRNLNSLHKEHLLSKPVETSRLESKEKSWIMEQEILRTTVFDREIVSENQDLVPKQRISGEESSHAVIMTRLTENGH

SEQ ID NO: 22930 - protein, 81 aa, Acinonyx jubatus
MLENYSHLVSLGLNISKPYVVSLLEQGKEPWLEKRGVRRDLFSEPNREVKEFSQKNVIYEDDSPQCLVVERILSHGPEYSS

SEQ ID NO: 22931 - protein, 81 aa, Vicugna pacos
VQGSLLFEDVAVDFTWEEWQLLAPDQKALYRDVMLENYSHLVSVGLQSSKPTEIFKLKQGDQPWLEEENTPGQNSPEVGEV

SEQ ID NO: 22932 - protein, 81 aa, Bos indicus
MLENYSNLVSVGYQASKPAALSRLERGELWPVEDKVHSRICPEMRKDDCLLQENLQNQSCPKRMERCHEHNALGNVYQSKN

SEQ ID NO: 22933 - protein, 81 aa, Cebus imitator
AHVSLAFRDVSIDLSQEEWECLDPAQRDLYKDVMFENYSNLVSLGYTIPKPDVIALLEQEKEPWIVMKEGTRSWYTDLEYK

SEQ ID NO: 22934 - protein, 81 aa, Sus scrofa
TAGPVTVKDVTLAFTKKEWEQLDATQRSLYKDVMLENYSNLASTGCQTLKPDMISKLGKGEELWLGKGKKPKQGGLSEIAR

SEQ ID NO: 22935 - protein, 81 aa, Enhydra lutris
MDFTLDWEHLGLDQGNLFWDTALDNYQNLFLLNPSKPKLTSQPDGAEEQKVLEREGPESAGPNPAEIKNCFLGQDFLEEGL

SEQ ID NO: 22936 - protein, 81 aa, Physeter macrocephalus
QAQETLTFDDVTVDFTWEEWQLLIPPQKDLYQEVMLENYSNLLSVGYQARKPDILSKLDQGEPWTMEDEIHCRTHSGYQAS

SEQ ID NO: 22937 - protein, 81 aa, Physeter macrocephalus
KSAAVSFSDVAVYFSLEEWGCLRPAQRALYRDVMRETYGHLGALGFPGPKPALISWMEQESEAWSPAAQDPEEGESLGGAL

SEQ ID NO: 22938 - protein, 81 aa, Trichechus manatus
SVTGADVAVDFTQEEWALLDLSQRKLYREVMTETFRNLASVVSRNPNDGEKLSTENIIVRFMRNDIWSSMVGEIYKLHGVE

SEQ ID NO: 22939 - protein, 81 aa, Carlito syrichta
LQGSVSFKDVTVDFTQEEWHQLNPAQKALYRDVMLENYCHFISVGFHMTKPDMIRKLEQGEELWTERIFSRQSHLEEDGKA

SEQ ID NO: 22940 - protein, 81 aa, Zalophus californianus
MRRKWKNILNAVPSQEEWGQLDLAQRRLYRSVTLETCSHLVSLGLLLSKPAVISWLEQGQDPWRAGQGPPRDWKNTFEKKE

SEQ ID NO: 22941 - protein, 81 aa, Zalophus californianus
LPDLVTFEDVAVEFTREEWALLDPSQRTLYRDVMRENCRNLASLGYHIDKSSLISHLEQEDKVTTEERGILPGTCPDLETV

SEQ ID NO: 22942 - protein, 81 aa, Sapajus apella
IQDSVVFEDVAVNFTQEEWALLDLAQRNLYRDVMLENFQNLASLGYLLHTPHLISQWEQEEDLQTLKRELIQGICVREHQE

SEQ ID NO: 22943 - protein, 81 aa, Tursiops truncatus
LQEQVSFKDVCVDFTQEEWYLLDPAQKILYRDVILENYSHLVSVGNCITKPEVIFKIEQGEEPWILEERFPKQCCSEDWKV

SEQ ID NO: 22944 - protein, 81 aa, Tursiops truncatus
SQSLVTFGDVAVEFSPEEWEWLDSAQRSLYRSVMLENYRSLVSLGLCVSKPKMISSLEQRKEPWVAKRTLTRGGCPDSRAL

SEQ ID NO: 22945 - protein, 81 aa, Tursiops truncatus
MAHLMMFRDVAVDFSQEEWECLDLEQRALYRDVMLENYSNMVSLGLCLYQPDVFSLLEKGKEPWMVLKDETGGPCPDMQSR

SEQ ID NO: 22946 - protein, 81 aa, Rhinopithecus roxellana
QGLLTFRDVAIEFSQEEWKCLDPAQRTLYRAVMLENYRNLVSLAISSKCMTKEFSSAVQGNREVLHTGTLQRHESHHIGDF

SEQ ID NO: 22947 - protein, 81 aa, Sus scrofa
LTLEDVAVDFTWEEWQLLTPNQKDLYQDVMLENYGNLVAVETEKVEDCVQWHCQKQNTLRRIEEGYEQSVFENITHQSKRS

SEQ ID NO: 22948 - protein, 81 aa, Bison bison
MLETYSNLVSLGLAISKPDVISFLEQGKEPWTVEEVVTGGLCPVLKSRYDTKVFSPKQQSYEVQSPPWEIMESLTTYGLEC

SEQ ID NO: 22949 - protein, 81 aa, Sus scrofa
MTFEDVAVEFTQWEWEQLDTAQKELYREVMLENFKNLASLGFPVSKPYVICQLEEGEEPCTVEREISTGAHSDWERRPRAK

SEQ ID NO: 22950 - protein, 81 aa, Sus scrofa
LQEPVTFRDVAVDFTQEEWGQLDPVQRTLYRDVMLETYGHLLSVGHQMAKPEVISLLEQGEEPWSTEQPYSPPGTCPEWMR

SEQ ID NO: 22951 - protein, 81 aa, Ursus arctos
MLENYFNLISVGCQVPKPEVIFNLEQEEPRMLDGEISSQSCLDGDIGFETSQQGMSEEVSIQFERINLFTSDDPYSILELW

SEQ ID NO: 22952 - protein, 81 aa, Ursus arctos
MAAGFQFKDVAIYFSQKEWECLHSAQKALYRDVMLENYNNLISLGLSDSKPDVISLLEQGKEPWMVKSQETKECCPGRFLR

SEQ ID NO: 22953 - protein, 81 aa, Leptonychotes weddellii
SQGSLSFEDVAVDFTREEWQLLDSAQKTLYRNVMLENLSSLVSLGFQLIRPDVIFRLEQEKPRVISEDIPSESFSEYRKVD

SEQ ID NO: 22954 - protein, 81 aa, Phascolarctos cinereus
GKESVTFKDVAVEFTSEEWVQLNPTQKKLYRDVMLENYRNLVSLGFAVSKPDVIYQLEREEASWMPKADIPRSSCPESGEF

SEQ ID NO: 22955 - protein, 81 aa, Phascolarctos cinereus
MLENYRNLVSLGFAVSKPNVIYQLERKEASSLPETDIPRSSCPESIEFGGDKPLQCNGYGNAFWSKEHHAVCQIIHTGDNP

SEQ ID NO: 22956 - protein, 81 aa, unidentified
  REGION 1..81: note = Bos indicus x Bos taurus
PLTQLTFEDVAVDFTQEEWALLDTSQRKLFRDVMLENISHLVFVGYQHCKLDVIFQLEQGEELWIEGRGFFQSHSPGRESA

SEQ ID NO: 22957 - protein, 81 aa, Carlito syrichta
CEGSVSFEDVTMDFSREEWQQLDSAQRHLYQDVMLEIYSHLFSVGYHIPNPEVIFRLVKGKEAELPHQRYQEGKFGLETPQ

SEQ ID NO: 22958 - protein, 81 aa, Acinonyx jubatus
MLENYINLISVGYQTTKPSVIHKLEQGEKPWMVEREIPNWSYAEETWQLDDHMEQHQENQETLLKHAAFIDQETGTDEKGN

SEQ ID NO: 22959 - protein, 81 aa, Enhydra lutris
SVTFRDVTVDFTQEEWQQLEPAQKDLYRDVMLENYRNLVSLDLETRPEMKESGPQEDSAEDRPPAGVVAEGPPRHGAHGLA

SEQ ID NO: 22960 - protein, 81 aa, Bison bison
WKGLLSFEDVVLYFTREEWDMLDWAQKALYRDVMLDNYRHVVSLGFQFPKPEVICQLEQWEEPWILDLPRAGTRKASGSAC

SEQ ID NO: 22961 - protein, 81 aa, Bison bison
VVFEDVAVDFTQEEWALLNLAQRNLYRDVMLENFRNLASLGFEIQLKINESVAPQDAYGKISNEQDVAGFKNSDSSLSILH

SEQ ID NO: 22962 - protein, 81 aa, Sus scrofa
SLGSALFRDVAVVFTREEWEQLAPAQRDLYRDVMLETYGNLVSLGLAVSKPEVIAFLEQGREPWMVEEVVTGSLCPVLESR

SEQ ID NO: 22963 - protein, 81 aa, Sus scrofa
VTFEDDVAISFTREEWDCLDPAQRALYKDVMLETYRNLIAVDHHRIHTGEKPYKCVVCGKFFKQKSTLTVHQRIHTEEKAY

SEQ ID NO: 22964 - protein, 81 aa, Ursus arctos
WAGSVTFRDVAIDFSQEEWEFLDSAQRDLYRDVMWENYSNFISLAEPSISKPDVITLLDEGKEPWMVVREGTRRHYSDLES

SEQ ID NO: 22965 - protein, 81 aa, Macaca fascicularis
MGLLTFRDVAIEFSLEEWQRLDAAQQNLYRNVMLENYRNLAFLGIAVSKPDLITCLEQGKEPWNMKRHEMVDKPPAICPHF

SEQ ID NO: 22966 - protein, 81 aa, Vicugna pacos
WSQMPVTFEDVALYLSREEWGQLDHTQQSFYRDVLQKRNGLSFAGFPFSRPFWASQVQGKGEASSSSRQTGDEERRGAMEV

SEQ ID NO: 22967 - protein, 81 aa, Vicugna pacos
GSVSFTDVTVDFTQEEWEQLDPSQRILYMDVMLENYSNLLSVEVWKADDQMEGDPRNPDEQARPFVIFKNHIPIEEEEDDL

SEQ ID NO: 22968 - protein, 81 aa, Odocoileus virginianus
PTAWSEDPVTFQEVSVDFSREEWAQLAPAQKILYQDVMLENYRNLTSVGYHLRKPCLLTQGELRTRKRRLLQDTCAGYYKI

SEQ ID NO: 22969 - protein, 81 aa, Odocoileus virginianus
MQFSWEEWQLLDSVQKHLYRDVTLENYSNLVAIGYHGNKPDLIFKLEQGEEPWIINSKVSHQSCPDGWEEWYQKNHDELES

SEQ ID NO: 22970 - protein, 81 aa, Vicugna pacos
FQGLVTFRDVAVDFSQEEWEWLSPSQRTLYRRVMLENYRSLVSLAGVSVSKPDVISLLEQGKEPWKVKKEWTGGTRPDWEY

SEQ ID NO: 22971 - protein, 81 aa, Vicugna pacos
SQDSVTFEEVVVDFSQEEWALLDPAQKILYRDVMLENFQNLASVGYHLCKHSLITEEEQEELRPEGRRLLQGACREWDTQF

SEQ ID NO: 22972 - protein, 81 aa, Phascolarctos cinereus
MLENYRNLVSLGPESPGSRPQIISWLEQGEGREFPGSIPSDSKTQTEARWGISTEGEVWKMGSEGTTGDADQEPKWGAASG

SEQ ID NO: 22973 - protein, 81 aa, Phascolarctos cinereus
GRKSVTFKDVAVEFTREEWLHLNPSQKKLYRDVMLENYRSLVSLGFAVSKPDVIYQLERKEAFWMPETDIIPRSSCPGNKE

SEQ ID NO: 22974 - protein, 81 aa, Cebus imitator
AQGSVSFNDVTVDFTQEEWQHLDHAQKTLYMDVMLENYCHLMSVGCHMTKPDVILKLERGEEPWTSFAGHTRLEENWKAED

SEQ ID NO: 22975 - protein, 81 aa, Physeter macrocephalus
SQGLVSFKDVAVDFTQEEWQQLDPAQKTLYRDVMLENYSHLVSVGHPVSKPDVISKLEQGEDPWIIKRDIPNWIYPYEDQA

SEQ ID NO: 22976 - protein, 81 aa, Trichechus manatus
AQESLTFSDVAVGFTWEEWQLLNPAQKDLYQDVMLENYNNLVSVGYQVSKPDVLSRLERGEQPWTILDKNHTRNFSEIWKV

SEQ ID NO: 22977 - protein, 81 aa, Trichechus manatus
FQGSMTFQDVAVDFTPEEWQLLDCAQRNLYWDVMLENFRNLISVGCPVANPKVIFKLEQGQEPWMVEGEDPCWSYPEADCL

SEQ ID NO: 22978 - protein, 81 aa, Pan troglodytes
MLENYGAVASLAFPFPKPALISQLERGETPWCSVPRGALDGEAPRGISSGYPFLKPAGMSHPEQVEEPLNLKLQGEGPSLI

SEQ ID NO: 22979 - protein, 81 aa, Sapajus apella
MLENYRNLVSLGGHSISKPVLVDLLEQGKEPWMILREETQFPDLDLQCEIISYIEVPTYDTDISSTQHQSIYQREKLYECK

SEQ ID NO: 22980 - protein, 81 aa, Sapajus apella
MVENFKNLVAVGHLPFQPDMVSQLEAEEKLWMMEAETQRSRYSGENPAAILSGSKHQNKMETLQKFALKYLSNQELSCWQI

SEQ ID NO: 22981 - protein, 81 aa, Capra hircus
GSVSFTDVTVDFTQEEWEQLEPSQRILYMDVMLENYSNLLSVEVWKADDQMETDHRNPDEQARPFVIFKDQTPTEERDNNL

SEQ ID NO: 22982 - protein, 81 aa, Tursiops truncatus
MLENYRILVSLGLCFSKPSVILLLEQGKEPWMVKRELTKDLCSDWESVCETEELTPKQDIYQVRSSQKVIETLTSCGLEYS

SEQ ID NO: 22983 - protein, 81 aa, Tursiops truncatus
SQGLLSFNDVAVDFTWEEWQLLDIVQKNLYRDVMLENYSNLMSLGYQVTKPEPVMHLEKEEEKEKAVVEREFPSQCGPERP

SEQ ID NO: 22984 - protein, 81 aa, Sus scrofa
TQESVTFQDVAVDFTEKEWPLLDSSQRKLYKDVMLENYSNLASVGCQVGKPSLISHLEQEEELRTEERGLHRGGPCSDWET

SEQ ID NO: 22985 - protein, 81 aa, Bison bison
SEDPVTFEEVSVDFSQEEWAQLAPAQKILYQDVMLENYRNLTSVGYHLRKPRLLTQEELRTRKRRLLQDTCADQNSQLKTK

SEQ ID NO: 22986 - protein, 81 aa, Sus scrofa
SQGALSFRDVTVGFTQEEWQHLDPAQRTLYRDVMLENYSHLVSVGYCVPEPEVILKLEQGEEPWVLEEEFSSQSYPELINS

SEQ ID NO: 22987 - protein, 81 aa, Sus scrofa
QEYGLLQRRLENMENLLRNRNFWVLRLPPGSRGEAPKVSRSLESDGVCFSEQDWENLEGWQKELYANVMKSNYEALVSLSE

SEQ ID NO: 22988 - protein, 81 aa, Ursus arctos
ELVTFGDVVISFSQEEWEYLDSAQRDLYWDVMMENYSNLVSLDLESKYDTKCSSTRKDITKKSGSQWKVTESKFIGLARND

SEQ ID NO: 22989 - protein, 81 aa, Ursus arctos
PLTFRDVAVVFTEEELGLLDPAQRKLYRDVMLENFRNLLSVGDKNEKEMEYIQGRELKCLSYRELSYWKIWEHVAGELTEN

SEQ ID NO: 22990 - protein, 81 aa, Vicugna pacos
SLGSDLFRDVAVVFSQEEWGRLAPAQRDLYRDVMLETYGNLVSLGLAFSKPAVISFLEQGQEPWMVEKLATGGPCPGEWGK

SEQ ID NO: 22991 - protein, 81 aa, Leptonychotes weddellii
AQESLTFDDVAVDFTWEEWQLLAPAQKDLYWDVMLDNYRNLVSVGFHISKQDVLSKLDQREPTWTVEEDIPCQTRSETWKL

SEQ ID NO: 22992 - protein, 81 aa, Neophocaena asiaeorientalis
MLENYSHLVSLVVTFAGYCIIKPQVIFKLEHGEEPWPSEEEFLNQKYPGCYRVDVHIEENQEKQEKPLWQVVFTDNKILSK

SEQ ID NO: 22993 - protein, 81 aa, Odocoileus virginianus
QELVMFEEVSVCFTSEEWACLSPVQRALYWDVMLENYGNVTSLEWETMTENEEVTSKLSISQRADSQRGISNRFQGGVPQL

SEQ ID NO: 22994 - protein, 81 aa, Phascolarctos cinereus
GLESVTFQDVTVDFTQREWRQLTQAQKSLYRQVMLENYENFVSLGLPVSKPELISQLECGEGPWMLLEEEPRSPCADWETQ

SEQ ID NO: 22995 - protein, 81 aa, Pteropus vampyrus
MDVMLENYCHLVSVGCRMTKPDVILKLERGEEPWTSFTGHTCLEETWKAEDFLVKFKEHQDTYSRSIVFINHRKLTKENRN

SEQ ID NO: 22996 - protein, 81 aa, Pteropus vampyrus
PQESLTFEDVAVYFTEEEWASLVPAQRALYRDVMLENYGALAFLAAPSTTKPALIYQLEQEKELCFSESQEALSGRASLAG

SEQ ID NO: 22997 - protein, 81 aa, Pongo abelii
MLENYFNLISVGCQVPKPEVIFSLEQEEPCMLDGEIPSQSLPDGDIGFGPLQQRMSEEVSFQSEININLFTRDDPYSILEE

SEQ ID NO: 22998 - protein, 81 aa, Trichechus manatus
SHGSVSFKDLIVDFTQEEWQQLDPAQRLLYRDVMLENYSNLVSVGCHVSKPDVIFKLEQGEEPWMEEEFSSQNYSEVDGAL

SEQ ID NO: 22999 - protein, 81 aa, Callithrix jacchus
YEISVSFEDVTVDFSKEEWQHLDPAQRRLYWDVTLENYSHLLSVGYHIPKSEATFKLEQGEGPWTLEGEAPHQSCSGEAIG

SEQ ID NO: 23000 - protein, 81 aa, Carlito syrichta
SQAPVTFEDMAMYLTREEWRPLDPTQRDLYRDVMQENYGNVVSLDFEIRSENEVNPKQEISEEVEFGATSERPVENAEENP

SEQ ID NO: 23001 - protein, 81 aa, Sapajus apella
SQGLLIFRDVAIEFSPEEWSYLNPAQQNLYRDVMLENYRNLVSLGIAISKPDLITCLEQRNEPWSVKKRETVAKQPAISSH

SEQ ID NO: 23002 - protein, 81 aa, Delphinapterus leucas
WSQMPVTFEDVAVYLSREEWGRLDHTQQSFYRDILQKRHGLSLAGFPFSRPFWASQVQGKGEASGSCQQMGDEEEEKRGAV

SEQ ID NO: 23003 - protein, 81 aa, Panthera pardus
PQEPVTFEDVAVLFTPEEWMFLDSAQRSLYRDVMLENYRNVASVGDQLGKFSSFSHLEQGEEWWPTERRVFPGSCPEPSLP

SEQ ID NO: 23004 - protein, 81 aa, Acinonyx jubatus
ISLTFEEVAMYFSQEEWEFLDPTQKALYNDVMWENYETVISLAVPVHQILAFSEKTNTKDWTVAPELVLPKSQSSLTFEEV

SEQ ID NO: 23005 - protein, 81 aa, Neophocaena asiaeorientalis
MDVFVDFTWEEWQLLDPAQKHLYRSVMLENYSNLVSLGYQHTKPNIIFQLEQEELWMMQIPSESHMDEVWEIDGHMEWHKE

SEQ ID NO: 23006 - protein, 81 aa, Neophocaena asiaeorientalis
MVKSQISFEDVAVDFTVEEWQLLNPTQKTLYRDVTLENCSNLVFLGYQMIKPEAIIKLEQEEPWILGEETLSQNFPEEVWL

SEQ ID NO: 23007 - protein, 81 aa, Odocoileus virginianus
LHRLVLFKDVAVDFSREEWGYLDLEQKDLHRDVMLESYSNLVSLGVSTSKPDMLSLLEQGKEPWKVVQDVTRDLSPDWESR

SEQ ID NO: 23008 - protein, 81 aa, Phascolarctos cinereus
FWESVTFKDVAVDFTWEEWGQLGPSQKELYREVMLENYRNLVCLGLAVSKPDVICQLERGGAPWWPEVGVPGSSCADWDTR

SEQ ID NO: 23009 - protein, 81 aa, Phascolarctos cinereus
FQVSVTFQDVAVDFSRDEWKRLDDAQKALYRDVMLENYENLVSLGLPVSKLDVISLLERREAPRRAKERVPRDLPPDSISQ

SEQ ID NO: 23010 - protein, 81 aa, Phascolarctos cinereus
MDSVTFQDVAVEFTREEWCLLDFSQKVLYRDVMLEISQNLLSLGLPAPKANWISQLDQREVPWIQERQAPGDFCPDEETGP

SEQ ID NO: 23011 - protein, 81 aa, Physeter macrocephalus
QQRPVSFKDVVVGFTQEEWHRLNPAQRALYRDVMLETYSNLVSVGYEGSKPYVILRLEQEEAPWICEASCSGCHCWENIWQ

SEQ ID NO: 23012 - protein, 81 aa, Trichechus manatus
LLTFKDVAIEFSQEEWQSLDSAQKALYRDVMLENYRNLVSLDISSRCMLQELSPDENIIKGELFRTVMLERRVSHSLENFD

SEQ ID NO: 23013 - protein, 81 aa, Delphinapterus leucas
KTWGPLSFMDVFVDFTWEEWQLLDPAQKHLYRSVMLENYSNLVSLGYQHTKPNIIFQLEQEELWMMQIPTQGHLDEVWEID

SEQ ID NO: 23014 - protein, 81 aa, Zalophus californianus
MLENYKSIVSLGLPVPQPDVIFQLKRGDEPWIVDLHGSEERECPENVSLDWETKPEIHGASEEESEGTARGKLGGEVPVCP

SEQ ID NO: 23015 - protein, 81 aa, Acinonyx jubatus
FDDAVTFDDVALDFTQEEWILLDLAQRNLYRNVMLENYQNLVTVGYQQSKPSLVARLEQEELRTVEKGVFPEWQTQHQSKE

SEQ ID NO: 23016 - protein, 81 aa, Sus scrofa
AQESVSFKDVTVDFTQEEWQHLDPAQKTLYMDVMLENYCHLVSVGCHMTKPDVILKLERGEEPWTSFTGHTCLEENWKAED

SEQ ID NO: 23017 - protein, 81 aa, Sus scrofa
MTVSQAPLTLEDMAIEFSWEEWACLDPAQRALYRDVMLETCRNLLSLGEHRFPLGVGICPWVSLRFPSCASQETLLCLTVL

SEQ ID NO: 23018 - protein, 81 aa, Leptonychotes weddellii
GQGSVSFKDVTVDFTRDEWLQLTGTQRTLYRDVMLENYSHLVSVGCHLTKPDVIFRLEHGEELWPSEGEFPDQGDQDKSQE

SEQ ID NO: 23019 - protein, 81 aa, Vicugna pacos
VVQESVTFRDVAVLFTQEEWAELSPAQRALHRDVMLETCGNLVSLGLLGPKPDTLSQLGRGEGWTLEDSLGGFCLDWVTMP

SEQ ID NO: 23020 - protein, 81 aa, Leptonychotes weddellii
KDQESLTLEDVAVDFTWEEWQLLAPTQKDLYRDVMLENYRNLVSVGYMASKPDALSRLEQGELWTTEHEIPSRIRPEIKKD

SEQ ID NO: 23021 - protein, 81 aa, Vicugna pacos
MTKPDVILKLERGEEPWTSCTGHTCLEESWKAEDFLVKFKEQQDEYSRSVALINHKKLIKEKSNTYEKTFTLSKNPINSTN

SEQ ID NO: 23022 - protein, 81 aa, Neomonachus schauinslandi
AQGRVTFEDVAVHFSWEEWGLLDEAQRCLYQDVMLENLALITSLGCRHGAEDEEAPEQKVSAQGVSQVRTFKAVVSPQKAH

SEQ ID NO: 23023 - protein, 81 aa, Pteropus vampyrus
PQGSVSFKDVTVDFTQEEWQQLDSDQKALYRDVMLENYCHLISVGFHMTKPDMIRKLEEGEELWTTERIFPSQSYLESPAV

SEQ ID NO: 23024 - protein, 81 aa, Pteropus vampyrus
MAFRDVAVDFTQEEWMLLSPAQRSLYREVMLENYSNLVSLGIPFSKPKLITQLEQGKETWGEERKCLPVTCPAEPKPEFHL

SEQ ID NO: 23025 - protein, 81 aa, Bos indicus
PEKSVTFEDVAVYFTQTEWDGLSTAQRALYRDVMLENYGNMASLGFPLLKPAVISQLEGGGELEGPSPLASAAGTGPQGLW

SEQ ID NO: 23026 - protein, 81 aa, Bos indicus
SQDSVTFTDVAVYFNQEEWTLLNPFQRKLYRNVMLENYKNLTTAGYQAIKPTLISWLEQDVLKTVERGILQEWEMQLISND

SEQ ID NO: 23027 - protein, 81 aa, Physeter macrocephalus
KEAVTFKDVAVTFTEEELGLLDSTQRKLYQEVMLENFRNLVSVEGKIQSEMETVSEAGLHEELSSWHIWQHIASDFTRCQD

SEQ ID NO: 23028 - protein, 81 aa, Physeter macrocephalus
WSQMPVTFEDVAVYLSREEWGRLDHTQQSFYRDVLQKRNGLSLAGFPFSRPFWASQVQGKGEASGSCQQMGDEEEEKRGAV

SEQ ID NO: 23029 - protein, 81 aa, Physeter macrocephalus
HQEVVTFEDVAVYFTQTEWAGLSPAQRALYRSVMLEIYGNLTSLGYPVPKPALVSLLERGELPWGLETRDDPPAQGTKDIC

SEQ ID NO: 23030 - protein, 81 aa, unidentified
  REGION 1..81: note = Bos indicus x Bos taurus
MLENYSHLVSMGHPVSKPDVISKLEQGEDPWIIKRDIPNWICPYEGQADGRLDRKSNLDNPQSCILGSVSFHNKILKGVIK

SEQ ID NO: 23031 - protein, 81 aa, Trichechus manatus
SVAVEDVAVDFTQEEWALLDLSQRKLYRDVMMETFRNLASVVSRNLNDGEKLSTENIIIPFMKNYTWSSMVGEICELHGIE

SEQ ID NO: 23032 - protein, 81 aa, Delphinapterus leucas
RKVPVSFEDVSVYFTKTEWKLLDPRQRMLYKRVMLENYRHLVSLGFSSSKPHLVARLERGEGPWVADVHRMGTTTGTQAGD

SEQ ID NO: 23033 - protein, 81 aa, Zalophus californianus
SQGPVSFKDVAVDFTQEEWQQLEPDEKTTYRDVMLENYSHLVSVGYDSTKPKVILKLEQGEEPWIAEGDLPCQSHPEIVWK

SEQ ID NO: 23034 - protein, 81 aa, Panthera pardus
MDSSQEEWTLLDQTQIALYRDAMLENYQNLITLAGYKSCKPDLSSALEGAELLRTGGRGVLQDLRPSEVDRDSLEREADGH

SEQ ID NO: 23035 - protein, 81 aa, Panthera pardus
YQGPVTFKDVIVEFTREEWQLLDAAQRTLYKEVMRENYGHLVSVGYCVHKPNAVFKLKQGKEPWILEVEFPRRNYPEDLWK

SEQ ID NO: 23036 - protein, 81 aa, Acinonyx jubatus
MFKDVAIDVSQEEWECLNPTQRSLYKDVMLENYSNLVSLGLSISKPAVISSLEQGKEPWMVVREVTGEQCPDLVSRCEAKK

SEQ ID NO: 23037 - protein, 81 aa, Tursiops truncatus
MLENYFNLISVGCQVPKPEVIFNLEQGEQPCMLDGEISSQSYLDQGIGFETSQQGMSEEVSIQFERINLFTRDDLYSILEE

SEQ ID NO: 23038 - protein, 81 aa, Tursiops truncatus
SQELLTFKDISVDFTQEEWGQLAPAHRNLYREVMLENYGNLVSVAGYQLSKPGVISQLEKGEQPWLMEREISGGPSPDLED

SEQ ID NO: 23039 - protein, 81 aa, Enhydra lutris
MLENYHNFVSVGYPIKKPEVIFKLEEGKEPWILEEEFLYQNYPEDSRAYYVAERIQKNQDKYLPHVLFNNKKVTSKKVYAL

SEQ ID NO: 23040 - protein, 81 aa, Acinonyx jubatus
MVDFSREEWQRLDLAQKSLYRDVMLENYFNLISVGCQVPKPEVIFNLEQEEPCVLDGDISSHNCLNGDIGFKTLQQGTSKE

SEQ ID NO: 23041 - protein, 81 aa, Bison bison
MGLLDLAQRKLYQEVMLENFRNLLSVGHQSFTPDVPSQLEREEKLQMIKTAAQSCCSSGNQNLNGIETLQEVGLRYLPHEE

SEQ ID NO: 23042 - protein, 81 aa, Panthera pardus
PQESVTFKDIAVDFTQEEWALLDASQRKLYRDVMLENIGHLVSVGYQVCKSDVISQLQQGVELWREGRGFPQGVIPDMIAV

SEQ ID NO: 23043 - protein, 81 aa, Panthera pardus
MTFKDVAVEFTQWEWGQLDPAQKDLYREVMLENFKNLASLGLPVSKPHVICQLEEGEEPCVVEGEISTDWEKRPKAKESRL

SEQ ID NO: 23044 - protein, 81 aa, Macaca nemestrina
AEGSVMFSDVSIDFSQEEWDCLDPVQRDLYRDVMLENYSNLVSVGLYTPKPQVISLLEQGKEPWMVGRELTRGLCSDLESM

SEQ ID NO: 23045 - protein, 81 aa, Tursiops truncatus
MTFEDVAVELTRWEWGQLDPTQKDVYREVMLENFKNLASLGFPMSKPYVICRLEEGEEPCILEREISTGAPADWERRHQAK

SEQ ID NO: 23046 - protein, 81 aa, Acinonyx jubatus
MEEWALLDPSQKKLYRDVMQETFRNLASIVCISEEKWEVYDSEDQDENHGTHLISQMVGRLCKCKECSQYEGIFGQIPNQN

SEQ ID NO: 23047 - protein, 81 aa, Tursiops truncatus
MTEEFATLEDVAMDFTLEDWEQLGLDQGDLFWDTALDNYQNLFLLNSPRPNLTSHPDDGEELAALAKGSPESTGPDTAEAK

SEQ ID NO: 23048 - protein, 81 aa, Acinonyx jubatus
FQDFVSFNDVSVNFTEEEWRELDPVQRVLYRDVMLENYRNLVSLGFPFSKPDIISQLEQAVNPWMQEGEVLRGSCTHLETR

SEQ ID NO: 23049 - protein, 81 aa, Sus scrofa
GWVPALFDEVAIYFSDEEWEVLTEQQKALYREVMRMNYETVLSLEFPFPKPDMITRLEGEEESQNSDEWQLQGGTFAENEE

SEQ ID NO: 23050 - protein, 81 aa, Sus scrofa
FQEAVTFKDVAVTFTEEELGLLDSTQRKLYRDVMLENFRNLLLVGNQPFKPELIFQLEREEMLLMLETEIQRGTKSHHSLE

SEQ ID NO: 23051 - protein, 81 aa, Leptonychotes weddellii
QESVTFKDVAVDFTLEEWGQLGPGQRELYRDVMLENYQNLLSLGVGPLGCKPDVISRLERGEEPRMEKKEARQATCPALHT

SEQ ID NO: 23052 - protein, 81 aa, Leptonychotes weddellii
AQDSVTFEDIAVYFSWEEWRLLDEAQRCLYHDVMLENFTLISSLGCCCGADDTEASFEQSTSIGVSQTTTPKAAQSSRKTH

SEQ ID NO: 23053 - protein, 81 aa, Odocoileus virginianus
NFWILRLPPGSKGEAPKEWGKLDEWQKELYKHVMRGNYETLVSLDYAISKPEVLSQIEQGKEPCSWRRTGPKVPDVPVDPS

SEQ ID NO: 23054 - protein, 81 aa, Leptonychotes weddellii
MDVMLENYCHLISVGCHMTKPDVILKLERGEEPWTSFTGHACLEENWKEEDFLVKFKEHQDKFSRSVVFINHKKLIKENSN

SEQ ID NO: 23055 - protein, 81 aa, Odocoileus virginianus
KGSVTLQDVAVEFTPEEWQLLDCDQRTLYWDVMLENFRNLISVGTGCPVTETTVIFKVEQGQEPWMVEGENSRWSSPEADC

SEQ ID NO: 23056 - protein, 81 aa, Odocoileus virginianus
SQRSLTFRDVAIDFSQEEWGFLDPAQRELYTAVMSETYQNLVWLGVSVAEPNIAFLLERGPQPWVMREEDAEAPGAESEST

SEQ ID NO: 23057 - protein, 81 aa, Phascolarctos cinereus
FQESVMFKDVAVDFTQEEWSRLDPAQRALYRDVMLENYENLVSLGLPVSKLDVISLLERGEAPWRPEGGGPRCSCPDLCIE

SEQ ID NO: 23058 - protein, 81 aa, Phascolarctos cinereus
MLDTYEVLVSLGLLGCKPAVISRLERGEAPWRPERGGHQSCCPDFCKQMESCPTEELTPEENTSVRELSTQSFAKDGIWDS

SEQ ID NO: 23059 - protein, 81 aa, Pteropus vampyrus
LVKIEDVADVAVSFILEEWGHLDQSQKALYRDDRKENYESITSMDYESRNDNMELIVKQISDEAESHWMTSGSTERNVPQS

SEQ ID NO: 23060 - protein, 81 aa, Phascolarctos cinereus
TPEGPVTFQDVAVVFTREEWHYLDPSQKELYRDVMLENYSNLLYLGLVISKPDVIHQFEQEAPWRPDRRVPGSVCPAEETG

SEQ ID NO: 23061 - protein, 81 aa, Odocoileus virginianus
SKAPVTFGDLAIYFSQEEWEWLSPIQKDLYEDVMLENYQNLVSLGLCFRRPNVITLLEKGKAPWMVDPVKRRRGLDLGSKG

SEQ ID NO: 23062 - protein, 81 aa, Odocoileus virginianus
FQEALTFKDVAVTFTEEELGLLDLAQRKLYRDVMLENFRNLLSVGHQSSKPDMISQLEREEKLWTTGIQPQRGGRSGGRNH

SEQ ID NO: 23063 - protein, 81 aa, Leptonychotes weddellii
MFKETVTFKDVAVAFTEEELGLLDSAQRKLYQDVMLENFRNLVSVGHQPFKRDQWHIEREERLWLMKTAAQIERNVGGNNQ

SEQ ID NO: 23064 - protein, 81 aa, Phascolarctos cinereus
HQGAVSFKDVAVVFTWEEWGRLHPAQQDLYREVMLDTYEVLVSLGLLGCKPAVISRLERGEAPWRPERGGHQSCCPDFCKQ

SEQ ID NO: 23065 - protein, 81 aa, Pteropus vampyrus
MAEALTQWGQRHPPRGHMQEKHRNLVLLGLPISKPGVISQVEHGEELERKVPKATSPDWETRPESKELTPEQDVSEEESTP

SEQ ID NO: 23066 - protein, 81 aa, Bos indicus
QEGVNFKIVTVDFTQEEEGTLSSAQRTLDRDVILENHGDSWDAATALGRRESRLKQSVFDDKLSHSVKIEKLTRDDPWLSS

SEQ ID NO: 23067 - protein, 81 aa, Pteropus vampyrus
MDFTLEDWEQLGLDQGDVFWDTALDNYQNLFLLNPPGSDLPSPPDVAEEPEALVRGSPEATGPDIAEAKNCSPLQDFLEEG

SEQ ID NO: 23068 - protein, 81 aa, Pteropus vampyrus
MMKSQEEWQQLDPAQRTLYRDVMLENFSHLVSMGHPVSKPDVISKLEQGEDPWIIKRNISNWIYPDRKSNLDNPQSCILGS

SEQ ID NO: 23069 - protein, 81 aa, Pteropus vampyrus
FQWLLTFRDVAVDFSQEEWDYLNPAQRDLYRDVMMENYSNLVLLGLSISKPDVISLLEQGKEPWMISRNMAGGWCPDLEFR

SEQ ID NO: 23070 - protein, 81 aa, Physeter macrocephalus
PVLFEDLAVYFSQEECVSLHPAQRSRSRDTPQECLEDMALMGGEGKIEINQKLRLESMGLEELALEKYSIAVPLVYYPEKS

SEQ ID NO: 23071 - protein, 81 aa, Trichechus manatus
PHWLVTFRDVAIDFSQEEWEYLNPAQRELYRDVMLENYSNLLSLAGCSVPKPDVSSLLEQGKDPWMMVIAMTRRRSSDFES

SEQ ID NO: 23072 - protein, 81 aa, Trichechus manatus
SVVFEDVAVNFTQEEWALLNFAQRKFYRDVMMETFRNLASVVSQQVDKGQMVSTDHLIMRFIKNNFRYTMLGEACEFHGVK

SEQ ID NO: 23073 - protein, 81 aa, Capra hircus
QERLTSEDVAIKFTQEEWEFLDPAQRALYRDVMLETYRNLLSVDIPPTHVIKHLQPTANSDKLETFQTLMLGSPESCEIKL

SEQ ID NO: 23074 - protein, 81 aa, Panthera pardus
MLENYSHLVSVGQLVPKPDVVIRLGQGGEARTAEGETPTRNPPEFWQVHDQMDNHKESQDQRLWPTAFVDQETQKDQSGQE

SEQ ID NO: 23075 - protein, 81 aa, Panthera pardus
SLGLVSFEDVAVNFTWEEWQDLDDAQRTLYRVVMLETYSSLVSLGHCIPKPEVIVKLEQGAEPWTVEEPLEQSLPDVQTAG

SEQ ID NO: 23076 - protein, 81 aa, Capra hircus
SQGRLTFQDVALDFTQEEWECLDLSQRELYRDVMLENYRNLASLAGLVVSKPDLVTFLEQMKTPWDVRRLAMPAIYTAVSS

SEQ ID NO: 23077 - protein, 81 aa, Acinonyx jubatus
LPHSVTFEDVAVEFTPEEWALLDPCQRTLYRDVMQENRRNLASLGNQVGKPGVVSKLEQKDNVVTKETGILPGSFPDLETL

SEQ ID NO: 23078 - protein, 81 aa, Vicugna pacos
PQGLMTFEDVAVNFTQEEWQYLNPPQKTLYRDVMLETYSHLVSVAGQQITKPDLILKLEVEEPCLTEGKIPVWSFPEEAFQ

SEQ ID NO: 23079 - protein, 81 aa, Odocoileus virginianus
AQGSVMFTDVSIDFSQEEWEFLNPDQRDLYRDVMLENYSNLVSMGLYIPKPQVISLLEQGKEPWMIGRELTRGLCSALESM

SEQ ID NO: 23080 - protein, 81 aa, Neophocaena asiaeorientalis
SQGSVTFRDVAVDFSREEWEWLQPAQRDLYRHVMLENYGHLVSLAGLNISKPHVVSLLEQGKEPWLGKDASRGLFSASESN

SEQ ID NO: 23081 - protein, 81 aa, Pteropus vampyrus
GVRESVTFEDVAVGLVQEWALLDGARRNLCRYGILDNCSTLAPRGAPPCKPKLVSHVGPRGELSTAGQGILCAMGVDWESQ

SEQ ID NO: 23082 - protein, 81 aa, Pteropus vampyrus
PVTFEDMAMYLTREEWRPLDPTQRDIYRDVMQENYGNVVSLDFEIRSENEVNPKQEISENVEFGTTSERPVGNTEENPESE

SEQ ID NO: 23083 - protein, 81 aa, Pteropus vampyrus
CEVSVSFEDVTVEFSREEWQQLNSTQRHLYQEVMLENYSHLLSVGYEIPKPEVIFKLEQGEEPWVLERETPHQSCSDGKFG

SEQ ID NO: 23084 - protein, 81 aa, Physeter macrocephalus
FRGSVMFRDVSINFSQEEWECLDSSQMNLYKEVMLENFSNLVSVGLSSSKPTVISLLEQGKEPWMVDRELTRGLCSDLESM

SEQ ID NO: 23085 - protein, 81 aa, Trichechus manatus
ARESVVFSDVSIAFSQEEWAHLDLEQKDLYRDVMLENYSNLVSLAGCFVSKPDVISLLEQGKEPWKIVRKGRRRYPDLETR

SEQ ID NO: 23086 - protein, 81 aa, Trichechus manatus
MDSVVFEDVTVEFTQEEWALLDFSQRKLYTDVMMDTLRNLDSVFQQDNNGQMSTKNDSWSSMLGEICEFHGIEHPHNNQGK

SEQ ID NO: 23087 - protein, 81 aa, Panthera pardus
WSQDSVTFEEVAVDFSQEEWALLDPTQKILYRDVMLENYRNLASVGYPLCKHSLITEVGQEALSTEERGMLQGTCIGLDIQ

SEQ ID NO: 23088 - protein, 81 aa, Macaca nemestrina
PKVPVSFEDVSVYFTKTEWKLLDLRQKVLYKRVMLENYSHLVSLGFSFSKPHLISQLERGEAPWVADIPRTWTTAGLHIGD

SEQ ID NO: 23089 - protein, 81 aa, Acinonyx jubatus
SQGLVTFEDVAVYFSLEEWERLDTGERDLYKDVMQENYGILVSLGYPIPKPDLIFRLEQGEEPWVPDSPRPEEGDIVTGVY

SEQ ID NO: 23090 - protein, 81 aa, Tursiops truncatus
MGSVTFQDVAVDFTLEEWQLLGYSQRKLYWDVMLENFRNLISVGCPVTKTKVIFKVEQGQEPWMVEGENPRWRSPEVICLL

SEQ ID NO: 23091 - protein, 81 aa, Tursiops truncatus
SQGLVTFEDVAVYFSLEEWERLDADQRELYKEVMQENYGILVSLGYPIPKPDLIFRLEQGEEPWVPDSPRPEEGDIVTGVY

SEQ ID NO: 23092 - protein, 81 aa, Tursiops truncatus
WKGLLSFEDVALYFTREEWDTLDWAQKDLYRDVMLDNYRNVLSLVGVQFPKPEVICQLEQWEEPWILDLPRAGTRKASGSA

SEQ ID NO: 23093 - protein, 81 aa, Sus scrofa
MTEEFVTLQDVAMDFTLEDWEQLRLDQSNLFWDTALDNYQSLFLLNPPRPNVTSRPDGGKELEALAKGSPESTAPDTAETK

SEQ ID NO: 23094 - protein, 81 aa, Cercocebus atys
MGLLTFRDVAIEFSLEEWQRLDAAQQNLYRNVMLENYRNLAFLGIAVSKPDLITCLEQGKEPWNMTRHEMVDEPPDICPHF

SEQ ID NO: 23095 - protein, 81 aa, Sus scrofa
FKEAVTFKDVAVAFTEEELGLLDSAQRKLYQEVMVENFRNLVSVGENSQNQSELRAIQDRGSHEELSCWQIWQQIADDLTR

SEQ ID NO: 23096 - protein, 81 aa, Sus scrofa
SQGLLTVEDVAIDFSPEEWECLDLGQRHLYRDVMLEICTHLVSLALSSHDTQGLMPPNPGMELFLQTALLGEFESSPVGTF

SEQ ID NO: 23097 - protein, 81 aa, Vicugna pacos
PVTFEDMAMYLTREEWRPLDPTQRDLYRDVMQENYGNVVSLDFEIRSDNEVNPKQEISEDVEFGTASERPVGNTAENPESE

SEQ ID NO: 23098 - protein, 81 aa, Bos indicus
SQGLLTFEEVAIYFSQEEWELLNPTQKALYNDVMHENYETVISLALFVLPKPKVIYLEQGEEPYIQGSPMFKDNPGELLSE

SEQ ID NO: 23099 - protein, 81 aa, unidentified
  REGION 1..81: note = Bos indicus x Bos taurus
MIENYRNLACLGLVVSKPDLVTFLEQMKDLRNIRRMETIGIYPAISPQDTQDLMPKKPRVEDLFPKANLGIYERFHLRNLE

SEQ ID NO: 23100 - protein, 81 aa, Neophocaena asiaeorientalis
PEGGVTFEDIALYFSWEEWKLLDEAQRRLYHDVMLENFALISSLGVCSGEENVEASFEQSVSVVMSQVRTSKEPSSSQKTH

SEQ ID NO: 23101 - protein, 81 aa, Phascolarctos cinereus
QQASMMFEDIAVYLTQEEWGLLDPVQRDLYRNVMMENYGNIVSVGFLVPKPDMISRLEQGQEPWVLDEQEAKGREAWRADC

SEQ ID NO: 23102 - protein, 81 aa, Pteropus vampyrus
MAVTFEDVTVIFTWEEWTFLDFSQKKLYREVMWENYTNVMSVGNWKESYKSPKERFRYLEHENLSCWPGWKNASTQLFENR

SEQ ID NO: 23103 - protein, 81 aa, Pteropus vampyrus
WKESVTFKDVTVDFTQEEWKQLDPVQRDLFRDVTLENYTHLVSIGLQVSKPDVISQLEQGTEPWIVEPGMPVGGFGDWATR

SEQ ID NO: 23104 - protein, 81 aa, Pteropus vampyrus
AQGLVTFRDVAVEFSQEEWKCLEPTQRDLYKDVTLENFGNLVSLGLSISKPDVISLLEQGKEPWMIANDITGPWGSDLESR

SEQ ID NO: 23105 - protein, 81 aa, Bos indicus
HLTFKDVAIEFSQEEWEALHPAQRALYRDVMLETYRNLLSVAVCHIHVIKKLKPKANSDTGVFQRVMLGRYKSQEVRDFYF

SEQ ID NO: 23106 - protein, 81 aa, Pongo abelii
FQESVTFKDVIVDFTQEEWKQLDPGQRDLFRDVTLENYTHLVSIGLQVSKPDVISQLEQGTEPWIMEPSIPVGTFADWETR

SEQ ID NO: 23107 - protein, 81 aa, Pteropus vampyrus
AQESLTFDDVAVDFTWEEWRLLAPAQKDLYRDVMSENYSNLVSLGCQARKPDTLSRLDQGEPPWTLADRVYSRTRSGIRKV

SEQ ID NO: 23108 - protein, 81 aa, Trichechus manatus
AQDSLTFSDVAVEFTWEEWQLLDPAQKDLYRDVMLENFSNLVTVGYQASKQDALSMLERGEELWTIEDETHCQTHSEIGKV

SEQ ID NO: 23109 - protein, 81 aa, Trichechus manatus
DQASLTFSDVAVEFTWQEWQLLDPAQKDLYWDVMLENYGNLVSMGYEVSKPDALSRLERGEQPWTVLDESHSRTFSEIWIF

SEQ ID NO: 23110 - protein, 81 aa, Sus scrofa
RSQESLTFQDVAVDFTREEWDQLYPAQKNLYRDVMLENYRNLVALGHQLYKPEVITQLEQEEQRMMGRGSLLDTHSDGENR

SEQ ID NO: 23111 - protein, 81 aa, Sus scrofa
NFWILRLPPGSKGEAPKEWGKLDEWQKELYKHVMRGNYETLVSLDYAISKPDILSRMERGEEPCPEGAWGREEGRQSEEAR

SEQ ID NO: 23112 - protein, 81 aa, Ursus arctos
SYGSLSFEDVTVGFTQEEWQHLDPAQRSLYRDVMLENYSHLVSLGCCIPKPEVILKLEQGEQPWILEEESPSQSYPEVCKV

SEQ ID NO: 23113 - protein, 81 aa, Sus scrofa
AQGTLTLEDVAVDFTWEEWQLLTPAQKDLFRDVTLENYHNLVAVGYQASKADIHSRLDQGEQPGATEADTHSRTQSEIWKV

SEQ ID NO: 23114 - protein, 81 aa, Vicugna pacos
AHDLVMFRDVTVDFSQEEWECLNSNQRNLYRDVILENYSNFVSLGGCSISKPDVITLLEQGKEPWKVVRDEKRRWSLDLES

SEQ ID NO: 23115 - protein, 81 aa, Vicugna pacos
SQGLVTFKDVALDFSQEEWEWLDSSQKDLYRDVMLENYRNLVWLGLSISKPNMISLLEQGKEPWLVEREMSDGQYADWESW

SEQ ID NO: 23116 - protein, 81 aa, Neophocaena asiaeorientalis
SLDSVSFTDIAIDFSQDEWECLNLAQRTLYKKVMLENYRNLASLGLCISKPDVISLLEQDKEPWMMKGEITRRLPTDLEYV

SEQ ID NO: 23117 - protein, 81 aa, Odocoileus virginianus
RLTSEDVAIEFTQEEWKFLDPAQRALYRDVMLETYRNLLSVDISPIHVIKHLQPKANSDKQEPFQTLMLGRPESCEIKHFH

SEQ ID NO: 23118 - protein, 81 aa, Neophocaena asiaeorientalis
QGHVVFEDVAVSFSQEEWGLLNNAQRLLYCDVMLENLSLIASLGCWCAVGTEEAASEQCVSVQLVTQDRNPNPDPSILKTL

SEQ ID NO: 23119 - protein, 81 aa, Odocoileus virginianus
WKGLLSFEDVALYFTREEWDTLDWAQKALYRDVMLDNYRHIISLGFQFPKPEVICQLEQWEEPWILDLPRAGTRKASGSAC

SEQ ID NO: 23120 - protein, 81 aa, Phascolarctos cinereus
ARSHESVTFKDVAMDFTPEEWGQLDPAQRDVMLENYKNLVSLWLPVSKPDGSSNFDQGENQWMMERKVPRGTHPDQLRKVE

SEQ ID NO: 23121 - protein, 81 aa, Phascolarctos cinereus
MDFTPEEWGQLDPAQRDVMLENYKNLVSLWLPVSKPDGSSNFDQGENQWMMERKVPRGTHPDQLRKVEAHCLNCRDKLKLN

SEQ ID NO: 23122 - protein, 81 aa, Pteropus vampyrus
SQEPVSFLDVAVDFTQEEWQQLDPVQRTTYRDVMLENYSHLVALGYDSAKPNVIVKLEQGEEPWVAEGDLPCRSRPEEVWQ

SEQ ID NO: 23123 - protein, 81 aa, Pteropus vampyrus
SQHLVTFEDVAVNFTQEEWTLLDQTQRDLYRDVMLENYKNLITLAGYESCKPSVSSGLERAGELKTATGGVWQELDLQLKT

SEQ ID NO: 23124 - protein, 81 aa, Panthera pardus
MLENYSNLVTVGYQVTKPDVIFKLEQEEDPWVVEEEMLGRHCPEVWEVDEQQIKKQQEALVRKVTSISKKTLIKENVIECK

SEQ ID NO: 23125 - protein, 81 aa, Panthera pardus
TARSQASVTFKDVAMDFTPEEWGKLDPAQREVMLENYRNLVSLWLPVSKSENYNLESGKEPLMLERKAPKSSYSGLLQTFH

SEQ ID NO: 23126 - protein, 81 aa, Sus scrofa
PQDLVTFKDVAVDFSQEEWKWLNPAQRNLYRSMMLENYQSLVSLDWESIYETQELPLKQFVCDDVLMERITTCGLKCSTFG

SEQ ID NO: 23127 - protein, 81 aa, Ursus arctos
FQDSVTFEDVAVCFSGGEWQCLTRAQRHLYADVMLENYGNMISVGFAVPKPPLISHLEQGAEPFIQDLQDWGFLTCSFPVS

SEQ ID NO: 23128 - protein, 81 aa, Ursus arctos
SQELVTFEDVAVYFIRKEWKRLEPAQRDLYRDVMLENYGNVFSLDGETRPEHGQELSEDTGSHGVLLGRFQKDISQGLKFE

SEQ ID NO: 23129 - protein, 81 aa, Leptonychotes weddellii
MQRALYLEVMLENYANITSLAALPFPKPDLILQLEQGEAPWDLDPWTPLEGEALEGVHTGGKNKTESEEQSPRLNISKDSA

SEQ ID NO: 23130 - protein, 81 aa, Vicugna pacos
DEALMGFRDVAVAFTQKEWKLLSLAQRILYRDVMLENYSHMVSLGIAFPKPKLITQLEQGDEPWREESEYLPDLCPAEPRT

SEQ ID NO: 23131 - protein, 81 aa, Odocoileus virginianus
SEGSITFEDVAVYFSWEEWVLLDEAQKLLYCNVMLENFALMASLGYWHGGEDEEAPSGQSVSVEGMSQILMIFKYLAMTFT

SEQ ID NO: 23132 - protein, 81 aa, Bos indicus
SEDPVTFEEVSVDFSQEEWAQLAPAEKILYQDVMLENYRNLTSVGYHLRKPRLLTQEELRTAKRRLLQDACAGEPWGKGAP

SEQ ID NO: 23133 - protein, 81 aa, Pteropus vampyrus
RSQESLTFQDVAVDFTREEWDQLYPAQKKLYRDVMLENYRNLVTLGHQLYKPKVITQLEQEEQWMMERDSPLDIHPDGENK

SEQ ID NO: 23134 - protein, 81 aa, Pteropus vampyrus
SQESVTFQDVAVDFTEKEWPLLDSSQRKLYKDVMLENYSNLASVGCQVSKPSLISHLEQEEELRTEERECHRSTCPDWETP

SEQ ID NO: 23135 - protein, 81 aa, Bison bison
MDSVVFEDVAVNFTLEEWELLDPAQRKLYRDVMLETCRNLATVGSCPQVKVSVSSPQWDILETGLCIEREVVRLTRNDSRS

SEQ ID NO: 23136 - protein, 81 aa, Tursiops truncatus
QGHVIFEDVAVSFSQEEWDLLNDAQRLLYCDVMLENLSLIASLGCWCAVGTEEAASEQCVSVELVTQDRNPNPDRSILKTL

SEQ ID NO: 23137 - protein, 81 aa, Vicugna pacos
FQESVTFKDVIVDFTREEWKQLDPVQRDLFRDVTLENYTHLVSIGLQVSKPDVISQLEQGTEPWIVEPSIPVGTFGDWETR

SEQ ID NO: 23138 - protein, 81 aa, Neophocaena asiaeorientalis
SQGLVSFKDVAVDFTQEEWQQLDPAQKTLYRDVMLENYSHLVSMGHPVSKPDVIFKLEQGEDPWIIKRDIPNWIYPYEDQA

SEQ ID NO: 23139 - protein, 81 aa, Odocoileus virginianus
MVQNYENLVSLAGLSVPKPYVIALLEDGKEPWMVEEKLSKDMVPDCKSRWENKELSKKEDIYDEDLPQMVIKEKTIQQNLE

SEQ ID NO: 23140 - protein, 81 aa, Muntiacus reevesi
HFKEAVTFMDVAVTFTEEELGLLDLAQKKLYQDVMLENFRNLVSVGCHPFRHDIFHLEKEKRLWVVKTATQSEGKSGNQNL

SEQ ID NO: 23141 - protein, 81 aa, Phascolarctos cinereus
MPVTFEDVAVYFSQEEWAILDQQQKELYQDVMRGTYELVTSLGYPAAKPEVICKIEQEEEPWMRDSQNHRRHLNRHWGSRN

SEQ ID NO: 23142 - protein, 81 aa, Phascolarctos cinereus
PKALVTFVDVAVNLTQEEWHLLGPDQRSLYRDVMLENYGNIVSLGFQVTKPDVISQLERGEEPWVLDTQGAEEKKVLRGDC

SEQ ID NO: 23143 - protein, 81 aa, Pongo abelii
LGPVTFEDVAVLFNEAEWKRLSLEQRNLYKEVMLENLRNLVSLAESKPEVHTCPSCPLAFGSQQFLSQDELHNHPIPGFHA

SEQ ID NO: 23144 - protein, 81 aa, Pongo abelii
HLTFMDVAIEFSQEEWKSLDPGQRALYRDVMLENYRNLVSLGRSCILGSNAENKPIKNQLGLTLDSHLSELQLFQAGRKMY

SEQ ID NO: 23145 - protein, 81 aa, Pteropus vampyrus
GWVPALFDEVAIYFSDEEWDVLTEPQRALYREVMRMNYDTVLSLEFPFPKPDVISRLEGEGEAQDCDGWQLPGGTFPENED

SEQ ID NO: 23146 - protein, 81 aa, Pteropus vampyrus
PKVPVTFDDISIYFSTPEWEKLEEWQKELYKNIMKGNYESLISMDYAMNQPDVLSQIQPEGEHNTEDQTGPQESEIPTDPS

SEQ ID NO: 23147 - protein, 81 aa, Pteropus vampyrus
HVAFEDVAIHFSQEEWGLLDEAQRLLYHDVMMENVALLSSVGCWHRAQDEEVPSDQGDSVEESQVRTPKPDPSTQKAEPHE

SEQ ID NO: 23148 - protein, 81 aa, Physeter macrocephalus
MLENYSHLISVGFCIPKPEVILKLEQGEEPWILEEESPSQCVPELINSSRNYSRKKFDEFNKGRKWFHDNKHEGIHSEEKP

SEQ ID NO: 23149 - protein, 81 aa, unidentified
  REGION 1..81: note = Bos indicus x Bos taurus
RCQDPVTFEDVAVVFTDEEWRRLVPTQRDLYKEVMLENYKSIVSLDWETKPEIQGASEEEKSEGSLKENLGRKGPPSPKVE

SEQ ID NO: 23150 - protein, 81 aa, Pan troglodytes
KSKEAVTFKDVAVVFSEEELQLLDLAQRKLYQDVMLENFRNVVSVGHQSTPDGLPQLEREEKLWVMKMATQRDNSSGAKNL

SEQ ID NO: 23151 - protein, 81 aa, Panthera pardus
MLENYSHLVSLAGLNISKPYVVSLLEQGKEPWLEKRGVRRDLFSEPNREVKEFSRKNVIYEDDSPQCFVVGRILSHGPEYS

SEQ ID NO: 23152 - protein, 81 aa, Panthera pardus
RSQESLTFQDVAVDFTREEWDQLYPAQKNLYRDVMLENYRNLVALGHQLYKPEVICQLEQEEQWMMERGSSGDIRAGGENR

SEQ ID NO: 23153 - protein, 81 aa, Capra hircus
RLTSEDVAIEFTQEEWEFLNAAQRALYRDVMLETYRNLLSVDLSPTHVIKHLQPKATSDKRETFQTLMLGSPESCEIECFN

SEQ ID NO: 23154 - protein, 81 aa, Panthera pardus
MLENYQNLITLAGYKSCKPDLSSALEGAELLRTGGRGVLQDLRPSEVDRDSLEREADGHNGATQDHHRSLSGSGYNSPNEH

SEQ ID NO: 23155 - protein, 81 aa, Tursiops truncatus
SQLSVTFEDVAVLFTRDEWRKLAPSQRNLYQDVMLENYSNLVSLGLLFSKPAVISLLQQGEDPWKVEKESPGGSSVGCKSS

SEQ ID NO: 23156 - protein, 81 aa, Tursiops truncatus
MVKSQISFEDVAVDFTLEEWQLLNPTQKTLYRDVMLENYSNLVFLGYQMIKPEAIFKLEQEEPWILGEEILSQNFPEEVWL

SEQ ID NO: 23157 - protein, 81 aa, Acinonyx jubatus
MLENYCHLISVGFHMTKPDMIRKLEQGEELWTTERIFPSQSYLEEDGKAEDVLVKFKEYQDRHSRSVIFNHKRLIKERSNI

SEQ ID NO: 23158 - protein, 81 aa, Tursiops truncatus
LQNSITFEDVAVDFTQEEWALLNSSQRKLHRDVMLENYRNLVSLGHQLSKPPLITQMEQEDEMDIVERRIHQDTCSDELIL

SEQ ID NO: 23159 - protein, 81 aa, Cercocebus atys
KSKEPVTFKDVAVVFSEEELRLLNLAQRKLYRDVMLENFRNVVSVGHQSTPDGLTQLEREEKLWMMKMATQRDNSSGGKNL

SEQ ID NO: 23160 - protein, 81 aa, Sus scrofa
VMFRDVAIDFSQEEWEYLDSAQRDLYRDVMLENYSNFVSLDLPSRGTNKDLSPKKDTSETELSQWEMSARLDNCNLEESSS

SEQ ID NO: 23161 - protein, 81 aa, Ursus arctos
SRGPLSFVDVCVDFTWEEWRLLEPAQKHLYRSVMLENYSHLVSLGYQDSKPDIIFRLEQGEELWMMQAQIPRQAPPEEVWE

SEQ ID NO: 23162 - protein, 81 aa, Leptonychotes weddellii
MAEGFTFKDVAIYFSQKEWECLHSAQKDLYRDVMLENYNNLISLGLSDSKPDVISLLEQGKEPWVVKSQETKEWCPDWESR

SEQ ID NO: 23163 - protein, 81 aa, Vicugna pacos
SQHLVTFEDVAVNFTQEEWTLLDQTQRDLYRDVMLENYQNLMALAGSESCKPHVNSPLEGAEELRTRARRILQSEFMAESD

SEQ ID NO: 23164 - protein, 81 aa, Phascolarctos cinereus
PQELVTFEDVAVYLSKEEWGLLDPAQRRLYRDVMLENYGNVASLGLPVSKPDLISQLERTDLPLVPRLPQTEIEDLFDEKL

SEQ ID NO: 23165 - protein, 81 aa, Phascolarctos cinereus
PQELVTFEDVAVYLTKEEWGQLGPAQRKLYRDVMLENYENVISLAGFPVSKPDLISQLERGEVPCLPDVPRTEVPETHGAK

SEQ ID NO: 23166 - protein, 81 aa, Phascolarctos cinereus
MLENYRNLVSLGFAVSKPDVIYHLERKEASWMPKADVPRNSCPESREFSQDKPLDCNEYDYQKAFRNKKHCAVYQRLHTGD

SEQ ID NO: 23167 - protein, 81 aa, Neomonachus schauinslandi
SVGPVSFRDVAVDFTQEEWQQLEPEQKTTYRDVMLENYSHLVSVGCHIIKPEVIIKLEQGEEPWIVEGAFLPQGYPEEVWK

SEQ ID NO: 23168 - protein, 81 aa, Phascolarctos cinereus
GKESVTFKDVAVEFTSEEWVQLNPTQKKLYRDVMLENYRNLVSLGFAVSKPDVIYHLERKEASWMPKADVPRNSCPESREF

SEQ ID NO: 23169 - protein, 81 aa, Phascolarctos cinereus
SPPSPSFSSTLHLDPPPPMPVTFTDMAVYFGDVMWESYRNLISLGFPIPKPELITHLEQGAEPWGLGSQESEERGVPKDPY

SEQ ID NO: 23170 - protein, 81 aa, Pteropus vampyrus
AVTFKDVAVAFTEEELGLLDSAQRKLYQDVMLENFRNLVSVGDNSHSELRTVRDRGPHEELSCWEIWQQIANDLTRCRDSM

SEQ ID NO: 23171 - protein, 81 aa, Pteropus vampyrus
SQGSVTFRDVAIDFSREEWEWLRPAQRDLYRQVMLENYGHLVSLAGLNFSKPDLVSFLEQGKEPWLGRGNVRRDLCSVSES

SEQ ID NO: 23172 - protein, 81 aa, Physeter macrocephalus
AHGSVMFSDVSIDFSQEEWDYLDLEQRDLYRDVMLENYSNLVSLGCFVSKPDVISLLEQGKEPWKVVRKERRRYSDLETNY

SEQ ID NO: 23173 - protein, 81 aa, Papio anubis
MGLLTFRDVAIEFSLEEWQRLDTAQQNLYRNVMLENYRNLAFLGIAVSKPDLITCLEQGKEPWNMKRHEMVDKPPAICPHF

SEQ ID NO: 23174 - protein, 81 aa, Sapajus apella
SKGSVMFRDVSIDFSQEEWEYLDSGQMNLYKEVMLENFSNLVSVGLSSSKPAVISLLEQGREPWLVDRELTRGLCSDLESM

SEQ ID NO: 23175 - protein, 81 aa, Zalophus californianus
PQVLVSFEDVAVFLSQEEWGCLGPAQRGLYSNVMLETYRNLISLGLQDSKPDVISRLEKGEEPWAPYSSRIEEGWIRSHRS

SEQ ID NO: 23176 - protein, 81 aa, Sapajus apella
MLETYGNLVSLGVGPAGPKPGVISQLERGDEPWVLDVQGTSGREYLRVNSPAVGTSTEYKELTSWETFDEEELGQLKGIFP

SEQ ID NO: 23177 - protein, 81 aa, Sapajus apella
QEGVNFKIVTVDFTQEEQGTWNPAQRSLDGDIILESHRDLVSWDLATAVGKEDSTSKQNIFDEEPANGVKTECFTRNDPWL

SEQ ID NO: 23178 - protein, 81 aa, Sapajus apella
MLENYRNLVALGHQLYKPEVITQLELEEEWVIEGDSLLDTCPDGENRPEIKKSTTSQNISDEHQTQEMIMERLTGDSFWYS

SEQ ID NO: 23179 - protein, 81 aa, Delphinapterus leucas
GRVPLTFSDVAIDFSQEEWECLNSDQRNLYRDVMLENYTNLISLDIDFTSESNKLSSEESSYEVNSYHWETMNRSKTFNFM

SEQ ID NO: 23180 - protein, 81 aa, Bos taurus
GPTFSDKGGLGDEMLAAALLKAKAQELVTFEDVAVYFIRKEWKRLEPAQRDLYRDVMLENYGNVFSLGFPFLNFDVISGLD

SEQ ID NO: 23181 - protein, 81 aa, Bison bison
VKKPVTFEDVAVNFTQEEWKCLDVSQRVLYQDVISETVRNLMSVDGIFLSNLDLIAKLEQEEKQWEADLCSPNGEGFHSGG

SEQ ID NO: 23182 - protein, 81 aa, Ursus arctos
PQGLVTFEDVAVDFTPEEWQYLNPPQKTLYREVMLETYSNVVSVAGPQATKPDLVLKLEVEEPCPAETKISFWSFPEAACQ

SEQ ID NO: 23183 - protein, 81 aa, Ursus arctos
CEGSLSFEDVTMDFSREEWQQLDPAQRRLYQDVMGEVYSHLLSLGYHIPNPEIISRMEKGEKLWLREAQLPHQRHGEGVFG

SEQ ID NO: 23184 - protein, 81 aa, Ursus arctos
MGVAEPCSEESVQKGVSVSKPDVISLLEQGKEPWMVKKEGTRGTCPDWEYTLKKNEFSSKQVIYEETSKLVIMGRSHLSHS

SEQ ID NO: 23185 - protein, 81 aa, Vicugna pacos
SQGPVSFKDVAVDFTQEEWQQLDSNEKTTYRDVMLENYSHLVSVGYDSTKPNVIVKLEQGEEPWTAAGELPRQAHPEEVWK

SEQ ID NO: 23186 - protein, 81 aa, Phascolarctos cinereus
YQESLTFSDVAVDFTQKEWDHLDLSQKKLYRDVMLENYRNLVYLGLAVSKPDLICHLEQGKAPWIHKKEIPKITCTGWESR

SEQ ID NO: 23187 - protein, 81 aa, Phascolarctos cinereus
MYRDVMLENYENFISLGLPVSKLDVISHLEKREAPWLLGGKVLQSPQLDSLVLQTRYETKESITEQLVSIEKLPKEKLTKD

SEQ ID NO: 23188 - protein, 81 aa, Neomonachus schauinslandi
KSLGSVSFKDVTVDFSREEWQQLDLAQKSLYRDVMLENYFNLMSVGCQVPKAEVIFSLEREEPCLLDGEISSHSCLDGDIG

SEQ ID NO: 23189 - protein, 81 aa, Pongo abelii
FEELVTFEDVFVDFSPEELSSLSAAQRNLYREVMLENYWNLVSLGYQFSKPDIISRLEEEESRAMETDSRHTVICQRESHD

SEQ ID NO: 23190 - protein, 81 aa, Pongo abelii
FVAFEDVAIYFSQEEWELLDEMQRLLYRDVMLENFAVMASLGCWCGAEDEGAPSADSISVEELSQGRTPKADTSTDKSHPC

SEQ ID NO: 23191 - protein, 81 aa, Pongo abelii
PQGLLTFRDVAIEFSQEEWKCLDPAQRTLYRDVMLENYRNLVSLEFWSVTPAKVQWCHLGSLQPPLPRFKQFSCLSLPSSW

SEQ ID NO: 23192 - protein, 81 aa, Pteropus vampyrus
FKEEVTFKDVAVVFTEEELGLLDAAQRKLYRDVTLENFRNLVSVGHQPFPPDVIPQLEREEKVWMIKTATHSHSSSGDKDL

SEQ ID NO: 23193 - protein, 81 aa, Bos indicus
SQVSVTFEDVAVLFTRDEWRKLAPPQRNLYQDVMLENYNNLVSLGHLFPKPKVISLLQQGEDPWKVEKESPGASSLGWKNS

SEQ ID NO: 23194 - protein, 81 aa, Physeter macrocephalus
PKVPVTFDDVAVHFSEQEWGNLSEWQKELYKNVMRGNYESLVSMDYAISKPDLMSQMERGERPAMQEQEDSEEGDAPADPS

SEQ ID NO: 23195 - protein, 81 aa, unidentified
  REGION 1..81: note = Bos indicus x Bos taurus
WNVQKEISGLDGGQLTFKDVAIKFTPEAWECLNPVQRALYRDVMIETLRNMLSVVKDNLPLKFGVCPGGGSLHFLCISKPC

SEQ ID NO: 23196 - protein, 81 aa, Trichechus manatus
SPGSVSFKDVTVDFTREEWQQLDLAQKSLYRDVMLENYFNLVSVGYQISKPEVIFNLEQGEEPYMLDDGEISRRSCQDGDI

SEQ ID NO: 23197 - protein, 81 aa, Delphinapterus leucas
SQGLLTFKDVAITFSQEEWECLDPAQRALYRDVMLETYRNLLSLGEDNSSPEVGSLSAGFTIKELSPREGINKGELYHLVI

SEQ ID NO: 23198 - protein, 81 aa, Zalophus californianus
MLENYRNLVSVGYQASKPDSVFQLEQGEPPWMVEGAAQSQTCQGYPATKPDVILNFERGEESWSVEDEMQCQCISGKKRYG

SEQ ID NO: 23199 - protein, 81 aa, Balaenoptera acutorostrata
VQESVTFKDVAVLFTQDEWAQLSPAQRALYRDVMLENYSNLVYLGLLGPKPDTFSQLGKGEEWMPEDSLGGFCLDWMTTPV

SEQ ID NO: 23200 - protein, 81 aa, Balaenoptera acutorostrata
TFQEAVTFKDVAVAFTEEELGLLDSAQRKLYQDVMVENFRNLVSVEENNQSELRAVQDRGSREDLSCRQIWQQIASDLTRC

SEQ ID NO: 23201 - protein, 81 aa, Cercocebus atys
LKGLVTFEDVAVEFTQEEWALLDPAQRTLYRDVMLENFRNLASLGDQVDKPGLIAQLEQEDKVMTEERGILPGTCPDVENP

SEQ ID NO: 23202 - protein, 81 aa, Sus scrofa
MLENYFNLISVGCQVPKPEVIFNLEWGEEPCMLGGEVSSLSCVDQVIGFETLQQGKSEEDLIRFERINLFTRDDPYSILGE

SEQ ID NO: 23203 - protein, 81 aa, Vicugna pacos
QAEVTFEDVAVLLSREEWGRLGPAQKGLYRDVMLETYRNLVSLGAGPAGPKPGVIAQLERGDEPWVLDLPGAEGSKQPRVR

SEQ ID NO: 23204 - protein, 81 aa, Phascolarctos cinereus
FQQLVTFEDVAVYLSKEEWGQLDLAQRELYRDVMLENYENLLSLGFLVSKPDIISQLEQRKEAWIRDIQGPKEREFSQNAC

SEQ ID NO: 23205 - protein, 81 aa, unidentified
  REGION 1..81: note = Bos indicus x Bos taurus
AQLTFKDVAIEFTQEEWECLDAAQRALYRDVMVETLRNLVSLDISHILVIEKLQLNEKTDRGEEFQTVILGRHERNKIKDF

SEQ ID NO: 23206 - protein, 81 aa, Trichechus manatus
MDPTQRNLHKDVMLENYRNLVSLGLAVSKPDMISHLEDGKGPWVVVREISRAPYPELETKLATKDVVLTEDYSEEDLSQGT

SEQ ID NO: 23207 - protein, 81 aa, Trichechus manatus
PVVVEDVAVVFSQEEWALLNLTQRKLYRDVMIQTFRNLASVVSQNLKDGEKLSSEVIMVQYMKNNTWSSALGEISQSHGNK

SEQ ID NO: 23208 - protein, 81 aa, Trichechus manatus
SVVFEDVAVDFTQEEWALLDFAQRKLYRDVMMETFRNLASVVSQQVDKGQIVSSEHLVMRFVRNNSWYTVLGEICEFHGIE

SEQ ID NO: 23209 - protein, 81 aa, Zalophus californianus
QCGVTFEDIAVYFSWKEWRLLDEAQRRLYHHVMLENFTLISSLGCCCGAEDEAPFAQSTSVGVSQTRTPKAALSSRKTHPC

SEQ ID NO: 23210 - protein, 81 aa, Trichechus manatus
LQESVTFKDVAVDFTQEEWHHMDPAQRILYRDVMLENYSHLVSLGYQVSKPEVIFKLEQGEEPWISEEEIQRPFCPDWETP

SEQ ID NO: 23211 - protein, 81 aa, Zalophus californianus
MLENCGLLVSLGCPVPRPELIYQLEHGQELWTWKRHLSQSAYPGDKGKPKTTELSPCAPALSEGALFQELRQGDPGNFHLG

SEQ ID NO: 23212 - protein, 81 aa, Macaca mulatta
MLENYANVASLAFPFTTPVLVSQLEQGELPWGLDPWEPMGREALRGICPGDEARTEKERLTPKEHVSKETVSFRLMVGVLP

SEQ ID NO: 23213 - protein, 81 aa, Delphinapterus leucas
PLTFKDVAIEFSREEWECLDPDQKAFYVDVMLETYSNLISLDISHIHVIKKLQPRANSDRGEVFQTVMLERQKSHEMKHFY

SEQ ID NO: 23214 - protein, 81 aa, Carlito syrichta
FQGPVTLKDVIVEFTKEEWKLLTHAQRTLYKDVMLENYRHLVSVGYRVNKPNAIFKLKQGKEPWILEVEFPHQNFPEDLWD

SEQ ID NO: 23215 - protein, 81 aa, Zalophus californianus
SFGREAENDQVSPFTKEEWQQLDPAQRTLYRDVMLENFSHLVSLGHPVSKPDIISKLEQGEEPWIIKRDISDWICPERETR

SEQ ID NO: 23216 - protein, 81 aa, Saimiri boliviensis
PKVPVSFEDVSVYFTKTEWKLLDLRQKVLYKRVMLENYSHLVSLGFSFSKPHLISQLERGEGPWIADVPRTWATRGLLIGD

SEQ ID NO: 23217 - protein, 81 aa, Saimiri boliviensis
MAHLMFRDVVIDFSQEEWEGLDLKQRDLYRDVMLENYSNMVSLGLCIYQPDVFSSLEKGKEPWKILRNETRGRCPDMRSKC

SEQ ID NO: 23218 - protein, 81 aa, Ovis aries
ERLTSEDVAIEFTQEEWEFLDPAQRALYRDVMLETYRNLLSVDISPTYVIKHSEPKANSDKLETFQTLMLGNPESCEIKHF

SEQ ID NO: 23219 - protein, 81 aa, Ovis aries
RLTSEDVAIKFTQEEWEFLDPAQRALYRDVMLETYRNLLSVDISPTYVIKHLQPKANSDKQETFQTLMPGRPESCEIKHFH

SEQ ID NO: 23220 - protein, 81 aa, Callorhinus ursinus
RPIAVSFADVAVYFSPEEWGCLRPAQRALYRDVMRETYGHLGALGFAGPKPALISWLERKKEVWSPEAEDSEEGARHPGSG

SEQ ID NO: 23221 - protein, 81 aa, Panthera pardus
EGTVTFEDVAVYFSGEEWGLLEEAQRRLYQDVMLENLALVTSLGCQHGAENEEAPSEQSVSVEGVSHVRTPKAGLSPQKAS

SEQ ID NO: 23222 - protein, 81 aa, Panthera pardus
CKGFVIFRDVSIDFSQEEWECLDSTQRNLYKYVMLENYSNLVSVGLCIPKPDVISLLEQGKEPWSVFDSELTRDPYLEEET

SEQ ID NO: 23223 - protein, 81 aa, Panthera pardus
PVTFEDVAVNFTQEEWMYLDASQRALYQDVMSETVRNLMSVDLVTKLEEEQWRTELQLQPPNGEGLPSGSRKQELPEGSPS

SEQ ID NO: 23224 - protein, 81 aa, Neophocaena asiaeorientalis
MPQEEWQQLDPAQKALYRDVMLENYFHLISVGFHMTKPDMIHKLEQGKELWTTEKIFPSQSYLEEDWKAEDVLVKFKEYQD

SEQ ID NO: 23225 - protein, 81 aa, Bos indicus
MEAVTFKDVAVAFTEEELGLLDSAQRKLYQDVMVENFRNLVSVEENNQSELSAIQERGLHEELSCWQIWQQIANDLTRCQD

SEQ ID NO: 23226 - protein, 81 aa, Trichechus manatus
MKENINHLVFIGNHLCKSDVISQLEQGEELWREGVGFLQDESLVISVRESGRKKQEVISCRKNISTIMAMQRSLTEENPFE

SEQ ID NO: 23227 - protein, 81 aa, Trichechus manatus
SVVVEDVAVDFTQEEWVLLDVSQRKLYRDVMMETFRNLASVVSQNLNDGEKLSSEQIIVRLMKNSTSPSMLREIREFHGIE

SEQ ID NO: 23228 - protein, 81 aa, unidentified
  REGION 1..81: note = Bos indicus x Bos taurus
MLETCGLLVSLGHPVPKAELIHLLEYGPELWTVKRGLSRNTCTGEKANPKTTELTASQLALTEEAPFEEQVTHGTSRDSWL

SEQ ID NO: 23229 - protein, 81 aa, Trichechus manatus
GSVSFTDVTVDFTQEEWEQLDPSQRILYMDVMLENYSNLLSVEVWKADDQMERDHRNPDEQARQFLILQSQTPVEERGNLF

SEQ ID NO: 23230 - protein, 81 aa, Trichechus manatus
MLENYGHVASLGFPLLKPTMISQLEGGAELWGPLPVPTGVGTGPQGLWTDIDIQTDNNLTKEMCEEKDSTSFKLQRNFPQE

SEQ ID NO: 23231 - protein, 81 aa, Sapajus apella
KSKEAVTFKDVAVVFSDEELRLLDLTQRKLYRDVMLENFRNVVSVGHQSIPDGLPQSGREEKLWTMKTATQRGNSSGGKHL

SEQ ID NO: 23232 - protein, 81 aa, Callithrix jacchus
KPGAVSFADVAVYFSPEEWGCLRPAQRALYRDVMRETYGHLGALGFPGPKPALISWMEQESEAWSSAAQDPENGESLGGAR

SEQ ID NO: 23233 - protein, 81 aa, Zalophus californianus
RSQESLTFQDVAVNFTREEWDQLYPAQKNLYRDVMLENYRNLVALGHQLYKPEVISHLEQEEQWVMERESPLDTHTDGESR

SEQ ID NO: 23234 - protein, 81 aa, Zalophus californianus
AVTFEDVAVDFTQEEWLLLDLTQRNLYRNVMLENYQNLVAVGKAANIPEYQLSKPKLIAWLEQQELRTVEKGVFQEWETQP

SEQ ID NO: 23235 - protein, 81 aa, Sapajus apella
SQGPLTFMDVAIEFSQEEWKCLDLAQRTLYKDVMLENYRNLVSLGVGLPDLSVVSMLEQKREPWTLQSEEKIARNPDGREC

SEQ ID NO: 23236 - protein, 81 aa, Zalophus californianus
MLENYGHMASLGFLVAKPALISLLEQGEEPGALILQGTEEPGSTASLCPDSRMQAAIKESCLRRVSSKQLGPLGTVWGHLP

SEQ ID NO: 23237 - protein, 81 aa, Sapajus apella
MLENYWSLVSLGLCHFDMNIISMLEEGKEPWTVKSYLKIARKPRMRECVKGVVTDIPPKCIIKDLLPKEQSSTEAAFHTAM

SEQ ID NO: 23238 - protein, 81 aa, Cercocebus atys
MDSVVFEDVAVDFTLEEWALLDSAQRDLYRDVMLETFRNLASVDKTQFKANGSVSQQDTYREEKSKEQTIPNFTRNNSCAY

SEQ ID NO: 23239 - protein, 81 aa, Bison bison
FQEAVTFKDVAVVFTEEELGLLDSAQRKLYQDVMVENFRNLVSVGQVPFKADMVSQLETEEKLWTMERETQRNGHSSEIHS

SEQ ID NO: 23240 - protein, 81 aa, Neophocaena asiaeorientalis
SQLSVTFEDVAVLFTRDEWRKLAPSQRNLYQDVMLENYSNLVSLGLLFSKPEVISLLQQGEDPWKVEKESPGGSSLGCKSS

SEQ ID NO: 23241 - protein, 81 aa, Leptonychotes weddellii
MLENYSHLVSVGCSIPKPEVILKLEQGEEPWILEEEIPSQSDPELINNSRNYSRKKFNEFNKGRNWLHNDKYERIHSEEKP

SEQ ID NO: 23242 - protein, 81 aa, Bos indicus
MWLWTSHRAAWQQMKPAQRNLYRDVMLENYSNLVTVGCQVTKPDVIFKLEQEEEPWVVEEEMLGRHCPEVWKVDEQIKKQQ

SEQ ID NO: 23243 - protein, 81 aa, Physeter macrocephalus
SLDSVSFTDIAIDFSQDEWEWLNLAQRTLYKKVMLENYRNLTSLGLCISKPDVISLLEQDKEPWMMKGEITRGLPPDLEYV

SEQ ID NO: 23244 - protein, 81 aa, Delphinapterus leucas
SQLSVTFEDVAVLFTRDEWRKLAPSQRNLYQDVMLENYSNLVSLGLLFSKPEVISLLQQGEDPWKVEKESPGGSSVGCKSS

SEQ ID NO: 23245 - protein, 81 aa, Pan troglodytes
CEVSVSFEDVTVDFSREEWQQLDSTQRRLYQDVMLENYSHLLSVGYQVPKSEAAFKLEQGEGPWMLEGEAPHQSCSGEAIG

SEQ ID NO: 23246 - protein, 81 aa, Callithrix jacchus
EQEPVTFKDVAVDFTQEEWGQLDLVQRTLYRDVMLETYGHLLSVGNQTAKPEVISLLEQGEEPWSVEQTCPQRACPEWMRN

SEQ ID NO: 23247 - protein, 81 aa, Carlito syrichta
LKGSVSFEDVTVELTREEWRQMGPGERSLYRDMMLENYGHLVAVGCCITKPKVILKLEQREEPWSLEVKFLNQKYPGYYKI

SEQ ID NO: 23248 - protein, 81 aa, Carlito syrichta
AQESVMFSDVSIDFSQEEWEYLNDDQRDLYRDVMLENYSNLISMGHSISKPNVISFLEQGKEPWLVDRELTRGHWPVLKSR

SEQ ID NO: 23249 - protein, 81 aa, Panthera pardus
NQIAVTFDDVALDFTQEEWILLDLFQRNLYRNVMLENYQNLVTVGYQQSKPSLVARLEQEELRTVEKGVFPEWQTQHQSKE

SEQ ID NO: 23250 - protein, 81 aa, Panthera pardus
SQGTVSFKDVAVNFTQEEWQYLDLPQRDLYKDVMLENYTNLISVGYQTTKPSVIHKLEQGEEPWMVEREIPNWSYAEETWQ

SEQ ID NO: 23251 - protein, 81 aa, Tursiops truncatus
FKEVVTFKDVAVTFTEEELGLLDSTQRKLYQEVMLENFRNLVSVEGKIQSEMETVSEAGPHEELSSWQIWQHIASDFTRCQ

SEQ ID NO: 23252 - protein, 81 aa, Acinonyx jubatus
MLENYSHLVSVGCQVTKPAVISRLERGQEPWMEEEELVRWSFPEAILQVDGHAGRPREHQATLLRSGAFLDGREPTERGPR

SEQ ID NO: 23253 - protein, 81 aa, Sus scrofa
AQSLLTFEEVAIYFSQEEWELLDPTQKALYNDVMHENYETVISLALFVFPKPKVISCLEREEVPWIQGSPQFKDDSRDVLP

SEQ ID NO: 23254 - protein, 81 aa, Ursus arctos
EAVVFADVAVDFTPEEWALLDGGQRRLYRDVMLETCRNLASLVCPSQDKRSAPRPQWSVLQNELPSEEKTGLFARNDSCSV

SEQ ID NO: 23255 - protein, 81 aa, Leptonychotes weddellii
PQGSLSFGDVAVDFSQEEWQCLDPAQRTLYRDVMLENYSHLVSVGYLIKKPSVIFKLEEGKEPWILEEESLYQNYPEDSKA

SEQ ID NO: 23256 - protein, 81 aa, Leptonychotes weddellii
SQGLLSFSDVAVDFTWEEWQLLDTVQRNLYRDVMLENYSNLMSLGYQATRPEATVPLEKGEQGMLEREFPSQCSPERPLQC

SEQ ID NO: 23257 - protein, 81 aa, Neophocaena asiaeorientalis
LQELVTFQDVAVDFTQEEWEHLDPSQRHLYREVMLENYGNLISLAGRLLSKPEMISHFEQEDDVWMEKKIPRSSYSGDKPC

SEQ ID NO: 23258 - protein, 81 aa, Pteropus vampyrus
MDPALEEWRLLDEAQRLLYRDVMLEVFALAVSLGTWHGTESPSEQNGFEGESQENTSQACPWKLCGLALESDLHLADNLRT

SEQ ID NO: 23259 - protein, 81 aa, Cebus imitator
MVSFEDVAVLLSQEEWDCLIPAQRGLYRDVMLETYGNLVSLGLQASKPDVISRLEQGDEPWTTHTLRTQGSWSWRHKREGY

SEQ ID NO: 23260 - protein, 81 aa, Pteropus vampyrus
MLENYSNLVSLAGYQVSKPEVIFKLEQGEEPWLSEGEIQRPFFPDWKTRPEAKSSNLQQSISEVSFSTDELSHATLEDAWD

SEQ ID NO: 23261 - protein, 81 aa, Physeter macrocephalus
GRVPLTFSDVAIDFSQEEWECLNSDQRNLYRDVMLENYTNLISLDIDFTSESNKLSSEKSSYEVNSYHRETMNRSKTFNFM

SEQ ID NO: 23262 - protein, 81 aa, Trichechus manatus
SVMAEDVAVVFSQEEWALLDVAQRKLYRDVMMETFRNLASVVSLKFNDEEKLSSEHIVVQLMKNNTWSSMLGEVCDQLHGN

SEQ ID NO: 23263 - protein, 81 aa, Trichechus manatus
FQGSVSLKDVIVGFTQEEWQHLDPTQRSLYRDVMLENYSNLISVGYCVTKPEVIFRLEQGEEPWILEEEFPSQSFSEVWKA

SEQ ID NO: 23264 - protein, 81 aa, Pan troglodytes
GLLTFEDVAVFFTQEEWDYLDPAQRSLYKDVMMENYGNLVSLDVLNRDKDEKPTVKQEIEEIEEEVEPQGVIVTRIKSEID

SEQ ID NO: 23265 - protein, 81 aa, Panthera pardus
SQEPVTFEDVAVYFTRNQWTSLDPMQRALYREVMLENYANITSLGAFPFPKPELILQLERGEAPRGLDPWTPTGGEAPGDV

SEQ ID NO: 23266 - protein, 81 aa, Vicugna pacos
AQETVTFKDVAVDFTQEEWGQLDPVQRTLYRDVMLETYGHLLSVGNQIAKPEVISLLEQGEEPWSMERVYPPQRTCPEWMR

SEQ ID NO: 23267 - protein, 81 aa, Leptonychotes weddellii
IMKSLKFKDVAVKFSKDEWKQLVPTQRALYREVMLENYQGFVSLGVLVPKPDVIFQLKRGEEPWKLDFQEDEESEVPGSTF

SEQ ID NO: 23268 - protein, 81 aa, Neophocaena asiaeorientalis
QAQETLTFEDVAVDFTWEEWQLLAPPQKDLYRDVMLENYSNLLSVGFQARKPNVLSKLGQGEPWTMEDEIHCQTRSEIWKV

SEQ ID NO: 23269 - protein, 81 aa, Phascolarctos cinereus
NKKSVTFKDVAVDFTEDEWRQLNPTQRQLYRDVMLENYRNLIFLGFSVFTPVVISRLEGGEEPWTVEREIPGSPGADWETN

SEQ ID NO: 23270 - protein, 81 aa, Phascolarctos cinereus
LVTFQDVAVDFTQEEWGLLDHPQKELYKEVMLENAQNLLSLEREIRPEMKETTAKLSISVKETHQENFMSDGSCDFTGRQI

SEQ ID NO: 23271 - protein, 81 aa, Physeter macrocephalus
SQLSVTFEDVAVLFTRDEWRKLAPSQRNLYQDVMLENYSNLVSLGLPFSKPEVISLLQQGEDPWKVEKESPGGSSVGCKSS

SEQ ID NO: 23272 - protein, 81 aa, Pteropus vampyrus
PVTFEDVALYLSREEWGRLDHTQQSFYHDVLQKRNRLALGKGWRLHWGGSFLRPLMSEVFPSAELFGPPKFRARVRPQARA

SEQ ID NO: 23273 - protein, 81 aa, Pteropus vampyrus
SKASVTFADLAVYFSQEEWEGLSPIQKDLYEDVMLETYQNLVSVGLSCRRPSVITLLEKGKAPWTVEPARQRRGPDSGAKC

SEQ ID NO: 23274 - protein, 81 aa, Monodelphis domestica
HQESLTFRDVAVLFTWDEWRRLGPAQRSLYREVMLETFEHLVALGLPVMKPDVLSGPEKGEAPSDPQPGSLCQEQQHDIKD

SEQ ID NO: 23275 - protein, 81 aa, Physeter macrocephalus
MTEELAILKDVAMDFTLEDWEQLGLDQGDLFWDTALDNYQNLFLLNPPRPNLTSHPDDGEELASLAKGSPESTGPDTAEAK

SEQ ID NO: 23276 - protein, 81 aa, Trichechus manatus
FQESLTFKDVAVVFTEEELELLDSDQRKLYRDVMLESFRNLVSAGQQPFKSGKISHLEQDKETWVTEREAPADAYPGDKHE

SEQ ID NO: 23277 - protein, 81 aa, Trichechus manatus
SVVAEDVAVVFSKEEWALLNLTQRKLYREVMIETFRNLVSVVSQNLKDGDKLCSKHIMVRYMNSNTLFSMLGELSELYGSK

SEQ ID NO: 23278 - protein, 81 aa, Pan troglodytes
EPGAVSFADVAVYFCREEWGCLRPAQRALYRDVMRETYGHLGALGFPGPKPALISWMEQESEAWSPAAQDPEKGERLGGAR

SEQ ID NO: 23279 - protein, 81 aa, Trichechus manatus
FMKSVTFKDVAVVFNEEELELLNSFQRKLYREVMLENFRNLVSLGGKFPKEMETTSQTRQQEELFCWQIWQQIASDLTRCQ

SEQ ID NO: 23280 - protein, 81 aa, Macaca mulatta
MLENYSHLVSVGYDITKPNVIIKLEQGEEPWIMEGEFPCQHSPEVWKFDDLIERIQENEDKHSRQAACINSKTLTEEKENT

SEQ ID NO: 23281 - protein, 81 aa, Macaca mulatta
MESVTLEDVAVEFIQEWALLDSARRSLCRYGMLDQCRTLTSRGTPPCKPSRVAQLAPRAEPRATERGILHATGVAWESQLK

SEQ ID NO: 23282 - protein, 81 aa, Rhinopithecus roxellana
DSVMFDDVAVEFTPEEWVLLDTTQKYLYRDVMLENYMNLASVEWEIQPRIKRPSLQQGFLKNPIFNGIQMTRGYSGWKLCD

SEQ ID NO: 23283 - protein, 81 aa, Acinonyx jubatus
MDSVVFVDVAVNFTPEEWALLDSSQRNLYRDVMLETCKNLASVDYCIRVNTSGSSPQWDVLEDEPSHEEKIVRFARNDSWS

SEQ ID NO: 23284 - protein, 81 aa, Tursiops truncatus
LQEPVTFRDVAVDFTQEEWGQLGPAQRTLYRDVMLETFGHLLSVGPELPKPEVISQLEQGAELWVAERGIAQGRCPGWESG

SEQ ID NO: 23285 - protein, 81 aa, Ursus arctos
WKELLSFEDVAMYFTREEWNRLDWAQKDLYRDVMLENYRNMILLGFQFPKPEVICLLEQWEEPWILDLPRAGTRKASSSAC

SEQ ID NO: 23286 - protein, 81 aa, Sus scrofa
VTFEDVVVDFTQEEWGQLEPAQRTLYRDVMLETFGLLVSVDLEARPQTKLSTAKQDITEEIPSNALVKSFLWESLWHSKGE

SEQ ID NO: 23287 - protein, 81 aa, Sus scrofa
PQEPVTFEDVAVYFTQNQWASLAPVQKALYREVMLENYASVASLAFPFPKPVLISQLERGEAPWGPDPWEAEVLRGICPGG

SEQ ID NO: 23288 - protein, 81 aa, Ursus arctos
SSQGLLTFRDVAIEFSQEEWGCLSHTQRELYRDVMLENYGHLLFLGLTVWKPDLVIFLEQEKQLWDVKRKETVAFHPGRWD

SEQ ID NO: 23289 - protein, 81 aa, Ursus arctos
SRGLLTFGDVAIEFSQEEWRCLSHTQRELYRDVILENYGHLLFLGVIVSKPDLVSLLEQRKEPWGEKRNKAVLFDPAVSSH

SEQ ID NO: 23290 - protein, 81 aa, Zalophus californianus
QAQESLTFDDVAVDFTWEEWQLLVPAQKDLYRDMMLENYRNLVSVGYQASKPDALSKLERGELWTLEDEIHSRICPEIRKV

SEQ ID NO: 23291 - protein, 81 aa, Pan troglodytes
MALPQGRLTFRDVAIEFSLEEWKCLNPAQRALYRAVMLENYRNLEFVGEENVPPDMRNLHLSILALSGFIFSFVILPHTCF

SEQ ID NO: 23292 - protein, 81 aa, Callithrix jacchus
LQEPVTFRDVAVDFTQEEWGQLDPTQRILYRDVMLETFGHLLSIGPELPKPDVISHLEQGTEPWVTERGTTQGCYPGWEPR

SEQ ID NO: 23293 - protein, 81 aa, Sapajus apella
MAEAISEGFIQRCHVGELQELGLSISKPNMISLLEQGKEPWMVERKMSQGHCADWESWCEIKELSPKWFTDEDEISQEVVM

SEQ ID NO: 23294 - protein, 81 aa, Delphinapterus leucas
FKEVVTFKDVAVTFTEEELGLLDSTQRKLYQEVMLENFRNLVSVEGKIQSEMETVSEAGPHEELSSWQIWQHIAGDFTRCQ

SEQ ID NO: 23295 - protein, 81 aa, Saimiri boliviensis
ALRSVMFSDISIDFSPEEWEYLDLEQKNLYRDVMLENYSNLVSLGCFISKPVVISLLEQGKEPWKVVRKRRQYPDLETKYE

SEQ ID NO: 23296 - protein, 81 aa, Balaenoptera acutorostrata
CEGSVSFEDVTIDFSREEWQQLDPAQRRLYQDVMLEIYSHLFSVGYHIPNPEIIFRMEKGKEQWMGEAELPRQRYHEGEFG

SEQ ID NO: 23297 - protein, 81 aa, Balaenoptera acutorostrata
AHGSVTFRDVAIDFSQEEWEFLDSAQRDLYKDVMWENYSNFISLAGPSISKPDVITLLDEGKEPWMVVRERTRRHHPDLES

SEQ ID NO: 23298 - protein, 81 aa, Balaenoptera acutorostrata
IEESLTYDDVTMKFTWEEWQLLDPDQKDLYRDVMLENYSNLVSVGYQASKPDAVSRLERGEQLWPVEDDSHGRICPEIRKV

SEQ ID NO: 23299 - protein, 81 aa, Ovis aries
MKWVLLDSSQRKLYRDVMRENFRNIVSVEAKQEDHDIEDQDKNQERKLRNPKAERHSEKKDINSSEESFNLIPTPNVKRTR

SEQ ID NO: 23300 - protein, 81 aa, Vombatus ursinus
FTESVTFKDVAMEFTQEEWLHLNPSQKKLYTNVILENYRNLVFLGFAISNPDVIYHLGKRKHFGCQRQTSQGAAIQRAKNL

SEQ ID NO: 23301 - protein, 81 aa, Enhydra lutris
FQEAVTFKDVAVVFTVEELGLLDSTQRKLYRDVMLENFKNLVSVGYLPFKPEMVSHLEAEEELWMMEGEPQRSVTSEDPMA

SEQ ID NO: 23302 - protein, 81 aa, Tursiops truncatus
MAFGDVAVDFTQEEWRLLSPAQRTLHREVMLETYNHLVSLEIPFCKPKLISQLERGEEPWIEERQRPLSLCPAGSKLEIQP

SEQ ID NO: 23303 - protein, 81 aa, Odocoileus virginianus
MFSDVSIDFSLEEWEFLNLEQRDLYRDVMLENYSNLVSLGCFISKPDVISLLEQGKEPWKVVRQGRRQYPDLETNYEIKKL

SEQ ID NO: 23304 - protein, 81 aa, Vicugna pacos
YQELVTFRDVAVDFSREEWDCLNSSQRHLYSNVMLENYRILVSLGLCFSKPSVILLLEQGKEPWMVKRELTKGLCSDWDSM

SEQ ID NO: 23305 - protein, 81 aa, Leptonychotes weddellii
AQGPMLFEDLAVYFSQEEYVSLHPAQRSLSRDTTQECFEDMALMDQVLSAIPAVRPVIIWLLYAWQLYLDLSSRRGGEGKT

SEQ ID NO: 23306 - protein, 81 aa, Phascolarctos cinereus
MLENYRNLVSLGFAVSKPDVIYQLEREEASWMPKADIPRSSCPESGEFSQDKPLECNEYDYQKAFRSKKHCAVYQRLHTGD

SEQ ID NO: 23307 - protein, 81 aa, Phascolarctos cinereus
MLENYNNFASLGLPFFKPDMISQLERGEGPWTPEAEVPQVTCPESLVQKRRYETMNSTSKQGFSVGRSCKERLTKNGPRDS

SEQ ID NO: 23308 - protein, 81 aa, Phascolarctos cinereus
CQETLTFKDVVVDFTRGEWQHLDPAQKDLYKEVMLDNYKNLVSLGIQVSKPDVIFQLERGESPSMLEGKDPSDPCLEFLSQ

SEQ ID NO: 23309 - protein, 81 aa, Monodelphis domestica
FQESLTFKDVAVEFTWEEWRHLDPAQRALHTNVMLENYENLVSIGIPVSKLDLFFLLKREDVQNEEGEAGTGTCIEGKIRL

SEQ ID NO: 23310 - protein, 81 aa, Bos indicus
VKESVTFKDVAVDFTLEEWRLMDPTQRDLHKDVMLENYRNLVSLGLAISKPDMISHLENGKGPWVVVREASRTPFSELETK

SEQ ID NO: 23311 - protein, 81 aa, Pteropus vampyrus
EVTFKDVAVIFTGEELELLNSAQKKLYREVTLENFRNLVSVGHRNQNEIETLQEVGLRYILNEDLIYWQIWEQFISKLTTN

SEQ ID NO: 23312 - protein, 81 aa, Physeter macrocephalus
SQESVSFEDVAVYFTQNQWASLDSAQRTLYRKVMLENYANVTSLAAFPFPKPDLILQLEQGEAPGGLDPWTPIRREVRGVC

SEQ ID NO: 23313 - protein, 81 aa, Physeter macrocephalus
VQASLSFEDVAVGFTWEEWQLLDPSQKDLYRNVMLENYYNLVSVGYQTPKPDSLFQLEQGEPPWMVDGAGQSQTCPEEIWE

SEQ ID NO: 23314 - protein, 81 aa, Trichechus manatus
WKELLSFEDVAMFFTREEWENLDSAQKYLYRDVMLENYRNLIFLGFQFPKPEVISQLEDWEEPWILDLPSAGNRKASSSAC

SEQ ID NO: 23315 - protein, 81 aa, unidentified
  REGION 1..81: note = Bos indicus x Bos taurus
LFQTSTFRDVAIHFSQQEWECLNPVQKNLYQDVMMENYDNLVSLGHSISKPDVITLLEQGKEPWMVVREETRRWPEDEHER

SEQ ID NO: 23316 - protein, 81 aa, Trichechus manatus
VKGPVSFEDVTVDFSREEWQQLDPAQRHLYQEVMLENYSHFLSMGYDLPKPEVIFRLEKGKEPWVVELKLPYWSCRAEEFG

SEQ ID NO: 23317 - protein, 81 aa, Trichechus manatus
LLTFRDVAIEFSQEEWECLDTTQRALYRDVMLENYRNLVSLDISARFVVKELPPEKNINKEELYQPVIMEKQESYGIEYFY

SEQ ID NO: 23318 - protein, 81 aa, Bos taurus
QPKAKKSWGPLSFMDVFVDFTWEEWQLLDSAQKHLYRSVMLENFRNLVSLGYQYTKPSIIFQLEQEELWMMHSPSQGHSGE

SEQ ID NO: 23319 - protein, 81 aa, Ovis aries
QLTSEDVAIEFTQEEWEFLDPAQRALYRDVMLETYRNLLSVDISPTHVIKHLQPKVNSDKRETFQTLMLGSPENCEIKHFH

SEQ ID NO: 23320 - protein, 81 aa, Panthera pardus
SQGPVSFRDVAVDFTQEEWQQLEPEEKTTYRDVMLENYSHLVSVGYDSTKPKVILKLEQGEEPWVVEGDLPCRRRPEVWKV

SEQ ID NO: 23321 - protein, 81 aa, Panthera pardus
MQENCRNLASLGNQVGKPGVVSRLEQKGKVVTEETGILPGSFPDLETLLRAKVLTSKQHVFRQEQHKGVKMERNHLGVKVN

SEQ ID NO: 23322 - protein, 81 aa, Capra hircus
HAEGCLTFQDVAIDFTQEEWECLDLSQRELYRDVMLENYGNLASLGLISMLDLVTFPEQLKDPRNIRRMETTAIYPAMSPQ

SEQ ID NO: 23323 - protein, 81 aa, Rhinopithecus roxellana
MLETYSNLVSVGYEGTKPDVILRLEQEEAPWIGGAARPGCHCWEDIWQVNIQRKRRQDMLLRQGAAISKKTLPKERSREYS

SEQ ID NO: 23324 - protein, 81 aa, Sus scrofa
LIFEDVAVNFTPEEWALLDPAQRKLYRDVMLETFRNLAFVGSCLHVKTSGSSAQRDILENVLCSEEKIVRFKRNDSKSVLG

SEQ ID NO: 23325 - protein, 81 aa, Sus scrofa
VAFEDVAVNFTQEEWECLDAGQRVLYQEVMSETFRNLMSVDLTAKLEQEEKQWRVDLCPPKEEGLHPGSKKEELLEQSQSL

SEQ ID NO: 23326 - protein, 81 aa, Ursus arctos
FQAKLTFEDVAVLLSQEEWDRLGPAQRGLYRHVMMETYGNVVSLGLPGSKPNVISQLERGEEPWVLDGQGAEKTRGLGSGH

SEQ ID NO: 23327 - protein, 81 aa, Ursus arctos
VTESVTFRDVAVLFSRDEWLRLDSAQRTLYREVMLENYGTLVSLGIPFSTPKVICQLQQGEDPCVVDRELPRDACPGLKTQ

SEQ ID NO: 23328 - protein, 81 aa, Vicugna pacos
CQDPVTFEDVAVVFTDEEWRRLVPIQRDLYKEVMLENYKSVVSLGLPVPGPDVIFQLKRGDAPWITELHGSEGTECTENVS

SEQ ID NO: 23329 - protein, 81 aa, Pongo abelii
FQELVTFRDVAIDFSRQEWEYLDPNQRDLYRDVMLENYRNLVSLEMRSRCVAQVGLKLLVSSDPPTSTFQNAGITGVSHRT

SEQ ID NO: 23330 - protein, 81 aa, Monodelphis domestica
SITFKDVAVDFTQEEWCLLDHSQKELYKEVVLENVQNLLFVEAETYFEVKEMSTKMRLFVEGSNSPRGMNKSPCDFFLRDS

SEQ ID NO: 23331 - protein, 81 aa, Bos indicus
AQLTFKDVAIEFTQEEWECLDAAQRALYRDVMVETLRNLVSLDISHILVIEKLQLNEATDRGEEFQTVILGRHERNKIKDF

SEQ ID NO: 23332 - protein, 81 aa, Trichechus manatus
SQELVSFKDVAVNFTQEEWQQLDSDEKIIYRDVMLENYSHLISLGFDITKPDVIIKLEQGEEPWIVEDEFPCQICPEEAWK

SEQ ID NO: 23333 - protein, 81 aa, Trichechus manatus
AQESLTFSDVAVKFTWEEWQLLDPAQKDLYWDVMLENYSNLMSIGYQVSKPDALSRLEQGEQPWTTLDESHSGLFSEIRKV

SEQ ID NO: 23334 - protein, 81 aa, Delphinapterus leucas
SQGLVSFKDVAVHFTQEEWQQLDPAQKTLYRDVMLENYSHLVSMGHPVSKPDVISKLEQGEDPWIIKRDIPNWIYPYEDQA

SEQ ID NO: 23335 - protein, 81 aa, Carlito syrichta
PQEPVTFEDVAVYFTQNQWASLEPVQRALYKEVMLENYASVASLVAFPFPKPLLISQLERGEVPWSPDPWDTEVRRTITPG

SEQ ID NO: 23336 - protein, 81 aa, Zalophus californianus
VQGSMSFEDVIVRFTQDEWQYMSPAQRTLYRDVMLENYSHLISVGYCTAKPEMIFKLEQGEEPWSLEEEFLNRRYPGYFSV

SEQ ID NO: 23337 - protein, 81 aa, Capra hircus
ESVTFEDVAVDFTQEEWALLDTSQRKLFRDVMLENISHLASVVISDREDDLKKQKMSSMQHTCKKDAPLRRAVRSHTQEDP

SEQ ID NO: 23338 - protein, 81 aa, Suricata suricatta
VSVEPNGGFLFSKPKVISLLQQGEDPWKVEKDSPGGPSLGYKSSPKTTKSTQTQDSLFQELLRKRLKKDEPWNFVSEKPCA

SEQ ID NO: 23339 - protein, 81 aa, Chlorocebus sabaeus
MLENYRNLVFLGIAVSKPDLITWLEQGKEPWNMKRREMVDKTPVMCSHFTQDVWPEQSIKDSFQKVILRTCGKYGHENLQL

SEQ ID NO: 23340 - protein, 81 aa, Suricata suricatta
VPGPVTSQDVAVEFIQEEWEHLGSAQRALYREVMLENYRILASLGKSGPGPIICTGLGGRHQAAPWEGHGTQLPSAHVVCL

SEQ ID NO: 23341 - protein, 81 aa, Suricata suricatta
LDITRRDVAIEFSQEEWGCLNQSQRELYRDVILETYGHLVFLGEDHSFQNPKSHSGFFPFYEDSFLEDHHLHSEDLHKLRA

SEQ ID NO: 23342 - protein, 81 aa, Suricata suricatta
MDVAIEFSQEEWGCLSHSQRELYRDVMLENYGHLLFLDLVVLKPDLVTFLERKRELWDVKRKETVASYPGRQTLKCGLSRH

SEQ ID NO: 23343 - protein, 81 aa, Chlorocebus sabaeus
RESGKAPVTFDDITVYLLQEEWVLLSQQQKELCGSDKLVAPLGPTVANRELFCKFGPGPEPWLGSVQGQRSHLEHHPGKKQ

SEQ ID NO: 23344 - protein, 81 aa, Suricata suricatta
SQESVTFKDVAVDFTQEEWALMDTTQRTLYRDVTLENISHLVSVGCHFFRSDVISQWEQRGELETIYMSPMWKKNPHWRET

SEQ ID NO: 23345 - protein, 81 aa, Suricata suricatta
AAGSVTFKDVTMAFTQKEWEQLDPAQRNLYKDVMLENYSNLASMGYQAPKPDMISKLEKGEEPWSGKGRKPRQSGPSEGAR

SEQ ID NO: 23346 - protein, 81 aa, Suricata suricatta
AQASVSFKDVTVEFTHEEWQQMGPIQRTLYRDVMLENYNNLVSVGNCVFKPAVIFKLERGEEPSFLEEEFSIQSQREDYRD

SEQ ID NO: 23347 - protein, 81 aa, Suricata suricatta
LQGLLTFRDVAIEFSQEEWGYLSHSQRELYRDVMLENYGHLLFLGLVVLKPDLVIFLEQQREVLDMKRKETIASYPGTNLI

SEQ ID NO: 23348 - protein, 81 aa, Chlorocebus sabaeus
QGLLTFRDVAIEFSQEEWKCLDAAQRTLYRDVMLENYRNLVSLDISSKCMMNTLLSTGQGNTEVIHTGTLQRQASHHIGDI

SEQ ID NO: 23349 - protein, 81 aa, Suricata suricatta
LQGQLTFRDVAVEFSQDEWGCLNHSQRELYADVMLETYGHLLSLGLLVSKPDLVIFLEHEKEMRGVKRQETVASHPAISSP

SEQ ID NO: 23350 - protein, 81 aa, Sus scrofa
LVFEDVAINFTPEEWALLDPAQRRLYRDVMLETFKNLAFVGSCLHVKTSGSSAQRDILENVLCSEEKIVRFKRNDSKSVLG

SEQ ID NO: 23351 - protein, 81 aa, Mandrillus leucophaeus
LFQVTFSDVAIDFSHEEWAWLDSAQRDLYKDVMVQNYENLVSVGLSVTKPYVIMLLEDGKEPWMVEKKLSKGVIPDWESRW

SEQ ID NO: 23352 - protein, 81 aa, Mandrillus leucophaeus
LKGLVTFEDVAVEFTQEEWALLDPAQRTLYRDVMLENCRNLASLGDQVDKPGLIAQLEQEDKVMTEERGILPGTCPDVENP

SEQ ID NO: 23353 - protein, 81 aa, Sus scrofa
QVSVTFKDVAVTFTREEWGQLDLDQRTLYWEVMLETCGLLVSLGDRAKRQTEEPSTSQSVLSEGALLRGSLTLGSSRDSSW

SEQ ID NO: 23354 - protein, 81 aa, Sus scrofa
FQGPLTLEDMAVEFSPEEWACLDPAQRALRRGMTLETFRNLIDVGISVSLVNVLAMLGQEKGPGAVESAGNELGGCIRGNP

SEQ ID NO: 23355 - protein, 80 aa, Sus scrofa
MAHGSVTFRDVAIDFSQEEWEFLDAAQRDLYRDVMWENYSNFISLAGPSISKPDVITLLDEGKEPWMVVREGTRRHHPGE

SEQ ID NO: 23356 - protein, 81 aa, Sus scrofa
PQEQLTFRDVSVDFTQEEWGQLAPAHRHLYREVMLENYGNLVSVARYQLSKPSVISQLEKGEEPWMTEKEGPGDPSSGLTS

SEQ ID NO: 23357 - protein, 81 aa, Sus scrofa
MTFEDVAVDFTQEEWQYLNPLQRTLYRDVMLETYSNLVSVAGQHVTKPTLILKLEVEEPCLAEGKIPVWNFPEEACQVDEQ

SEQ ID NO: 23358 - protein, 81 aa, Sus scrofa
LGLWFKDVAIYFSQKEWECLHFAQKDLYREVMFENYNNLIALGFSNSKPDVISLLEQGKEPWLVRSKEIKNGVQVSNGDSD

SEQ ID NO: 23359 - protein, 81 aa, Sus scrofa
ELVTFRDVVITFSQEEWEYLDSAQRDLYWDVMMENYSNLVSLDLESNYHTKTLSIEKDTIEKSDSQWEVIESSKLVDFENS

SEQ ID NO: 23360 - protein, 81 aa, Bos mutus
IMAAVVFSVGPLVLIGIQYLKVWKKTVLLFPNLGLQSRASLRYLWLAISKPDMISHLENGKGPWVVVREISRTPFSELETK

SEQ ID NO: 23361 - protein, 81 aa, Bos mutus
MKWRISCIRCCMFHSVPLSKIENYIILMCSLHETARDGHQVPDSFVFGYHGTKPDLIFKLEQGEEPWIINFEVSHQSCPDV

SEQ ID NO: 23362 - protein, 81 aa, Neophocaena asiaeorientalis
DPEQVTFEDVVVEFTWEEWGQLEPAQRTLYRDVMLETFGLLASVGHWLPKPDVISLLEHKAELWVVDKGAPRGVCTDFETR

SEQ ID NO: 23363 - protein, 81 aa, Bos mutus
QGGVTFEDVFVYFSREEWELLEEAQRLLYRDVMLENFALVSSLGALPPPVLVPRVGAVGAQAQPWWRPLPEQSDTCCTKPF

SEQ ID NO: 23364 - protein, 81 aa, Neophocaena asiaeorientalis
MLENYSHLVSVGFLVAQPGRISRLGQGGEEARMAAGESTTRRCPGEPMPGQLGQGKGTWWVREILASGVRPGVLLRNPRLG

SEQ ID NO: 23365 - protein, 81 aa, Neophocaena asiaeorientalis
GGVTFEDIALYFSWEEWKLLDEAQRRLYHDVMLENFALISSLGCCCGAEDAEAPFQRSISISMSQARTHREGSFSQKSHPC

SEQ ID NO: 23366 - protein, 81 aa, Bos mutus
PGGEDSGASREVYMKYDKASIKQQKMNKYRILRSLTLENSFVGYCANRPNAIFKLKQGKEPWILEVQFPRQNNPEDLCNTH

SEQ ID NO: 23367 - protein, 81 aa, Bos mutus
EVVVDADVEVDVTVEAALAGEQSPASGTQECPHGSRDTESPGLQEKGYPVPKPDLIFRLEQGEEPWVPDSPRPEDGDIVTG

SEQ ID NO: 23368 - protein, 81 aa, Neophocaena asiaeorientalis
MLETFRHLVIVVSWISKPAIVVQLELGVEPWIMDRGLSQDSCPAWKNRPKSQESPSTEAISGDRLPSSMNLERYTMGDSWC

SEQ ID NO: 23369 - protein, 81 aa, Nomascus leucogenys
MEGLVMFQDLSIDFSQEEWECLDAAQKDLYRDVMMENYSSLVSLGLSTPKPDVISLLEQGKEPWMVSRDVLGGWCPDRLKK

SEQ ID NO: 23370 - protein, 81 aa, Neophocaena asiaeorientalis
LQGSVTFQDVAVDFTLEEWQLLGYSQRKLYWDVILENFRNLISVGCPVTKTKVIFKVEQGQEPWMVEGENPRWRSPEVICL

SEQ ID NO: 23371 - protein, 81 aa, Neophocaena asiaeorientalis
MLYMDVMLENYCHLVSVGCHMTKPDVILKLERGEEPWTSFTGHTCLEEKWKAEDFLVKFKEQQDKISRSVVLINHKKLIKE

SEQ ID NO: 23372 - protein, 81 aa, Nomascus leucogenys
DGLVTFRDVAIDFSQEEWECLDPAQRDLYVDVMLENYSNLVSLDLESTTYETKKIFSEKDIFEISFSQWEMKEKSKTIGLE

SEQ ID NO: 23373 - protein, 81 aa, Nomascus leucogenys
MGPLQFRDVAIEFSLEEWHCLDTAQRNLYRDVMLENYSNLVFLGIVVSKPDLITCLEQGKKPLTMERHEMIAKPPVISSHF

SEQ ID NO: 23374 - protein, 81 aa, Trichechus manatus
ARVSVMFKDVAVTFTREEWGQLDLAQRTLYREVMLETCRLLISLGHPVPKPELTHLLEHGQELWRVKRGPSQSTGSGDRAK

SEQ ID NO: 23375 - protein, 81 aa, Trichechus manatus
MDSVVIEDVAVDFTLEEWALLDLAQRKLYRDVMMETFRNLASVGEICKLYGVEDHYKHQGRKVRKRAVENLCESNESNQCG

SEQ ID NO: 23376 - protein, 81 aa, Trichechus manatus
FQESVVFSDVSIAFSQEEWAHLDLEQKDLYRDVMLENYSNLVSLGCFVSKPDVISLLEQGKEPWKIVRKGRRRYPDLETRY

SEQ ID NO: 23377 - protein, 81 aa, Trichechus manatus
SLTFKDVAVVFTEEELGLLDPAQKKLYRDVMVENFRNLVSVGGKNPRQMETVPQAGAQEELSGSHIWQQVASDLTRCQDSV

SEQ ID NO: 23378 - protein, 81 aa, Trichechus manatus
MLENYNNLVSLGYRVSKPDALSRLEQGEQPWTILDESHNQNFSGKEQGTTHIRINLEARGTTQDTVLQSEIWEVDHLLGHS

SEQ ID NO: 23379 - protein, 81 aa, Trichechus manatus
TPKHEAKGLSSKDTDWPQEKRKPTMLEPVTFEDVTVVFTEAEWKRLSSEQKHLYKEVMLEIYRNLLSLGEDVLFSFPSLIQ

SEQ ID NO: 23380 - protein, 81 aa, Trichechus manatus
PQKLVTFEDVAVYFTQTEWDGLSPTQRALYRDVMLENYGHVASLGFPLLKPTMISQLEGGAELWGPLPVPTGVGTGPQGLW

SEQ ID NO: 23381 - protein, 81 aa, Equus caballus
AQESVTFSDVSVDFSQEEWECLDPAQRDLYRDVMLENYSNLVSMGFYIPKPQVISLLEQGKEPWMVGRELTRGLCSDLESM

SEQ ID NO: 23382 - protein, 81 aa, Equus caballus
AQECLTFKDVFVDFTLEEWQQLDGAQKNLYRDVMLENYSHLVSVGYLMAKPDVIFRLGQGEEAGMAGRETPMQSCPEFWQV

SEQ ID NO: 23383 - protein, 81 aa, Equus caballus
PPSLVTFGDVAIDFSQEEWEWLNSAQRTLYRNVMLENYRNLASLGLCGSKPDMISSLEQRREPWITKRKLTRGRCPDLKAV

SEQ ID NO: 23384 - protein, 81 aa, Equus caballus
PQEPVTFEDVTVDFTQEEWQQLYPAQRTLHREVMLEVYSHLVSVGYSGIKPDVIFKLQHGEDSWIIESELSRSNSDRDKSL

SEQ ID NO: 23385 - protein, 81 aa, Equus caballus
AQVPLTFSDVAIDFSQEEWECLNSAQRGLYRDVMLENYTNLASLDFDFTTETNKLSSENSSYEVNSCHRETMKRSKTFSLM

SEQ ID NO: 23386 - protein, 81 aa, Equus caballus
SKVELLTLEDVAVEFTWEEWQLLAPAQRNLYRDVMLENYSNLVSVGCQASKPDALSRLEQGEPWTTEDGIHRRTCPEIKKD

SEQ ID NO: 23387 - protein, 81 aa, Equus caballus
IAEGCEWSHCTLIELSSCGQGLVVFTDVAIHFSQEEWGLLDEVQRSLYRHVMLENFALLSSLGKALIPTPVSWTGSCSFLQ

SEQ ID NO: 23388 - protein, 81 aa, Equus caballus
MALEDVAVYFAQEEWELLDEAQRHLYRDVMLENLALVASLGCASSKSRVAAQLGEGKEPWVLDRVDVSPAIAREAGREPGS

SEQ ID NO: 23389 - protein, 81 aa, Neovison vison
EFAPLGDAAMDFTLDWEHLGLDQGDLFWDTALDNYQNIFLLNPSKPKLTSQQDGAEEQKVLERESAESAGPNPAEVKNCLL

SEQ ID NO: 23390 - protein, 81 aa, Capra hircus
FQELVTFEDVAVYFIRKEWKRLEPAQRDLYRDVMLENYGNVFSLDGETRTEPDSEISEDGGSHGVLLGRFQKDISQGLKFE

SEQ ID NO: 23391 - protein, 81 aa, Capra hircus
MAFTRKEWEQLDPAQKSLYKDVMLENYSNLASMGYQALKPDMISKLEKGEEPWLGKGKRPKQAGSSEIARTKEIGANGKVH

SEQ ID NO: 23392 - protein, 81 aa, Chrysochloris asiatica
LQGLLSFKDISMEFTWEEWQLLDSAQKYLYQDVILENYNNLVSVGYHGSKPDLIFKLEQGEEPWTLNGKLSRQNYSEGWEE

SEQ ID NO: 23393 - protein, 81 aa, Suricata suricatta
WSLLDEAQRRLYYDVMLENFTLVSSLGKALPVPRAGAYRKSPLCRIGWTVSVGVSQASVSTAALSSRKTHPCEMCGPVLRD

SEQ ID NO: 23394 - protein, 81 aa, Chrysochloris asiatica
MATPSPPPEPKEWDYLDPAQRSLYKDVMMENYGNLVSLDVLSKDNDEEPIVKQEIEEIEEVEPQSVIVTRIKSEIDQDPMS

SEQ ID NO: 23395 - protein, 81 aa, Chrysochloris asiatica
MDFTLEDWEQLVLDERDLFWDTALDNYQNLFLLNPTRSNVTSHPGDGEELEALGNESPKAMDPDTTESKHSPLKQDFLEEG

SEQ ID NO: 23396 - protein, 81 aa, Mandrillus leucophaeus
EQDYVTFEDVAVYFSQEEWRLLDETQRLLCRNVMLENFSLLASLGLASSKTHEITQLESWKEPFMPASEVVTSAIPRGTWV

SEQ ID NO: 23397 - protein, 81 aa, Mandrillus leucophaeus
AAVSVTFKHVTMTFTQKEWKQLDPAQRNVYHDVMLENYSNQASMGYQAPKPDLISKLEKGEAPWLGKGKRPSQGCPSKIAR

SEQ ID NO: 23398 - protein, 81 aa, Mandrillus leucophaeus
MRSNYETLVSLDDGLPKPELISWIEHGGEPFRNWRESQKSANIICSSGDLHFDPGFQEQLFWGSQQAVNSRKTKSHFQLEL

SEQ ID NO: 23399 - protein, 81 aa, Mandrillus leucophaeus
MLENYGAVASMAAFPFPKPALISQLERGEAPWCSVPWGALDGEDPRGISSGYPFLKPAGISHLQQVEEPLNLKLQEEGPSL

SEQ ID NO: 23400 - protein, 81 aa, Sus scrofa
AQVPLTFSDVAIDFSQEEWECLNSDQRNLYRDVMLENYTNLVSLDFDFTTESNKLSSEKSNYEVNSYHWETTKRSKTFNLM

SEQ ID NO: 23401 - protein, 81 aa, Mandrillus leucophaeus
EKGPLTFRDVVIEFSQEEWQCLDTAQQDLYRKVMLENFRNLVFLGIDVSKPDLITCLEQGKNPWNMKRHSMVATPPGVFFV

SEQ ID NO: 23402 - protein, 81 aa, Sus scrofa
NPGVVLIAREELTLEDVAIEFSPEEWACLDPAQRALYRDVMLETCRNLLSLGEHHFPPGVGICPWVSLRFPCVPLGSLCIA

SEQ ID NO: 23403 - protein, 81 aa, Neophocaena asiaeorientalis
SQEMLTIRDVFVDFTLEEWQQLDATQKNLCRDVMLENYSHLVSDSSWPNQVGSPGWDKEERRPGWQLEKAQHGGVQVSPCR

SEQ ID NO: 23404 - protein, 81 aa, Neophocaena asiaeorientalis
MYQQEMKTNYESLDSLGCISSKPDLITWMEQGRMLLIRDQGHLEKTQMTLSLSGDQGTLGAKEEECHLNGLQEQGFCAPLS

SEQ ID NO: 23405 - protein, 81 aa, Bos mutus
QGWLTFRDVAIDFTQEEWECLDLGQRELYRDVMIENYRNLACLGLVVSKPDLVTFLEQMKDVRNIRRMETIGIYPAISPQD

SEQ ID NO: 23406 - protein, 81 aa, Bos mutus
GLVMFKDVAIDVSQEEWECLNPAQRNLYKDVMLENYSNLVSLGLSISKPAVITSLEQGKEPWMVMREVTRERYPEPDFWDI

SEQ ID NO: 23407 - protein, 81 aa, Bos mutus
ATVNLLLNLRVPVPWENEERRRRAQEKPSDLVPYLVSAFPRPARKDHGPGCQVTKPAVISRLEQGQEPWMEEEEILRWSFP

SEQ ID NO: 23408 - protein, 81 aa, Bos mutus
FQDAVTFTDVAVDFSQDEWEWLTLAQRTLYKKVMLENYSSLASLGLCISKPDVISLLEQDKEPWMMKGELTRGLCPGKCRT

SEQ ID NO: 23409 - protein, 81 aa, Loxodonta africana
MAMYLTREEWRPLDPTQRDLYRDVMQENYGNVVSLDFEIRNENEVNPKQEISEDVDFGTTSERPVGNAEENPEIEEAFESG

SEQ ID NO: 23410 - protein, 81 aa, Capra hircus
AQGSVTFPDVAVYFSWEEWRLLDEAQRRLYLDVMLENYALISSLGFWSGEEKVETSFAQSVSEAVSQARTSKEASSSQKTH

SEQ ID NO: 23411 - protein, 81 aa, Chrysochloris asiatica
MKFTWEEWQLLDLAQKDLYWDVMLENYNNLVSVGYKVSKRDALSWLEQRGKAWFTLEKSRSRVCSVNQSRDDEIANLAELN

SEQ ID NO: 23412 - protein, 81 aa, Chrysochloris asiatica
MQKTLYREMMLENYRNLVSVEHQLSKPEVVSQLEEAEELWLKDRAIPQDTFTECYVAQLEPHESPLPCGGRGENPVVVEVL

SEQ ID NO: 23413 - protein, 81 aa, Chrysochloris asiatica
PQELVTFEDVAVYFTQSQWTSLEPAQRTLYREVMLENYATITSLVSFPALKPALISQLESGEAPWGPDPWEAKVLRDICSS

SEQ ID NO: 23414 - protein, 81 aa, Chrysochloris asiatica
IQESVTFEDIAVNFTDREWQCLTQAQRHLYKDVMLENYGNLVSLGFLFPKPSLIAHLERGTELWVQDLQDREFLSCSCPVS

SEQ ID NO: 23415 - protein, 81 aa, Chrysochloris asiatica
GLVTFEDVAIDFSQDEWACLDPSQRDLYWDVMLENYSNLVSLDWVSSFETESLSSVKDIYEMSFSQWNARRKRQSAAGRDW

SEQ ID NO: 23416 - protein, 81 aa, Suricata suricatta
PLDSVTFLDVAIDFSQDEWEWLDLAQRTLYKKVMLENYRNLASLGLCISKPDVISLLERGEDPWMVKGDVTGGLCPDVEYV

SEQ ID NO: 23417 - protein, 81 aa, Chlorocebus sabaeus
QGPLTFQDVTIEFSLEEWQCLDTAQQTLYRDVMLENYRNLVFLGIAVSKLDLIACLKQGKEPWNMKRHEMITKPPVMRSHF

SEQ ID NO: 23418 - protein, 81 aa, Chrysochloris asiatica
TVIIEDVVVVFTQEEWDLLDPPQKKLYRDVMMETLRNLASVVVLLHLWTRRLFAFVTLHVCHYGEMPYECKECGKTFRESS

SEQ ID NO: 23419 - protein, 81 aa, Chlorocebus sabaeus
SQESVAFEDVAVYFTTKEWAIMVPAERALYRDVMLENYEAVAFVAVPPTSKPALVSHLEQGKESCFIRPPGVLSRSDWRAG

SEQ ID NO: 23420 - protein, 81 aa, Suricata suricatta
TARSQASVTFKDVAMDFTPEEWGNLDPAQREVMLENYRNLVSFWLPASKPENYNLENGKEPLTLERKAPKSSSSDLETQPE

SEQ ID NO: 23421 - protein, 81 aa, Mandrillus leucophaeus
GRLTFRDVAIEFSLAEWKCLDPAQRALYREVMLENYRNLESVDSSLKSMMEFSSHEHSNTGEGFYTGTLERHKSYHIGDFC

SEQ ID NO: 23422 - protein, 81 aa, Sus scrofa
MGSVVFEDVAVNFTLEEWALLDPAQRRLYRDVMLETCRNLASVDYETLSKASESVAQQDTSEEKICHKQKIAKFTKYNSCA

SEQ ID NO: 23423 - protein, 81 aa, Sus scrofa
LQGSLLFEDVAVEFTWEEWRLLDPAQKDLYQDVMLENYSNLVAVGYQSTKPIEIFRLKQGDKPWIEKESIHGENFPEVGEV

SEQ ID NO: 23424 - protein, 81 aa, Mandrillus leucophaeus
PRLPLTFEDVAIYFSEQEWQDLEAWQKELYKHVMRSNYETLVSLDDGLPKPELISWIEHGGEPFRNWRESQKSANIICSSG

SEQ ID NO: 23425 - protein, 81 aa, Mandrillus leucophaeus
GHLTFRDVAIEFSQAEWKCLDPAQRALYKDVMLENYRNLVSLGSSYALGSNAKDKPTKKQLGVSFHLHLSELELFPDERVI

SEQ ID NO: 23426 - protein, 81 aa, Mandrillus leucophaeus
RNVMLENYKNLVFLGIDISKQDPITSLEQEKEPWNMKRHEMLDESPGQVWLTPVISALWEARAGGLLEPRSLRPAWSTWKN

SEQ ID NO: 23427 - protein, 81 aa, Mandrillus leucophaeus
DSVVFEDVAVDFTLEEWALLDSAQRNLYRDVMLETFQNLASVDDETQFKASGSVSQQDIYGEKIPKESKIAAFTRNVSWAS

SEQ ID NO: 23428 - protein, 81 aa, Mandrillus leucophaeus
LYEAVTFKDVAVVFTEEELELLDPAQRKLYRDVMLENFRNLLSVGKIQTEMETVPEAGTHEEFSCKQIWEQIASDLTRSQD

SEQ ID NO: 23429 - protein, 81 aa, Sus scrofa
KVPVTFVDIAVYFSEDEWKNLDEWQKELYHNLVKENYKTLMGPLNLPGLNGQPSYSHGVDQGVGRVASRREGARRTVRRAP

SEQ ID NO: 23430 - protein, 81 aa, Sus scrofa
MLENYSHLVSVGYQVSKPEVIFKLEQGEEPWIAEGEIQRPFCPDWKTRPEAKSSNLRQNISEVFPSTDDLSHATLEDAWDV

SEQ ID NO: 23431 - protein, 81 aa, Neophocaena asiaeorientalis
SQKSVTFQDVAVDFTEKEWPLLDSSQRKLYKDVMLENYSNLASVGCQVSKPSLISHLEQEEELGTEEQELHQGPCPDWETP

SEQ ID NO: 23432 - protein, 81 aa, Bos mutus
QTQLTFKDVFIDFTPEEWECLDPAQRTLYKDVMVETLRNLLSVDVSQIRMIKKLQAKGNSGKEESFQRVVFGTAESHEIED

SEQ ID NO: 23433 - protein, 81 aa, Neophocaena asiaeorientalis
FQGSLTFSDVAIGFSQQEWECLDLIQKTLYRDVMMENYGNLVSLAGHSISKPNVITLLEQGKEPWMFMREKTRSWCTDLDS

SEQ ID NO: 23434 - protein, 81 aa, Neophocaena asiaeorientalis
AAGSVTFKDVTMAFTKKEWEQLDPAQKSLYKDVMLENYSNLASMGYQALKPDMISKLGKGEEPWLGKGKRPRQGGLSEIAR

SEQ ID NO: 23435 - protein, 81 aa, Neophocaena asiaeorientalis
ELVTFRDVVISFSQEEWEYLDSAQRDLYWDVMMENYSNLVSLDLESKCDKETSSTEKDIIEKNDSHWEVTESSKLVGLENS

SEQ ID NO: 23436 - protein, 81 aa, Bos mutus
MLLPTLTFNYLFTFLSTLPVLSTAKSYQISKSDVVFQLEQGKELWTQAAGGLQGQSPGSESLFRQQEITLMQSVYWKHTSP

SEQ ID NO: 23437 - protein, 81 aa, Bos mutus
MSVVTKPVAPLSEKANAIEEGSRPSGRNHQAAVKRKQRARGAGHQLPKPDVILRLEKGEEPWLVEREIHQETQPDLETSVE

SEQ ID NO: 23438 - protein, 81 aa, Nomascus leucogenys
PQKSVTFEDVAVYFTQAEWDGLSPAQRTLYRDVMLENYGNVASLGFPLLKPAVISQLEGGGDLGGPSPLAAGTGLQGLRTV

SEQ ID NO: 23439 - protein, 81 aa, Nomascus leucogenys
RQVSITFKDLAVRFSEEEWRLLEEGQREFYRDVMRENYETLVSVGTAELLPLSAFLSPSDPGRAVGGGSHADEGQEAGCGG

SEQ ID NO: 23440 - protein, 81 aa, Nomascus leucogenys
QFHRVTFEDVAVDFTQEEWQQLNPAQKTLHRDVMLETYNHLVSVGCSGIKPDVIFKLEHGEDPWIIESELSRWIYPDRVKG

SEQ ID NO: 23441 - protein, 81 aa, Nomascus leucogenys
AHGSVTFRDVAIDFSQEEWEFLDPAQRDLYRDVMWENYSNFISLGPSISKPDLITLLDEEGKEPGMVVREGTRRYCPDLES

SEQ ID NO: 23442 - protein, 81 aa, Nomascus leucogenys
LYEAVTFKDVAVVFTEEELQLLDLAQRKLYRDVMLENFRNLLSVGGKIQTEMETVPEAGTHEEFSCKQIWEQIASDLTRSQ

SEQ ID NO: 23443 - protein, 81 aa, Capra hircus
CSLPGSSAHALFQARILEWVAISFSRESPRELTQKLSEVVSILSWYEVPKPEVIFKLEQGEEPWALKEKALHHSCSDGKFG

SEQ ID NO: 23444 - protein, 81 aa, Capra hircus
FQGWLTFQDVALDFTQEEWECLDLGQRELYRDVMLENYRNLASLAGLVVSKPDLVTFLEQMKTPWDVRRLETPAVYTAVSS

SEQ ID NO: 23445 - protein, 81 aa, Capra hircus
FCGSLSFEDVTVGFTQEEWQKLDPDQRTLYRDVMLENYSHLISVGYCIPKPELIFKLEQGEQPWVLEAESPSQSYPGQSEH

SEQ ID NO: 23446 - protein, 81 aa, Suricata suricatta
MLDTLDVAIEFSQEEWGCLNHRQQELYRDVMLENYGHLLFLGLIVSKPGLVIFLEQKKDVWDVRRKETEASCPGMGVKQMT

SEQ ID NO: 23447 - protein, 81 aa, Chrysochloris asiatica
SQGTVTFKDVAIDFTQAEWQHLDCDQRRLYRSVMLENYNNLITVGCPFTKPDVIFKLEQEEEPWVLEEEVLRRHSPGEIWG

SEQ ID NO: 23448 - protein, 81 aa, Chrysochloris asiatica
SQGLVSFKDVAVDFTQEEWQQLAPAQRTLYRDVMLENYSHLVSMGYPVSKPDVISKLEQGEDPWIIRKDISNWIYPVENQA

SEQ ID NO: 23449 - protein, 81 aa, Suricata suricatta
AGQLTFTDVAVEFSQEEWEWLDPAQRALYKDVMLETYRNLVSLDGFAAFMVKELLPKKDINDGELYQSMILGRSESHGLDD

SEQ ID NO: 23450 - protein, 81 aa, Suricata suricatta
MAVTFEDVTVIFTWEEWRFLDSSQKKLYREVMWENYTNVMSVGNWKESYKPQEERFRYLEHENLPCWQGWRNASNQIYKNR

SEQ ID NO: 23451 - protein, 81 aa, Chlorocebus sabaeus
KPGTVSFADVAVYFSREEWGCLRPAQRALYRDVMRETYGHLGALGVGGSKPALISWVEEAAELWDPAARDPEVTKCPTETD

SEQ ID NO: 23452 - protein, 81 aa, Chrysochloris asiatica
ITFEDVAIYFSQEEWGLLDEAQRILYNDVMLENFAVIASLGRWHEVEEEKASFEQSVSIEGLSQARTPQIVPATQKTHYWE

SEQ ID NO: 23453 - protein, 81 aa, Suricata suricatta
SQGLLSFRDVTVDFSQEEWQRLAPAQRTLYRDVMLENYSHLVSVGLSIPKPEVIRKLEQGEEPWILETRGQSDPELINSSR

SEQ ID NO: 23454 - protein, 81 aa, Mandrillus leucophaeus
VHGSVTFRDVAIDFSQEEWECLQPEQRTLYRDVMLENYSHLISLGSSVSKPDVITLLEQEKEPWIVVRKETSRWYPDLESK

SEQ ID NO: 23455 - protein, 81 aa, Mandrillus leucophaeus
KCLDPAQRTLYRDVMLENYRNLVSLAISSKCMMKMFSSTGQGNTEVIHTGTLQRQASHHIGDICFQEIGKDIHDFVFQWQE

SEQ ID NO: 23456 - protein, 81 aa, Mandrillus leucophaeus
ADVSLAFRDVSIDLSQEEWECLDPVQRDLYKDVMLENYSNLVSLGYTIPKPDVITLLEQQQEPWIVMREGTRSWYTDLEYK

SEQ ID NO: 23457 - protein, 81 aa, Sus scrofa
RPRAVKFADVAVYFSPEEWGCLRPAQRALYRDVMRETYGHLGSLGCAGPKPSLISWLERNTDDWEPAALDPQECPRGVTVQ

SEQ ID NO: 23458 - protein, 81 aa, Sus scrofa
QAMVKIEDMAVSLILEEWGCQNLARRNLSRDSRQENYGNVISQGGENRTEKEESTSKAESAEDAASHGETAGKFQKDFGEK

SEQ ID NO: 23459 - protein, 81 aa, Sus scrofa
CKESVIFKDVCVNFSLEEWECLDLTQRNLYRCVMLENYSNLVSVVGLSIPKPDVISLLEQGKEPWGVFDSEMTRGLNQDCG

SEQ ID NO: 23460 - protein, 81 aa, Neophocaena asiaeorientalis
PQEAAVFKFLSVDYTQQKWKGLALSQRALYWNIVLENCCSLASLGENRMESSELPPKQELSKVLKSSDRTSVVLCGMIPGG

SEQ ID NO: 23461 - protein, 81 aa, Neophocaena asiaeorientalis
PQGSTPFNSVTVAFTQKGWRQLAPTPRDRFKKGMPEKSRNLVLLGLPVSQPGMNSQLEQREGSWMLEREGLRSTCPDWKIV

SEQ ID NO: 23462 - protein, 81 aa, Bos mutus
LQDLVTFEDVTVEFTQEEWALLDSSQRKLYRDVMLENCRNLASLGYHVDKPSLISQLEQEDKVVTEEGGILPDTRPDLETV

SEQ ID NO: 23463 - protein, 81 aa, Bos mutus
MRTRVFPAGCQVTKPDVIFKLEQEEEPWVVEEEMLGGHCPEVWKVDEQIKKQQETLVRNVTSISKKTLNKENAVEYKNVAK

SEQ ID NO: 23464 - protein, 81 aa, Nomascus leucogenys
TEGDVTFSDVAIDFSHEEWACLDSAQRDLYKDVMVQNYENLVSVGLSITKPYVIMLLEDGKEPWTVEKKLSKDWESRWENK

SEQ ID NO: 23465 - protein, 81 aa, Neovison vison
SLDSVTFTDVAIDFSQDEWEWLNLAQRTLYKKVMLENYRNLLSLGLCLSKPDVISLLEQGREPWLMEGEMTRGFCSDLEYV

SEQ ID NO: 23466 - protein, 81 aa, Neovison vison
FSQEEWELLDAAQKALYCHVMLENFALVASLGLSASRPRVVIQLERGEEPWVLSGTVVTPVRNAPRKPSPGSRHLAYDRVV

SEQ ID NO: 23467 - protein, 81 aa, Loxodonta africana
HQEPVTFEDVAVTFTEEEWRHLVPIQRDLYKEVMLENYSSIVSLGLPVPQPDVIFQLKRGEEAWIVDPHGSEKRECPENIS

SEQ ID NO: 23468 - protein, 81 aa, Loxodonta africana
QEEWDYLDPAQRSLYKDVMMENYGNLVSLDVLNKDKDEEPTVKQEIEEIEEVEPQSVIVTRIKSEIDQDPMGRETFELVGR

SEQ ID NO: 23469 - protein, 81 aa, Capra hircus
EQGLIAFEDVAVHFSQEEWGLLDTAQRALYRRVMLENFALLASLGLSVSQPRVVTQLERGDEPWVLSGADVTLAQDAQRRP

SEQ ID NO: 23470 - protein, 81 aa, Capra hircus
QAEVTFKDVAVFLSQEEWGLLGPAQKGLYREVMLETYRNLVSLGAGLAGPKPEVIVHLERGDELWSLCVLSGKEGWRQAHG

SEQ ID NO: 23471 - protein, 81 aa, Capra hircus
ELVTFRDVVISFSQEEWEYLDSVQRDLYWDVMMENYSNLVSLDLESKYDTKTLSVEKDILEKNNSQWEVIENSKLVGLQNS

SEQ ID NO: 23472 - protein, 81 aa, Chrysochloris asiatica
KVPVTFVDIAVYFSEDEWKSLDGWQKELYNNLVKENYKTLMSLDAENPAPKQAAPPQVEPREEPCVWEQRNPEERDIPVDP

SEQ ID NO: 23473 - protein, 81 aa, Chlorocebus sabaeus
YQDLVIFEDTAVDFTQEEWTLLDPVQRNLYRDVMLENYENVAKVGFQLLKPSVISWLEEKELRTLQQGVLQDRAMKHQTSV

SEQ ID NO: 23474 - protein, 81 aa, Chrysochloris asiatica
MLENYSHLVSVGYQAGNPGALSMLEQGELWAIEDEIHSRICPEICKVHDHLQGPLESQQMLKTVEQYQEHNFYIKTLKSNL

SEQ ID NO: 23475 - protein, 81 aa, Chrysochloris asiatica
RREPVTFEDVAVYFSENEWSSLAPAQRALYRDVMLENYGAVASLAFSFPKPALISQLERGEAPWSLAPQGALDGEGSRGIS

SEQ ID NO: 23476 - protein, 81 aa, Chrysochloris asiatica
FQESVTFKDVIVDFTWEEWKQLDPVQRDLFRDVTLENYTHLVSIGLQVSKPDVISQLEQGTEPWMVEPGVPFGDWKTRPEN

SEQ ID NO: 23477 - protein, 81 aa, Suricata suricatta
MLENYGHLLLLGLVSKPDLVNFLEQKMEAWDVNRRGTVATHPAVSSHDMLSFLLKSCIEVSFQNKSMGGCKHNTLENLHLM

SEQ ID NO: 23478 - protein, 81 aa, Suricata suricatta
TLREFVIHRVIAMDFTLEDWEQLGLDQGDLFWDTALDNYQNLFLLNPCKPKLTSYPDGGKELEAVVRESPKSEGLAPYFSP

SEQ ID NO: 23479 - protein, 81 aa, Suricata suricatta
KPGAVSFADVAVYFSPEEWGCLRPAQRALYRDVMRETYGHLGALGFRGTKPALICWVEEEADLWGPEARDPEVGACLTEAD

SEQ ID NO: 23480 - protein, 81 aa, Chrysochloris asiatica
LLSPLQVSVIFEDVFLYFSQGEWRLLDESQRLLYRDVMLDNFALIASLGISQLVHGEEPRVPGPTRKAQREPGPGCLCAVE

SEQ ID NO: 23481 - protein, 81 aa, Suricata suricatta
AVDFTQEEWGQLDPLQRTLYRDVMLETYGHLLSVGNQIAKPEVICLLEQGEDPWSVEQAHPQSTCPEWMRNLESKALIPTQ

SEQ ID NO: 23482 - protein, 81 aa, Suricata suricatta
MLENYGHLLFLGLVVLKPDLVTFLERKRELWDVKRKETIASYPAVSSNANERLPPKIFIETTFQNVSVDSYKHSALENGPL

SEQ ID NO: 23483 - protein, 81 aa, Chlorocebus sabaeus
HELLTFKDISVDFTQEEWGQLAPAYQNLYREVMLENYSNLVSVEAGYQLSKPSVISQLEKGEEPWMAEKEGPGDPSSDLKS

SEQ ID NO: 23484 - protein, 81 aa, Sus scrofa
MSFEDVTVDFSREEWQHLDPAQRRLYQDVMLENYSHLLSLGYEIPKPEVILKLEQGEEPWMLERDTPHRRCSDGKFGIKTS

SEQ ID NO: 23485 - protein, 81 aa, Sus scrofa
MLETCGLLVSLGHPVPKPELIHLLEHGQELWTVKRGHSKSTCAGDKAKPKTTELTASQPALTEEAPFEERVTHGPSRHSRL

SEQ ID NO: 23486 - protein, 81 aa, Mandrillus leucophaeus
SVAFEDVAVTFTQEEWALLDPSQKTLYRDVMQETFRNLASVGKKWKAQNIYVEYENLKRNLRTFVGERFFESKEGYQHGEI

SEQ ID NO: 23487 - protein, 81 aa, Sus scrofa
SQEPVTFEDVAVYFTQNQWASLAPAQRALYREVMLENYVNLTSLAAFPFSKPDLIFQLERGEAPRGLDPWTPVGGEALRGV

SEQ ID NO: 23488 - protein, 81 aa, Mandrillus leucophaeus
IYFSQEEWELLEYTQKALCNDVMQENYETVISLALFVLPKPKVISCLEQGEEPWVQVSREFKDSAGKSPTGLKLKNDTENH

SEQ ID NO: 23489 - protein, 81 aa, Sus scrofa
LGSPSPVLSCPPAFASGQQGCMLTSMMFQSPVSFKDVAVTFTWEEWGQLDPAQRTLYREVTLETCSHLVSLGNVGVWDPIS

SEQ ID NO: 23490 - protein, 81 aa, Sus scrofa
MLEICTHLVSLEYVISKPDLVRLLEQKKDPWDVKGMETVAIQPALSSHDTQGLMPPNPGMELFLQTALLGEFESSPVGTFD

SEQ ID NO: 23491 - protein, 81 aa, Sus scrofa
QEDDLKFKDVAIYFSQKEWECLHFAQKDLYREVMFENYNNLIALGFSNSKPDVISLLEQGKEPWLVRSKEIKEWCPDWESR

SEQ ID NO: 23492 - protein, 81 aa, Neophocaena asiaeorientalis
MLENYFNLISVGCQVPKPEVIFNLERGEQPCMLDGEISSQSYLDQGIGFETSQQGMSEEVSIQFERINLFTRDDLYSILEE

SEQ ID NO: 23493 - protein, 81 aa, Neophocaena asiaeorientalis
QGSVTFEDVVVYFSWEEWGLLDEAQRCLYHDVMLENFALVTSLGCWYGMEDEEAFSVQSVSVEPMSLGKTPTPDPSIQKTH

SEQ ID NO: 23494 - protein, 81 aa, Loxodonta africana
QPVSFSAHPTAGVLVFKPELISRLEQGQEPWVLDLQGSEGRETPRTSQTESTIRTDNEQACEEMDILKSEDIPPSPGFADS

SEQ ID NO: 23495 - protein, 81 aa, Capra hircus
YACWVTFSDVAIDFSHEEWRWLNSTQRDLYKDVMVQNYENLVSLAGLSIPKPYVIALLEDGREPWMVEEKLSKDMFSDCKS

SEQ ID NO: 23496 - protein, 81 aa, Capra hircus
AQLTFKDVFIDFTPEEWECLDPAQRTLYKDVMVEILRNLLSVDMSHIHMVKKLQAKANCGKGEIFERVMFGRAEILEIKDF

SEQ ID NO: 23497 - protein, 81 aa, Capra hircus
RLTSEDVAIEFTPEEWEFLDPAQRALYRDVMLETYRNLLSVDISPTHVIKHLQPTANSDKLETFQTLMLGSPESCEIKHVH

SEQ ID NO: 23498 - protein, 81 aa, Capra hircus
AHMSLSFRDVAIDLSQEEWECLDPFQRALYRDVMLENYSNLVSLGCSTPKPDMITLLEQEKEPWMIMREGTGSWFTDLESK

SEQ ID NO: 23499 - protein, 81 aa, Capra hircus
QLTIEDVAIEFTPEEWECLAPAQRTLYWDVMLETYRNLLSVDISPIHIIKKLQPKENTNSTDTFQTVILGRHESPGVKDFY

SEQ ID NO: 23500 - protein, 81 aa, Capra hircus
VQDCVVFEDVAVYFSQEEWGLLDEAQRHLYHAVMAENLALVTSLGCWHGAPGEETSSEQGVSIVMSEVRTAKPDPSSRKAQ

SEQ ID NO: 23501 - protein, 81 aa, Capra hircus
QAQETFTFADVAVDFTWEEWQLLAPVQKALYRDVMLENYSNLVSVGFQASTPEVLSKLDQGEPWMMDDEIHCQTHSEVWKF

SEQ ID NO: 23502 - protein, 81 aa, Chrysochloris asiatica
SQAPVTFEDMAMYLTREEWRPLDPTQRDLYRDVMQENYGNVVSLDFEIRSENEVNPKQEISEDVKFGTTSERPVGNTEENP

SEQ ID NO: 23503 - protein, 81 aa, Chlorocebus sabaeus
PRGHLTFMDVAIEFSQEEWKCLDPGQRALYRDVMLENYRNLVSLGICLPDLSIISRLKQRREPLTLQSEVKIVKNPDGRQC

SEQ ID NO: 23504 - protein, 81 aa, Chrysochloris asiatica
FWTLVTFKDVLVDFTEEEWTLLSTAQQILYKRVMLENYKNLVFLGLQFPKPEVILRLEKDEAPWLMEIHQETIPGSETAVE

SEQ ID NO: 23505 - protein, 81 aa, Chrysochloris asiatica
SQASVSFMDVAVELTQEEWQHMGPAQRTLYRDVMLENYSHLVSLGYCLTKPEMIFKLEQGEDPWSLEEEFPAQCYSGYCKG

SEQ ID NO: 23506 - protein, 81 aa, Suricata suricatta
THGSTPFSSVAVAFTQDAWRHLIPAPRDRFKEGSPGNTRNLVLLGLPVSQPGMNSQLEQREEGPWVLEGGGLRSTCPDWKL

SEQ ID NO: 23507 - protein, 81 aa, Chlorocebus sabaeus
FQGSVTFRDVAIDFSQEEWKWLQPAQRDLYRGVMLENYGHLVSLAGLSISKPDVVSLLEQGKEPWLGKRNVKRDLFSVSES

SEQ ID NO: 23508 - protein, 81 aa, Suricata suricatta
MSFKGVTVDFTRDEWLQLTGTQRTLCRGVMLENYSHPAAVGGGARCKPFLIRQPSLHLRGLKQKRNPLIVQNTGAIPVTSQ

SEQ ID NO: 23509 - protein, 81 aa, Chlorocebus sabaeus
GCPIPRPELIYHLEHGQEPWTRKEDLSQDTCPGDKGKAKTTEPTTCEPALSEGISLQGQLTEGNSVDSQLGQAEDQDGLSE

SEQ ID NO: 23510 - protein, 81 aa, Suricata suricatta
SQGLVTFRDVALGFSQEEWEWLDPSQKDLYRDVMLENYRNLVWLGLSMSKPNMISLLEQGKEPWMVEKEMSDGPYADWESW

SEQ ID NO: 23511 - protein, 81 aa, Chrysochloris asiatica
SQELLTFRDVAVEFSQDEWDCLEPAQRALYRDVMLENYRNLVSLGEIGCSDLNSISILEQEREPAFMEMKIATKHKKTNGW

SEQ ID NO: 23512 - protein, 81 aa, Suricata suricatta
AQESVTFKDVAVDFTQEEWALMDTTQRTLYRDVTLENISHLVSVGCHFFRSDVISQWEQRGELWREERGPPQGWSPGMKNN

SEQ ID NO: 23513 - protein, 81 aa, Mandrillus leucophaeus
PKVPVTFDDVAVYFSEQEWGKLEDWQKELYKHVMRGNYETLVSLDYAISKPDILTRIERGEEPCLDGWGQEKQNEVEVGHP

SEQ ID NO: 23514 - protein, 81 aa, Mandrillus leucophaeus
ELLTFRDVAIEFSPEEWKCLDPAQQNLYRDVMLENYRNLVSVGVAISNPDLVTCLEQRKEPYNVKIRKIVARPPAVCSHFT

SEQ ID NO: 23515 - protein, 81 aa, Sus scrofa
SQVSVTFEDVAVLFSRDEWRRLGPSQKNLYQDVMLENYSNLVSLGLPFSKPKVISLLQQGEDPWKVEKESPGSFPGCKSSP

SEQ ID NO: 23516 - protein, 81 aa, Mandrillus leucophaeus
IQGLLTFGDVAVAFTRIEWRHLDAAQRALYRDVMLENYGNLVSVGLLSSKPKLITQLEEGAEPWMEVREAPSGPRAVQDYW

SEQ ID NO: 23517 - protein, 81 aa, Sus scrofa
SWGSVTFSDVAIDFSQEEWEWLQPAQRDLYRHVMLENYGHLVSLAGLNISKPDVVSLLEQGKEPWLGKGDVNRDLFSASES

SEQ ID NO: 23518 - protein, 81 aa, Sus scrofa
MLENYGHLVSLAGLNISKPDVVSLLEQGKEPWLGKGDVNRDLFSASESNGEIKEFSQKSIIYEDDSFQYLMVERFLSQGSE

SEQ ID NO: 23519 - protein, 81 aa, Sus scrofa
IKKLLTVEDVAINFSPEEWECLDLSQWDLYRDVMIEICRHLVSLEYVISKPDLVRLLEQKKDPWDVKGVETVREGGQKKYS

SEQ ID NO: 23520 - protein, 81 aa, Sus scrofa
SQEQVSFKDVCVDFTQEEWYLLDPAQKILYRDVILENYSHLVSVEDWKVDDLIESSQENQDEHFWQLAFTTNKTLSTESGD

SEQ ID NO: 23521 - protein, 81 aa, Sus scrofa
EMGLLTFEDVAIDFSPEEWECLDLGQRHLYRDVMLEICRHLVSLGEDPFLPEFLFSHWVKKHTGGKPDKCEESTSYSAFTR

SEQ ID NO: 23522 - protein, 81 aa, Sus scrofa
STGSLSFKDVAVGFTRKEWQQLDSAQRTLYREVMLENYSHLVSVGCQVTKPAVISRLEQGQEPWMKEEEILRWSTPQDSQQ

SEQ ID NO: 23523 - protein, 81 aa, Sus scrofa
MEAVTFGDVAVHFSREEWQCLDPGQRALYKEVMLENHSSVAGLGFLVFKPELISRLEQGQEPWVLDLQGTEGREAPRPSRT

SEQ ID NO: 23524 - protein, 81 aa, Neophocaena asiaeorientalis
MLENYSNLVSLGLLFSKPEVISLLQQGEDPWKVEKESPGGSSLGCKSSPKTTKSTQTQDSSFWGPVRKRLKKNEPWNFISE

SEQ ID NO: 23525 - protein, 81 aa, Pteropus vampyrus
PQAKVTFEDVAVLLSQEEWDHLCPAQRGLYRHVMMETYGNVVSLGLPGTKPNVISQLERGEEPWVLDGQGAEESRGLGGGR

SEQ ID NO: 23526 - protein, 81 aa, Trichechus manatus
AVTFKDVAVVFTEEELALLDKTQISLYQDVMLENFRNLVSVGDGIKSTISNLQEKGLSYLSQEVLYCWQIWKQRISDLTES

SEQ ID NO: 23527 - protein, 81 aa, Trichechus manatus
TFREAVTFKDVAVAFTEEELELLDPAQRKLYQDVMVENFRNLVSVGHQPFERDISHIERREKLWLMKIAIQRERNSGEKNQ

SEQ ID NO: 23528 - protein, 81 aa, Trichechus manatus
SVVVEDVAVDFTQEEWALLDHSQRQLYRDVMMEIFRSLTSVASQNLIDGDKLSTENIIVRFMKNDTWSSMVGEICELPGTE

SEQ ID NO: 23529 - protein, 81 aa, Trichechus manatus
NQESLTYRDVAVDFTWEEWQLLDTAQKDLYRDVMLENFSNLVSVGFQAGKPDALSKLERGEEPWTVEDEIQRQARSAYSDD

SEQ ID NO: 23530 - protein, 81 aa, Trichechus manatus
VCASVSFKDVAVELTQEEWQHMGPAQRTLYRDVMLENYSHLVSAGYCITKPEVIFKLERGEEPLSLEEFPSHGYRENCKAD

SEQ ID NO: 23531 - protein, 81 aa, Trichechus manatus
MLENYRNLVSLGLCISKPDVISLLEQGKEPWEVNRQMTRGLCPDLEYVWVTKELFPKQDIYEEKLSQEMLMEKLRSCGLEC

SEQ ID NO: 23532 - protein, 81 aa, Trichechus manatus
AQESLTFSDVAVKFTWEEWQLLDPTQKDLYWDVMLEDYSNLVSIGCQVSKPDALSRLERGKQPWTILDESHRVIFSEIMNI

SEQ ID NO: 23533 - protein, 81 aa, Trichechus manatus
PKVPVTFDDVAVYFSEQEWGQLDEWQKELYKHVMRGNYETLVSLDYAISKPEVLSQIEQGKEPCNWRRTGPKIPDVPVDPS

SEQ ID NO: 23534 - protein, 81 aa, Trichechus manatus
RQAAVTFEDVAVLLSQEEWDRLGPAQRGLYRNVMMETYGNVVSLGLPGSKPEVISQLERGEEPWVLDEQETEGREHLRNGH

SEQ ID NO: 23535 - protein, 81 aa, Trichechus manatus
SVVVEDVAVVFSQEEWALLDLPQRKLYRDVMMETFRNLDSIVSGTLNDGERLSTEPTMMQLMKNNTWSSMLVEISESHGNK

SEQ ID NO: 23536 - protein, 81 aa, Trichechus manatus
QESSVTFEDVVLTFTKEEWGLLSPAQRSLYQEVMLETWRLSISLGRPVPKPELIDLLEHRQELWVVKRGPSQGTCPGDRAK

SEQ ID NO: 23537 - protein, 81 aa, Trichechus manatus
MQGPVTFEDVAVYFSWDEWGILNVTQRLLYCDVMLENFALIGSLGCLCGSEDKTAVLEQVKSCWAHLSEQPFTCEECSKDF

SEQ ID NO: 23538 - protein, 81 aa, Trichechus manatus
AQESLTFSDVAVKFTWEEWQLLDPAQKDLYWDMMLENYSNLVSVGCQVNKPDALSKLERGEQPWTILDESHSGIFSEIQKV

SEQ ID NO: 23539 - protein, 81 aa, Trichechus manatus
DSVAFEDVAVDFTQEEWALLDLSQRQLYRDVMMEIFRSLASVGEICELHGIEDQDKNQKTHVSMLPVFNRRHMLENLCESN

SEQ ID NO: 23540 - protein, 81 aa, Trichechus manatus
SVVFEDVAVDFTEEEWALLNFAQRKLYRDVMMETFRNLASVVSQKVDKEQMVSTEHLIMRFMKNNFQYTILGETCEFHGFE

SEQ ID NO: 23541 - protein, 81 aa, Trichechus manatus
SLVVEDVAVVFSQEEWALLNLPQRKLYRDVMMETFRNLASVVSRNFDDEENLSSERIMVQFIKNKTWSSMLEFSKLHGNKD

SEQ ID NO: 23542 - protein, 81 aa, Equus caballus
PHWLVTFRDVAIDFSQEEWECLDPAQRDLYREVMLENYSNLVSLAGCSVPKPDVFSLLEQGKEPWMVVRAMARRRSSDLES

SEQ ID NO: 23543 - protein, 81 aa, Equus caballus
PRGRAGEDSVTFGDVAVYFSWEEWRLLDEAQRHLYHDVMLENFALISSLGKALSLPVTWTKLYPDSPPYLHPKDKSHLIIV

SEQ ID NO: 23544 - protein, 81 aa, Equus caballus
QESVTFEDVAVVFTQEEWALLDTSQRKLFRDVMLENISHLVSIDWEGDLKKQEVICMQHICKKDTSLISAMSSHTQEDSFE

SEQ ID NO: 23545 - protein, 81 aa, Equus caballus
SQGPVTFEEVVVDFSWEEWELLEPAQKILYRDMMLENFRNLTSGRYHLCKPNLRTQEKQEAGDQEEKNSPRTCADQKSQLE

SEQ ID NO: 23546 - protein, 81 aa, Equus caballus
LQGLVSFEDVAVHFTWEEWQDLDDAQRTLYKDVMLETYSSLASLGHCITKPEVIVKLEQDAEPWTVEAPPNQSLPGGSMRT

SEQ ID NO: 23547 - protein, 81 aa, Equus caballus
FQESVTFEDVAVYFSENEWTGLAPAQRSLYRDVMLENYGAVSSLGYPFLKPAGISHLEQVEEPLNLKLQGEGPSLICTEGV

SEQ ID NO: 23548 - protein, 81 aa, Equus caballus
MFQDVAIDVSQEEWECLNPAQRNLYKDVMLENYSNLVSLGLSVCKPAVISSLEQGKEPWMVVREVTGGRCPDLVSRCKPKK

SEQ ID NO: 23549 - protein, 81 aa, Equus caballus
DHGLVMFQDVAIDVSQEEWECLNPAQRNLYKDVMLENYSNLVSLGLSVCKPAVISSLEQGKEPWMVVREVTGGRCPDLVSR

SEQ ID NO: 23550 - protein, 81 aa, Neovison vison
REVMLENYANVASLAFPFPKPDLISQLESGEAPWGPDPWEAELLRGICPGGESWMKEEEPAVKQEASEQAEMSRMPGGGLL

SEQ ID NO: 23551 - protein, 81 aa, Neovison vison
EVIFKLEQGEEPWILERKTPHQSHTDGKFGIKTSQKRISGKASFHGEMEGEDTRDDSLYSILEELWQDSEQIKRYQEKQSK

SEQ ID NO: 23552 - protein, 81 aa, Mandrillus leucophaeus
VAFEDVAVNFTQEEWTLLDISQKNLFREVMLETFRNLTSIGKDDSFPFLSALVNQSLIEEKVNEIKEDSHCGETFTQVPDD

SEQ ID NO: 23553 - protein, 81 aa, Sus scrofa
SREGSVSFRDVAVDFSREEWQQLDLDQKNLYRDVMLETYSHLLSVGYQVPDPEVLKLEQGKDPWALQGESPHQSCLEELWQ

SEQ ID NO: 23554 - protein, 81 aa, Mandrillus leucophaeus
GRRAEEAVTFKDVAVVFTEEELELLDPAQRKLYRDVMLENFRNLLSVGHQPFHGDTFHFLREEKFWVMETASQREGTSGPL

SEQ ID NO: 23555 - protein, 81 aa, Mandrillus leucophaeus
MCGPLTFRDVKIEFSLEEWQCLDTAQRNLYRDVMLENYRNLVFLGIAVSKPDLITWLEQEKEPWNVKRREMVDKTPVMCSH

SEQ ID NO: 23556 - protein, 81 aa, Mandrillus leucophaeus
MARGCSISKPDVITLLEQGKEPWMVVRDEKRRWTLDLESRYDTKKLFQEKDIYEMNLSQWKVMERIKSCGLEGQESPHEVC

SEQ ID NO: 23557 - protein, 81 aa, Mandrillus leucophaeus
LEMGPLTFRDVAIEFSLEEWQCLDTAQQDLYRKVMLENYRNLVLGIDVSKPNLITCLEQGKDPWNMKRHSMVVKPPVICSH

SEQ ID NO: 23558 - protein, 81 aa, Sus scrofa
SLDSVTFTDIAIDFSHDEWEWLNPAQRTLYKKVTLENYGNLVSLGLCISKPDVISLLEQGKEPWMVTGETTGGLCPDLEYV

SEQ ID NO: 23559 - protein, 81 aa, Sus scrofa
FQEAVTFKDVAVTFTEEELGLLDSTQRKLYRDVMLENFRNLLLVGNQPFKPELIFQLEREEMLLMLETEIQRGRCSGTKSH

SEQ ID NO: 23560 - protein, 81 aa, Sus scrofa
TFKEAVTFKDVAVAFTEEELGLLDSAQRKLYQEVMVENFRNLVSVGHQPFKRDTSCKEKEKLWMMNLATQVNLDKNQMIMS

SEQ ID NO: 23561 - protein, 81 aa, Sus scrofa
MTSIFQLSLSGFIFSTSLIAAENEQIPGYCVNKPNAVFKLKQGKEPWILEVEFPRRNNPEDLWNIHDQGAKHKKSQAENSR

SEQ ID NO: 23562 - protein, 81 aa, Sus scrofa
FQGLLTVEDVAIDFSPEEWECLDLGQRHLYRDVMLEICRHLVSLEYVISKPDLVRLLEQKTDPWDMKGMETVAIQPALSSH

SEQ ID NO: 23563 - protein, 81 aa, Bos mutus
VRESVTFKDVAVLFTQDEWAQLSPAQRALYRDVMLENYSNLVSLGLLGPKPDMFSQLGEGEEWMPEDSLGGFCLDWVITPT

SEQ ID NO: 23564 - protein, 81 aa, Bos mutus
SVTFTDVAVYFNQEEWTLLNPFQRKLYRNVMLENYKNLTTAVNESKRSLNHHPSISPQTQSHNGQELYDCEHSWKDFSDSD

SEQ ID NO: 23565 - protein, 81 aa, Neophocaena asiaeorientalis
ISKTSVSFKDVTVEFTLEEWQCMSSAQKTLYRDVMLENYSLLVSSGYCLTKPDVIVKLEQDDPLLLEEEILSKSHADCKLD

SEQ ID NO: 23566 - protein, 81 aa, Neophocaena asiaeorientalis
SQGSVTFRDVAVDFSREEWEWLQPAQRDLYRHVMLENYGHLVSLGLNISKPHVVSLLEQGKEPWLGKDASRGLFSASESNG

SEQ ID NO: 23567 - protein, 81 aa, Bos mutus
SLEPLTFKDIIVDLTQEEWGHLAPAHQNLYREVMLENYGNLVSVGYQLSKPGVVSQLEKGEEPWLMKREVSGGPSPGKSKA

SEQ ID NO: 23568 - protein, 81 aa, Equus caballus
LQVLVSFEDVAVLLSQEEWGLLDPAQRGLYRDVMLETYRNLVSLGLQGSKSDVISRLEQGQEPWAPHSPRIEASWIWRLRS

SEQ ID NO: 23569 - protein, 81 aa, Neovison vison
ENYKNLVSLGHQLPKPHVILQLEKGEEPWLVERGIHQETQADLETAVEIKSISSKSISKNKQSCGIKMEGIAKSDLWYLSL

SEQ ID NO: 23570 - protein, 81 aa, Neovison vison
AVSPQDLAYICKSEVPPPSKDHSCSQDVELFARNGLERRVPAGVGSQESVTFQDVAVDFTEKEWPLLDSSQRKLYKDVMLE

SEQ ID NO: 23571 - protein, 81 aa, Loxodonta africana
SQSLISFSQMTTWFYPESWGKEHWLSKNVFLKEKISNFGNFFTLGLCISKPDIISLLEQGKEPWIMKRKMTQGQGPDLKPL

SEQ ID NO: 23572 - protein, 81 aa, Capra hircus
SHTLVTFKDILVNFTREEWKLLDTAQQIMYKDVMLENYRNLVSLGHQLPKPDVILRLEKGEEPWLVEREIHQETHPDLETS

SEQ ID NO: 23573 - protein, 81 aa, Capra hircus
MLENYGNVASLGFPLLKPAVISQLEGGGELEGPSPLASGAGTDIDIQTDNNLTEEMYEEKYNISHELQRNSFQETDFSETY

SEQ ID NO: 23574 - protein, 81 aa, Capra hircus
FQEPVTFRDVAVDFTQEEWGQLGPAQRTLYRDVMLETFGHLLSVGPELPKPDVISQLEQGAELWVAERGLAQGCQTPALLE

SEQ ID NO: 23575 - protein, 81 aa, Suricata suricatta
EEWGYLSHSQWELYRDVMLENYRHLLFLGYICKECGNVFNGHSALIQHQKVHTGENAYQCVEGDKTFNYGSSVNGHRLIHN

SEQ ID NO: 23576 - protein, 81 aa, Chrysochloris asiatica
QEPVTFEDIALYFTQSQWAILNLAQKALYREEIQKHYANVASLHKTSLLPAITCPSILEQGELPWGLDPCEPVDRGTLRAV

SEQ ID NO: 23577 - protein, 81 aa, Chlorocebus sabaeus
MLATGVSARTRGCPPTTEPHAGFLVFKPELISRLEQGEEPWVLDLQGAEGTEAPRTSKTDSMIRTENEQSCEDMDILKSES

SEQ ID NO: 23578 - protein, 81 aa, Chrysochloris asiatica
LFTFRDVAVEFSQEEWECLNPAQRALYRDVMLENYRNLVSLGEDNFPSKTLSPKEIINKGELCQTLFLEGPERYGIGDFDF

SEQ ID NO: 23579 - protein, 81 aa, Suricata suricatta
KSLGSVSFKDITVDFSREEWLHLDLAQKSLYRDVMLENYFNLISVGCHVPKPEVIFHLEQEEPCVLDGDIPSHRCLDGDVG

SEQ ID NO: 23580 - protein, 81 aa, Suricata suricatta
HQEPVTFEDVAVYFTQNEWVTLDPSQRALYREVMLENYANVASLAFLFARPALVSRLERGELPWGPGPWEPSGGHALGGVC

SEQ ID NO: 23581 - protein, 81 aa, Suricata suricatta
AHGSLMFSDVSIVFSQEEWECLDLEQRDLYRDVMLENYTNLVSLGCFISKPDVISLLEQGKEPWKVVRKRRGQYADLETRY

SEQ ID NO: 23582 - protein, 81 aa, Chlorocebus sabaeus
FQQLMMFRDVAVDFCQEEWECLDLEQRDLYRDVMLENYSNMVSLGLCIYQPEVFSLLEKGKEPWKILRDETRGPYPDMQSR

SEQ ID NO: 23583 - protein, 81 aa, Chlorocebus sabaeus
FQGFVSFKDVAVNFTDEEWKELDPAQRVLYRDVMLENCRNLVSLIGCPFSKPAIISQLEEVVNPRTHMQEGEVPRSSCTGK

SEQ ID NO: 23584 - protein, 81 aa, Chlorocebus sabaeus
QTLLTFRDVAIEFSLEEWKCLDPAQQNLYRDVMLENYRNLFSIGLTVSKPGLITCLEQSKEPWNVKRQEAADGHPEMGFHH

SEQ ID NO: 23585 - protein, 81 aa, Chlorocebus sabaeus
PQRSVSFQDLTVNFTQEEWQQLDPAQRLLYRDVMLENYSNLVSVGYHVSKPDVIFKLEQGEEPWIVEEFSNQNYPIDDALE

SEQ ID NO: 23586 - protein, 81 aa, Mandrillus leucophaeus
PQEAVMFEDVAVYFTRIEWSCLAPDQQALYRDVMLENYGNLASLGFLVAKPALISLLEQGEEPGALILQVAEQSVAKASLC

SEQ ID NO: 23587 - protein, 81 aa, Mandrillus leucophaeus
RVTFKDVAVVFTKEELALLDKAQINLYQDVMLENFRNLISVGDGIKNSILNLQEKGLSYLSQEVLRCWQIWKQRIRDLTVS

SEQ ID NO: 23588 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPELTEAS

SEQ ID NO: 23589 - protein, 81 aa, Sus scrofa
RQVSVTFKDVAVTFTREEWGQLDLDQRTLYWEVMLETCGLLVSLGHPVPQPELTHLLEHRQEPWAVTRGRSRRTCTGDRAK

SEQ ID NO: 23590 - protein, 81 aa, Sus scrofa
MSFSAETVVPERSRSQVTDTCPAYTFRDFSIFPRPAKYEEILWYCIPKPELIFRLEQGEQPWILEEESPSQSYPGVCRVDN

SEQ ID NO: 23591 - protein, 81 aa, Sus scrofa
QGLLTFQVAATKFSQDEWEFTYIVQWELYRDMMLENYRNLVSLGRFWSSFRGIFLRQKSDPWDGKGMETTYPGSGTPPGEG

SEQ ID NO: 23592 - protein, 81 aa, Bos mutus
QAQLSFKDVFIDFTPEEWECLDPAQRSLYKDMMVETLRNLLSVDMSHIHMTKKLQTKASSGKGEIFQRVMFGRAESPEIKD

SEQ ID NO: 23593 - protein, 81 aa, Neophocaena asiaeorientalis
RQVGVTFEDIAVYFSWEEWRLLDEAQIRLYLDVMLENYALISSLGCCCGAEDAEAPFEQIASLGMTQARTPKAALCSQKMH

SEQ ID NO: 23594 - protein, 81 aa, Bos mutus
LTVEDVDIKFTPEEWECLDPAQRALYWDVMEETYRNNLLSVARISVSDLNLTSILVAEEDLWIVENEVQMSGNQMSYKSQI

SEQ ID NO: 23595 - protein, 81 aa, Bos mutus
TDSQVGQITAKDLSREEMVRRWSTHIRQAGQLQHGNMSSPPAGCQLSKPSVISQLEKGEEPWMTEKEGPGDPNSDLKSKTE

SEQ ID NO: 23596 - protein, 81 aa, Nomascus leucogenys
TTFKEAVTFKDVAVFFTEEELGLLDPAQRKLYQDVMLENFTNLLSVGHQPFHPFHFLREEKFWMMETATQRDGNSGGKTVA

SEQ ID NO: 23597 - protein, 81 aa, Equus caballus
RYSSMTFSDVAIDFSQQEWEGLDPVQKTLYQDVMVESYRNLVSLGIHSNSKPDVITLLEQGKEPWMVVREETRRCYTSKYE

SEQ ID NO: 23598 - protein, 81 aa, Equus caballus
SQGPVSFKDVAVDFTQEEWQQLDPDEKMTYRDVMLENYSHLVSLGYDSTKPNVIVKLEQGEEPWVAEGEFPCRGHAEIWKV

SEQ ID NO: 23599 - protein, 81 aa, Neovison vison
VMLENYGNLTSLGYPVPKPILISLLEGENLPWGLEAQENPSAEGTKDICKDTETSIGNESTSTQGLSEERDVILLHGLRKS

SEQ ID NO: 23600 - protein, 81 aa, Neovison vison
LLAPAQKNLYRDVMLENYRNLVSVGYKASKPDAISRWEQGELWTTEDEIHSQICPEIKKDDGHLQGHLQNQRCPKRMIQCH

SEQ ID NO: 23601 - protein, 81 aa, Capra hircus
ISQERLTSEDVAIEFTQEEWEFLDPAQRALYRDVMLETYGNLLSVGEDDFLPELPLGICIFPVCPLGGPDVFHLRVLVTGA

SEQ ID NO: 23602 - protein, 81 aa, Capra hircus
RLTSEDVAIEFTQEEWEFLDPAQRALYRDVMLETYRNLLSVDISPTHVIKHLQPKANSDKLETFQTLMLGNPESCEIKYFH

SEQ ID NO: 23603 - protein, 81 aa, Capra hircus
WKAWVKKPVTFEDVAVNFTQEEWKCLDASQKVLYQDVISETVRNLMSVDLIAKLEQEKKQWEADLCSPNGEGFHSGGEKEE

SEQ ID NO: 23604 - protein, 81 aa, Capra hircus
AQETLSFKDVAVDFTWEEWQLLAPAQKTLYRDVMLENYSNLVSVGYRVSKSDVLSKLEQGKERWMTEDEIHSRTWPETGNI

SEQ ID NO: 23605 - protein, 81 aa, Capra hircus
IAAAGPAEAAKEWEQLDPAQKSLYKDVMLENYSNLASMGYQALKPDMISKLEKGEEPWLGKGKRPKQAGSKVHQDDDQLKN

SEQ ID NO: 23606 - protein, 81 aa, Suricata suricatta
SLETVTFKDVAVDLTQEEWQQLKPAQRNLYRDVMLENYSNLVTVGYQVTKPDVIFRLEQEEEPWVVEEEMLGRHCSEVWEV

SEQ ID NO: 23607 - protein, 81 aa, Chrysochloris asiatica
SLATVTFTDVAVDFSQEEWQQMKPAQRNLYREVMLENYSNLVTVGCQVTKPDVIFKLEQEAEPWLVKETMFGRHWSGGGVL

SEQ ID NO: 23608 - protein, 81 aa, Chlorocebus sabaeus
MFRDVAIDVSQEEWECLNPAQRNLYKEVMLENYSNLVSLGLSVSKPAVISSLEEGKEPWMVVREETGRWCPDLASRDEPQK

SEQ ID NO: 23609 - protein, 81 aa, Chrysochloris asiatica
SQGLLTFRDVAVEFSQEEWDCLEPAQRALYRDVMLENYRNLVSLGISVSELNIISVLEQGTESWTVEWKEKRAKYPDVSEF

SEQ ID NO: 23610 - protein, 81 aa, Mandrillus leucophaeus
PQGLLTFRDVAIEFSQEEWKCLDPAQRTLYRDVMLENYRNLVSLEFRSVTQAKVQWCDLGSLQPPLPRFKQFSCLSLPSSW

SEQ ID NO: 23611 - protein, 81 aa, Suricata suricatta
MTFKDVAVEFTQWEWGQLDPSQKDLYREVMLENFKNLASLGLPVSKPYVICQLEEGEEPCVVEGEISTDWEKRPKTKESML

SEQ ID NO: 23612 - protein, 81 aa, Mandrillus leucophaeus
MLENYRNLVFLGIAVSKPDLITCLEQGKEPWNVKRHEMGAEPPVVCPYFAQHLWPKQGIKNYFQKVILRRYKKCGHENLQL

SEQ ID NO: 23613 - protein, 81 aa, Mandrillus leucophaeus
GVNKMSNEELVGQNHGMEGEACVGGDRDLYKDVMVQNYKNLVSVTGLSVTKPYVITVLEDGREPWMVEKKLSKGMIPDWES

SEQ ID NO: 23614 - protein, 81 aa, Sus scrofa
QGSCRCLDLTLQVSVTFDDVAVTFTQEEWGQLDPAQRTLYQEVMLENRGLSIHVATHMPCFSSWLLPLTLLPTLSFAPQHV

SEQ ID NO: 23615 - protein, 81 aa, Sus scrofa
VTFDDVAVTFTQEEWGQLDPAQRTLYQEVMLENRGLLVSLGERYRLEGGLEVFQPRSFRVFSSSLPPRIDVWPSVPEESST

SEQ ID NO: 23616 - protein, 81 aa, Sus scrofa
SQETSAFRDMFVDFTLEEWQQLDAAQKTLYRDVTLENYSHLLSVGYLVAQPEGIFSLGQAEGAGKADGEAPTITDIMVHIQ

SEQ ID NO: 23617 - protein, 81 aa, Trichechus manatus
MEDVAVVFSQEEWALLDLAQRKLYRDVMMETFRNLASIVSRNLNDEQKLSSEQIMARFMKNNTWSSMLGEISKSPRYKDQH

SEQ ID NO: 23618 - protein, 81 aa, Trichechus manatus
QERVNFKIVTVVYTQEEQGTLNSAQKILDRDVMLENHRDLVSWDLATAHDRRESVSKLSTFDEEPSHGVKIERLARGDPWL

SEQ ID NO: 23619 - protein, 81 aa, Zalophus californianus
MYFSQEEWELLDPTQEALYNDVMRENYETVISLALFVLPKPKVISYLEQGEDPWVQGPLELKNSPGELPSGLKVKTDNENH

SEQ ID NO: 23620 - protein, 81 aa, Zalophus californianus
MDAVVFADVAVYFTPEEWALLDRGQRRLYRDVMLETCRNLASLDCCIQVKPCGSGTQLNILENELSSEDKIVRFTRNDSWA

SEQ ID NO: 23621 - protein, 81 aa, Zalophus californianus
AAPALTFKDVAVTFTGEEWRHLDLAQRTLYREVMLETCGLLVSLGHPVPKPELTYLAEDGQELWTVRRGLSRSTYTGEKAK

SEQ ID NO: 23622 - protein, 81 aa, Zalophus californianus
PQGLVTFGDVVVDFTPEEWQYLNPPQKTLYREVMLETYSNLVSVAGPQVTKPDLILKLEVEEPCPAETKISFWSFPAACQI

SEQ ID NO: 23623 - protein, 81 aa, Equus caballus
FQESVTFEDVAVYFSENEWTGLAPAQRSLYRDVMLENYGAVSSLAFPFPKPALISQLERGEAPWCSAPQGVLDGEGPRGIS

SEQ ID NO: 23624 - protein, 81 aa, Equus caballus
HQEVVTFEDVAVCFTRAEWAGLSPAQRALYRSVMLENYGNLTSLGYPIPTPALISLLEGGDLSWGLEAQDDPPAERTTDIC

SEQ ID NO: 23625 - protein, 81 aa, Loxodonta africana
PKVPVTFDDISIFFSTPEWEKLEEWQKELYKNIMKGNYESLVSMDYAMNQPDVLSQIQPEGEHNPGGQAGPEESQIPTDPS

SEQ ID NO: 23626 - protein, 81 aa, Chlorocebus sabaeus
PRGSTFFSSVTVAFAREGWRCLVSTPRERYKEGIPEKSRNLVLLGLPVSQPGMNSQLEQREGTWMLEGKDVRSPSPGWKIV

SEQ ID NO: 23627 - protein, 81 aa, Suricata suricatta
KDQESLTLEDVAVDFSREEWQLLAPAQKDLYRDVMLENYRNLVSLGYVASKPEALSRLEPGGVWMTEGETHHRICPEIKKD

SEQ ID NO: 23628 - protein, 81 aa, Suricata suricatta
KIEGLVIVRDVAIDFSQEEWECLDPAQRDLYRDVMTENYSNALLGLSMPKPDVISLEQEKELWIVLRNRMGGWCPDRFKNV

SEQ ID NO: 23629 - protein, 81 aa, Suricata suricatta
FKEAVTFKDVAVVFSEEELGLLDPAQRKLYGDVMLENFRNLLSVGHGPFTPDVMPQFERGVALWMIKAAAPSQGSSGDKNL

SEQ ID NO: 23630 - protein, 81 aa, Suricata suricatta
QAEVTFEDVAVLFSREEWGRLGPAQRGLYRDVMLETYRNLASLGAGRAGSKPGVITQLERGDEPWVLDAQGAKGKGQPRVS

SEQ ID NO: 23631 - protein, 81 aa, Chrysochloris asiatica
QGGVTFEDVAIDFSQEEWGLLDEAQRLLYCDVMLETFAVTASLARPGLGSALLRAVYSLNSPNCAGKERQETSSRMQPPFL

SEQ ID NO: 23632 - protein, 81 aa, Chrysochloris asiatica
MPDLLTLEDVAVEFTREEWQLLAPAQKALYRDVMLENYSHLVSVGHQVSKPDALSQLQEEQPWTVLDNSCNRNFSEIWKVD

SEQ ID NO: 23633 - protein, 81 aa, Chrysochloris asiatica
FQEAVTFKDVAVVFSEEELRLLDFTQRTLYRDVMVENFKNLVSVGHHPFKLDMLFQLEAEEKLWMMETETQRSEYSRSRNP

SEQ ID NO: 23634 - protein, 81 aa, Chlorocebus sabaeus
MGLLTFRDVAIEFSLEEWQCLDTAQKNLYRNVMLENYRNLAFLGIAVSKPDLIICLEKEKEPWNMKQHEMVDEPPGICPHF

SEQ ID NO: 23635 - protein, 81 aa, Chrysochloris asiatica
GPVTFEDVTVVFTEAEWKRLSSEQKNLYREVMLEIYRSLLSLDKALKKLESSRFGAVSCGENGADCGLNSNFITNQKPVSR

SEQ ID NO: 23636 - protein, 81 aa, Suricata suricatta
MQPLMQHLGLRDLKGVQLAQACLRFSFTGYDSTKPKVILKLEQGEEPWVAEGELPCQSHPEARKADHMMEGIPENGDGLSR

SEQ ID NO: 23637 - protein, 81 aa, Chrysochloris asiatica
MGTVIIEDVAVVFTHEEWDLLDPAQRKLYRDVMMETLRNLASVGAVMESHGWKDHLDNQGRHLRIGTIKNLGERCEHNQCG

SEQ ID NO: 23638 - protein, 81 aa, Suricata suricatta
MSLGRRLFVDLALPVWQGHVNFEDVARLLYRDVMLENLTLMASLGYESSTSRTDASLELGTQPWVSDWAYLTPARTREAQG

SEQ ID NO: 23639 - protein, 81 aa, Chlorocebus sabaeus
MLFVFNKTGIVVSKPDLITSLEQGEKPLTMKKHEMVAKPPVLCSHFTQDLWPEQNIKDYFHKGILRRYEKCGHDNLQFKKG

SEQ ID NO: 23640 - protein, 81 aa, Sus scrofa
SQASVSFKDVTVEFTQEEWQQMGPIQKTLYRDVMLENYNNLVSVGNCIFKPEVIFKLEQGEEPWFLEEEFSNQNHKEDYRD

SEQ ID NO: 23641 - protein, 81 aa, Mandrillus leucophaeus
DSVVFEEVAVNFTPEEWALLDHAQRSLYRDVMLETCRNLASLDCCIYVRTCGSSSQRDVLGNGISNDEEIVKFTSDYWSIF

SEQ ID NO: 23642 - protein, 81 aa, Mandrillus leucophaeus
NGLLTFRDVAIEFSQEEWKCLDPAQRTLYRDVMLENYRNLVSLDISSKCTMKEFSSTAQGNTEVIHRETMQRRERHHIGDF

SEQ ID NO: 23643 - protein, 81 aa, Mandrillus leucophaeus
VHGSVTFRDVAIDFSQEEWECLQPDQRTLYRDVMLENYSHLISLGSSISKPDVITLLEQEQEPWMVVRKETNRWYPDLESK

SEQ ID NO: 23644 - protein, 81 aa, Sus scrofa
MFQVTFSDVAIDFSHEEWGWLDSAQRDLYKDVMVQNYENLVSLAGLSIPKPYVIALLEDGREPWMVEEKLSKSLFPDWESR

SEQ ID NO: 23645 - protein, 81 aa, Mandrillus leucophaeus
SQHLVTFKDVAVDFTQEEWTLLDQTQRDLYRDVMLENYKNLIILAGSELCKTSLMSGLEQMEELRTGVTGVLQERSNTAEK

SEQ ID NO: 23646 - protein, 81 aa, Sus scrofa
MAAPSPYDNRISRPSVISHLEQKEEPWILPLQNFEASKIQRESHTDFKNQVVKLNQDIISETAEPGGTSTERANKDISHMP

SEQ ID NO: 23647 - protein, 81 aa, Sus scrofa
NFWILRLPPGSKGEAPKEWGKLDEWQKELYKHVMRGNYETLVSLDYAISKPDILSRMERGEEPCPEGTWGREEGRQSEEAR

SEQ ID NO: 23648 - protein, 81 aa, Neophocaena asiaeorientalis
LQELVTFQDVAVDFTQEEWEHLDPSQRHLYREVMLENYGNLISLGRLLSKPEMISHFEQEDDVWMEKKIPRSSYSGDKPCR

SEQ ID NO: 23649 - protein, 81 aa, Loxodonta africana
LQEPVTFRDVAVDFTQEEWGQLDPAQRTLYRDVMLETFGHLVDVGPELPKPDVISQLEQGAELWVAESGLAQGCCPGWQTR

SEQ ID NO: 23650 - protein, 81 aa, Loxodonta africana
FQSSVTFGDVAIDFSQEEWECLDPAQRDLYRDVMWENYSNLASLDLESSYKTNNLSPEKDIYEIYSFQWEIMERIKSYSLQ

SEQ ID NO: 23651 - protein, 81 aa, Loxodonta africana
VSFKDVAVELTQEEWQHMGPAQRTLYRDVMLENYSHLVSVGYCITKPEVIFKLEQGEEPWSLEEESPNHSYLGEFLNPGRR

SEQ ID NO: 23652 - protein, 81 aa, Capra hircus
GQSRVTFEDVAVYFSQEEWCLLDEAQIQLYLDVMLENVALVCMLGSWPGVGDEETPFEQSKSAGVSQIGTPRTDSSAEKVQ

SEQ ID NO: 23653 - protein, 81 aa, Capra hircus
PGESLTFKDVAVNFTQEEWHHVDAAQRRLYRDVMLENYSHLVFLGYQVSKPEVIFKLEQGEEPWIAEGEIQRPVCPDWKTR

SEQ ID NO: 23654 - protein, 81 aa, Capra hircus
CQDPVTFEDVAVVFTDEEWRSLVPTQRDLYKEVMLENYKSIVSLGLPIPGPDVIFQLKRGDEPWLVECHEFEGKEGAENVS

SEQ ID NO: 23655 - protein, 81 aa, Capra hircus
RLTSEDVAIKFTQEEWEFLDPAQRALYRDVMLETYRNLLSVDISPTHVIKDLQPKVNSDKRETFQTLMLGRPKSCEIKHVH

SEQ ID NO: 23656 - protein, 81 aa, Capra hircus
MLENYANITSLAFPFPKSDLVFWLKRGEEPGRLDPWTLVGREHPRGTCRGRETKTENGGQTAELGISKGPESHKLITEVLL

SEQ ID NO: 23657 - protein, 81 aa, Capra hircus
WSQMPVTFEDVALYLSREEWGRLDHTQQSFYREVLQKRSGLSLGFPFNRPFWASQVQGKGEAPGSSRQLGHEEEKRGVVEA

SEQ ID NO: 23658 - protein, 81 aa, Chlorocebus sabaeus
MGVLTFRDVAIEFSPEEWECLDAAQQCLYRDVMLENYRNLVSLGLAIFKPDLMTCLEQRKEPWKVKRQEAVVKHPAGSFHF

SEQ ID NO: 23659 - protein, 81 aa, Chrysochloris asiatica
LQGPVTFKDITVEFTQEEWQLLSPAQKTLYRDVMLENYRHLISVGYRVNKPNAVFKLKQGKEPWMLEVEFPHQGYPGENGK

SEQ ID NO: 23660 - protein, 81 aa, Chrysochloris asiatica
LQEAVTFKDVAVVFSEEELGLLDSAQRTLYRDVMLETFQNLVSLGHQPFKPDVISQLEREEMLWMKGLQTGRGRCSGGRNQ

SEQ ID NO: 23661 - protein, 81 aa, Chrysochloris asiatica
MVQNYENLVSLGLSKPKPYVITLLEEGKEPWMVEKKPSEDMFSDWESRRENNELAAKERMYGDIPQNVIIEKSIKQDPGCS

SEQ ID NO: 23662 - protein, 81 aa, Suricata suricatta
MPANQTSPGPSVALAVGRCDDLCKGSVSFEDVTVDFSREEWQQLDSTQRRLYQDVMLENYSHLLSLGKQSHSKNLQGACYG

SEQ ID NO: 23663 - protein, 81 aa, Chrysochloris asiatica
VQVSVTFKDIAVLFTRAEWRTLDPSQRNLYRDVMLENYSNLVSLGPPFSKPKVISLLQQGEDPWKVEKENLGGSSLGWKNC

SEQ ID NO: 23664 - protein, 81 aa, Chlorocebus sabaeus
MLENYRNLVWLGLSISKPNMISLLEQGKEPWMVERKMSQGHCADWESWCEIKELSPKWFIDEDEISQEMIMERLTSHGLEC

SEQ ID NO: 23665 - protein, 81 aa, Chlorocebus sabaeus
DSVAFEDVAVNFTLEEWALLDPSQKNLYRDVMRETFRNLASIGKQWEDQNIEDPFKIPRRNIRSHIPERLCESKEGSQGEE

SEQ ID NO: 23666 - protein, 81 aa, Chlorocebus sabaeus
MLFISNKAGIAVTKPDLITCLEQGKEPWNIKRHEMVAKPSVICSHFAQDLWPEQDIKDSFQEAILKKYGNYEHDNLQLQKG

SEQ ID NO: 23667 - protein, 81 aa, Suricata suricatta
SYEGSVSFRDVAVDFSREEWQHLDVAQRNLYRDVMLETYSHLLSVGYDVPQPEVFMLEQGKEPWVLKGESPHQSCPGEKLW

SEQ ID NO: 23668 - protein, 81 aa, Suricata suricatta
KEAVTFKDVAVAFTEEELGLLDSAQRKLYQDVMLENFRNLVSVGHQPLKQDKWHLEREEKRSLMKTATQLERNVGGNSQSE

SEQ ID NO: 23669 - protein, 81 aa, Chrysochloris asiatica
GKATDSLTLEDVTVNFTPEEWALLDDSQKKLYKDVMMETFENLNSVFQQADYREKFSVNKDFWSSVLEFFQFSDVEDENND

SEQ ID NO: 23670 - protein, 81 aa, Suricata suricatta
NLSQRELYRDVMLENYGHLLFLGLVVSKPDLVIFLEQQRDLWDMQRKMTVASYPGSANLIHKSIHLEENPFKYNEYGKTLN

SEQ ID NO: 23671 - protein, 81 aa, Suricata suricatta
AQESLTLDDVAVNFSREEWQLLAPTQKSLYRDVMLENYRNLVSVGFHPSKPDVLPKLEQGKPAGTVEDGIPCRTRSEIWKL

SEQ ID NO: 23672 - protein, 81 aa, Suricata suricatta
MDPGDVTFKDVAVYFSQEEWGLLEEAQRLRDVMLENLTLMASLGYESSTSCRDASLELGIKPWVSDWADLTPARTREAQGC

SEQ ID NO: 23673 - protein, 81 aa, Chrysochloris asiatica
DAVAVEDVAVDFTQDEWALLDLPQRKLYRDVMMETFRNLASVEGSFVVWDLGKTLIVRIRDSRYDFTENRSHLPISREPEP

SEQ ID NO: 23674 - protein, 81 aa, Chlorocebus sabaeus
ILQDQISFEDVAVDFTLEEWQLLNPTQKNLYRDVMLENYSNLIFLGYQILKPDVIFKLEQQDPWIIGQEILNQNFSEVWLD

SEQ ID NO: 23675 - protein, 81 aa, Suricata suricatta
RSVGPVSFRDVAVDFTQEEWQQLDPEQKTTYRDVMLENYSHLVSLEVRKVEDLVERVQETEGKHSRQAVSINKTLTEGRGN

SEQ ID NO: 23676 - protein, 81 aa, Chlorocebus sabaeus
FQGSVTFEDVAIAFSQQEWESLDSSQRGLYRDVMLENYRNLVSMAGHSLSKPHVIALLEQWKEREVTVRKDGRRWYTDLQL

SEQ ID NO: 23677 - protein, 81 aa, Chrysochloris asiatica
PQGLVTFDDVAVDFSHEEWEWLNVAQRSLYQTVMLENYRSLLSLGLCVSKPDLIFLLEEGQEPWMVRETTGDQGPDLTPLQ

SEQ ID NO: 23678 - protein, 81 aa, Chlorocebus sabaeus
DSVVFEDVAVDFTQEEWALLDLAQRNLYREVMLENFQNLASLGYLLHTPHLICQWEQEEDLQTVKTELIQGSIWSCFETQL

SEQ ID NO: 23679 - protein, 81 aa, Suricata suricatta
LQSPVTFEDVTVYFSKEEWGLLDAGQRDLYHNVMLENFELMTSLGCWHGVEDEGAHSKQNASVQGMLQVKIPIANPSTQKA

SEQ ID NO: 23680 - protein, 81 aa, Suricata suricatta
DLALLQEEHSGDQENGHGAPESQKREIPFSKPKLICQLEQGEEPWIEENPHPLGLCPGSKLEVEPGPPCPRALSGQQGLSQ

SEQ ID NO: 23681 - protein, 81 aa, Sus scrofa
CKESVIFKDVCVNFSLEEWECLDLTQRNLYRCVMLENYSNLVSVGLSIPKPDVISLLEQGKEPWGVFDSEMTRGLNQDCGS

SEQ ID NO: 23682 - protein, 81 aa, Suricata suricatta
RQVSVAFQDLAVRFSEDEWQLLGEGQRALYRDVMQENYETLLSLGTAELLPLSAFLSPAEPDRAMEGRSCAGEGQEPPGGQ

SEQ ID NO: 23683 - protein, 81 aa, Sus scrofa
MLENYSHLVSLGCCITKPQVIFKLEQGEEPWSSEEEFLNQSIPGYYKVDDHIEENQEKQEKHSWQVIFIDNKILSKEEQKV

SEQ ID NO: 23684 - protein, 81 aa, Mandrillus leucophaeus
GTVTFEDVAVKFTQEEWNLLSEAQRCLYRDVMLENLALISSLGCWCGVEDEAPSKQSIYIQRETQVRIPMAGVSPKKAHPC

SEQ ID NO: 23685 - protein, 81 aa, Mandrillus leucophaeus
RPESVTFEDVAVYFSESEWIGLGPAQRVLYRDVMLENYGAVASMAFPFPKPALISQLERGEAPWCSVPWGALDGEDPRGIS

SEQ ID NO: 23686 - protein, 81 aa, Mandrillus leucophaeus
MELLTFRDMAIEFSPEEWKCLDPSQQNLYRDVMLENYRNLVSLGVTISNPDLVTCLEQRKELYNFKIHQTAARPSAVCSHF

SEQ ID NO: 23687 - protein, 81 aa, Mandrillus leucophaeus
YQDLLIFEDTAVDFTQEEWTLLDPVQRNLYRDVMLENYENVAKVGFQLLKPSVISWLEEEELRTLQQGVPQDWAMKHQTSV

SEQ ID NO: 23688 - protein, 81 aa, Sus scrofa
QVSVTFQDVAVDFTGEEWQLLGCAQRKALYKAVMLEISGNLVLVGEDSCSLENFLFLWLLKASQPGGRPTAPVRAAVPTRA

SEQ ID NO: 23689 - protein, 81 aa, Sus scrofa
FQEPVTFEDVAVYFTQNQWASLAPAQRALYREVMLENYVNLTSLAFPFSKPDLIFQLERGEALRGVCTGGKTKTENGGQTP

SEQ ID NO: 23690 - protein, 81 aa, Sus scrofa
ERGHSWFPLFSSWQGSVTFEDVYLAMTFTWEEWGELDQAQKTLYREVMLETCGLLVSLGKAHLPSMLLCRLKGIVCTCIYA

SEQ ID NO: 23691 - protein, 81 aa, Sus scrofa
SQGLLTIEDVAIDFSPEEWECLDLRQRELYRDVMIEIYKHLVSLALSSHDTQSLMPQNPGMEFFLQTMLLGKYKSYPVGTF

SEQ ID NO: 23692 - protein, 81 aa, Sus scrofa
TQDPVIFEDVAVDFTQEEWALLDLAQRNLYRDVMLENFQNLASLGYPLHTPYLISQWKEEEDLETVERGPTQGDHQEGFET

SEQ ID NO: 23693 - protein, 81 aa, Sus scrofa
TGLQLPKPDVILRLEKGEDLWPVERGIRQEPCPDLDTAVEIKSISSQSVSKDKQFCDIKVERKAKNDLWYLSLEEVWTCES

SEQ ID NO: 23694 - protein, 81 aa, Equus caballus
TDALVTFSDVAIGFSQEEWECLDPAQRDLYMDVMLENYSNVASLDLESTDETKNTFSEKDNSEIKFSQWEIKERSKTLGLE

SEQ ID NO: 23695 - protein, 81 aa, Equus caballus
LQEAIVFEDVAVYFTRIEWSCLAPDQRALYRDVMLENYGHVASLGCLVAKPALISLLEQGEEPGALILQVAEKRETRASLC

SEQ ID NO: 23696 - protein, 81 aa, Equus caballus
PQVSVSFKDVTVEFTQEEWRQMDSTQRTLYRDVMLENYSHLVSVGYCFTKPELIFTLEQGDDPWLLKKELLSRSSPEESQP

SEQ ID NO: 23697 - protein, 81 aa, Equus caballus
SQESVTFQDVAVDFTEKEWPLLDSSQRKLYKDVMLENYSNLASVGCQVGKPSLISHLEQEEELRTEERGLHRGSCPDWETP

SEQ ID NO: 23698 - protein, 81 aa, Equus caballus
QPLESVTFEDVAIDFTQEEWALLDTSQRKLYRDVMLENVSHLVSMGYQHCKSDVIFHLEQEELWSEGTGFLQGQSPGRESG

SEQ ID NO: 23699 - protein, 81 aa, Equus caballus
KEPVTFKDVAVTFSEEELGLLDHAQRQLYRDVMLENFQNLLSVGGKIQSKIETVSEAGPHEELSCWQIGQQIASDLTECQD

SEQ ID NO: 23700 - protein, 81 aa, Neovison vison
WSQMPVTFEDVALYLSREEWGRLDHAQQSFYRDVLQKRNGLSLAGFPFSRPLWGSQGQGKGEASSSSQQMGDDKEKAGAIE

SEQ ID NO: 23701 - protein, 81 aa, Capra hircus
AHGSVTFRDVAIDFSQEEWEFLDSAQRDLYRDVMWENYSNFISLAGPSMSKPDVITLLDEGKEPWMVVREGTGRHHPDLES

SEQ ID NO: 23702 - protein, 81 aa, Chrysochloris asiatica
IWGSVMFSDVSIVFSQEEWEYLDLEQKDLYRDVMLENYSNLVSLGCFISKPDVISLLEQGKEPWKVVRKGRSQHPDLKTRY

SEQ ID NO: 23703 - protein, 81 aa, Capra hircus
TSEPVSFADVAVYFSPEEWGCLRPAQRALYRDVMRETYGHLGALGFRGTKPALISWVEEEAELWRPDAGPPEMGECLTEAD

SEQ ID NO: 23704 - protein, 81 aa, Suricata suricatta
MSFKGVTVDFTRDEWLQLTGTQRTLCRGVMLENYSHPAAVGCRLAKPEVTFKLEQGEELWPSRRESPDEGDQGELVTMEKE

SEQ ID NO: 23705 - protein, 81 aa, Chlorocebus sabaeus
VTLRDVVINFSQEEWEYLNSAQRNLYWDVMMENYSNLLSLDLESRNETKHLSVGKDIIKNTGSQWEVMESSKLRGLESSIF

SEQ ID NO: 23706 - protein, 81 aa, Suricata suricatta
IGLRRFSPLNSVIIALFPVKCGYFFKEQVESNSLDPILSCPVLTGYQVPKPEVIFKLEQGEEPWILERKTPHQSCSDGRFE

SEQ ID NO: 23707 - protein, 81 aa, Sus scrofa
MLENYCHLISVGCHMTKPDVILKLERGEEPWTSFTGHTCLEENWKAEDFLVKFKEQQNKYPRSVLLINHKKLIKDNNNAFE

SEQ ID NO: 23708 - protein, 81 aa, Mandrillus leucophaeus
DVIVEFTKEEWKLLTPAQRTLYKDVMLENYSHLVSVGYHVNKPTAVFKLKQGKEPWILEVEFPHRVLPFKHQKTRTTEKAY

SEQ ID NO: 23709 - protein, 81 aa, Mandrillus leucophaeus
FQEAVTFKDVAVAFTEEELGLLDSAQRKLYRDVMLENFRNLVSVGHQSFKPDMISQLEREEKLWMKEFQTQRGKFLCIFSS

SEQ ID NO: 23710 - protein, 81 aa, Sus scrofa
LVLFTDVAIDFSQEEWECLDLQQKDLYRDVMLENYSNLVSLEWESRCETRKLSSKGEIYELEASQWEIIEQLTSHKYKCKS

SEQ ID NO: 23711 - protein, 81 aa, Sus scrofa
MIDFLFYSEALNLMSLAQFPCHFPFTGYCIPKPELIFRLEQGEQPWILEEESPSQSYPGVCRVDNQLEQSQEIQNRQFWQA

SEQ ID NO: 23712 - protein, 81 aa, Equus caballus
SVTFHDVAVYFSRGEWRLLDEAQRRLYLDVMLENFALLSSLGCCCGAEGLEAPFERSVSVEVSAARAPKAAPSSQKTHPCE

SEQ ID NO: 23713 - protein, 81 aa, Loxodonta africana
SQGLVTIKDVSLCFSQEEWRSLDPSQTDFYGEYVMQENCGIVVSLRFPIPKLDMLSQLEGGEEQWVPDPQDLEDRDILRVT

SEQ ID NO: 23714 - protein, 81 aa, Loxodonta africana
FQDLVTFGDVAVDFSQEEWEWLNPAQRTLYRKVMLENYRSLVSLGASVSKPDVISLLEQGKEPWMVKKEGTRRTYPDWEYI

SEQ ID NO: 23715 - protein, 81 aa, Capra hircus
SQESVTFEDVAVDFTQEEWALLDTSQRKLFRDVMLENISHLASVGNQLYKSDVISHLEQGEQLSKEGLGFLQSQSPVISDR

SEQ ID NO: 23716 - protein, 81 aa, Capra hircus
MAFRDVAVDFTQDEWVLLSPAQRSLYREVMLENYSNLVSLGIPFSKPKLITQLEQGKETWREERKCSLHILAFLLQGGHRH

SEQ ID NO: 23717 - protein, 81 aa, Capra hircus
LQETLTFRDVFVDFTQEEWQQLDAAQKNLHRDVMLENYSHLVSVGYLVAQPHGIFRLGQGEEEARMAAGESVMWSCPEFWK

SEQ ID NO: 23718 - protein, 81 aa, Chlorocebus sabaeus
FQNLMTFEDVAVEFTQGEWGQLNPAQKDLYREVMLENFRNLAFLGLPVSRPYVICQLEEGGEPFIVEREISTGAYSGHLLG

SEQ ID NO: 23719 - protein, 81 aa, Chlorocebus sabaeus
MLENYSNLVSVGYQASKPDALSKLEQGEPWMVENEIHSQICPEIKKVDNRLQMHSQNQRCLKRVEQCHKHAFGNIIHQRKS

SEQ ID NO: 23720 - protein, 81 aa, Chlorocebus sabaeus
ACESITFGDVAIDFSHQEWEYLNLVQKTLYQEVMMENYDNLVSLGHSMSKPDLITLLEQGKEPWMIVGEETRGECTDLDSR

SEQ ID NO: 23721 - protein, 81 aa, Suricata suricatta
SQELVTYEDVAVDFTQEEWQNLDPAQKILHRDVMLEIYSHLISVGCSGINPGKIFKLEYEEDPGFMKSELSRWTHSDREKS

SEQ ID NO: 23722 - protein, 81 aa, Suricata suricatta
SVGPVSFRDVAVDFTQEEWQQLDPEQKTTYRDVMLENYSHLVSLGCHIIKPEVIIKLEQGEEPWIVEGEFLPHSYPEVRKV

SEQ ID NO: 23723 - protein, 81 aa, Chlorocebus sabaeus
QESLTLEDVAVDFTWEEWQLLGPAQKDLYRDVMLENYSNLVAVGTGYQASKPDALSKLEQGEEPCTTEDEIYTRICCEIRK

SEQ ID NO: 23724 - protein, 81 aa, Suricata suricatta
LQEQVSFKDVCVDFTQEEWYLLDPAQKILYRDVILENYSHLVSVGYCFTKPEVVFKIEQGEEPWIVEAGFPSHCHQEDWKV

SEQ ID NO: 23725 - protein, 81 aa, Suricata suricatta
MDFTLEDWEQLGLDQGDLFWDTALDNYQNLFLLNPCKPKLTSYPDGGKELEAVVRESPKSEGLAPYFSPRGTGDVSTLPPS

SEQ ID NO: 23726 - protein, 81 aa, Suricata suricatta
FEGSVSFEDVAVDFTRQEWHSLDPAQRTMHKDVMLENYSNLASVGLCVAKPEMIFKLERGEELWLLEEESSGHGYPGSLSL

SEQ ID NO: 23727 - protein, 81 aa, Chrysochloris asiatica
PQAAVTFEDVAVLLSQEEWDRLGPAQRGLYRNVMMETYGNVVSLGLPGSKPDVISQLERGEAPWVLDGKEAEGREHLRNGH

SEQ ID NO: 23728 - protein, 81 aa, Chlorocebus sabaeus
MGLLTFRDVAIEFSQEEWEYLDSDQKLLYGDVMLENYRNLVSLGLAVSKPDLIITFLEQRKEPWNVKSEETVALQPDIFSH

SEQ ID NO: 23729 - protein, 81 aa, Mandrillus leucophaeus
CQESVTFEDVAVVFTDEEWSHLVPIQRDLYKEVMLENYNSIVSLGLPVPQPDVIFQLKRGDKPCVVDLHGSEERERPESVS

SEQ ID NO: 23730 - protein, 81 aa, Sus scrofa
MFSDVSIDFSQEEWECLNDDQRALYRDVMLENYSNLVSMAGHSISKPDVISFLEQGKEPWLVDRELTRGQWPVLESRCETK

SEQ ID NO: 23731 - protein, 81 aa, Sus scrofa
GLLSFSDVAVDFTWEEWQLLDTVQKDLYRDVMLENYSNLMSLGKDNFPNNRSICPLIACLFSIATIYGYLDALNDFELGLV

SEQ ID NO: 23732 - protein, 81 aa, Equus caballus
PLGPVSFKDVAVDFTQEEWQQLDPEQKTTYRDVMLENYSHLVSLGCHIIKPEVIIKLEQGEEPWIVEGEFLLQSCPEEVWK

SEQ ID NO: 23733 - protein, 81 aa, Equus caballus
FQGSLTFSDVAIAFSQQEWEGLDPVQKTLYQDVMMENYRNLLSLAGHAISKPGVITLLEQGKEPWMVVREETRRWCPGKVC

SEQ ID NO: 23734 - protein, 81 aa, Equus caballus
GSVSFTDVTVDFTQEEWEQLDPSQRILYMDVMLENYSNLLSVEVWKADDQMERDHRNPDEQARPCIIFKNQTPIEEKDNLF

SEQ ID NO: 23735 - protein, 81 aa, Equus caballus
GQGSLSFRDVAVGFTRKEWQQLDPTQRTLYRDVMLENYSHLVSVGCQVSKPAVISRLEQGQEAWVEDEEILEWSFPEEALR

SEQ ID NO: 23736 - protein, 81 aa, Loxodonta africana
AGCSLSKPDVISFLEQGKEPWVVDRELTRAHWPVLESRCETKKLYLKKESYKIEPSQWEIMERLTRHHLRCSSFRGDWECN

SEQ ID NO: 23737 - protein, 81 aa, Capra hircus
CVTFEDVAIYFSQEEWGLLDEAQRHLYHKVMLENFALTASMVCLHETETKETSSEQNLSLEALSQIRTPKVGPVTENAHPC

SEQ ID NO: 23738 - protein, 81 aa, Capra hircus
RGSVTFEDVAVYFSWEEWALLDEAQRCLYHDVMLENFALTSSLGCCHGVEDKGAPSENSISVEGMSQIKTLKADSSPQKGQ

SEQ ID NO: 23739 - protein, 81 aa, Capra hircus
FRDVAIDFSQEEWEFLDSAQRDLYRDVMWENYSNFISLDLESRYSANILSSEKDIYEVYSFQWEIMERVKSYSLQDSIFRN

SEQ ID NO: 23740 - protein, 81 aa, Chlorocebus sabaeus
TQGRVVFEDVAIYFSQEEWGHLDEAQRLLYRDVMLENLALLSSLGCWHGAEDEEAPSQQGFSVGMLEVTTSKSCLSTQKVH

SEQ ID NO: 23741 - protein, 81 aa, Suricata suricatta
NSEPGACLWILCLPLSLTLPCSRCLDVVIEFSQEEWECLDPTQRALYRDVMLETYRNLISLGEENVPPEVGNYFLCLCIYY

SEQ ID NO: 23742 - protein, 81 aa, Chlorocebus sabaeus
ARGCVVFEDVFVYFSREEWELLDDAQRLLYHDVMLENFALLASLGIAFSRSRAVIKLEQAEEPWVYDQVDMTSATEREAQR

SEQ ID NO: 23743 - protein, 81 aa, Chlorocebus sabaeus
VHGSVTFRDVAIDFSQEEWECLQPEQRTLYRDVMLENYSHLISLAGSSISKPDVITLLEQEKEPWIVVRKETSRWYPDLES

SEQ ID NO: 23744 - protein, 81 aa, Suricata suricatta
FQEAVTFGDVAVHFSREEWQCLDPSQRALYKEVMLENHSSVAGLAGFLVFKPELISRLEQGQEPWVLDLKGVEEREVARTS

SEQ ID NO: 23745 - protein, 81 aa, Suricata suricatta
LLQESVTFKDVVVLFTRDEWAQLSPTQRALYRDVMLENYSNLVSLGLLGPQPDVFSQLRKGEEWVLEGASGGFCLDWMTLP

SEQ ID NO: 23746 - protein, 81 aa, Suricata suricatta
AQGSVSFEDVVVEFTQDEWQYMSPAQRTLYRDVMLENYGHLISVGYCLTKPKMIFRLEQEEEPWSLEEEFLNQRYPGYFSV

SEQ ID NO: 23747 - protein, 81 aa, Chlorocebus sabaeus
LQESVTFQDVAVDFTAEEWQLLDCTERTLYWDVMLENYRNLISVGCPINKTKVILKVEQGQEPWLVEGANPHQSSPESDCP

SEQ ID NO: 23748 - protein, 81 aa, Suricata suricatta
PRPLENDGGCFSEQEWETLEDWQKELYRNVMKSNYEALVSLKVLGPPEEAAELGPGMLGDLEDEGPGGAHPAGGVMIKQEM

SEQ ID NO: 23749 - protein, 81 aa, Suricata suricatta
KPGVLTFADVAVYFSSEEWGCLRPAQRALYRDVMRETYGHLGALGFPGPKPALISWMEQESEESEAWSPAAKDPEEGESLG

SEQ ID NO: 23750 - protein, 81 aa, Suricata suricatta
SQGSVTFRDVAIDFSQEEWERLQPAQRALYRHVMLENYSHLASLGLNISKPYVVSLLEQGKEPWLEKGDVRRDLFSALKEA

SEQ ID NO: 23751 - protein, 81 aa, Suricata suricatta
MFAGYCLTKPKMIFRLEQEEEPWSLEEEFLNQRYPGYFSVDIHIEGNQEKQEKEKPLWQVIFTNTKTWSKEGQKVLKTPFN

SEQ ID NO: 23752 - protein, 81 aa, Chlorocebus sabaeus
QEGVNFKIVTVDFTQEEQGTWNPAQRTLDRDVILENHRDLVSWDLATAVGKKDPTSKQSIFDEEPANGVKIERLTRDDPWL

SEQ ID NO: 23753 - protein, 81 aa, Chrysochloris asiatica
VEPVTIEDVTVVFTEAEWKSLSSEQKNLYGEVMLEIYRNLLSLVDPKPDTHPCSSSLLAFSCQQFLSQHILQIFPGSCAVH

SEQ ID NO: 23754 - protein, 81 aa, Chlorocebus sabaeus
MLENYSHLVSLGFSFSKPHLISQLERGEGPWVADIPRTWTTAGLHIGDRTQSKTSTSTQKHSGRQLPGVDSQGGKDGQAAR

SEQ ID NO: 23755 - protein, 81 aa, Mandrillus leucophaeus
QGHVTFEDIAVYFSQEEWGLLDEAQRCLYHDVMLENFSLMASVAGLSQSNHKDSCSQQKVTVSLNNCVAQCSPDDGHYTPK

SEQ ID NO: 23756 - protein, 81 aa, Mandrillus leucophaeus
RVQSCVTFEDVFVYFSREEWELLEEAQRFLYRDVMLENFALVATLAFIFPVPRSCPVGEGRKPWVPDRADTTAATVKETYR

SEQ ID NO: 23757 - protein, 81 aa, Mandrillus leucophaeus
MFKEAVTFNDVAVAFTEEELGLLGPAQRKLYRDVMVENFRNLLSVGHQPFKQDVSPIERNEQLWIVTTATQRRRNLDTLLV

SEQ ID NO: 23758 - protein, 81 aa, Mandrillus leucophaeus
FFISFTGQLTFRDVAIEFSQEEWKCLNSTQRTLYRDVMLENYRNLVSLEYYLMWEHRKEPWTMESVKIGKTSDGGRRTQSQ

SEQ ID NO: 23759 - protein, 81 aa, Mandrillus leucophaeus
MRETYGHLGALGFPGPKPALISWMEQETEAWSPAAQDPEKGERLGGARRGDAPNRKEEEPEEAPRAKGPRKAPVKDSPEVP

SEQ ID NO: 23760 - protein, 81 aa, Sus scrofa
VTFQDVVVTFTREERELLGQAQRTLYRKVMLETFQLLLSMGKTSPHLQAGALQPPTRPILSLKASREGGQVSGSARPPHPP

SEQ ID NO: 23761 - protein, 81 aa, Sus scrofa
SSHCGSEETNLDVAIEFSQEEWACLDPAQRALYRDVMLETCRNLLSLEEHRFPLGVGICPWVSLHFPLCASWEPLLCLAEH

SEQ ID NO: 23762 - protein, 81 aa, Sus scrofa
VQGKVNLEDVFVYFSQEEWRLLDEAQRLLYREVMLENFALMASLGSWHGTEEEVIPFEQSVSVKGVSQVMIPKMVLSSQKA

SEQ ID NO: 23763 - protein, 81 aa, Neovison vison
SQGLVTIKDVSLCFSQEEWRSLDPSQTDFYGEYVMQENCGIVVSLRFPIPKLDMLSQLEAGEEQWVPDPQDLEERDILRVT

SEQ ID NO: 23764 - protein, 81 aa, Loxodonta africana
VMFSDVSVDFSQEEWECLNEDQRDLYRDVMLENYNNLVSMVLESRCETKKLYLKKESYKIEPSQWEIMERLTRHHLRCSSF

SEQ ID NO: 23765 - protein, 81 aa, Loxodonta africana
PKVPVTFDDVAVHFSEQEWGNLSEWQKELYKNVMRGNYESLVSMDYAISKPDLMSQMERGERPAVQEQEDSEEGETPADPS

SEQ ID NO: 23766 - protein, 81 aa, Capra hircus
RLTSADVAINFTQEEWEFLAPAQRALYRDVMLETYRNLLSVDISPTHVIKLLQPKANRDKLETFQTLMLGRPESCEIKHVH

SEQ ID NO: 23767 - protein, 81 aa, Capra hircus
AQGYVTFEDVTIYFSPEEWGLLDEAQRLLYCDVMLENFALIASLGLASFRSHIVAQLEMGEEPWVPDRVDMTSAMARGMYR

SEQ ID NO: 23768 - protein, 81 aa, Capra hircus
MLENYSHLVSMGHPVSKPDVISKLEQGEDPWIIKTDIPNRICPYEGQADGRLDRKSNLDNPQSCILGSVSFHNKILKGVIK

SEQ ID NO: 23769 - protein, 81 aa, Suricata suricatta
SHSQRELYRDVMLENYGHLLFLGEDHSLSISQTTLRGFVPSFEDSSYPGRNWNDFTFIPYISVVSSNANVRLPSKIFIETS

SEQ ID NO: 23770 - protein, 81 aa, Chrysochloris asiatica
FKEPVTFRDVAVDFTREEWRQLDPAQRTLYRDVMLETFGHLVDVGPELPKPDVISQLEQGAELWAMERGLTQDRCPAWETG

SEQ ID NO: 23771 - protein, 81 aa, Suricata suricatta
NFTWEEWQDLDDSQRTLYRTVMLETYSSLVSLGHCIMKPEVIVKLEQGAEPWMVEEPLKQSLPDVQSAGGLMETDQEHQSR

SEQ ID NO: 23772 - protein, 81 aa, Chrysochloris asiatica
GEGSLSFEDVAVGFTWEEWQFLDPSQQDLYKAVMLENYSNLVSVGCQTTKPDAIFKLEQGETPWIVEGAVHGQTTLEEQPH

SEQ ID NO: 23773 - protein, 81 aa, Suricata suricatta
RPESVTFEDVAVYFSENEWTGLAPAQRVLYRDVMLENYGAVASLAFPFPKPALISQLERGEAPWCRAPRGGLDGERPRGLS

SEQ ID NO: 23774 - protein, 81 aa, Suricata suricatta
NSGVTFEDVAVYFSWEEWRLLEETQRCLYHNVMLENFALISSLGKGPLILRKSQTESPSAGECGKTFRYKSSFAIHQRFHT

SEQ ID NO: 23775 - protein, 81 aa, Chlorocebus sabaeus
PEGSVSFRDVAIDFSREEWRHLDPSQRNLYRDVMLETYSHLLSVGTGYQVPEAEVVMLEQGKEPWALQSERPRQSCPGEKL

SEQ ID NO: 23776 - protein, 81 aa, Suricata suricatta
SQGQLTFRDVALEFSQEEWECLNHSQQELYADVILETYGHLFFLGLLVSKPDLVIFLGHEQELRGVKRQETVASHPGRSLT

SEQ ID NO: 23777 - protein, 81 aa, Suricata suricatta
GWLTFRDVIVEFSPEEWECLGPAQRALYRDVMLENYRNLVSLGSPSAGFTVQELSPTKDINKREFSHLMILKSNESHGIKD

SEQ ID NO: 23778 - protein, 81 aa, Chrysochloris asiatica
SVGYADVALEFTQEEWSLLNFSQRKLYRDVMLEILRYLVSAHMTRVSQKPVMRKAGLLPTGPHCLRPALLHSSPALKTKST

SEQ ID NO: 23779 - protein, 81 aa, Suricata suricatta
MLENYRNMILLGFQFPKPKVICLLEQWEEPWILDLPRAGTRKASSSACSGSEAKWKMKKLTPKQKVSKDLELCKTWAVKQK

SEQ ID NO: 23780 - protein, 81 aa, Chlorocebus sabaeus
RPLEMAVSEPEASAAKEWKQLDSAQRNVYHDVMLENYSNQASMGAGYQAPKPDVISKLEKGEAPWLGKGKRPSQGCPSKIA

SEQ ID NO: 23781 - protein, 81 aa, Chlorocebus sabaeus
MCYFFYAGSSISKPDVITLLEQEKEPWMVVRKETSRWYPDLELKYGPEKVSPENGISEVNLPKQVIKHISTTLSLEAFYFR

SEQ ID NO: 23782 - protein, 81 aa, Sus scrofa
QEDDLKFKDVAIYFSQKEWECLHFAQKDLYREVMFENYNNLIALGFSNSKPDVISLLEQGKEPWLVRSKEIKNDWESRRET

SEQ ID NO: 23783 - protein, 81 aa, Mandrillus leucophaeus
VTFKDVAIDFTLEEWRLMDPTQRNLHKDVMLENYRNLVSLDVEPKPATKNATRTKDISEDLSQDAVLEKLTENGLWDSRVE

SEQ ID NO: 23784 - protein, 81 aa, Mandrillus leucophaeus
PLTFKDVAIEFSQEEWKSLDPVQKALYKDVMLENYRNLVFLGISPKCVIKELPPTENSNTGERFQTVALERHQSCDIENLY

SEQ ID NO: 23785 - protein, 81 aa, Mandrillus leucophaeus
QVRLTFRDVAIEFSQEEWKCLDPAQRTLYRDVMLENYWNLVSLDIPPKCTTKDLLPKEKSSTEAVFHTVMLERHESPDIED

SEQ ID NO: 23786 - protein, 81 aa, Sus scrofa
VTFEDVAIYFSQEEWGLLDEAQRCLYRDVMLETLALTTSLDCWCGAQGEEVLSEQSISVGMSQVKTSQSVSSTQKTHPCEK

SEQ ID NO: 23787 - protein, 81 aa, Sus scrofa
RLESVTFEDVAIFFSENEWTSLAPAQRALYREVMLENYAAVASLAFPFPKPALIFLLERGEAPWSSAPEGPLDGEGPRGIS

SEQ ID NO: 23788 - protein, 81 aa, Mandrillus leucophaeus
SCEGSVSFRDVAIDFSREEWRHLDPSQRNLYRDVMLETYNHLLSVGYQVPEAEVVMLEQGKEPWALQGERLRQSCPGEKLW

SEQ ID NO: 23789 - protein, 81 aa, Equus caballus
QPPVSFKDVAVTFTREEWGQLDPAQRMLYRDVTLETCSHLFSLDWKTTLEKKEPTSKEGTAAEDTSHHVEVKHCVWEEGFW

SEQ ID NO: 23790 - protein, 81 aa, Neovison vison
KSLGSVSFKDITVDFSKEEWQQLNLAQKSLYRDVMLENYFNLISVGCQVPKQEVIFSLEQEEPRMLDGEISSHSSLGGDIG

SEQ ID NO: 23791 - protein, 81 aa, Capra hircus
EQLTSEDVAIEFTQEEWEFLDPPQRALYRDVMLETYRNLLSVDISPTLVIKHLQCKANSDKQETFQTLMLGSPESCEIKHV

SEQ ID NO: 23792 - protein, 81 aa, Loxodonta africana
GSVSFTDVTVDFTQEEWEQLDPSQRILYMDVMLENYSNLLSVEVWKADDQMERDHRNPDEQARQFLILKSQTPVEERGNLF

SEQ ID NO: 23793 - protein, 81 aa, Capra hircus
WSQDLVTFKEVSVEFSQEEWALLAPTQKVLYRDVMLENFRNLALVGYHLCKHSPITEVAQEELRPEERGILQNACTDGVTQ

SEQ ID NO: 23794 - protein, 81 aa, Capra hircus
SFQAPVTFDDITVYLLEEEWVLLSQQQKDICGSDKLVAPLGPTIASPEMFYKFERGPEPWLASVQGQRSHLSPNPGKTKMG

SEQ ID NO: 23795 - protein, 81 aa, Capra hircus
NKFSFTDVTVDFTQEEWEQLEPSQRILYMDVMLENYSNLLSVEVWKADDQMETDHRNPDEQARPFVIFKDQTPTEERDNNL

SEQ ID NO: 23796 - protein, 81 aa, Capra hircus
SQESVKFRDVAVVFSPEQWAHLSPEKRELYRDVMLDTCDHLVSLGHWAYKAEVMSSLRQGKEPWILEKEVTSAPCPACQPA

SEQ ID NO: 23797 - protein, 81 aa, Capra hircus
FDDVAVTFTQEEWGHLEPAQRTLYQEVMLETCRLLVSLGCPVPRPELIYQLEHGQELWTVKRDLSRSTCPVDKGKPKTTEP

SEQ ID NO: 23798 - protein, 81 aa, Chlorocebus sabaeus
PKVPVTFDDVAVHFSEQEWGNLSEWQKELYKNVMRGNYESLVSMDYAISKPDLMSQMERGERPTMPEQEDSEEGETPTDPS

SEQ ID NO: 23799 - protein, 81 aa, Chrysochloris asiatica
LQKFVMFRDVAVFFSQEEWLHLDPAQRALYRDVMLENYSNLVSLGIPFSKPKVISQLQQGEDPWMVEKRVPQGSCRGWKSL

SEQ ID NO: 23800 - protein, 81 aa, Suricata suricatta
SSQGLLTFRDVAVEFSQEEWGCLNHSRWELYRDVMLETYEHLVFLGLVSKPDLVIFLEQKRELWDVKRKETVASYPHTWGL

SEQ ID NO: 23801 - protein, 81 aa, Suricata suricatta
FKLRIFHQRLRKLVPSSGDAYIREKLVNYFNRSNSDFLETGLLVPKPDVVFQLKRGEEPWKLDFQEDEEREVPGSTFLGRY

SEQ ID NO: 23802 - protein, 81 aa, Suricata suricatta
SGHLVTFEDVAVYFTQTEWAGLCSGQKALYRSVMLENYGNLTSLGYSVPRPALISLLEAGSLPWGLEAQGNLSAERTKDIY

SEQ ID NO: 23803 - protein, 81 aa, Suricata suricatta
WSQMPVTFEDVALYLSREEWGRLDHAQQNFYRDVLQKRNGLSLGFPFSRPFWAQGQGKGEASSSWRQMGVEEKTGAVEVGK

SEQ ID NO: 23804 - protein, 81 aa, Chlorocebus sabaeus
QASVSFKDVTVEFTQEEWQHMGPVERTLYRDVMLENYSHLVSVGYCFTKPELIFTLEQGEDPWLLEKERGFLSRNSPDSQP

SEQ ID NO: 23805 - protein, 81 aa, Chlorocebus sabaeus
MPLSEFPTVFHSIGNFYMFFLHAGLCLCKPDVISLLEQEKDPWVIKEEMTRGLCPDLECVWVTKSLSLNQDVYEEKLPPAI

SEQ ID NO: 23806 - protein, 81 aa, Suricata suricatta
MTFEDVAVYFSWEEWGLLDEAQRLLYRDVMLETFALMASLGLGSSRIHEITQLEWWREPSLPPHGVMTAAVPRGVRRRAEV

SEQ ID NO: 23807 - protein, 81 aa, Chlorocebus sabaeus
GIAVSKPDLITCLEQGKEPWNMNRHEMVAKPPVMCSHIAEDLWPEQDIKDFSQKVILGRHDKCEHENLQLRKGCKSVDECK

SEQ ID NO: 23808 - protein, 81 aa, Chrysochloris asiatica
TQDLVVFEDVAVMFTQEEWALLDLAQRNLYKDVMLENFHNLASVGYPLSIPHLILHWEQEEDLKTMEKRFIQVTGTGEHQE

SEQ ID NO: 23809 - protein, 81 aa, Suricata suricatta
MQENYRHLVSVGYRVNKPNAVFKLKQGKEPWILEVEFPGRNYPEDLWKIHDLGTRSEESQAENSRNGELTKHQQTPAREKT

SEQ ID NO: 23810 - protein, 81 aa, Sus scrofa
TFKEAVTFKDVAVAFTEEELGLLDSAQRKLYQEVMVENFRNLVSVGHQPFKRDTSCKEREKLWMMNLATQVNLDKNQMIMS

SEQ ID NO: 23811 - protein, 81 aa, Mandrillus leucophaeus
VQEPVTFKDVAVDFTQEEWGQLDFVQRTLYRDVMLETYGHLLSVGNQIAKPEVISLLEQGEEPWSVEQACPQRACPEWMRN

SEQ ID NO: 23812 - protein, 81 aa, Mandrillus leucophaeus
QGLLTFRDVAIEFSQEEWKCLDSAQRTLYREVMVENYRNLVSLDISSKCMMEFLSTAQSNREVIHTGTLERHESHHIGDFC

SEQ ID NO: 23813 - protein, 81 aa, Neovison vison
APLPLTFEDVAIYFSEQEWQNLEAWQKELYKHVMRTNYEILVSLDNGLPKPELISWIEQEREFFQNWREAQKSGTIICSSA

SEQ ID NO: 23814 - protein, 81 aa, Capra hircus
PQGGVTFEDVALSFSWKEWKLLDAAQRRLYHDVMLENYALISSLGFWSGEEKVETSFAQSVSEAVSQARTSKEASSSQKTH

SEQ ID NO: 23815 - protein, 81 aa, Capra hircus
YQELVTFRDVAVDFSQEEWDYLNPSQRHLYSNVMLENYRILVSLDWESMCETEELTPKQDIYEPQSSQKVIEKLTSYGLEY

SEQ ID NO: 23816 - protein, 81 aa, Chrysochloris asiatica
IKETVTFKDVAVDFTWEEWRLMDPTQRNLHKDVMLENYRNLVSLGLVVSKPDMISHLEDGKRPWVMVREFSRAPYTELETK

SEQ ID NO: 23817 - protein, 81 aa, Chlorocebus sabaeus
DSISLEDVAVNFTLEEWALLDPGQRNIYRDVMRATFKNLACIGEKWKDQDIEDDPKNQGRKPSSPTVETLCENKEDRPCGK

SEQ ID NO: 23818 - protein, 81 aa, Suricata suricatta
GVFVAGTEEWGCLSHSQRELYRDVMLENYGHLLFLDLVVLKPDLVTFLERKRELWDVKRKETQMTEVTLPSKIFIETSFQN

SEQ ID NO: 23819 - protein, 81 aa, Chlorocebus sabaeus
QGLLTFRDVAIEFSQEEWKCLDPAQRTLYRDVMLENYRNLVSLDISSKCMLKTLSSTGKGNTEVILTGTLQRQANDHIGEF

SEQ ID NO: 23820 - protein, 81 aa, Suricata suricatta
PKVPVTFDDISIYFSTPEWEKLEEWQKELYKNIMKGNYESLISMDYAMNQPDVLSQIQPEGEHNTEEPAGPEESEIPADPS

SEQ ID NO: 23821 - protein, 81 aa, Chlorocebus sabaeus
MLEIYSNLVSVGYQVSKPDALSRLERGEEPWTMEDERHSQICPENNKVDDHLQDHLENQRMLKSVEQYHERNAFGNTASQT

SEQ ID NO: 23822 - protein, 81 aa, Chlorocebus sabaeus
MLFIFNKTGIIVSKPDLITRLEQGKKPLTMKRQEMVGKPPVLCSRFTQDLWPEQSIKDSFQKLILRRYEKYGHDNLQFKKG

SEQ ID NO: 23823 - protein, 81 aa, Suricata suricatta
TGSMSFKGVTVDFTRDEWLQLTGTQRTLCRGVMLENYRVLPCIPLTGCRLAKPEVTFKLEQGEDHNKCGEIFQKSQPMDLP

SEQ ID NO: 23824 - protein, 81 aa, Suricata suricatta
SQELLTFRDVAIEFSQEEWGCLNVVQWELYRDVMLENYGHLLFLGLAVSKPDLVIFLEEKRELCDVNEKETTATPLAISSD

SEQ ID NO: 23825 - protein, 81 aa, Chlorocebus sabaeus
WQGRVVFEDVAIYFSQEEWGHLDEAQRLLYRDVMLENLALLSSLGCCHGAEDEEAPLEPGVSIGVSQVMAPKPCLSTQKTQ

SEQ ID NO: 23826 - protein, 81 aa, Sus scrofa
PLQGSVSFKDVTVDFTQEEWQQLDPAQKALYRDVMLENYCHLISVGKENSLNLSMSYFPFQEFLKHISIPHLNVFKRSLFF

SEQ ID NO: 23827 - protein, 81 aa, Mandrillus leucophaeus
EMLSQSPRDVAIEFSLEEWQRLDAAQQNLYRNVMLENYRNLAFLGIAVSKPDLITCLEQGKEPWNMKRHEMVDKPPGLYFS

SEQ ID NO: 23828 - protein, 81 aa, Mandrillus leucophaeus
MEARSKLVPPQASVCFEDVAMAFTQEEWEQLDLAQRTLYREVTLETWEHIVSLGLFLSKSDVISQLEQEEDLCRAEQVAPR

SEQ ID NO: 23829 - protein, 81 aa, Mandrillus leucophaeus
GPLTFRDVAIEFSQEEWKSLDPVQKALYWDVMLENYRNLVFLGILPKCMTKELPPIGNSNTGEKFQRVMLERHECYDIENF

SEQ ID NO: 23830 - protein, 81 aa, Mandrillus leucophaeus
GEGSLSFEDVAVDFTREEWQFLDWSQKVLYKEVMLENYSNLVSVGYQGTKPDALFKLEQGEPPWIVEGAAHSQTCPGFVIQ

SEQ ID NO: 23831 - protein, 81 aa, Sus scrofa
PHRLVLFTDVAIDFSQEEWECLDLQQKDLYRDVMLENYSNLVSLGFSISKPDVLSLLEQGKEPWKVVQDVTSGQSPEWESR

SEQ ID NO: 23832 - protein, 81 aa, Sus scrofa
MLENYSNLVSVGYCITKPEMIFRLEQGEEPWILEDEFPSQSSPVWKNDHIKDRSQENQSKHVWEVVFISNKMLTEEQGNVI

SEQ ID NO: 23833 - protein, 81 aa, Sus scrofa
AQGSLSFEDVTVEFTQDEWRFVGPAQRSLYRAVMLENYSHLVSLGYYKVDDHIEENQEKQEKHSWQVIFIDNKILSKEEQK

SEQ ID NO: 23834 - protein, 81 aa, Equus caballus
VMFRDVAIDFSQEEWECLDAAQKDLYRDVMLENYSNLVSLDLPSRSANKKLSPKKDTYETELSQWEMSARLENWDLEESSS

SEQ ID NO: 23835 - protein, 81 aa, Equus caballus
ARSEVTFKDVAVNFTQEEWGQLDSPQRALYRDVMLENYQNLLSLGPPVCKPDVISHLERGEEPWQVPGEVPGAARPEQEPG

SEQ ID NO: 23836 - protein, 81 aa, Equus caballus
LLTFKDVTIEFSQEEWECLDPAQRALYRDVMLENCRNLLSLGEESFPLEVRICPDISARSMIKELLLKEDINIGELYQPVV

SEQ ID NO: 23837 - protein, 81 aa, Equus caballus
SHGHGTFEDVAVSFSQTECVLCDEAQGCPYREVMLENWSLMAFLGCWHAVKAEEAPSEQCTSVERSITQGYCQFWESPRPP

SEQ ID NO: 23838 - protein, 81 aa, Equus caballus
AQESVMFSDVSIDFSQEEWECLNDDQRQLYRDVMLENYSNLVSMAGHSISKPDVISFLEQGREPWLVHRELTRGQWPVLQS

SEQ ID NO: 23839 - protein, 81 aa, Equus caballus
SHTLVTFKDILVNFNREEWKLLNAAQQIMYKDVMLENYENLVSLGHQLPKPDVILRLEKGQEPWLAERGIHQETHPDLETA

SEQ ID NO: 23840 - protein, 81 aa, Equus caballus
MTESQGTVTFKDVAIDFTQEEWQQLDPAQRNLYRNVMLENYNNLITVGCPFTKPDVIFKLEQEEEPWVEEDVDVLRRHWPG

SEQ ID NO: 23841 - protein, 81 aa, Equus caballus
KFKEPVTFEDVAVVFTEEELGLLDATQRQLYRDVMLENFRNLLSVGHQPLKPDISHIEREAKLWMMKTASQVERNFGENNQ

SEQ ID NO: 23842 - protein, 81 aa, Equus caballus
ARLPLTFEDVAIYFSEQEWQKLEAWQKELYKHVMRTTYDIFVSLDDGIPKPELISWIEQGRELFRNWGESQKSGNIICFSA

SEQ ID NO: 23843 - protein, 81 aa, Equus caballus
QKNVIFHDVAVYFSWGDWRLLDEAQRRLYLDVMLENFVLISSLGLIFSMSHIVAQLRVQIGEKAYKCSDCAKSFTSSAALS

SEQ ID NO: 23844 - protein, 81 aa, Neovison vison
MFQVTFSDVAIDFSHEEWGWLDSAQRDLYKDVMVQNYENLVSLGLSIPKPYVITLLEDGKEPWMVEKKDWESRWENKELVT

SEQ ID NO: 23845 - protein, 81 aa, Neovison vison
EVMLENYGTLVSLGILFSKPKVIFQLQQGKDPWMVENGVSQGPCVGWERLFETTISEEENQEVMNKLLGDGPFDFKLGKAY

SEQ ID NO: 23846 - protein, 81 aa, Neovison vison
VMLENYANVASLAFLFTRPVLVSQLERGELPWGLEPWEPADREALRGICPGGEARAEKEESTPKEHISKEIESHRLTLGGL

SEQ ID NO: 23847 - protein, 81 aa, Loxodonta africana
GSKESVTFQDIAVDFTEKEWPLLDSSQRKLYKDVMLENYSNLTSVGYQGKPSLISHLEQEELLRTEERGACQGTCPDWEIP

SEQ ID NO: 23848 - protein, 81 aa, Chrysochloris asiatica
MLENYRSLVSLGASVSKPDVIALLEQGKEPWMVKKKRTRGTCSGWEYIFGNSEFSSKQTLYEEGSKVIKVGPSPLSYGLDC

SEQ ID NO: 23849 - protein, 81 aa, Suricata suricatta
GTVTFEDVAVYFSGEDWGLLEESHRHLYQDVMLENLALITSLGRQHGAEDKEAPEQSICVQGGSRGRTPKAGLSPQKTSPC

SEQ ID NO: 23850 - protein, 81 aa, Suricata suricatta
HGLLAFRDVAIEFPQEDGGCLRLPQREQDVYRIVMLESYGHHLFLGLVVSKPDLVIFLEQKRELWDVKRKDTTVQCDFSSH

SEQ ID NO: 23851 - protein, 81 aa, Chrysochloris asiatica
APVTFEDVTVVFTEAEWVTLSLEQKNLYKEVMLEMYRNLLSLAEPTPETCPGPSCLLPLSCQQFLSQHVLQIFSGVCAEHP

SEQ ID NO: 23852 - protein, 81 aa, Chlorocebus sabaeus
WLQEPMTFKDVAVEFTQDEWMMLDSAQRSLYKDVMLENYRNLTSVEYQLCRLTVISPLDQEEIRNMEKRIPRGICPDQKIL

SEQ ID NO: 23853 - protein, 81 aa, Chlorocebus sabaeus
EKGPLTFRDVVIEFSQEEWQCLDTAQQDLYRKVMLENFRNLVFLAGIDVSKPDLITCLEQGKDPWNMKRHSMVATPPVNCS

SEQ ID NO: 23854 - protein, 81 aa, Chrysochloris asiatica
GPQSRFVSVTFEDVSVTFTQEEWGQLSPTQRCLYQKVMLETWTLLTSLDLICRLEHGQELWTTETGLAESTCAGDKTQPKT

SEQ ID NO: 23855 - protein, 81 aa, Chlorocebus sabaeus
MCLGLCVSKPDVISSLEQGKEPWTVKRKMTRAWCPDLKTVRKIKELPLKKDFCEGKLSQAVITERLTSYTLEYSLLGEHWD

SEQ ID NO: 23856 - protein, 81 aa, Suricata suricatta
MLENYRNLVWLGLSMSKPNMISLLEQGKEPWMVEKEMSDGPYADWESWYEIKELSAKWYIDEEEISQGMVMERLTSCDLDC

SEQ ID NO: 23857 - protein, 81 aa, Chlorocebus sabaeus
LQESLTLRDVAVDFTWEEWQLLGPAQKHLYRDVMLENYGNLVSVGFQASKPDALTKLEQGEPLWALEDEIHSPTHPEIEKA

SEQ ID NO: 23858 - protein, 81 aa, Suricata suricatta
KPQGLVTFEDVAVDFTQEEWQYLNPSQKSLYREVMLETYSNLVSVGQQVTKPDLILKLEVEEPCLAETEISTWGFPEEDYQ

SEQ ID NO: 23859 - protein, 81 aa, Mandrillus leucophaeus
IQDSVVFEDVAVDFTQEEWALLDLAQRNLYREVMLENFQNLASLGYLLHTPHLICQWEREEDLQTVKRELIQVIFMGEHQE

SEQ ID NO: 23860 - protein, 81 aa, Mandrillus leucophaeus
MTEEFVTLKDVSMDFTLEDWEQLGLEQGDMFWDTALDNCQDLLLLDPPRPNLTSHPDGGEDLEPLPGGSPEATGSDATETK

SEQ ID NO: 23861 - protein, 81 aa, Mandrillus leucophaeus
YVGLQFQGSVTFEDVAIAFSQQEWESLDSSRGLYRDVMLENYRNLVSMGHSLSKPHVIALLERWKEPKVTERKDGRRWCTG

SEQ ID NO: 23862 - protein, 81 aa, Mandrillus leucophaeus
LLTFRDVAIEFSQEEWKCLDPAQRTLYRNVMLENYRNLVSLGIFSKHEIKELPTKKESNTGEIFQTVMLERHESHDIEDFC

SEQ ID NO: 23863 - protein, 81 aa, Sus scrofa
QVSIAFRDLAVRFSEDEWRLLGEGQRALYLDVMQENYEALVSLGTAELLPLSAFLTPMEPGGARGAGDGQEPPRGAGPLGG

SEQ ID NO: 23864 - protein, 81 aa, Pan paniscus
MLRRGHLTFRDVAIEFSQEEWKCLDPAQRTLYREVMVENYRNLVFLLPDLSVISMLEQRRDPRNLQSEVKIANNPGSCSVT

SEQ ID NO: 23865 - protein, 81 aa, Lipotes vexillifer
YFREQNSVVFEDVAVDFTLEEWALLDSAQRELYRDVMLENFRNLASVEDETQFKANGGERPYVCKLCGKTFPRTSSLNRHI

SEQ ID NO: 23866 - protein, 81 aa, Pan paniscus
RDVAVEFSLEEWHCLDTAQQNLYRDVMLENYRHLVFLGIIVSKPDLITCLEQGIKPLTMKRHEMIAKPPVMCSHFAQDLWP

SEQ ID NO: 23867 - protein, 81 aa, Equus caballus
AQDSVIFHDVAVYFSWGDWRLLDEAQRRLYLDVMLENFVLISSLGCCCGAEDLEAPFEQSISVEVSTARAPTAAPSSQKTH

SEQ ID NO: 23868 - protein, 81 aa, Equus caballus
GSAAYEFLCVDYTQKKWRGPAVSQRALYQNVMPENHCSAASLAGENRMESSELPAKQEISKGLESSDRLSGGLCGVVPGGP

SEQ ID NO: 23869 - protein, 81 aa, Equus caballus
YQRPVSFKDVVVGFTQEEWHRLNPAQRALYRDVMLETYSHLVSVGYEGTKPYVILRLEQEEAPWICEAACSGCHCQGIGKL

SEQ ID NO: 23870 - protein, 81 aa, Neovison vison
WGLLDEAQRCLYQDVMLENLALVTSLGCRQGAEDDEAPEQSISVQRASQVRTFRAVVSPQKAHPREVCGQDLRDLLLSSEH

SEQ ID NO: 23871 - protein, 81 aa, Neovison vison
QESLTFRDVFVDFTLEEWQQLDSAQRNLYRDVTLENYSHLVSVGYLITKPDEVLRPRQVEEAMGAEGEPPARNHPEFWQAD

SEQ ID NO: 23872 - protein, 81 aa, Neovison vison
TQEEWQQLDPAQKALYRDVMLENYCHLISVGFHMTKPEMIRKLEQGEEPWTAERNFPSQSYLEEDGKAEDALVKFKEYQDR

SEQ ID NO: 23873 - protein, 81 aa, Chlorocebus sabaeus
QQGVLTFRDVAIEFSLEEWQCLDTAQQNLYRNVMLENYSNLVFLGIAASKPDLITCLEQGKEPWNVKRHEMGAEPPVVCPY

SEQ ID NO: 23874 - protein, 81 aa, Suricata suricatta
EGAGVGAESGTLLVASLCPILCLSLCTGHQLPKPDVILHLEKGEEPWLVGRGIQQEARPDVDTAVEIKSSVSSKSISKDKQ

SEQ ID NO: 23875 - protein, 81 aa, Chlorocebus sabaeus
MKCGYFSKEQMESNLLDPILYHVLLTGFEVPKPEVIFKLEQGEGPWTLEGEAPHQSCSDGKFGIKPSQKRISGKSTLHSEM

SEQ ID NO: 23876 - protein, 81 aa, Chrysochloris asiatica
AQGLLTFEEVAVRFSREEWGHLDSAQRALYRDVMWENYRNLTFVGFIFPKPELISQLEQGEEPWVPEGPRPPDLGLIPTFS

SEQ ID NO: 23877 - protein, 81 aa, Chlorocebus sabaeus
MPSPTFSPQAGPPLHKPDVISHLERGEEPWSMQREVPGGPCPEWQLKAVPSQQQGICKEEPAQEPITERPLGGAQAWGRQA

SEQ ID NO: 23878 - protein, 81 aa, Chlorocebus sabaeus
GYQLTKPDVILRLEKGEEPWLVERGIHQEAHPDSETAFEIKSSVSSRSVFKDKQSCDIKMEGMARNDLWYLSLEEVWKCKD

SEQ ID NO: 23879 - protein, 81 aa, Sus scrofa
MTKPDMIRKLEQGKELWTTEKIFPSQSYPEEDGTAEDILVKFKEYQDRHSRSVVFINHKKLMKERSNIFGKTFTVNKNHII

SEQ ID NO: 23880 - protein, 81 aa, Mandrillus leucophaeus
EKGPLTFRDVAIEFSLEEWQCLDTAQQGLYRKVMLENYRNLVFLGIAVTKPDLITCLEQGKEPWNIKRHEMVAKPSVICSH

SEQ ID NO: 23881 - protein, 81 aa, Mandrillus leucophaeus
AQESVTFEDVAVNFTNREWQSLTYAQRHLYKHVMLENYGNMVSLGFPFPKPPLISHLEQGVEPCVQDPQDRESLSCSYTVS

SEQ ID NO: 23882 - protein, 81 aa, Mandrillus leucophaeus
PVTFEDVAVNFTQEEWDCLDASQRVLYQDVMSEIFKNLASPPVLRALEHLVSLDRTQVLQASQARPPFFCRICGKCFSRRS

SEQ ID NO: 23883 - protein, 81 aa, Sus scrofa
SQGLLTFEDVAIDFSPEEWECLDLGQRHLYRDVMLEICRHLVSLEYVISKPDLVRLLEQKTDPWDMKGMETVAIQPALSSH

SEQ ID NO: 23884 - protein, 81 aa, Equus caballus
FRGPVTFKDVTVEFTKEEWQLLDAAQRTLYREVMQENYGHLLSVGYCVNKSKTIFKLKQGKEPWILEIEFPRRNSPEDLWN

SEQ ID NO: 23885 - protein, 81 aa, Equus caballus
SRSLENDGVCFSEQEWENLEDWQKELYRNVMKSNYETLVSLKVLGQPEEEVELGTEMLGDLEEEGPGGVHQAEGVMIKQEV

SEQ ID NO: 23886 - protein, 81 aa, Equus caballus
PTLHTFDVAVNFTPEEWALLDPSQKKLYRDVMWETFRHLASVGKNEDIPSRHQCRCGKGSQCGENFILLSNLSLNKKTTGA

SEQ ID NO: 23887 - protein, 81 aa, Equus caballus
SLFGPHLLIVIFPQVQRSSSSCCSRAAWLSLCDFPSTGYHGTKPDLIFKLEQGEEPWIVNARASRQSCPVEGWKEWYQKNQ

SEQ ID NO: 23888 - protein, 81 aa, Equus caballus
SQESVTFKDVAVDFTWEEWHYVDPAQRRLYRDVMLENYSHLVSLGYQVSKPEVIFKLEQGEEPWITEGEIQRPFCPAFCFN

SEQ ID NO: 23889 - protein, 81 aa, Neovison vison
LENYSNLASMGFQAPKPDMISKLEKGEEPWLGKGKRPRQGGPSEIARPKQTGTNGNVQQGNDQLENHQESQNKLCKEVAFK

SEQ ID NO: 23890 - protein, 81 aa, Capra hircus
QGHVTFEDVAVSFSQEEWGLLGEAQRLLYYDVMLENLSLIASLGCWRGGETEEAGSEQCVSAEQVTRDRNPRVDSSILKAV

SEQ ID NO: 23891 - protein, 81 aa, Capra hircus
KGSVTFQDVAVEFTPEEWQLLDCDQRTLYWDVMLENFRNLISVGTGCPVTETTVIFRVEQGQEPWMVEGEDSRWSSPEADC

SEQ ID NO: 23892 - protein, 81 aa, Capra hircus
MAFRDVAVDFTQDEWVLLSPAQRSLYREVMLENYSNLVSLGIPFSKPKLITQLEQGKETWREERKCSPVSCLEPKPELHLC

SEQ ID NO: 23893 - protein, 81 aa, Capra hircus
MDFTLENWEQLGQGQGDLFWDTALDNYQNLFLLNPLRPNLTFHLDGGEKLEALAKESPESTDAGIAETSPLPQDFMEEGLF

SEQ ID NO: 23894 - protein, 81 aa, Capra hircus
PQKSVTFEDVAVYFTQTEWDGLSTAQRALYRDVMLENYGNVASLGFPLLKPAVISQLEGGGELEGPSPLASGAGTGPQGLW

SEQ ID NO: 23895 - protein, 81 aa, Chrysochloris asiatica
MLENHSSVAGLAGVLVFKPELISRLEQGQEPWVLDLKGLENRELPRTSPTDSTLRTDNEQACEEMDILRSELHGMRIRIPL

SEQ ID NO: 23896 - protein, 81 aa, Chrysochloris asiatica
PKVPVTFDDVAVHFSEQEWGNLSEWQKELYKNVMRGNYESLVSMDYAISKPDLMSQMERGERPTVPEQDDSEEGEAPTDPS

SEQ ID NO: 23897 - protein, 81 aa, Chrysochloris asiatica
YQELVTFKDVAVDFSREEWDCLDSSQRHLYSNVMLENYRILVSLGLCFSKPSVILLLEQGQEPWLVKTELSEGLCSGWDSM

SEQ ID NO: 23898 - protein, 81 aa, Chlorocebus sabaeus
MNVMLENYKNLVFLGIAVSKQDPVTCLEQEKEPWNMKRHEMVDEPPAMCSYFTKDLWPEQDIKDSFQQVILRRYGKCEHEN

SEQ ID NO: 23899 - protein, 81 aa, Chrysochloris asiatica
TLEMVTFRDVAVDFTQEEWQQLDPAQRDLYNDVMLENFQNLSSLDLESRSKSDGVEGAVSMGLSPLLELEELGRGHLWSFA

SEQ ID NO: 23900 - protein, 81 aa, Chlorocebus sabaeus
KGLVTFEDVAVEFTQEEWTLLGPAQRTLYRDVMLENFRNLASLGTGNQVDKPGLISQLEQEDKVMTEEKGILPGTCPDVEN

SEQ ID NO: 23901 - protein, 81 aa, Chlorocebus sabaeus
QDSVAFEDVAVNFTHEEWALLGPSQKNLYRDVMQETIRNLNCVGMKWENQNIDDQYQNLRRNPRCDVVERFGKIKDGSQCE

SEQ ID NO: 23902 - protein, 81 aa, Chrysochloris asiatica
DSVVVEDVTVKFTQEEWALLDLAQRKLYIDVMMETFVNLASVDHSSYRHCTTSETGCSIYKCKEYEEACRYPYLSTPVKNL

SEQ ID NO: 23903 - protein, 81 aa, Suricata suricatta
LRETAESQPVGIAQDEEFWNAYQDLQEQLSRNTHKETEPVCERALFVLPKPKVISYLEQGEEPWVQGSTEFKDSPGELPTG

SEQ ID NO: 23904 - protein, 81 aa, Chrysochloris asiatica
ILEPITIEDVTVVFTDEEWNMLTSEQKSLYREVMLETYRNLFSLDYDTFSSSALLKNHQPEIIIKDFMEEVFNKSAWLAES

SEQ ID NO: 23905 - protein, 81 aa, Suricata suricatta
LTFGDVAIEFCEEEWGCLNRSQRELYRDVMLENYGHLLFLGEMTGKLYVACLSRMRVYLVYSSFPCPGATTPHHQGTKLSE

SEQ ID NO: 23906 - protein, 81 aa, Chrysochloris asiatica
VTFEDVALYLSREEWGRLDHAQQSSYREDLQKRNGMSLGFPINRALWASHMQGKGEASSSHLQRGDEEETVVCTDAMDVGT

SEQ ID NO: 23907 - protein, 81 aa, Suricata suricatta
YQELVTFGDVAVDFSREEWDCLNSSQRHLYSNVMLENYRILVSLGLCFSKPSVILLLEQGKEPWMVKRELAKGLCSGWESM

SEQ ID NO: 23908 - protein, 81 aa, Sus scrofa
FPETSAFRDMFVDFTLEEWQQLDAAQKTLYRDVTLENYSHLLSVGYLVAQPEGIFSLGQAEGAGKADGEAPTRSGPGERAP

SEQ ID NO: 23909 - protein, 81 aa, Lipotes vexillifer
AGCPPEMAVSEPGGSAAKEWEQLDPAQKSLYKDVMLENYSNLASMGYQALKPDMISKLGKEEPWLGKGKRPRQGDLSEIAR

SEQ ID NO: 23910 - protein, 81 aa, Lipotes vexillifer
QEWLTFEDVAIEFTQEEWECLDPAQRTLYRDMMVETYRNLLSVVSTALLHPSLHLLHHSHCRNDPSVELLDNILRTGPMSP

SEQ ID NO: 23911 - protein, 81 aa, Lipotes vexillifer
FQESVSFEDVAVYFTQNQWASLDSAQRTLYREVMLENYESITSLAAFPFPRPDLIFQLERGEAPGGLDPWIPIRREVRGVC

SEQ ID NO: 23912 - protein, 81 aa, Pan paniscus
SPGLLTFRDVVIEFSLEEWQCLDHAQQNLYRDVMLENYRNLVSLGIAVSKPDLITCLEQNKDPWNIKRNEMVTKHPVMCSH

SEQ ID NO: 23913 - protein, 81 aa, Lipotes vexillifer
EDSVVFEDVAVNFTVEEWALLDPAQRKLYRDVMLETFRNLASVGSCPQVKTSGSSPQWDILENELCSEKKIVRCTRNDSCS

SEQ ID NO: 23914 - protein, 81 aa, Lipotes vexillifer
SQAPVTFEDMAMYLTREEWRPLDPTQRDLYRDVMQENYGNVVSLDFEIRSENEVNPKQESSEDVEFGTASERPVGNTEDSP

SEQ ID NO: 23915 - protein, 81 aa, Callorhinus ursinus
DPVTFEDVAVEFTQEEWILLDQTQRRLCRDVMLANYKSLAAIDWEICLNTKWSAPQQNILQGKTPNVVEMERSHTGEELFN

SEQ ID NO: 23916 - protein, 81 aa, Callorhinus ursinus
VVFADVAVNFTPEEWALLDRGQRRLYRDVMLETCWNLASLVCPSQDKRSASRTQWNILQNELPSEEKIVIFARNDSCSVFG

SEQ ID NO: 23917 - protein, 81 aa, Callorhinus ursinus
VEGSVTFKDVTMAFTQKEWEQLDPAQRNLYKDVMLENYSNLASMGYQAPKPDMISKLEKGEEPWLGKGKRPRRCGPSEIAR

SEQ ID NO: 23918 - protein, 81 aa, Callorhinus ursinus
VMFEEVSVCFTSEEWECLGPIQRALYWDVMLENYGNVTSLEWETMTENEEVTPKPSISQRADSQKGTSKRLQGGVPQTLDF

SEQ ID NO: 23919 - protein, 81 aa, Callorhinus ursinus
MFQVTFSDVAIDFSHEEWGWLDSAQRDLYKDVMVQNYENLVSLGLSIPKPYVISLLEDGKEPWMVEEKLSKDWESRWENKK

SEQ ID NO: 23920 - protein, 81 aa, Tursiops truncatus
MLENYRNLASLGLCISKPDVISLLEQDKEPWMLKGEITRGLPPDLEYVWMRKELSPNQDIYEEKLSQAMIMERLTGCDLKC

SEQ ID NO: 23921 - protein, 81 aa, Equus caballus
WSQMPVTFEDVALYLSREEWGRLDHTQQSFYGDVLQKRNGLSLGAIEVGKEEPAPSLAALRDVKALRTRAGRTQGDILQCR

SEQ ID NO: 23922 - protein, 81 aa, Equus caballus
MNIAQGLVSFEDVTVEFTQEEWRQMDSTQRALYKDVMLENYGHLVSMGYCSTKPRVIFKLEQGEEPWSLEEEFLNQRYPGE

SEQ ID NO: 23923 - protein, 81 aa, Equus caballus
MTKNWKCLESSQKDCPRDAMLDNYENMVPQGSFLQFSVMPQIAGNDTPGVSNTNEMEMERSNMREKFLISVTKLVESKSYN

SEQ ID NO: 23924 - protein, 81 aa, Equus caballus
MIESQISFEDVAVDFTLEEWQLLNPTQKNLYRDVMLENYSNLAFLGYQIIKPDAVFQLEQEEQWITDEEILNHSCPEEVWL

SEQ ID NO: 23925 - protein, 81 aa, Equus caballus
SQHLVTFEDVAVDFTQEEWMLLDPTQRALYRDVMVENYQNLLSVAGYRSCKPDLSSGLKGADEVRTGARGVLQGGKQFWSG

SEQ ID NO: 23926 - protein, 81 aa, Equus caballus
WLKDYQQDSMTLDNVVVDFTQKEWLLLDLTQRNLYRDKNLVTVGYQLFKPSLITWLEQGKKLRAVDRGVLQGRDPQWSRTL

SEQ ID NO: 23927 - protein, 81 aa, Equus caballus
NLEPVTFKDIAIDFTQEEWALLDPSQRKLYRDVMLENISHLVSVGYELRKSDVISELEQGKELWREEKGFPQGLSPGELQA

SEQ ID NO: 23928 - protein, 81 aa, Equus caballus
KEAFVAFRDVAVDFTQEEWRLLSPAQRTLHREVMLETYSHLVSLEIPLSKPKLISQLEQGDEPWIEERQCRLGLCPGSKLE

SEQ ID NO: 23929 - protein, 81 aa, Equus caballus
SQESVTFQDVAVDFTEKEWPLLDSSQRKLYKDVMLENYSNLASVDWETPSKTKWTILVEDIFGKETTNGVTMDRTHLGEKS

SEQ ID NO: 23930 - protein, 81 aa, Neovison vison
LPDLVTFEDVAVEFTQEEWALLAPSQRTLYRDVMRETCRNLASLGYHVDKPSLISQLEQEDKVVTEERGVLPGTCPDLETV

SEQ ID NO: 23931 - protein, 81 aa, Neovison vison
VTFTDVAVNFTREEWALLDSRQRILYRDVMLENCRNLASLDLLTQHQTKNSTPQPDILAKKTTVEAKRVCTVSHASRLSLL

SEQ ID NO: 23932 - protein, 81 aa, Neovison vison
VPALFDEVAIYFSDEEWEVLTEQQKALYREVMRMNYETVLSLGKALFSFVSWKLGAQRVVPMSLLWCVRHPFLLNVDSVSS

SEQ ID NO: 23933 - protein, 81 aa, Capra hircus
QGGVTFPDVAVRFSQREWRLLDETQRRLYLDVMLENYTLVSSLGCCCGAEGEETPCENTVPVGVSWTGSPTAAPFSQKTHP

SEQ ID NO: 23934 - protein, 81 aa, Loxodonta africana
SQELVTFEDVAVYFIRKEWKRLEPAQRNLYRDVMLENYGNVFSLDGENRRENDQEISEDTGSHGVLLGRFQKDISQGLKFE

SEQ ID NO: 23935 - protein, 81 aa, Capra hircus
LQEALTFKDVAVTFTEEELGLLDLAQRKLYRDVMLENFRNLLSVGHQSSKPDMISQLEREEKFWTTEIQPQRGVCSGGWNH

SEQ ID NO: 23936 - protein, 81 aa, Capra hircus
SQDSVTFADVAVNFTQEEWTLLNCFQRKLYRDVMLENYKNLTAAGYQVFKPTLISWLEEEELSTVEKGVLQEWGIQLKAKD

SEQ ID NO: 23937 - protein, 81 aa, Sarcophilus harrisii
SQIPLTFQDVAVDFTWEEWGLLEPSQKDMYWDVMLEIYENFISLGGVPLSIPDVISQLERMEAPWMTQGGVLISTFLDSST

SEQ ID NO: 23938 - protein, 81 aa, Sarcophilus harrisii
SQKALTFQDVAVEFTPEEWGLLEPAQKDMHRDVMLENYENFVFLDLPVPKPTLIFHLEKRETPWLSAGDIIRYTCPDFLVQ

SEQ ID NO: 23939 - protein, 81 aa, Lipotes vexillifer
PVLFEDLAVYFSQEECVSLHPAQRSRSRDTPQECLEDMALMGGEGKIEINQKLRLESMGLEELALEKYSIAMPLVYYPEKS

SEQ ID NO: 23940 - protein, 81 aa, Lipotes vexillifer
MFKEAVTFKDVAVTFTEEELGLLDSTQRKLYQEVMLENFRNLVSVGYHPFKHDIFHLEKEKRLWVVKTATQKEGTSAKNQA

SEQ ID NO: 23941 - protein, 81 aa, Lipotes vexillifer
EAQETLTFDDVAVDFTWEEWQFLAPPQKDLYRDVMLENYSNLLSVGFQASKPDILSKLDQGEPWMMEDEIHCQTHSEVWKV

SEQ ID NO: 23942 - protein, 81 aa, Callorhinus ursinus
AQDSVTFEDVAVYFSWEEWGLLDEAQRRLYHDVMLENFALVTTLGCWHGAEDGKAPSEQAASIGVSQVRTHHAGSYPQKAH

SEQ ID NO: 23943 - protein, 81 aa, Callorhinus ursinus
MLENYRNLVSVGYEASKPDSVFQLEQGEPPWMVEGAAQSQTCQEEIWEIDHMQWHPENQNESKTLERYQQSNALGNNFDLC

SEQ ID NO: 23944 - protein, 81 aa, Callorhinus ursinus
SQASVSFKDVTVEFTQEEWQQMGPIQRTLYRDVMLENYNNLVSVGNCIFKPAVIFKLEQGEEPWFLEEEFSNQSHREDYRD

SEQ ID NO: 23945 - protein, 81 aa, Callorhinus ursinus
LLTFRDVAIEFSPEEWECLDPAQRALYRDVMVENYRNLVSLDISVRSMIKKLSPKEDISKEELFQTLMLERHKRNDIKDLG

SEQ ID NO: 23946 - protein, 81 aa, Callorhinus ursinus
LLTFRDVAIEFSPEEWECLDPAQRALYRDVMVENYRNLVSLGEDSFPPEESLALNVISILEPGTEPRAVEGEVKIEKKPSG

SEQ ID NO: 23947 - protein, 81 aa, Tursiops truncatus
KLKPAEAQQVGMSQDEEFWNTHQSLQELLIRNTHKETEPVCERALFVLPKTKVICCLEQGEEPWVQGPPIFKDSPEELFSE

SEQ ID NO: 23948 - protein, 81 aa, Tursiops truncatus
APLPLTSEDVAVYFSEQEWRDLEPWQKELYKQVMNTNYEILVSLDDGLPKPELISWLEQGRERFRIWGQSQKSGNIICTSA

SEQ ID NO: 23949 - protein, 81 aa, Tursiops truncatus
QDPVAFEDVAVNFTLEEWALLGPSQKKLYRDVMRETLRNLASIGEKWEDHNTEDQYKNQGRNLRSHTLRRCCESEEGSQCG

SEQ ID NO: 23950 - protein, 81 aa, Tursiops truncatus
PLESVTFEDVAINFTQEEWALLDTSQKTLFRNVMLENITHLVSVGYQISKSDVISQLEQGKELWSEATGCLQGQSPGSESP

SEQ ID NO: 23951 - protein, 81 aa, Equus caballus
MFQVTFSDVAIDFSHEEWGWLDSAQRDLYKDVMVQNYENLVSLAGLSIPKPYVITLLEDGKEPWMVEKKLSEGVYSGWESR

SEQ ID NO: 23952 - protein, 81 aa, Equus caballus
SQASVSFKDVTVEFTQEEWQQMGPIQRTLYRDVMLENYKNLVLVGNCTYKPEVIFKLEQGEEPWFLEEEFSNQSLQVLGDC

SEQ ID NO: 23953 - protein, 81 aa, Equus caballus
AQGCVTFEDVTIYFAQEEWGLLDEAQRLLYCDVMLENFALIASLGLTSFRSHVVAQLELGAEPWVPDRVDMTSAMARGLYG

SEQ ID NO: 23954 - protein, 81 aa, Equus caballus
LQVLVTFKDVAVTFTQEEWGQLDLHQRTLYQEVMLETCRLLVSLGHPVPTPEFFPLLEHRQELWTVRTGLSHSPCPGDTTK

SEQ ID NO: 23955 - protein, 81 aa, Equus caballus
AQESLTLEDVAVEFTWEEWQLLAPAQRNLYRDVMLENYSNLVSVGYQVSKADALSKLEQIEPPWTLEDEIHSQPHPEFEKV

SEQ ID NO: 23956 - protein, 81 aa, Equus caballus
GFGSLTFSDVAIAFSQQEWEGLDPVQKTLYQDVMMENYRNLLSLGHAISKPGVITLLEQGKEPWMVVREETRRWCPVFLDF

SEQ ID NO: 23957 - protein, 81 aa, Neovison vison
DPVTFKDVAIDFTLEEWRLMDPSQRNLHKDVMLENYRNLVSLGLAVSKPDMISHLEAGKGPWVVVREIARTPYPELETKPA

SEQ ID NO: 23958 - protein, 81 aa, Neovison vison
YRDVMLETFGHLLSVGPELPKPEVISQLEQGTELWAAERGIAQGYYPGWESGPESHTPPKEHGLPEMEPSCVTEREGFLMD

SEQ ID NO: 23959 - protein, 81 aa, Sousa chinensis
QGSTPFNSVTVAFTQKGWRQLAPTPRDRFKKGMPEKSRNLVLLDWKIVSESPPEQDISEESFQDPSVEMPSGESDHRNSEL

SEQ ID NO: 23960 - protein, 81 aa, Pteropus vampyrus
LAEGMNFEDVAIDFSQEEWGLLDEAQRLLYYDVMLENFALVASVGCWHKTEDEEAPSEQSESVGEARVRASKTAPTIQKTH

SEQ ID NO: 23961 - protein, 81 aa, Pteropus vampyrus
TARSQASVTFKDVAMDFTPEEWGKLDPAQRDTMLENYRNLVSLWLPVSKPENYSLENGKDPLMLERKAPKSSYSDLESGPE

SEQ ID NO: 23962 - protein, 81 aa, Pteropus vampyrus
AQESVMFRDVAVDFSQEEWECLDPAQRDLYREVMLENYSNLVSMGLYIPKPQVISLLEQGKEPWMVGRELTRGLCSDLESM

SEQ ID NO: 23963 - protein, 81 aa, Pteropus vampyrus
AQEPVTFADVAVLFTPEEWMFLDSAQKSLYRDVMLENYRNLASVGDQLCKPSTFSCLEQREELWTTERGTFPGDHPEPQLQ

SEQ ID NO: 23964 - protein, 81 aa, Pteropus vampyrus
SVTFQDVAVGFSPEEWALLDHSQRRLYREVMLETRRNLASVGKACVTCSHLFSISCVPRAMPGSGSFLVDKEATVLPTWGS

SEQ ID NO: 23965 - protein, 81 aa, Pteropus vampyrus
SQEPVTFRDVAVDFTQEEWGQLGPAQRTLYRDVMLETFGHLLSVGKHTAKPEVISLLEQGEEPWLVEHAPPQRICPEMMKN

SEQ ID NO: 23966 - protein, 81 aa, Trichechus manatus
QESVTFKDVAVDFTLEEWGWLGPGQRELYRDVMLENYQNLLSLGAGLPGTKPDVISRLERGEEPKMEERQARWVTCSDLEK

SEQ ID NO: 23967 - protein, 81 aa, Trichechus manatus
LQESLSFEDLSVDFTQKEWQLLDPSQKDLYKDVMLENYSSLVSLGYEVMKPDVIFKLEQGEEPWIVDGEIASSDSPEEVWQ

SEQ ID NO: 23968 - protein, 81 aa, Trichechus manatus
PKAVENEQIPDFTQEEWEQLDPSQRILYMDVMLENYSNLLSVEVWKADDQMERDHRNPDEQARQFLILQSQTPVEERGNLF

SEQ ID NO: 23969 - protein, 81 aa, Trichechus manatus
VVFEDVAVEFTQEEWALLDFSQRKLYTDVMMDTLRNLDSVFLQDTNGQILPIKCDSCSSMLGEICEFHGIERQHNHQRKHM

SEQ ID NO: 23970 - protein, 81 aa, Trichechus manatus
IVASVSFKDVAVELTQEEWQHMGPAQRTLYRDVMLENYSHLISVGYCITKPEVIFQLEQGGEPWSLKEEFPNNSYPVHQET

SEQ ID NO: 23971 - protein, 81 aa, Trichechus manatus
DSVVEDVAADFTQEEWALLDHSQRQLYRDVMMEIFRSLASVASQNLIDGDKLSTENIIVRFMKNDTWSSMVGEICELPGTQ

SEQ ID NO: 23972 - protein, 81 aa, Trichechus manatus
CGGSVVFEDVAVDFTQEEWAFLDPAQRKLYRDVMLETFRNLASVDDETPFKANGSISQESTPEEKISNEDKILKFRRNDSW

SEQ ID NO: 23973 - protein, 81 aa, Zalophus californianus
MLENCGLLVSLGCPVPRPELIYQLQHGQELWTWKRDLSQSAYPGDKGKPKTTESTASEPALSEGVSFQEQLTQGVPGITQV

SEQ ID NO: 23974 - protein, 81 aa, Zalophus californianus
GVTFEDIAVYFSWKEWKLLDEAQRRLYHHVMLENFTLISSLGCCCGAEDEAPFAQSTSVGVSQTRTPKAAQSSRKTHPCEM

SEQ ID NO: 23975 - protein, 81 aa, Zalophus californianus
SVTFEDIAVYFSWEEWRLLDEAQRCLYHDVMLENFTLISSLGCCCGAEDEAPFAQSTSVGVSQTRTPKAAQSSRKTHPCEM

SEQ ID NO: 23976 - protein, 81 aa, Zalophus californianus
MLENYGHLLFLGLIASKPDLIIFLEQEEQLWVVKRKETVAFHPGRQIHTGEKLYICKECGKAFKRLQHLSQHHRIHTGEKP

SEQ ID NO: 23977 - protein, 81 aa, Zalophus californianus
RWGWLIQRMLLESAKEWVLLDEAQRHLYHDVMLENFALIASLVCWHGMEDEEAPFEQSISGEVLSWVRTPKAGPSTQKTHP

SEQ ID NO: 23978 - protein, 81 aa, Zalophus californianus
PQESVTFKDVAVDFTQEEWHHVDAAQRRLYRDVMLENYSHLVSLGYQVSKPEVIFKLEQGEEPWISEGEIQRPFCPDWKTR

SEQ ID NO: 23979 - protein, 81 aa, Zalophus californianus
VSRSLENDGVCFSEQEWENLEDWQKELYRNVMKSNYETLVSLKVLGQTEGEAELGAGMLGDLEEEGPGDVHPAEGVMIKQE

SEQ ID NO: 23980 - protein, 81 aa, Zalophus californianus
PKVPVTFDDVAVYFSEPEWGKLDEWQKELYKHVMRGNYETLVSLDYAISKPDILTRMERGEEPCPEGPWGQEEGSKREAAR

SEQ ID NO: 23981 - protein, 81 aa, Zalophus californianus
SQGLVTFRDVALDFSQEEWEWLDQSQKDLYRDVMLENYRNLVWLGLSISKPNMISLLEQGKEPWMVEKEMSDGQCADWDSW

SEQ ID NO: 23982 - protein, 81 aa, Zalophus californianus
SRSLENDGVCFSEQEWENLEDWQKELYRNVMKSNYETLVSLKVLGQTEGEAELGAGMLGDLEEEGPGDVHPEGVMIKQEIQ

SEQ ID NO: 23983 - protein, 81 aa, Zalophus californianus
SQHLVTFEDVAVNFTQEEWTLLDQTQRDLYRDVMLENYQNLIILGCESCKPDLNSSMGGAEELRTGGRGILQELDLQLKTK

SEQ ID NO: 23984 - protein, 81 aa, Equus caballus
KVPVTFVDIAVYFSEDEWKNLDEWQKELYNNLVKENYKTLMSLDSEGPVPKPDAPTQAEPREEPCMWEQRDPEEREILMDP

SEQ ID NO: 23985 - protein, 81 aa, Equus caballus
CQESVTFEDVAVIFTDEEWRHLVPIQRDLYKEVMLENYKSIVSLGLPVPRPDVIFQLKTGDEPWRVDCHGAEERECSETVP

SEQ ID NO: 23986 - protein, 81 aa, Equus caballus
DEALMAFRDVAVAFTQKEWKLLSPAQRTLYRDVMLENYSHLVSLGIAFSKPKLITQLEQADEPWREESEGVLDLCPEPEAE

SEQ ID NO: 23987 - protein, 81 aa, Equus caballus
AHALVTFSDVAIDFSQEEWACLDSTQRDLYWDVMLENYSNLVSLDLESPYETKSLPIEKGIYEINFSKWNSNGKRKSLGVD

SEQ ID NO: 23988 - protein, 81 aa, Equus caballus
SLGSDLFRDVAVVFSQEEWEWLAPAQRDLYRDVMLETYSNLVSLGLAISKPDVISFLEQGKEPWMVEKVATGGLCPVLESR

SEQ ID NO: 23989 - protein, 81 aa, Equus caballus
AQGQVNFEDVFVYFSQEEWGLLDETQKLLYRDVMLENFALMASLGNASSMSREVTPLELGSELWVPDWADGTPAMTREAQH

SEQ ID NO: 23990 - protein, 81 aa, Neovison vison
SQGLVTFEDVAVYFSLEGWERLDADQRDLYKDVMQENYGILVSLGYPIPKPDLIFRLEQGEEPWVPDSPRPEEGDIVTGVY

SEQ ID NO: 23991 - protein, 81 aa, Neovison vison
GHREPASASFHPPRIQEEWGLLDPSQKELYWDAMLEKYGTVVSLAGIPAPQPEAREELEPGALRTGTEGRRSLHPGDESES

SEQ ID NO: 23992 - protein, 81 aa, Neovison vison
VMRGNYESLVSMDYAISKPDLMSQMERGERPTVQEQEDSEEGETPADPSAAHDGIVIKIEVQTNDEGSESLETPEPLMGQV

SEQ ID NO: 23993 - protein, 81 aa, Neovison vison
LMEAVTFGDVAVHFSREEWQCLDPGQRALYKEVMLENYKSIVSLGLPVPQPDVIFQLKRGDEAWVVDLHGSEERECPENVS

SEQ ID NO: 23994 - protein, 81 aa, Neovison vison
ENYSNLVSVGYQASKPDALSRLERGEEPWAKQEEVPSGTRQEPSKVHNHLQGHWENPRMLKGMEQNHKNDAFGNTVPQSKN

SEQ ID NO: 23995 - protein, 81 aa, Neovison vison
DVMLENYSHLVSMGHSVSKPDVISFLEQGKEPWLVDRELTRDQWPVLESRCETKKLFLKKEIYEIESAQWEIMERLTRHDL

SEQ ID NO: 23996 - protein, 81 aa, Loxodonta africana
KPGVVRFVDVAVYFSPEEWACLRPAQRALYRDVMRETYGHLGALGFPGPKPALISWMEQENEAWSPAAQDPEERENLGGVP

SEQ ID NO: 23997 - protein, 81 aa, Capra hircus
RLTFQDVALDFTQEEWECLDLSQRELYRDVMLENYRNLASLAVSSHNTHGLMSKNPRLENLIQKANLGIHERAHLGNEHLM

SEQ ID NO: 23998 - protein, 81 aa, Pteropus vampyrus
MPVTFEDVALYLSREEWGRLDHTQQSFYHDVLQKRNRLALGVSSSQRTLGSLDFSHRAVEVGKEEPMPCPASHGDVKSFRT

SEQ ID NO: 23999 - protein, 81 aa, Pteropus vampyrus
AQESLTFDDVAVDFTWEEWQLLAPTQKDLYRDVMSENYSNLVSVGCQAKKPDTLSRLDQGEPPWTMADEVHPRSRSGIWKV

SEQ ID NO: 24000 - protein, 81 aa, Pteropus vampyrus
FQGSVMFRDVSINFSQEEWECLDPGQMNLYKEVMLENFSNLVSVGLSSAKPVVISLLEEGKEPWMVEREVKRGLCSDLESM

SEQ ID NO: 24001 - protein, 81 aa, Pteropus vampyrus
MDMVVFEDVAVDFSQEEWALLDAAQRELYREVMLETCQNLASVGKIWEELSIEDQYTHQERQERNHVMERLWESNDQCGEG

SEQ ID NO: 24002 - protein, 81 aa, Pteropus vampyrus
CEGPVSFEDVTIDFSREEWQQLDPAQRHLYQDVMLEICSHLFSVGYHVPNPEVIFRMEKEAKLPHRRCQEEEFGLETQQQE

SEQ ID NO: 24003 - protein, 81 aa, Pteropus vampyrus
PEESVTFKDVAVDFTQEEWGQLDSPQRALYRDVMLENYQNLLALGPPVCKPDVISHLERGEEPWQVPREVPGGAHPEWEPR

SEQ ID NO: 24004 - protein, 81 aa, Trichechus manatus
MESVVFEDVAVDFTLEEWALLDPVQRKLYRDVMLETFRNLASVDDETPFKANESVSQRDTHEKKISKEDKILKFTRNDSWS

SEQ ID NO: 24005 - protein, 81 aa, Trichechus manatus
SQSLVIFGDVSVVFSQDEWEWLNPAQRSLYRNVMLENYRNLVSLGLCISKPDIISLLEQGKEPWMVKRKMTRGWGPDLKPL

SEQ ID NO: 24006 - protein, 81 aa, Trichechus manatus
AQESLSFEDVAVGFTWEEWQLLDPSQKDLYKEVMLENYNNLVSVGYPATKPNPVFKLEQGEPPWIVEGAIHSWTSPEEIWA

SEQ ID NO: 24007 - protein, 81 aa, Trichechus manatus
SQGLLTFRDVAIEFSQEEWDCLDPAQKALYKDVMLENYRNLVSLGISIPELNLISILEQGAEPWTVEIKVKIAKNLGRWEC

SEQ ID NO: 24008 - protein, 81 aa, Trichechus manatus
QQRSVSLKDVVVGFAQEARHQLIPAQRALYQDVMLETYRNLISVGYEGTKPDVILKLEAEEEPWISKAVCPGCYCQEDFWE

SEQ ID NO: 24009 - protein, 81 aa, Trichechus manatus
LKASVSFKDVAVELTQEEWQHMGPAQRTLYRDVMLENYSHLVSVGYCIFKPEVIFKLEQGEQPWFLEQEFSNQSYPEDYNI

SEQ ID NO: 24010 - protein, 81 aa, Trichechus manatus
AQESLTFNDVGMEFTLEEWQLLDAAQKKLYWDVMLENYRNLVSIGYQVSKPEALSRLEQRKQSWTISDENHRGVFSEIRKV

SEQ ID NO: 24011 - protein, 81 aa, Trichechus manatus
MGEGLTFKDVAIYFSQKEWECLESTQKDLYRDVMLKNYDILVSLGLPDSKPSVISLLEQGKEPWMVRREEAEGWCPDWESR

SEQ ID NO: 24012 - protein, 81 aa, Trichechus manatus
TSKEAVTFNDVALVFTEEELGLLDSAQRKLYRDVMVENFMNLVSMGIHPFKHNIFYLIREKSLWIMKPRTQREGNSGSKIQ

SEQ ID NO: 24013 - protein, 81 aa, Trichechus manatus
GGELITFKDVAVDFTWWEWEQLDPTQKDLYREVMLENFRNLASLGLLLSKPYVICQLEEGEEPCVLEREISAGAHSDWERK

SEQ ID NO: 24014 - protein, 81 aa, Trichechus manatus
AQDSLTFSDVAVKFTWEEWQLLDPAQKDLFWDVMLENYNNLVSLGYRVSKPDALSRLEQGEQPWTILDESHNQNFSGKEQG

SEQ ID NO: 24015 - protein, 81 aa, Zalophus californianus
RPESVTFEDVAVYFSENEWTGLAPAQRVLYRDVMLENYGAVASLAAFPFPKPALISQLERGEAPWCKAPQGARDGEGPRGV

SEQ ID NO: 24016 - protein, 81 aa, Zalophus californianus
MGEGGEEASFLVAKPALISLLEQGEEPGALILQGTEEPGSTASLCPDSRMQAAIKESCLRRVSSKQLGPLGTVWGHLPGGR

SEQ ID NO: 24017 - protein, 81 aa, Zalophus californianus
TPGVAGAAARMNTAQGCVTFEDVFVYFSREEWELLEEAQRLLYRDVMLENFALVSSLGLAVSRSHVVTHMEPEGSPGCLRR

SEQ ID NO: 24018 - protein, 81 aa, Zalophus californianus
PQASVSFKDVTVEFTQEEWRQMDSAQRTLYRDVMLENYSHLVSVGYCFTKPELIFTLEQGEDPWLLKKELLRKSSPEDSQP

SEQ ID NO: 24019 - protein, 81 aa, Equus caballus
GTGWGTFEDVAVYFAQEEWELLDEAQRHLYRDVMLENLALVASLGCASSKSRVAAQLGEGKEPWVLDRVDVSPHSREKPFT

SEQ ID NO: 24020 - protein, 81 aa, Equus caballus
QQGGVTFEDVAIYFSLKEWGLLDEAQRRLYRDVMLENLALITSLGCCHEAENKEDPFEQSVSVQRVSQVRTPKADLPPKKV

SEQ ID NO: 24021 - protein, 81 aa, Equus caballus
FWILRLPPGSKGEAPKEWGKLDEWQKELYKHVVRGNYETLVSLGSGPPVPAPDLLMQIKQEGELQLQEQQALGVEAWAAGQ

SEQ ID NO: 24022 - protein, 81 aa, Equus caballus
ARALVSFEDVAVTFTVEEWRHLDLAQRTLYQEVMLETCGLLVSLGHPVPKPELISLLEHGQELWSGKKVRFKSTYTGERRK

SEQ ID NO: 24023 - protein, 81 aa, Neovison vison
ENYSHLVSVGYDSTKPKVILKLEQGEEPWVAEGEVPCQSQPEEVWKADDPIERIPGSEDEHSRQAISINSKTPVEERENAF

SEQ ID NO: 24024 - protein, 81 aa, Neovison vison
SKVPVTFGDLAIYFSQEEWEWLHPAQRDLYRHVMLENYGHLVSLGLNISKPYVVSLLEQGRDPWLDNRDVRRDLFSESKGE

SEQ ID NO: 24025 - protein, 81 aa, Loxodonta africana
ESVTFRDVAVLFSQEEWGQLDPAQRALYREVMLENYSNLVSLGIPFSKPKVISQLQQGEDPWMVDKGVPQGTRQGLKTWPK

SEQ ID NO: 24026 - protein, 81 aa, Capra hircus
QAQETLTFADVAVDFTWEEWQLLAPVQKALYWHVMLENYSNLVSAGFQASTSEVLSKLDQGEPWMMDDEIHCQTLSEVWKV

SEQ ID NO: 24027 - protein, 81 aa, Capra hircus
LQGSVTFQDVAVEFTPEEWQLLDCDQRTLYWDVMLENFRNLISVGCPVTETTVIFRVEQGQEPWMVEGEDSRWSSPEADCP

SEQ ID NO: 24028 - protein, 81 aa, Chrysochloris asiatica
PKVPVTFDDVSIYFSTSEWEKLEEWQKELYKNIMKGNYGSLVSMDYAMSQPDVLSQIQPEGGQGAPGESELPTDPSEEPGI

SEQ ID NO: 24029 - protein, 81 aa, Chrysochloris asiatica
SQGLVTIKDVSLCFSQEEWRSLDPSQTDFYGEYVMQENCGIVVSLRFPIPKLDMLTQLENGEEQWVPDPHDLEDRDILRVT

SEQ ID NO: 24030 - protein, 81 aa, Chrysochloris asiatica
TQESVMFSDVSIDFSQEEWEYLNEDQRDLYRDVMLENYSNLVSMGYSISKPDVISFLEQRKEPWFVDRELTRGQWPVLESR

SEQ ID NO: 24031 - protein, 81 aa, Chrysochloris asiatica
MAFRDVAVDFTQEEWRLLSSAQRALYREVMLENYGNLVSLGIPFSKPRLITQLEQGKDTWREETKCPPAICPELKPEIQLC

SEQ ID NO: 24032 - protein, 81 aa, Mandrillus leucophaeus
DSVTFDDVAVDFTQEEWTLLDPTQRSLYSDVMLENYKNLATVGKTGLIPSCSEPRSGWEMQLETQWSALQQDSLTGQTSIG

SEQ ID NO: 24033 - protein, 81 aa, Lipotes vexillifer
SDSVGFEDVAVNFTAEEWALLDPAQRKLYRDVMLETFRNLASVEVLGCLGVNHLVESLCEGKEGHQCLETQNQLTHLTVHK

SEQ ID NO: 24034 - protein, 81 aa, Callorhinus ursinus
VHQALLTFRDVAIEFSQEEWGCLTHTQRQLYRDVMLENYGHLLFLGLIVSKPDLVSFLEQKKEPWDVKRKKTVAIPRGRWE

SEQ ID NO: 24035 - protein, 81 aa, Callorhinus ursinus
GLVTFRDVAIDFSQEEWECLDPAQRDLYVDVMLENYSNLVSLDLESTYETKNTISEKDIFEINFSQWEMKERSKTLGLEAS

SEQ ID NO: 24036 - protein, 81 aa, Callorhinus ursinus
AQGLMAFEDVAVYFSQEEWELLDPAQRALYCHVMLENFTLVASLGLSASRPRVVIQLERGEEPWVLGGTVATPARNAHRKP

SEQ ID NO: 24037 - protein, 81 aa, Callorhinus ursinus
FQESVTFEDVAVYFSENEWTGLAPAQRVLYRDVMLENYGAVASLAAFPFPKPALISQLERGEAPWCKAPQGALDGEGPRGV

SEQ ID NO: 24038 - protein, 81 aa, Tursiops truncatus
VTFKDVAVDFTQEEWQYLDPPQRDLYRDVMLEDYINLISVDEDRFPVLVGYKTTKPALIYKLEQGEEPWMVEREISSWRYP

SEQ ID NO: 24039 - protein, 81 aa, Tursiops truncatus
QGSVTFEDVAVYFSWEEWCLLDEVQIHLYLDVMLENFAVVCMLGSFPAVEDEEMPSEQSVSAEGVSQMRTPRAGSSPERAQ

SEQ ID NO: 24040 - protein, 81 aa, Equus caballus
VKKLVTFEDVAVNFTREEWECLDASQRVLYQDVMSKTFENLMSVARFFLSNPNLTTKLEQEEKQWRADLCHQNEKGLPSEG

SEQ ID NO: 24041 - protein, 81 aa, Equus caballus
FQESVTFEDVAVYFTENQWASLDPVQRALYREVMLENYANVTSLVAFPFPKPHLILQLEQGEAPWGLDPWTPVVGEALRCV

SEQ ID NO: 24042 - protein, 81 aa, Equus caballus
ALLDGAQRKLYRDVMLETFRNLVSVDNEIQLKTNGSISQRDIFEEKLSNEQKIARFTKNDSWTSLLGESWEDQCIEDKHNN

SEQ ID NO: 24043 - protein, 81 aa, Equus caballus
LQESFSFEDLSVDFTQKEWQLLGPHQKDLYRDVMLENYSSLVSLGYEVTKPDVIFKLEQGEEPWVGDGEVPSSDSPEQLLQ

SEQ ID NO: 24044 - protein, 81 aa, Equus caballus
FQEAVTFGDVAVHFSREEWQCLDPGQRALYKEVMLENHSSVAGLAGFLVFKPELISRLEQGQEPWVLDLQGAEGDEAARTS

SEQ ID NO: 24045 - protein, 81 aa, Chrysochloris asiatica
APGSVSFKDVAVDFTQEEWQRLDTSQKTIYKDVMLENYSHLISLGHPIIKPDVITKLEQGEEPWIVEGEFLLQSYPEEAQK

SEQ ID NO: 24046 - protein, 81 aa, Suricata suricatta
MASSQGLLPFRDVAIGFSQEEDVMLENYGHLFFLGCLVSKPDLVIFLEKKQVLWDVKRKETVASYPAVSLDDTEKLLPKIF

SEQ ID NO: 24047 - protein, 81 aa, Suricata suricatta
AQESVTFRDVAVVFSRDEWLCLDPAQRSLYREVMLENYGTLVSLGILFSKPKVIFQLQQGEDPWMVESGVSQGPCVGWESM

SEQ ID NO: 24048 - protein, 81 aa, Suricata suricatta
MFQVTFSDVAIDFSHEEWGWLDSAQRNLYKDVMVQNYENLVSLGLSIPKPYVISLLEDGKEPWMVEKKLSKDWESRWEKKE

SEQ ID NO: 24049 - protein, 81 aa, Chlorocebus sabaeus
PLTFKDVAIEFSQEEWKCLEPVQKALYKDVMLENYRNLVFLGISPKCVIKELPPTEDSNTGERFQTVALERHQSYDIENLY

SEQ ID NO: 24050 - protein, 81 aa, Suricata suricatta
PQASVSFKDVTVEFTQEEWRQMDYAQRTLYRDVMLENYSHLVSVGYCFTKPELIFTLEQGEDPWLLTKEFLRKTSPEESQP

SEQ ID NO: 24051 - protein, 81 aa, Chrysochloris asiatica
DSVIVEDVAVVFTQEEWALQELAQRKLYRDVMMETFRNLASVDGYKTYCCPSPFILHSSFHNKEKCHECQECGKAFSDSSA

SEQ ID NO: 24052 - protein, 81 aa, Suricata suricatta
KFQEAVTFKDVAVVFTEEELGLLDPAQRELYRDVMLENFRNLVSLGHSSSKPDMISQLEREEKLCVKDVHAQRGGHAVWTL

SEQ ID NO: 24053 - protein, 81 aa, Suricata suricatta
ISFEDVAVDFSLEEWQLLNPTQKNLYRDVMLENYSNLVFLEVWLDNNLKMWHQHNQDTLRRMERGREYDVFRKIFHSSINF

SEQ ID NO: 24054 - protein, 81 aa, Equus caballus
SDSLERNTHQGCALAGTLPALLDTSQRKLYRDVMLENISHLVSMGYQHCKSDVIFQLEQEELWSEGTGFLQGQSPGRESGR

SEQ ID NO: 24055 - protein, 81 aa, Equus caballus
MAHLVALRDVAVDFSQEEWECLDSEQKDLYRDVMLENYSNLVSLGLCIYQPDVFSLLKKGKEPWMVSKDKTTGSCSDVQSR

SEQ ID NO: 24056 - protein, 81 aa, Equus caballus
SQGLVTFRDVALGFSQEEWEWLDSSQKDLYRDVMLENYRNLVWLGLSISKPNMISLLEQGKEPWMVEREMSDGQYADWESW

SEQ ID NO: 24057 - protein, 81 aa, Neovison vison
KVPVTFVDIAVYFSEDEWKNLDEWQKELYNNLVKENYKTLMSLDTEGTVPKPDAPSQVEPREEPCVWEQRDPEDREILMDP

SEQ ID NO: 24058 - protein, 81 aa, Neovison vison
DVMLENYNNLVSVGNCIFKPAVIFKLEHGEEPWFLEEEFSNQSHQEIRDDDLMKKNKKIQDKHLQEIIFIDNKPLTIKEEE

SEQ ID NO: 24059 - protein, 81 aa, Loxodonta africana
LQEFVMFRDVAVFFSQEEWGQLDTAQRALYREVMLENYSNLVSLGIPFSKPKVISQLQQGEDPWMVDKGVPQGACQGWKSF

SEQ ID NO: 24060 - protein, 81 aa, Loxodonta africana
PKVPVTFDDVAVYFSEQEWGKLDEWQKELYKHVMRGNYETLVSLDYAISKPEVLSQIEQGKEPCSWRRAGPKIPDVPVDPS

SEQ ID NO: 24061 - protein, 81 aa, Capra hircus
MAAHSKEWQQLDLDQKNLYRDVMLETCSHLLSIGYQVPEIEVFMLEQGKEPWALQGEGPYQSCPGEKLQDHNQCGKILSYE

SEQ ID NO: 24062 - protein, 81 aa, Chrysochloris asiatica
CVTLEDVAIYFSLEEWSLLDESQRLLYYNVMLENFALITSLGYGHEMETQETPPEHCVFIEGLSQDRTLNVDLSIQKHYPD

SEQ ID NO: 24063 - protein, 81 aa, Chlorocebus sabaeus
AQEPVTFRDVAIYFSREEWACLEPSQRALYRDVMLDNFSSMAALGFCSPRPDLVSRLEQWEEPWVEDRESPELQAVQRGHW

SEQ ID NO: 24064 - protein, 81 aa, Chrysochloris asiatica
VTIEDVAVVFTHEEWDLLDPTQRKLYRDVMMETLRNLASREKPSESKKAIPEASSLPQRVSSHSGEMPYECKECGKTFRES

SEQ ID NO: 24065 - protein, 81 aa, Chrysochloris asiatica
CQEPVTFEDVAIIFTEEEWGHLVPIQRDLYKEVMLENYTSIVSLGLPVPQPDVIFHLKKEEEAWVVDLHESEERECPENVS

SEQ ID NO: 24066 - protein, 81 aa, Mandrillus leucophaeus
PQGLLTFRDVAIEFSQEEWKCLDPAQRTLYRDVMLENYRNLVSLDISSKCMLKTLSSTGKGNTEVIVTGTLQRQASHHTGE

SEQ ID NO: 24067 - protein, 81 aa, Chlorocebus sabaeus
AGYQVSKPEVIFKLEQGEEPWISEGEIQRPFCSDWKTRPEVKSSHLQQDVSEVSHCTHDLSHATLEDSWDVSSQLNRQQEN

SEQ ID NO: 24068 - protein, 81 aa, Mandrillus leucophaeus
TPEPHFAQATDMEQGLTRAPPVPQVPALPHEESPGDQAAVLLTVRYQQFVTFEDVAEWGYLDPVQRDPYRDVRLEIYGNVV

SEQ ID NO: 24069 - protein, 81 aa, Sus scrofa
RPGAVKFADVAAYFFQEEWGCLRPAQRALDRDVMREIYRHLGALGFAGLKPALISWMEGRKEVWRPEAEDPKKGRGTQVLG

SEQ ID NO: 24070 - protein, 81 aa, Mandrillus leucophaeus
SQGRVTFEDVTVNFTKGEWQRLNPKQRNLYRDVMLENYSNLVFVGREETTKPDVILRLEQGKEPWLVEEEVLGSGRPEKNG

SEQ ID NO: 24071 - protein, 81 aa, Sus scrofa
GTICSGQLVGIFFPFCAKNIDHFTWNRNVLFQGPVSFKAMAVNFTQEEWQYLDPPQRDLYKDMMLDNYISLISVGKDHFPG

SEQ ID NO: 24072 - protein, 81 aa, Sus scrofa
MAHDLVMFRDVTVDFSQEEWECLNSNQRNLYRDVILENYSNLVSLVITLLEQGKEPWMVVRDEKRRWSLDLESRYDTKKLF

SEQ ID NO: 24073 - protein, 81 aa, Aotus trivirgatus
GTVTFEDVAVKFSQEEWSLLSEAQRCLYHDVMLENLALISSLGCWYGANDETPSKQTLSIQQQSPLRSHWTGVCTKKAHPW

SEQ ID NO: 24074 - protein, 81 aa, Papio anubis
SLKKVTFEDVAIDFTQEEWAMMDTSKRKLYRDVMLENNSHLVSLGYQISKSYITLQLEQGKELWWKGREFLQGQNLNKESA

SEQ ID NO: 24075 - protein, 81 aa, Sarcophilus harrisii
PQECVTFKDVAVNFTQEEWQQLNPAQRDLYREVMLENYRNLISLGLPVSKPDVIFQLEQGEEPWMLDLQRIEEGEISRNMY

SEQ ID NO: 24076 - protein, 81 aa, Sarcophilus harrisii
LQESVTFSDVAVDFTLEEWGCLCPPQKEMYREVMLENYGNLVCLGLAMSKPDVISRLERGEAPRSPGGDLGSADWGTESGA

SEQ ID NO: 24077 - protein, 81 aa, Sarcophilus harrisii
AWKPMTFKDVSVDFTQGEWGQLDPAQRDLYRDVMLENYRNLVSLELQVIKPEVISRLERGEAPCMLEREGISSCPDNDTIS

SEQ ID NO: 24078 - protein, 81 aa, Pan paniscus
AQGLVTFRDVAIEFSLEEWKCLEPAQRDLYREVTLENFGHLASLGLSISKPDVVSLLEQGKDPWMIANDVTGPWCPDLESR

SEQ ID NO: 24079 - protein, 81 aa, Lipotes vexillifer
SQDPVSFEDVAIDFTQEEWQQLDPAQRTLYRDVMLENYSHLVSVGYPVSKPGVISKLEQGEEPWIMKKDVSNWIYPGENLA

SEQ ID NO: 24080 - protein, 81 aa, Lipotes vexillifer
FQDAVTFEDVAVVFTDEEWRCLVPAQRDLYKEVMLENYKSIVSLGLPVPGPDVIFQLKRGDEPWIVELHGSEGKECAENVS

SEQ ID NO: 24081 - protein, 81 aa, Lipotes vexillifer
GSVSFKDVTVDFTQEEWQQLDSAQRNLYKDVMLENYSNLVSVVKNINVFSVGKPSVESQDLLYIREFILGKNRTNVMTEKA

SEQ ID NO: 24082 - protein, 81 aa, Lipotes vexillifer
QGHVIFEDVAVSFSQEEWGLLNNAQRLLYCDVMLENLSLIASLGCWHGVEAEEAISEQCVSVEQVTEDRNPKLEPSILKPL

SEQ ID NO: 24083 - protein, 81 aa, Lipotes vexillifer
SHTLVTFKDILVNFTREEWKLLDPAQQLMYKDVMLENYRNLMSLGHQLPKPEVILQLEKGEEPWLMERGIHQESHPDLETA

SEQ ID NO: 24084 - protein, 81 aa, Pan paniscus
FQEMVTFKDVAVVFTEEELGLLDSVQRKLYRDVMLENFRNLLLVAHQPFKPDLISQLEREEKLLMVETETPGDGCSGRKNQ

SEQ ID NO: 24085 - protein, 81 aa, Pan paniscus
GTVTFEDVAVKFTQEEWNLLSEAQRCLYRDVTLENLALISSLGCWCGVEDEAAPSKQSIYIQRETQVRTPMTGVSPKKAHP

SEQ ID NO: 24086 - protein, 81 aa, Lipotes vexillifer
PQGSTPFNSMTVAFTQKGWRQLAPTPRDRFKKGMPEKSRNLVLLGLPVSQPGMNSQLEQREGSWMLEREGLRSTCPDWKIV

SEQ ID NO: 24087 - protein, 81 aa, Pan paniscus
TFKETVTFKDVAVVFTEEELGLLDPAQRKLYRDVMLENFRSLLLVGNQPFHQDTFHFLRKEEFWMMKTTSQREGNSGGKIQ

SEQ ID NO: 24088 - protein, 81 aa, Lipotes vexillifer
LQGLVSFKDVAVDFTQEEWQQLDPAQKTLYRDVMLENYSHLVSMGHPVSKPDVISKLEQGEDPWIIKRDISNWIYPYEDQA

SEQ ID NO: 24089 - protein, 81 aa, Callorhinus ursinus
SQEPVTFEDVAVYFTQNQWASLDPMQRALYLEVMLENYANITSLALPFPKPDLILQLEQGEAPWGLDPWTPLDGEALGGVH

SEQ ID NO: 24090 - protein, 81 aa, Callorhinus ursinus
MDSVVFEDVAVDFTLDEWALLDSMQKNLYRDVMLETFQNLVSVDYETLLKASGLVSQQDMHEKKKSNEQKMAKFTKNHSCA

SEQ ID NO: 24091 - protein, 81 aa, Callorhinus ursinus
LQGSVTFPDVAVDFTPEEWQLLDCEQRTLYWDVMLENFRNLISVGGPVTKTKAIFKAEQGQEPWMREGVNPRWRHPEADCL

SEQ ID NO: 24092 - protein, 81 aa, Callorhinus ursinus
WLTFRDVAIEFSQEEWECLDPAQRALYRDVMVENYRNLVFLAISSKCMIKELPPKENSNTGEVLQTVILERHKSRDTEDYA

SEQ ID NO: 24093 - protein, 81 aa, Tursiops truncatus
LLTFEDVALFFTEEEWQLLDPAQKILYHNVMQENYETVISLGLKLKNDTGNDQPMSLSTLEIQASGCKVLRKARMKVAQKT

SEQ ID NO: 24094 - protein, 81 aa, Zalophus californianus
VEGSVTFKDVTMAFTQKEWEQLDPAQRNLYKDVMLENYSNLASMGYQAPKPDMISKLEKGEEPWLGKGKRPRQCGPSEIAR

SEQ ID NO: 24095 - protein, 81 aa, Zalophus californianus
LLTFRDVAIEFSPEEWECLDPAQRALYKDVMLENYRNLVSLDISVRSMIKKLSPKEDISKEELFQTLMLERHKRNDIKDLG

SEQ ID NO: 24096 - protein, 81 aa, Zalophus californianus
QDSVTFEEVAVDFSQEEWALLDPAQKILYRDVMLENYRNLASVGYPLCKHSLIMEVEQEVLGTEEGAVLQGACTDWDIQLK

SEQ ID NO: 24097 - protein, 81 aa, Equus caballus
DHELLTFRDVVINFSQEEWDYLDSAQRDLYWDVMMENYSNLVSLDLESKYDTKNLSIEKDITENNSSEWKVTEGSKFLGFE

SEQ ID NO: 24098 - protein, 81 aa, Equus caballus
EAVTVLFDDVALYFSEEEWEILEKWQKEMYQQVMKTNYETLDSLGWVFSKPDLITWMEQGRMLFTRDQGHLEKTRITLSPS

SEQ ID NO: 24099 - protein, 81 aa, Equus caballus
QSPVTFEDVAVYFSKEEWGLLDAAQRHLYHNVMLENFELMTSLGCWHGVEDEEAHSKQTASVEGVSQVRIPSAHASTQKAD

SEQ ID NO: 24100 - protein, 81 aa, Equus caballus
AQGLVTFRDVAIEFSQEEWKCLEPAQRDLYRDVTLENFSNLVSLGLSIAKPDVVSLLEQGKEPWTIANDMPGAWCPDLESR

SEQ ID NO: 24101 - protein, 81 aa, Equus caballus
LQEPVTFRDVAVDFTQEEWGQLGPAQRTLYRDVMLETFGHLLSVGPELPKPEVISQLEQGAELWVMERGIAQGCCPDWEPG

SEQ ID NO: 24102 - protein, 81 aa, Equus caballus
FQEQVTFEDVVVDFTREEWGQLEPAQRTLYRDVMLETFGLLVSVGHWLPKLDVISLLEQVTEPWAVDKGLPQDLETRPQTK

SEQ ID NO: 24103 - protein, 81 aa, Equus caballus
NMDSVVFEDVAVDFTQEEWDLLNLAQRNLYRDVMLENLQNLASLGYPLHTPCLISHWKQEEDLERVKRGPIQGEHQEGFET

SEQ ID NO: 24104 - protein, 81 aa, Equus caballus
PLESVTFEDVAIDFTQEEWLLLDTSQRKLYRDVMLESIDHLVSIGYQIFKSDVIFQLEQGKELWSEGDGFLQGQSPVTLGS

SEQ ID NO: 24105 - protein, 81 aa, Equus caballus
TARSQASVTFKDVAMDFTPEEWGKLDPAQRDVMLENYRNLVSLWLPVSKPENYYLENAKEPLMLERKAPKSGYSDLETSPE

SEQ ID NO: 24106 - protein, 81 aa, Capra hircus
QAEVTFKDVAVFLSQEEWGLLGPAQKGLYREVMLETYRNLVSLGAGLAGPKPEVIVHLERGDELWVLDMRGAEQPSVDGSA

SEQ ID NO: 24107 - protein, 81 aa, Capra hircus
PSEGRLTFQDVAIDFTQEEWECLDLSQRKLYRDVMLENYGNLASLGLVSVLDLVTFLEQLKDPRNIRRMETTAIYPAVSPQ

SEQ ID NO: 24108 - protein, 81 aa, Lipotes vexillifer
FRGSVMFRDVSINFSQEEWECLDSGQMNLYKEVMLENFSNLVSVGLSSSKPTVISLLEQGKEPWMVDKELTRGLCSDLESM

SEQ ID NO: 24109 - protein, 81 aa, Pan paniscus
ESITLKDVAVTFSRGEWKKLEPFQKELYKEVLLENLRNLEFLDFPVSKLELISQLKWVELPWLLEEVSKGSRLDESALDKI

SEQ ID NO: 24110 - protein, 81 aa, Tursiops truncatus
MLDLEQKSLYREVLLENYRNLVSVEHQLSKPDVVSQLEEEEELWSVERGIPRDTFSECPEAQLDPQFHPFPAGNPLMKIEV

SEQ ID NO: 24111 - protein, 81 aa, Tursiops truncatus
TQVSVTFDDVAVTFTQEEWRQLDPAQRTLYQEVMLENCRLLVSLGCPVPRLELIFQLEQGQKLWTVKKDLSRSTCPGKRCR

SEQ ID NO: 24112 - protein, 81 aa, Tursiops truncatus
SVTFEDIAVYFSWEEWRLLDETQRRLYLDVMLENFALISSLGCCCGAEDAEAPFEQITSLGVSQARTPKADLSFQKTHPCE

SEQ ID NO: 24113 - protein, 81 aa, Tursiops truncatus
AAMSFADVAVYFSPEEWGCLRPAQRALYRDVMRETYGHLDALGDAPNKKEEEPKTGPGAKGSEKTPRKERPEELVKNSLDS

SEQ ID NO: 24114 - protein, 81 aa, Tursiops truncatus
MESVTLEDVAVGLIQEWALLDDARRNLCRYALLDNCRTLAPQAGTPSCKTCLVSQVGPREELMTAERGILCAMGVDWESQL

SEQ ID NO: 24115 - protein, 81 aa, Tursiops truncatus
LQETLTFRDVFVDFTLEEWQQLDATQRNLCKDVMLENYSHLVSVGFLVAQPGRTFRLGQGEEEARMAAGESPTQRCPDLHP

SEQ ID NO: 24116 - protein, 81 aa, Pteropus vampyrus
VKEPVTFKDVIVEFTREEWQLLDPSQRTLYREVMQENYGHLVSVGYCLNKPNAVFKLKQGKEPWILEVEFPRRNYPGENVA

SEQ ID NO: 24117 - protein, 81 aa, Trichechus manatus
QSAVAFEDVAVYFSGDEWRLLNVTQRHLYRDVMLENFALIGSLGCLCGAEDEGAPLKHVKSFRAHLLKKPFIRGESPKDVM

SEQ ID NO: 24118 - protein, 81 aa, Trichechus manatus
ALALVSFEDVAVTFTGEEWQYLDLAQRILYQEVMLETCGLLVSLGHPVPKPELIFLLEHRQELWTMKRGLSQSISPGEKAK

SEQ ID NO: 24119 - protein, 81 aa, Trichechus manatus
DSAVEDVVVDFTQEEWALLDLSQRQLYRDVVMEIFRSLASVASRNLIDGEKLSTEKIIVRFMKNDTWSSVVGEIHELHGTE

SEQ ID NO: 24120 - protein, 81 aa, Trichechus manatus
SVVIEDVAVEFTQEEWALLDLAQRKLYKDVMMETFRNLASIVSQNLNDGEKLSSEYLIVELMKNDTSFSILGEICKLHDIE

SEQ ID NO: 24121 - protein, 81 aa, Trichechus manatus
GLLTFEDVAVFFTQEEWDYLDPAQRSLYKDVMMENYGNLVSLDVLNKDKDEEPTVKQEIEEIEEEVEPQSVIVTRIKSEID

SEQ ID NO: 24122 - protein, 81 aa, Trichechus manatus
HKPVVTFKDVAVDFTREEWGLLGPTQRILYRNVMLRNYSNLVSLGLPDSKPDVISKLEQWEDPWIVERDVPRGSWPDSEPD

SEQ ID NO: 24123 - protein, 81 aa, Trichechus manatus
VTFEDVAVYFIRKEWKRLEPAQRDLYRDVMLENYGNVFSLDGENDQEISEDTGSHGVLLGRFQKGISQGLKFEEAYEQEVG

SEQ ID NO: 24124 - protein, 81 aa, Trichechus manatus
GPGCVTFEDVAVCFSREEWELLDVAQRLLYRDVMLETFGLMASLGLVSSRTHEITQLEQWSEPWVPDQEAMAPDTPRGCWR

SEQ ID NO: 24125 - protein, 81 aa, Trichechus manatus
FTESVTFKDVAVVFTEEEMGLLTPAQKKLYRDVMVENFRNLVSVGGKNPRQVETVPQAGAHEELSSLHIWQQIASDLTGCQ

SEQ ID NO: 24126 - protein, 81 aa, Trichechus manatus
GETHMAFRDVAVDFTQDEWRLLSSAQRTLYREVMLENYGNLVSLGIPFSKPKLIIQLEQGKETWREEKKCPPAICPAEPKP

SEQ ID NO: 24127 - protein, 81 aa, Zalophus californianus
LHKPVTFKDVAVDFTQEEWGLLGPTQRILYRDVMLRNYSNLVSLGLPDCKPDVISKLEQWEDPWTVKRDVPRGPDSEPGPR

SEQ ID NO: 24128 - protein, 81 aa, Zalophus californianus
FQGSVSFKDVTVGFTQEEWQRLDPAQRSLYRDVMLENYSNLVSLGYCVTKPEVIFRLEQGEEPWILEEEFPSQSFPEIWKT

SEQ ID NO: 24129 - protein, 81 aa, Zalophus californianus
SVTFRDVTVDFTQEEWQQLEPAQKDLYRDVMLENYRNLVSLDLETRPEMKESGPKEDSAEDRPSVGAVVEGPPRNGARGLA

SEQ ID NO: 24130 - protein, 81 aa, Zalophus californianus
MDFTLEDWEHLGLDQGDLFWDTALDNYQNLFLLNPSKPKLTSHTDGTEELKVRVRESPESAGPDTAEVKNCLLAQDFLEEE

SEQ ID NO: 24131 - protein, 81 aa, Chrysochloris asiatica
APESVTFRDVTVDFTQEEWQQLEPAQKALYRDVMMENYRNLVSLEGTWKQSDCRERQPGSADTHLESLEISHDNKLTRELG

SEQ ID NO: 24132 - protein, 81 aa, Chrysochloris asiatica
RPRAVRFADVAVYFSPEEWGCLRPTQRALYRDVMREIYGHLGALGCAGPKPALISWLERNADDWEPAALDPQKCPRGITVQ

SEQ ID NO: 24133 - protein, 81 aa, Chlorocebus sabaeus
VMLENYSLLLSVGYCITKPVVICKLEHGEVLWILEEESPSQNHLDCCIDDNLLERRQENQDQHLQKVDFFNNKTLTTDRNG

SEQ ID NO: 24134 - protein, 81 aa, Chlorocebus sabaeus
GEGSLSFKDVAVDFTREEWQFLDWSQKVLYKEVMLENYSNLVSVGYQGTKPDSLFKLEQGEPPWIVEGAAHSQTCPGFVIQ

SEQ ID NO: 24135 - protein, 81 aa, Chrysochloris asiatica
QDLVVVDDVTVNFTQEEWALLDFSQRKLYKDVMMETFRNLDSEDPNLLCLFQKSMVENLHESKEYTVKENKEGNQCGKTFS

SEQ ID NO: 24136 - protein, 81 aa, Chlorocebus sabaeus
MLETYSSLVSLGHCITKPEVIFKLEQGAEPWLGEEWANQCLSDVQTVDIIERSQEIHHRHIWQVAITNSKTSTKETVELGK

SEQ ID NO: 24137 - protein, 81 aa, Suricata suricatta
WGCLSHSQRELYRDVMSENYGHLLFLGEDHSLSISQPDLVFLLEPKQELWDVKRMETVASYPVSSNANERLSPKIFIENSF

SEQ ID NO: 24138 - protein, 81 aa, Chlorocebus sabaeus
QGSLTFRDVAIEFSLEEWQCLDTAQQNLYRNVMLENYRNLVFLGIAVSKPKLITCLEQEKEPWNVKTHDMVAKPPVICSHI

SEQ ID NO: 24139 - protein, 81 aa, Sarcophilus harrisii
MTFRDVAVDFTGEEWRRLEPAQRALHRDVMLENYQNLVFLGLPVSKLDVISLLERGEAPWRPKGGGPPDPCPDALSQETRF

SEQ ID NO: 24140 - protein, 81 aa, Sarcophilus harrisii
PQGPVTFQDVAVVFTQEEWRYLDPSQKELYRDVMLENYRNLLYLGLVVSKPNVIYRFEQGEASWRPDQRDSGSTCSDEETG

SEQ ID NO: 24141 - protein, 81 aa, Lipotes vexillifer
LKEAVTFKDVAVVFTEEELGLLDSAQKKLYQEVMLENFQNLVSVGHQSFTPDVISQLKREENLWMIKIATQSCRSLGDKNL

SEQ ID NO: 24142 - protein, 81 aa, Tursiops truncatus
AQVLVTFKDVAVTFTREEWGQLDLDQRTLYQEVMLEICGLLVSLGHPVPKPELIHLLEHGQELWMGRRGLPHSMCPDDRAK

SEQ ID NO: 24143 - protein, 81 aa, Tursiops truncatus
QGLLTFRDVAIEFSQEEWECLDPAQRALYRDVMLETYRNLLSLDTSISFLTKELLKKKNINNRELYQSVVLGRHGSHGIED

SEQ ID NO: 24144 - protein, 81 aa, Trichechus manatus
SLDTVTFKDVAVDFTQEEWQQMKPAQRNLYRDVMLENYSNLVTVGCQVTKPDVIFKLEQEEEPWVGEEETLGRHCPEIWEV

SEQ ID NO: 24145 - protein, 81 aa, Trichechus manatus
VQESLTFSDVAVKFTWEEWQLLDPAQKDLYWDVILENYSNLVSIGYQVSKPDVLSRLELGEQPWTILYERHSGIFSEIQKG

SEQ ID NO: 24146 - protein, 81 aa, Trichechus manatus
SVVIEDVAVVFSQEEWALLDLAQKKLYRDVMMETFRNLASVDSQNFNDGEKLSSEHIMMQFMKNNLWSSMLREISDQSHDN

SEQ ID NO: 24147 - protein, 81 aa, Trichechus manatus
AQESLAFEDVAVKFTWEEWQLLDPAQKNLYRDVMLENFRNLVSVGYQVTKPDALSRLRRGELPWSILDEIDSRNFLEIWKV

SEQ ID NO: 24148 - protein, 81 aa, Trichechus manatus
YQDLVTFEDVAVDFTKEEWTLLDEMQRDLYRDVMLENYRNLVAVGYRLCKPNLISRLEQGEELRTRERGVLQKLYLQFKRR

SEQ ID NO: 24149 - protein, 81 aa, Trichechus manatus
SVVAEDVAMVFSQEEWALLDLAQRKLYKDVMLETFRNLASVVSRNLSDGEKLSSEHIMVQFIKNNTWSSMLGEIFESHGNK

SEQ ID NO: 24150 - protein, 81 aa, Trichechus manatus
LLTFKDVAIEFSQEEWECLDPAQKALYRDVMLENYRNLISLDVSSTCVIKELSPKEIINKGELFQRMMLERHESHGTEDFD

SEQ ID NO: 24151 - protein, 81 aa, Trichechus manatus
AHGSVTFRDVAVDFSQEEWECLDPAQRDLYRDVMWETYSNFISLDLESTYRTNNLSPEKDIYEIYSFQWEIMERIKSYSFP

SEQ ID NO: 24152 - protein, 81 aa, Trichechus manatus
SVVIEDVAVVFSQEEWALLDLAQRKLYRDVMMENFRNLASIVSRKLNDGNKLSSELIMLRFMKNNTWSSMLGEISESHGTR

SEQ ID NO: 24153 - protein, 81 aa, Zalophus californianus
PQGSAAYQFLSVDYTERKWKGPALSQRAVYRSIVPENYCSMASLGETRTRRSELPARQEVSKGPASSDGTSGGLCGVVSGE

SEQ ID NO: 24154 - protein, 81 aa, Zalophus californianus
AQESVTFRDVAVFFSQDEWLRLDSAQRTLYREVMLENYGTLVSLGILFSKPKVIFQLQQGEDPWMVENGVCQGPCVGWERL

SEQ ID NO: 24155 - protein, 81 aa, Zalophus californianus
SPGAVSFADVAVYFSPEEWGCLRPAQRALYRDVMRETYGLLGALGEVEAWSPEAQDPEGETRAAVIRDRGSRDESEEKEEL

SEQ ID NO: 24156 - protein, 81 aa, Zalophus californianus
APGLVTFEDVAVYFSREEWGLLNLTQRSLYRDVMLENFALIGSLGVAPSGSHVVAQLESEEDLWMPNMVDLTLGSRAEARR

SEQ ID NO: 24157 - protein, 81 aa, Equus caballus
EAGPVSFADVAVYFSPEEWGCLRPAQRALYRDVMRETYGHLGALGFRGTKPALISWVEEEAELWSQDAQDPVGECLAKADT

SEQ ID NO: 24158 - protein, 81 aa, Equus caballus
DSVAIEDVKVNFTPEEWALLDPSQKKLYRDVMWDTFRHLASVGKNEDIPSLDSVKVKTVVSAEKTSALFQISSSCVIHPFM

SEQ ID NO: 24159 - protein, 81 aa, Neovison vison
QRTLYRDVMLENYSHLVSLGIAFSKPRLITQLEQGEEPWREESECLLDLCPEPGIECQPYGHSCPLTFSSPQFLEQYVLCG

SEQ ID NO: 24160 - protein, 81 aa, Equus caballus
VGLQFQGSVTFGDVAVAFSQQEWASLDPAQRALYRDVMLETYSHLASLGHSVSKPHVITFLEQWKEPWVVVRKEQRQRQTG

SEQ ID NO: 24161 - protein, 81 aa, Neovison vison
LVSFEDVAMDFSREEWQQLDPAQRCLYQDVMLEIYSHLLSVEGALGLKTSQQKIFEKASFHNGKESEVTRGGMWCSISEDL

SEQ ID NO: 24162 - protein, 81 aa, Loxodonta africana
AGYQRSKPGVISQLEKGEEPWLTEREISGGPSSDLESETETKESTLKNDISWKELHDGLMMERSTKGSTLYSTLGEVSKCD

SEQ ID NO: 24163 - protein, 81 aa, Loxodonta africana
ESVTFKDVAMDFSPEEWGKLDPAQRDVMLENYRNLASLWLPVSKVENYNLENGKEPWMFEEKKNKSSYSDWEARPESKEST

SEQ ID NO: 24164 - protein, 81 aa, Loxodonta africana
SQGLVTFEDVAVYFSLEEWERLDTGQRDLYRDVMQENYGILVSLGYPIPKPDLIFRLEQGEEPWVPDSPHPEEGDIVTGVY

SEQ ID NO: 24165 - protein, 81 aa, Capra hircus
MAESVAFRDIAVLFSRDEWLCLDSAQRTLYREVMLENYSTLVSLGIPFSMPELICQLQQGEDPCMVEREIPQDTCLGFKTW

SEQ ID NO: 24166 - protein, 81 aa, Aotus trivirgatus
AHGSVTFRDVAIDFSQEEWEFLDPAQRDLYRDVMWENYSNFISLGPSISKPDVITLLDEEGKEPGMVVREGIRRYCPDLDS

SEQ ID NO: 24167 - protein, 81 aa, Aotus trivirgatus
AQGSVSFNDVTVDFTQEEWQHLDHAQKTLYMDVMLENYCHLISVGCHMTKPDVILKLERGEEPWTSFAGHTYLEENWKAED

SEQ ID NO: 24168 - protein, 81 aa, Aotus trivirgatus
FSSLRVPWLAEMDPAQDRVVFEDVAIYFSQEEWGHLDEAQRLLYRDVMLENLALLSSLGKALTLVQCPGLGCPQAALRFLQ

SEQ ID NO: 24169 - protein, 81 aa, Aotus trivirgatus
MLENYRNLAFLAGIAVSKADLITCLQQGKDPWNMKRHSIVAKPPVLCSHFGQDLWPRLGIKDSFQKVILRENGKCGHKDLQ

SEQ ID NO: 24170 - protein, 81 aa, Pan paniscus
MLLFFLNKTGIAVSKPDLITCLEQNKDPWNIKRNEMVTKHPVMCSHFTQDLPPELGIKHSLQKVIPRRYGKCGLDNLQVKK

SEQ ID NO: 24171 - protein, 81 aa, Lipotes vexillifer
SLGTVTFKDVAVDLTQEEWQEMKPAQRDLYRDVMLENYSNLVTVGCQVTKPDVIFKLEQEEEPWVIEEEMLGRPCPEVWED

SEQ ID NO: 24172 - protein, 81 aa, Lipotes vexillifer
KFQPVSFKDVAVVFTEGELGLLDSAQRKLYRDVMLENFRNLLSVGNQPFKPELIFQLEREEELLMMETETQREGCSGTKSQ

SEQ ID NO: 24173 - protein, 81 aa, Pteropus vampyrus
SQSLLAFEEVAVYFSQEEWELLDPSQRALYNDVMQENYETVISLAIFVLPKPKVISCLEQGEEPCVQGSPNFKDSPGALSM

SEQ ID NO: 24174 - protein, 81 aa, Pteropus vampyrus
MEPVTFEDVAVYFTQNQWASLDPVQRALYREVMLENYANVASLAFPFPKPVLISQLEQGEAPWGPDPGEAEVLKGIWPGGE

SEQ ID NO: 24175 - protein, 81 aa, Pteropus vampyrus
SLGSDLFRDVAVLFSQEEWDRLAPAQRDLYRDVMLETYSNLVSLDLAICKPDVIAFLEQGREPWVVEEAAFGGLCPAYRSL

SEQ ID NO: 24176 - protein, 81 aa, Trichechus manatus
RYQEFVTFEDVAVYLTREEWGCLDPVQRDLYREVMLENYGNVVSLGFPFFKPDGISQLEQDLQVFDLETKNREVLKRQLLR

SEQ ID NO: 24177 - protein, 81 aa, Trichechus manatus
SQVLLTFRDVAIEFSQEEWDYLDPAQRTLYRDVMLENYRNLLSLGISPSEINIVSILKKGTEPWTVEKTAKLAENPDVIST

SEQ ID NO: 24178 - protein, 81 aa, Trichechus manatus
VTESVTFRDVAVLFSQEEWGHLDSSQRALYREVMLENYSNLISLGIRFSKPKVISQLQQGEDPWMVDKGVSHGTCQGIPFS

SEQ ID NO: 24179 - protein, 81 aa, Trichechus manatus
MDSVVAEDVAVVFSKEEWALLNLTQRKLYREVMIETFRNLVSVGELSELYGSKDHHKFPEGCLRSHTVENLFEDNEGNQCG

SEQ ID NO: 24180 - protein, 81 aa, Trichechus manatus
SQSLLTFEEVAMYFSQEEWELLEPPQKVLYHDVMQENYETVISLALFVLPKPKVISCLEQGEEPWIQGPQEFKDSHVESPT

SEQ ID NO: 24181 - protein, 81 aa, Trichechus manatus
SVAVEDVTVDFTREEWALLDLSQRKLYRDVMMETFRNLASIVSQNINVGEKLSTENRIVQFMKNDTCSSMVGEICELHGIE

SEQ ID NO: 24182 - protein, 81 aa, Trichechus manatus
EELPVVFEDVAVYFTREEWGLLDKQQKELYRDVMRMNYELLASLGPAAAKPDLISKLERRAAPWIKDPRGPKWGKGHPPDP

SEQ ID NO: 24183 - protein, 81 aa, Trichechus manatus
SQGLLTFRDVAIEFSQEEWECLDPAQRALYRDVMLENYRNLVSLGISSSEMNGISILKKKTEPWTLYTMMDIAYDPDVFST

SEQ ID NO: 24184 - protein, 81 aa, Trichechus manatus
AEGLVAFEDVAVYFSQEEWRLLNMAQRALYRHVMLENFALVASLGLAASRPRVVIQLDGDEEPWVPNGTDVAPVTARKVQR

SEQ ID NO: 24185 - protein, 81 aa, Trichechus manatus
SQELLTFRDVAIEFSQEEWECLAPAQRTLYWDVMLENYSNLVSLAEVSLSEMNIISILKKGTEPWTVENKMKIAKNPDVSP

SEQ ID NO: 24186 - protein, 81 aa, Trichechus manatus
IPAFSDKDSFGNEMLAAALLKAKSRELVTFEDVAVYFIRKEWKRLEPAQRDLYRDVMLENYGNVFSLGFPFLNPDMISQLE

SEQ ID NO: 24187 - protein, 81 aa, Zalophus californianus
LQGSVTFPDVAVDFTPEEWQLLDCEQRTLYWDVMLENFRNLISVGGPVTKTKAIFKAEQGQEPWMGEGANPRWCHPEADCL

SEQ ID NO: 24188 - protein, 81 aa, Equus caballus
PHGSMPFGSVTEACTQEGWRHSVPAPQDRFKEGIPEKSRNLVLLGLPVSQAGMNSQLEQREGSWVLEGEGLRSPCPDQKIV

SEQ ID NO: 24189 - protein, 81 aa, Equus caballus
LQGCVISEDVFVYFSWEEWMLLDDAQRLLYWDVMLENFALLASLGIASFRSHLVTQLEQGEEPWMPDQVDVTPASEREAQK

SEQ ID NO: 24190 - protein, 81 aa, Mandrillus leucophaeus
FEELVTFEDVFVDFSPEELSSLSAAQRNLYREVMLENYRNLVSLGYQFSKPDIISRLEAEESRAMEKDSRHTVICQGEAHD

SEQ ID NO: 24191 - protein, 81 aa, Aotus trivirgatus
PQDLMTFDDVAVEFTQWEWGQLNPAQKDLYREVMLENFRNLTLLGLLVSKPYMICQLEEGGEPFMVNTEISVGAHSDWERR

SEQ ID NO: 24192 - protein, 81 aa, Sarcophilus harrisii
PQQSMAFKNVAVAFGQEEWSQLDPTQKDVYRDVILEKYRHLVSMGLPISKPDVISQLERKEDPWMLEREVSRDVYSDWETK

SEQ ID NO: 24193 - protein, 80 aa, Pan paniscus
GPLTFMDVAIEFSLEEWQCLDTAQQNLYRNVMLENYRNLVFLGIAVSNLDLITCLEQGKEPWNMKIHEMVAKPPGWSAVA

SEQ ID NO: 24194 - protein, 81 aa, Lipotes vexillifer
ESVTFKDVAVDFTQEEWALLDTSQRKLFRDVMLENISHLVSVGNQLYKSDVISHLEQGEQLSREGLGFLQGQSPGREDDLR

SEQ ID NO: 24195 - protein, 81 aa, Lipotes vexillifer
RESGKAPVTFDDITVYLLQEEWMLLSQQQKEIYGSDELVAPLGPTIANPELFYKFERGPEQWLANVQGQRSLLSLHRGKNK

SEQ ID NO: 24196 - protein, 81 aa, Pan paniscus
FQEMVTFKDVAVVFTREELGLLDLAQRKLYQDVTLENFRNLLSVGYQPFKLDVILQLGKEDKLLMMETEIQGDGCSGHRNQ

SEQ ID NO: 24197 - protein, 81 aa, Lipotes vexillifer
MAHLMMFRDVAVDFSQEEWECLDLEQRALYRDVMLENYSNMVSLGLCLYQPDVFSLLEKGKEPWMVLKDEIRGPCPDMQSR

SEQ ID NO: 24198 - protein, 81 aa, Pan paniscus
DTVAYEDLSVDYTQKKWKGLTLSQRALQWNMMPENHHSMASLAGENMMKGSELTPKQEIFKGSESSNRTSGGLFGVVPGAA

SEQ ID NO: 24199 - protein, 81 aa, Callorhinus ursinus
VQGSMSFEDVIVKFTQDEWQYMSPAQRTLYRDVMLENYSHLISVGYCTAKPEMIFKLEQGEEPWSLEEEFLNQRYPGYFSV

SEQ ID NO: 24200 - protein, 81 aa, Callorhinus ursinus
DNVTLEDVAVYFSWEEWGLLDEAQRRLYHDVMLENLALITSLDCLCGIEHEEVPSGQNVSLGRMPQIRSSEPNPSTEKVHF

SEQ ID NO: 24201 - protein, 81 aa, Callorhinus ursinus
SQGLVTFEDVAVYFSLEEWERLGADQRDLYKDVMQENYGILVSLGYPIPKPDLIFRLEQGEEPWVPDSPRPDEGDIVTGVY

SEQ ID NO: 24202 - protein, 81 aa, Callorhinus ursinus
STEPVIFRDVAMYFTQKEWQLLEPAQKDLYREVMLENYGNLASLGYRLFKPKLITRLEQGDEPCVKERDVPRDPQQGGAGI

SEQ ID NO: 24203 - protein, 81 aa, Tursiops truncatus
MLENYSNLVSLGLPFSKPEVISLLQQGEDPWKVVKESPGGSSLGRKNSYKTTKSTQTQGSSFQEMIMKRSKRNGPWDFKSE

SEQ ID NO: 24204 - protein, 81 aa, Tursiops truncatus
PQGSTPFNSVAVAFTQKGWRQLAPTPKDRFKKGMPEKSRNLVLLGLPVSQPGMNSQLEQREGSWMLEREGLRSTCSDWKIV

SEQ ID NO: 24205 - protein, 81 aa, Tursiops truncatus
PVRRLAPVTFDDITVYLLQEEWMLLSQQQKEICGSDELAAPLGPTIANPELFYKFERGPEQWLANVQGQRSLLSLHRGKNK

SEQ ID NO: 24206 - protein, 81 aa, Equus caballus
PQDLVTFKDVAIDFSQEEWEWLTPAQRSLYRSMMLENYRSLVSLGLCVSKPYVISLLEQGKEPWEMKNEMTRSPFPDWESM

SEQ ID NO: 24207 - protein, 81 aa, Equus caballus
FQESVKFEDVAVNFSSGEWQCLTHAQRHLYKDVMLENYGNMVSLGFPFPKPPLISHLEREAEPCVQDLQDSEFLSCSYPVS

SEQ ID NO: 24208 - protein, 81 aa, Equus caballus
PMLFEDLAVYFSQEECVSLHPAQRSLSRDATQECFEDMALIGGEGKTDINQQVNVESMGREELALEEYSIAMPLVCYPEES

SEQ ID NO: 24209 - protein, 81 aa, Equus caballus
QISFEDVAVDFTLEEWQLLNPTQKNLYRDVMLENYSNLAFLEVWLDDNLKMWHQDNQDKGMERGHEYDVFGKIFHSSINFV

SEQ ID NO: 24210 - protein, 81 aa, Monodelphis domestica
MLENAWNLLSVGLPAPPEDVISYLEQKVTSWMREQEGLRSCCPEGKIRPEMKVTPPEVSLSVEETEKQKFLSDGPDHLAWR

SEQ ID NO: 24211 - protein, 81 aa, Monodelphis domestica
ARGSVTFRDVAVDFSGDEWGFLSPAQRELYWDVMLENFKNLLFLGLLDPEPNLLSCSEGREDLQIWHLQGGVLGSTCSCKA

SEQ ID NO: 24212 - protein, 81 aa, Papio anubis
FQGSVSFKDVTVGFSQEEWQHLDPSQRALYRDVMLENYSNLVSVGYCVHKPEVISRLEQGEEPWRLVEEFPSQSFSEVWTA

SEQ ID NO: 24213 - protein, 81 aa, Aotus trivirgatus
LQESFSFDDLSVDFTQKEWQLLDPSQKNLYKDVMLENYSSLVSLGYEALKPDVIFKLEQGEEPWIGDEEIPSSYSPEVWKV

SEQ ID NO: 24214 - protein, 81 aa, Aotus trivirgatus
ARGCVVFEDVFVYFSREEWELLDDAQRLLYHDVMLENFALLASLGIAFSTSDAVMKLEQGEKPWVYDQVDMTSATGREAQR

SEQ ID NO: 24215 - protein, 81 aa, Papio anubis
SCEGSVSFRDVAIDFSREEWRHLDPSQRNLYRDVMLETYSHLLSVGYQVPEAEVDMLEQGKEPWALQGERPRQSCPGEKLW

SEQ ID NO: 24216 - protein, 81 aa, Aotus trivirgatus
RSQESLTFQDVAVDFTREEWDQLYPAQKDLYRDVMLENYRNLVALGHQLYKPEVIAQLELEEEWMIERDSLLDTCLDGENR

SEQ ID NO: 24217 - protein, 81 aa, Sarcophilus harrisii
PRAPLVFQDVAVDFTREEWRRLSPAQRDLYREVTLETYENLVFLGFPVSKPEVIWRLERGEAPWPPRRGTSRAACPGSYGQ

SEQ ID NO: 24218 - protein, 81 aa, Tursiops truncatus
APVTFGDLAIYFSQEEWEWLSPIQKDLYEDVMLENYQNLVSLDLGSKCETKKLSPYQCNKSGQSIYQKAVSTPQKVPTGKR

SEQ ID NO: 24219 - protein, 81 aa, Tursiops truncatus
QGSVTFEDVALYFSWEEWALLDEAQRCLYHDVMLENFALTSSLGCWHEVEDKETSPEQSISVEGVSQIRTLKAISSPQKAQ

SEQ ID NO: 24220 - protein, 81 aa, Trichechus manatus
SVAIEDVAVDFTQEEWALLDLSQRKLYRDVMMETFRNLASVVSRNNDGGKLSTENTIVGFMKNDTCFSMVGDICKSHGVED

SEQ ID NO: 24221 - protein, 81 aa, Zalophus californianus
VTESVTFRDVAVFFSQDEWLHLDSAQRTLYREVMLENYGTLVSLGIPFSRPKVICQLQEGEDPCVVDRELPWDACLGLKTR

SEQ ID NO: 24222 - protein, 81 aa, Zalophus californianus
QGSAAYQFLSVDYTERKWKGPALSQRAVYRSIVPENYCSMASLAGETRTRRSELPARQEVSKGPASSDGTSGGLCGVVSGE

SEQ ID NO: 24223 - protein, 81 aa, Pan paniscus
KEAVTFKDVAVVFTEEELGLLDPAQRKLYRDVMLENFRNLLSVGEHGHLLCLNIRPQQWFCTLECSSLSVHWEPKYPVNFA

SEQ ID NO: 24224 - protein, 81 aa, Pan paniscus
FQKSVTFEDVAVYFTQAEWDGLSPAQRTLYRDVMLENYGNVASLGFPLLKPAVISQLEGGGELGGPSPLAAGTGLQGLQTV

SEQ ID NO: 24225 - protein, 81 aa, Lipotes vexillifer
RYLGPVKFEDVVVIFTEAEWKRLSLEQRNLYKEVMLENFRNLVLLADSKPEVHPWPLCPACPLAFDGQQFLSHHELCSHLI

SEQ ID NO: 24226 - protein, 81 aa, Lipotes vexillifer
QAEVTFEDVAVLLSREEWGRLGPVQKGLYRDVMLETYRNLVSLGAGPAGPKPEVITQLERGDEPWVPDVQGREQPTIDGSA

SEQ ID NO: 24227 - protein, 81 aa, Lipotes vexillifer
QAGCPPEMAVSEPGGSAAEWEQLDPAQKSLYKDVMLENYSNLASMGYQALKPDMISKLGKEEPWLGKGKRPRQGDLSEIAR

SEQ ID NO: 24228 - protein, 81 aa, Pan paniscus
SQHLVTFEDVAVDFTQEEWTLLDQAQRDLYRDVMLENYKNLIILAGSELFKRSLMSGLEQMEELRTGVTGVLQDEFIKLDL

SEQ ID NO: 24229 - protein, 81 aa, Pan paniscus
HLTFTDVAIEFSQEEWKSLDPGQRALYRDVMLENYRNLVFLGRSCVLGSNAENKPIKNQLGLTLEPHMSELQLFQAGRKIY

SEQ ID NO: 24230 - protein, 81 aa, Tursiops truncatus
SPLPAPLRPRTAMASAAAALRDPPQDSMTFEDIAVYFSWEEWRLLDEVQRHLYHDVMLENFTSYPHWSTGSGRTGLVTMAH

SEQ ID NO: 24231 - protein, 81 aa, Pteropus vampyrus
EQESVSFKDVTIDFSREEWQQLDFAQKSLYRDVMLENYFNLISVGCQVPKPEVIFNLEQVENSCMLHRKISRQSCLDGDIG

SEQ ID NO: 24232 - protein, 81 aa, Pteropus vampyrus
AQVSLAFRDVAVEFSQEEWACLDPAQRALYRDVMAENYRTLLSLGHSIPKPDVITLLEQEKEPWMFVTEGTRIWHAAEMCL

SEQ ID NO: 24233 - protein, 81 aa, Pteropus vampyrus
MTFTDVAIDFSQDEWEWLNLAQRTLYKKVMLENYRNLVSVGLCISKPDVISLLEQGKEPWVVNRDMTAGSCPNLEYVWIVK

SEQ ID NO: 24234 - protein, 81 aa, Pteropus vampyrus
PQESLTFDDVAVDFTWEEWQLLAPAQKDLYRDVMSENYSNLVSLGCQARKPDTLSRLDQGEPPWTLADRVYSQTRSGIWKV

SEQ ID NO: 24235 - protein, 81 aa, Pteropus vampyrus
KVPVTFVDIAVYFSEDEWKNLDEWQKELYNNLVKENYKTLTSLDAEGTAPKPDAPSQAEPREEPCVWEQREPGDREILMDP

SEQ ID NO: 24236 - protein, 81 aa, Pteropus vampyrus
SQELLTLEDVAVDFTWEEWQLLAPAQKDLYWDVMSENYSNLVSVGYEVSKPDVLSKLERGEEPWTIEHEIHSPVCPEIDKV

SEQ ID NO: 24237 - protein, 81 aa, Trichechus manatus
SVAVEDVAVDFTQEEWALLDLSQRQLYRDVMMEIFRSLASVASRNLTDGDNLSTESIIVRFMKNDTWFLMVGEIRELHGTE

SEQ ID NO: 24238 - protein, 81 aa, Trichechus manatus
MLENYRILVSLGLCFSKPSVILLLEQGKEPWMVKRELTEGLCSGWESMCETEELTPKQAIYEEESSQKLIEEITSCGLEFS

SEQ ID NO: 24239 - protein, 81 aa, Trichechus manatus
SLVIEDVAVDFTQEEWTLLDLPQRKLYRDVMIETLRNLASIVSRDVNDGGKLSNEHITEEIMKKTTWFSMLGEICELHGTE

SEQ ID NO: 24240 - protein, 81 aa, Trichechus manatus
VTFEDVTVVFTEAEWKRLSSEQKHLYKEVMLEIYRNLLSLEPKPELHPCSSCLLAVSCQRFLSQHVLPIFPGFCAEHHFHP

SEQ ID NO: 24241 - protein, 81 aa, Trichechus manatus
SVVIEDVAVVFSQEEWALLDLAQQKLYKDVMIENFRNLASVVSRNLKDGEKLSSDNIMVRYMNSNTWFSMLGEISESHGNK

SEQ ID NO: 24242 - protein, 81 aa, Trichechus manatus
MSFSSMTVAFTQEGCRHPVLAPRDRYKEGIPEKSRNLVLLGLPVSQPGLNSQLEQREEPWMLEGEGLRSTCPDWKTVSKES

SEQ ID NO: 24243 - protein, 81 aa, Trichechus manatus
KGCVIFEDVAVNFSQEEWGLLDEAQRLLYQDVMLENFAIIDSLGCCHETEEEEAFSEQSVSVEGVSQVRTPQAGPCTQKTH

SEQ ID NO: 24244 - protein, 81 aa, Trichechus manatus
TARSQESVTFKDVAMDFTPEEWGKLDPAQRDVMLENYRNLVSLWLPVSKAENYNLENGKEPWMFEGKKTKSSYSDWEARPE

SEQ ID NO: 24245 - protein, 81 aa, Trichechus manatus
FQEAVTFGDVAVHFSREEWQCLDPGQRALYREVMLENHSSVAGLAGVLVFKPELISRLEQGQEPWVLDLQASEGRETSKTS

SEQ ID NO: 24246 - protein, 81 aa, Zalophus californianus
MAVTFEDVTVIFTWEEWKFLDSSQKKLYREVMWENYTNVMSVGNWKESYKPQEEGFRYLEHENLPCWQAWRNASAQTYENR

SEQ ID NO: 24247 - protein, 81 aa, Zalophus californianus
SQEPVTFEDVAVYFTQNQWASLDPMQRALYLEVMLENYANITSLALPFPKPDLILQLEQGGAPWGLDPWTPLEGEALGGVH

SEQ ID NO: 24248 - protein, 81 aa, Equus caballus
TSAPVTFGDLAIYFSQEEWEWLSPVQKALYEDVMLENYQTLASLGLSFRRPNVITLLEKGKAPWMVEPVRRRRGLDSGSKC

SEQ ID NO: 24249 - protein, 81 aa, Equus caballus
RQEPVTFEDVAVYFTQNEWVILDPAQRALYREVMLENYANVASLAFSFTRPVLVSQLERGELPPGLDPWERASPEALRGIC

SEQ ID NO: 24250 - protein, 81 aa, Equus caballus
PKVPVTFDDVAVYFSESEWGRLDKWQKELYKHVMRGNYEMLVSLDYAISKPDILTRMERGEEPCPDGPWGPEEGKEREAAR

SEQ ID NO: 24251 - protein, 81 aa, Loxodonta africana
RQAEVTFEDVAVLLSQEEWDHLGPAQRGLYRNVMMETYGNVVSLGLPGSKPDVISQLERGEEPWVLGGHEAEGREHLKNGH

SEQ ID NO: 24252 - protein, 81 aa, Loxodonta africana
SSNHFCYLGTSLNASPWKNKWLSPMVESQYKGIAVKLFSNIKWLGLCISKPDIISLLEQGKEPWIMKRKMTQGQGPDLKPL

SEQ ID NO: 24253 - protein, 81 aa, Lipotes vexillifer
MAFEDVAVYFSREEWGLLDAAQRALYRRVMLENFTLLASLGLSVSRPHVVIQLECGEEPWVLNGTDVTLARNAAAAASPGE

SEQ ID NO: 24254 - protein, 81 aa, Pan paniscus
IGGDVTFNDVAIDFSHEEWGWLSSAQRDLYKDVMVQNYENLVSVAGLSITKPYVITLLEDGKEPWMMEKKLSKGMIPHWES

SEQ ID NO: 24255 - protein, 81 aa, Tursiops truncatus
MLENYSHLVSVGYPVSKPGVISKLEQGEEPWIMKRDISNWIYPDRETRLDTHQLDTLGDVYFHKDILESVTRDHSLYSILK

SEQ ID NO: 24256 - protein, 81 aa, Tursiops truncatus
MAEDLKFKDVAIYFTQKEWECLHSAQKDLYRDVMLENYNILISLGFSDSKPDVISLLEQGKEPWMVNSKETKEWCPDWESR

SEQ ID NO: 24257 - protein, 81 aa, Tursiops truncatus
EQLTFKDIDIEFSQEEWECLEPAQQALYRDVMLETYRNLLSLDISPMHVIKKLQLKVNTGRGEVLQKVMLGRHERNKVKRF

SEQ ID NO: 24258 - protein, 81 aa, Pteropus vampyrus
SWGPVTFKDVAVNFSRGEWKKLEPFQKQLYKEVLLENFRNLEFLGFPVSKLDLISQLKWVELPWLLEKEVSKGSKPECNSR

SEQ ID NO: 24259 - protein, 81 aa, Pteropus vampyrus
MRDELPQEEWECLDPGQMNLYKEVMLENFSNLVSVGLSSAKPVVISLLEEGKEPWMVEREVKRGLCSDLESMCETKILSLK

SEQ ID NO: 24260 - protein, 81 aa, Pteropus vampyrus
TIKEEVTFKDVAVIFTEEELGLLDSAQRQLYRDVMLENFKNLVSVGYQPFKQGVIHLVRGEKYWMMKMATQRKGNSGGKIQ

SEQ ID NO: 24261 - protein, 81 aa, Pteropus vampyrus
MREEWALLDHSQRRLYRDVMLETCQNLAFVVHVRTHSGEKFSKCLQCGRTISQQQYLQIQSTRHSWDKPWECKQPRNAFSD

SEQ ID NO: 24262 - protein, 81 aa, Trichechus manatus
AHVSLAFRDVTIDFSQEEWECLDPAQRSLYRDVTLENYSNLVSLGCSFPKPDVITLLEQEKEPWMVVKEGTRSWYTDLESK

SEQ ID NO: 24263 - protein, 81 aa, Trichechus manatus
SLVIEDVAVDFTQEEWTLLDLPQRKLYRDVMMETLRNLASVVSQDLSSGEKLSSEHITEKIMKRNTWLSVLGEIGKLHGIE

SEQ ID NO: 24264 - protein, 81 aa, Trichechus manatus
RTGVISFAGVAVYFSPEEWACLRPTQRALYPDMMRKPYDHLGALGFSGPKPAFNFWVEGEVEAWSPEAQEEDENPGVVSRG

SEQ ID NO: 24265 - protein, 81 aa, Trichechus manatus
REAFVAFGDLAVDFTQEEWWLLSPAQRTLYREVMLETCNHLVSLAGIPFSKPKLITQLEHREEPRRGERKHLLDPCLGGSK

SEQ ID NO: 24266 - protein, 81 aa, Trichechus manatus
AHGSVTFRDVAVDFSQEEWECLDPAQRDLYRDVMWETYSNFISLAGPSISKPDGITLLEEGKEPWMAVREGAGKHGRDLES

SEQ ID NO: 24267 - protein, 81 aa, Trichechus manatus
GVTFEDVAIDFSQEEWGLLDETQRILYRDVMLENFAIIASLGCWHGTEEEVASSEQSVSVGVSQVRAPQEGPFTQKTHPCE

SEQ ID NO: 24268 - protein, 81 aa, Trichechus manatus
WLQKPVTFKDVAVEFTQEEWVMLDPAQRNLYRDVMLENYRNLTSVEYQLCRPTVISQLDQEERRTVERRISQGTYPDRENL

SEQ ID NO: 24269 - protein, 81 aa, Trichechus manatus
SQGLLSFNDVAVDFSWEEWQLLDPVQKNLYWDVMLENYSNLMSLGYQATKPEAIVQLEKGDEQGIVEKEFPSQCSPEVIWQ

SEQ ID NO: 24270 - protein, 81 aa, Trichechus manatus
AVTFKDVAVAFTEEELELLDPAQRKLYQDVMVENFRNLVSVGEKNQRALGTVEDEGSREELSRWQIWQQIANDLARCQDSI

SEQ ID NO: 24271 - protein, 81 aa, Trichechus manatus
MTKPDMILKLEQGEELWTTGRVYPSHTYLEEDGKAGDVLVKFREYQDKHSRSGVFINHRKLIKERSNVYGKTFTLGKNRIT

SEQ ID NO: 24272 - protein, 81 aa, Trichechus manatus
SVAVEDVAVDFTQEEWALLDLSQRQLYRDVMMETFRNLASVVSRNLSDGGKLSSENIIVRFTKNDTWFSMVGEICELHGSE

SEQ ID NO: 24273 - protein, 81 aa, Trichechus manatus
SVVIEDVAVVFTQEEWALLDLTQRKLYRDVMMETFKNLVSVVSRNINEGEESSSEHIMMQFVKTNTWSSMLGEISESCGSK

SEQ ID NO: 24274 - protein, 81 aa, Trichechus manatus
SRMLVTFKDVLVDFTKEEWKLLNASQQIMYKHVMLENYKNLVSLGHQFPKPDVILQLEKGEDPWLMEIHQETFPDSETAVE

SEQ ID NO: 24275 - protein, 81 aa, Trichechus manatus
SMLFEDLAVYFSQEECVSLHPAQRSLSKGITQECFGDVAWLGEEDKTEINQQLSLESIELEELALEKYSTAVPLIYYSEES

SEQ ID NO: 24276 - protein, 81 aa, Zalophus californianus
DPVTFEDVAVEFTQEEWILLDQTQRRLCRDVMLENYKSLAAVDWEICLNTKWSAPQQNILQGKTPNVVEMVRFSVCNSLSS

SEQ ID NO: 24277 - protein, 81 aa, Zalophus californianus
MPQEEWQQLDPGQKALYRDVTLENYCHLISVGFHMTKPDMIRKLEQGEELWTTEKIFPSQSYLGEDGKTEDVLVKFKEYQD

SEQ ID NO: 24278 - protein, 81 aa, Zalophus californianus
PQRFPALVPGQSGRSFEEWHRLDPAQRTMHKDVMLENYSNLASVGLCVAKPEMIFKLERGEELWILEEESSGHGYPGSLSM

SEQ ID NO: 24279 - protein, 81 aa, Equus caballus
SQALVSFKDVTVEFNQEEWRHLGPAQRALYRDVMLENYSHLVSVGYCFIKPEVIFKLEQGEDPWLLEDEFPNRSYQEDRRL

SEQ ID NO: 24280 - protein, 81 aa, Equus caballus
AQELVTLEDVAVKFSWEEWQLLDPAQKDLYRDVMLENYHNLVSLGYQATKPDVLFKLEHRDELWRIEEEIQTKTCPGIGKV

SEQ ID NO: 24281 - protein, 81 aa, Equus caballus
SQGSVTFGDVAIDFSREEWEWLQPAQRDLYRIVMLENYGHLVSLGLNVSKPDVVSLLEQGKEPWLGNGDVRRDLFSVSESN

SEQ ID NO: 24282 - protein, 81 aa, Equus caballus
FTEPVTFKDVAVTFSEEELGLLDHAQRQLYRDVMLENFQNLLSVGHLPFKPGLLSQLEAEENLCMVERETWRNGCSSEKHV

SEQ ID NO: 24283 - protein, 81 aa, Equus caballus
AQESLTFDDVAVEFTWEEWQLLAPAQKDLYRDVMLENYSNLVSVGYQASKPDALSKLVQGEPPWTMEDEIHCRTHSEIWEV

SEQ ID NO: 24284 - protein, 81 aa, Equus caballus
CEVSVSFEDVTVDFSREEWQQLDSTQRRLYQDVMLENYSHLLSVGYEVPKPEVIFKLEQGEEPWILEGETPHQSCSAQKKM

SEQ ID NO: 24285 - protein, 81 aa, Physeter macrocephalus
QPQEAVTFKDVEVTFSQDEWGWLDASQRNLYRDVMLENYGNVASLVGPFTKPALISWLEAREPWGLNVQGAHPKGSPSAAP

SEQ ID NO: 24286 - protein, 81 aa, Physeter macrocephalus
ARLTFKDVVIEFSPEEWECLDPAQRVLYRDVMLETYRNLISVDLSHIHMIKKLQLKSNTDTGEIFQTVMLGSHGSCEIKHF

SEQ ID NO: 24287 - protein, 81 aa, Physeter macrocephalus
MKPGVILKLEHGEEPWTGDGEIPGSDSPEQVLQVNGHITWHKDNQEKLKNMKQDQECDALGKNFNLSMNFVPLRKSNSEGN

SEQ ID NO: 24288 - protein, 81 aa, Physeter macrocephalus
VTFEDIALYFSWEEWKLLDEAQRRLYHDVMLENFALISSLGCCCGAEDAEAPFQRSISISMSQARTPRASSFSQKSHPCKK

SEQ ID NO: 24289 - protein, 81 aa, Monodelphis domestica
PEAPRSLESVTFPDVPLINAQKSLYREVMLENYENFVSVAGFPSFKPELISQLECGKGPWMLVEEEMIQRFSERPRRLSLF

SEQ ID NO: 24290 - protein, 81 aa, Monodelphis domestica
IQGSLTFKDVAVDFTQEEWCLLDHSQKELYLEVMLENVQNLLSVGLPVPREYCASYFQQGKAPWLLELKGPRSSFPEAETN

SEQ ID NO: 24291 - protein, 81 aa, Monodelphis domestica
RQGTLTFQDVAVIFSPGEWRLLGRAQRELYREVMLENYWTLAWLAGFVGAQPEVISHLEQADMPWVPEDSFPSSNHTDLDT

SEQ ID NO: 24292 - protein, 81 aa, Aotus trivirgatus
MELLTFRDVAIEFSPEEWKCLDPGQQNLYRDVTLENYRNLVSLDLVTCLEQRKELYNVKIHETVARPPMIYLQGYSESQYP

SEQ ID NO: 24293 - protein, 81 aa, Aotus trivirgatus
KKKPVTFEDVAVNFTQEEWDCLDASQRVLYQDVMLETFKNLASVARMFVHKPELITKLEQQEKQWRVFLHLPNTEGLSEGM

SEQ ID NO: 24294 - protein, 81 aa, Aotus trivirgatus
DPEQVTFEDVVVDFTQEEWGQLELAERTLYCDVMLDTFRLLVAVGHWLPKPNIISLLEQEAKLWAVDPGVPRGVYQEIKGH

SEQ ID NO: 24295 - protein, 81 aa, Pan paniscus
MWLSWNTAQKDLYQDVMVENSNHLVSLGYQTSKPDALSKLAHGWEPLKTDAKVQNKNCPGIRKVDSHLQEHSPNHMQQCSG

SEQ ID NO: 24296 - protein, 81 aa, Pan paniscus
PQGLLTFRDVAIEFSQEEWKCLDPAQRTLYRDVMLENYRNLVSLDISSKCMMKEFSSIGKGNTEVIHTGTLQRLARHHIGE

SEQ ID NO: 24297 - protein, 81 aa, Tursiops truncatus
LSFEDVALYFTREEWDTLDWAQKDLYRDVMLDNYRNVLSLGPEARFKMKELTPKQNISEDLESCKMSLVKQKMARKPLEKL

SEQ ID NO: 24298 - protein, 81 aa, Pteropus vampyrus
MRDELPQVMSKEEWECLDPGQMNLYKEVMLENFSNLVSVGLSSAKPVVISLLEEGKEPWMVEREVKRGLCSDLESMCETKI

SEQ ID NO: 24299 - protein, 81 aa, Pteropus vampyrus
RKARLRVTFEDVTVYFSSEEWDLLDEAQRRLYQDVMLENLALITSLAPTPAVMKICRERIRVWSLPVNLKDTTLLAFSLTR

SEQ ID NO: 24300 - protein, 81 aa, Pteropus vampyrus
LEEQVTFEDVVVYFSQEEWGLLDDTQRLLYRDVMLETFALTASLGYASSMSHGIACLELDGKAQVSHWTDMTPAMTREARD

SEQ ID NO: 24301 - protein, 81 aa, Pteropus vampyrus
TQESVTFEDVAVDFTQEEWRQLDPAQKTLHRDVMLEIYSHLVSVGCSSIKPGIIFKLEHETDLWIIDSELSRWIYSDREKS

SEQ ID NO: 24302 - protein, 81 aa, Pteropus vampyrus
SQGALTLSDVFIEFSQEEWECLTPAQRALYREVTLESYRKLRFLGISVSDLYIVSILEQGKAPWILESELKIAQKPNRQKC

SEQ ID NO: 24303 - protein, 81 aa, Trichechus manatus
SLIIEDVAVVFSQEEWALLDLAQRKLYREVMMETFRNLALVVSQNLNNGEKLSTEHIIVRFMKNDSWSSMLGEISESHGSK

SEQ ID NO: 24304 - protein, 81 aa, Trichechus manatus
SGEPVTFEDVTLGFTPEEWELLDPMQKTLYREVMLENYRNLVSVEHQLSKPDVVSQLEEAEELWLKEREIPQDTFPECPVA

SEQ ID NO: 24305 - protein, 81 aa, Trichechus manatus
LSFKDVAVGFTWEEWQLLDPSQKDLYKEVMLENYNNLVSVEEIWATDQMQWQPENQNELKSLERCQQNYAFGNNLDLSKNL

SEQ ID NO: 24306 - protein, 81 aa, Trichechus manatus
AKMSVTFEDVSVTFTQKEWGQLGPAQRTLYREVMLETWGLLTSLGKPLPKPELIYGLEHGQELWTTEGGLAQSTCAGNKTQ

SEQ ID NO: 24307 - protein, 81 aa, Trichechus manatus
RHQEPVTFEDVAVIFTEEEWRHLVPIQRDLYKEVMLENYRSIVSLDGETKPEIQDTSEEEISKGTLRERLGSKGPLCPKFE

SEQ ID NO: 24308 - protein, 81 aa, Trichechus manatus
KNELLSFEDVAMFFTREEWENLDSAQKYLYRDVMLENYRNLIFLGSATQGALPGWICRSFLWKGNFQAHPQVKCKEEGMNI

SEQ ID NO: 24309 - protein, 81 aa, Trichechus manatus
TQDSVVFEDVAVDFTQEEWALLDLAQRNLYRDVMLENFQNLASLAGYPLHIPHLISQWEQEDLKIVKRGLIQDTCTGEHQE

SEQ ID NO: 24310 - protein, 81 aa, Trichechus manatus
SVVIEDVAVVFSQEEWALLGLAQRKLYRDVMMETFRNLASIVSQNLNDGEKLLSSEHIMMQFVKNDMWSSMLGEISKSHGN

SEQ ID NO: 24311 - protein, 81 aa, Trichechus manatus
MEDSVVFEDVAVEFTQEEWALLDFSQKKCYRDVMMETFRNLDSVFKQDNNGQMTVKNDSWFSMLGAIFEFHGIECQHNNQG

SEQ ID NO: 24312 - protein, 81 aa, Trichechus manatus
SVAVEDVAVDFTQEEWALLDHSQRQLYRDVMMEIFRSLASVASQNLIDGDKLSTENIMVRFMKNDTWSSMVGEICELPVTE

SEQ ID NO: 24313 - protein, 81 aa, Neovison vison
ALALVSFQDVAVTFTGEEWRHLDLAQRTLYREVMLETCGLLVSLGRPVPKAELISLVEQGQELWTVMRGLSKSMYTGEKAK

SEQ ID NO: 24314 - protein, 81 aa, Lipotes vexillifer
PKESLSFEDVTLDFTQEEWQHLDTAQRTLYRDVMLENYSHLVSVGYCIPKPELIFRLEQGEQPWVLEEESPGQSYPEVCKV

SEQ ID NO: 24315 - protein, 81 aa, Lipotes vexillifer
ELQETVTFKDVAIDFTEEEWQQLDPAQRNLYWNVMLENYNNLITVGCPFTKPDVIFKLEQEEPWVVAEEVSKRHCPGEIWG

SEQ ID NO: 24316 - protein, 81 aa, Callorhinus ursinus
QGHVTFEDVAVYFSQEEWALLDEAQRHLYHTVMLENLALIASLGCWHGVKAEEAFSEQCVFMERVAQARTPDPGLSIPKAH

SEQ ID NO: 24317 - protein, 81 aa, Callorhinus ursinus
PWEPVTFADVAVLFTPEEWMFLDSAQRSLYRDVMLENYRNLASVGDQLGKPSTFSHLEPGEELWPPERRSFPGTHPEPQHQ

SEQ ID NO: 24318 - protein, 81 aa, Tursiops truncatus
VTFRDVAVDFSQEEWDCLNSSQRHLYSNVMLENYRILVSLDWESVCETEELTPKQDIYQVRSSQKVIETLTSCGLEYSRLK

SEQ ID NO: 24319 - protein, 81 aa, Tursiops truncatus
EGSVTFEDVAVNFSLEEWGLLDEAQRCLYHDVMLENLALTTSPGCWHGEEDEEALSEQSISDQGSSQIRIVKAGLSPQKAN

SEQ ID NO: 24320 - protein, 81 aa, Tursiops truncatus
KSQGFVSFKDVTVDFTQEEWQQLDSAQRNLYKDVMLENYSNLVSVGYQSLNSDVIFLFKQGEPWMEEGEMSNWAYSETVYQ

SEQ ID NO: 24321 - protein, 81 aa, Trichechus manatus
IQDLVTFGDVAVDFSQEEWEWLNPAQKTLYRKVMLENYRSLVSLAGASLSKPDVISLLEQGKEPWTVKKQGTRGICPDWEY

SEQ ID NO: 24322 - protein, 81 aa, Trichechus manatus
MTEEFVTLKDVAMDFTLEDWEQLGLDQGDLFWDTALDNYQNLFLLNPLRPNLISHPGDGEELEALGRESSKAADPDTAEPK

SEQ ID NO: 24323 - protein, 81 aa, Trichechus manatus
AEGHVTFEDVAVYFSQEEWGLLDVAQRLLYHDVMLETFALMASLGLVSSRTHEITQLEWWREPWMPDREAMAPDMTRGCWH

SEQ ID NO: 24324 - protein, 81 aa, Zalophus californianus
PCRLVLFKDVAVDFSQEEWECLDLEQKDLYRDVMLENYSNLVSLAGFSISRADVLSLLKQGKEPWKVVQDVTRSQSSDWES

SEQ ID NO: 24325 - protein, 81 aa, Zalophus californianus
GQGSLSFEDVAVDFTREEWQLLDSAQKTLYRNVTLENLSSLVSLGFQLIRPDVIFRLEQEKPRVISEDIPSQSFSEYWKVD

SEQ ID NO: 24326 - protein, 81 aa, Zalophus californianus
WEAWLEKPVTFDDVAVNFTQEEWVCLDASQRVLYQNVMSETFRNLMSVDLIIELEQEEKQWRAELQLHPPNGEGLPSGGRT

SEQ ID NO: 24327 - protein, 81 aa, Zalophus californianus
KFQAVTFKDVVVVFTREELGLLDSTQRKLYRDVMLENFRNLLSVGYEPFRLDTTLLLGREEKLWMMETQTPGDGRSGLRNQ

SEQ ID NO: 24328 - protein, 81 aa, Equus caballus
FQESVTFKDVIVDFTQEEWKQLDPVQRDLFRDVTLENYTHLVSIGLQVSKPDVISQLEQGTEPWIMEHFIFLSDWETRPEN

SEQ ID NO: 24329 - protein, 81 aa, Equus caballus
KPRAVKFADVAVYFSPEEWECLRPAQRALYRDVMRETYGHLGALGCAGPKPVLISWLERNTDVWEPAALDPQEYPRGVTGQ

SEQ ID NO: 24330 - protein, 81 aa, Equus caballus
FLSVNLSLDVAIAFSQQEWEGLNPVQKTLYQDVMMENYRNLLSLGHAISKPGVITLLEQGKEPWMVVREETRRWCLKHIEN

SEQ ID NO: 24331 - protein, 81 aa, Sarcophilus harrisii
MSFSQEEWRCLNSAQRVLYRGIMQENCRNVDSLGLSKPLLISEVEHGKDICLPDLQSSKETEILNTSHTNEDRIQTEKRAK

SEQ ID NO: 24332 - protein, 81 aa, Lipotes vexillifer
LQGSVSFKDVTVDFTQEEWQQLVPAQKALYRDVMLENYCHLISVGFHMTKPDMIHKLEQGKELWTTEQTFPSQSYLEEDWK

SEQ ID NO: 24333 - protein, 81 aa, Tursiops truncatus
MLETCGLLVSLGHPVPKPELIHLLEHGQELRTVKRGLSRSTCTGEKAKPEITELTASHLVLTEGAPFEERVTHGASRHSRL

SEQ ID NO: 24334 - protein, 81 aa, Tursiops truncatus
MDVFVDFTWEEWQLLDPAQKHLYRSVMLENYSNLVSLGYQHTKPNIIFQLEQEELWMMQIPSEGHMDEVWEIDGHMEWHKE

SEQ ID NO: 24335 - protein, 81 aa, Pteropus vampyrus
EMDSVTFEDVAVNFTSEEWALLDPSQKKLYRAVMRETFRNLASIGLNLGKKWEDHNIEDRYKTHGKKLRSHMVEKLHESKE

SEQ ID NO: 24336 - protein, 81 aa, Pteropus vampyrus
FKESVSFEDVAVDFTRQEWYRLDSAQRTMHKDVMLENYSNLASVGLCVAKPEMIFKLERGEELWVLEEESSGHGYPGSLSL

SEQ ID NO: 24337 - protein, 81 aa, Trichechus manatus
MAAPSPPPEPKEWDYLDPAQRSLYKDVMMENYGNLVSLDVLNKDKDEEPTVKQEIEEIEEEVEPQSVIVTRIKSEIDQDPM

SEQ ID NO: 24338 - protein, 81 aa, Trichechus manatus
SLVIEDVVVVFTQEEWALLDLAQRKLYRDVMMETFRNLASVVSRNLNDENKLSSEHIIVRLMNNYTWSSMLEEISESHGSK

SEQ ID NO: 24339 - protein, 81 aa, Trichechus manatus
SVAFEDVAVDFTQEEWSLLDLSQRQLYRDVMMEIFRSLASVASQNLIDGDKLSTENIIVQFVKNDTWSSMVGDVRELHGTE

SEQ ID NO: 24340 - protein, 81 aa, Trichechus manatus
MKPAQRNLYRDVMLENYSNLVTVGCQVTKPDVIFKLEQEEEPWVGEEETLGRHCPEIWEVDEQIEKQQETLVRKVTSISKE

SEQ ID NO: 24341 - protein, 81 aa, Trichechus manatus
PVTFEDMAMYLTREEWRPLDPTQRDLYRDVMQENYGNVVSLDFEIRNENEVNPKQEISEDVEFGTTSKRPVGNAEENPESE

SEQ ID NO: 24342 - protein, 81 aa, Trichechus manatus
CGESVTFKDVAVDFTQEEWGQLDSPQRALYRDVMLENYRNLLALGPPVCKPDVISHLERGEAPWCSQRGGHAAACPEWEPP

SEQ ID NO: 24343 - protein, 81 aa, Trichechus manatus
SVVIEDVAVVFSQEEWALLDLAQRKLYRDVMMETFRNLASVVSQNLNDGEMLFNEHVMVRFMKNTWSSILEENSESCGNQD

SEQ ID NO: 24344 - protein, 81 aa, Trichechus manatus
SKEPVTFADVAVDFTQEEWQQLDPAQKTLHRDVILETSSHLVSTGRSGMKPYVIFKLEHGANPWIIERQLSMWLYPDREKS

SEQ ID NO: 24345 - protein, 81 aa, Trichechus manatus
SVAVEDVAVDFTQEEWALLDLSQRKLYRDVMMETFRNLASVVSRNLNDGEKLSSENIIVQFMRNDTWSSMVGEIHEFHSTE

SEQ ID NO: 24346 - protein, 81 aa, Trichechus manatus
SVIIEDVAVLFSQEEWALLDIAQRKLYRDVMMETFRNLASVVSQNFIDGEKLSSEHIMMRLTKDNTWSSVLGNIFKSHGSK

SEQ ID NO: 24347 - protein, 81 aa, Zalophus californianus
QESVTFEDVAIDFTEEEWALLDISQRKLFRDVMLENISRLVFLVILGMESPRKNQEIKLTYQQEGYSPDYANDLSNSFSLR

SEQ ID NO: 24348 - protein, 81 aa, Zalophus californianus
SQGLLTFRDVAIEFSQEEWGCLNHTQRELYRDVMLENYGHLLFLGLIVWKPDLVLFLEQEKQLWDVKRKETVAFHPAVISL

SEQ ID NO: 24349 - protein, 81 aa, Zalophus californianus
MLENYSHLVSVGCQVTKPAVISRLEQGQEPWMEEEEILRWSFPEEILQVGRPVGRQQEHQDKLLRHVTFLDKQEPTKKGHR

SEQ ID NO: 24350 - protein, 81 aa, Equus caballus
MNFEDVAISFSQEEWRLLDEAQRLLYCDVMLETFALVASLGCWHGAEDEDAPSEQNVSAEGDLQVRASTTGPSTQNTHSCE

SEQ ID NO: 24351 - protein, 81 aa, Equus caballus
LQGALSFEDVAVGFTWEEWQLLDPSQKDLYRDVMLENYNNLLSVGYQAMKPDSLFRLEQGEPPWIAEGAAHSQTCPEIWEI

SEQ ID NO: 24352 - protein, 81 aa, Equus caballus
HQEVMTFEDLAVYFTRAEWAGLSPAQRALCRSVMLENYGNLTSLGYPVPTPALISLLDGGDLSWGLEAQDDPPAERTTDIC

SEQ ID NO: 24353 - protein, 81 aa, Equus caballus
SKDLVTFGDVAVDFSQEEWQWLNPAQRNLYRKVMLENYRSLVSLGVSVSKPDVISLLEQGKEPWMVKKEGTRGTCPDWEYA

SEQ ID NO: 24354 - protein, 81 aa, Equus caballus
FTPEEWGLLDLEKKSLYRQVMLENYRNLVSVEHQLSKPDVVSQLEEEEELWSVERGIPQDTFSECPEAQLDPQLDPLPAGN

SEQ ID NO: 24355 - protein, 81 aa, Equus caballus
AAGSVTFKDVTMAFTQKEWEQLDPAQRNLYKDVMLENYSSLASMGYQAAKPDMISKLEKGEEPWLGKGKRPSQGGPSEIAR

SEQ ID NO: 24356 - protein, 81 aa, Equus caballus
FQGSVTFQDVAVDFTPEEWQLLDCDQRTLYWDVMLENFRNLVSVGDPVTKTKVIFKVEQGQEAQMGEGESPRWSCPEADYP

SEQ ID NO: 24357 - protein, 81 aa, Neovison vison
YQELVTFRDVAVDFSQEEWDCLNSSQRHLYSNVMLENYRILVSLGLCFSKPNVILLLEQGKEPWMVKRELAKGLCSGWDSM

SEQ ID NO: 24358 - protein, 81 aa, Neovison vison
EWGQLDPAQRTLYQEVMLENCGLLVSLGCPVPRPELIYQLEQGQELWMLKGHLSQSAYADVKGKLTTTELSSCAPALSGEA

SEQ ID NO: 24359 - protein, 81 aa, Aotus trivirgatus
AQDRVVFEDVAIYFSQEEWGHLDEAQRLLYRDVMLENLALLSSLGCWHGAEDEVAPSQQDFSAGVSEVTTSKSCMFTQKVH

SEQ ID NO: 24360 - protein, 81 aa, Aotus trivirgatus
LTGSTSFSSVTVAFAQEEWRCLVSTPRDRFKEGLPEKSRNLVLLGLPVSQPGMNSQLELREGAWMLEGEDLRNPSPNWKIV

SEQ ID NO: 24361 - protein, 81 aa, Papio anubis
RGHVTFEDIAVYFSQEEWGLLDEAQRCLYHDVMLENFSLMASVAGLSQSNHKDSCSQQKVTVSLNSCVAQCSPDDGHYTPK

SEQ ID NO: 24362 - protein, 81 aa, Papio anubis
MLENYKNLATVGYQLFKPSLISWLEQEEQRGDFPQVSEWKVQLKIKESALQQDFLGEPNSSGIQMIGSHTIFLRANVSARE

SEQ ID NO: 24363 - protein, 81 aa, Aotus trivirgatus
QGRLTFRDVVIEFSLAEWKCLTRAQRVLYREVMLENYRNLESVDISSKCIMKKFSSTGQGNTEVFHTGTLERDESHHIGEF

SEQ ID NO: 24364 - protein, 81 aa, Aotus trivirgatus
TLVTFKDIFVDFTREEWKLLDTAQQIVYRNVMLENYKNLVSLDSETAFEIKSSVCSRSIFKDKQSCDSKMQGMARNDLWYL

SEQ ID NO: 24365 - protein, 81 aa, Aotus trivirgatus
LQEPVTFRDVAVDFTQEEWGQLDPTQRILYRDVMLETFGHLLSIGSELPKPEVISHLEQGTEPWVTERGTTQGCSPGWEPQ

SEQ ID NO: 24366 - protein, 81 aa, Aotus trivirgatus
GEGLLSFEDVAVDFTQEEWQFLDPSQKVLYKEVMSENYRNLVSVGYQGTKPDVLFKLERGESPWIVEGAAYSQTCPGFVIQ

SEQ ID NO: 24367 - protein, 81 aa, Lipotes vexillifer
SQGTLTFRDVFVDFNLEEWQQLDATQKNLCRDVMLENYSHLVSVGFLVAQPGRIFRLGQGEEEARMAAGESPTRRCPEFWQ

SEQ ID NO: 24368 - protein, 81 aa, Pan paniscus
SQGLLIFRDVAIEFSPEEWSYLDPAQQNLYRDVMLENYRNLVSLGIAVSKPDLITCLEQRNEPWNVKKHETVAIHPAVSSH

SEQ ID NO: 24369 - protein, 81 aa, Lipotes vexillifer
LQNSITFEDVAMDFTQEEWALLNSSQRKLYRDVMLENYRNLASLGHQLSKPPLITQMEQEDEMEIVERRTHQDTRSDELIL

SEQ ID NO: 24370 - protein, 81 aa, Tursiops truncatus
AQLTFKDVAIEFSQEEWECLDPAQRALYRDVMLETYRNLVSLDISHVHVIKKLQLNANTDRAEVFQTLILGRHEKIKPFYL

SEQ ID NO: 24371 - protein, 81 aa, Pteropus vampyrus
SEDLVTFGDVAVDFSQEEWARLNPAQRDLYRHVMLENYRNLVSLGVSVSKPDVISLLEQGKEPWMVKKEGSRGKCYDWEYA

SEQ ID NO: 24372 - protein, 81 aa, Pteropus vampyrus
PDSVVFEDVAVDFTQEELALLNPAQRKLYRDVMLETFRNLVSVADEIQLKTNGSTSQKDIFGEKLSNEQKIARFTKNDSWT

SEQ ID NO: 24373 - protein, 81 aa, Pteropus vampyrus
SVAFEDVAVNFTPEEWALLDPSQKKLYRDVMRETFENLASVGKGMEDYDIEDQYKNQGRKLRSHIEERIYESEASGQCEEN

SEQ ID NO: 24374 - protein, 81 aa, Pteropus vampyrus
TQDSVLFEDVAVDFSQEEWALLDLTQKSLYRDVMLENFQNLASLGYPLHTPCLILQWKQEEELEIAKRGPIEQEHQEGFET

SEQ ID NO: 24375 - protein, 81 aa, Pteropus vampyrus
KPRAVKFADVAVYFSPEEWGCLRPAQRALYRDVMRETYGHLGALGCVGPKPALISWLERNTDDWELAALDPQECPKRVTVQ

SEQ ID NO: 24376 - protein, 81 aa, Trichechus manatus
GWVPALFDEVAIYFSDEEWEVLTEQQKALYREVMRMNYETVLSLEFPFPKPDMITRLEGEEESQKSKEWQLQGGTFTENED

SEQ ID NO: 24377 - protein, 81 aa, Pteropus vampyrus
AEVLVTFKDVAVTFTQEEWGQLDLDQRTLYWEVMLETCRFLVSLGHPVPRPELIHPLEHRQELWMAKRGFSHSTCPGDGAK

SEQ ID NO: 24378 - protein, 81 aa, Trichechus manatus
VAVEDVAVDFTQEEWALLDVSQRQLYRDVMMEIFRSLASVASRNPVDEEKLSTENKTVRFMKNDTCSSMVGEMRELHGTED

SEQ ID NO: 24379 - protein, 81 aa, Trichechus manatus
LLTFRDVAIEFSQEEWDCLDPAQRALYREVMLENYRNLVSVDIFARKVINKLLPKQDNNKGELHHPVILERHESHGIEDFD

SEQ ID NO: 24380 - protein, 81 aa, Trichechus manatus
KSQGPVSFEDVAVNFTQEEWQQPAQRTLYRDVMLENYSHLVSMGYPVPKPDVIAKWEHGEEPRIVKRDIVHWIYPGEILAD

SEQ ID NO: 24381 - protein, 81 aa, Trichechus manatus
AHDLVMFTDVAVDFSQEEWECLDSYQKNLYRDVILENYNNLVSLGCSISKPDVVTLLEQGKEPWLIGRDKKIRWSPDLESK

SEQ ID NO: 24382 - protein, 81 aa, Trichechus manatus
KAQESLIFSDVVVKFTWEEWQILDPAQKDLFWNVMLENYSNLVSIGCRGSKPDAHPRLEREQPWTLLNRSHSEIFSEIQNV

SEQ ID NO: 24383 - protein, 81 aa, Trichechus manatus
ARAPVSFEDMAVTFSWEEWGCLEPAQTALYRDVMLDTCGHLVFLGLLLSKTDVISRLEQEDPWWVEQGRPRDWKTTLGKKQ

SEQ ID NO: 24384 - protein, 81 aa, Zalophus californianus
PQGLVTFGDVVVDFTPEEWQYLNPPQKTLYREVMLETYSNLVSVGPQVTKPDLILKLEVEEPCPAETKISFWSFPAACQID

SEQ ID NO: 24385 - protein, 81 aa, Zalophus californianus
PQDLMTFEDVAVEFTQWEWGKLDPAQKDLYRAVMLENFKNLASLGLPVSKPYVISQLEEGKEPYVLEGEISTDFILERNPT

SEQ ID NO: 24386 - protein, 81 aa, Zalophus californianus
VLQGLSFKDVAVNFTEEEWKELDPAQRDLYKDVMLENYRNLVSLGFPFSKPDIISQLEQAGNPWMQEREVLRRSCTYLETR

SEQ ID NO: 24387 - protein, 81 aa, Equus caballus
PVTFEDVAVAFTEEELGLLDAAQRQLYRDVMLENFWNLLSVGDRNAKDLENIQEKELTSLPYRELLCWKIWEQAADELTGS

SEQ ID NO: 24388 - protein, 81 aa, Equus caballus
MIPSLSSSRSFFLFQRPSSLGHLVQVLNYFTLTGYCVTKPEVIFRLEQGEEPWISEEEFPSQVFPEVWKSDQLKERSQENQ

SEQ ID NO: 24389 - protein, 81 aa, Equus caballus
PQVSVTFEDVAVLFTRDEWRKLSPSQRSLYQDVMLENYSNLVSLGLPFSKPKVISLLQRGEDPWKVERESSGGCSAGCKSS

SEQ ID NO: 24390 - protein, 81 aa, Equus caballus
TAHMAFRDVAVDFTQEEWLLLSPAQRSLYREVMLENYSNLVSLGIPFSKPKLITQLEQGKETWREETQGPPATCPAEAKPE

SEQ ID NO: 24391 - protein, 81 aa, Equus caballus
SLDSVTFTDVAIDFSQDEWEWLNLAQRTLYKKVMLENYRNLVSLGLCVSKPDVISLLEQGKEPWMMKGEMTRGLCPDLEYV

SEQ ID NO: 24392 - protein, 81 aa, Equus caballus
FQELLTFRDVAIEFSQEEWECLDPAQRALYRDVMLENCRNLLSLGLIASKPELVTFLEQKKDPWVVKREKKIVIHPGRWGW

SEQ ID NO: 24393 - protein, 81 aa, Pan paniscus
MCFQELLTFRDVAIEFSPEEWKCLDPAQQNLYRDVMLENYRNLVSLDLVTCLEQRKEPYNLKIDETVAKPPMISLQVYSET

SEQ ID NO: 24394 - protein, 81 aa, Lipotes vexillifer
MTFKDVAIDFTEEEWQQLDPAQRNLYWNVMLENYNNLITVGCPFTKPDVIFKLEQEEPWVVAEEVSKRHCPGEIWGMDEHQ

SEQ ID NO: 24395 - protein, 81 aa, Pan paniscus
LRGLVTFEDVAVEFTQEEWALLDPAQRTLYRDVMLENCRNLASLGCRVNKPSLISQLEQDKKVITEERGILPSTCPDLETL

SEQ ID NO: 24396 - protein, 81 aa, Lipotes vexillifer
WLQEKEGKAQVVKMVTFRDVAVVFTEAEWKRLSSEQRDLYREVLLENYRNLLSLGQKVTILGFVCDMVSVTTLNSALVGLK

SEQ ID NO: 24397 - protein, 81 aa, Lipotes vexillifer
FQVLVSFEEVAVLLSQEEWGHLGPAQKGLYRDVMLETYGNLVSLGLQGSKPDVISKLEQGEEPWAPHSPRIEGSWIWRRRR

SEQ ID NO: 24398 - protein, 81 aa, Callorhinus ursinus
LQESLTFRDVFVDFTLEEWQQLDSAQKSLYRDVTLENYSHLVSVGYLVARPDEVSRLGRGEEARRADGGPSAPNFPEFWQV

SEQ ID NO: 24399 - protein, 81 aa, Callorhinus ursinus
LQEAIVFEDVAVYFTRIEWSCLAPDQRALYRDVMLENYRHMASLGFLVAKPALISLLEQGEEPGALILQGTEEQGSTASLC

SEQ ID NO: 24400 - protein, 81 aa, Callorhinus ursinus
SQALLTFRDVAIEFSQEEWGCLTHTQRELYRDVMLENYGHLLFLGLIASKPDLIIFLEQEEQFWVVKRKETVTFHPGRWEW

SEQ ID NO: 24401 - protein, 81 aa, Callorhinus ursinus
MLENFSHLVSLGHPVSKPDIISKLEQGEEPWIIKRHISDWICPERETRLENPQLDILEGVSFPKEILEGVTRDHSLYSIFK

SEQ ID NO: 24402 - protein, 81 aa, Callorhinus ursinus
AQVCVISEDVFVSFSREEWMLLDDSQRLLYQDVMLETFALLASLGIVSSRSHSVAQLEQKEDPQMAAQVDMTPVSEREAQK

SEQ ID NO: 24403 - protein, 81 aa, Callorhinus ursinus
MKMHLPPPSEALSSDNLAHVLCHFPLTGLCVAKPEMIFKLERGEELWILEEESSGHGYPGSLSMLCGNSSVGGNAVRHDND

SEQ ID NO: 24404 - protein, 81 aa, Callorhinus ursinus
GQRSVSFRDVTVDFTRDEWLQLTGPQRMLYRDVMLENYSHLVSVGCHLTKPEVIFRLEQGEELWPSGGEFPDQGDQDKSQE

SEQ ID NO: 24405 - protein, 81 aa, Callorhinus ursinus
QESVTFKDVAVDFTLEEWGQLGPGQRELYRDVMLENYQNLLSLGVGPLGSKPDVISRLERGEEPRMEKKEARQATCPALHT

SEQ ID NO: 24406 - protein, 81 aa, Tursiops truncatus
AQGSVTFEDVAVYFSWEEWCLLDEVQIHLYLDVMLENFALVCMLGSWHRVEDEETPFEQSVSAGVSQIRTSSAGSSPEKAQ

SEQ ID NO: 24407 - protein, 81 aa, Tursiops truncatus
QSLVTFEDVAVHFSKEEWGLLDAAQRQLYHSVMLENLELMTSLGCWHGVEDEEVCSKQDASVDVVSQVRIFSAHFSTQKAD

SEQ ID NO: 24408 - protein, 81 aa, Tursiops truncatus
MDSVTIEDVAVDFTLEEWALLGPSQRKLYRDVMQETLRNLAAVGAKREYHAIEDQYKNQGRKLRTFMVERFCKSKDISLCG

SEQ ID NO: 24409 - protein, 81 aa, Sousa chinensis
LQETLTFRDVFVDFTLEEWQQLDATQKNLCKDVMLENYSHLVSVGFLVAQPGRTFRLGQGEEEARMAAGESPTRRCPGEPV

SEQ ID NO: 24410 - protein, 81 aa, Pteropus vampyrus
MKPAQKNLYRDVMLENYSNLVTVGYQVTKPDVIFKLEQREEPWVIEEEMFGRHCPEVWEVDEQIKKQQEIVRKVTSISNKT

SEQ ID NO: 24411 - protein, 81 aa, Pteropus vampyrus
VTFEDVALYLSREEWGRLDHTQQSFYHDVLQKRNRLALGAVEVGKEEPMPCPASHGDVKSFRTRAERAHGDSLQCGQQAAR

SEQ ID NO: 24412 - protein, 81 aa, Pteropus vampyrus
SQGCVTFEDVAVYFSWEEWGLLDEAQRLLYRSVMLENFALMASLGLASSGTQDITQLQRWGEPFLPAREVITVAVPRGSWC

SEQ ID NO: 24413 - protein, 81 aa, Pteropus vampyrus
WLLTFRDVAVDFSQEEWDYLNPAQRDLYRDVMMENYSNLVLLDLEFRCKTKELCLRKEINEVTSSQWMITEKSHSLLGSNI

SEQ ID NO: 24414 - protein, 81 aa, Pteropus vampyrus
SQGSVTFRDVAIDFSREEWEWLRPAQRDLYRQVMLENYGHLVSLGLNFSKPDLVSFLEQGKEPWLGRGNVRRDLCSVSESN

SEQ ID NO: 24415 - protein, 81 aa, Trichechus manatus
MDSVVFEDVAVEFTQEEWALLDFSQRKLYRDVMMENFRNLDSVFKQDNNGQTSMKNDSWPSMLGEVHEFHGIEHQHNNRRR

SEQ ID NO: 24416 - protein, 81 aa, Trichechus manatus
MAQESLTVSDVFVKFTWEEWQILDPAQKDLFWNVMLENYSNLVSIGCRVSKPDVLSRLEQEQPWTILDESHSGTFSETWRV

SEQ ID NO: 24417 - protein, 81 aa, Zalophus californianus
AQISVTFDDVAVTFTQEEWGQLDPAQRTLYQEVMLENCGLLVSLGCPVPRPELIYQLQHGQELWTWKRDLSQSAYPGDKGK

SEQ ID NO: 24418 - protein, 81 aa, Zalophus californianus
FVSLKDVTVDFTWEEWQHLNSAQRNLYRDVMLENYSNLVSVGCQSLKSDVISLKQGEPWMKEEGISSWAYSELKSQVTSFT

SEQ ID NO: 24419 - protein, 81 aa, Equus caballus
MGEGLKFKDVAIYFSQKEWECLHSTQKDLYQDVMLENYNNLISLGLSDSKPDVISLLEQKKEPWMVKRKETREWCPDWESK

SEQ ID NO: 24420 - protein, 81 aa, Equus caballus
DHMSLAFGDVAIDLSQEEWACLDPAQRALYRDVMLENYRNLASLGWSIPKPDVITFLEQDKEPWMVTREGTRSWCSDLESK

SEQ ID NO: 24421 - protein, 81 aa, Equus caballus
WLQGPVTFKDVAVEFTQEEWLMLDSAQRSMYRDVMLENYINLTSVEYQLCKPTVISLLGQEEIRIIKRRIPQGTYSDWEIQ

SEQ ID NO: 24422 - protein, 81 aa, Equus caballus
PLPALLPDPCGCAREGWVRAGEKKLRVVSFADVAVYFSPEEWGCLRLVQRALYQDVMRETYGHLGALGSPGFHGPQSNPGV

SEQ ID NO: 24423 - protein, 81 aa, Aotus trivirgatus
QASVCFEDVAMAFTQEEWGQLDLAQRTLYREVTLETWEHLVSLDWKATLEKNRLNSGKDQAWDEISHHVEVKQCVQEEPPC

SEQ ID NO: 24424 - protein, 81 aa, Lipotes vexillifer
GVSVNFEDVAVTFSWEEWGLLDEVQRYLYRDVMLEDLALITSLGPISASLQPSLEGSSVRNLPISLIKSNLIEHQRSNTRD

SEQ ID NO: 24425 - protein, 81 aa, Callorhinus ursinus
VLCEGERITSGGLVSQLLAHSQEHPKMNKSQRSVSSKDLTVDFTPQEEWQQLCPTRRLLDRAVILENCRQLVSVGEYSFPG

SEQ ID NO: 24426 - protein, 81 aa, Callorhinus ursinus
SQGSISFEDVTVNFTQEEWGQLDPDQRTLYRDVMLENYSIFISLECHFKPQEMRRGPEANGSGEAPMREKRKKSVSVLRQR

SEQ ID NO: 24427 - protein, 81 aa, Callorhinus ursinus
SQDLVTFKDVAIDFSQEEWEWLNPAQRNLYKNMMLENYQNLVSLGLCISKPYVISLLEQGKEPWEMKTEMTRSPFPDLGPI

SEQ ID NO: 24428 - protein, 81 aa, Callorhinus ursinus
QGSLSFKDVAVVFTWEEWQLLDPIQKNLYQDVMLENYSNLVSLEDTWQVDCHTDEHQDNQGNLETMESHQKNNAFRKILCL

SEQ ID NO: 24429 - protein, 81 aa, Tursiops truncatus
MLQNYSNLVSLGISFSKPTPVILLEYGEEPWKEERGHQPSPCSADPKPEIPPYSSSVLVFCGQQLHQHVLHDHHLPICPGL

SEQ ID NO: 24430 - protein, 81 aa, Tursiops truncatus
VTFPDVAVRFSWGEWKLLDEAQRRLYLSVTLDIYALISSLGCCCGAEGEETSCEETVPVGVSQAGSPKAAPSSQKTHPCEM

SEQ ID NO: 24431 - protein, 81 aa, Pteropus vampyrus
VTFEDVTVYFSSEEWDLLDEAQRRLYQDVMLENLALITSLVGMGPRMRRHFLSRAFLYKECHRSGLPRLACVPRRPIPMRC

SEQ ID NO: 24432 - protein, 81 aa, Pteropus vampyrus
PWLPLTFEDIAIYFSEQEWQNLEAWQKDLYRNVMRANYEILVSLGDGLPKPELISHIEQGKELFWNLGETQKSGNIICSSA

SEQ ID NO: 24433 - protein, 81 aa, Pteropus vampyrus
SQKSLTFADVFMDFTLEEWQQLDSTQKSLYRDVMLENYSHPVSVGYLVAKPDVIFRLGQVEARKADGEPATQSCPEVLQVD

SEQ ID NO: 24434 - protein, 81 aa, Pteropus vampyrus
MDFTPEEWGKLDPAQRDTMLENYRNLVSLWLPVSKPENYSLENGKDPLMLERKAPKSSYSDLESGPESKDSTSVQDFSKEE

SEQ ID NO: 24435 - protein, 81 aa, Pteropus vampyrus
GRVTFEDVIVYFSSEEWDLLDEAQRRLYRDVMLENWALITSLGGWHGVQDEEAPSEQSISVRGGSGSRVRTPKAGVSLQKP

SEQ ID NO: 24436 - protein, 81 aa, Equus caballus
FKEPVTFEDVAVVFTEEELGLLDATQRQLYRDVMLENFRNLLSVGHQSVTPDGIPRLEREEKLWLVKTAAQSQSSSGDKNL

SEQ ID NO: 24437 - protein, 81 aa, unidentified
  REGION 1..81: note = Bos indicus x Bos taurus
NKTFLGRLTFKDVAIEFTPEEWECLDLAQRALYREVMVETLRNLLSVGEDHFPPEVGICPWVALNQKGVPATHPKNLTCPR

SEQ ID NO: 24438 - protein, 81 aa, Pan troglodytes
QGLVTFRDVALDFSQEEWEWLKPSQKDLYRDVMLENYRNLVWLGDGCSCRSTLRTTVTAEASSSSSSIQASFHSLALPLMS

SEQ ID NO: 24439 - protein, 81 aa, Pan troglodytes
MGSLDTLFTQGLPVPQPDVIFQLKRGDKPWMVDLHGSEEREWPESVSLDWETKPEIHDASDKKSEGSLRECLGRQSPLCPK

SEQ ID NO: 24440 - protein, 81 aa, Pan troglodytes
IGGDVTFNDVAIDFTHEEWGWLNSAQRGLYKDVMVQNYENLVSVAGLSITKPYVITLLEDGKEPWTVEKKLSKGMIPREWE

SEQ ID NO: 24441 - protein, 81 aa, Pan troglodytes
KSMVTFEDVAVYFSQEEWELLDAAQRHLYHSVMLENLELVTSLGCWRGVEGEEAHPEQNVSVEVLQVRIPNADPSTKKANS

SEQ ID NO: 24442 - protein, 81 aa, Cercocebus atys
PQGLLTFRDVAIEFSQEEWKCLDPAQRTLYRDVMLENYRNLVSLEFQSVTQAKVQWCHLGSLQPPIPRFKQFSCLSLPSSW

SEQ ID NO: 24443 - protein, 81 aa, Cercocebus atys
QAEVTFEDVAVFLSREEWGRLGPAQRGLYRDVMLETYGNLVSLGVGPAGPKPGVISQLERGDEPWVQDVQGTSGREHLKVN

SEQ ID NO: 24444 - protein, 81 aa, Felis catus
WSQMPVTFEDVALYLSREEWGRLDHVQQNFYRDVLQKRNGLSLGFPFSRPFWASQGQGKGEASGSCRQMGDEEKTGACRGA

SEQ ID NO: 24445 - protein, 81 aa, Leptonychotes weddellii
CEVSVSFEDVTVDFSREEWQHLDPAQRRLYRDVTLENYSHLRSVGYQVPKPEVIFKLEQGEGPWTLEGETPHQRCSDEAIG

SEQ ID NO: 24446 - protein, 81 aa, Leptonychotes weddellii
SQGLLSFSDVAVDFTWEEWQLLDTVQRNLYRDVMLENYSNLMSLERPLQCFSKGIRLKQKSDSKFQSKNYAEMNSFELSSH

SEQ ID NO: 24447 - protein, 81 aa, Felis catus
YTLESLTLEDVAVDFTQEEWRLLAPAQKDLYRDVMLENFRNLVSVGYVASMPAALSRLERGGWWMTEDETRRWICPEIKKD

SEQ ID NO: 24448 - protein, 81 aa, Felis catus
SQAPVTFEDMAMYLTREEWRPLDPTQRDLYRDVMQENYGNVVSLDFEIRSENEVNPKQEISEDVEFGTASERPVGNAEENP

SEQ ID NO: 24449 - protein, 81 aa, Leptonychotes weddellii
ADSVVFEDVAVDFTLEEWALLDSMQKNLYRDVMLEIFQNLVSVDYETLLKASGLVSQQDMHEEKKSNEQKMAKFTRNCSCA

SEQ ID NO: 24450 - protein, 81 aa, Felis catus
AYGSVSFRDVAISFSQEEWAYLDPAQRALYRDVMLENYSHLLSLAGRSISKPDVITLLEQEKEPWVVIWSQIMELRSYLQK

SEQ ID NO: 24451 - protein, 81 aa, Neomonachus schauinslandi
MEEWALLDPSQKKLYRDVMQETFRNLASIVCISEEKWEIHDSEDQNENRGTDLSNQMVERLCKSKECSQYEEIFSQIPYHN

SEQ ID NO: 24452 - protein, 81 aa, Pongo abelii
QESVTFHKDVSVDFTQEEWYHVDPAQRSLYRDVMLENYSHLVSLGYQVSKPEVIFKLEKGEEPWISEGEIQRPFYPDWKTR

SEQ ID NO: 24453 - protein, 81 aa, Pan troglodytes
GKGVLTFRDVAIEFSLEEWHCLDTAQQNLYRNVMLENYRNLVFLGVGVSKPDLITCLEQGEEPWKRHKMVSKPPVVCSHFA

SEQ ID NO: 24454 - protein, 81 aa, Pan troglodytes
LTFRDVAIEFSQEEWKSLDPVQKALYWDVMLENYRNLVFLGKDNFALEVKICPRVFLYFLCCLSWEPFHYLTETEALLTHK

SEQ ID NO: 24455 - protein, 81 aa, Pan troglodytes
DHLSQDVFCLHESEFEEERMVAGWLTNYSQDSVTFEDVAVDFTQEEWTLLDQTQRNLYRDVMLENYKNLVAVSSVVEMNSE

SEQ ID NO: 24456 - protein, 81 aa, Pan troglodytes
ATLRLSAQGTVTFEDVAVNFTWEEWNLLSEAQRCLYRDVTLENLALISSLGMTFLHVCQALDSLRQVIHPPQPPKVLGLQV

SEQ ID NO: 24457 - protein, 81 aa, Pan troglodytes
VAFEDVAVNFTQEEWTLLDISQKNLFREVMLETFRNLTSIGKKWSDQNIEYEYQNPRRSFRSLIEEKVNEIKEDSHRGETF

SEQ ID NO: 24458 - protein, 81 aa, Pan troglodytes
FQKPVTFEDVAVNFTQEEWDCLDASQRVLYQDVMSETFKNLISVARIFLHKPELITKLEQEEEQWRETQVLQASQAGPPFF

SEQ ID NO: 24459 - protein, 81 aa, Camelus dromedarius
SLGSVSFKDVTVDFSREEWQQLDLAQKSLYTDVMLENYFNLISVGCQVPKPEVIFTLELGEEPCMLDDGISSQSCLDQSVG

SEQ ID NO: 24460 - protein, 81 aa, Camelus dromedarius
EDTAHSVAHLDIDCHSEQLIFEDVAIRFSQEEWECLVPAQRALYRDVMLETYRNLLSVGERTSLLMLRFALGYLHFPLCAC

SEQ ID NO: 24461 - protein, 81 aa, Myotis davidii
KQMSVTFKDVAVLFTRDEWRKLRPPQRHLYQDVMLENYSNLVSLGLLFSKPKVISLLQQGEEPWKVEEESPWGAPLGCKSN

SEQ ID NO: 24462 - protein, 81 aa, Myotis davidii
CSEGAWVPALFDEVAIYFSDEEWEVLTEPQKALYREVMRMNYETVLSLEHEDADIKPPDWAGPMHTVSPFPPPQPLDGLGL

SEQ ID NO: 24463 - protein, 81 aa, Myotis davidii
MLENYNNLITVGCPFTKPDVIFKLEQEEEPWVVEEEVLKRHCPGELSGLDHQNIQDRLLTQLRDKFIKVLTEEKVSECHKK

SEQ ID NO: 24464 - protein, 81 aa, Myotis davidii
LQISLSFEDVTVDFSRDEWQHLDPAQRCLYWDVTLENYSHLLSVGYQVPKPEVIFKLEQGKGPWTLEGETPHQSCSDKDVG

SEQ ID NO: 24465 - protein, 81 aa, Myotis davidii
LIGDQDFGTSLLHTAPQEHWKHLDSIQKEQYWDLMLETYGKMVSGGISNSKPDLTNSTESNSKPVLTNSTECGEELAGLHL

SEQ ID NO: 24466 - protein, 81 aa, Myotis davidii
MDLEDVAIAFSQEEWGLLDAAQRLLYCEVMLEIFALVASVGKTLLFSRCPEEDWGLLDAAQRLLYCEVMLENFALVASVGC

SEQ ID NO: 24467 - protein, 81 aa, Cercocebus atys
QDTVAYEDLCVDYTQKKWKCPALSQRALQWNMIPENDRSMASLGENMMKGSELTPKQEIFKGSESSNKTSGGLFGMVPGGA

SEQ ID NO: 24468 - protein, 81 aa, Cercocebus atys
PQGLLTFRDVAIEFSQEEWKCLDPAQRTLYRDVMLENYRNLVSLDISSKCMLKTLSSTGKGNTEVILTGTLQRQASHHTGE

SEQ ID NO: 24469 - protein, 81 aa, Neomonachus schauinslandi
QGHVTFEDVAVYFSQEEWGLLDEAQRHLYRTVMLENLALMASLGCWHGVKTEEAFSEQCVFMERVSQTRTPDPGLSIPKAH

SEQ ID NO: 24470 - protein, 81 aa, Neomonachus schauinslandi
RPPLVTFKDVAVDFAQEEWEHLDASQSHLYGEVMLENYENLISLGHLLSKPEMIFYFEQEDGVWMEEEMPRSSYSETPRER

SEQ ID NO: 24471 - protein, 81 aa, Monodelphis domestica
DQEAVTFKDVTVDFTQEEWCLLSPPQKELYKEVMLENAQNLISVGLPAPSEEVISYLEQRETPWMLEQEDLRSFYPGPLPQ

SEQ ID NO: 24472 - protein, 81 aa, Physeter macrocephalus
AQGSVSFEDVTVEFTQDEWQYVGPAQRTLYKDVTLENYSHLVSLGYCIIKPQVIFKLEHGEEPWSSEEEFLNQKYPGYYRV

SEQ ID NO: 24473 - protein, 81 aa, Physeter macrocephalus
AQGSVSFEDVTVEFTQDEWQYVGPAQRTLYKDVTLENYSHLVSLGYYRVDVHIEENQEKQEKPLWQVVFTDNKILSKEEQK

SEQ ID NO: 24474 - protein, 81 aa, Monodelphis domestica
PQASVTFEDVAVYLTQEEWGHLGPAQRGLYRDVMLENYGNVVSLGFPVSKPDVILQLEQKGEPWFLGMQDTEDCETRTEIK

SEQ ID NO: 24475 - protein, 81 aa, Monodelphis domestica
AQEAVTFKDVAVNFTQEEWCLLSPPQKELYKEVMLENAWNLLSVGLPGPPEDMISYLEQKDSPWMLEQEGLRSFCLEGEIR

SEQ ID NO: 24476 - protein, 81 aa, Monodelphis domestica
CRVSMTFKDVAVEFTSEEWGCLKPFQKKLYRDVMLENYRNLVSLGFTVSKPDVICRLERKKASWMPEANVPRSSSASEYLK

SEQ ID NO: 24477 - protein, 81 aa, Monodelphis domestica
MLENVQNLLSVGLPVPRENFISCFQQGKASWLLEQKDPRNSCPEAEANFEVKEMSMNLSFFVEVSCPQRCMNEGPHDFILR

SEQ ID NO: 24478 - protein, 81 aa, Monodelphis domestica
GLAARFQDVAVEFTWEEWRHLDPAQRALHRNVMLENYENLVSIEGKIRLEMNEISAELRLSREETQKQRYIGDGASDSTWR

SEQ ID NO: 24479 - protein, 81 aa, Physeter macrocephalus
QGSVTFEDVALYFSWEEWALLDEAQRCLYHDVMLENFALTSSLGCWHGVEDKEAPSQQSISVDGVSQIRPLKAGSSLQKAQ

SEQ ID NO: 24480 - protein, 81 aa, Monodelphis domestica
LQAAVSFRDVVVDFTEEEWGRLSPAQWQLYKEVMLENYRNLVSLGLMEDKPGLISRLEQGEVLPLTSAAPRPPLWEGDASA

SEQ ID NO: 24481 - protein, 81 aa, Monodelphis domestica
MDFTQEEWRLLDHSQKELYLEVMLENVQNLLSVEAKTDFEVKDMSTKLSLFVEGSGSQRCVNEGLCHFILKEIFASNIKVN

SEQ ID NO: 24482 - protein, 81 aa, Monodelphis domestica
PKEAVTFKEVAVDFTGEEWCLLSPPQKELYKEVMLENAQNLLSVGLPGTPEDMISSLEQREAPWILEQEGLRNCCPEGEIR

SEQ ID NO: 24483 - protein, 81 aa, Monodelphis domestica
FQGSITFKDVAVDFTQEEWYLLDHSQKELYLEVMLENVQNLLSVGLPVPRENFISHIQQRKTSWLLEQKGPRSSSLDFEVK

SEQ ID NO: 24484 - protein, 81 aa, Physeter macrocephalus
FQEPVSFKDVAVTFTKEELGLLDSTQRKLYRDVMLENFQNLLSVGYQPFKLDMILQLGRKEKLWVMEPETQGAGCSGHGNQ

SEQ ID NO: 24485 - protein, 81 aa, Monodelphis domestica
SQGLMNFKDVAVDFSQEEWCLLDHSQKELYLEVMLENVQNLLSVGLLVPREDIVSCFQQGEAPWLLEQRGPRSSCPETETN

SEQ ID NO: 24486 - protein, 81 aa, Monodelphis domestica
LQEVVTFQDVAMDFTREEWPLLSPHQKELYKEVMLENARNFLSVGLPAPSEEVISYLEQREAPWILEQEGLRNCCSEGEIR

SEQ ID NO: 24487 - protein, 81 aa, Monodelphis domestica
VVTFQDVAVDFTREEWRLLSPPQKELYKEVMLENARNLLFVEGEIRPEIKENPIEVSFPVEEMNLQRCTDGLDKFASREFC

SEQ ID NO: 24488 - protein, 81 aa, Monodelphis domestica
APEAVTFKDVAVDFTREEWRLLSPPQKELYKEVMLENAQNLLSVGLPGPPEDVISYLEQREAPWLLEKEGLRSCCPGDIRP

SEQ ID NO: 24489 - protein, 81 aa, Physeter macrocephalus
MLENFRNLISVGCPVTKTKVIFKVEQGQEPWMMEGENARWHSPEVICLLDDELEGQEGEGSKDNFLNQGMFTFKKTLTNET

SEQ ID NO: 24490 - protein, 81 aa, Monodelphis domestica
VTFRDVSLDFTWEEWECLSAVQRELYRDVMLENYRNLVSLAWDPKLKNQESAEKQEVRPVEILEERRPGVVLRNQIFVVGP

SEQ ID NO: 24491 - protein, 81 aa, Papio anubis
TVTFEDVAVNFSQEEWSLLSEVQRCLYRDVMLENLALISSLDCWCGSKDKEAQSKQSISVQRESQNRTPRAVVSPKKAHPC

SEQ ID NO: 24492 - protein, 81 aa, Aotus trivirgatus
FQGPVTLKDVTVEFTKEEWKLLTPAQRTLYKDVMLENYSHLASVGYRVNKPNVVFKLKQGKEPWMLVVEFPHRGLPEDLWN

SEQ ID NO: 24493 - protein, 81 aa, Aotus trivirgatus
ELLTFRDVAIEFSPEEWTCLDPAQQNLYRDVMLENYRNLVSLGVAISNPDLVTCLKQRKEPCNVKIRETVAKPPAVCSHFT

SEQ ID NO: 24494 - protein, 81 aa, Papio anubis
GRVVFEDVAIYFSQEEWGHLDEAQRLLYRDVMLENLALLSSLGCWHGAEAKEALEQSASVKVPSSNVQQHQKHYGEKPLKR

SEQ ID NO: 24495 - protein, 81 aa, Aotus trivirgatus
TFLSVTFEDVVVHFSLEELSSLSAAQRNLYREVTLETYRNLVSLGYHFSKPDIISRLEKEESRAMETDSSAVICQGESYDD

SEQ ID NO: 24496 - protein, 81 aa, Aotus trivirgatus
LQGLVTFEDVAVEFTQEEWALLDPAQRTLYKDVMLENCRNLASLGCHVNKPRLISQLEQDKKVMTEERGILPSTCPDLETL

SEQ ID NO: 24497 - protein, 81 aa, Sarcophilus harrisii
ALESVTFQDVAVNFTHEEWGHLKPAQKDLYREVMMENYQNFVSLGLPFSKPHVISQLEKGEAPWITEKASLVPRVSCQDFF

SEQ ID NO: 24498 - protein, 81 aa, Lipotes vexillifer
CEGSVSFEDVTIDFSREEWQQLDPAQRCLYQDVMLEIYSHLFSVGYHIPNPEVIFRMEKGKEQWMQEAELPRQRYHVSETA

SEQ ID NO: 24499 - protein, 81 aa, Lipotes vexillifer
PKVPVTFDDISIYFSTPEWEKLEEWQKELYKNIMKGNYESLISMDYAMNQPDVLSQIQPEGDHNTEDQAAPEESEIPTDPT

SEQ ID NO: 24500 - protein, 81 aa, Callorhinus ursinus
MLENYGNLTSLGYPVPKPALISLLEGGNLPWGLEAQDNPSAERTKDICKDTETNVGSESTSTQGISEERDVILSHGLQKSV

SEQ ID NO: 24501 - protein, 81 aa, Callorhinus ursinus
VLQGLSFKDVAVNFTEEEWRELDPAQRDLYKDVMLENYRNLVSLGFPFSKPDIISQLEQAGNPWMQEREVLRSSCTYLETR

SEQ ID NO: 24502 - protein, 81 aa, Callorhinus ursinus
PQESVTFKDIAVDFTQEEWALLDTSQRKLYRDVMLENISHLVSVGYHLCKSDVISQLEQGVELWREGRGFPQGPNPDRKSG

SEQ ID NO: 24503 - protein, 81 aa, Monodelphis domestica
PQELVTFKDVAVEFTRTEWRCLTPSQKELYRDVMLENYGNLVCLGLAVSKPDVISQLERREAPWMPGGIQRSCCPDWEASC

SEQ ID NO: 24504 - protein, 81 aa, Monodelphis domestica
EAVTFQDVAVDFTRGEWRLLSPPQKELYKEVMLENARNLLSVGEIRPEMKVTPKDASLSVEDSDRQRFMSDGPNKLSWREL

SEQ ID NO: 24505 - protein, 81 aa, Monodelphis domestica
SLESVTFQDVAVDFTHEEWGRLEPAQKDLYRDVMLENYQNFVSLGLPFSKPHMISQLERGEAPWITEKDIIPRVSCPDFFI

SEQ ID NO: 24506 - protein, 81 aa, Monodelphis domestica
PQGMVTFRDVAVIFSPGEWRLLDPPQKQLYREVMLENYRTLVWLGFVGAKPEVISHLEQGDAPWVPEDPFPSGSCTDRDTE

SEQ ID NO: 24507 - protein, 81 aa, Monodelphis domestica
AQEVVTFQDVAVDFTQEEWRLLSPPQMELYKEVILENARNLLSVGLPAPPEEVISYLEQRKAQWMLEQEGLRNCCPEGEIR

SEQ ID NO: 24508 - protein, 81 aa, Monodelphis domestica
SQGSIAFKDVAVDFTQEEWCLLDHSQKELYLEVMLENVQNLCSVGLPVPRENLISYFQQRKAPWLLEQKGPRSSCPEAETN

SEQ ID NO: 24509 - protein, 81 aa, Physeter macrocephalus
MAHQDLAVRFSKDEWRLLGQGQRALYLDVMRENYETLASLGTVELLPLSAFLSPSEPGGAMGGGSCAGDGQEPPRGGGPLG

SEQ ID NO: 24510 - protein, 81 aa, Physeter macrocephalus
MLYKRVMLENYHHLVSLGFSSSKPHLVSRLERGEGPWVADVHRMGTTTGMQAGDRMKSKPIISKQKNCPEELAGADLQGGN

SEQ ID NO: 24511 - protein, 81 aa, Aotus trivirgatus
PQGQVTFRDVAVEFSQEEWTCLDPAQRSLYRDVMLENYRNLASLGISCFDLSIISMLEQGKEPFTLESQVQIAGNPDGWEW

SEQ ID NO: 24512 - protein, 81 aa, Aotus trivirgatus
FQESVTFQDVAVDFTPEEWQLLDCAERTLYWDVMLENYKNLISVGCPVTKTKVILKAEQGQEPWMVEGVNPHQSSPESDCP

SEQ ID NO: 24513 - protein, 81 aa, Aotus trivirgatus
IQELLTFGDVAVAFTRIEWRHLDAAQRALYRDVMLENYGNLVSVGLLSSKPKLITQLEQGAEPWMEVREAPSGTRAVPDYW

SEQ ID NO: 24514 - protein, 81 aa, Aotus trivirgatus
SHDSVTFDDVAVDFTQEEWTLLDPTQRNLYSDVMLENYKNLATVGGQIIKPSLISWLEQEEESRTVQGGVLKGWELQLETQ

SEQ ID NO: 24515 - protein, 81 aa, Sarcophilus harrisii
SSRPVTFQDVAVHFTWEEWSRLDSAQRALYREVMLETFENIVSLGLPVSKPQVICLLERGETPCLPETEGPYPDSLNSGTK

SEQ ID NO: 24516 - protein, 81 aa, Sarcophilus harrisii
IQESVTFKDVAVDFTQEEWIQLDPAQRNLYRDVMLENYKNFVSLGFPIFKPDVISQLERGEGPWAPETEISQVICPDSIIQ

SEQ ID NO: 24517 - protein, 81 aa, Lipotes vexillifer
SQGLVAFEDVAVYFSLEEWERLDADQRELYQEVMQENYGILVSLGYPIPKPDLIFRLEQGEEPWVPDSPRPEEGDIVTGVY

SEQ ID NO: 24518 - protein, 81 aa, Pan paniscus
IGGDVTFNDVAIDFTHEEWGWLNSAQRGLYKDVMVQNYENLVSVGLSITKPYVITLLEDGKEPWMVEKKLSKGMIPGEWEN

SEQ ID NO: 24519 - protein, 81 aa, Tursiops truncatus
SQKSVTFQDVAVDFTEKEWPLLDSSQRKLYKDVMLENYSNLASVGCQVSKPSLISHLEQEEELRTEEQELHQGPCPDWETP

SEQ ID NO: 24520 - protein, 81 aa, Monodelphis domestica
MLENVQNLLSVGLPVTREHLISCFQQGKTPWLPEQKGPKSSSPDFEMNVMCTNLSLFVEGSGPQRCMKEVPHDFILREICD

SEQ ID NO: 24521 - protein, 81 aa, Monodelphis domestica
MFDDVAVYFTRKEWMCLDSPQRALYRDIMLENYENLVCLGFPDSKPNVIFQLERGKEPWDMELLQGPEEREYTLKGLKTDS

SEQ ID NO: 24522 - protein, 81 aa, Monodelphis domestica
AQKLVTFQDVAVDFTQEEWGLLDHSHKELYMEVMLENAQNSLFLGLLVPRESFISCFQQKEALWIRESKGPRNSCPEIKFN

SEQ ID NO: 24523 - protein, 81 aa, Monodelphis domestica
SQESVTFKDVAVNFTQEEWQQLNPAQRDLYRDVMLENYRNLISLGFPIAKPAVIFQLEQGEEPWIHELQRIEEREVSKNTY

SEQ ID NO: 24524 - protein, 81 aa, Physeter macrocephalus
SLGPVSFTDVAVDFTQEEWQQLDPEQKTTYRDVMLENYSHLVSVGCHIIKPEVITKLEKGEEPWIVGGEFLLQSYPEEDWE

SEQ ID NO: 24525 - protein, 81 aa, Aotus trivirgatus
CQESVTFEDVAVVFTDEEWSHLIPIQRDLYKEVMLENYKSVVSLGLPVPQPDMIFQLKRGDEPWMVDLHGSEEREWPESGS

SEQ ID NO: 24526 - protein, 81 aa, Aotus trivirgatus
ESVAFEDVAVYFTQNQWASLDPAQRALYREVMLENYANVASLVAFPFPKPALISHLEKGEAPWGPDPWDAEIPSSLSQGDE

SEQ ID NO: 24527 - protein, 81 aa, Papio anubis
MVEGEEEWQQLNPAQKTLHRDVMLETYSHLVSVGCSGIKPDVIFKLEHGKDPWIIESELSRWIYLDRVKGLESSQQIISGE

SEQ ID NO: 24528 - protein, 81 aa, Aotus trivirgatus
AQDRVVFEDVAIYFSQEEWGHLDEAQRLLYRDVMLENLALLSSLGCCHGAEDEEAPLEQGVSVGLSQVMAPKPCLSTQKTQ

SEQ ID NO: 24529 - protein, 81 aa, Aotus trivirgatus
VPGSVTFRDVAIDFSQEEWECLQPAQRTLYRDVMLENYSHLISLGSSISKPDVITLLEQEKEPWMVVRKETSRWYTDLESK

SEQ ID NO: 24530 - protein, 81 aa, Aotus trivirgatus
MVAGERKRQQLNPAQKTLHRDVMLETYSHLVSVGCSGIKPEVIFKVEHGKDPWIKDSELSRWIYPDREKGLKSSQRIISGE

SEQ ID NO: 24531 - protein, 81 aa, Papio anubis
GTVTFEDVAVNFSQEEWSLLSETQRCLYHDVMLENLALISSLGCWYGAKDETPSKQTLSIQQESPLRTHWTGVCTKKVHLW

SEQ ID NO: 24532 - protein, 81 aa, Lipotes vexillifer
QLTLNDVAIEFSPEEWECLDPAQRALYRDVMLETCRNLISVDISHIHVIRKLQLKSNIDRGGVFQTVILGRHEIQEIKPFY

SEQ ID NO: 24533 - protein, 81 aa, Pan paniscus
QGTVTFEDVAVHFSWEEWGLLDEAQRCLYREVMLENLALLTSLDVHHQKQHLGEKHFRSNVGRALFVKTCTFHVSGEPSTC

SEQ ID NO: 24534 - protein, 81 aa, Lipotes vexillifer
LQGSFSFEDLSVDFTQKEWQLLAPYQKDLYKDVMLENYSSLVSLGYEVMKPGVILKLEHGEEPWTGDGEIPGSDSSEQVLQ

SEQ ID NO: 24535 - protein, 81 aa, Callorhinus ursinus
MLENYGHLVSLAGFNISKPYVVSLLEQGREPWLVKGDVRRDPFSESNGEIKEFSPKNVTYEDSSSQYLVVERILNQDPEYS

SEQ ID NO: 24536 - protein, 81 aa, Tursiops truncatus
WLTFKDVVIEFSQEEWECLDPGQRALYRDVMLETYRNLISVDICPIHVVKQLQPKGNSDPGEVFQRVILGRSKSREIKHFY

SEQ ID NO: 24537 - protein, 81 aa, Tursiops truncatus
GVTFEDIAVYFSWEEWRLLDEAQIRLYLDVMLENYALISSVGCCCGAEDAEAPFEQIASLGMSQARTPKAALCSQKTHPCE

SEQ ID NO: 24538 - protein, 81 aa, Tursiops truncatus
QAQETLTFEDVAVDFTWEEWQLLAPPQKDLYRDVMLENYSNLLSVGFQASKPNVLSKLGQGEPWMMEDEIHCQTRSEIWKV

SEQ ID NO: 24539 - protein, 81 aa, Tursiops truncatus
PEVGVTFEDIALYFSWEEWKLLDEAQRHLYHDVMLENFALISSLGVWSGEENVEASFEQNVSVVMSQVRTSKEPSSSQKTH

SEQ ID NO: 24540 - protein, 81 aa, Monodelphis domestica
FQESVTFRDVAVDFTQEEWRHLEPAQRALYRDVMLENYENLVSVGIPVSRLDVTSLLERQEAVWKDGGLRDSCLDSLSNKI

SEQ ID NO: 24541 - protein, 81 aa, Monodelphis domestica
MLENVWNLHSVGLPTPPEDVISYLDLREFPWMLEQDGLRSCCPEGKIRPEMKVKPTEMSLPVEEMDLQRFMSDGPDNFSLK

SEQ ID NO: 24542 - protein, 81 aa, Monodelphis domestica
RPPSQGLITFKDVAVDFTQEEWCLLDHSQKELFLEVMLENVHNLLSVGIPVPRKYCTSCFQQGEAPWLLEQKDPRSSFSGE

SEQ ID NO: 24543 - protein, 81 aa, Physeter macrocephalus
SQESVSFEDVAVYFTQNQWASLDSAQRTLYRKVMLENYANVTSLAFPFPKPDLILQLEQGEAPGGLDPWTPIRREVRGVCT

SEQ ID NO: 24544 - protein, 81 aa, Monodelphis domestica
AQEVMTFKDVAVDFTREEWHLLSPPQKELYKEVMLENAQNLLSVGLLGPPEDAISYLEQKEAPWMLEQEGLRGCCREGEIR

SEQ ID NO: 24545 - protein, 81 aa, Monodelphis domestica
GQEAVTFQDVAVDFTREEWRLLSPPQKELYREVMLENVRNLLSVGLPASPEDVLSSLEQKEAPWMLEQEGLRSCCPEGEVR

SEQ ID NO: 24546 - protein, 81 aa, Monodelphis domestica
SQELVTFEDVAIYFTEEEWGLLDPAQRKLYRDVMLENFGNVLLLGFPVSKPDIISKLERGEIPCVPFLPRKKILVIRLGGG

SEQ ID NO: 24547 - protein, 81 aa, Monodelphis domestica
AQEAVMFKDVAVDFTREEWRLLSPPQKLLYKEVMLENARNLLSVGLQAPSDDVFSSLEQREAPWMLEQEVLRSCCPGEIKP

SEQ ID NO: 24548 - protein, 81 aa, Physeter macrocephalus
MAHLMMFRDVAVDFSAEEWECLDLEQRALYRDVMLENYSNMVSLGLCLYQPDVFSLLEKGKEPWMVLKDETRGPCPDVQSR

SEQ ID NO: 24549 - protein, 81 aa, Monodelphis domestica
GQEVVTFQDVAVDFTQGEWRLLSPPQKELYREVMLENVRNLLSVEREIRPEMKLTATEVSLSVEEMNLQRFMSDCPDNFAF

SEQ ID NO: 24550 - protein, 81 aa, Monodelphis domestica
IQGSLTFKDVTVDFTEEEWCHLDHSQKELYLEVMLENVQNLLSVGLPVPREYYTSYFQQEKAPWLLVQKGPRNSSPEAETN

SEQ ID NO: 24551 - protein, 81 aa, Monodelphis domestica
TKESVTFKDVSVDFTREEWGQLDPTQKNLYRDVMLENYRNLVSLGLQVFKPDVITRLERAEAPWTLENKGFRPTCLDWEMK

SEQ ID NO: 24552 - protein, 81 aa, Monodelphis domestica
PQDLVTFWDVAVDFTQQEWRRLGPAQKELYREVMLENYRNLVSLGFVGAKPEVISHLEQGEVPWMPEGSFPRSSSHEDLNT

SEQ ID NO: 24553 - protein, 81 aa, Physeter macrocephalus
PLTFKDVAMVFTEEELGLLDSAQRKLYRDEMLENFRNVVSVGDKDAKDMEYIQEKELRLLLHRELSYCKIWEQVAGELTRN

SEQ ID NO: 24554 - protein, 81 aa, Physeter macrocephalus
WLQGPVSFKDVAVEFTQEEWMMLDSAQRSMYRDVMLENYINLTLVEYQLRKPVISLSGQEDIRTVKRRIPQGTCPDWEIQL

SEQ ID NO: 24555 - protein, 81 aa, Papio anubis
QGLLTFRDVAIEFSQEEWKCLDPAQRTLYRDVMLENYRNLVSLDISSKCTMKEFSSTAQGNTEVIHRETMQRHERHHIGDF

SEQ ID NO: 24556 - protein, 81 aa, Papio anubis
SQGLVTFEDVAVYFSLEEWERLEADQRGLYQEVMQENYGILVSLGYPIPKPDLIFRLEQGEEPWVPDSPRREEGDIVTGVY

SEQ ID NO: 24557 - protein, 81 aa, Papio anubis
MGPLQFRDVAIEFSLEEWHCLDTAQRNLYRNVMLENYKNLVFLGIPVSKPDLITCLEQGKKSWTMKRHEMVAKSPVSFLQL

SEQ ID NO: 24558 - protein, 81 aa, Aotus trivirgatus
FEEAVTFKDVAVVFSSEELRLLDLTQRKLYRDVMVENFKNLVAVGHLPFQPDMVSQLEAEEKLWIMEAETQRSRYSGENPA

SEQ ID NO: 24559 - protein, 81 aa, Aotus trivirgatus
RPGAVSFADVAVYFSPEEWGCMRPAQRALYRDVMRETCGHLGALGFSGPKSAFISWVEGEVEAWSPEVQDPEGESPGTVSR

SEQ ID NO: 24560 - protein, 81 aa, Pan paniscus
GHLTFKDVAIEFSQEEWKCLEPMQKALYKDVMLENYRNLVFLGISPKYVIKELPPTENSNTGERFQTVPLERHQSYDIENL

SEQ ID NO: 24561 - protein, 81 aa, Pan paniscus
RGTVTFEDVAVKFTQEEWNLLSEAQRCLYRDVTLENLALISSLGCWCGSKDEEAPCKQSISVQRESQSRTPRAGVSPKKAH

SEQ ID NO: 24562 - protein, 81 aa, Tursiops truncatus
MEFTWEEWQLLDSAQKHLYRDVTLENYSNLVSVGYHGTKPDLVFKLEQGEEPWIINAEVSRQSCPEGWKEWYQKNQDELES

SEQ ID NO: 24563 - protein, 81 aa, Tursiops truncatus
QGHVIFEDVAVSFSQEEWGLLNNAQRLLYCDVMLENLSLIASLGCWHGVEAEEAVSEQCVSVEQVTENRNPKLEPSILKPL

SEQ ID NO: 24564 - protein, 81 aa, Monodelphis domestica
VSFADVAVYFSPEEWGRLRPEQRALYRDVMRETYGHLGALGEERVHEAEGPSSGGEGAVRMLGTEEEPVIKRLEDVGQPPI

SEQ ID NO: 24565 - protein, 81 aa, Monodelphis domestica
MLENVQNLQTVGLPVPREIFLSCFQQGEAPWLLEQKGPRSSCPKAETTFDVEMSTKLSLFVEGCGPQRCMNEGPCDFISRE

SEQ ID NO: 24566 - protein, 81 aa, Monodelphis domestica
QQGAVTFRDVAVDFSPDEWRRLGPAQKELYREVMLENYRSLAWLGLEVCKPHVIQRLECGEAPWTPQGGVPGSCAPDCKTR

SEQ ID NO: 24567 - protein, 81 aa, Monodelphis domestica
KVPVTFVDIAVYFSEDEWKNLDEWQKELYNNLVKENYKTLMSLGAENTVPKPDAQSRVEPREEPCVWEQHNPEEREIPMDP

SEQ ID NO: 24568 - protein, 81 aa, Monodelphis domestica
SQGSVTFQDVTMDFTQEEWRLLDHSQKELYREVMLENVQNLLSVGLPVPRENFISCFQQGKAPWLLEQKGPRSFCPEAETT

SEQ ID NO: 24569 - protein, 81 aa, Physeter macrocephalus
PQGCAISEDVFVYFSREEWVLLDENQRLLYRDVMLENFALLASLGITSSRSHLVMQLEQGEEPWMPAQVDMTPATEKEAQK

SEQ ID NO: 24570 - protein, 81 aa, Monodelphis domestica
VVTFQDVAVDFTWEEWRLLSPPQKELYKEVMLENVRNLLSVGKEPLPAASVCHPSVSHFVEEMDLQRFMSDGPNNMTPKEF

SEQ ID NO: 24571 - protein, 81 aa, Monodelphis domestica
LVTFKDVAVDFTKEEWCLLSPPQKELYKEVMLENAQNLLSVEGEIRSEIKANPTDISFPLEEVELQRFMRGGPGNFASREF

SEQ ID NO: 24572 - protein, 81 aa, Monodelphis domestica
SQEVVTFQDVAVNFTREEWRLLSPPQKELYREVMLENARNLLSVGLPASIEDVISNVEQREALWMLEREGLRSCCPEEDIR

SEQ ID NO: 24573 - protein, 81 aa, Monodelphis domestica
GPGSVTFRDVAVDFTWEEWRRLGPAQKELYREVMLETYRTLVCLGLAVPKPGVSAQLDGGERRASARGRPGTHVVHGFLNP

SEQ ID NO: 24574 - protein, 81 aa, Monodelphis domestica
QGSITFKDVAVDFTQEEWRLLDHSQEELYREVMLENVQNLLFVEAETNFEVKEMTTKLSLFLEGSGPSRGMNKGPCDFILR

SEQ ID NO: 24575 - protein, 81 aa, Monodelphis domestica
STFHLTFKDVAVEFTWEEWIYLNSSQRKLYRDVMLENYRNLVFLGFTVSKPDVICRLERKKASWMPEADVPRSSSASEYLK

SEQ ID NO: 24576 - protein, 81 aa, Papio anubis
PQGLLTFRDVAIEFSQEEWKCLDSAQRTLYRDVMVENYRNLVSLDISSKCMMEFLSTAQSNREVIHTGTLERHESHHIGDF

SEQ ID NO: 24577 - protein, 81 aa, Papio anubis
EDVAVDFTLEEWALLDSAQRNLYRDVISVSRFEMWERTKTQFKANGSVSQQDTYRKEKSKEQTIPNFTRNNSCAYTLEKTC

SEQ ID NO: 24578 - protein, 81 aa, Aotus trivirgatus
FQKPVTFEDVAVNFTQEEWDCLDASQRVLYQDVMLETFKNLASVARMFVHKPELITKLEQQEKQWRVTRVLQASRGGPPFF

SEQ ID NO: 24579 - protein, 81 aa, Aotus trivirgatus
AHRSVMFSDISIDFSPEEWEYLDLEQKDLYRDVMLENYSNLVSLGCFISKPDVISLLEQGKEPWKVVRKRRRQYPDLETKY

SEQ ID NO: 24580 - protein, 81 aa, Aotus trivirgatus
LQGLVTFEDVAVEFTQEEWALLDPAQRTLYRNVMLENFWNLSSSLGNQVDKPSLISQLEQEDKLMTEERGIVPGPRPDVET

SEQ ID NO: 24581 - protein, 81 aa, Aotus trivirgatus
MEPLTFKDVAIEFSLEEWQCLDAAQRDLYRNVLLENYRNLVFLGIAVSKPYLITCLEQKKEPWNMKRHEMVAKPPVMCFHF

SEQ ID NO: 24582 - protein, 81 aa, Lipotes vexillifer
WKEMVTFKDVAIYFTQKEWECLHSAQKDLYRDVMLENYNTLISLGFCDSKPDVISLLEQGKEPWMVNSKETKEWCPDWESR

SEQ ID NO: 24583 - protein, 81 aa, Lipotes vexillifer
LQESVTFRDIAVLFSRNEWLHLDSAQRTLYREVMLENYSTLVSLGIPFSMPKLICQLQHGEDPCMVEREIPQGTCLGFKTW

SEQ ID NO: 24584 - protein, 81 aa, Callorhinus ursinus
MLENYRHMASLGFLVAKPALISLLEQGEEPGALILQGTEEQGSTASLCPDSRMQAAIKESCLRRVSSKQLGPLGTVWGHLP

SEQ ID NO: 24585 - protein, 81 aa, Callorhinus ursinus
AQGSVVFTDVSVDFSQEEWECLDPGQRDLYRDVMLENYSNLLSMGLYIPKPQVISLLEQGKEPWMVGRELTRGLCSDLESM

SEQ ID NO: 24586 - protein, 81 aa, Tursiops truncatus
MKFTWEEWQLLDTDQKDLYRDVMLENYSNLLSIGYRASKPDALSRLERGEQLWPVEDDSHGRICPEIRKVDDALQHHLPNH

SEQ ID NO: 24587 - protein, 81 aa, Monodelphis domestica
MTFQDVAVDFTREEWCLLSPPQKELYKEVMLENARNLLSVGLPVPTEDVLSYLEQSEAPWMLEQEDLRSCHPEGEIRPEMK

SEQ ID NO: 24588 - protein, 81 aa, Monodelphis domestica
QESVAFKDVVMDFTPEEWKQLELPQKDLYKDLMLEKYRNLVLLGLPVSKPDVNSELEQGEGEESWIPRKEVPGSTCSDWET

SEQ ID NO: 24589 - protein, 81 aa, Physeter macrocephalus
MLQNYSNLLSVGYRVSKPDALSKLERGEEPWTIEDEIHSQTCPETGNVGNHLQGEWENERMLKGIEQYQEHNAFGNPVPQS

SEQ ID NO: 24590 - protein, 81 aa, Physeter macrocephalus
MGFTQEEWQHLDPAQRTLDRDVMLKNYSHLISVGYCVTKPEVIFKLEQEEPWMLEEESQSQSHPASPSVILRTNCVNKTVL

SEQ ID NO: 24591 - protein, 81 aa, Physeter macrocephalus
KVPVTFVDIAVYFSEDEWRNLDEWQKELYNNLVKENYKSLASLDSEGPVSKPDAPPQAEPREEPCVWEQRDPEEREILMDP

SEQ ID NO: 24592 - protein, 81 aa, Monodelphis domestica
FQGSITFKDVVVNFTKEELCLQDCSQKKLCKEVMLENVQNLLSVGLIVPRRNLITCLQQGESPWLPENEGSVFSLGPRPSE

SEQ ID NO: 24593 - protein, 81 aa, Physeter macrocephalus
QDPVAFEDVAVNFTLEEWALLGPSQKKLYRDVMRETLRNLASIGGKWEDHNTEDQYKNQGRNLRSHTLQRRCESEEGSQCG

SEQ ID NO: 24594 - protein, 81 aa, Monodelphis domestica
SQGSITFMDVAVDFTQEEWCLLDHSQKELYLEVMLENVKNLLSVGLPVPTETFISCFQQRKAPCLVEQKVPRNFFPDFEVK

SEQ ID NO: 24595 - protein, 81 aa, Papio anubis
FRDVAIEFSQEEWKCLDPAQRTLYRDVMVENYRNLVSLDISSKCKMKEFLSTAQSNREVFHTGTLQRHESQQIGDYCFQDV

SEQ ID NO: 24596 - protein, 81 aa, Aotus trivirgatus
PQESVAFEDVAVYFTKKEWATMMPEQRASYCVMLENYEAVAFVAVPSTSKLALVSHLEQGKEPCFTQPQGVLSRRGWRAGF

SEQ ID NO: 24597 - protein, 81 aa, Aotus trivirgatus
PVTFRDVTVIFTEAEWKRLSPEQRNLYKEVMLESYRNLLSLAELKPEIYPCFSCLLAFSCQQFLSQHVLQIFLGLCAENHF

SEQ ID NO: 24598 - protein, 81 aa, Lipotes vexillifer
SWDSVTFADVAVDFTQEEWTLLDPIQRKLYRDVMLENYKNLTTAGYQSLKPTVISWLEQEDDLRTVERRGVLQEGTWESSV

SEQ ID NO: 24599 - protein, 81 aa, Lipotes vexillifer
KFQVMSFKDVAVVFTEGELGLLDSAQRKLYRDVMLENFRNLLSVGNQPFKPELIFQLEREEELLMMETETQREGCSGTKSQ

SEQ ID NO: 24600 - protein, 81 aa, Pan paniscus
FQELLTFRDVTIEFSLEEWEFLNPAQQSLYRKVMLENYRNLVSLGLTVSKPELISCLEQREEPWNVKRHETIAKPPAMSSH

SEQ ID NO: 24601 - protein, 81 aa, Lipotes vexillifer
QGHVIFEDVAVSFSQEEWGLLNDAQRLLYCDVMLENLSLIASLGCWHGVEAEEAISEQCVSVEQVKEDRNPKLEPSILKPL

SEQ ID NO: 24602 - protein, 81 aa, Lipotes vexillifer
MLENYSHLVSVGYDSTKPNVILKLEQGEEPWVADGEFPRQFHPEEVWKVDDLMERAQENKDECSRQAVSINSRTLTKEREV

SEQ ID NO: 24603 - protein, 81 aa, Lipotes vexillifer
GSVTFEDVAVYFSCEEWCLLDEVQIHLYLDVMLENFALVCMLGSWRGVDEETPSEENICVEGVSQIRTPRAGSSEKAQPCK

SEQ ID NO: 24604 - protein, 81 aa, Pan paniscus
QGRLTFRDVAIEFSLAEWKFLNPSQRALYREVMLENYRNLEAVDISSKRMMKEVLSTGQGNAEVIHTGMLQRHESYHTGDF

SEQ ID NO: 24605 - protein, 81 aa, Callorhinus ursinus
RDWGTFEDVAVYFSREEWELLDETQRHLHHDVMLENLALVASLGCWCGVEEAPLEQSVSVEGALHFRTPKACPSTQKANTC

SEQ ID NO: 24606 - protein, 81 aa, Callorhinus ursinus
SPGAVSFADVAVYFSPEEWGCLRPAQRALYRDVMRETYGLLGALGFSGPKPAFISWVEGEVEAWSPEAQDPEGETRAAVIR

SEQ ID NO: 24607 - protein, 81 aa, Callorhinus ursinus
MDSVVFEDVVVDFTQEEWALLNPAQRKLYKDVMLETFRNLVSVDDETQLKTNESISQQDIFGEKLSTEQKIARFTKNDFWT

SEQ ID NO: 24608 - protein, 81 aa, Monodelphis domestica
RPPSQGSITFKDVAVDFTQEEWCLLDPSQKELFRKVMLENVQNLLFVGLPTTRAYLISGSQGEESPWLLVKKDPKISCPGG

SEQ ID NO: 24609 - protein, 81 aa, Monodelphis domestica
SQGPITFKDVAVDFTQDEWGLLEPAQKGLYRDVMLENYRNLVSLGLVLVKPKVISRLERWGEPWRPDGGGRSSGASEMKTA

SEQ ID NO: 24610 - protein, 81 aa, Physeter macrocephalus
SQGLVSFKDVSVNFTQAEGQWLDSAQKILYRDVMLENYSNLVSVGCLISKTDVTSQLEQGEEPWIIEVEFSSQSLPGMESS

SEQ ID NO: 24611 - protein, 81 aa, Monodelphis domestica
EVVTFRDVAVDFTREEWRLLSPPQKELYREVMLENVRNLLSVGETRSEMKVNPREVSLLLEEMDLQRFKSDGLDKFAAVQF

SEQ ID NO: 24612 - protein, 81 aa, Monodelphis domestica
QETLTFKDVAVEFTWEEWRHLDPAQRALHRNVMLENYENLISIEGKIRLEMKEMTAELSLSGDETQRQRCIGDGACDSTWR

SEQ ID NO: 24613 - protein, 81 aa, Physeter macrocephalus
VQELLTLEDVAVEFNWEEWQLLDAAQKDLYRDVMLENFNNLVSLGYQATNPDTLSKLEHGKEPCIIENEIQNRTCPGIGKV

SEQ ID NO: 24614 - protein, 81 aa, Physeter macrocephalus
GVMESVTLEDVAVGLIQEWALLDDAQRNLCRYVLLDNCRTLAPWGTPPCKACLVSQVGPREELVTAERGILCATGVDWESQ

SEQ ID NO: 24615 - protein, 81 aa, Monodelphis domestica
MLENARNLLSVGLAVPRDVISYVEQREAPWRLEQEGLRSCSPGEIRPDMKVTSIDVNLSVDESDQQRLMSGGLAKLPLREF

SEQ ID NO: 24616 - protein, 81 aa, Monodelphis domestica
SQGSIAFKDVAVDFTQEEWCLLSYSQKELYLEVMLENVQNLLSLGLPVPRENFIFCFLQRESPWLLDQKSPRSFCPETDTN

SEQ ID NO: 24617 - protein, 81 aa, Monodelphis domestica
SITFKDVVVDFTQEEWCLLDPSQKELYREVMLENVQNLFFVEAETNFEVKEISTKQSLFVEGSDPPRGMSKSPCDFILRKI

SEQ ID NO: 24618 - protein, 81 aa, Monodelphis domestica
AQEVVTFKDVAVDFTEEEWHLLSPPQKELYKEVMLENAQNLLSVGLPGCPEDVISYLEQKEAPWMLKQEGLRSCCPEGEIR

SEQ ID NO: 24619 - protein, 81 aa, Papio anubis
KVTFEDVAIDFTQEEWAMTDTSKRKLYREAMLENVCHLVSLGEVQISKSYITLQLEQGKELWREGREFLQGQNLDKESALK

SEQ ID NO: 24620 - protein, 81 aa, Aotus trivirgatus
MGPLEFMDVAIEFSLEEWHCLDTAQRNLYRDVMLENYRNLVFLGIVVSKPDLITCLQQGKKPLTVKRHEMIATPPVTYSHF

SEQ ID NO: 24621 - protein, 81 aa, Aotus trivirgatus
KQYDSVAFEDVAVNFTQEEWALLGPSQKSLYRDVMWETIRNLDYIGMKWEDTNTEDQHKNPRRSLRCHIVERFHKSSQISD

SEQ ID NO: 24622 - protein, 81 aa, Aotus trivirgatus
IKGSLTFRDVAIEFSLEEWQCLDTAQQDLYRQVMLENYTNLAFLGIAVSKADLIACLQQEKDPWNMKRHSMVAKPPVLCSH

SEQ ID NO: 24623 - protein, 81 aa, Aotus trivirgatus
MAPLTFRDVTVEFSLEEWQCLDAVQRKLYRDVMLENYRNLAFLGIAVSKPDLITCLEQEKEPWNMKRHEMVAKSSVMCSHF

SEQ ID NO: 24624 - protein, 81 aa, Aotus trivirgatus
SQELLTFKDISIDFTQEEWGQLTPAHQSLYREVMLENYSNLVSVGYQLSKPSVISQLEKGEEPWMTEKEGPGDPSSDLKSN

SEQ ID NO: 24625 - protein, 81 aa, Pan paniscus
EMGLLTFRDIAIEFSLAEWQCLDRAQQNLYRDVMLENYRNLFSLGMTVSKPDLIACLEQNKEPQNIKRNEMAAKHPVTCSH

SEQ ID NO: 24626 - protein, 81 aa, Pan paniscus
AQESVTFEDVAVNFTNREWQCLTYAQRHLYKDVMLENYGNMVSLVLILYHQDLAQKLRVLSLSADKMWPENEKASSQQEIF

SEQ ID NO: 24627 - protein, 81 aa, Lipotes vexillifer
MLETFGLLASVGHWLPKPDVISLLEHEAELWVVDKGAPRGVCTELGLRDISIFLFLLDFETRQTKLSTVKQDITEEIPNNA

SEQ ID NO: 24628 - protein, 81 aa, Callorhinus ursinus
MDPSQRNLHKDVMLENYRNLVSLGLAVSKPDMISHLEDGKGPCVVEREIARTPYPELETKPATKNVSIEDISEDVSQETII

SEQ ID NO: 24629 - protein, 81 aa, Monodelphis domestica
SQGSITFKDVAVDFTQEEWCLLDHSQKELYQEVMLENVHNVLSVGLPVPRENLIFCFQQGLAPWLLEQKGPRISCPDAERC

SEQ ID NO: 24630 - protein, 81 aa, Monodelphis domestica
SQGLITFKDVAVDFTQEEWCLLGYSQKELYLEVMLENVQNLLSLGLPVPRENFIFCFLQRESPWLLDQKSPRSSCPDAETN

SEQ ID NO: 24631 - protein, 81 aa, Monodelphis domestica
SQGLITFKDVAVDFTQEEWCLLDHSQKELYLEVMLENVQNVLSVGLPVPRENLIYCFQQGKTPWLLEQKGPRMSCPELHSL

SEQ ID NO: 24632 - protein, 81 aa, Monodelphis domestica
PQESMTFKDVAVEFTWEEWGHLNPSQKKLYRHVMLENYRNLVSLGFAVSKPDVIYHLERKEAFWRPEADISRNNCPESKEF

SEQ ID NO: 24633 - protein, 81 aa, Physeter macrocephalus
LQETVTFKDVAIDFTEEEWQQLDPAQRNLYRNVMLENYNNLITVGCPFTKPDVIFKLEQEEEPWVVEEEVSKRHCPGEIWG

SEQ ID NO: 24634 - protein, 81 aa, Monodelphis domestica
SQKLLTFQDVAVDFTREEWGLLEPAQKDLFRDVMLESYENFVSLGLPDSKEDVISQLEKTEAPGPPEGEVPGDTYTDFLHE

SEQ ID NO: 24635 - protein, 81 aa, Monodelphis domestica
SEELITFKDVVVDFTKEEWCLLDSSQKELCKEVMLENVQNLLSVGHTLPRENFITCLQQGESPWLPENEGSLHPYVLPLNT

SEQ ID NO: 24636 - protein, 81 aa, Physeter macrocephalus
SQPPVSFKDVAVTFTWEEWGQLDLAQRMLYREVTLETCSHLVSLGLLLSKPDVIARLEQGEDPWRVEQGPPRDWKTTLEKK

SEQ ID NO: 24637 - protein, 81 aa, Monodelphis domestica
SQGSITLKDVTVDFTQEEWHLLDHSQKELYLEVMLENVQNLLAVGLPVPRENFISCFQQGEAPWLLKQECARSSCPEADTN

SEQ ID NO: 24638 - protein, 81 aa, Monodelphis domestica
MTFKDVAVDFTREEWCLLSPPQKELYREVMLENAWNLLFVGLPAPPEDVISSLEQREVPLMLVQEDLRSCCPEEEIRPEMK

SEQ ID NO: 24639 - protein, 81 aa, Monodelphis domestica
YQESMTFKDVAVEFSWEEWGHLNPSQKKLYRHVMLENYRNLVSLGFAVSKPDVIYRLERKEAFWRPEADILRNCPENKEFN

SEQ ID NO: 24640 - protein, 81 aa, Monodelphis domestica
IQAPVTLRDVAVEFTWEEWRHMEPAQRDLYRDVMLDNYENLVFIGIPVSKPDLLFLLKRDVQNQEGKVRSGIYSDPVFEEN

SEQ ID NO: 24641 - protein, 81 aa, Physeter macrocephalus
MTFEDIAVYFSWEEWRLLDEVQRHLYHDVMLENFTLISSLGCCCGAEDAEAPFQRSISISMSQARTPRASSFSQKSHPCKK

SEQ ID NO: 24642 - protein, 81 aa, Physeter macrocephalus
MAAMLLMARRKTEWKLLDLRQRMLYKRVMLENYHHLVSLGFSSSKPHLVSRLERGEGPWVADVHRMGTTTGMQAGDRMKSK

SEQ ID NO: 24643 - protein, 81 aa, Papio anubis
EPVTFKDVAVVFSEEELRLLNLAQRKLYRDVMLENFRNVVSVGEDRHSLTEHCLPLVSLCKNLKEMETLQEVGLRYLSHEE

SEQ ID NO: 24644 - protein, 81 aa, Aotus trivirgatus
YEVSVSFEDVTVDFSREEWQHLDSTQRRLYQDVMLENYSHLLSVGFEVPKPEVIFKLEQGEGPWTLEGETPHHSCSDGKFG

SEQ ID NO: 24645 - protein, 81 aa, Aotus trivirgatus
RRGSVTFKDVTMAFTQKEWEQLDPAQRNLYKDVMLENYSNLASMGCQAPKPDLISKLEKGEAPCLGKGKRLSQGCPSKIAR

SEQ ID NO: 24646 - protein, 81 aa, Aotus trivirgatus
EMGLLTFRDVAIEFSRKEWQCLDTAQQNLYRNVMLENYRNLVFLGIAASKPDLITCLEQGKEPWNVKRHEMVAESPVACSY

SEQ ID NO: 24647 - protein, 81 aa, Aotus trivirgatus
EDVSVNFSQEEWALLAPSQKKLYRDVMQETFKNLASIGKDDIIFSFFFFFEMESFFMRRSSLTRHMRSHTGYELIEKPYKC

SEQ ID NO: 24648 - protein, 81 aa, Aotus trivirgatus
VQESVTFRDVAVFFSPDEWLHLDSAQRALYREVMLENYSSLVSLGILLSKPKVISHLEQGEDPWMVESGVPQGTHLGWESL

SEQ ID NO: 24649 - protein, 81 aa, Aotus trivirgatus
EDVAVNFTQEEWALLDSSQKNLYREVMQETCRNLTDVGNKWKDQNIEDYFKKPGKDIRNHMEQRLCESKEGNQYGEVVSQI

SEQ ID NO: 24650 - protein, 81 aa, Aotus trivirgatus
MGQLTFNDVIIEFSLEEWQRLDKTQRNLYRDVMLENYRNLVFLGIAVSKPDLIACLKQGKEPWNMRRHEMVTKPPAMCSHF

SEQ ID NO: 24651 - protein, 81 aa, Papio anubis
MNMFKEAVTFNDVAVAFTEEELGLKLYRDVMVENFRNLLSVGHQPFKQDVSPIERNEQLWIVTTATQRQRNLALLLYDLAQ

SEQ ID NO: 24652 - protein, 81 aa, Lipotes vexillifer
TQASVSFKDVTVEFTQEEWWQMDSAQRTLYRDVMLENYSHLVSVGHCFTKPELIFMLEQGEDPWLLEKEFVNRSSPEESQP

SEQ ID NO: 24653 - protein, 81 aa, Pteropus vampyrus
HQEVVTFKDVAVYFTQAEWDGLSSAQKALYRSVMLENCGNLTSLGYPVPKPALISLLEGGDLPWGLEAQGDPSAERTTDFC

SEQ ID NO: 24654 - protein, 81 aa, Pteropus vampyrus
MGPAHRTLYRDVMLENCSHFVSMGYCITKPQVIFKLEQGEEPWSLEEEFPNQRFPGYYKVDVHIEGNQEKQEKPLWQVVIF

SEQ ID NO: 24655 - protein, 81 aa, Pteropus vampyrus
QAQEPLTLEDVAVDFTWEEWQLLDPDQKDLYRDVMSENYSNLVSVGYQVSKPDALSRLEQGEPWAVEDEVHSRICPEIQKD

SEQ ID NO: 24656 - protein, 81 aa, Pteropus vampyrus
LQETVTFKDVAVVFTEEELGLLDAAQRKLYRDVTLENFRNLVSVGSQPLKPDLIFQLEREEKLSRVETETQRDGCSGTKNQ

SEQ ID NO: 24657 - protein, 81 aa, Trichechus manatus
MDSVLFEDVAMNFTQEEWALLDFSQRKLYKDVMMETFRNLDSVFQQDKQKTKPTAIESILTEFEKDNNSQKLSMKNDSWSS

SEQ ID NO: 24658 - protein, 81 aa, Trichechus manatus
MDVMLENYCHLVSVGCHMTKPDVILKLERGEEPWTSFAGRAYLEENWKAEDFLMKSKEHQDTYSRSVVFINHKKVIKEKSN

SEQ ID NO: 24659 - protein, 81 aa, Trichechus manatus
SVTIEDVAVVFSQEEWALLDLTQRKLFRDVMMETFRNLASVVSRNLDNGEKLSSEHIMVQFMKNKTWSSMLGDISKLHGNK

SEQ ID NO: 24660 - protein, 81 aa, Zalophus californianus
AQESLTFDDVAVDFTWEEWQLLAPAQKDLYRDVMLENYRNLVSVGFHTSKQDVLSKLDQGEPTWTVEDDIPCQSHSETWKL

SEQ ID NO: 24661 - protein, 81 aa, Zalophus californianus
SVLSQKEQKKNKSQGSISFEDVTVNFTQEEWGQLDPDQRTLYRDVMLENYSIFISLGHCITKPEEILKLEQEGTMGVRERI

SEQ ID NO: 24662 - protein, 81 aa, Zalophus californianus
ESAFVSFHDVAVDFTREEWRLLSHAQRMLYRCVMLENYSNLVSLGTPFPKPTLVILLEQGEEPWKEESEHLLSPCSADAKP

SEQ ID NO: 24663 - protein, 81 aa, Zalophus californianus
WQKSLKFKDVAVKFSKDEWKQLVPTQRDLYREVMLENYQGFVSLGLLVPKPDVIFQLKRGEEPWKLDFQEGEESDVPGSTF

SEQ ID NO: 24664 - protein, 81 aa, Zalophus californianus
MGMAGPVSEGFIQRCHVGELQELGLSISKPNMISLLEQGKEPWMVEKEMSDGQCADWDSWYEIKELSPKWYIDEEEISQGM

SEQ ID NO: 24665 - protein, 81 aa, Zalophus californianus
MQRALYLEVMLENYANITSLAALPFPKPDLILQLEQGGAPWGLDPWTPLEGEALGGVHIGGKNKIEREEQSPRLNISKDSA

SEQ ID NO: 24666 - protein, 81 aa, Zalophus californianus
AREPVTYEDVAVDFTQEEWQHLDPAQKTLHRDVMLEIYSHLVSVGCSGIKPGVIFKLEHEEDPWIIKTELSRWIHSDREKS

SEQ ID NO: 24667 - protein, 81 aa, Zalophus californianus
PKVSRSLENDGVCFSEQEWENLEDWQKELYRNVMKSNYETLVSLTEGVMIKQEIQYAQEGSADLPGEFSGIAEEQAFLSPE

SEQ ID NO: 24668 - protein, 81 aa, Equus caballus
FEGSVSFEDVAVDFTRQEWHRLDPAQRIMHKDVMLENYSNLASVGLCVAKPEMIFKLERGEELWILEEDSSGHGYPGSLSL

SEQ ID NO: 24669 - protein, 81 aa, Equus caballus
MEGLVMFRDVAVDFSQEEWACLDPAQRGLYRDVMLENYHHLVSLGLSLSKPDVISLLEQGKEPWMVSRNMAGGWCPDRLKN

SEQ ID NO: 24670 - protein, 81 aa, Equus caballus
RDSVIFHDVAVYFSWGDWRLLDEAQRRLYLDVMLENFVLISSLGKTWNSLTTPSSQKTHPCQMCGPVLRDIFHLAEQQGTQ

SEQ ID NO: 24671 - protein, 81 aa, Capra hircus
LPLDLFRDVAVVFSQEEWERLAPTQRDLYRDVMLETYSNLVSLGLAISKPDVISFLEQGKEPWTVEEVATGGLCPVLKSRH

SEQ ID NO: 24672 - protein, 81 aa, Chlorocebus sabaeus
CEASLSFEDVTVDFSREEWQQLDPAQRRLYQDVTLELYSHLFSVGYHIPNPDVIFRMLKEKEPCVEEAELSHQRYQEEEFG

SEQ ID NO: 24673 - protein, 81 aa, Lipotes vexillifer
SLDSVSFMDIAIDFSQDEWEWLNLAQRTLYKKVMLENYRNLASLGLCISKPDVISLLEQDKEPWMMKGEITRGLPPDLEYV

SEQ ID NO: 24674 - protein, 81 aa, Lipotes vexillifer
VQESVTFKDVAVLFTQDEWAQLSPAQRALYRDVMLENYSNLVSLGLLGPKPDTFSQLGKGEESMPEDSLGGFCLDWMTTPV

SEQ ID NO: 24675 - protein, 81 aa, Callorhinus ursinus
SYEGSVSFRDVAVDFSREEWQHLDLAQRNLYRDVMLETYSHLLSVGYEVPQPEVFMLEQGKEPWALQGESPHQSCPVTPKH

SEQ ID NO: 24676 - protein, 81 aa, Tursiops truncatus
TSTSVGSQDVAVDFTEKEWPLLDSSQRKLYKDVMLENYSNLASVGCQVSKPSLISHLEQEEELRTEEQELHQGPCPDWETP

SEQ ID NO: 24677 - protein, 81 aa, Tursiops truncatus
MDSVVFEDVAVNFTAEEWALLDLAQRKLYRDVMLETFRNLASVGSCSPVKTSRSSAHWDILETGLCSEEKVVRFTRNDSRS

SEQ ID NO: 24678 - protein, 81 aa, Tursiops truncatus
ELVTFRDVVISFSQEEWEYLDSAQRDLYWDVMMENYSNLVSLDLESKCDKKTLSTEKDIIEKNDSQWEVIESSKLVGLENS

SEQ ID NO: 24679 - protein, 81 aa, Tursiops truncatus
FRGSVMFRDVSINFSQEEWECLDSGQMNLYKEVMLENFSNLVSVGLSSSKPTVISLLEQGKEPWMVDRELTRGLCSDLESM

SEQ ID NO: 24680 - protein, 81 aa, Tursiops truncatus
KDQGSLTLEDVAVDFTWEEWQLLAPAQKDLYRDVMLENYSNLLSVGYQASKPDALSRLERGEPWPVEDEIHSRICPEMRKD

SEQ ID NO: 24681 - protein, 81 aa, Tursiops truncatus
KGCVTFEDVASYFSQEEWGLLDEAQRRLYHKVMLENFLLTASMVCLHGTEKKETHSGQNISLEVLSQVRTPKVGLISQKAH

SEQ ID NO: 24682 - protein, 81 aa, Equus caballus
KSQGSLSFKDVAVVFTWEEWQLLDPIQKNLYQDVMLENYSNLVSVGYQVTKADAVYQLEQGTPWRIEEEIQSQTHPDNTWK

SEQ ID NO: 24683 - protein, 81 aa, Equus caballus
KGRVVFEDVAIYFSQEEWDLLDEAQRRLYCHVMLENFALLSSIGEDEEAPSEQGVSVGVSQVRTPKPGPSIQNAHSCEMCG

SEQ ID NO: 24684 - protein, 81 aa, Equus caballus
SQEQVSFKDVCVDFTQEEWYLLDPAQKILYRDVILENYSHLLSVGYCITKPEVIFKIEQGEEPWILEEGFPGHSHPEDWKV

SEQ ID NO: 24685 - protein, 81 aa, Equus caballus
AQGLMAFEDVAVYFSREEWELLDAAQRALYRHVMLENFSLVASLGLSASRPRVVIQLECGEEPWVLSGMDVTPVRNVQRRP

SEQ ID NO: 24686 - protein, 81 aa, Capra hircus
QSPMAAALRDPAQGSVTFPDVAVYFSWEEWRLLDEAQRRLYLDVMLENYALISSLGSVTFEDVAVNFSWEEWGLLDESHKR

SEQ ID NO: 24687 - protein, 81 aa, Chrysochloris asiatica
LQDSVTFQDVAVDFTEKEWPLLDSSQRKLYKDVMLENYSNLTSVGYQLGKPSLISHLEQEEELRTEEKEAHQAFSQGWEIP

SEQ ID NO: 24688 - protein, 81 aa, Chrysochloris asiatica
LQESLSFEDLSVDFTQKEWQLLDSRQRDLYKDVMLENYSSLVSLGYEVMKPDVIFKLEQGEEPWIVDGEVASSNSPEVWQV

SEQ ID NO: 24689 - protein, 81 aa, Chrysochloris asiatica
GLSSKDTGWPQEKKRKPQIPAPVTFEDITVVFTEAEWVTLSLEQKNLYKEVTLETYRNLLSLGEDVFFSPPSLTQSICIAT

SEQ ID NO: 24690 - protein, 81 aa, Chrysochloris asiatica
VVVEDVTMVFSQEEWTLLDLAQRKLYKDVMMETYRNLASVVSQNLDDEEKVPSDHTEPTMMQFMNDSAWSSTFGELSRSHG

SEQ ID NO: 24691 - protein, 81 aa, Chlorocebus sabaeus
MTFEDVAIYFSQEEWELLDESQRFLYCDVMLENFAHVTSLGYCHGMDNEVIASEQSVSTQVRTSKGDTPTQKSLSEIKMCV

SEQ ID NO: 24692 - protein, 81 aa, Suricata suricatta
KEARVAFRDVAVDFTREEWGLLSPAQRTLHREVMLETYSHLVSLEIPFSKPKLICQLEQGEEPWIEENPHPLGLCPGSKLE

SEQ ID NO: 24693 - protein, 81 aa, Trichechus manatus
SQGLVTFEDVAVYFSLEEWDRLDAGQRDLYKDVMQENYGILVSLGYPIPKPDLIFHLEQGEEPWVPDSPHPEEGDIVTGVY

SEQ ID NO: 24694 - protein, 81 aa, Trichechus manatus
MFFTREEWENLDSAQKYLYRDVMLENYRNLIFLGFQFPKPEVISQLEDWEEPWILDLPSAGNRKASSSACPGSEARYKMKK

SEQ ID NO: 24695 - protein, 81 aa, Trichechus manatus
LTFSDVAVKFTWEEWQLLDPAQKDLFWDVMLENYNNLVSLEIWEVDHLLGHSQNESRVDSMEQCYEHNTLENIVHRHKNHS

SEQ ID NO: 24696 - protein, 81 aa, Trichechus manatus
MLLSDRFSDPFLEAKKWYQASKQDALSMLERGEELWTIEDETHCQTHSEIGKVNDHLQCLLQKQRIQKCMEQCHKHNAFGN

SEQ ID NO: 24697 - protein, 81 aa, Trichechus manatus
SRELVSFKDVTVEFTQEEWQQLDSAQRNLYRDVMLENYSNLVSVGYQSLKSDLIFLLKQEESLMEEGEISSWVYSDFDISP

SEQ ID NO: 24698 - protein, 81 aa, Trichechus manatus
RPRAVRFADVAVYFSPEEWGCLRPMQRALYRDVMRENYGHLGALGCAGPKPALISWLERNTDDWEPAALDPQECPRGITVQ

SEQ ID NO: 24699 - protein, 81 aa, Trichechus manatus
AQVSVTFKDVAILFTRDEWRKLDPSQRSLYRDVMLENYSNLVSLGPPFSKPEVISLLQQGEEPWKVEKEGPAGSSLGWENS

SEQ ID NO: 24700 - protein, 81 aa, Trichechus manatus
AQEFVMFRDVAVFFSQEEWGHLDPAQRALYREVMLENYSNLVSLGIRFSKPKVISQLQQGEDPWMVDRGVPQGACQGWKSL

SEQ ID NO: 24701 - protein, 81 aa, Trichechus manatus
SQALVSFKDVTVEFTQEEWKHMNLAQRTLYRDVMLENYSHLVSVGYCFTKPEVIFKLEQAKDPCLSEEDFLNRSYQEDCQL

SEQ ID NO: 24702 - protein, 81 aa, Trichechus manatus
HKEAVTFEDVAVYFTRTEWAGLSPTQRALYRHVMLENYGNLTFLGYPVPEPSLISLLEGGDLPWGLETQDDPPAERTKDIC

SEQ ID NO: 24703 - protein, 81 aa, Trichechus manatus
EEEPLTFQDVAVYFSQAEGKQLGPHQRALYRDVMLENYGNMASLGFPVPKPDLISQLEQGEELWVLDLLGAEEPEVLRSCR

SEQ ID NO: 24704 - protein, 81 aa, Trichechus manatus
GMSPVTFEDVAVYFSWEEWGLLDAAQRHLYYDVMLENFELMTSLGYWHGIEDEGSSPKQSVSIEGVSQVKIPKADPSTQKA

SEQ ID NO: 24705 - protein, 81 aa, Trichechus manatus
PKVPVTFDDVAVYFSEPEWGQLDEWQKELYKHVMRGNYETLVSLDYAISKPDILTQIERGEEPCCDGQWGQEKQKEMVHPR

SEQ ID NO: 24706 - protein, 81 aa, Trichechus manatus
MLESFRNLVSAGQQPFKSGKISHLEQDKETWVTEREAPADAYPGDKNEKDMEYIQEKELKVLLHKELSYWKLWEQVTGELT

SEQ ID NO: 24707 - protein, 81 aa, Trichechus manatus
AQELLTFDDVAIKFTWEEWQLLDPAQKDLYLDVMLENYSNLVSMGYQANNPVTLSMLERGEELWTTEDEIHSQICPETCRV

SEQ ID NO: 24708 - protein, 81 aa, Trichechus manatus
PQESVTFEDVAVYFTQSQWASLGPLQRALYREVMLENYANVASLVAFPFPKPVLISQLEREEAPLGPDPWETEVLRDICPG

SEQ ID NO: 24709 - protein, 81 aa, Trichechus manatus
DSVVFEDVAMGFSQEEWALLDFSQRKLYKDVMVETFRNLDSVSQQDNNGQKLSIEHILVQFMMNDSWSSMVGEICEFHDSE

SEQ ID NO: 24710 - protein, 81 aa, Zalophus californianus
TQESVVFNDVSIDFSQEEWECLNDDQRDLYRDVMLENYSHLVSMAGHSVSKPDVISFLEQGKEPWLVDRELTRDQWPVLES

SEQ ID NO: 24711 - protein, 81 aa, Equus caballus
MLEHYSLLVSVGHPVSKPDVISKLEQGEDPWIIKRDISNWIYPDENQADGRQDRKSNLENPESCILGSVSFHNKILKGVTK

SEQ ID NO: 24712 - protein, 81 aa, Equus caballus
LPDLVTLEDVAVEFTPDEWALLDPSQRTLYRDVMLENCRNLASLGYHVDKPSLISQLEQEDKVMAEERGILPGTCPDLETV

SEQ ID NO: 24713 - protein, 81 aa, Equus caballus
SWGPFSFTDVFVDFTWEEWRLLDVAQKHLYRSVMLENYSNLVSLGHQHTKPDIILKLERGEELWMMQAQSPSQGRPGKVWE

SEQ ID NO: 24714 - protein, 81 aa, Equus caballus
MLENYSTLVSLGIPFSTPKVICQLQQGEDPCMMEREIPQDTCRGFKTWPEIEAFPPRQDAFIEETARGIMKKKAIKFGHWD

SEQ ID NO: 24715 - protein, 81 aa, Neovison vison
DVAVDFTPEEWQLLDCGQRTLYWNVMLENFRNLISVGGPGTKTKGIFKAEQGQEPWLGEGENPRLCCPEADCLLVDESEKH

SEQ ID NO: 24716 - protein, 81 aa, Loxodonta africana
VAFEDVAVYFSQEEWRLLDMAQRALYHHVMLENFALVASLGKALTSRPRVVVQLERGKEPWVPDGTDTAPSRGGLALVSGG

SEQ ID NO: 24717 - protein, 81 aa, Loxodonta africana
PPGSKGEVPKVPVTFDDVAVYFSEQEWGKLDEWQKELYKHVMRGNYETLVSLDYAISKPDILTQIERGEEPCPEDQWGQEK

SEQ ID NO: 24718 - protein, 81 aa, Capra hircus
SQVSVTFEDVAVLFTRDEWRKLAPPQRNLYQDVMLENYSNLVSLGLLFPKPKVISLLQQGEDPWKVEKENLGGEWVGILCS

SEQ ID NO: 24719 - protein, 81 aa, Capra hircus
PQGSTPFSSVTVDFTHGGWRQLAPAPRDRFEEGMPEKSRNLVLLGLPVSQPGMNSQLEQREGSWMLERDGLRNACPDWKII

SEQ ID NO: 24720 - protein, 81 aa, Capra hircus
WLQGPMSFKDVAVEFTQEEWMMLDSAQRSMYRDVMLENYINLTLVEYQLCKPVISLLGQEDIRTVKSRIPQGTCSDWEIQL

SEQ ID NO: 24721 - protein, 81 aa, Chrysochloris asiatica
SQGVVTFRDVAVDFSQEEWDWLNLSQRDLYRDVMLENYRNLVWLGLSISKPNMISLLEQGKEPWMLEREMSAGQCADWESW

SEQ ID NO: 24722 - protein, 81 aa, Suricata suricatta
GCVTFEDVFVYFSREEWELLEEAQRLLYRDVMLENFALVASLGCWREADEETPEQSVSVSISPLRTHESDLFMQKAHPCDV

SEQ ID NO: 24723 - protein, 81 aa, Suricata suricatta
SQESVTFEDVAVDFTQEEWTLLDGSQRKLFRDVMLENMSHLVSIGKQLYKSDTISHLVKGVHLSREGIGLLQYSEDDLKKQ

SEQ ID NO: 24724 - protein, 81 aa, Suricata suricatta
RSRESLTFQDVAVDFTREEWDQLYPAQKNLYRDVMLENYRNLVALGHQLYKPKVISQLEQEERRMMEGGSPGGTRAGGENR

SEQ ID NO: 24725 - protein, 81 aa, Chrysochloris asiatica
MHSVVIEDVAVVFSQEEWALLDIAQRQIYRDVMMEAFKNLASVKSYIENLCEDIEGNQYGNTFSWIPDLTVVKENAPEASR

SEQ ID NO: 24726 - protein, 81 aa, Chlorocebus sabaeus
DSLVFEEVAVNFTPEEWALLDHAQRSLYRDVMLETCRNLASLDCCIYVRTSGSSSQRDVLGNGISNDEEIVKFTRDYWSIF

SEQ ID NO: 24727 - protein, 81 aa, Suricata suricatta
SQGTVTFRDVAIDFTQEEWQQLDPAQRNLYRNVMLENYNNLITVGCPFTKPDVIFKLEQEEEPWVVKEEVLRRHRPGEVWG

SEQ ID NO: 24728 - protein, 81 aa, Chrysochloris asiatica
MIIEDVAVVFTHEEWDLLDPAQRKLYRDVMMETLRNLASVELTAHKRIHSGEKPYECKQCGKAFRLSLQCSRHMRTHSGER

SEQ ID NO: 24729 - protein, 81 aa, Lipotes vexillifer
KSCSGFSGLCASPVEERYGALISSCNSRTMTDGLVTFRDVAIDFSQEEWEFLDPAQRDLYVDVMLENYSNLVSLGKFICLK

SEQ ID NO: 24730 - protein, 81 aa, Lipotes vexillifer
VTFPDVAVRFSWGEWKLLDEAQRRLYLSVMLDSYALISSLGCCCGAEGEETPCEETVPVGVSQAGSPKAASFSQKTHPCEM

SEQ ID NO: 24731 - protein, 81 aa, Pteropus vampyrus
PEESVTFKDVAVDFTQEEWGQLDSPQRALYRDVMLENYQNLLALAGPPVCKPDVISHLERGEEPWQVPREVPGGAHPEWEP

SEQ ID NO: 24732 - protein, 81 aa, Pteropus vampyrus
TSKETVTFKDVAVTFTKEELRLLNSAQRKLYQDVMLENFRNLVSVGRYPFKHDVFYLEQEKRLWMMTVTQREGKSGGKIQS

SEQ ID NO: 24733 - protein, 81 aa, Pteropus vampyrus
FKVAVTFADVAVSFSREEWRLLDEAQRRLYLAVMLENFALVSSQGCCCGAEDVEASIEPSISHSYLCSVSVFSCTFVVELS

SEQ ID NO: 24734 - protein, 81 aa, Pteropus vampyrus
GSEPVTFEDVTLGFAPEEWGLLDLEHKSLYREVMLENYRNLVSVEHQLSKPDVVSQLEEEEELWSVERGILQDTFSGCPEA

SEQ ID NO: 24735 - protein, 81 aa, Zalophus californianus
DEALMAFRDVAVAFTQKEWKLLSPAQRTLYRDVMLENYSHLVSLEPGTEFRPCGHSCPVTFSSTQFFGQYVLCGHLPQIFP

SEQ ID NO: 24736 - protein, 81 aa, Equus caballus
FQGSVMFSDVSIDFSQEEWEYLDLEQRALYRDVMLENYSNLVSLGCFISKPDVISLLEQGKEPWKVVRKGKRRYPDLETRY

SEQ ID NO: 24737 - protein, 81 aa, Equus caballus
QAELTFEDVAVFLSQEEWGRLDPAQRGLYRDVMLETYRNLVSLGAGPAGPKPGVITQLERGDEPWVLDTQGVEGRERQKVD

SEQ ID NO: 24738 - protein, 81 aa, Equus caballus
SQAPVTFEDMAMYLTREEWRPLDPTQRDLYRDVMQENYGNVVSLDFEIRSENEVNPKQEISEDVEFGTTSERPVENTEENP

SEQ ID NO: 24739 - protein, 81 aa, Equus caballus
SQGPVSFKDVAVDFTREEWQFLDPPQRDLYKDVMLENYINLISVGFQSTKPAVVHKLEQGEEPWIVERKIPSWSYPDEVLQ

SEQ ID NO: 24740 - protein, 81 aa, Equus caballus
DVESLTFDDVAVEFTWEEWQLLAPAQKDLYRDVMLESYNNLVSLGYQASKPDALFKLERGEELWTGEDETPSQTCPEIRKV

SEQ ID NO: 24741 - protein, 81 aa, Equus caballus
AHGLVMFRDVAVDFSQEEWECLKPYQRNLYRDVILENYNNLVSLGWSSSKPDVITLLEQGKEPWMVLRDEEKRWSLDLDSK

SEQ ID NO: 24742 - protein, 81 aa, Equus caballus
LLQEPVTFKDVAVAFTEEELGLLDSTQRQLYQDVMLENFRNLLSVGHQPLKPDISHIEREAKLWMMKTASQVERNFGENNQ

SEQ ID NO: 24743 - protein, 81 aa, Neovison vison
QKELYKHVMRGNYEMLVSLDYAVSKPDILTRMERGEEPCPGGPWGQEEGSRREVAQPRRPSPGVPPRPEHILGPVSPAREE

SEQ ID NO: 24744 - protein, 81 aa, Neovison vison
YSNLVSLESSISKPDMITLLEQEKEPWVVLRRETSGWYPDLESNYGTEKLPSENYTYEINLPKLGIKQISKTLGLKASNFR

SEQ ID NO: 24745 - protein, 81 aa, Capra hircus
MVIEFFPHEWEFLDSLQKKLYCNVMMENYSNLVSLGHSISKPNVITLLEQGKEPWIVVREETRSWCTDLDSRYEITSNGKA

SEQ ID NO: 24746 - protein, 81 aa, Capra hircus
ELEPVTFADVAVLFTPEEWLFLDSSQKSLYRDVMLENYRNVASVAGDQLCKTRMSSRLEQREELCVTERGIFPGEPPQVGE

SEQ ID NO: 24747 - protein, 81 aa, Capra hircus
LGLFTFKDVAVEFTQEEWECLDPTQRALYRDVMLETYRNLLSLGEENISPDISKVSELSSPKEDISKGELCHLMTLEKNET

SEQ ID NO: 24748 - protein, 81 aa, Chlorocebus sabaeus
MLENYRNLVSLGLPFTKPKVISLLQQGEDPWKVEKDSSGDSSLGSKSSHKTTKSTQTQDSSFQGLILKRSNRNVPWDLKLE

SEQ ID NO: 24749 - protein, 81 aa, Chrysochloris asiatica
AQSVVTFEDVAVYFSQDEWRLLNVTARHLYRDVTLENFALIGSLGLAPSRFHVVAQLEGDEELWVPNIVDVTLVSRAEAGR

SEQ ID NO: 24750 - protein, 81 aa, Chrysochloris asiatica
MDVMLENYCHLVSVGCHMTKPDVILKLERGEEPWPSFAGHTYLEENWKAEDFLMKSKEQQDKYSRSVVFINHKKLIKEKGI

SEQ ID NO: 24751 - protein, 81 aa, Chlorocebus sabaeus
MLENYRNLVSLGLPFTKPKVISLLQQGEDPWKVEKDSSVDSSLGCKSTPKMTKSAQTQDSFQEQMRKRLKRVEPWNFIPER

SEQ ID NO: 24752 - protein, 81 aa, Chrysochloris asiatica
KGEPVRFADVAVYFSREEWACLRPVQKALYLDVMRETYGHLLALGFRGSKPALISWVEEEAELWGPNAQDPEAGICLTETD

SEQ ID NO: 24753 - protein, 81 aa, Chrysochloris asiatica
FQGSVTFQDVAVDFTPEEWQLLNYAQRKLYGSVMLENCRNLLSVGCPVTSPKGILKLKQGKKPWMEEGEDPHLSYPEADCL

SEQ ID NO: 24754 - protein, 81 aa, Chlorocebus sabaeus
MLENYNSIVSLGLPVPQPDVIFQLKRGDKPWVVDLHGSEERERPESVSLETKPEIHDASDEKSEGSLRECLGRQSPLCPKF

SEQ ID NO: 24755 - protein, 81 aa, Suricata suricatta
NFWILRLPPGSKGEAPKEWGKLDEWQKELYKHVMRGNYETLVSLDYAISKPEVLSQTEQGKEPCSWRRAAPKVPDVPVDPS

SEQ ID NO: 24756 - protein, 81 aa, Chrysochloris asiatica
AQGMVTFRDVTIEFSQEEWKYLEPTQKDLYRDVTLENFSHLLSLGISISKPDVISLLEQGKEPWILAKNMKEQWCSDLESR

SEQ ID NO: 24757 - protein, 81 aa, Chrysochloris asiatica
KGPPVSFEDVAVDFSREEWQQLDPAQRQLYQEVMMENYSHFLSMGYDLPKPELIFRLDREKEPWMVEVGLPPWSYPDEQFG

SEQ ID NO: 24758 - protein, 81 aa, Aotus trivirgatus
VQEPVTFKDVAVDFTQEEWGQLDLVQRTLYRDVMLETYGHLLSVGNQIAKPEVISLLEQGEEPWSVEQTCPQRSCPEWMRN

SEQ ID NO: 24759 - protein, 81 aa, Sarcophilus harrisii
HQELVTFKDVAVEFTPEEWGHLHSSQKALYRDVMLENYRNLVCLGLAVSKPGVICQLEQGKVPWMPEDDIPRTPYLDWDTT

SEQ ID NO: 24760 - protein, 81 aa, Zalophus californianus
HGPLTFGDIPFYFSREEWGSLDPAQRELFWDIKRENSRNVALALVPEPSGTEEAAPSRLAGAGLQSQSQRSGLGEAVTVLP

SEQ ID NO: 24761 - protein, 81 aa, Zalophus californianus
MLENYSNLVSLGYQDSKPDIIFKLEQEELWMMQAQIPSQGHPEKVWEIDDHMEWHQENEGKLESVAKGYECPTFGKLCLLT

SEQ ID NO: 24762 - protein, 81 aa, Zalophus californianus
QPREAVTFKDVEVTFSQDEWGWLDPAQRNMYRDVMLENYGNVVSLVGPFTKPVLISWLEAREPWGLNVQEAQPKGKPGVAP

SEQ ID NO: 24763 - protein, 81 aa, Equus caballus
DHGLVMFQDVAIDVSQEEWECLNPAQRNLYKDVMLENYSNLVSLDLESKYDTKNLSIEKDITENNSSEWKVTEGSKFLGFE

SEQ ID NO: 24764 - protein, 81 aa, Equus caballus
SCEGSVSFKDVAVDFSREEWQHLDLAQRNLYRDVMLETYSHLLSVGYQVPEPEVFMLEQGKEPWALQGESQHQSCPGEKLW

SEQ ID NO: 24765 - protein, 81 aa, Capra hircus
QERLTSEDVAIEFTPEEWEFLDPAQRALYRDVMLETYRNLLSVDIPPTHVIKHLQPTANSDKLETFQTLMLGSPESCEIKL

SEQ ID NO: 24766 - protein, 81 aa, Capra hircus
VFQGQLTFQDVAIDFTQEEWECLDLSQRELYRDVMLQNYRNLASLGLVSMLDLVAFLEQLKDPRSMRRMETTAIYPAMSPQ

SEQ ID NO: 24767 - protein, 81 aa, Chlorocebus sabaeus
FQELLTFRDVAIEFSPEEWKCLDPAQQNLYRDVMLENYRNLVSLGVAISNPDLVTCLEQRKEPYNVKIRKIVARSPAVCSH

SEQ ID NO: 24768 - protein, 81 aa, Chlorocebus sabaeus
DTVAYKDLSVGYTQKKWKCPALSQRALQWNMMLENDCSMASLAGGNMMESSELIPKQEIFKGSESSNSTSGGLFGVVPGGA

SEQ ID NO: 24769 - protein, 81 aa, Chlorocebus sabaeus
QGSLSFEDVTVGFTQEEWQHLDPAQRTLYRNVMIENYSHLVSVGYCVPKPEVIFKLEQGEQPWILEEELPGQRYPVLEVCK

SEQ ID NO: 24770 - protein, 81 aa, Chlorocebus sabaeus
MYSEPLKQSYLAPVLCYFILTGYCITKPEVIFKIEQGEEPWILEKGFPSQCHPERKWKVDDMLGSNQENEDDHFWELLFHN

SEQ ID NO: 24771 - protein, 81 aa, Suricata suricatta
SQGLVTFRDVAIEFCEEEWGCLTRSQRELYRDVMFENYGHLLFLGLIVSKPDLVIFLEQKKDVWDVRRKETEASCPNSYWS

SEQ ID NO: 24772 - protein, 81 aa, Chlorocebus sabaeus
RGLVTFEDVAVEFTQEEWALLDPAQRTLYRDVMLENCRNLASLEIGCRVNKPSLISQLEQDKKVMTEERGILPSSCPDLET

SEQ ID NO: 24773 - protein, 81 aa, Suricata suricatta
GLLTFRDVAIEFSQEEWGCLNHSQWELYRDVMLETYGHLVFLDLVVSKPDLVIFLEQKRELWNVKRKETVASYPVRVLHVH

SEQ ID NO: 24774 - protein, 81 aa, Suricata suricatta
FQESVTFEDVAVDFTQEEWALLDTSQRKLFRDVMLENIRHLVSLGCQHCQSAVVFQLEHGEELWGEGSRSLRGQGPVLLGR

SEQ ID NO: 24775 - protein, 81 aa, Suricata suricatta
MAHAMMFGDVAVDFSQEEWECLDLEQRHLYRDVMLENYSNMISLGLCIYQPDVFSLLEKGKEPWIFLQDETRGHCPELQSR

SEQ ID NO: 24776 - protein, 81 aa, Chlorocebus sabaeus
FEELVTFEDVFVDFSPEELSSLSAPQRNLYREVMLENYRNLVFLGYQFSKPDIISRLEVEESHAMETDSRHTVICQGEAHD

SEQ ID NO: 24777 - protein, 81 aa, Chlorocebus sabaeus
MLENYRNLVFLGIAVSKPDLITCLEQEKEPWEPMRRHEMVAKPSVMCSHVAQDFWPEQHIKHPFQKVTLRRYKNCGHKNVH

SEQ ID NO: 24778 - protein, 81 aa, Chrysochloris asiatica
KPASASLLPTKIQEEWGLLDPSQKELYWDAMLEKYGTVVSLGMSPPRPEAHTLPRSGVPHAGPGSLPGFHPGNGSGHPHPS

SEQ ID NO: 24779 - protein, 81 aa, Chrysochloris asiatica
DEAFVAFRDVSVDFTQNEWQLLSPAQRTLYKDVMLENYINLSSLGISFSKPKLITQLEQGIAPWIEERECILGPCPAEPKP

SEQ ID NO: 24780 - protein, 81 aa, Suricata suricatta
KVPVTFVDIAVYFSEDEWKNLDEWQKELYNNLVKENYKTLVSLDAEGAAPKPDAPSQAEPREEPCVWEQRDPEEREILMDP

SEQ ID NO: 24781 - protein, 81 aa, Sousa chinensis
VTFEDVAVLFTRDEWRKLAPSQRNLYQDVMLENYSNLVSLAGLPFSKPEVISLLQQGEDPWKVVKESPGGSSLEKLFKCKD

SEQ ID NO: 24782 - protein, 81 aa, Pteropus vampyrus
MLENCGNLTSLGYPVPKPALISLLEGGDLPWGLEAQGDPSAERTTDFCKDAETNTDSESTSTQGVSEDRDVMLSCGLQKSI

SEQ ID NO: 24783 - protein, 81 aa, Pteropus vampyrus
MDVVVFADVAVNFTREEWALLDHTQRRLYRDVMLETCRNLAFVGCYTEVKTFGSFSQRKTLENNIANKEKTVRFTRNDSWS

SEQ ID NO: 24784 - protein, 81 aa, Pteropus vampyrus
WQGWGTFEDVAVYFSREEWELLDEAQRHLYHSVMLENLALVASLGPASPKSCVVAHLEQGKDPWVPDRGDVSPATARETWR

SEQ ID NO: 24785 - protein, 81 aa, Pteropus vampyrus
GPAEGRVTFEDVTVYFSSEEWDLLDEAQRRLYQDVMLENLALITSLAPTPAVMKICRERIRVWSLPVNLKDTTLLAFSLTS

SEQ ID NO: 24786 - protein, 81 aa, Pteropus vampyrus
MLENYGHLVSLAGLNFSKPDLVSFLEQGKEPWLGRGNVRRDLCSVSESNDEIREFSPKNVIYENDSSQYLIKERILSQGPE

SEQ ID NO: 24787 - protein, 81 aa, Pteropus vampyrus
WLTFKDVFIEFSPEEWERLDPAQRALYWDVMAENYRNLLSLGSLTVGFSIKELPPRWDINKDELYHLMILERNDSHVVKNC

SEQ ID NO: 24788 - protein, 81 aa, Pteropus vampyrus
MIVSQISFEDVAVEFTLDEWQLLDPAQKNLHRDVMLENYSNLVLLGCQILKPGAVFKLEQEEPWMINAEVPSQSFAAKGRA

SEQ ID NO: 24789 - protein, 81 aa, Pteropus vampyrus
VTESVTFRDVAVLFSRDEWLCLDPAQRALYREVMLENYSSLVSLGIPLSTPKVICQLQRGKDPCLVEGEACQGACQDFKTW

SEQ ID NO: 24790 - protein, 81 aa, Pteropus vampyrus
KFTSVSFKDVTVGFTQEEWQHLDPTQRSLYRDVMLENYSNLVSVGYCVTKPEVIFRLEQGEEPWILEKELPSQSFSEVWKT

SEQ ID NO: 24791 - protein, 81 aa, Trichechus manatus
MLENYGNLVSMGLRSSKPKLITQLEQGAEPWMEDGDFPSSTCPVQEYWFEAKISALKQNTSEESLLGEQTKSATMERSLDW

SEQ ID NO: 24792 - protein, 81 aa, Trichechus manatus
SEDLVTFGDVAVDFSQEEWEWLNPAQKTLYRKVMLENYRSLVSLGASLSKPDVISLLEQGKEPWTVKKQGTRGICPDWEYV

SEQ ID NO: 24793 - protein, 81 aa, Trichechus manatus
MLENYSHLVSVGYCVTKPEVIFMLEQGDEPWILEEESPCHIHPDFHILDDQMEKSQENQDQHLCKIDFINNKTLTKGRNST

SEQ ID NO: 24794 - protein, 81 aa, Trichechus manatus
LLTFRDVAIEFSQEEWECLDPAQRALYKDVMLENYRNLISLDISYRCMLQELSPNENIIKEELFPAVMFEGHESHGIENFD

SEQ ID NO: 24795 - protein, 81 aa, Trichechus manatus
TGKALMEPTQGSVNFEDVAVYFSQEEWGLLDEAQKLLFCDVMLENFAIIASLGSWHGTEDEETSSKQNVSVEIQIPGKNEY

SEQ ID NO: 24796 - protein, 81 aa, Trichechus manatus
SQGLVSFKDVAVDFTQEEWQQLDPAQRTLYRDVMLENYSHLVSMGYPVSKPDVISKLEQGEDPWIIKKDISNWIYPDENQA

SEQ ID NO: 24797 - protein, 81 aa, Zalophus californianus
AQGSMVFSDVSIDFSQEEWECLDPGQRDLYRDVMLENYSNLLSMGLYIPKPQVISLLEQGKEPWMVGRELTRGLCSDLESM

SEQ ID NO: 24798 - protein, 81 aa, Zalophus californianus
MNTSQASVSFKDVTVEFTQEEWQQMGPIQRTLYRDVMLENYNNLVSVVIFKLEQGEEPWFLEEEFSNQSHREDYRDDDLLK

SEQ ID NO: 24799 - protein, 81 aa, Zalophus californianus
RDWGTFEDVAVYFSREEWELLDETQRHLYHDVMLENLALVASLGCWCGVEEAPLEQSVSVEGALHFRTPKACPSTQKANTC

SEQ ID NO: 24800 - protein, 81 aa, Zalophus californianus
DEALMAFRDVAVAFTQKEWKLLSPAQRTLYRDVMLENYSHLVSLGIAFSKPKLITQLEQGDEPWREESECLPDLCPAEPGT

SEQ ID NO: 24801 - protein, 81 aa, Equus caballus
TQDCVTFEDVAIDFSQEEWGILDEAQRRLYHDTVLENFALIASLVCWHGTENEETPFEQSVSVEALSQIRTPKVGPATQKA

SEQ ID NO: 24802 - protein, 81 aa, Equus caballus
GWVPALFDEVAIYFSDEEWEVLTEQQKALYREVMRMNYETVLSLEFPFPKPDMITRLEGEESQNPDEWQLQGGSFAENEDS

SEQ ID NO: 24803 - protein, 81 aa, Equus caballus
FQGSLSIEDVTVGFTQEEWQHLDPAQRTLYRDVMLENYSHLVSVGYCIPKPEVIFKLERGEQLWILEEESSSQSHPEVCKV

SEQ ID NO: 24804 - protein, 81 aa, Neovison vison
QQVPVTLEDMAAYLSQEEWESPDPAQRDCSWDALPEHRGLGLQLDGEDAREDMSMRRERDREPAGVMTRPEQPLERAGPRR

SEQ ID NO: 24805 - protein, 81 aa, Chrysochloris asiatica
SVFLQKGPPLTLEDVAMYSQAEGQQLGALYRDVMLDNNSLGFPVPKLELITQLEHREEMWVLNLLGAERLEVLRCCRTDED

SEQ ID NO: 24806 - protein, 81 aa, Suricata suricatta
MAHMAFRDVAVDFSQEEWMLLSPAQRSLYREVMLENYSNLVSLGIPFSKPKLITQLEQGKETWREEGKCPPGTCPAEPKPE

SEQ ID NO: 24807 - protein, 81 aa, Suricata suricatta
AQASVSFKDVTVDFSREEWQHLDPAQKTLYVDVMLENYCHLISVGCHMTKPDVILKLERGEEPWTSFTGHTCLEENWKDED

SEQ ID NO: 24808 - protein, 81 aa, Mandrillus leucophaeus
VGLQFQGSVTFEDVAIAFSQQEGLYRDVMLENYRNLVSMAGHSLSKPHVIALLERWKEPKVTERKDGRRWCTDLQLEDDTI

SEQ ID NO: 24809 - protein, 81 aa, Lipotes vexillifer
LQESLLFEDVAVEFTREEWRLLDPAQKDLYQDVMLENYSNLLSVGYQSPKPIHIFRLKQRDKPWLEKENIHGQNFPEVGEI

SEQ ID NO: 24810 - protein, 81 aa, Lipotes vexillifer
TQGLVTFRDVAIEFSQEEWKCLEPAQKDLYKDVTLENFSNLVSLGLSLPKPDVISLLEQGKEPWMVINDMTGPWCPDLESR

SEQ ID NO: 24811 - protein, 81 aa, Lipotes vexillifer
PQKSVTFEDVAVYFTQAEWDGLSPAQRALYRDVMLENYGNVASLGFPLLKPTVISQLEGGGELEGPSPLASGTGTGPQGLW

SEQ ID NO: 24812 - protein, 81 aa, Lipotes vexillifer
GVMESVTLEDVAVGLIQEWALLDDARRNLCRYVLLDNCRTLAPRGTPFCKACLVSQVGPREELMTAERGILCATGVDWESQ

SEQ ID NO: 24813 - protein, 81 aa, Trichechus manatus
SLSFEDVSLDFTWEEWQLLDSAQKNLYRNVMLENFSSLVSLEYWNIDDYVAWHQELQDKLKRLEKDHGSNASGKLFQSGMN

SEQ ID NO: 24814 - protein, 81 aa, Equus caballus
SQGLVTFEDVAVYFSLEEWERLDAAQRDLYKEVMQENYGILVSLGYPIPKPDLIFRLEQGEEPWVPDSPRPEEGDIVTGVY

SEQ ID NO: 24815 - protein, 81 aa, Equus caballus
SLGSVSFKDVTVDFSREEWQQLDLAQKSLYRDVTLENYFNLLSVGCQVPKPEIVFHLEHGEEPCLLDGEISSQSCLGGNIG

SEQ ID NO: 24816 - protein, 81 aa, Equus caballus
AQESVTFKDVAVLFTWDEWAQLSPAQRALHREVMLENYSTLVSLGLLGPEPDMLSQLGKGGVWMPEDASRCLCLDWITMPV

SEQ ID NO: 24817 - protein, 81 aa, Equus caballus
ADSVIFHDVAVYFSWGDWRLLDEAQRRLYLDVMLENFVLISSLGKTWNSLTKFYVWDRMDITAAMAGWAQRGPALLSGSWG

SEQ ID NO: 24818 - protein, 81 aa, Neovison vison
YQNLVSVGLSFRRPNVITLLEKGRAPWMVEPVRKRRGVDSGSKCETKKLLPNLCNKSGQSIYQKPVSASQKVPSGKRGCKR

SEQ ID NO: 24819 - protein, 81 aa, Capra hircus
HLTFKDVAIKFSQEEWECLDPAQRTLYRDVMLETYRNLLSVAVSHIHVIKKLKPKANRDTGVFQRVMLGRYESHEIRDFYF

SEQ ID NO: 24820 - protein, 81 aa, Chrysochloris asiatica
RNESVTFKDVAVLFSQDEWEHLNSAQRALYKDVMLENYSNLVSVGLIVPKPDMFSQTRKGEEWMLEDASGGSCLGKIHTYD

SEQ ID NO: 24821 - protein, 81 aa, Chlorocebus sabaeus
MGLLTFRDVAIEFSLEEWRRLDAAQQNLYRNVMLENYRNLVFLGIAVSKPDLITCLEQGKEPWNMKRHEMVDKPPDICPHF

SEQ ID NO: 24822 - protein, 81 aa, Chlorocebus sabaeus
SQESLTFQDVAVDFTKEEWDQLYPAQKNLYRDVMLENYRNLVALGIGYQLYKPEVIAQLELEEEWVIERDSLLDTHPDGEN

SEQ ID NO: 24823 - protein, 81 aa, Suricata suricatta
AHHLVMFRDVAVDFSQDEWECLNSYQRNLYRDVILENYSNLVSVAGCSISKPDVITLLEQGREPWMVVRDERRRRTLDLES

SEQ ID NO: 24824 - protein, 81 aa, Chlorocebus sabaeus
VTFEDVTIIFTWEEWKFLDSSQKRLYREVMWENYTNVMSVENCNKSYTSQEEKFRYLEYENFSCWQGWWNAGAQMCENQNY

SEQ ID NO: 24825 - protein, 81 aa, Suricata suricatta
QSPVVFEDVAIHFSQEEWGLLDGAQRLLYRAVMLENLALLSSLGCWHGARGEELSQVRTPQPGPSVQEAQPCETCGPVWKH

SEQ ID NO: 24826 - protein, 81 aa, Chrysochloris asiatica
EPFTLDDVTVKFTQEEWNCLDASQKALYRDVMLETFKNLASIGDKEYEEPREWRLCLRDRTGGNKVSPAGEGAGPQSPRSS

SEQ ID NO: 24827 - protein, 81 aa, Suricata suricatta
MLENYRNLVSLGLCISKPDVISLLERGEDPWMVKGDVTGGLCPDVEYVWMTQESSPKQEIYEGKLSEAVMLERLPSCDLTC

SEQ ID NO: 24828 - protein, 81 aa, Suricata suricatta
RPRAVKFADVAVYFSTEEWGCLRPAQRALYRDVMRETYGHLGALGFPGPKPALISWMEQESEESEAWSPAAKDPEEGESLG

SEQ ID NO: 24829 - protein, 81 aa, Suricata suricatta
AQESLTLEDVDVVFSREEWQLLGPAQKDLYRDVMLENYRNLMSVGWQTAKPDALSKLEHRDETWMTKDKIQDRTWAGIGKV

SEQ ID NO: 24830 - protein, 81 aa, Chlorocebus sabaeus
MLENYRNLVFLGICLPDLSIISMLEQRRDPRNLQSEVKIANNPDGRECIKGVNTESSSKLGSNTENKSLKNQLGLTFQLHL

SEQ ID NO: 24831 - protein, 81 aa, Chrysochloris asiatica
MGIEDVAVVFSPEEWALLDPAQRELYRDVMMETFTNLASVVSYNLSDKEKWPSEPTVLRSMKNNPWSSLLPEISDCPLTND

SEQ ID NO: 24832 - protein, 81 aa, Chlorocebus sabaeus
QESVTFKDVAVDFTLEEWGWLEPGQRELYRDVMLENYRNLLSLGAGLPGSKPDVISRLERGEEPRPEEREAWRVTCPDLET

SEQ ID NO: 24833 - protein, 81 aa, Suricata suricatta
CWGLLSFKDVSVEFTRDEWQLLDSAQKHLYRDVVLENYSHLVSVGYHGTKPDLIFKLEQGQEPWIINARVSRQSYPENWED

SEQ ID NO: 24834 - protein, 81 aa, Suricata suricatta
SQGQLTFQDVAVEFSQEEWECLNHSQRELYADVILETYGHLLFLGLLVSKPDLVIFLGHEQELRGVKRQETVASHPAVSSH

SEQ ID NO: 24835 - protein, 81 aa, Chrysochloris asiatica
FQEAVTFKDVAVVFSEEELRLLDSTQKKLYQDVMLETFWNLLSVEDKHQTKNKIETLERLRYHLYEELSCSVIWEKVVREL

SEQ ID NO: 24836 - protein, 81 aa, Chlorocebus sabaeus
SFQGSVTFQDVAINFSKEEWGFLNPAQRDLYTTVMLENYQNLVWLGLSVSKSVISLLEKRKLPWIMGKEEIRVPLPDAPGA

SEQ ID NO: 24837 - protein, 81 aa, Suricata suricatta
MAHGSVTFRDVAIDFSQEEWEFLDSAQRDLYRDVMWENYSNFISLEPSISKPDVIEGKEPWMVVREGTRRHCPDLESRYRT

SEQ ID NO: 24838 - protein, 81 aa, Suricata suricatta
RLLTFRDVAIKFSQEEWGCLKHSQGELYRDVMLENYGHLLFLGSPTGFGIKELSPTEDINKGEFYHVVILERNESHGIKDF

SEQ ID NO: 24839 - protein, 81 aa, Lipotes vexillifer
EEGRVTFEDVAVYFSQEEWGLLDKAQRLLYYSVMLENFSLMASLGLTSSRTQEVTQLEQWGEPFVPACGVVITATPRGCWC

SEQ ID NO: 24840 - protein, 81 aa, Lipotes vexillifer
TQEPVVFEDVAVAFTQEEWALLDLAQRNLYRDVMLENFQNLASLGYPLHTPYLISQWKQEEDLEIAERGPTQGEHQEGFEA

SEQ ID NO: 24841 - protein, 81 aa, Lipotes vexillifer
VAESVVFEDVAVDFTPEEWALLDPAQRNLYRDVMLETFRNLASVETHTVEKPYACKECEKSFSSPSSLRKHARMHTGEKAY

SEQ ID NO: 24842 - protein, 81 aa, Callorhinus ursinus
AHHLVMFRDVAVDFSKEEWECLNSYQRNLYRDVILENYSNLVSVGCSISKPDVITLLEQGKEPWMVVRDERRRRSLDLESR

SEQ ID NO: 24843 - protein, 81 aa, Trichechus manatus
QGCVTFEDVAIYFSQEEWGLLDEAQRILYSDVMLENFTIIASLGHWHEMEEEETSSEQNVSIEGVSQTGPSTQKTHSWEMC

SEQ ID NO: 24844 - protein, 81 aa, Trichechus manatus
HPESLTFEDVAVYFSENEWTSLAPAQRALYRDVMLENYGAVASLAAFPFPKPALISQLEQGEIPWCLAPQGALDGKGPRGI

SEQ ID NO: 24845 - protein, 81 aa, Trichechus manatus
LQEPVTFRDVAVDFTREEWGQLDPAQRTLYRDVMLETFGHLVDVGPELPKPDVISQLEQGAELWVAERGLAQGCCPGWETR

SEQ ID NO: 24846 - protein, 81 aa, Trichechus manatus
PKVPVSFEDVAVYFTKTEWKLLDLRQRIFYKRVMLENYSHLVSLGFSFSKPHLVSQLERGEAPWVTNTDRMETGGISGGDR

SEQ ID NO: 24847 - protein, 81 aa, Zalophus californianus
IEEARMVAGLLMDSSQEEWTLLDQTQRDLYRDVMLENYQNLIILGCESCKPDLNSSMGGAEELRTGGRGILQELDLQLKTK

SEQ ID NO: 24848 - protein, 81 aa, Loxodonta africana
GWVPALFDEVAIYFSDEEWEVLTEQQKALYREVMRMNYETVLSLEFPFPKPDMITRLEGEEESQKSNEWQLQGGPFPENED

SEQ ID NO: 24849 - protein, 81 aa, Loxodonta africana
VSFRDVAVNFTREEWQQLDSDEKIIYRDVMLENYSHLISLGFDITKPDVIIKLEQGEEPWIVEGEVPCQRHVKEAWKVDDL

SEQ ID NO: 24850 - protein, 81 aa, Capra hircus
SRSLENDGVCFSEQEWENLEDWQKELYANVMKSNYETLVSLKVLGQPEGEMELGAEMPGDLEEEESRGVHPAEEVVAKQET

SEQ ID NO: 24851 - protein, 81 aa, Pteropus vampyrus
MRLSAHSGFGEMAVFSLLLREEPCLCRCCQARKPDTLSRLDQGEPPWTLADRVYSRTRSGIRKVDDHELEHFQDGSLENNL

SEQ ID NO: 24852 - protein, 81 aa, Trichechus manatus
FMEAVTFKDVAVVFTEDELGLLDPAQKKLYRDVMVETFRNLVSVGDKNPRQVETVLQAGAHEDLSSLHIWQQIASDLTRCQ

SEQ ID NO: 24853 - protein, 81 aa, Trichechus manatus
GTGLLTFRDVAIEFSQQDWECLDPAQRALYRDVMLENYRNLVSLGISPSEMNIISILKKDTEPWTVEKKKTAKNPGMWEYI

SEQ ID NO: 24854 - protein, 81 aa, Trichechus manatus
PVTFEDVTVVFTEAEWKRLSSEQKNLYKEVMVEIYRNLLSLAELKRELYPCSSCLLAVSCQQFLSQHVLQIFPGLRAENHF

SEQ ID NO: 24855 - protein, 81 aa, Trichechus manatus
REAFVAFGDLAVDFTQEEWWLLSPAQRTLYREVMLETCNHLVSLGIPFSKPKLITQLEHREEPRRGERKHLLDPCLGGSKP

SEQ ID NO: 24856 - protein, 81 aa, Trichechus manatus
KQGQVTFKDLFVYFSQDEWGLLDEAQRLLYRDVMLDNLALMASLGHSPSMSQVVAPLELGREPWVPGWADRTPAVTREAQH

SEQ ID NO: 24857 - protein, 81 aa, Trichechus manatus
DSVTGADVAVDFTQEEWALLDLSQRKLYREVMTETFRNLASVGEIYKLHGVEEQDDNQKTHVSMQPVFNRRHMVENLCESY

SEQ ID NO: 24858 - protein, 81 aa, Trichechus manatus
SQRLLTFRDVAIEFSQEEWDYLDPAQRTLYRDVMLENYRNLVSLGISPSEINIISILKKGTEPWTVEKETKLAKNPDVFST

SEQ ID NO: 24859 - protein, 81 aa, Trichechus manatus
DSVVIEDVAVIFSQEEWALLDLTQRKLYRDVMLETFRNLASVVSRNLDGERLSSEHIMVQFMKSNTWSYVLGKISKSYGSK

SEQ ID NO: 24860 - protein, 81 aa, Trichechus manatus
VKEAVTFKDVAIDFTLEEWRLMDPTQRNLHKDVMLENYRNLVSLGLAVSKPDMISHLEDGKGPWVVVREISRAPYPELETK

SEQ ID NO: 24861 - protein, 81 aa, Trichechus manatus
LQEAVTFKDVAVVFTEEELGLLDSTQRTLYRDVMLENFRNLVSLGHQSFKPDVISQLEREEKLWLKKLQTQRGRRSGGRSQ

SEQ ID NO: 24862 - protein, 81 aa, Zalophus californianus
LFQGSLSFKDVAVVFTWEEWQLLDPIQKNLYQDVMLENYSNLVSLGYQITKADAFYQLEHGTPWITEEEIQSQIYPEDTWQ

SEQ ID NO: 24863 - protein, 81 aa, Equus caballus
WSQMPVTFEDVALYLSREEWGRLDHTQQSFYGDVLQKRNGLSLGFPFGRPVWASQVQGKGEASSSCRQTDEEEKRGAIEVG

SEQ ID NO: 24864 - protein, 81 aa, Equus caballus
WALLDPSQKKLYRDVMWETFRHLASVGKNEDIPSQKPYECKICSKAFSYITSLTTHERSHTGAKPYECKCGKAFASSRSLQ

SEQ ID NO: 24865 - protein, 81 aa, Equus caballus
PHRLVLFRDVAVDFSQEEWACLDSEQKDLYRDVMLENYSNLVSLGFSSSKADMLSLLEQGKEPWKVVQDVARSQSSDLGSR

SEQ ID NO: 24866 - protein, 81 aa, Equus caballus
MYFSQEEWELLDPTQKALYNDVMQENYETLISLALFVLPKPKVISCLEQGEDPWVQGSPEFNDRPRELPTGLKLKNNTENQ

SEQ ID NO: 24867 - protein, 81 aa, Neovison vison
VMRGNYETLVSLDYAISKPEVLSQTEPGKEPCSWRRPGPKVPDVPVDPSPGSGPPVPAPDLLMQIKQEGELQLQEQQALGV

SEQ ID NO: 24868 - protein, 81 aa, Loxodonta africana
QSLVTFGDVAVIFSQDEWEWLNPAQRSLYRNVMLENYRSLVSLGLCISKPDIISLLEQGKEPWIMKRKMTQGQGPDLKPLQ

SEQ ID NO: 24869 - protein, 81 aa, Capra hircus
SQVSVTFEDVAVLFTRDEWRKLAPPQRNLYQDVMLENYSNLVSLAGLLFPKPKVISLLQQGEDPWKVEKENLGGSSLGWKN

SEQ ID NO: 24870 - protein, 81 aa, Capra hircus
PQESVTFEDVAVNFSHEEWQCLTHAQRHLYKDVMLENYGNMVSLGFSFSKPPLISCLEQGAESYVQDQQDWEFLSCSYPVS

SEQ ID NO: 24871 - protein, 81 aa, Capra hircus
LFQSLSFRDVAVDFTQEEWQHLDPEQKTTYRDVMLENYSHLISVGCHIIKPEVITKLEQGEEPWVVEGEFLLQIHDLMEGR

SEQ ID NO: 24872 - protein, 81 aa, Capra hircus
PHRLVLFKDVAIDFSQEEWAYLDLEQKDLYRDVMLENYSNLVSVGVSISKLDVLSLLEQGKEPWKVVQEVTRDLSPDWESR

SEQ ID NO: 24873 - protein, 81 aa, Capra hircus
EQLTFKDVAVEFSQEEWECLDPAQRAFYMDVMVETLRNLISVDISHIHVVKKLQPIARSDRGDAFQTMTLERQESPEMKYF

SEQ ID NO: 24874 - protein, 81 aa, Chrysochloris asiatica
RSQESVTFQDVAVDFTQEEWEQLDPAQKSLYRDVTLENYRNLAALGHQLYKPEVITHLEQEEQWMMESKNLPVTHPDVENR

SEQ ID NO: 24875 - protein, 81 aa, Chlorocebus sabaeus
QEPLTFRDVAIEFSPEEWKCLDPAQQNLYRDVMLENYRNLVSLAMCSHFTQDFLPVQGIEDSFHKCILRRYEKCGHENLQL

SEQ ID NO: 24876 - protein, 81 aa, Suricata suricatta
WSLLDEAQRRLYYDVMLENFTLVSSLGKALPVPRGPDWAFLCPDQCHICGLESDYVCSGCAKSFNHSEVLITRSVQTLERP

SEQ ID NO: 24877 - protein, 81 aa, Chrysochloris asiatica
PVTFEDVTVVFTEAEWKRLSSEQKNLYREVMLEIYRNLLSLAEPKPETYHCFSCLLAFSCQQFLSQHVLQIFPSLCAEHLF

SEQ ID NO: 24878 - protein, 81 aa, Suricata suricatta
SQGLLTFRDVAVKFSQEEWGCLNHSQWELYRDVMLETYGHLVFLGLVVSMPDLVIFLEQKRELWDVKRKETVASYPRIALN

SEQ ID NO: 24879 - protein, 81 aa, Lipotes vexillifer
MDFTLEDWEQLGLDQGDLFWDTALDNYQNLFLADPPRPNLPSHPDDGEELAALAKGSPESTDPDTAEGKTSPLPEDFLEEG

SEQ ID NO: 24880 - protein, 81 aa, Pteropus vampyrus
MLETCGFLVSLGQLVPIPELIYFLEPWQTLWTVKRDLSKSTCTGEKAKLETKEPPASQLAFTEEAAFKEGVTQRASRDSRL

SEQ ID NO: 24881 - protein, 81 aa, Pteropus vampyrus
GSVTFEDVAVYFSWEEWDLLDEAQRRLHQDVMLENLALMTSLGWWCGAEDEAPEQSISVGRMSQVRISEAGLSSQMAHPCG

SEQ ID NO: 24882 - protein, 81 aa, Pteropus vampyrus
LTLEDVAVDFTWEEWQLLAPAQKDLYWDVMSENYSNLVSVVPLHFPQAGYEVSKPDVLSKLERGEEPWTIEHEIHSPVCPE

SEQ ID NO: 24883 - protein, 81 aa, Pteropus vampyrus
CVTFEDVAIYFSREEWGLLDEAQRFLYRDVMLENFALTTSLDCWYGAKDEETPSEQRVSVEQESQARTPKACPSTQKTHPC

SEQ ID NO: 24884 - protein, 81 aa, Trichechus manatus
MPVTFEDVALYLSREEWGRLDHAQQNFYRGTHTGAKPHKCPVCSKCFTHSSALVSHQRTHTGVKPYPCPECGKCFSQRSNL

SEQ ID NO: 24885 - protein, 81 aa, Trichechus manatus
SVAVEDVAVDFTQEEWALLDLSQRQLYSDVMMEIFRSLASVASRNLIDGEKLSTENIIVRFMKNDTWSLMVGEICKLHGIE

SEQ ID NO: 24886 - protein, 81 aa, Trichechus manatus
MDSVVFEDVAVEFTQEEWALLDFSQKKLYRDVMMETFSNLDSGEICEFHGSIHQYNNQGRHLKTCTVESLYENKDGKVNKG

SEQ ID NO: 24887 - protein, 81 aa, Trichechus manatus
GLVTFADVAIDFSQEEWACLDTAQRDLYWDVMLENYSNLVSLDLVSTYETESLPTEKNIYEISFSQWNAHRKSKSTGLDWK

SEQ ID NO: 24888 - protein, 81 aa, Trichechus manatus
SLVFEDVAVCFTQEEWALLDFSQRNLYRDVMMETFRNLDSVSQQDNNGEKFSSEHTVVRLMKNDSWSSMSGEIFEFRGNEN

SEQ ID NO: 24889 - protein, 81 aa, Zalophus californianus
YQEVVTFEDVAVYFTRTEWAGLSPAQRALYREVMLTNYGNLTSLGYPVCRLALISLLEGGDLPWGLEPQDDLPAENTSDVS

SEQ ID NO: 24890 - protein, 81 aa, Zalophus californianus
EPRPELRPQGELAAAGWCLGPEGGQLTFRDVAIEFSQEEWECLDPAQRELYKDVMVENYRNLVSLDVSYTCDQEITTKGEQ

SEQ ID NO: 24891 - protein, 81 aa, Zalophus californianus
MQENYGILVSLGYPIPKPDLIFRLEQGEEPWVPDSPRPDEGDIVTGVYTGAWFWTDDLDDHEEDDDEDFLAEVAEEENEPP

SEQ ID NO: 24892 - protein, 81 aa, Equus caballus
FQGSVSFKDVTVGFTQEEWQHLDSTQRSLYRDVMLENYSNLVSVGYCVTKPEVIFRLEQGEEPWISEEEFPSQVFPVWKSD

SEQ ID NO: 24893 - protein, 81 aa, Equus caballus
MHLTNFSNVLKPKQLNPNLPLSGCHMTKPEVILKLERGEEPWTSFTGHTCLEENWKAEDFLVKFKEHQDKYSRSVVFINQK

SEQ ID NO: 24894 - protein, 81 aa, Equus caballus
RSQESLTFQDVAVDFTREEWDQLYPAQKNLYRDVMLENYRNLVTLGHQLYKPEVIIQLEQEEQWMMERDSPPDTPPDGENR

SEQ ID NO: 24895 - protein, 81 aa, Equus caballus
IYGLVSFEDVAVHFTWEEWQDLDDAQRTLYKDVMLETYSSLASLGHCITKPEVIVKLEQDAEPWTVEAPPNQNLPGGSMRA

SEQ ID NO: 24896 - protein, 81 aa, Chrysochloris asiatica
VQRSLTLEDVDVNFTWEEWQLLDSAQKDLYRDVMLENYNNLVLMGYQGSKPDAFSKREQGEEPWITEDEIHPIVCPEIKKG

SEQ ID NO: 24897 - protein, 81 aa, Chrysochloris asiatica
EPVTFEDVNVVFTKAEWKRLSAEQKKLYREVMLDTYRNLLSLGKVMKELKMLRFGADSYREDGADCGLKADFITNQRSVFW

SEQ ID NO: 24898 - protein, 81 aa, Suricata suricatta
CQGLVVFTDVAVHFSQEEWGLLDEAQRRLYCGVMLETFALVSSLGCWHGAQDEEASSEHGVSVRASQVRMPQPGPSVQEAQ

SEQ ID NO: 24899 - protein, 81 aa, Suricata suricatta
PQKSVTFEDVAVYFTQTEWDGLSPAQRALYRDVMLENYGNVASLGFSLLKPAVILQLEGAGELGDPSLLVAGTEVGSQGVW

SEQ ID NO: 24900 - protein, 81 aa, Chrysochloris asiatica
KQGQVTFEDVFVYFSPEEWGLLDEAQRLLYRDVMLDNFALMDSLGKALALTPVSVNWTLPFPSSWRRPAGCKDGGTSGQLT

SEQ ID NO: 24901 - protein, 81 aa, Chlorocebus sabaeus
FQGSVSFRDVTVGFTQEEWQNLDPAHRTLYRDVMLENYSHLVSVGYCIPKPEVILKLEKGEEPWILEEKFPSQRHLELINT

SEQ ID NO: 24902 - protein, 81 aa, Sarcophilus harrisii
VPALVTFRDVAVDFTQEEWRHLEPAQRALHRDVMLENFQNLVSVGLPVSKVDVISLLERGEAPWQPEGGGPPDPCYDYLNW

SEQ ID NO: 24903 - protein, 81 aa, Sarcophilus harrisii
PKVPVTFDDVSIYFSTPEWEKLEEWQKELYKNIMKGNYESLISMDYAMTQPEVLSQTHPESEQNTENQARPDENEMAAEPS

SEQ ID NO: 24904 - protein, 81 aa, Pan paniscus
AQESLTLEDVAVDFTWEEWQFLSPAQKNLYRDVMLENYSNLVAVGYQAGKPDALTKLEQGEPLWTLEDEIHSPAHPEIEKA

SEQ ID NO: 24905 - protein, 81 aa, Lipotes vexillifer
AQGKVNFEDVFVYFSQEEWGLLDEAQRLLYREVMLENFALMASLGYASSMFHGIAPLELDSEPWLSEWANMTPAMTREAQG

SEQ ID NO: 24906 - protein, 81 aa, Lipotes vexillifer
MLENYQNVLSLGLPESKPDVISRLERGEEPRMERREAWRVTCSDTFMILKATGHLFQEAFPDFQAERPFNCTECGKAFIYH

SEQ ID NO: 24907 - protein, 81 aa, Lipotes vexillifer
MAFKDVAVAFTQKEWKLLSPAQRTLYRDVMLENYSHMVSLGIAFPKPKLIIQLEQGDEPWREESESLLDLCPEPRTEFQPH

SEQ ID NO: 24908 - protein, 81 aa, Pan paniscus
GTVTFEDVAVKFTQEEWNLLSEAQRCLYRDVTLENLALMSSLGCWCGVEDEAAPSKQSIYIQRETQVRTPMASVSPKKAHP

SEQ ID NO: 24909 - protein, 81 aa, Pan paniscus
PVTSEDVAVLFIEAEWKRLRLEQRNLYKEVMLENLTESKPEVHTCPCCPLAFGSPQFLNQDELHNHPIPGFHAGNQLHPGN

SEQ ID NO: 24910 - protein, 81 aa, Lipotes vexillifer
DHSLVSFKDVAIDFSQEEWECLDLEQKDLYRDVMLENYSNLVSLGFSISKPDVLSLLEQGKDPWKVVWDVTRGLSPDWESR

SEQ ID NO: 24911 - protein, 81 aa, Pan paniscus
SQKSLTFKDVFVDFTLEEWQQLDSAQKNLYRDVMLENYSHLVSVGHLVGKPDVIFRLGPGEESWMADGGTPVRTCAGEDRS

SEQ ID NO: 24912 - protein, 81 aa, Pan paniscus
PQGCLTFRDVAIEFSLEEWKCLNPAQRALYRAVMLENYRNLESVDSSLKSMMEFSSTGHGNTGEVIHTGTLQRHKSHHIGD

SEQ ID NO: 24913 - protein, 81 aa, Callorhinus ursinus
SEESVTFKDVAVDFTQEEWGQLDSPQRALYRDVMLENYQNLLSLAGPPVCKPDVISHLERGEEPWQMPREVPGGACSEGEP

SEQ ID NO: 24914 - protein, 81 aa, Pteropus vampyrus
VPVIFRDVAVVFTEAEWKRLSSEQRNLYKEVMCENYRNLLSLIKAKTRLLSSCLLASSQPLLSQHVLQIFSGLCDFHPRNS

SEQ ID NO: 24915 - protein, 81 aa, Pteropus vampyrus
SQESVTFEDVAVDFTQEEWALLDTSQRELFRDVMLENISHLVSIVSQLYKSDVISLSEEREQLSREGIGFLQGQSPDRGDD

SEQ ID NO: 24916 - protein, 81 aa, Pteropus vampyrus
SQGLLIFRDVAIEFSQEEWECLDTAQRALYRDVMSENYRNLVFLGLAVSKPDLITFLEQMKEYCVLKRKKTISIHPGTWEC

SEQ ID NO: 24917 - protein, 81 aa, Pteropus vampyrus
MLETCRNLASLGYHVNEPSLISHLEQEDKVMTEQRGILPGTCPDLETVLKDRWLTPKKHGFRKKRSNGIKAERNHLGVKLN

SEQ ID NO: 24918 - protein, 81 aa, Pteropus vampyrus
GLLTFEDVAVFFTQEEWDYLDPAQRSLYKDVMMENYGNLVSLDVLNRDKDEEPTVKQEIEEIEEKVESQGIIVTRIKSEID

SEQ ID NO: 24919 - protein, 81 aa, Pteropus vampyrus
SQGLVTFEDVAVYFSLEEWQRLDAAQRDLYKEVMQENYGILVSLGYPIPKPDLIFRLEQGEEPWVPDSPRPEEGDIVTGVY

SEQ ID NO: 24920 - protein, 81 aa, Pteropus vampyrus
VPVTFDDVAVHFSEQEWGNLSEWQKELYKNVMRGNYESLVSMGKSGVRPAALNPAVWCDGAKADRHPLDLHMGSGSDLSKR

SEQ ID NO: 24921 - protein, 81 aa, Pteropus vampyrus
MLENYGHLVSLGLNFSKPDLVSFLEQGKEPWLGRGNVRRDLCSVSESNDEIREFSPKNVIYENDSSQYLIKERILSQGPEH

SEQ ID NO: 24922 - protein, 81 aa, Zalophus californianus
GVTFEDIAVYFSWKEWRLLDEAQRRLYHHVMLENFTLISSLGCCCGAEDEAPFAQSTSVGVSQTRTPKAAQSSRKTHPCEM

SEQ ID NO: 24923 - protein, 81 aa, Zalophus californianus
KPQGLVTFGDVVVDFTPEEWQYLNPPQKTLYREVMLETYSNLVSVGPQVTKPDLILKLEVEEPCPAETKISFWSFPEAACQ

SEQ ID NO: 24924 - protein, 81 aa, Zalophus californianus
TRNIVTFEDVCIYFSPEEWELLDEAQKRLYCNVMLENFLLVTSLGLAISRYHLIPQRLPVREPVVPANVAIAPAEAGMVSG

SEQ ID NO: 24925 - protein, 81 aa, Equus caballus
SQGSLSFRDVTVGFTQEEWQHLDPAQRTLYRDVMLENYSHLISVGYCTPKPEVILKLEQGEEPWILEEEFPSQSDPELTNS

SEQ ID NO: 24926 - protein, 81 aa, Aotus trivirgatus
FQGPVSFRDVTVGFTQEEWQHLDPAQRTLYRDVMMENYSHLVSVGYCIPKREVILKLENGKEPWISEEKFPSQSHLDQLVC

SEQ ID NO: 24927 - protein, 81 aa, Aotus trivirgatus
PKVPVSFEDVSVYFTKTEWKLLDLRQKVLYKRVMLENYSHLVSLGFSFSKPHLISQLERGEGPWVADIPRTWATRGLLIGD

SEQ ID NO: 24928 - protein, 81 aa, Aotus trivirgatus
MRPLTFMDVAIEFSPEEWQCLDTTQQNLYRNVMLENYRNMVFLGIAVSKPDLIACLEQGKDPWNMKRQEMVAKPPDMCSYF

SEQ ID NO: 24929 - protein, 81 aa, Lipotes vexillifer
TFQEAVTFKDVAVAFTEEELGLLDSAQRKLYQDVMVENFRNLVSVGEDSFRQDTKHIEREERLWLMNSATQIEIALKENNQ

SEQ ID NO: 24930 - protein, 81 aa, Pan paniscus
VMFRDVAIDFSQEEWECLDSAQRDLYRDVMLENYSNLVSLDLPSRCASKDLSPEKNTYETELSQWEMSDRFENCDLEESNS

SEQ ID NO: 24931 - protein, 81 aa, Lipotes vexillifer
KPAAVSFADVAVYFSPEEWGCLRPAQKALYRDVMRETYGHLDALGFPGPKPALISWMEQESEAWSPAAQDPEEGESLGGAL

SEQ ID NO: 24932 - protein, 81 aa, Lipotes vexillifer
VTGLVSFEDVAVNFTWEEWQDLDDAQRTLYRDVMLENYSSLVSLGHCITKPEVIIKLEQGAAPWTVKEKPQTRVSRASQCT

SEQ ID NO: 24933 - protein, 81 aa, Callorhinus ursinus
AQGSVTFEDVALYFSWEEWDLLDEAQRCLYHDVMLENFALTSSLGFGSSRSHAVAQLGLGEESPVLPVSTRWAPRGPDPGC

SEQ ID NO: 24934 - protein, 81 aa, Callorhinus ursinus
MDSVAFEDVTVKFTMEEWALLDPSQKKLYRDVMQETFRNLASIVCISEEKWEIHDREDQNENHGTDLSSQMVERLCKSKEC

SEQ ID NO: 24935 - protein, 81 aa, Callorhinus ursinus
LQNSITFEDVAMDFTQEEWALLNSRQRKLYRDVMLENYRNLASLEKQLSKPTVITQMKQEDEMKTGTGNHQDTCSNGMVLL

SEQ ID NO: 24936 - protein, 81 aa, Tursiops truncatus
AHGSVMFSDVSIDFSQEEWDYLDLEQRDLYRDVMLENYSNLVSLGCFVSKPDVIFLLEQGKEPWKVVRKGRRRYPDLETNY

SEQ ID NO: 24937 - protein, 81 aa, Tursiops truncatus
MQENYETVISLALFVLPKTKVICCLEQGEEPWVQGPPIFKDSPEELFSEIKMKNDTENHQPICFSDLEIQAPGDIVSKKAS

SEQ ID NO: 24938 - protein, 81 aa, Tursiops truncatus
MLENYGNVVSLGFPFPKPPLISHLEQEAELCVQDGQDREFLSCPHPVSAAKTRPENEKASSEQAVFENGEVCWVKFKSLLK

SEQ ID NO: 24939 - protein, 81 aa, Tursiops truncatus
RAGSVTFRDVAIDFSQEEWEFLDSAQRDLYRDVMWENYSNFISLAGPSISKPDVTTLLDEGKEPWMVVREGTRRHHPDLES

SEQ ID NO: 24940 - protein, 81 aa, Trichechus manatus
LQGSVSFRDVAVDFSREEWQHLDPDQRNLYWDVMLETYSHLLSVGYQVPKSDFFFMVEQGKEEGENPHQSCPGEKLWYQNA

SEQ ID NO: 24941 - protein, 81 aa, Trichechus manatus
KPGAVRFVDVAVYFSPEEWACLRPAQRALYRDVMRETYGHLGALGFPGPKPALISWMEQESEAWSPAAQDPEERENLGGAP

SEQ ID NO: 24942 - protein, 81 aa, Trichechus manatus
SVVVEDVTVIFSQEEWALLDLVQRKLYRDVMMETFRNLATVVSRNLNDGERLSSEHIMVQFMKNNTWSYVLGEIFEWRSST

SEQ ID NO: 24943 - protein, 81 aa, Trichechus manatus
AQGLVTFRDVTVEFSQEEWKYLEPAQKDLYRDVTLENFSNLVSLGISISKSDVISLLEQRKEPWMIAKDMTEQWYPDLVSR

SEQ ID NO: 24944 - protein, 81 aa, Trichechus manatus
SVVIEDVAVVFSQEEWTLLNLTQRKLYRDVMMETFRNMASVVSRNLNDGEELSSEHIMVQFMKSNTWSSMLGEISELYGNK

SEQ ID NO: 24945 - protein, 81 aa, Trichechus manatus
AQGLLTFEEVAVSFSQEEWGHLNSAQRALYRDVMWENYRNLISVGFIFAKPKLISQLEQGEEPWVPEGPRPSNLGLIPTFS

SEQ ID NO: 24946 - protein, 81 aa, Trichechus manatus
IQAQESLTFDDVAVEFTWTEWQLLGPDQKDLYWHVMLENYNNLVSVAGKPDALSKLEQGEELWTTEDEIHCRICPEIRKVD

SEQ ID NO: 24947 - protein, 81 aa, Zalophus californianus
GVTFEDIAVYFSWKEWRFLDEAQRRLYHHVMLENFTLISSLGCCCGAEDEAPFAHSTSVGVSQTRTPKAAQSSRKTHPCEM

SEQ ID NO: 24948 - protein, 81 aa, Zalophus californianus
SQSLLTFEEVAMYFSQEEWELLDPTQKALYNDVMRENYETVISLALFVLPKPKVISYLEQGEDPWVQGPLEFKNSPGGLPT

SEQ ID NO: 24949 - protein, 81 aa, Aotus trivirgatus
ETGPLTFRDVAIEFSLEEWQCLDTAQQDLYRKVMLENYRNLIFLAGIAVSTPDWITCLEQGKDPWNIKRHSMVAKPPVLCS

SEQ ID NO: 24950 - protein, 81 aa, Sarcophilus harrisii
ARSHESVTFKDVAMDFTPEEWGQLDPAQRDVMLENYRNLVSLWLPVSKPDGNSNFDQGENQWMMEKKVPRGNCSDWDTRSE

SEQ ID NO: 24951 - protein, 81 aa, Pan paniscus
MGPLQFRDVAIEFSLEEWHCLDTAQWNLYRDVMLENYRNLVFLGIVVTKPDLITCLEQGKKPFTVKRHEMIAKPPVMCFHF

SEQ ID NO: 24952 - protein, 81 aa, Callorhinus ursinus
FQGSVTFRDVAIDFSQEEWEWLQPAQRDLYRHVMLENYGHLVSLGFNISKPYVVSLLEQGREPWLVKGDVRRDPFSESNGE

SEQ ID NO: 24953 - protein, 81 aa, Tursiops truncatus
LRGWGTFKDIAVYFSQEEWGLLDEAQRHLYCDVMLENLALVASLDYGCGAEAEEASYEQSVYVAVLQSRTPKADPSIQKAN

SEQ ID NO: 24954 - protein, 81 aa, Tursiops truncatus
PQACVTFEDVAIYFSQEEWGLLDEAQRFLYHDVMLENFELTTSLDCQCGAEDEEIPSEQSVSGGESQVRTSQSVPSNQKTH

SEQ ID NO: 24955 - protein, 81 aa, Tursiops truncatus
AAVFEFLSVDYTQQKWKGLALSQRALYWNIMLENCCSLASLGENRMESSELPPKQELSKVLKSSDRTSVVLCGMIPGEPEA

SEQ ID NO: 24956 - protein, 81 aa, Tursiops truncatus
AAVFEFLSVDYTQQKWKGLALSQRALYWNIMLENCCSLASLAGENRMESSELPPKQELSKVLKSSDRTSVVLCGMIPGEPE

SEQ ID NO: 24957 - protein, 81 aa, Trichechus manatus
AQKLLTLEDVAVNFTWEEWQLLDPTQKELYWDVMLENYNNLISMGYQASKPHALSKLEQGEEPWIIEDEICSIVCPEMRKV

SEQ ID NO: 24958 - protein, 81 aa, Trichechus manatus
AHEEEEGIAPYLMANASFAGQQVCGAPHTVMPEVELTDQLFTVLPVDHELVTFRDVVISFSQEEWEYLDSSQKDLYWDVMM

SEQ ID NO: 24959 - protein, 81 aa, Equus caballus
MLENYRNLVSLGFPFSKPGIISRLEQVVNPWMQEGEVLSSSCTYLETRKSKPKKVFSEKESYQRINMERSTEADARTSSLK

SEQ ID NO: 24960 - protein, 81 aa, Equus caballus
MAVTFEDITVIFTWEEWRFLDSSQKKLYREVMWENYTNVLSVENWKESYKPQEERFRYLEHENLSCWQGWRNANTQIHENQ

SEQ ID NO: 24961 - protein, 81 aa, Equus caballus
AEGHVTFEDVAVYFSWEEWGFLDEGQRLLYHNVMLENFALMASLGLASSRTHEVTQWERWGEPFVPACGVMTAAMPRGCWH

SEQ ID NO: 24962 - protein, 81 aa, Aotus trivirgatus
AQESVTFEDVAVNFTDREWQCLTYAQRHLYKDVMLENYGNMVSLGFPVPKPPLISHLERGVEPCVQDPQDRESLSCSYPVS

SEQ ID NO: 24963 - protein, 81 aa, Sarcophilus harrisii
QEAVTFKDVYVDFSLAEWGCLGPDQRELYRDVMLENYRNLVSLGAEFPSAKPELISQLEQSGGEPRPQGGPPGDPCPDGRP

SEQ ID NO: 24964 - protein, 81 aa, Lipotes vexillifer
GWVPALFDEVAIYFSDEEWDVLTEQQKALYREVMRMNYETVLSLEFPFPKPHMITRLEREEESQNSDEWQFQGGTFAENEE

SEQ ID NO: 24965 - protein, 81 aa, Pan paniscus
ILKSQVRDVAVYFSWEEWDLLDEAQKHLYFDVMLENFALTSSLGCWCGVEHEETPSEQRISGERVPQFRTSKEGSSSQNAN

SEQ ID NO: 24966 - protein, 81 aa, Lipotes vexillifer
AQGSVLFEDVSVDFTQKEWQLLDRAQRLLYRDVMLENYRHLVSLGHCVSKPELILKLEQEEELWVLKGQLPSESHPEVQRT

SEQ ID NO: 24967 - protein, 81 aa, Pteropus vampyrus
PKVPVTFDDVAVYFSELEWGKLDEWQKELYKHVMRGNYEMLVSLDYAISKPDILTRMERGEEPCPEGLWGQEEGKESEAAR

SEQ ID NO: 24968 - protein, 81 aa, Pteropus vampyrus
RESGKAPVTFDDITVYLLQEEWMLLSQQQKEICGSDRLLAPLGATLANPEPFYKFERGPEPWLGSIQGRRHLLGHYPGKKM

SEQ ID NO: 24969 - protein, 81 aa, Pteropus vampyrus
MAMYLTREEWRPLDPTQRDIYRDVMQENYGNVVSLDFEIRSENEVNPKQEISENVEFGTTSERPVGNTEENPESEEVFESR

SEQ ID NO: 24970 - protein, 81 aa, Trichechus manatus
LQGPVIFEDVFVYFSQEEWGLLDEAQRLLYRNVMLENFALIASLGIASSRLHKVTQLEQGEEPWMPDQVDMIPAPARTAQR

SEQ ID NO: 24971 - protein, 81 aa, Trichechus manatus
LVTFEDVAVEFTQEEWALLDPSQRKLYRDVMLENSRNLASLDLESIPKVKELTSKQRVFRKKQTKHMKTERSHLGVKLNEC

SEQ ID NO: 24972 - protein, 81 aa, Trichechus manatus
AAGAVTFKDVTMAFTQKEWEQLEPVQRDLYKDVMLENYSNLASMGYEASKPDMISKLEKGEEPWLRKRKRPSQGGPSELAR

SEQ ID NO: 24973 - protein, 81 aa, Trichechus manatus
SMQSAVAFEDVAVYFSGDEWRLLNVTQRHLYRDVMLENFALIGSLGLAPSRSHVVAQLGSEEPWVPNMLDVILVSRAEARK

SEQ ID NO: 24974 - protein, 81 aa, Trichechus manatus
PVTFEDVSVVFTEAEWKRLSCEQKNLYKEVMLEIYRNLLSLAELKPELYPCSSCLLAVSCQQFLSQHVLQIFPGLCAENHF

SEQ ID NO: 24975 - protein, 81 aa, Trichechus manatus
FQESVTFKDVAVYFTQSQWASLDPAQRGLYKEVMLENYANVASLAEFPFLKPDLILQLERGEAPWGPDPWTLLGEEALRGI

SEQ ID NO: 24976 - protein, 81 aa, Trichechus manatus
AVVFEDVAVEFTQEEWALLDFSQRKLYRDVMMETFRNLDSVFKQDDNGQTFMKNDSSSSMLGKICEFHGIEHQYNNQGRHV

SEQ ID NO: 24977 - protein, 81 aa, Zalophus californianus
LLDLVTFEDVAVEFTREEWALLDPSQRTLYRDMMRENCRNLASLGNQVDKPGLVSELEQEDKVITEEIRILPGNCPDLETL

SEQ ID NO: 24978 - protein, 81 aa, Zalophus californianus
MKWGKPAGFLVFKPELISRLEQGQEPWVLDLKGVEGREGARTFLTDSAVGIAGEQACEDMDVLKSEPCVAMVRSPPQGFPQ

SEQ ID NO: 24979 - protein, 81 aa, Zalophus californianus
RFRTASCWDISVEFTWEEWQLLDSTQKYLYRDVILENYSHLVSVGYHGTKPDLIFKLEQGEEPWIINAKVSRQSCPEGWKE

SEQ ID NO: 24980 - protein, 81 aa, Equus caballus
LQAEVTFEDVAVLLSQEEWDRLGPAQRGLYRHVMMETYGNVVSLGLPGSKPSIISQLERGEEPWVLDGQGTEKSRGPGSSH

SEQ ID NO: 24981 - protein, 81 aa, Aotus trivirgatus
SVTFEDVAVNFTQEEWALLDPSQKKLYRDVMWETFRNLASIGKQKEWNVEEEYKNQGRNLRSHMVERFFESKEGSHGGESF

SEQ ID NO: 24982 - protein, 81 aa, Lipotes vexillifer
MAVTFEDVTVNFTWEEWKFLDSSQKKLYREVMWENYTNVMSVGNWKESYRLQEERFRYFEHEHLSCWQGWRNASTQIYDNQ

SEQ ID NO: 24983 - protein, 81 aa, Lipotes vexillifer
LQAPVTFEDVAVYFSREEWGILNLTQRSLYRDVMLENFALIGSLGNSPTRDPTRVAQMKGEEEPWVPNMLDMTVVSRAEAR

SEQ ID NO: 24984 - protein, 81 aa, Lipotes vexillifer
MFKDVAIDVSQEEWECLNPAQRNLYKDVMLENYSNLVSLGLSISKPAVISSLEQGKEPWMVMREVIGEQFPDLVSKRESKK

SEQ ID NO: 24985 - protein, 81 aa, Lipotes vexillifer
MMLENYQSLVSVGLCISKPYVISLLEQGKEPYEDPEFSKLCKVYRYVPSLLQPIIKETFAFLNLSDWESVYETQELPLKQF

SEQ ID NO: 24986 - protein, 81 aa, Pan paniscus
PQGHLTFTDVAIEFSQEEWKSLDPGQRALYRDVMLENYRNLVFLGICLPDLSIISMLKQRREPLILQSQVKIVKNTDGREC

SEQ ID NO: 24987 - protein, 81 aa, Pteropus vampyrus
SQGLLSFTDVFVHFTWEEWRLLDAAQKHLYRSVMLENYGNLVSLGYQHTKPDVIFKLEQEEELWMRQAQVPSQSPLDRVWE

SEQ ID NO: 24988 - protein, 81 aa, Pteropus vampyrus
PQSPVTLEDVAVCFSQEEWGLLDIAQRHLYHDVMLEIFELMISLGCWHGVEDEGACSEQNAVEGVSQVGILSAHPSTQKTD

SEQ ID NO: 24989 - protein, 81 aa, Pteropus vampyrus
ITGQLTLNDVFIEFSQEEWECLAPAQRALYREVMLESYRNMRFLGISVSDLYIVSILEQGKAPWTLESESNIAQKPNRWER

SEQ ID NO: 24990 - protein, 81 aa, Trichechus manatus
WGPLSFKDVFVDFTWEEWRLLDPAQKSLYRTVMLENYSNLMSLEKVREIDHNMEWQHENQGKLGSVAKGYEYTTFKKLCLS

SEQ ID NO: 24991 - protein, 81 aa, Trichechus manatus
AQGCVTFEDVAIYFSQEEWGLLDETQRLLYCNVMLENFALIASLGITSFRPNVVAQLEMEKEPWMPDRVDMTPAMARGAYR

SEQ ID NO: 24992 - protein, 81 aa, Trichechus manatus
VVFEDVAVNFSRAEWALLSASQRNLYKDVMLETFWNLASVDWCIQVKTTGSSPQQDLFGSEISNDEKRKKFMQKDSSSDLE

SEQ ID NO: 24993 - protein, 81 aa, Trichechus manatus
PQGSVTFEDVAVDFSQEEWELLDPAQRTLYREVMLETCRNLVSLGCSLCQPVAPPHLEQGEAVWMVDRGIPQAFCSDWETR

SEQ ID NO: 24994 - protein, 81 aa, Trichechus manatus
LQASVSFKDVAVELTQEEWQHMGPAQRTLYRDVMLENYNHLVSVGSCFTKPELIFRLEQGEDPWLLKEEFLNRSTPENCQH

SEQ ID NO: 24995 - protein, 81 aa, Trichechus manatus
SVTFKDVAVVFTEEELGLLNSAQKKLYQDVMVENFRNLVSVGGKNPRQMEIVPPAGAHEELSSSRIWQQIASDLTRCQDSV

SEQ ID NO: 24996 - protein, 81 aa, Trichechus manatus
PQDLVTFKDVAIDFSQEEWEWLNPTQRSLYKSMMLENYQSLVSLGLCISKPYIISLLEQGKEPWKVKSEMTRGPFLDWESI

SEQ ID NO: 24997 - protein, 81 aa, Trichechus manatus
IQGPVSFKDVTVGFTQEEWLHLDPAQRTLYRDVMLENYSHLVSVGYCVTKPEVIFMLEQGDEPWILEEESPCHIHPDFHIL

SEQ ID NO: 24998 - protein, 81 aa, Zalophus californianus
MPLAGCPVPRPELIYQLEHGQELWTWKRHLSQSAYPGDKGKPKTTELSPCAPALSEGALFQELRQGDPGNFHLGQTKDQSG

SEQ ID NO: 24999 - protein, 81 aa, Zalophus californianus
YQGRLTFRDVAIEFSEEEWECLDPAQRALYRDVMVENYRNLVSLGEDNVPPEVGICPKSSARFMIKELLPKKENNRKLCQL

SEQ ID NO: 25000 - protein, 81 aa, Zalophus californianus
QESVTFEDVAVDFTQEEWTLLDRSQRKLFRDVMLENISHLVSIDREDDLKKQEMIFVQHICKKDTTLISAMQRSHTQEDTF

SEQ ID NO: 25001 - protein, 81 aa, Zalophus californianus
KRKALLTFRDVAIEFSQEEWRCLNHTQRQLYRDVMLENYGHLLFLGLILSKPDLIMFLEQEKQLWDVRRKETVAFHPGRWE

SEQ ID NO: 25002 - protein, 81 aa, Zalophus californianus
KRKALLTFRDVAIEFSQEEWRCLNHTQRQLYRDVMLENYGHLLFLGFVLSKPDLMMFLEQEKQLWDVKRKETVAFHPGRWE

SEQ ID NO: 25003 - protein, 81 aa, Equus caballus
PKVPVSFEDVSVYFTKTEWKLLDLRQRILYKQVMLENYRHLVSLGFSSSKPHLVSQLERGQGPWVADVRRMGATTRMEAGD

SEQ ID NO: 25004 - protein, 81 aa, Papio anubis
YQDSVTFDDVAVDFTQEEWTLLDPSQRDLYRDVMLENYENLASVGRDLFKPSVICWLEEEEELRAEQRGVLQEWRLKTKGP

SEQ ID NO: 25005 - protein, 81 aa, Aotus trivirgatus
AQGQVNFEDVFVYFSQEEWVLLDEAQRLLYRDVMLENFALMASLGHTSFTSHTVASLWELGKGFWFSTNLHQHQKQHSGEK

SEQ ID NO: 25006 - protein, 81 aa, Aotus trivirgatus
KVSITFKDLAVRFSEEEWRLLEEGQREFYRDVMRENYETLVSVGTAELLPLSAFLSPSEPGGAAGGGSRADEGQEPAGCGG

SEQ ID NO: 25007 - protein, 81 aa, Papio anubis
KSLVTFEDVAVYFSQEEWELLDAAQRHLYHSVMLENLKLVTSLGCWHGVEGEEAHPKQNISVEEVLPVRIPNADSSTKKAN

SEQ ID NO: 25008 - protein, 81 aa, Aotus trivirgatus
SQESLTFKDVFVDFTLEEWQQLDSAQKNLYRDVMLENYSHLVSVGYLLAKPDMIFRLGPGDESWRADGGTPVRTCAGKVFQ

SEQ ID NO: 25009 - protein, 81 aa, Sarcophilus harrisii
PQKSLTSKELAVKFTQEEWEQLDPSQRNLYRDVLLERYRNLVLLGLPISKPDVISQLERGKEPWMLEREDSKGAHLDWDRP

SEQ ID NO: 25010 - protein, 81 aa, Pan paniscus
QGRLTFRDVAIEFSLAEWKCLNPSQRALYREVMLENYRNLEAVDISSKRMMKEVLSTGQGNTEVIHTGTLQRHRSYHIGDF

SEQ ID NO: 25011 - protein, 81 aa, Lipotes vexillifer
PLTFKDVAIEFSREEWECLDPDQKAFYVDVMLETYSNLISLDISHIHMIKKLQPGANSDRGEVFQTVMLERQKSHEMKHFY

SEQ ID NO: 25012 - protein, 81 aa, Pan paniscus
CEASVSFEDVTVDFSREEWQQLDPAQRCLYRDVMLELYSHLFSVGYHIPNPEVIFRMLKEKEPRVEEAEVSYQRCQEREFG

SEQ ID NO: 25013 - protein, 81 aa, Tursiops truncatus
VGVTFEDIALYFSWEEWKLLDEAQRRLYHDVMLENFALISSLGCCCGAEDAEAPFQQSISISMSQARTHREGSFSQKSHPC

SEQ ID NO: 25014 - protein, 81 aa, Tursiops truncatus
MMENYSNLVSLGHSISKPDIIVLLEQGKEPWMVVREETRNWSTGLDSSYKIISDRKTFIPGKHSSLLLHQRIHSGEKPYED

SEQ ID NO: 25015 - protein, 81 aa, Tursiops truncatus
QAQETLTFDDVTVDFTWEEWQLLTPPQKDLYQEVMLENYSNLLSVGYQARKPDVLSNLDHEEPWMMEDEIHCQTHSGYQAS

SEQ ID NO: 25016 - protein, 81 aa, Tursiops truncatus
MQENYRHLISVGYCVNKPNAVFKLKQGKEPWILEVEFPRQKYPEDLWNTHDQGARYQESQAKNSRNGELTKHQKTHTNEKS

SEQ ID NO: 25017 - protein, 81 aa, Tursiops truncatus
SEEEARKRRERKEKESEMALSQAPLTFKDVAIEFTQEWERLDPAQRALYRDVMEETSRNLLSVGEKTRVQKRSFPIPGRME

SEQ ID NO: 25018 - protein, 81 aa, Tursiops truncatus
RDPPEGSVTFEDVAVNFSLEEWGLLDEAQRCLYHDVMLENLALTTSPGCWHGEEDEEALSEQSISDQGSSQIRIVKAGTLM

SEQ ID NO: 25019 - protein, 81 aa, Tursiops truncatus
YQGLVSLEDVAVNFTWEEWQDLDDAQRTLYRDVMLENYSSLVSLGHCITRPEVIIKLEQGAAPWTVKEKPQTRVSRCQCTL

SEQ ID NO: 25020 - protein, 81 aa, Zalophus californianus
AHRSMTFRDVAIDFSQQEWEYLDSLQKNLYRDVMMENYDNLVSLAGHSISKPDVITLLEQGKDPWMVVREDTRRWCTDLES

SEQ ID NO: 25021 - protein, 81 aa, Zalophus californianus
MIKSQISFEDVAVGFTSEEWQLLNPSQKSLYREVMLENYSNLVFLGCQIIKPDAIFKLEHEEPWIIDEEVLSQNFSEEVWL

SEQ ID NO: 25022 - protein, 81 aa, Zalophus californianus
PKVPVSFEDVSVYFTKTEWKLLDLRQRILYKRVMLENYRHLASLGFLSSKPHLVSWLEQGEGPRAAGTCRTRAAAGMQKGD

SEQ ID NO: 25023 - protein, 81 aa, Equus caballus
LLQGSVSFKDVTVAFTQEEWQHLDPAQRTLYRDVMENYSHLVSVGYCITKPEVVFKLEQGEEPWVLEDESSSQSPPGELGL

SEQ ID NO: 25024 - protein, 81 aa, Equus caballus
AQDSVTFHDVAVYFSRGEWRLLDEAQRRLYLDVMLENFALLSSLGCCCGAEGLEAPFEQSISVEVPLARTPEAAPSSQKTH

SEQ ID NO: 25025 - protein, 81 aa, Papio anubis
GTVTFEDVAVNFTQEEWNLLSEAQRCLYRDVMLENQALISSLGCWCGVEDEEAPSKQSIYIQRETQVRIPMAGVSLKKAHP

SEQ ID NO: 25026 - protein, 81 aa, Aotus trivirgatus
PQGHLTFMDVAIEFSQEEWRCLDPAQQALYRDVMLENYRNLVSLGICLPDLSIISMLEQRREPSTLQGEVKIVKIQDGREC

SEQ ID NO: 25027 - protein, 81 aa, Aotus trivirgatus
MEPLEFRDVAIEFSLEEWHCLDTAQRNLYWDVMLENYRNLVFLGIVVSKPDLITCLQQGKKPLTVKRHEMIATPPVTYSHF

SEQ ID NO: 25028 - protein, 81 aa, Aotus trivirgatus
FQEMVTFKDVAVVFTEEELGLLDSVQRKLYRDVMLENFRNLLLVAHQPFKPDLISQLEREEKLLMVDTETPRDGCSGRKNQ

SEQ ID NO: 25029 - protein, 81 aa, Aotus trivirgatus
STLSISFKDVTVDFSRDEWQQLNVAQKSLYRDVMLENYFNLISVGCQVPKPEVIFNLEQEEPCMLNGGNSSQSCPDGKIGF

SEQ ID NO: 25030 - protein, 81 aa, Aotus trivirgatus
SQEPVTFEDVAVDFTREERQQLNPAQKTLHRDVMLETYSHLVSVGCSGIKPEVIFKVEHGKDPWIKDSELSRWIYPDREKG

SEQ ID NO: 25031 - protein, 81 aa, Sarcophilus harrisii
FHQLVTFEDVAVYLSKEEWKRLNLAQRELYRDVMLENYENLLSLGFPVSKPDIISQLEQRKEAWIVQGPEKRKFSQNAHRD

SEQ ID NO: 25032 - protein, 81 aa, Lipotes vexillifer
RSQESLTFQDVAVEFTREEWVQLYPAQKNLYRDVMLENYRNLVALGHQLYKPEVITQLEQEEQWMMERDSPPDTHPDGENS

SEQ ID NO: 25033 - protein, 81 aa, Lipotes vexillifer
TALGSVTFEDVAVYFSQEEWRLLDEAQRFLYHDVMLETFALVASLGLAFSRSHVVQVKLGGEPWVLDRVDMTPAFHNEQRH

SEQ ID NO: 25034 - protein, 81 aa, Lipotes vexillifer
PLESVTFEDVAINFTQEEWALLDTSQKTLFRNVMLENITHLVSVGYQIGKSDVVSQLEQGKELWSEATRCLQGQSPDGESP

SEQ ID NO: 25035 - protein, 81 aa, Pan paniscus
MLRRGHLTFRDVAIEFSQEEWKCLDPAQRTLYREVMVENYRNLVFLGEDNVPSEQRRDPRNLQSEVKIANNPGGRECIKGV

SEQ ID NO: 25036 - protein, 81 aa, Pteropus vampyrus
MGPAHRTLYRDVMLENCSHFVSMGYCITKPQVIFKLEQGEEPWSLEEEFPNQRCPGGHIPAAQLKAETHPGQDTIPSQGAF

SEQ ID NO: 25037 - protein, 81 aa, Pteropus vampyrus
SVAFEDVAVNFTPEEWALLDPSQKKLYRDVMRETFENLASVGKRMEDYDIEDQYKNQERKLRSHIEERICESEASGQCEEN

SEQ ID NO: 25038 - protein, 81 aa, Pteropus vampyrus
KSQEFVSFKDVTVDFTWEEWQQLDSAQRNLYRDVMLENYSNLVSVGYPSLKSDKILLKQREPWTEEGEISNWAYPDFEIRP

SEQ ID NO: 25039 - protein, 81 aa, Pteropus vampyrus
SSLLPQEIIIKVEREDAGSLAVPSQEGVNFKIVTVDFTREEERTLKHVQRTLDRGVILENHKDLVSWGCLIFLFSRLSNCI

SEQ ID NO: 25040 - protein, 81 aa, Pteropus vampyrus
AQGLMVFEDVAVYFCEEEWDLLDAAQRALYCHVMLENFALVASLGLSASRPRVVTQLERGEEPWVLSGTDVTLARNAQRRP

SEQ ID NO: 25041 - protein, 81 aa, Pteropus vampyrus
MLENYGHLVSLGFPLFKPKLISLLQQGEEPWKVEEGSRRGSWLGSKSSPKTTKSTQTQDSSFWGLIKKRLKRDEPWNFLSE

SEQ ID NO: 25042 - protein, 81 aa, Pteropus vampyrus
YQEFVTFEDVAVHLTREEWGCLDPVQRDLYREVMLENYGNVVSLGFPISKPDGISQLEQDLQVFDLETKNREVLRDGCSDG

SEQ ID NO: 25043 - protein, 81 aa, Trichechus manatus
SVVFEDVAMDFTQEEWALLDFSQRKLYKDVMVETFRNLDSVSHQDNNGQKLSIEHIIVRFMENDSCSPVVGEICEFLDYEN

SEQ ID NO: 25044 - protein, 81 aa, Trichechus manatus
APLPLTFEDVAVYFSEQEWQNLKAWQKDLYKHVMRANYETLASLGDGIPKPELISWIEQGREPFRNWGESQKCENIICSSA

SEQ ID NO: 25045 - protein, 81 aa, Trichechus manatus
MLENYGNLVSMGYEVSKPDALSRLERGEQPWTVLDESHSRTFSEIWIFDNHLPEHMKNENRMDKMKQCYEHNTLENIVHQH

SEQ ID NO: 25046 - protein, 81 aa, Trichechus manatus
SVIFEDVAVDFTREEWALLNFAERKLYRDVMMETFRNLASVVSQQVDNGQMVSSEHLIMRFMKNNSQYTMLGEICESHGIE

SEQ ID NO: 25047 - protein, 81 aa, Papio anubis
FQESVTFQDVAVDFTAEEWQLLDCTERTLYWDVMLENYRNLISVGCPINKTEVILKVEQGQEPWMVEGANPHQSSPGWSTV

SEQ ID NO: 25048 - protein, 81 aa, Sarcophilus harrisii
RSQSVTFRDVAVDFTQEEWRRLAPAQRDLYRDVMLENYHNFASLGLPVFKPDVISQLERGEGPWTPEAEVPQVTCPESLVQ

SEQ ID NO: 25049 - protein, 81 aa, Lipotes vexillifer
QQGLLSFNDVAVDFTWEEWQLLDIVQKNLYRDVMLENYSNLMSLGYQVTKPEPVMHLEKGKEKEKEVVEREFPIQCGPGEK

SEQ ID NO: 25050 - protein, 81 aa, Lipotes vexillifer
FQEAVTFKDVAVTFTEEELGLLDSAQRKLYQDVMVENFRNLVSVGHLPFKPDMVSQLETEEKLWMMERETQRNGHSSENRR

SEQ ID NO: 25051 - protein, 81 aa, Lipotes vexillifer
FEGSVSFEDVAVNFTRQEWYRLDPAQRTMHKDVMLENYSNLASVGLCVAKPDMIFKLERGEELWILEEEFSGHGYPGSLSL

SEQ ID NO: 25052 - protein, 81 aa, Lipotes vexillifer
MLENYQNLLALGPPVCKPDVISHLERGEEPWWAPRAVPGGAGPEPEWEPEPEVEEPWSQQLCVYKEEPSWELIAGGLARSG

SEQ ID NO: 25053 - protein, 81 aa, Pan paniscus
SQGRVTFEDVTVNFTQGEWQRLNPEQRNLYRDVMLENYSNLVSVGQEETTKPDVILRLEQGKEPWSEEEEVLGSGRAEKNG

SEQ ID NO: 25054 - protein, 81 aa, Tursiops truncatus
SRDSVTFADVAVDFTQEEWTLLDPIQRKLYRDVMLENYKNLTTAGYQSLKPTLISWWEQEDDLRTAERKGVLQDSAIQQDN

SEQ ID NO: 25055 - protein, 81 aa, Tursiops truncatus
SQELLTFKDISVDFTQEEWGQLAPAHRNLYREVMLENYGNLVSVGYQLSKPGVISQLEKGEQPWLMEREISGGPSPDLEDE

SEQ ID NO: 25056 - protein, 81 aa, Tursiops truncatus
LQGSLTLKDVAVDFTWEEWQLLDPDQKDLYRDVMLENYSNLVSVGYQVNKPDILSKLEQGEPPWTLEDEVHSHPHPEIDKV

SEQ ID NO: 25057 - protein, 81 aa, Pteropus vampyrus
LLTFEDVAISFSEEEWKLMDPAQKMLYSDVMQENYETVISLGLKLKKDTGNDQPISTSTLEIQASGCKVLRKARMKVAQKT

SEQ ID NO: 25058 - protein, 81 aa, Pteropus vampyrus
MSENYSNLVSVDHSPIQRACLFCHFPRTGYQVSKPDALSRLEQGEPWAVEDEVHSRICPEIQKDNVHLQGHLQNQRCLKRM

SEQ ID NO: 25059 - protein, 81 aa, Pteropus vampyrus
LQESISFEDLSVDFTQKEWQLLDPYQKDLYKDVMLENYGSLVSLGYEVVKPDIIFKLEQGEEPWVGDGAVPRSAPLEQVLQ

SEQ ID NO: 25060 - protein, 81 aa, Pteropus vampyrus
MEFTWEEWQLLDPTQRYLYREVILENYHNLVSVGYHGTKPDLIFKLEQGEEPWILSARISHESCAEGWKEWYQKNQDELQS

SEQ ID NO: 25061 - protein, 81 aa, Trichechus manatus
MRANYETLASLGDGIPKPELISWIEQGREPFRNWGESQKCENIICSSANIHFDTVLEGQLFWVSGCWPAVKAGEREGHFLR

SEQ ID NO: 25062 - protein, 81 aa, Trichechus manatus
SQASVSFKDVAVELTQEEWQHMGPAQRTLYRDVMLENYSHLVSVGYCLIKPEVIFQLEQGEDPWSLEEEFPNQSCPGYCKV

SEQ ID NO: 25063 - protein, 81 aa, Trichechus manatus
AQGTLSFEDVAVGFTWEEWQLLDLSQKDLYKDVMLENYNNLVSVGYQGTKPDSVFKLEQGETPWIVEGGIHSGTSPEEIWA

SEQ ID NO: 25064 - protein, 81 aa, Trichechus manatus
MLENYSNLMSLGYQHTKPDIIFKFKQGEELRMIKAQIPNQSFPEKVREIDHNMEWQHENQGKLGSVAKGYEYTTFKKLCLS

SEQ ID NO: 25065 - protein, 81 aa, Trichechus manatus
QAAVTFEDVAVLLSREEWCRLAPAQRDLYRDVMLETYRNLISLGTGLTGPKPGVISQLERGHEPWVLDVQSTKGRVDGSDC

SEQ ID NO: 25066 - protein, 81 aa, Trichechus manatus
SVVVEDVAVEFTQEEWALLSLAQRKLYKEVMMETFRNLASVISQNLNGGKKLSSEYVIVEFMKNDIWSSMLEGICELRGVE

SEQ ID NO: 25067 - protein, 81 aa, Zalophus californianus
VRMPVTFEDVAVTFTQEEWGQLDPAQRTLYQEVMLETCGLLVSLGCPLPKPELFYPLDHSPELQTLKRGLSPNSCPGDSTK

SEQ ID NO: 25068 - protein, 81 aa, Zalophus californianus
QAEVTFEDVAVLFSREEWGRLGPAQRGLYRDVMLETYRNLVSLGHGTRTEYKELSSGEMLDEEELDQLQRAVPQGPDPGET

SEQ ID NO: 25069 - protein, 81 aa, Zalophus californianus
IEGSLTFGDVAVALTQFEWKHLDATQQALYRDVMLENYGNLVSVGLLSSKPKLITQLEQGAEPWMQVQQIPSDTCSVQEYW

SEQ ID NO: 25070 - protein, 81 aa, Papio anubis
SLKKVTFEDVAIDFTQEEWAMMDTSKRKLYRDVMLENVSHLASLGYQISKSYVTLQLEQGKELWREGREFLQGQNLDKESA

SEQ ID NO: 25071 - protein, 81 aa, Lipotes vexillifer
GLSSFKDISMEFTWEEWQLLDSAQKHLYRDVTLENYSNLVSVEGWKEWYQKNQDELESVERSYACNAFGKLHLSKSHISSR

SEQ ID NO: 25072 - protein, 81 aa, Lipotes vexillifer
LQVSVSFEDVAVDFSREEWQQLDSTQRRLYQDVMLENYSHLLSLGCEIPKPEVIFKLEQGEEPWTLEEETPHQSCSDEKFG

SEQ ID NO: 25073 - protein, 81 aa, Lipotes vexillifer
LQGPVSFTDVAVDFTQEEWQQLDPEQKTTYRDVMLENYSHLVSVGCHIIKPEVITKLEKGEEPWIVRGEFLLQSCPEEDWE

SEQ ID NO: 25074 - protein, 81 aa, Callorhinus ursinus
ALALITFKDVAVTFTGEEWRHLDLAQRTLYREVMLETCGLLVSLGHPVPKPELTYLVEDGQELWTVRRGLSKSTYTGEKAK

SEQ ID NO: 25075 - protein, 81 aa, Tursiops truncatus
NQGQVTFEDVAITFSREEWECLDPAQRALYRDVMLETYGNLLSLVRISVSVVNIVSILEQGKELWALQSEVKNSKKSNEWE

SEQ ID NO: 25076 - protein, 81 aa, Tursiops truncatus
MLENYRSLVSLGLCVSKPKMISSLEQRKEPWVAKRTLTRGGCPDSRALPKTKELSSKKSFCEEKSSQAVLMERPTTYSLEC

SEQ ID NO: 25077 - protein, 81 aa, Tursiops truncatus
GEFVTFEDVAVHLTREEWGCLDPVQRALYREVMLENYGNLVSLDGETREENKLLIPKQKIPEEVHSYKVRVGRLKKDIAQV

SEQ ID NO: 25078 - protein, 81 aa, Trichechus manatus
VVFEDVAMDFSQEEWALLDLAERKLYRDVMVETFRNLAAVVSRNLNDGEKLSSEPIMLQYLENKTWLSVLEICELHSNVDH

SEQ ID NO: 25079 - protein, 81 aa, Trichechus manatus
MYPQESGTIKDEAVDFTHGEWALLDTSQWKLYNMENINHLVSTGYHLCQSDVISHSRQGEELWRDKRELIQNQSPGSQQTQ

SEQ ID NO: 25080 - protein, 81 aa, Trichechus manatus
FQESVTFEDVAVYFTQSQWASLGPLQRALYREVMLENYANVASLAFPFPKPVLISQLEREEAPLGPDPWETEVLRDICPGG

SEQ ID NO: 25081 - protein, 81 aa, Trichechus manatus
SVVIEDVVVVFTQEEWALLDLAQRKLYRDVMMETFRNLASVVSENVNDGEKLPSERIIVQFMKNNSSSSVLGKIFKLLVSE

SEQ ID NO: 25082 - protein, 81 aa, Trichechus manatus
SQNSLTFEEVAVEFSQEEWALLNPAQKNLYRDVMLENFRNLASLDWETQLKSKDAMAMQNVPGKKTSNGIKMAPAQPGKKL

SEQ ID NO: 25083 - protein, 81 aa, Trichechus manatus
VVFEDVAVDFTLEEWALLDPAQRKLYKDVMLETFRNLASLDDETPFKANESVSQQDIYVKKLSKEHKTTKFTRSDSQTSIL

SEQ ID NO: 25084 - protein, 81 aa, Zalophus californianus
AHGSVTFRDVAIDFSQEEWEFLDSAQRDLYRDVMWENYSNFISLGEPSISKPDVITLLDEGKEPWMVVREGTRRHYSDLES

SEQ ID NO: 25085 - protein, 81 aa, Zalophus californianus
MLENYGTLVSLGIPFSRPKVICQLQEGEDPCVVDRELPWDACLGLKTRPEMEALPPRQGISREETSQGIIKKRSVKCGLWD

SEQ ID NO: 25086 - protein, 81 aa, Pan paniscus
VTFEDVAVYFIRKEWKRLEPAQRDLYRDVMLENYGNVFSLDWIHVSLTTQKVMLAWLTGTLSVAKGLCSSELVSVEPPDTF

SEQ ID NO: 25087 - protein, 81 aa, Lipotes vexillifer
LVTFRDVAINFSQEEWEYLDPIQRDLYREVMVENYSHLISLDLEYSCETKRSCPEKGTCEMESLQWENMRKPISHNLECND

SEQ ID NO: 25088 - protein, 81 aa, Callorhinus ursinus
VHQALLTFRDVAIEFSQEEWGCLNHTQRELYRDVMLENYGHLLFLGLIVSKPDLVSFLEQKKEPWDVKRKKTVAIPRGRWE

SEQ ID NO: 25089 - protein, 81 aa, Callorhinus ursinus
MLETYSNLVSLGLAIAKPDVISFLEQGKEPWVVEKMSRGGLCPVLESRYDTKVSSPEQHIYEIQSPQWEIMESLTSYGLEC

SEQ ID NO: 25090 - protein, 81 aa, Callorhinus ursinus
VTGFPATWLQVPVTFKDAWMMLDSDQRRIYRDVMLENYMNLTSVEYQLGKPTMISPLGQEEIRTMKRRLLAGTYPDWEIQL

SEQ ID NO: 25091 - protein, 81 aa, Callorhinus ursinus
RWAGREAEVVCAVLLNFLGPAEDSAAVRLEVRRLVTLSFKDVVVDFTSEEWQLLDAVQKNLYWDVILENYSNLLSVGKDPW

SEQ ID NO: 25092 - protein, 81 aa, Callorhinus ursinus
RESGKAPVTFDDITVYLLQEEWMLLSQQQREICGSDKLVAPLGPTIANPELFYKFEQGPEPWLGNVQSQRNVLSHHPGKNK

SEQ ID NO: 25093 - protein, 81 aa, Tursiops truncatus
GQLTLNDVAIEFSPEEWECLDPAQRALYRDVMLETYRNLISVDISHIHVVRKLQLKSNIDRGGVFQTVILGRHEIQEPFYL

SEQ ID NO: 25094 - protein, 81 aa, Tursiops truncatus
KGFEGGVTFQDIAMYFSWEEWGLLDEAQRRLYLEVMLENSALVSSLKRFPPFSDFRSPAMHSSHFFRVQPACLQKYPWTHA

SEQ ID NO: 25095 - protein, 81 aa, Pteropus vampyrus
SQDPVTFEDVAVYFSREEWSLLNSTQRCLYRDVMLENFALIISLGFAPSRAHVVAQLEGEEEPWVPSIVDMTLVSRAEAGR

SEQ ID NO: 25096 - protein, 81 aa, Trichechus manatus
SVVFEDVTVDFTQEEWALLDFSQRKLYRDVMMETFRNLALVVSQQVGNGQMMSSEHLIMRFMKSNSWYSRLGETCEFCGIE

SEQ ID NO: 25097 - protein, 81 aa, Trichechus manatus
SQASVSFKDVAVELTQEEWQHMGPAQRTLYRDVMLENYNHLVSVGYNFTKPEVIIKLEQGEDPWLLEEEFLNKNSPEVCQL

SEQ ID NO: 25098 - protein, 81 aa, Trichechus manatus
YVTFEDVAINFTREEWGQLDLTQRTLYLEVMLEICGLLVSLGGKAKLESTEPTTPELALSEGASDQGRLTQVVSKDCQLGR

SEQ ID NO: 25099 - protein, 81 aa, Trichechus manatus
PQELLTFRDVAIEFSQQEWECLEPAQRALYRDVMLENYRNLISLGISPSEMNIISILKKGTEPWTVKKKMKLAKNSDVLSP

SEQ ID NO: 25100 - protein, 81 aa, Trichechus manatus
LVKIEDVADVAVSFILEEWGHLDQSQKNHYRDDRKENYGSIASIDYESRNENMELIVEQNSDEAESHWMTSGSTERNVPQS

SEQ ID NO: 25101 - protein, 81 aa, Trichechus manatus
KVPVTFVDIAVYFSEDEWKSLDGWQKELYNNLIKENYKTLMSLDAEDPAPKPDAPPQVEPREEPCVWEQRNPEERDIPMDP

SEQ ID NO: 25102 - protein, 81 aa, Trichechus manatus
ESVTFKDVAVDFTLEEWALLDTSQRKLFRDVMMENIDHLVFVGGETGLNKEEMVSLQHISRKDTPTIMALQRSLTGEDTFE

SEQ ID NO: 25103 - protein, 81 aa, Trichechus manatus
KESMTFKDVAVVFTEEELGLLDSDQRKLYQDVMLENFRNLVSVGGQIQSEMETAPDARPCDALSCWQIWQQSTSDLTRCQG

SEQ ID NO: 25104 - protein, 81 aa, Trichechus manatus
FQGLMMFRDVFINFSLEEWECLDSGQMDLYTEVMLENYSNLVSVGLSSSKPAVISLLEQGKEPWMVDRELTRGLCSDLESM

SEQ ID NO: 25105 - protein, 81 aa, Trichechus manatus
SQVLLTFRDVAIEFSQEEWDYLDPAQRTLYRDVMLENYRNLLSLAGISPSEINIVSILKKGTEPWTVEKTAKLAENPDVIS

SEQ ID NO: 25106 - protein, 81 aa, Trichechus manatus
TQVSLTFDDVAVKLTWEEWQLLDPAQKDLYRDVMLENYSNLVSVGYQVSKPDALSRLERGEPPWSIEDKIHTRTFSGERPY

SEQ ID NO: 25107 - protein, 81 aa, Trichechus manatus
SQGLLTCRDVAIEFSQEEWDCLDPAQRALYRDVMLENFRNLVSLGISPSGMNIIPILKERTEPWTVVKKMDKANYPEPTQA

SEQ ID NO: 25108 - protein, 81 aa, Zalophus californianus
LQESLTLEDVAVDFTWEEWQLLAPAQKDLYRDVMLENYSNLVSVGYQASKPDALSKLERGEEPCTKQEEVPSGTRPEPSKV

SEQ ID NO: 25109 - protein, 81 aa, Lipotes vexillifer
PEGSLSFRDVTVGFTQEEWQHLDPAQRTLYRDVMLENYSHLISVGFCIPKPEVIFKLEQGEEPWILEEESPGQSVPELINS

SEQ ID NO: 25110 - protein, 81 aa, Lipotes vexillifer
SRELLTFKDISVDFTQEEWGQLAPAYRNLYREVMLENYGNLVSVGYQLSKPGVISQLEKGEEPWLMEREISGGPNPDLEDE

SEQ ID NO: 25111 - protein, 81 aa, Lipotes vexillifer
NFWILRLPPGSKGEAPKEWGNLSEWQKELYKHVMRGNYETLVSLDYAISKPEVLSQIEQGKEPCSWRRTGPKVPDVPVDPS

SEQ ID NO: 25112 - protein, 81 aa, Lipotes vexillifer
PQACVTFEDVAVYFSQEEWGLLDEAQRFLYHDVMLENFALTTSLDCQCGAEDEEIPSEQSVSGGESQVRTSQSVPSTQKTH

SEQ ID NO: 25113 - protein, 81 aa, Pteropus vampyrus
KQEMLSFEDVAMYFTREEWNKLDWTQKDLYRDVMLENYRNMILLGFQFPKPEVICQLEQWEDPWILDLPRAGTRKSSSSAC

SEQ ID NO: 25114 - protein, 81 aa, Pteropus vampyrus
SASQTCAPCRLPVPGTGDFRDVAIGFSHEEWECPDPAQRDLYQDVMLENYSNLVSLDLGSNYGAEKLSPETDVYEINLPRV

SEQ ID NO: 25115 - protein, 81 aa, Pteropus vampyrus
MFKEAVTFKDVAVAFTEEELELLDSAQRKLYQDVMLENFKNLVSVGYQPFRRDISYIEREERLWMMKTELQIDKKKKIGKN

SEQ ID NO: 25116 - protein, 81 aa, Trichechus manatus
AQGSLSFEDVAVGFTWEEWQLLDPSQKDLYKEVMLENYNNLVSVGYPATKPDSIFKLEQRETPWIVEGAIHSQSSPEKIWA

SEQ ID NO: 25117 - protein, 81 aa, Trichechus manatus
SVAVEEVAVNFTQEEWALLDLSQRQLYRDVMMEIFRSLASVASQNLIDGDKLSTENTILRFMKNDTWSSIVGEIFELLVTE

SEQ ID NO: 25118 - protein, 81 aa, Trichechus manatus
PQESVTFKDVAVYFTQKEWASLVPAQKALYRDVMLENYEAVAFLVSPASKPALISQLEQGEEPGFSQPQGALSRRGRRAGL

SEQ ID NO: 25119 - protein, 81 aa, Trichechus manatus
SVVVEDVAVEFSQEEWALLDLAQRKLYRDVMMETFRNLASVVSRNFNDGERLSSEHIMVRFMKNNIWSSMLGAISESHDNK

SEQ ID NO: 25120 - protein, 81 aa, Trichechus manatus
SQGQVTFEDVAVDFTQEEWQYLDPPQRTLYRDVMLETYSNLVCVEHQVTKPDLIFKLELEEPSPAEGKIPIWSFPEEDCQV

SEQ ID NO: 25121 - protein, 81 aa, Trichechus manatus
MDPAQRILYRDVMLENYSHLVSLGYQVSKPEVIFKLEQGEEPWISEEEIQRPFCPDWETPEAKSSKPQQGISTISCNTDDL

SEQ ID NO: 25122 - protein, 81 aa, Trichechus manatus
NQESLTFNDVAMEFTLEEWRLLDPAQKKLYWDMLLENYRNLVSIGYQVSKPHALSRLEQGKQPWNVSEESHHGIFSGRQKV

SEQ ID NO: 25123 - protein, 81 aa, Trichechus manatus
FEGSVSFEDVAVDFTRQEWHGLDPAQRTMHKDVMLENYSNLASVGLCVAKPEMIFKLERGEELWILEEESSGHNYSGSLSL

SEQ ID NO: 25124 - protein, 81 aa, Zalophus californianus
HQALLTFRDVAIEFSQEEWGCLNHTQRELYRDVMLENYGHLLFLGLIVSKPDLVSFLEQKKEPWDVKRKETVAFHPAISSH

SEQ ID NO: 25125 - protein, 81 aa, Equus caballus
LSCKKCAGHGSVSFEDVTVDITQDEWLQLTLMQRTLYPDVMLEDYSHLVSVREECSLCNASQHAFLFLLLSCQNLWAFGGV

SEQ ID NO: 25126 - protein, 81 aa, Equus caballus
MDPAQRIRYSDVILTGYCSTKPRVIFKLEQGEEPWSLEEEFLNQRYPGYYKVDVHLEGNREKEEKPLWQVIFMDNKRLSKE

SEQ ID NO: 25127 - protein, 81 aa, Loxodonta africana
VTFRDVAIAFSQEEWECLDPAQRDLYVDVMLENYSNLVSLGNQSFTPNIIPQLEREEKLWMITPATQRDSSSGAKNLNEME

SEQ ID NO: 25128 - protein, 81 aa, Loxodonta africana
DFLTAGSQVSDLLLVEPTLGSGHTPQKPRDCEGEVEEEGEGVWTGAGYPIPKPDLIFRLEQGEEPWVPDSPHPEEGDIVTG

SEQ ID NO: 25129 - protein, 81 aa, Capra hircus
RAVKFGDVALYFSREEWGCLRPAQRALYRDVMQETYGHLGALGATPNKKEEEPEAGLGAKAPRKAPGKERPEELVKHNPGT

SEQ ID NO: 25130 - protein, 81 aa, Capra hircus
PQDLVTFKDVAVDFSQEEWQWLSPAQRSLYRSMMLENYQSLVSLGLCISKPSVISLLEQGKEPWMMMENELRSPFPDWESI

SEQ ID NO: 25131 - protein, 81 aa, Capra hircus
MTFEDVAVEFTWWEWGQLDPTQKDLYREVMLENFKNLASLGFPVSKPYMICQLEEGEEPCILERAISTGVHSDWERRPQAK

SEQ ID NO: 25132 - protein, 81 aa, Pan paniscus
MFLDVAIEFSLEEWQCLDTIQQNLYRNVMLENYRNLVFLGIVVSKPDLITCLEQEKEPWTRKRHRMVAEPPVICSHFAQDF

SEQ ID NO: 25133 - protein, 81 aa, Pan paniscus
SILKSQVRDVAVYFSWEEWDLLDEAQKHLYFDVMLENFALTSSLGLTLSWSHVVAQLGLGEVPSVLHRMFMTPASARWDQR

SEQ ID NO: 25134 - protein, 81 aa, Pan paniscus
MMTFRDVAIDFSQEEWKWLQPAQRDLYRCVMLENYGHLVSLGLSISKPDVVSLLEQGKEPWLGKKGISESSGEIKDFSPKN

SEQ ID NO: 25135 - protein, 81 aa, Tursiops truncatus
SVTFEDVAVYFSQEEWRLLDEAQRFLYHDVMLETFALVASLGCWHGAEVKETPSEQNVFVEVPRINTSKTNLSTQEAYPWE

SEQ ID NO: 25136 - protein, 81 aa, Tursiops truncatus
SQGPVSFEGVSMGFTQEEWQHLDPAQRTLYRDVMLENYSHLISVGYCVIKPEAIFKLQQGEEPWMLEEESQSQSHPDFCIV

SEQ ID NO: 25137 - protein, 81 aa, Pteropus vampyrus
FQEPVTFKDVAVFFTEEELGLLDASQRKLYQDVMLENFKNLVSAGHLPFKPDIVSQLETEEKLWMMERETPRNGNSGSKNQ

SEQ ID NO: 25138 - protein, 81 aa, Pteropus vampyrus
MQEQVTFEDVVVYFSQEEWGLLDDTQRLLYRDVMLETFALTASLGCWHRIEEEEIPFEQKVSVEGVSQIRTPKAVPSTQKA

SEQ ID NO: 25139 - protein, 81 aa, Pteropus vampyrus
MGPAHRTLYRDVMLENCSHFVSMGYCIPKPQVIFKLEQGEEPWSLEEEFPNQRFPGGHIPAAQLKAETHPGQDTIPSQGAF

SEQ ID NO: 25140 - protein, 81 aa, Pteropus vampyrus
SVAFEDVAVNFTPEEWALLDPTQKKLYRDVMRETFENLASVGKRVEDYDTEDQYKNHGRKLRSHIEERIYESEASGQCEEN

SEQ ID NO: 25141 - protein, 81 aa, Pteropus vampyrus
PEESVTFKDVAVDFTQEEWGQLDSPQRALYRDVMLENYQNLLALGPPVCKPDVISHLEREWEPRPEMKEESCQQQVIYKEE

SEQ ID NO: 25142 - protein, 81 aa, Pteropus vampyrus
SRSLENDGVCFSEQEWENLEDWQKELYRNVMKSNYETLVSLKVLGQPEGEAELGTEMLGDLEEEGPGGVHPEGVMIKQETQ

SEQ ID NO: 25143 - protein, 81 aa, Pteropus vampyrus
FQGLLSFKDVAVDFTREEWQLLDTVQKNLYRDVMLENYSNLMSLGYQAAKPGAVVHWEKEEQGLVEREFPSHFSSEVIWQV

SEQ ID NO: 25144 - protein, 81 aa, Pteropus vampyrus
VTTVLLTPASQKSVLIGDMAEALTQWGQRHPPRGHMQEKHRNLVLLGLPISKPGVISQVEHGEELERKVPKATSPDWETRP

SEQ ID NO: 25145 - protein, 81 aa, Pteropus vampyrus
AVTFADVAVSFSREEWRLLDEAQRRLYLAVMLENFALVSSQGCCCGAEDVEASIEPSISVGASHGGTPKEPSSSQKTHPCE

SEQ ID NO: 25146 - protein, 81 aa, Pteropus vampyrus
MLFWSLSFRLVLESCSTQRHATPSPQAGPPVCKPDVISHLERGEEPWQVPREVPGGAHPEWEPRPEMKEESCQQQVIYKEE

SEQ ID NO: 25147 - protein, 81 aa, Pteropus vampyrus
LSQGLVTFKDVAVCFSQDQWSDLDPTQKEFYGEYVLEEDCGIVVSLSFPIPRLDEISQVREEPLVPDILELQEPQEPEILS

SEQ ID NO: 25148 - protein, 81 aa, Pteropus vampyrus
WLQGPVTFKDVAVEFTQEEWMMLGSAQRSMYKDVMLENYINLISVEYQLCKPTVISLLGQETGTMKRIPQDTYPDWEIQIK

SEQ ID NO: 25149 - protein, 81 aa, Trichechus manatus
SVAVEDVAVDFTQEEWALLDFSQRQLYRDVMMEIFRSLASVASRNLIDGDKLSTENIIVRFMKNDTWSSVVGETCELHGTE

SEQ ID NO: 25150 - protein, 81 aa, Trichechus manatus
AQESVTFNDVAVEFTWEEWQLLLPAQKDLYQDVMLENYSNLVSVGYQVSEPNAPCKLKRGEQPWPIQDEIHSQNFSEIWKA

SEQ ID NO: 25151 - protein, 80 aa, Trichechus manatus
MTKSQGSLSFKDVAVVFTWEEWQLLDPVQKNFYKDVMLENYSNLVSVGYEVPKADTVFQLEQGKPWIVEEEIQSQVHPGK

SEQ ID NO: 25152 - protein, 81 aa, Zalophus californianus
MLENYGNLVSVAGYQLSKPSVISQLEKGQEPWMTEKEGPGDPSSDLKNKTETNGSTAKNDILQEQLYHGIVMEGFLRDDVI

SEQ ID NO: 25153 - protein, 81 aa, Zalophus californianus
VQGQVNFEDVAVYFSQEEWGLLDEAQRLLYRDVMLENLALMASLGYESSTSHGVASLELGSKLWRSDWADVTPGGTREAQG

SEQ ID NO: 25154 - protein, 81 aa, Equus caballus
AHGSVTFRDVAIDFSQEEWECLDSAQRDLYRDVMWENYSNFVSLDLESRYRTNTLSPEKDIYEIYSFQWEIMERIKSYSLQ

SEQ ID NO: 25155 - protein, 81 aa, Equus caballus
CWGLLSFKDISMEFTWEEWQLLDPAEKHLYRDVILENYRNLLSVGYHGTKPDLIFKLEQGEEPWIVNARASRQSCPVEGWK

SEQ ID NO: 25156 - protein, 81 aa, Equus caballus
MLETCGLLVSLGHPVPKPELISLLEHGQELWSGKKVRFKSTYTGERRKHETTELTAASHLAFTEEAPFKEQVTQAAPRDSR

SEQ ID NO: 25157 - protein, 81 aa, Equus caballus
SLKGSVSFKDVTVAFTQEEWQHLDPAQRTLYRDVMENYSHLVSVGYCITKPEVVFKLEQGEEPWIYGLQISSPNCYVVFSF

SEQ ID NO: 25158 - protein, 81 aa, Neovison vison
MLENYGNLVSVGYQFSKPGVISQLEKGEEPWLIEREISGSPSSDLENKTETRESALKNDISWEELHHGLMKEQSTRGGTLY

SEQ ID NO: 25159 - protein, 81 aa, Loxodonta africana
QEQVSFKDVCVDFTQEEWYLLDPAQKILYRDVILENYSHIVSVGCCVTKPEVIFKIEQGEEPWILEEGFSGLRHPEDWKVD

SEQ ID NO: 25160 - protein, 81 aa, Pteropus vampyrus
QMPVTFEDVALYLSREEWGRLDHTQQSFYHDVLQKRNRLALGVSSSQRTLGSLDFSHSFPFSRTFWASQVQGKGKASSSCQ

SEQ ID NO: 25161 - protein, 81 aa, Pteropus vampyrus
TENSITFEDVSMDFTQEEWALLNSSQRKLYRDVMLENYRNLASLGHQFSKPALIAKMEREDEMETVERSHQDTYSGDYQAY

SEQ ID NO: 25162 - protein, 81 aa, Pteropus vampyrus
IREQRMPAVRGKPKSKEEWEGLSPIQKDLYEDVMLETYQNLVSVGLSCRRPSVITLLEKGKAPWTVEPARQRRGPDSGAKC

SEQ ID NO: 25163 - protein, 81 aa, Pteropus vampyrus
GSAAYEFLSVDYSERKWKGPALSQRAQRRNIMPETHRSVASWAGDIRMENSELPLKQEISKGSESSDGTSGGLYGVVPGGQ

SEQ ID NO: 25164 - protein, 81 aa, Trichechus manatus
FKEAVTFKDVAVVFTEEELELLDSAQRKLYQDVMLENFRNLVSLGHQSFTPNIIPPLEREEKLWMMKPATQRDSSLGGKNL

SEQ ID NO: 25165 - protein, 81 aa, Trichechus manatus
MLENYSHLLSVGYQVPKPEVIFKLEQGEEPWMLEGEPAHQSRSDEDIGQTQQQGISGEVSFHCERFDQSTGEDSVCSILEE

SEQ ID NO: 25166 - protein, 81 aa, Trichechus manatus
FQEAVTFRDVAVVFTKEELGLLNSAQRKLYRDVMVENFRNLVSVGSQPFTPGAMLQLGREAKLWMTETETQGDGCSGHRNQ

SEQ ID NO: 25167 - protein, 81 aa, Trichechus manatus
AQESLTFDDVAVEFTWAEWQLLGPDQKDLYRDVMLENYNNLVSVGYQAGKPDGLSKLEQGEELWTIEDEVHCQISPEIRKV

SEQ ID NO: 25168 - protein, 81 aa, Trichechus manatus
IRGLLTFGDVAIEFSQEEWECLNPAQRALYRDVMLENFRNLVSLGISPFEMNIISILKKGTELWMVEKKMKLANNTDVIST

SEQ ID NO: 25169 - protein, 81 aa, Trichechus manatus
MLENYFNLVSVGYQISKPEVIFNLEQGEEPYMLDDGEISRRSCQDGDIGFETSQQGISEQVLFQYEGVNLFTRDDSLYSII

SEQ ID NO: 25170 - protein, 81 aa, Trichechus manatus
SVVIEDVAVVFSQEEWALLDLAQRMLYRDVMMETFRNLASVVFQNLHDGETLFSEHVMVRFMKSTWSAVLGEISESYGNKD

SEQ ID NO: 25171 - protein, 81 aa, Trichechus manatus
SVAFEDVAVDFTQEEWALLDLSQRQLYRDVMMEIFRSLASVASRKVIDGCKLSTESITVRFMKNDTWSLMVREIFELPVTE

SEQ ID NO: 25172 - protein, 81 aa, Trichechus manatus
SVIVEDVAVLFSQEEWALLDLAQKTLYRDVMMETFRNLASVVSGNLKNGEKLSSEHIMVRLLKNETWSSMLGEISDQSHGN

SEQ ID NO: 25173 - protein, 81 aa, Zalophus californianus
HILALLTFRDVAIEFSQEEWGCLNHTQRELYRDVMLENYGHLLFLGLIVSKPDLIMFLEQERQLWDVKRKETVAFHPGRWE

SEQ ID NO: 25174 - protein, 81 aa, Zalophus californianus
MDSVAFEDVTVKFTMEEWALLDPSQKKLYRDVMQETFRNLASIVCISEEKWEIHDREDQNENHGTDLSQMVERLCKSKECS

SEQ ID NO: 25175 - protein, 81 aa, Equus caballus
VQEPVTFEDVAVAFTEEELGLLDATQRQLYRDVMLENFWNLLSVGNQPFKPELIFQLEREEKLSMMETETWRDGCSGTKNE

SEQ ID NO: 25176 - protein, 81 aa, Equus caballus
SLETVTFKDVAVDLTQEEWQQLKPAQRNLYRDVMLENYSNLVTVGYEVTKPDVIFKLEQEEEPWVVEEEMFGSHCPEVWEV

SEQ ID NO: 25177 - protein, 81 aa, Equus caballus
SRELVTFEDVAVYFIRKEWKRLEPAQRDLYRDVMLENYGNVFSLDGETRTEHDQEISEDTGSHGVLLGRLQKDISQGFKFE

SEQ ID NO: 25178 - protein, 81 aa, Equus caballus
VQASVTFRDVAVLFSRDEWLHLDSAQRTLYREVMLENYSTLVSLGILFSKPKVIFQLQQGEDPWMVENGVSQGACLGWESL

SEQ ID NO: 25179 - protein, 81 aa, Capra hircus
PQGSVTFEDVAVYFSWNEWCLLDEVQIRLYLDVMLENFALVCMLGSWRGVQDKETPSEEIKPAGVLQFLTPRAGLSPEKTQ

SEQ ID NO: 25180 - protein, 81 aa, Pan paniscus
GPLPGSLLFRSTIFGEFSLEEWQCLDTAQQNLYRNVMLENYRNLVFLGIAVSKPDLITCLKQGKEPWNMKRHEMVTKPPGM

SEQ ID NO: 25181 - protein, 81 aa, Lipotes vexillifer
AREPVTFEDVAVDFSQEEWQNVDPAQKTLHTDVMLEIYSHLVSVGCSGIKPDIISKLEHGEDLWIIKSELSRWIYSDKEKS

SEQ ID NO: 25182 - protein, 81 aa, Lipotes vexillifer
ELVTFRDVVISFSQEEWEYLDSAQRDLYWDVMMENYSNLVSLDLESKYDKKTLSTEKDIIEKNDSQWEVIESSKLVGLANS

SEQ ID NO: 25183 - protein, 81 aa, Pan paniscus
RDVAIEFSLEEWECLNPAQQNLYMNVMLENYKNLVFLGVAVSKQDPVTCLEQEKEPWNMKRHEMVDEPSAMCSYFTKDLWP

SEQ ID NO: 25184 - protein, 81 aa, Pan paniscus
GPLTFRDVAIEFSQEEWKSLDPVQKALYWDVMLENYRNLVFLGILPKCMTKELPPIGNSNTGEKCQTVMLERHECYDVENF

SEQ ID NO: 25185 - protein, 81 aa, Sousa chinensis
QESLTFQDVAVEFTREEWDQLYPAQKNLYRDVMLENYSNLVALGHELHKPEVITQLEQEEQWMMERDSPPDTHPGEKQAFG

SEQ ID NO: 25186 - protein, 81 aa, Pteropus vampyrus
SCEGSVSFRDVAVDFSREEWQHLDLAQKNLYRDVMLETCSHLLSVGYQVPEPEVFMLEQGKEPWALQDESPHQSSSEKLWQ

SEQ ID NO: 25187 - protein, 81 aa, Pteropus vampyrus
LMEAVTFGDVAVHFSREEWQCLDPGQRALYKEVMLENHSSVAGLGEPVPRGPLRSASSISAHLPGICERLGIWWPCSQALS

SEQ ID NO: 25188 - protein, 81 aa, Pteropus vampyrus
TDGLVTFRDVAIDFSQEEWECLDPAQRDLYVDVMLENYRNLVSLDLESTYETKNTFLGKDIFEINFSQWEIKEGKKTLGLE

SEQ ID NO: 25189 - protein, 81 aa, Pteropus vampyrus
MLENYRNLVTLGHQLYKPKVITQLEQEEQWMMERDSPLDIHPDGENKPEIKKSTPNQNISDENKTHDMIMERLAGDSFWYS

SEQ ID NO: 25190 - protein, 81 aa, Pteropus vampyrus
PEESVTFKDVAVDFTQEEWGQLDSPQRALYRDVMLENYQNLLALAGPPVCKPDVISHLEREWEPRPEMKEESCQQQVIYKE

SEQ ID NO: 25191 - protein, 81 aa, Pteropus vampyrus
QGSAAYEFLSVDYSERKWKGPALSQRAQRRNIMPETHRSVASWGDIRMENSELPLKQEISKGSESSDGTSGGLYGVVPGGQ

SEQ ID NO: 25192 - protein, 81 aa, Pteropus vampyrus
KPEDVSFAEVAVYFSLDEWGYLWPAQRALYRDVMRETYGHFGELGFPGPKPALISWMEQESEAWSPAAQDPEEGESVGGAV

SEQ ID NO: 25193 - protein, 81 aa, Pteropus vampyrus
QGCVTFEDVALYFSWEEWDLLDEAQRCLYHDVMLENLVLTSSLGCWSGVEGEEAASEQSSSVEGESQIRILKAGSSPQKAQ

SEQ ID NO: 25194 - protein, 81 aa, Pteropus vampyrus
SQSLVTFGDVAVDFSQEEWERLSSDQRDLYRRVMLENYRNLVSLGLCFSKPDIISSLEQRKELWMAKREVTRGQCPDWKAV

SEQ ID NO: 25195 - protein, 81 aa, Pteropus vampyrus
AHDLVMFGDVAIDFSQEEWECLNSYQRNLYRDVILENYSNLVSVGCSTSKPGVITLLEQGKEPWMVRYRDRQTDRWQEEGR

SEQ ID NO: 25196 - protein, 81 aa, Pteropus vampyrus
AQTSVTFKDVAVTFTQDEWEQLNPAQRTLYWEVMLETCRLLISLGYPVTHLEPMHLPEHRQELWMVKRGLSRSVCPGARTK

SEQ ID NO: 25197 - protein, 81 aa, Trichechus manatus
YQRSVSFKDVVVGFTQEEWHQLNPAERALYRDVMLETYSNLVSVGYEGTKPDVILRLEQEEAPWISEAGCHCREDFWEVDV

SEQ ID NO: 25198 - protein, 81 aa, Trichechus manatus
IKAQESLTLEDVAVEFTWEEWQLLGPAQKDLYRDVMLENFSNLVSVGIQKVDRLPEHLEDESWVDGKEQCYEYNALENVVH

SEQ ID NO: 25199 - protein, 81 aa, Trichechus manatus
KTQVSLEFNDVAVEFAWEEWQLLDPAQKDLYREVMLENFHNLVSVGCQVGKPDVLFRLEREPPWSLEDEIHSQNFSEIQEV

SEQ ID NO: 25200 - protein, 81 aa, Trichechus manatus
ALGCVTFEDVAIDFSQEEWGLLDETQRLLFYDVMLENFAIIASLGSLHGRQEEVETSSGHSVSVGVSQVRTSQAGPSTQKT

SEQ ID NO: 25201 - protein, 81 aa, Zalophus californianus
FKEAVTFKDVAVVFTEEELGLLDPAQRKLYRDVMLENFGNLVSVGEKVQHEMETIPKAEPHEELSCWQIWQHIANDLTRCQ

SEQ ID NO: 25202 - protein, 81 aa, Zalophus californianus
FQEPVMFKDVAVVFSEEELGLLDSTQRKLYRDVMLENFRNLVSVGNQPSKPELIFRLEREEKLLMMETETQRDGYLGTKSQ

SEQ ID NO: 25203 - protein, 81 aa, Zalophus californianus
ARPESVTFEDVAVYFSENEWTGLAPAQRVLYRDVMLENYGAVASLEGVLKSQKDFILKEERFEEAKDHVVLSSRPRWCGSQ

SEQ ID NO: 25204 - protein, 81 aa, Equus caballus
AQGSVSFKDVTVDFSREEWQHLDPAQKTLYMDVMLENYCHLVSVGCHMTKPEVILKLERGEEPWTSFTGHTCLEENWKAED

SEQ ID NO: 25205 - protein, 81 aa, Equus caballus
AQESVTFKDVAVLFTWDEWAQLSPAQRALHREVMLENYSTLVSLGILFSKPKVIFQLQQGEDPWMVENGVSQGACLGWESL

SEQ ID NO: 25206 - protein, 81 aa, Equus caballus
FQGSLTFSDVAIAFSQQEWEGLDPVQKTLYQDVMMENYRNLLSLGHAISKPGVITLLEQGKEPWMVEFNFSYGTCISAVFL

SEQ ID NO: 25207 - protein, 81 aa, Equus caballus
LVTFRDVAIDFSQEEWECLDPAQRDLYREVMLENYSNLVSLDLESSCGTKKSSPEKGTYETESLQWNYMRKPVSHNLKHHD

SEQ ID NO: 25208 - protein, 81 aa, Papio anubis
MTFEDIVVDFTREEWALLDTSQRKLFQDVMLENISHLVSIGKQLCKSVVLSHLQQVEKLSTQGISLLQGGEGDIKHQEIPF

SEQ ID NO: 25209 - protein, 81 aa, Aotus trivirgatus
MLENYGSVASLTAFPFPKPALISQLEGKAPWCSAPRGALDGEGQRGISSGEILELPGATMWSLRIKPIPKKTVAKQTETRS

SEQ ID NO: 25210 - protein, 81 aa, Aotus trivirgatus
GLLAFRDVAIEFSLEEWQCLNHAQQNLYRDVMFENYRNLVSLGIAVSKPELITCLEENNEPWNIKRNEMVCEVHKGGYNEV

SEQ ID NO: 25211 - protein, 81 aa, Sarcophilus harrisii
HQDLVTFKDVAVDFTPEEWGQLVPSQKELYRDVMLENYQNLVWLGLAVSKPDVIYQLEQVGGTWVPEGETLTVSCSDFVTR

SEQ ID NO: 25212 - protein, 81 aa, Lipotes vexillifer
PQEAVTFEDVAVNFSNEEWQCLTHAQRHLYKDVMLENYGNMVSLGFPFPKPPLISHLEQEAELCVQDGQDREFLSCSHPVS

SEQ ID NO: 25213 - protein, 81 aa, Lipotes vexillifer
SQLSVTFEDVAVFFTRDEWRKLAPSQRNLYQDVMLENYSNLVSLGLLFSKPEVISLLQQGEDPWKVEKESPGGSSVGCKSS

SEQ ID NO: 25214 - protein, 81 aa, Lipotes vexillifer
SQKQLTFKDVAIEFTQEEWECLDPAQRALYRDVMLENYRNLLFLVISVPDLNIICILEQEEEPLTVKSDMKIAKKTMAGDV

SEQ ID NO: 25215 - protein, 81 aa, Callorhinus ursinus
KIEDVADVAVSFILEEWGHLDQSQKSLYRDDRKENYGSITSMDYESGHDNVELAVKPISDDAEPHWMTSGSPERNVPQSQG

SEQ ID NO: 25216 - protein, 81 aa, Callorhinus ursinus
SLESDLFRDVAIVFSQEEWEQLAPTQRDLYRDVMLETYSNLVSLGLAIAKPDVISFLEQGKEPWVVEKMSRGGLCPVLESR

SEQ ID NO: 25217 - protein, 81 aa, Tursiops truncatus
MLENYSNLVSLGLLFSKPAVISLLQQGEDPWKVEKESPGGSSVGCKSSPKTTKSTQTQDSSFWGPVRKRLKKNEPWNFISE

SEQ ID NO: 25218 - protein, 81 aa, Tursiops truncatus
LPGLLTFKDVAITFSQEEWECLDPAQRALYRDVMLETYRNLLSLGEDISSPEVGSLSAGFAIKELSPREDITKGELYHLVI

SEQ ID NO: 25219 - protein, 81 aa, Pteropus vampyrus
PQESLTFEDVAVYFTEEEWASLVPAQRALYRDVMLENYGALAFLAPSTTKPALIYQLEQEKELCFSESQEALSGRASLAGY

SEQ ID NO: 25220 - protein, 81 aa, Pteropus vampyrus
MAVSEPGGSAAKEWEQLDPAQRNLHKDVMLENCSHLASMGYQAAKPDMISKLEKGEEPWLGKGKTPRQGGPNETARPKQTE

SEQ ID NO: 25221 - protein, 81 aa, Pteropus vampyrus
NSNTVLFTHTVEPLQFLTFFQEQQKMNIAQGSVSFEDVTVEFTPGYCITKPQVIFKLEQGEEPWSLEEEFPNQRCPGYYKV

SEQ ID NO: 25222 - protein, 81 aa, Pteropus vampyrus
PQKSVTFEDVAVYFTPTEWDGLSPAQRALYRDVMLENYGNVASLGFPLLKPAVISQLEERSELEGPSPLAAGTGTGPPDLR

SEQ ID NO: 25223 - protein, 81 aa, Pteropus vampyrus
IVTFKDVAVVFTEEELALLDKAQINLYQDVTLENFRNLVSVGDGIKNNILNLQEKGLSCLSREVLYCWQIRKQRISELTVS

SEQ ID NO: 25224 - protein, 81 aa, Pteropus vampyrus
QESVTFEDVAVDFTQEEWALLDTSQRELFRDVMLENISHLVSIDRGDDLKKQEMISIQHSYKKDTSLLDAVRFHTQEYPFE

SEQ ID NO: 25225 - protein, 81 aa, Monodelphis domestica
AQEVVSFKDVAVDFTREEWRLLSPPQKELYKEVMLENARNLLSVGLSAPPEDMFSSLEQREAPWMLEKDDLRSCCPEGKMR

SEQ ID NO: 25226 - protein, 81 aa, Monodelphis domestica
FQTPLTFQDVAVDFSWEEWGLLEPFQKDMYWDVMLENYENFVSLGGLPISIPDVISQLERLEAPWMAEKGVLISTFLDSLS

SEQ ID NO: 25227 - protein, 81 aa, Aotus trivirgatus
MGLLTFRDVAIEFSLEEWEHLDSNQKNLYGDVMLENYRNLVCLGLAVSKPDLITFLEQRKEPWNVKSVETVAIQPDVFSRN

SEQ ID NO: 25228 - protein, 81 aa, Papio anubis
GEACIGGDVTFSDVAIDFSHEEDLYKDVMVQNYKNLVSVTGLSVTKPYVITLLEDGREPWMVEKKLSKDWESRWESKELST

SEQ ID NO: 25229 - protein, 81 aa, Aotus trivirgatus
MFSDVSIDFSQEEWDCLDPVQRDLYRDVMLENYSNLVSMGLYTPKPQVISLLEQGKEPWMVGRELTRGLCSDLESMCETKL

SEQ ID NO: 25230 - protein, 81 aa, Aotus trivirgatus
TFKEAVTFKDVAVFFTEEELELMDPAQRKLYRDVMLENFRNLLAVGHQPFHGDTFYFLREEKFWMMETRSQGEGNSGGRIQ

SEQ ID NO: 25231 - protein, 81 aa, Aotus trivirgatus
SVVFEEVAVRFTPEEWALLSHAQRRLYRDVMLEICRNLASLGKDSCLHYVPGEQRYLGLISNEEEIAKFTRSDSWSIFGQN

SEQ ID NO: 25232 - protein, 81 aa, Lipotes vexillifer
MLVTYEDVAVTFTQEEWGQLDPAQRTLYQEVMLETCGLLVSLGCPLPKAELIHPLEHSPELQTWKRGLSPSSCPGDNTKAD

SEQ ID NO: 25233 - protein, 81 aa, Pan paniscus
QGRLTFRDVAIEFSLAEWKFLNPAQRALYREVMLENYRNLEAVDISSKRMMKEVLSTGQGNTEVIHTGTLQRHQSYHIGDF

SEQ ID NO: 25234 - protein, 81 aa, Pan paniscus
GHLTFRDVAIEFSLEEWKCLDPMQRALYRAMMLENYRNLHSVDISSKCMMKKFSSTAQGNTEVDTGTLERHESHHIGDFCF

SEQ ID NO: 25235 - protein, 81 aa, Tursiops truncatus
QQEPVTFEDVTVYFTQNEWVILDPVQRALYREVMLENYANVTSLAFSFTRPVLVSQLEAGELPWGLDPWEPVGREALRGVC

SEQ ID NO: 25236 - protein, 81 aa, Tursiops truncatus
QPQEAVTFKDVEVTFSQDEWGWLDASQRNLYRDVMLENYGNVTSLVGPFTKPALISWLEAREPWGLNVQGAHPKRSPSAAP

SEQ ID NO: 25237 - protein, 81 aa, Sarcophilus harrisii
AQESVSFRDVAVDFSQEEWGFLDASQKKLYREVMLENYRNLASLGLPVCKPDEVSQLERGDAPWMLEREGPRASLADWELR

SEQ ID NO: 25238 - protein, 81 aa, Pan paniscus
APLQFRDVAIEFSLEEWHCLDTAQRNLYRNVMLENYRNLVFLGIVVSKPDLITCLEQGEKPLTMKKHEMVAQPLSNVLLLF

SEQ ID NO: 25239 - protein, 81 aa, Lipotes vexillifer
FQDLMTFEDVAVEFTRWEWGQLDPTQKDVYREVMLENFKNLASLGFPMSKPYVICRLEEGEEPCILERDISTGAPAGYYKC

SEQ ID NO: 25240 - protein, 81 aa, Callorhinus ursinus
SQGSISFEDVTVNFTQEEWGQLDPDQRTLYRDVMLENYSIFISLEELKVDGIIESKENQDRHYGKMITEKENVLRKTFNLY

SEQ ID NO: 25241 - protein, 81 aa, Callorhinus ursinus
FQRSVTFRDVAVAFSQQEWESLNPAQRHLYRNVMLENYSNLVSLAGHSISKPHVITLLEQWKEPAMIVRKDQRRQYTDFQL

SEQ ID NO: 25242 - protein, 81 aa, Tursiops truncatus
SLGSDLFRDVAVVFSQEEWEQLAPAQRDLYRDVMLEIYSNLVSLGFAISKPDVISFLEQGREPWMVEKVATGGQCPDQVSQ

SEQ ID NO: 25243 - protein, 81 aa, Trichechus manatus
PQGLLTFRDVAVEFSQEEWECLDPAQKTLYKDVMLENYRNLVSLAGISVSELNIISVLEQGTEPWTLEGKEKIAKYPDVSP

SEQ ID NO: 25244 - protein, 81 aa, Trichechus manatus
PQKLVTFEDVAVYFTQTEWDGLSPTQRALYRDVMLENYGHVASLDIDIQTDNNLTKEMCEEKDSTSFKLQRNFPQEADFPE

SEQ ID NO: 25245 - protein, 81 aa, Trichechus manatus
ERDRVTFEDIAVYFTWKEWGLLDEAQRHLYHDVMLENFSLVASLGLASSKSCVVAQLEQDREPWMPDTVDASPATAREAQR

SEQ ID NO: 25246 - protein, 81 aa, Trichechus manatus
LQEAVTFKDVAVVFTEEELGLLDSTQRTLYRDVMLENFRNLLSVGHQPFKPDLISQLEKEEKLLMMETETQGDEGSGDKSQ

SEQ ID NO: 25247 - protein, 81 aa, Zalophus californianus
MLENYSHLVSLGLSLSKPTLISFLEQDNEPWIVEKESPKSLYPDVKSQCATKELSSKDDNYEMKLSQRKKMERLTSHDFGC

SEQ ID NO: 25248 - protein, 81 aa, Zalophus californianus
MKGLDQASGNIAVYSAFSVLSQKEQKKNKSQGSISFEDVTVNFTQEEWGQLDPDQRTLYRDVMLENYSIFISLEKCPVNII

SEQ ID NO: 25249 - protein, 81 aa, Zalophus californianus
RPESVTFEDVAVYFSENEWTGLAPAQRVLYRDVMLENYGAVASLAFPFPKPALISQLERGEAPWCKAPQGARDGEGPRGVS

SEQ ID NO: 25250 - protein, 81 aa, Aotus trivirgatus
EMGPLTFRDVAIEFSLEEWQCLDTAQQDLYRKVMLENYRNLAFLGIAVSKPDLITCLEQGKEPWNMKRQEMVDETPVIYSH

SEQ ID NO: 25251 - protein, 81 aa, Papio anubis
PQGLLTFRDVVIEFSQEEWKCLDPAQRTLYRDVMLENYRNLVSLDISSKCMMKTLSSTGQGNTEVILKGTLQRQASHHIGE

SEQ ID NO: 25252 - protein, 81 aa, Papio anubis
MHSLNKVTFEDVAIDFTQEEWAMTETSKRKLYRDVMLENVSHLQISKSYITLQLEQGRELWWDGRQFLQGQNLDKESALEK

SEQ ID NO: 25253 - protein, 81 aa, Aotus trivirgatus
KGCVTFEDIAIYFSQEEWGRLDEAQRLLYLEVMLENFALVASLGVTSRQGLPQDCGCGHGTEDEKTPSEQNVSIGVSQSKA

SEQ ID NO: 25254 - protein, 81 aa, Papio anubis
MDTVVFEDVVVGFTLEEWALLNPAQRNLYREVMLETFKHLASVDDEAQLKTNASISQQDTSGEKLSLKQKIEKFTRKHTWA

SEQ ID NO: 25255 - protein, 81 aa, Aotus trivirgatus
VTFEDVAVYFIRKEWKRLEPAQRDLYRDVMLENYGNVFSLDRIRVSLTIQKVMLAWFTGTLTVGRGLCPSELASVEPPDTN

SEQ ID NO: 25256 - protein, 81 aa, Papio anubis
VAFEDVAVNFTQEEWALLGPSQNNLYRYVMQETIRNLDCIRKIWEGQNTEDQNKNPRRNLRCHMLERFSESKDSSQCGEPF

SEQ ID NO: 25257 - protein, 81 aa, Aotus trivirgatus
QGHVTFEDIAVYFSQEEWGLLDEAQRCLYHDVMLENFSLMTSVAGLSQNNHKDSCLQWKVPVSMKNCVAQCSPDEVHYTPM

SEQ ID NO: 25258 - protein, 81 aa, Pan paniscus
QGLLTFRDVAIEFSQEEWKCLDPAQRTLYRDVMLENYRNLVSLDISSKCTMKEFSSTAQGNREVFHAGTSQRHESHHNGDF

SEQ ID NO: 25259 - protein, 81 aa, Tursiops truncatus
ARLTFKDVVIEFSPEEWECLDPAQRALYRDVMVENYRNLISVDLSHIHVIKKLQLKSNTDIGEIFPTVMLGSHGSCEIKHF

SEQ ID NO: 25260 - protein, 81 aa, Tursiops truncatus
AHMSLSFRDVAIDLSQEEWECLDAVQRALYRDVMLENYSNLVSLGCSSPKPDVITLLEQEKEPWTVMREGTRSWYTDLESK

SEQ ID NO: 25261 - protein, 81 aa, Tursiops truncatus
MLETYSNLVSVGYEGTKPYVILRLEQEEAPWICEASCSGCHCRENIWQGNVQKKRRQDMLLRQGTFISKKTLPKERSHECN

SEQ ID NO: 25262 - protein, 81 aa, Pteropus vampyrus
MESVTFEDVAVTFTLEEWALLDPSQKKLYRDVMQETIRNLASVGKKWENHYIEDKYKNQGRKQSSHKVKRIYEEKKSSQCG

SEQ ID NO: 25263 - protein, 81 aa, Pteropus vampyrus
VKKPVTFEDVAVNFTQEEWESLDASQRVLYQDVMSETFKNLVSVACIFLSNPDLITKLEQDEKQWRADLCPPNREGHPSGG

SEQ ID NO: 25264 - protein, 81 aa, Pteropus vampyrus
SRSLENDGVCFSEQEWENLEDWQKELYRNVMKSNYETLVSLKVLGQPEGEAELGTEMLGDLEEEGPGGVHPAEGVMIKQET

SEQ ID NO: 25265 - protein, 81 aa, Pteropus vampyrus
AHGSVTFRDVAIDFSQEEWEFLDSAQRDLYRDVMWENYSNFISLAGPSISKPDVVTLLDEGKEPWMVVREGISRHYPDLES

SEQ ID NO: 25266 - protein, 81 aa, Pteropus vampyrus
NFQGSVTFQDVALDFTPEEWQLLDCDQRTLYWDVMLENFRNLISVGGPVTKTKVIFKQGQEPQMVERENPYWSRPEAECPH

SEQ ID NO: 25267 - protein, 81 aa, Trichechus manatus
SQELLTFRDVAIEFSQEEWDCLDPTQRTLYRDVMLENYRNLVSLGVSPSEMNIICILKKETEPWTVEKTMKLANNSDVFSP

SEQ ID NO: 25268 - protein, 81 aa, Aotus trivirgatus
EMGPLTFRDVAIEFSLEEWQCLDTDQQDLYRNVMLENYTNLVFLGIAVSKADLITCLQQEKDPWNMKRHSIVAKPPVLCSH

SEQ ID NO: 25269 - protein, 81 aa, Aotus trivirgatus
EAVTFKDVAVFFTEEELELMDPAQRKLYRDVMLENFRNLLAVGGRIQTETATVPEARTHEKFSCQKIWEQIASDLTKSQDS

SEQ ID NO: 25270 - protein, 81 aa, Aotus trivirgatus
SQGSVLFEDVSVYFTQKEWQLLDPAQRLLYRDVMLENYRHLVSLGHCVTKPELIVKLKQGDEPWILKRQPPSQSHSEDQKA

SEQ ID NO: 25271 - protein, 81 aa, Aotus trivirgatus
QMPVTFEDVALYLSREEWGRLDHTQQNFYRDVLQKRNGLSLGKHLPGGGTGVSGRGPIQEGQGVPIPPVAALGDVKPFRIR

SEQ ID NO: 25272 - protein, 81 aa, Aotus trivirgatus
MGPLQFKDVAIEFSLEEWHCLDTAQRNLYTDVMLENYRNLVFLGIVVSKPDLITCLEQGKKPLTMKKHGMIAKPPVMCSHL

SEQ ID NO: 25273 - protein, 81 aa, Aotus trivirgatus
QDSVAFEDVAVSFTQEEWALLDPSQKNLYRDVMQEIFKNLASVGKTWQVQNIEDKYKNSRRNLSLLIREKLFESKESNHRG

SEQ ID NO: 25274 - protein, 81 aa, Papio anubis
PQGLLTFRDVAIEFSQEEWKCLDPAQRTLYRDVMLENYRNLVSLAISSKCRMKKFSSTGQGNIEVIHTGTLQSQASHLIGE

SEQ ID NO: 25275 - protein, 81 aa, Sarcophilus harrisii
YQESLTFEDVAVYFTRKEWKHLDSCQKDLYRNVMLENYGNMTLLKFTVSKPELISQLELGEEPWVLTLQGAEDQDTSKGFY

SEQ ID NO: 25276 - protein, 81 aa, Lipotes vexillifer
LQEPVTFRDVAVDFTQEEWGQLGPAQRTLYRDVMLETFGHLLSVGPELPKPEVISQLEQGAELWLAETGIAQGRCPGWGRG

SEQ ID NO: 25277 - protein, 81 aa, Lipotes vexillifer
SAAGSVTFKDVTMAFTKKEWEQLDPAQKSLYKDVMLENYSNLASMGYQALKPDMISKLGKEEPWLGKGKRPRQGDLSEIAR

SEQ ID NO: 25278 - protein, 81 aa, Papio anubis
PQASVCFEDVAMAFTQEEWEQLDLAQRTLYREVTLETWEHIVSLGLFLSKSDVISQLEQEEDLCRAEQVAPREGGAAGSFL

SEQ ID NO: 25279 - protein, 81 aa, Aotus trivirgatus
MGPLTFRDVKIEFSLEEWQCLDTAQRNLYRDVMLENYRNLVFLAMCSHFTQNCWLEQNIKGSFRKVTLSRYGKCGHKNLQL

SEQ ID NO: 25280 - protein, 81 aa, Aotus trivirgatus
AIRSVMFSDISIDFSPEEWEYLDLEQKDLYRDVMLENYSNLVSLGCFISKPDVISLLEQGKEPWKVVRKRRRQYPEMLLLL

SEQ ID NO: 25281 - protein, 81 aa, Sarcophilus harrisii
TQELVTFKDVAVDFSPEEWGLLDPDQRELHKEVMLENAENLLSLGVPVPREDFISHVERGGLRNSCPDAETLFDMKEVSAN

SEQ ID NO: 25282 - protein, 81 aa, Callorhinus ursinus
SQESVTFQDVAVDFTEKEWPLLDSSQRKLYKDVMLENYSNLASVGYQVGKPSLISHLEQEEELRTEERALHQATSPDWETP

SEQ ID NO: 25283 - protein, 81 aa, Callorhinus ursinus
QAEVTFEDVAVLFSREEWGRLGPAQRGLYRDVMLETYRNLVSLGRGTRTEYKELSSGEMLDEEELDQLQRAVPQGPDPGET

SEQ ID NO: 25284 - protein, 81 aa, Callorhinus ursinus
LQEPVTFRDVAVDFTQEEWGQLGPAQRTLYRDVMLETFGHLLSVGPELPKPEVISQLEQGAELWAAERGIAQGYCPGREPG

SEQ ID NO: 25285 - protein, 81 aa, Callorhinus ursinus
MAFSQEEWGCLNHTQRELYRDVMLENYGHLLFLGFIVSNHLVIVSTDLVIFLEQKNAHWDVKTVAIQLVCTDEEGAHLCVV

SEQ ID NO: 25286 - protein, 81 aa, Lipotes vexillifer
GSVSFTDVTVDFTQEEWEQLDPSQRILYMDVMLENYSNLLSVEVWKADDQMERDHRNPDEQARPFIIFKNQTSIEERDNLF

SEQ ID NO: 25287 - protein, 81 aa, Lipotes vexillifer
FFDLVMFRDVTVDFSQEEWECLNSNQRNLYRDVILENYSNLVSLGGCSVSKPDVITLLEQGKEPWMVVRDEKRRWSLDLES

SEQ ID NO: 25288 - protein, 81 aa, Lipotes vexillifer
PQEPVTFEDVAVYFTQNQWASLEPVQKALYREVMLENYANVASLEALPFPSPVLIAQLERGEAPWGPDPWEAEILRGICPG

SEQ ID NO: 25289 - protein, 81 aa, Tursiops truncatus
PQGCAISEDVFVYFSREEWVLLDEDQRLLYRDVMLENFALLASLGITSSRSYLVTQLEQGEEPWMPAQVDMTAATEKEAQK

SEQ ID NO: 25290 - protein, 81 aa, Tursiops truncatus
QLTFKDVAIEFSQEEWECLDPAQRALYRDVMLETYGNLLSLDASLKCVIKESAPKENSHTGEVLQTVLLERHESCETEDYG

SEQ ID NO: 25291 - protein, 81 aa, Tursiops truncatus
KSAAMSFADVAVYFSPEEWGCLRPAQRALYRDVMRETYGHLDALGFPGPKPALISWMEQESEAWSPAAQDPEEGESLGGAL

SEQ ID NO: 25292 - protein, 81 aa, Tursiops truncatus
RPRAVKFGDVAVYFSPEEWECLWPAQRALYRDVMQETYGHLGALGCAGPKPTLISWLERNTDDWEPAALDPQECPRRVTVQ

SEQ ID NO: 25293 - protein, 81 aa, Tursiops truncatus
WLQGPVSFEDVTVEFTQEEWVLLDSAQRSMYRDVMLENYMNLTLVEYQLCKPVISLSGQEDIRTVKRRIPQGTCLDWEIQL

SEQ ID NO: 25294 - protein, 81 aa, Tursiops truncatus
LQETLTFRDVFVDFTLEEWQQLDATQRNLCKDVMLENYSHLVSDSSWPNQVGPSGWDKEKRRPGWQLEKAQHRGVQISILC

SEQ ID NO: 25295 - protein, 81 aa, Tursiops truncatus
PQDLVTFKDVAIDFSQEEWEWLNPAQRSLYRSMMLENYQSLVSVGLCVSKPYVISLLEQGKEPWEMKSEMRRTPFPDWESV

SEQ ID NO: 25296 - protein, 81 aa, Pteropus vampyrus
CEVSISFEDVTVDFSREEWQHLDPAQRCLYRDVTLENYSHLLSVGYQVPKPEIIFQLEQGEGPWMLERETPHQSYSDEDIG

SEQ ID NO: 25297 - protein, 81 aa, Pteropus vampyrus
TQESVTFRDVAVHFSRDEWLYLDPAQRALYREVMLENYSSLVSLGILFSKPKVIFQLQQGEDPWMVENGVSCGACLGWESL

SEQ ID NO: 25298 - protein, 81 aa, Pteropus vampyrus
WKAWVKKPVTFEDVAVNFTQEEWESLDASQRVLYQDVMSETFKNLVSVDLITKLEQDEKQWRADLCPPNREGHPSGGKKEE

SEQ ID NO: 25299 - protein, 81 aa, Trichechus manatus
SVIIEDVAVLFSQEEWALLDLAQRRLYRDVMMETFRNLASVVSLHLNDGENLSSEHIMVRLMKNNTWSSMLGEISDSLGNK

SEQ ID NO: 25300 - protein, 81 aa, Trichechus manatus
AQVSVTFEDVAVTFTQEEWGQLDLTQRSLYQEVMLENCGLLISLGCPVPKPELIYELELRQKLWAVKKDLSLSIFPGDKTK

SEQ ID NO: 25301 - protein, 81 aa, Trichechus manatus
IKSQVSFEDVAVDFTLEEWQLLNLTQKNLYRDVMLENYSNLVFLGYQIIKPNAIFKLEQGEEPWIIDEEMISQNFSEVWLD

SEQ ID NO: 25302 - protein, 81 aa, Trichechus manatus
SVAFEDVAVDFTQEEWALLDLSQRKLYRDVMMEIFRNLASVVSRKLNDGEKLSSENIILRFMKNDTWSSMVGEMCELHGTE

SEQ ID NO: 25303 - protein, 81 aa, Trichechus manatus
LVLIEDVVVVFTQEEWALLDLAQRKLYKDVTMETFKNLASVVSQNLNDGDKLSSEHTIVRLMKNDTWSSVLGEISESYGSK

SEQ ID NO: 25304 - protein, 81 aa, Trichechus manatus
VYPCPDPLHFAPSESLSLPHTSLPLKASGDFARYTGPPKPISFSAHHTAGVLVFKPELISRLEQGQEPWVLDLQASEGRET

SEQ ID NO: 25305 - protein, 81 aa, Trichechus manatus
ESVTFKDVALDFTQEEWSLLDTTQRNLFRDVMKENINHLVFIVISVRESGRKKQEVISCRKNISTIMAMQRSLTEENPFEC

SEQ ID NO: 25306 - protein, 81 aa, Trichechus manatus
LREPVTFEDVAVHFSKEEWACLDPSQRVLYQDVMLENFRTLAALGLHGLRPQLVLCLEKWVEPWADKWERSEALAWPRGSS

SEQ ID NO: 25307 - protein, 81 aa, Trichechus manatus
QCLPLKYEGGMGKNELLSFEDVAMFFTREEWENLDSAQKYLYRDVMLENYRNLIFLDQRDKTKLQDISLQLTNHHIPFTSP

SEQ ID NO: 25308 - protein, 81 aa, Trichechus manatus
AEGCVNFEDVAIDFSQEEWGLLDETQKLFYCDVKLENFAVISSLACWHGVEEEKASSEQSVSLEGVLQVRTPQEVHPPRRL

SEQ ID NO: 25309 - protein, 81 aa, Leptonychotes weddellii
WGAWLEKPVTFDDVAVNFTQEEWVCLDASQRVLYQDVMSETFRNLMSVDLIIELEQEEKQWRAELQLRPPNGEGLPSGGRK

SEQ ID NO: 25310 - protein, 81 aa, Monodelphis domestica
PAQEVVTFQDVAVDFTREEWRLLSPPQKVLYKEVMLENVRNLLSVGLSAPPEDMILEQREAPWMLEQEGLKCCCPGEVRSE

SEQ ID NO: 25311 - protein, 81 aa, Monodelphis domestica
CRVSVTFKDVAVEFTSEEWGCLKPFQKQLYRDVMLENYRNLVSLGFTVSKPDVICRLERKKASWMPEANVPRSSSASEYLK

SEQ ID NO: 25312 - protein, 81 aa, Physeter macrocephalus
PKVPVTFDDVAVYFSEQEWGKLDECQRELYKHVMRGNYETLVSLDYAISKPDILTRMERGEEPCPEGPRGREEGSDREEAR

SEQ ID NO: 25313 - protein, 81 aa, Monodelphis domestica
FIFRIWKFDVAVDFTQEEWCLLDHSQKELYLEVMLENVQNLLSVGKDHFLLLISAQGSTCACFSIKKRRKKKKTLNSVMGS

SEQ ID NO: 25314 - protein, 81 aa, Monodelphis domestica
SQGSITIKDVTVDFTQEEWVLLDHSQQELYLEVMLENVQNLLSVGLLVPRENVISSFQQGEAPCLLEQDCPRSSCPEAKIY

SEQ ID NO: 25315 - protein, 81 aa, Monodelphis domestica
WQDSLTFKDVTVDFTQEEWHLLNHSQKELYKTVMLENSQNLLSLGIPVVREDLISHFEEKEALWILDQKGLKNSSLDGETS

SEQ ID NO: 25316 - protein, 81 aa, Monodelphis domestica
SQMSLTFQDVTVDFSQEEWDRLEPAQKDMYRDVMLENYENFVFLGLPVSKPDVISHLERRETSWMTESEVLISTYLDSLIP

SEQ ID NO: 25317 - protein, 81 aa, Monodelphis domestica
AQESLTFQDVAVDFTQEEWRLLEPPQKELYREVMLDNAQNLLFLGIPVPRGYLISHFKQEGPRNSCLDAETRVDVKELPTE

SEQ ID NO: 25318 - protein, 81 aa, Physeter macrocephalus
GQLTLNDVVIEFSQEEWECLDPAQRALYRDVMLETYRNLISLDISQIHVIKKLQLKSNTDRGGVFQTLMLGSHESQGIKHF

SEQ ID NO: 25319 - protein, 81 aa, Monodelphis domestica
LAAQVTFKDVAVDFTREEWRLLSPPQKELYKEVMLENTWNLLSVGLLAPPEDVISSLEQREAPWMLGQEGLRSCCPGEREG

SEQ ID NO: 25320 - protein, 81 aa, Aotus trivirgatus
TSALMAFWDVAVAFTQKEWQLLSSAQRTLYREVMLENYSHLVSLGIVFSKPKLITQLEQGDEPWREENKHLLDLCPETHKL

SEQ ID NO: 25321 - protein, 81 aa, Aotus trivirgatus
EPGAVTFGDVAVYFSREEWGCLRPAQRALYRDVTRETYSHLGALGVGGSKPALISWMEEEAELWGPAAQDPEVAKCPTEAD

SEQ ID NO: 25322 - protein, 81 aa, Aotus trivirgatus
PQASVCFEDVAMAFTQEEWGQLDLAQRTLYREVTLETWEHLVSLGLLLSKPDVISQLEQEEDLCRAEQVALQDWKATLEKN

SEQ ID NO: 25323 - protein, 81 aa, Aotus trivirgatus
SVTFEDVFVYFSRDEWELLEEAQRFLYRDVMLENFALVATLGFWCEAENEEAPSEQSISVEGVSQVRTAEPGLFQKAHPCE

SEQ ID NO: 25324 - protein, 81 aa, Papio anubis
RNVMLENYKNLVFLGIDISKQGPLTSLEQEKEPWNMKRHEMVDESPGQVWLTPVISALWEARAGGLLEPRSLRPAWSTWKN

SEQ ID NO: 25325 - protein, 81 aa, Aotus trivirgatus
IGWQESVTFQDVAVGFTPEEWQLLDCNYRNLFSVGCPVTKTKVILKAEQEQEPWIVEGVNPHQSSPESDCPLVDEPGKHWE

SEQ ID NO: 25326 - protein, 81 aa, Aotus trivirgatus
EMGLLTFRDVAIEFSLTEWQFLDTAQRNLYRNVMLENYENLVFLGIAVSKPDLITCLEQEKELWNMKRLEVVDKPPVLCSH

SEQ ID NO: 25327 - protein, 81 aa, Aotus trivirgatus
VTFEDVFVYFSRDEWELLEEAQRFLYRDVMLENFALVATLAFIFQFHVVAHLERGRKPWVPNRADITPATIWETWGGPVLA

SEQ ID NO: 25328 - protein, 81 aa, Papio anubis
GLLTFRDVAIEFSQEEWKCLDPAQRTLYRDVMLENYRNLVSLGIFSKYEIKELPTKKESNTGEIFQTVMLERHESHDIEDF

SEQ ID NO: 25329 - protein, 81 aa, Sarcophilus harrisii
TSWLHQESVTFKDVAVDFTQEEWRQLNPSQKELYRDVMLENYRNLVFLDVIYQLEQRKIPWMLGREVPRSTYTDWETKPEI

SEQ ID NO: 25330 - protein, 81 aa, Sarcophilus harrisii
CQRPVTFQDVSVDFTWEEWGQLDLPQRDLYRDVMLENYENLVFLGLSVSKPYVISQLERGEAPGLLKEPEEEVLIDPGPDY

SEQ ID NO: 25331 - protein, 81 aa, Lipotes vexillifer
LQGSVTFQDVAVDFTLEEWQLLGCAQRKLYWDVMLENFRNLISVGCPVTKTKVIFKVEQGQEPWMVEGENPRWRSPEVICL

SEQ ID NO: 25332 - protein, 81 aa, Pan paniscus
TGYVTFEDVAVYFSQEEWRLLDDAQRLLYRNSFWLSAATHLSFSLGLASSKTHEITQLESWEEPFMPAWEVVTSAIPRGCW

SEQ ID NO: 25333 - protein, 81 aa, Pan paniscus
PQLTFEDVAVKFTQEEWNLLSEAQRCLYRDVTLENLALISSLGCWCGVEDEAAPSKQSIYIQRETQVRTPMTGVSPKKAHP

SEQ ID NO: 25334 - protein, 81 aa, Lipotes vexillifer
SLGSVSFKDVTVDFSREEWQQLDLAQKSLYRDVMLENYFNLISVGCQVPKPEVIFNLERGEEPCMLDGEISSQSYLDQGIG

SEQ ID NO: 25335 - protein, 81 aa, Pteropus vampyrus
VLEQVTFEDVVVDFTQEEWEQLTPAQRMLYSDVMLDTFELLVSIGHWLPKPAVISLLEQEAEPWAAAEGVPDGVCPDFETG

SEQ ID NO: 25336 - protein, 81 aa, Pteropus vampyrus
DQALMAFQDIAVAFTEKEWKILSPAQRTLYRDVMLENYSHLVSLGIAFSKPELITQLEQGDEPWKDESECLLDLCPAEPRT

SEQ ID NO: 25337 - protein, 81 aa, Pteropus vampyrus
QESVTFKDVAVDFTLEEWGRLGPGQRELYRDVMLETYQNLLSLGAGLPGSKPDVISRLERGEEPRMEEREVWQVTCPDLET

SEQ ID NO: 25338 - protein, 81 aa, Aotus trivirgatus
QAEVTFEDVAVLLSREEWGRLGPAQRGLYRDVMLETYGNLVSLALGTSTEYKELTSRETFDEEELGRLRGIFPQGSEPVDA

SEQ ID NO: 25339 - protein, 81 aa, Aotus trivirgatus
SQEPVTFADVAVVFTPEEWVFLDSTQRSLYRDVMLENYRNLASVAGDQLCKPNALSYLEQRGEQWTTERGVISDTCPEPQL

SEQ ID NO: 25340 - protein, 81 aa, Aotus trivirgatus
IQGQVNFEDVFVYFSQEEWVLLDEAQRLLYRDVMLENFALMASLGCWPGMKDEEIPFEQSISIGLSQIRIPKGSPSTQKAY

SEQ ID NO: 25341 - protein, 81 aa, Pan paniscus
APDLDTVTFDDVAVDFTQEEWTLLDPSQRDLYRDVMLENYENLASVEWRLKTKGPALLQDGSWFRASNETQMARSHNGGQL

SEQ ID NO: 25342 - protein, 81 aa, Lipotes vexillifer
FQVPVTFSDVAIDFSQEEWECLNSDQKNLYRDVMLENYTNLISLDIDFTSESNKLSSEKSSYEVNSYHRETMNRSKTFNFM

SEQ ID NO: 25343 - protein, 81 aa, Lipotes vexillifer
MLENYGHLVSLGFNISKPHVVSLLEQGKDWRNPWLGKDASRGLFSASESNGEIKEFSPKNVIYEDDSSQYLIRSSNLSFER

SEQ ID NO: 25344 - protein, 81 aa, Callorhinus ursinus
FQGSVTFRDVAIDFSQEEWEWLQPAQRDLYRHVMLENYGHLVSLAGFNISKPYVVSLLEQGREPWLVKGDVRRDPFSESNG

SEQ ID NO: 25345 - protein, 81 aa, Callorhinus ursinus
MFKDVAVVFSEEELGLLDSTQRKLYRDVMLENFRNLVSVGNQPSKPELIFRLEREEKLLMMETETQRDGYLGTKSQHIMES

SEQ ID NO: 25346 - protein, 81 aa, Callorhinus ursinus
NSQGFVSLKDVTVDFTWEEWQHLNSAQRNLYRDVMLENYSNLVSVGCQSLKSDVISLKQGEPWMKEEEISSWAYSDFDIRP

SEQ ID NO: 25347 - protein, 81 aa, Callorhinus ursinus
MLENYSNLVSIGLCIPKPDVISLLEQGKEPWSVFDSELTRGLYLEYKSRCKNKKLSLKKDNYKIDSSQCVIMEGFTKHGLK

SEQ ID NO: 25348 - protein, 81 aa, Tursiops truncatus
FQEPVSFKDVAVTFTKEELGLLDSTQRKLYQDVMLENFRNLVSVGYLPFKLDMILQLGRKKKLWVMEPEAQGAGCSGHGNQ

SEQ ID NO: 25349 - protein, 81 aa, Tursiops truncatus
GGTGMCKGFEDIAMYFSWEEWGLLDEAQRRLYLEVMLENSALVSSLKRFPPFSDFRSPAMHSSHFFRVQPACLQKYPWTHA

SEQ ID NO: 25350 - protein, 81 aa, Tursiops truncatus
VTFEDVAINFTQEEWALLDTSQKTLFRNVMLENITHLVSVGESVNTDVSHTQGDPVGWTDLSDEFTPRSSPQHSPIPLRRK

SEQ ID NO: 25351 - protein, 81 aa, Tursiops truncatus
PLGPVSFKDVAVDFTQDEWQQLDPEQKTTYRDVMLENYSHLVSVEEDWEAHDLIEGAQENEDKHSRQTESVNNKTLIEERG

SEQ ID NO: 25352 - protein, 81 aa, Tursiops truncatus
PALSVQISTASEEQQKMSKSQGFVSFKDVTVDFTQEEWQQLDSAQRNLYKDVMLENYSNLVSVVNLDGKKMGTASCSFFRG

SEQ ID NO: 25353 - protein, 81 aa, Tursiops truncatus
MDPALEEWKLLDEAQRFLYHDVMLETFALAASLGLSSSRYHVVQLELRGEPWVHDRVDMTPDRARGAQIWPGPGCWYIAEN

SEQ ID NO: 25354 - protein, 81 aa, Pteropus vampyrus
SQGRLTLSDVFVEFSQEEWECLAPAQRAFYREVMLESYQNLLFLGISVPDLYIVSILEQGKAPWTLESELKIAQKPNWWEC

SEQ ID NO: 25355 - protein, 81 aa, Pteropus vampyrus
MFQVTFSDVAIDFSHEEWRWLDSAQRNLYKDVMVQNYENLVSLGLSIPKPYVITLLEDGKEPWMVEKKLTKAMFPGWESKW

SEQ ID NO: 25356 - protein, 81 aa, Pteropus vampyrus
MRLSAHSGFGEMAVFSLLLREEPCLCCQARKPDTLSRLDQGEPPWTLADRVYSRTRSGIRKVDDHELEHFQDGSLENNLEQ

SEQ ID NO: 25357 - protein, 81 aa, Pteropus vampyrus
GLLIFRDVAIEFSQEEWECLDTAQRALYRDVMSENYRNLLSLGLAVSKSETCLLDPIIFLEQMKEPWDLKRKKTISIHPAV

SEQ ID NO: 25358 - protein, 81 aa, Pteropus vampyrus
FVGPVSFKDVAVDFTQEEWQQLDLVQRTTYRDVMLENYSHLVAVGCHVVKPEVIIKLEQGEEPWIVEGEVLLQSYPEVWKV

SEQ ID NO: 25359 - protein, 81 aa, Pteropus vampyrus
VAIDDVAVNFTLEEWALLDPSQKKLHKDVMQEIFRNLDSIGKKWEDQNIEDQYKHQGRKLRSQMVEILCENKEESQRGENS

SEQ ID NO: 25360 - protein, 81 aa, Pteropus vampyrus
SQGTVTFKDVAIDFTQEEWQQLDPAQRNLYRNVMLENYNNLITVGYPFTKPDVIFKLEQEEEPWVVEEEVLRRHCPGEIWG

SEQ ID NO: 25361 - protein, 81 aa, Pteropus vampyrus
SVAFEDVAVNFTPEEWALLDPSQKKLYRDVMRETFENLASVGKRVEDYDTEDQYKNHGRKLRSHIEERIYESEASGQCEEN

SEQ ID NO: 25362 - protein, 81 aa, Monodelphis domestica
SQGFITFKDVTVDFTQEEWCLLDYSQKDLYREVMLENVKNLFSVGLSVLREDFVSSFQKGEGTWLLEQKGSKSSCPGTQTN

SEQ ID NO: 25363 - protein, 81 aa, Physeter macrocephalus
VKESVTFKDVAIDFTLEEWRLMDLTQRKLHKDVMLENYRNLVSLGLAVSKPDMISHLEDEKGPWVVVRETSKTPYSELETK

SEQ ID NO: 25364 - protein, 81 aa, Physeter macrocephalus
QLTFEDVAIEFSQEEWECLDPAQRALYRDVMLETYRNLISLDISPIHVIKQLQPKVNSDKGEVFQTPMLGRPESCKIKHFH

SEQ ID NO: 25365 - protein, 81 aa, Monodelphis domestica
PLTFRDVAVDFTREEWRYLHPSQKDLYRDVMLENYRNLVCLGKHSSPGPQNLSGGGSLLSFLVHIVGSPECFLLHVWPTDD

SEQ ID NO: 25366 - protein, 81 aa, Physeter macrocephalus
RISAFTQGLQKTTKSQEEWQYLDPPQRDLYWDVMLENYINLISVGYKTTKPAVIYKLEQGEEPWMVEREISSWRYPEKVWQ

SEQ ID NO: 25367 - protein, 81 aa, Monodelphis domestica
SQESVTFKDVAVYFTQEEWGQLDPGQKYLYRDVMLENYRNLVSLGHHISKPDVISHLEQGEEPWMVGIEILRGTSPGGMTR

SEQ ID NO: 25368 - protein, 81 aa, Monodelphis domestica
AQEVVTFKDVAVDFTREEWCLLSPPQKELYKEVMLENAQNLLSVGLPGPPEDVISYLKQRKDPWMLEQEGLRSCCPEGEIR

SEQ ID NO: 25369 - protein, 81 aa, Physeter macrocephalus
SQGSLSFRDVTVGFTQEEWQHLDSAQRTLYRDVMLENYSHLISVGFCIPKPEVILKLEQGEEPWILEEESPSQCVPELINS

SEQ ID NO: 25370 - protein, 81 aa, Monodelphis domestica
SITFKDVAVDFTQEEWCLLDHSQKALHLEVMLENVQNLLSVETETNFEVKELSRKVNLIIEGSGPQGYINENPHDFFLREI

SEQ ID NO: 25371 - protein, 81 aa, Monodelphis domestica
QGALTFKDVAVDFTQEEWCLLDHSQKELYLEVMLENVQNLLSVETETNFEVKEMSTKLTLFVEGFGPERCLNDGPHVFILR

SEQ ID NO: 25372 - protein, 81 aa, Monodelphis domestica
VQVPIKFEDVAVYFSEPEWKNLDQWQKELYKHVMTANYEILFSLDSAIPKPDLISHIERGEEPFLRDHGNLMKRDKTIGYG

SEQ ID NO: 25373 - protein, 81 aa, Monodelphis domestica
SQGPVKFEDVAIYLWKEEWELMDSTQKRLYRQVMLETYENVLSVGTPHDKPAMIVHLEQGETAWSPALQRPGKEKGRLHGH

SEQ ID NO: 25374 - protein, 81 aa, Monodelphis domestica
LSQRDSDVAVDFTQEEWCLLDHSQKELYLEVMLENVEHLISCFQQGKAPWLLEKKGPRSFSPDFKVKLICTKLSPFMEGSV

SEQ ID NO: 25375 - protein, 81 aa, Monodelphis domestica
MVENAQNLLSVGLPAPPEDVISYLEHREAPWILDEEDPSCCCPEGENRPKIKVNPTDMSLPVEDMDLQRFLSDDPDNVAFR

SEQ ID NO: 25376 - protein, 81 aa, Monodelphis domestica
SQKALTFQDVAVEFTQEEWGLLEPAQKNMHRDVMLENYENFVSLGLPVPKSALIFHLERRETPWLPSGEVLRNTYPDYLVQ

SEQ ID NO: 25377 - protein, 81 aa, Monodelphis domestica
MAGSVTFRDVAVDFSPDEWGRLGPAQRELYREVMLENYRSLAWLAGLAGSCPEVVCQLERGAGPWLLEGDGLASGGPEAGE

SEQ ID NO: 25378 - protein, 81 aa, Monodelphis domestica
SQEYVSFKDVTVDFTHEEWCLLDSSQKALYRDVMLEIAQNLHSLAGLPVPKADLISQLDQEEVPWLLDPKDPRNSCLDRQT

SEQ ID NO: 25379 - protein, 81 aa, Papio anubis
LVMFQDLFIDFSQEEWECLDADQKDLYRDVMMENYSSLVSLDSEFRCKTKDSCLPKEIYEVTSSQWVRMEKCHSLVGSSVR

SEQ ID NO: 25380 - protein, 81 aa, Papio anubis
DSVTFEDVAVDFTQEEWTLLDQTQRNLYRDVMLENYKNLVAVDWESHVNTKWSAPQQNCLQGKTSSVVEMSHTLSPRLECS

SEQ ID NO: 25381 - protein, 81 aa, Papio anubis
MGLLTFRDVAIEFSQEEWEHLDSDQKLLYGDVMLENYRNLVSLGLAVSKPDLITFLEQRKEPRNVKSEETVAIQPDMFSHD

SEQ ID NO: 25382 - protein, 81 aa, Papio anubis
SQHLVTFEDVAVDFTQEEWTLLDQTQRDLYRDVMLENYKNVIILAGSELCKTSLMSGLEQMEELRTGVTGVLQGEKQYCRE

SEQ ID NO: 25383 - protein, 81 aa, Aotus trivirgatus
IQDSVVFEDVAVDFTQEEWALLDLAQRNLYRDVMLENFQNLASLGYLLHTPHLISQWEQEEDLQTVKRELIQGICVREHQE

SEQ ID NO: 25384 - protein, 81 aa, Papio anubis
VTFEDVAVYFIRKEWKRLEPAQRDLYRDVMLENYGNVFSLDWIHISLTMQKVMLAWFTGTLSVGKDSGSRELASVEPPDTF

SEQ ID NO: 25385 - protein, 81 aa, Papio anubis
SQESVAFEDVAVYFTTKEWAIMVPAERALYRDVMLENYEAVAFVVPPTSKPALVSHLEQGKESCFIRPQVVLSRSDWRAGL

SEQ ID NO: 25386 - protein, 81 aa, Papio anubis
MFKEAVTFNDVAVAFTEEELGLLPAQRKLYRDVMVENFRNLLSVGHQPFKQDVSPIERNEQLWIVTTATQRQRNLGEKNQS

SEQ ID NO: 25387 - protein, 81 aa, Aotus trivirgatus
VTFEDVAVNFSKEEWCLLSEAQRCLYRDVMLENLALISSLGCWCGLKDEAAPSKQSLTVQTESQDRTPRAVSPKKAHSCDM

SEQ ID NO: 25388 - protein, 81 aa, Sarcophilus harrisii
MFEDVAVYFTQKEWADLAPAQRALYKDVMLENYGNIVSLAFPFPKPAVISKLEQGEEPWSLDPQVAPNGEGLKGISFSKTA

SEQ ID NO: 25389 - protein, 81 aa, Pan paniscus
EMGLLTFRDVAIEFSPEEWQCLDTAQQNLYRNVMLENYRNLAFLGIAVSKPDLITCLEQGKEPWNMKQHEMVDEPTDRVLL

SEQ ID NO: 25390 - protein, 81 aa, Pan paniscus
PQGSLTFRDVAIEFSQEEWKCLDSVQKALYRDVMLENYRNLGFLGLCLPDLNIISVLEQGKEPWTVVSQVKIARNPNCGEC

SEQ ID NO: 25391 - protein, 81 aa, Lipotes vexillifer
AKDCVTFEDVAIYFSQEEWGLLDEAQRLLYCDVMLENFALIASLGLTSFRSHVVAQLEMGAEPWVPDRVDMTSAMARGAYR

SEQ ID NO: 25392 - protein, 81 aa, Aotus trivirgatus
DSMTLEDIVVDFTREEWALLDTSQRKLFRDVMLENISHLVSIGKEGDIKHQEMPFIQHIYQKDISTISTMRSHTQDDPFLC

SEQ ID NO: 25393 - protein, 81 aa, Aotus trivirgatus
RPRALKFVDVAVYFSSEEWGCLRPAQRALYRDVMRETYGHLGALGFPGPKPALISWMEQESEAWSSAAQDPEKGENLGGAR

SEQ ID NO: 25394 - protein, 81 aa, Papio anubis
LTGLLTFRDVAIEFSQEEWKCLDPAQRTLYRDVMLENYRNLVSLDISSKCMMNTLSSTGQGNTEVFHTGILQRQASYHIGA

SEQ ID NO: 25395 - protein, 81 aa, Aotus trivirgatus
AHALVTFRDVAIDFSQKEWECLDPTQRKLYRDVMLENYSNLVSLGLLSRHKTKKLSSEKDIHEISFSKGNIIEKSKTLHLK

SEQ ID NO: 25396 - protein, 81 aa, Aotus trivirgatus
TSKEAVTFKDVAVVFTEEELGLLDSAQRRLYRDVMLENLRNLLSVGHLPFNRDTFHFLREEKFWMMDIATQREGNSGGKIE

SEQ ID NO: 25397 - protein, 81 aa, Aotus trivirgatus
TQESLTLEDVAVEFSWEEWQLLDTAQKDLYRDVMVENYNHLVSLGYQTSKPDALSKLAHGQEPWMTDAKIQNKNCPGIRKV

SEQ ID NO: 25398 - protein, 81 aa, Aotus trivirgatus
MLENYRNLAFLGIAASKPDLITCLEKAKEPWKMKQHAMVDEPPVICPHFAQDLWPEQGMEDSFQKVILRRYQKCGHENLQF

SEQ ID NO: 25399 - protein, 81 aa, Aotus trivirgatus
GMTFEDVAIYFSQEEWELLDEAQRFLYCNVMLENFAHVTSLGFCHGTENEAIASEHSVSLQVRTSKGDTPTQNTHLTEVKM

SEQ ID NO: 25400 - protein, 81 aa, Lipotes vexillifer
RKVPVSFEDVSVYFTKTEWKLLDLRQRMLYKRVMLENYRHLVSLGFSSSKPHLVSRLERGEGPWVADVHRMGTTTGMQAGD

SEQ ID NO: 25401 - protein, 81 aa, Pan paniscus
VKESLTLEDVAVEFSWEEWQLLDTAQKNLYRDVMVENYNHLVSLGYQTSKPDVLSKLAHGQEPWITDGKIQNKNCPGIGKV

SEQ ID NO: 25402 - protein, 81 aa, Lipotes vexillifer
SVTFEDIAVYFSWEEWRLLDETQRRLYLDVMLENFALISSLGCCCGAEDAEAPFEQITSLGVSQARIPKAALSSQKTHPCE

SEQ ID NO: 25403 - protein, 81 aa, Lipotes vexillifer
SRSLENDGVCFSAQEWENLEGWQKELYTNAMKSSYETLVSLKVLGQPEGEAELGTEMLDDLEEEDSHGVHPVEGVMIKQEI

SEQ ID NO: 25404 - protein, 81 aa, Pan paniscus
ETVTFKDVAMDFTPEEWGKLDPVQRDVMLENYRNLVSLWLPVSKPENYNLENGKEPLKLERKAPKSSYSDVETRPQSKDST

SEQ ID NO: 25405 - protein, 81 aa, Lipotes vexillifer
AQVLVTFKDVAVTFTREEWGQLDLDQRTLYQEVMLEICGLLVSLGHPVPKPESIHLLEHGQELWTGRRGLPRSMCPGDRAK

SEQ ID NO: 25406 - protein, 81 aa, Callorhinus ursinus
FQELVTFRDVAIDFSRQEWEYLDPIQRDLYRDVMLENYRNLVSLGHSISKPDVVDLLEQGKEPWMILREETQGQYTDLDLH

SEQ ID NO: 25407 - protein, 81 aa, Callorhinus ursinus
MDFTLEDWEHLGLDQGDLFWDTALDNYQNLFLLNPSKPKLTSHTDGTEELKVLVRESPESAGPDTAEVKNCLLAQDFLEEE

SEQ ID NO: 25408 - protein, 81 aa, Callorhinus ursinus
FQESVTFEDVAVYFSENEWTGLAPAQRVLYRDVMLENYGAVASLAFPFPKPALISQLERGEAPWCKAPQGALDGEGPRGVS

SEQ ID NO: 25409 - protein, 81 aa, Callorhinus ursinus
CEGLVSFEDVTMDFSREEWQQLDPAQRCLYWDVMLEIYSHLLSVGYHIPNPEIISRMEKGKKSWIRGAQLPHQRHREVVFG

SEQ ID NO: 25410 - protein, 81 aa, Tursiops truncatus
EEGRVTFEDVAVYFSQEEWGLLDKAQRLLYRSVMLENFSLMASLGLTFSRTQEITQLEQWGEPFVPACEVVITATPRGCWC

SEQ ID NO: 25411 - protein, 81 aa, Tursiops truncatus
MDFTPEEWGRLDPAQRDVMLENYRNLVSLWLPVSKPENHNLENGKEPLMLERKAPKSSCSDSETRPGSKDSTSVQDFSKEE

SEQ ID NO: 25412 - protein, 81 aa, Tursiops truncatus
ASQGLLTFQDVVIEFSQDKWEFLESTQWELYRDVMLENYKNVVSLGPVSKPDLVTFMEQRRAPWDVKGMETIAIHPGTGDP

SEQ ID NO: 25413 - protein, 81 aa, Tursiops truncatus
SAAGSVTFKDVTMAFTKKEWEQLDPAQKSLYKDVMLENYSNLASMGYQALKPDISKLGKGEEPWLGKGKRPRQGGLSEIAR

SEQ ID NO: 25414 - protein, 81 aa, Tursiops truncatus
MVENYSHLISLAGCSIPKPDVFSLLERGKEPWMVVRAMTRWSSDLEYICETKRSCPEKGTYEMESLQWENMRKPISHNLEC

SEQ ID NO: 25415 - protein, 81 aa, Pteropus vampyrus
LQEQVSFKDVCVDFTQEEWYLLDPTQKILYRNVMLENYSHLVSIGCCTIKPEVIIKIEQKEEPWILEQGFPSQCHPEDWKV

SEQ ID NO: 25416 - protein, 81 aa, Pteropus vampyrus
TQASVSFKDVTVEFTLEEWQYLSASQRTLYRDVMLENYSHLISVGYCFTKPELIFMLEQGEALWLLEKEFLSRSSPEESQL

SEQ ID NO: 25417 - protein, 81 aa, Pteropus vampyrus
SQHLVTFEDVAVNFTQEEWTLLDQTQRDLYRDVMLENYKNLITLGYESCKPSVSSGLERAGELKTATGGVWQELDLQLKTK

SEQ ID NO: 25418 - protein, 81 aa, Pteropus vampyrus
PQGLVTFEDVAVDFTQEEWQYLNPPHRTLYRDVMLETYSNLVSVAGQQATKPDIILKLEVEEPCLAEGIIPIWSFPEEACQ

SEQ ID NO: 25419 - protein, 81 aa, Papio anubis
SQGRVTFEDVTVNFTKGEWQRLNPEQRNLYRDVMLENYSNLVFVGREETTKPDVILRLEQGKELWLVEEEVLGSGRPEKNR

SEQ ID NO: 25420 - protein, 81 aa, Aotus trivirgatus
MAATGPCSEAPVQGCDAGELQQLGLCGVPDVQRSWSKFCNFPLTGYHVSKPDVIFKLEQGEEPWIVEEFSNQSYPEVDHTL

SEQ ID NO: 25421 - protein, 81 aa, Papio anubis
FEELVTFEDVFVDFSPEELSSLSAAQRNLYREVMLENYRNLVSLGYQFSKPDIISRLEAEESRAMETDSRHTVICQGEAHD

SEQ ID NO: 25422 - protein, 81 aa, Aotus trivirgatus
MLENYKNLSTVGCQLFKPSLISWLEQEESRTVQRGDFQTGSHNGGELNDIKQCGDVSSEHSCLNTHVRTQNSESTFECHQY

SEQ ID NO: 25423 - protein, 81 aa, Aotus trivirgatus
QERLTFRDVSIEFSSAEWKCLTPAQRALCREVMLENYRNLESVANGNLNCSSFLRKQINHLGKKQYECDVCGKVFNEKRCL

SEQ ID NO: 25424 - protein, 81 aa, Papio anubis
QDTVAYEDLCVDYTQKKWKCPALSQRALQWNMIPQNDHGMASLGRNVMESSELIPKQEIFKGSESSNSTSGGLFGVVPGAA

SEQ ID NO: 25425 - protein, 81 aa, Aotus trivirgatus
GSVTFEDVAVYFSWEEWDLLDETQKHLYFDVMLENFVLTSSLGYWRGLEREEAPSSSRISVKGVPQFRTSKEGSSSQTAYS

SEQ ID NO: 25426 - protein, 81 aa, Aotus trivirgatus
SKGSLMFRDVSIDFSQEEWECLDSGQMNLYKEVMLENFSNLVSVGLSSSKPAVISLLEQGREPWMVDRELTRGLCSDLESM

SEQ ID NO: 25427 - protein, 81 aa, Lipotes vexillifer
KIEDVADVAVSFILEEWGHLDQSQKSLYRDDRKENYGSITSMDYESRNDNVELIVKQISDEAASPWMTSGSPERNVPPSQE

SEQ ID NO: 25428 - protein, 81 aa, Lipotes vexillifer
MLENFRNLLSVGNQPFKPELIFQLEREEELLMMETETQREGCSGTKSQHIMESIQEVGLSCLSPKELSTWQTWQQGAGMLT

SEQ ID NO: 25429 - protein, 81 aa, Pan paniscus
PRGSTFFSSVTVAFAQEGWRCLVSTPRERFKEGIPGKSRSLVLLGLPVSQPGMNSQLEQREGAWMLEGKDLRSPSPGWKII

SEQ ID NO: 25430 - protein, 81 aa, Pan paniscus
WSQMPVTFEDVALYLSREEWGRLDHTQQNFYRDVLQKKNRLSLGFPFSRPFWAPQAHGKGEASGSSRQAGDEKEWRGACTG

SEQ ID NO: 25431 - protein, 81 aa, Lipotes vexillifer
QAQETLTFEDVAVDFTWEEWQLLAPPQRDLYRDVMLENYSNLLSVGFQASKPNILSKLGQGEPWMMEDEIHCQTRSEIWKV

SEQ ID NO: 25432 - protein, 81 aa, Lipotes vexillifer
KEAFMAFGDVAVDFTQEEWRLLSPAQRTLHREVMLETYNHLVSLEIPFSKPKLISQLERGEEPWIKERQRPLSLCPAGSKL

SEQ ID NO: 25433 - protein, 81 aa, Callorhinus ursinus
PKVPVTFDDISIYFSTPEWEKLEEWQKELYKNIMKGNYESLISMDYAMNQPDVLSQIQPEGEHNTEEQAGPEGSEIPTDPS

SEQ ID NO: 25434 - protein, 81 aa, Callorhinus ursinus
SQEPVTFEDVAVYFTQNQWASLDPMQRALYLEVMLENYANITSLAALPFPKPDLILQLEQGEAPWGLDPWTPLDGEALGGV

SEQ ID NO: 25435 - protein, 81 aa, Callorhinus ursinus
TEQAVMFRDVAVDFSQEEWEFQDLKQRNLYRDVMLENYSHLVSLGLSLSKPTLISFLEQDNEPWIVEKESPKSLYPDVKSQ

SEQ ID NO: 25436 - protein, 81 aa, Pan paniscus
SLEVGVLTFRDVAIEFSLEEWQCLDTAQQNLYRNVMLENYRNLVFMGIAASKPDLITCLEQGKEPWNVKRHEMVAEPPGLQ

SEQ ID NO: 25437 - protein, 81 aa, Lipotes vexillifer
QMDSVVFEDVAVNFTAEEWALLDPAQRKLYRDVMLETFRNLASVGNTGQETSYSLECKKSGKALTCPSSFQEHERVHYGQK

SEQ ID NO: 25438 - protein, 81 aa, Callorhinus ursinus
MAFSQEEWGCLNHTQRELYRDVMLENYGHLLFLGFIVWNHLVIVSTDLVIFVEQKNAHWDVKTVAIQLVCTDEEGAHLCVV

SEQ ID NO: 25439 - protein, 81 aa, Callorhinus ursinus
SQGLVTFKDVAVCFSQDQWSDLDPAQKEFYGEYVLEEDCGIVVSLSFPIPRLDEISHVREEEPLVPDTPEPQEPQEPEILS

SEQ ID NO: 25440 - protein, 81 aa, Tursiops truncatus
AHGSLTFSDVAIGFSQQEWECLDLVQKTLYRDVMMENYGNLVSLGHSISKPNVITLLEQGKEPWMFMREKTRSWCTDLDSR

SEQ ID NO: 25441 - protein, 81 aa, Tursiops truncatus
VQASLSFEDVAVHFTWEEWQLLDPSQKDLYRNVMWENYCNLVSVGYQTPKPDSFFQLEQGEPPWTVEGAGQSQTCPGTRAS

SEQ ID NO: 25442 - protein, 81 aa, Tursiops truncatus
SRSLENDGVCFSEQEWENLEGWQKELYTNAMKSSYETLVSLKVLGQPEGEAELGTEMLGDLEEEDARGVHPAEGVMIKQEI

SEQ ID NO: 25443 - protein, 81 aa, Sousa chinensis
TSLSNKKNLVSYDDFLLSKFYPSPGEAQKRRKQCMLNLYKQFSGYVGVSSFFSSKPTVISLLEQGKEPWMVDRELTRGLCS

SEQ ID NO: 25444 - protein, 81 aa, Pteropus vampyrus
SQTLLTFEEVAVYFSQEEWELLDPSQKAFCNDIMQENYESVISLAIFVLPKPKVISCLEQGEEPWVQGSPNLKNNDKELPT

SEQ ID NO: 25445 - protein, 81 aa, Pteropus vampyrus
VQSPLFPTSQKGCTEEEGFVNGFLTSWLLDLVTFEDVAVEFTQEEWALLDPSQRKLYRDVMLETCRNLASLGKADITPTSV

SEQ ID NO: 25446 - protein, 81 aa, Pteropus vampyrus
AHGSVTFRDVAIDFSQEEWEFLDSAQRDLYRDVMWENYSNFISLGPSISKPDVVTLLDEGKEPWMVVREGISRHYPDLESR

SEQ ID NO: 25447 - protein, 81 aa, Trichechus manatus
ESVTFKDVAVDFTLEEWALLDTSQRKLFRDVMMENIDHLVFVGGETGLNKEEMVSLQHISRKDTPTIMALRSLTGEDTFEC

SEQ ID NO: 25448 - protein, 81 aa, Papio anubis
AQGLVTFRDVAIEFSLEEWKCLEPAQRDLYREVTLENFGHLASLGLSISKPDVISLLEQGKEPWMIANDVTGPWCPDLESR

SEQ ID NO: 25449 - protein, 81 aa, Papio anubis
FQKPVTFEDVAVNFTEEEWDCLDASQRVLYQDVMSEIFKNLASVARIFLHKPERITQLEQQEEQWRETQVLQASQAGPPFF

SEQ ID NO: 25450 - protein, 81 aa, Aotus trivirgatus
VQESVTFRDVAVFFSPDEWLHLDSAQRALYREVMLENYSSLVSLGIPFSMPKVIHQLQQGQDPCMVEGEVPSDICLGFKTW

SEQ ID NO: 25451 - protein, 81 aa, Aotus trivirgatus
LVTFRDVAIDFSQEEWECLDPAQRDLYRDVMLENYSNLISLDLESSCEINKLSPEKEIYEVESFQWENMGKFINHHLQYNG

SEQ ID NO: 25452 - protein, 81 aa, Papio anubis
PQGHLTFMDVAIEFSQEEWKCLDPGQRALYRDVMLENYRNLVSLGRSCILGSNAENKPTKNQLGFTLESHLSELQLFEAGR

SEQ ID NO: 25453 - protein, 81 aa, Aotus trivirgatus
LFQVTFSDVILLRDLYKDVMVQNYENLVSLGLSITNNVITLLEDGKEPWMVEQKLSKGVTPDWESKLENKELSTKKDIYEE

SEQ ID NO: 25454 - protein, 81 aa, Aotus trivirgatus
KSQGSVSFKDVAVGFTWEEWQLLDPVQKTLYRDVMLENYSNLVSLGYQVTKADALFRLEHRKLWILEEEIQSQVCPEDAWQ

SEQ ID NO: 25455 - protein, 81 aa, Callorhinus ursinus
TFKEAVTFKDVAVVFTEEELGLLDPAQRKLYRDVMLENFGNLVSVGHQPFKRDVVHLVREEKFWMVKLATQRKGNSGEKVQ

SEQ ID NO: 25456 - protein, 81 aa, Callorhinus ursinus
AVTFKDVVVVFTEEELALLDKAQINLYQDVMLENFRNLVSVGDRIKNNISHLQGKGLSYLSQKVLYCWQIWKQRISELTVS

SEQ ID NO: 25457 - protein, 81 aa, Callorhinus ursinus
YQEFVTFEDVAVHLTREEWGCLDPVQRDLYREVMLENYGNVVSLGFPISKPDGISQREQDLQVFDLETKNREVLRDDCSDG

SEQ ID NO: 25458 - protein, 81 aa, Callorhinus ursinus
MDSVVFADVAVYFTPEEWALLNRGQRRLYRDVMLETCRNLASLDCCIQVKPCGSGTQLNILENELSSEDKIVRFTRNDSWA

SEQ ID NO: 25459 - protein, 81 aa, Callorhinus ursinus
SVAFQDLAVRFSEEEWQLLGEGQRALYRDVMRENYETLRSLGTDELLPLSAFLSPTAPGGATEGRSYAGEGQEPPRGGGPL

SEQ ID NO: 25460 - protein, 81 aa, Callorhinus ursinus
SQHLVTFEDVAVNFTQEEWTLLDQTQRDLYRDVMLENYQNLIILGCESCKPDLNSSVGGAEELRTGGRGILQELDLQLKTK

SEQ ID NO: 25461 - protein, 81 aa, Callorhinus ursinus
MLENYGNLVSVGLLSSKPKLITQLEQGAEPWMEVKQIPSDTCSVQEYWFETKMSPLKQHTSEGSDLGEQTKSDVMERGLDW

SEQ ID NO: 25462 - protein, 81 aa, Callorhinus ursinus
MLENYRNLVSVGYVARKPDALSRLEQGELWTTEHEIPSRICPEIKKDDGHLQGHLQNQRCPKRMKQCHEHNAFGNVIHQSK

SEQ ID NO: 25463 - protein, 81 aa, Tursiops truncatus
MLENFRNLISMGCPVTKTIVIFKVEQGQEPWMVEGENPRWRSPEADCPLIDESDKHQESKDNFLNSVLFMFNKILTVKRLH

SEQ ID NO: 25464 - protein, 81 aa, Tursiops truncatus
CEGSVSFEDVTIDFSREEWQQLDPAQRRLYQDVMLEIYSHLFSVGYRIPNPEIIFRMEKRKEQWMREAELPRQRYHEGESG

SEQ ID NO: 25465 - protein, 81 aa, Tursiops truncatus
VPVTFDDVAVYFSEPEWGKLDEWQKELYKHVMRGNYETLVSLGLPPYPEHTSSPVSPARKEPKEGQASKHQQDSETRVTPP

SEQ ID NO: 25466 - protein, 81 aa, Monodelphis domestica
MLENYRNLVCLGLADSNKDVRISELESGEPHWIPTGGVLRSCWPGWESRPQNKESAPKMSISVKVLSQEKFLEDDPRICKM

SEQ ID NO: 25467 - protein, 81 aa, Papio anubis
GSVTFTDVAIDFSQDEWERLNLAQRSLYKKVMLENYRNLVSVGLCLSKPDVISLLEQEEDPWVIKGEMTRSLCPDLECVWV

SEQ ID NO: 25468 - protein, 81 aa, Papio anubis
WSQMPVTFEDVALYLSREEWGRLDRTQQNFYRDVLQKRNGLSLGFPFSRPFWAPQALGKGEASGSSRQTGDEKEEWRGAYS

SEQ ID NO: 25469 - protein, 81 aa, Papio anubis
PLTFKDVAIEFSREEWKCLEPVQKALYKDVMLENYRNLVFLGISPKCVIKELPPTENSNTRERFQTVALERHQSCDIENLY

SEQ ID NO: 25470 - protein, 81 aa, Sarcophilus harrisii
RRESVTFKDVAVEFTLEELVHLNPSQKKLYKEVMMENYKNLVFLGCTISKPDMIYQMESKEIFWVPDADIPRTSCPETKEC

SEQ ID NO: 25471 - protein, 81 aa, Pan paniscus
ALAQGQLSFSDVAIEFSQEEWKCLDPGQKALYRDVMLENYRNLISLDFSLLAWDARVSRVEAWRASGGAEEPTDPNFVGND

SEQ ID NO: 25472 - protein, 81 aa, Pan paniscus
AQESLTLEDVAVDFTWEEWQFLSPAQKDLYRDVMLENYSNLVAVGYQASKPDALFKLEQGEQPWTTEDGIHSGACSDIWKV

SEQ ID NO: 25473 - protein, 81 aa, Lipotes vexillifer
AAVSFADVAVYFSPEEWGCLRPAQKALYRDVMRETYGHLDALGDAPNKKEEEPKTGPGAKGSEKTPRKERPEELVKNNLDP

SEQ ID NO: 25474 - protein, 81 aa, Pan paniscus
KSKEAVTFKDVAVVFSEEELQLLDLAQRKLYQDVMLENFRNVVSVGHQSTPDGLPQLEREEKLWMMKMATQRDNSSGAKNL

SEQ ID NO: 25475 - protein, 81 aa, Lipotes vexillifer
GQLTLNDVVIEFSQEEWECLDPAQRALYRDVMLETYRNLIFVDISHIHVTKKLQLKSNTDKGGVFQTLMLERHESQGIKHF

SEQ ID NO: 25476 - protein, 81 aa, Lipotes vexillifer
LQDLVSFEDVTVEFTQEEWALLDPSQRTLYRDVMLENCRNLASLGYHVDKPSLISQLEQEDKVMAEETGILPGTCPDLETV

SEQ ID NO: 25477 - protein, 81 aa, Lipotes vexillifer
PEGGVTFEDIALYFSWEEWKLLDEAQRRLYHDVMLENFALISSLGVWSGEENVEASFEQSVSVVMSQVSTSKEPSSSQKTH

SEQ ID NO: 25478 - protein, 81 aa, Pan paniscus
PQGLLTFRDVAIEFSQEEWKCLDPAQRTLYRDVMLENYRNLVSLDISSKCMLKTLSSTGQGNTEVIHTGTLQRQASHHTGE

SEQ ID NO: 25479 - protein, 81 aa, Papio anubis
KDVAIDFTLEEWRLMDPTQRNLHKDVMLENYRNLVSLGLAVSKPDMISHLENGKGPWVTMREISRIPYPDMEPKPATKNAT

SEQ ID NO: 25480 - protein, 81 aa, Papio anubis
VQEPVTFKDVAVDFTQEEWGQLDLVQRTLYRDVMLETYGHLLSVGNQIAKPEVISLLEQGEEPWSVEQACPQRACPEWMRN

SEQ ID NO: 25481 - protein, 81 aa, Aotus trivirgatus
AQESMTFRDVAVFFSQDEWLHLDSAQRALYREVMLENYSTLVSLGIPFSMPKVIHQLQQGQDPCMVEGEVPSDICLGFKTW

SEQ ID NO: 25482 - protein, 81 aa, Aotus trivirgatus
GPLTFRDVTIEFSQEEWKCLDPAQKALYKDVMLENYRNLVFLGIIPKCTTKELPPIGNSNTGEKIQTMTLERHECYDIEDI

SEQ ID NO: 25483 - protein, 81 aa, Papio anubis
FQELVTFRDVAVDFSQQEWEYLDPNQKDLYRDVMLENYRNLVSLGGHSISKPVVVDLLEQGKEPWMILREETQFTDLDLQC

SEQ ID NO: 25484 - protein, 81 aa, Aotus trivirgatus
MTTVSSTARPQESVAFDDMARALYRDVMLENYEAVVFVVPPTSKPALVSHLEQGKEPCFTQPQGILSRRDWKAAFIGRSEL

SEQ ID NO: 25485 - protein, 81 aa, Aotus trivirgatus
PRLPLTFEDVAIYFSEQEWQDLQAWQKELYKRVMRSNYETLISLDAGLPKPELISWIEQGEEPFRNWRESQKSGNIICSSV

SEQ ID NO: 25486 - protein, 81 aa, Pan paniscus
KDVAIEFSPEEWKCLDTSQQNLYRDVMLENYRNLVSLGVTISNPDLVTCLEQRKEPYNLKIHETAARPPAVCSHFTQNLWT

SEQ ID NO: 25487 - protein, 81 aa, Lipotes vexillifer
QGLLTFRDVAIEFSQEEWECLDPAQRALYRDVMLETYRNLLSLDISISFLTKELLKKKNINNRELYQPVVLGRHGSHGIED

SEQ ID NO: 25488 - protein, 81 aa, Callorhinus ursinus
MKWGKSAGFLVFKPELISRLEQGQEPWVLDLKGVEGREGARTFLTDSAVGIAGEQACEDMDVLKSEPYVAMVRSPPQGFPQ

SEQ ID NO: 25489 - protein, 81 aa, Callorhinus ursinus
ELLSFEDVAMYFTREEWNKLEWAQKDLYRDVMLENYRNMILLGSEARCKMKKPTPKQKISEDLESSVVKQTTANRSAEELH

SEQ ID NO: 25490 - protein, 81 aa, Tursiops truncatus
AQGKVNFEDVFVYFSQEEWGLLDEAQRLLYREVMLENFALMASLGCSHGMEEEEIPFEQSVSVKGVSQVTIPKTIPSSQKA

SEQ ID NO: 25491 - protein, 81 aa, Tursiops truncatus
MYKDVMLENYRNLVSLGHQLPKPEVILQLEKGEEPWLLERGIHQETYPDLETAVEVKSSASSKSISKDKHSCDVKMKRMAK

SEQ ID NO: 25492 - protein, 81 aa, Pteropus vampyrus
MASPSPPLEPKEWDYLDPAQRSLYKDVMMENYGNLVSLDVLNRDKDEEPTVKQEIEEIEEKVESQGIIVTRIKSEIDQDPM

SEQ ID NO: 25493 - protein, 81 aa, Sus scrofa
MESVTLKDVAMGLIQEWALLDDAWRNLCRYMLLDNCRTLAPRGAPPCKASLVSQVGPRKELRAAEGGILQATCADWESQLK

SEQ ID NO: 25494 - protein, 81 aa, Bos mutus
QELVMFEEVSVCFTSEEWACLSPVQRALYWDVMLENYGNVTSLAFILKKSLILHQRIHSGEKPYKCDECGKTFAQTTYLVD

SEQ ID NO: 25495 - protein, 81 aa, Nomascus leucogenys
QDSVAFEDVAVNFTREEWALLGPSQKSLYRDVMWETIRNLDCIGMKWEDTNIEDQHKNPRRNLRCHIIERFSESSQIPDNT

SEQ ID NO: 25496 - protein, 81 aa, Nomascus leucogenys
RDVAIELSLEEWQCLDTAQQNLYRNVMLENYRNLVFLGIAAFKPDLIIFLEQGKEPWNMKRHEMVEEPPVICSHFAQELWP

SEQ ID NO: 25497 - protein, 81 aa, Nomascus leucogenys
MLENYFNLISVGCQVPKPEVIFSLEQEEPCMLDGEIPSQSRLDGDIGFGPLQQRMSEEVSFQSEININLFTRDDPYSILEE

SEQ ID NO: 25498 - protein, 81 aa, Nomascus leucogenys
SKESVSFKDVAVDFTQEEWGQLDSAQRALYRDVMLENHQNLLALGPPLHKPDVISHLERGEEPWSMQREVPGGPCPGEQRH

SEQ ID NO: 25499 - protein, 81 aa, Nomascus leucogenys
FQGSVTFEDVAIAFSQQEWERLDSSQRGLYRDVMLENYRNLVSMAGHSLSKPHVIALLEQWKEPEVTVRKDGRRWCTDLQL

SEQ ID NO: 25500 - protein, 81 aa, Nomascus leucogenys
FQASVSFQDVTVEFSQEEWQHLGPVERTLYRDVMLENYSHLVSVGYCFTKPELIFTLEQGEDPWLLEKEKGFLSRNSPEDS

SEQ ID NO: 25501 - protein, 81 aa, Nomascus leucogenys
VAFEDVAVNFTLEEWALLDPSQKNLYRDVMRETFRNLASIGKGDNIPSLSELENNHIPERLCESKEGSQGEETFSQIPDGF

SEQ ID NO: 25502 - protein, 81 aa, Nomascus leucogenys
KSKEPVTFKDVAVVFSEEELRLLDLAQRKLYRDVMLENFRNVVSVGHQSTPDGLPQLEREEKLRMMKMATQRDNSSGGKNL

SEQ ID NO: 25503 - protein, 81 aa, Bos indicus
LLAGPTAAAARMDRAQGGVTFADVFVYFSREEWELLEEAQRLLYRDVMLENFAHVAALGESLFQLPIGTCQTTPKVADVKQ

SEQ ID NO: 25504 - protein, 81 aa, Bos indicus
QMTVEDVAIKFTPEEWECLSPAQRTLYWDVMLETYRNLLSVDISPIHIIKKLQSKENTNSTDTLQTVILGRHESHGVQDFY

SEQ ID NO: 25505 - protein, 81 aa, Bos indicus
LSQKRLTSEDVAIKFTQEEWEFLDPAQRALYRDVMLETFRNLLSVGEDDFLPELPLGIYIFPVCPLGGPDVFHLRVLVTRA

SEQ ID NO: 25506 - protein, 81 aa, Canis lupus
IQGSLTFGDVAVAFTQFEWKYLDATQRALYKDVMLENYGNLLSVGFLSSKPKLITQLEQGAEPWMEVQQIPSDNYSVQEYW

SEQ ID NO: 25507 - protein, 81 aa, Muntiacus muntjak
GLGNVTFEDVFVSFSQEEWGLLGEAQRLLYREVMLETFALMASLGHTSSVSHGVSPQELGREPWVSDRADTSPALTREAQS

SEQ ID NO: 25508 - protein, 81 aa, Canis lupus
SMEPVIFRDVAMYFTQNEWQLLEPAQKDLYRDVMLENYGHLASLGHWFFKPKLITRLEQGDEPCVKERGIPPAPQRGSAGI

SEQ ID NO: 25509 - protein, 81 aa, Muntiacus muntjak
MGRLTFWDVAIDFTQEEWECLDLGQRELYADVMVENYRNLASLGLVVSKLDLVTFLEQMKNPWDVRRMQTTGIYPVLLLYR

SEQ ID NO: 25510 - protein, 81 aa, Muntiacus muntjak
PTLTPHTRTFTPHWRQHVTFEDVFLYFSREEWELLEEAQRLQYRDVMLEDFALVSSLGLAVSRSHGATQPEPEGSPGCLRR

SEQ ID NO: 25511 - protein, 81 aa, Gorilla gorilla
PQVSLTFEDVAVLFTRDEWRKLAPSQRNLYRDVMLENYRNLLSLGLSFTKPKVISLLQQGEDPWELEKDSSGVSSLGCKST

SEQ ID NO: 25512 - protein, 81 aa, Homo sapiens; identical to SEQ ID NO: 2847

SEQ ID NO: 25513 - protein, 80 aa, Homo sapiens
ARNLVFLGIAVSKPDLITCLEQEKEPWNLKTHDMVAKPPGTAFSIFYMFVKFYKYMQCQYTFSEFGYFGTSFFHFSGQIC

SEQ ID NO: 25514 - protein, 81 aa, Homo sapiens; identical to SEQ ID NO: 2848

SEQ ID NO: 25515 - protein, 81 aa, Homo sapiens; identical to SEQ ID NO: 2849

SEQ ID NO: 25516 - protein, 81 aa, Homo sapiens; identical to SEQ ID NO: 2850

SEQ ID NO: 25517 - protein, 81 aa, Homo sapiens; identical to SEQ ID NO: 2851

SEQ ID NO: 25518 - protein, 81 aa, Homo sapiens; identical to SEQ ID NO: 2852

SEQ ID NO: 25519 - protein, 80 aa, Homo sapiens; identical to SEQ ID NO: 2853

SEQ ID NO: 25520 - protein, 81 aa, Homo sapiens; identical to SEQ ID NO: 2854

SEQ ID NO: 25521 - protein, 81 aa, Homo sapiens; identical to SEQ ID NO: 2855

SEQ ID NO: 25522 - protein, 81 aa, Homo sapiens; identical to SEQ ID NO: 2856

SEQ ID NO: 25523 - protein, 81 aa, Homo sapiens; identical to SEQ ID NO: 2857

SEQ ID NO: 25524 - protein, 81 aa, Homo sapiens; identical to SEQ ID NO: 2858

SEQ ID NO: 25525 - protein, 81 aa, Homo sapiens; identical to SEQ ID NO: 2859

SEQ ID NO: 25526 - protein, 81 aa, Homo sapiens; identical to SEQ ID NO: 2860

SEQ ID NO: 25527 - protein, 81 aa, Homo sapiens; identical to SEQ ID NO: 2861

SEQ ID NO: 25528 - protein, 81 aa, Homo sapiens; identical to SEQ ID NO: 2862

SEQ ID NO: 25529 - protein, 81 aa, Homo sapiens; identical to SEQ ID NO: 2863

SEQ ID NO: 25530 - protein, 81 aa, Homo sapiens; identical to SEQ ID NO: 2864

SEQ ID NO: 25531 - protein, 81 aa, Homo sapiens; identical to SEQ ID NO: 2865

SEQ ID NO: 25532 - protein, 81 aa, Homo sapiens; identical to SEQ ID NO: 2866

SEQ ID NO: 25533 - protein, 81 aa, Homo sapiens; identical to SEQ ID NO: 2867

SEQ ID NO: 25534 - protein, 81 aa, Homo sapiens; identical to SEQ ID NO: 2868

SEQ ID NO: 25535 - protein, 81 aa, Homo sapiens; identical to SEQ ID NO: 2869

SEQ ID NO: 25536 - protein, 81 aa, Homo sapiens; identical to SEQ ID NO: 2870

SEQ ID NO: 25537 - protein, 81 aa, Homo sapiens; identical to SEQ ID NO: 2871

SEQ ID NO: 25538 - protein, 81 aa, Homo sapiens; identical to SEQ ID NO: 2872

SEQ ID NO: 25539 - protein, 81 aa, Homo sapiens; identical to SEQ ID NO: 2873

SEQ ID NO: 25540 - protein, 81 aa, Homo sapiens; identical to SEQ ID NO: 2874

SEQ ID NO: 25541 - protein, 81 aa, Homo sapiens; identical to SEQ ID NO: 2875

SEQ ID NO: 25542 - protein, 81 aa, Homo sapiens; identical to SEQ ID NO: 2876

SEQ ID NO: 25543 - protein, 81 aa, Homo sapiens; identical to SEQ ID NO: 2877

SEQ ID NO: 25544 - protein, 81 aa, Homo sapiens; identical to SEQ ID NO: 2878

SEQ ID NO: 25545 - protein, 81 aa, Homo sapiens; identical to SEQ ID NO: 2879

SEQ ID NO: 25546 - protein, 81 aa, Homo sapiens [sequence omitted]

SEQ ID NO: 25547 - protein, 81 aa, Homo sapiens; identical to SEQ ID NO: 2881

SEQ ID NO: 25548 - protein, 81 aa, Homo sapiens; identical to SEQ ID NO: 2882

SEQ ID NO: 25549 - protein, 81 aa, Homo sapiens; identical to SEQ ID NO: 2883

SEQ ID NO: 25550 - protein, 81 aa, Homo sapiens; identical to SEQ ID NO: 2884

SEQ ID NO: 25551 - protein, 81 aa, Homo sapiens; identical to SEQ ID NO: 2885

SEQ ID NO: 25552 - protein, 81 aa, Homo sapiens; identical to SEQ ID NO: 2886

SEQ ID NO: 25553 - protein, 81 aa, Homo sapiens
ASFKDVVVGFTQEEWHRLSPAQRALYRDVMLETYSNLVSVGYEGTKPDVILRLEQEEAPWIGEAACPGCHCWALKVLRELQ

SEQ ID NO: 25554 - protein, 81 aa, Homo sapiens; identical to SEQ ID NO: 2887

SEQ ID NO: 25555 - protein, 81 aa, Homo sapiens; identical to SEQ ID NO: 2888

SEQ ID NO: 25556 - protein, 81 aa, Homo sapiens; identical to SEQ ID NO: 2889

SEQ ID NO: 25557 - protein, 81 aa, Homo sapiens; identical to SEQ ID NO: 2890

SEQ ID NO: 25558 - protein, 81 aa, Homo sapiens; identical to SEQ ID NO: 2891

SEQ ID NO: 25559 - protein, 80 aa, Homo sapiens; identical to SEQ ID NO: 2892

SEQ ID NO: 25560 - protein, 81 aa, Ursus maritimus
MLENYQNLLSLGAGPPGSKPDVISRLERGEEPRMEKREAKQAACPDLDTSSATPWETPLKKSISEEATSPMGKMEGVLRAV

SEQ ID NO: 25561 - protein, 81 aa, Ursus maritimus
EESVTFEDVAVYFSENEWTGLAPAQRVLYRDVMLENYGAVASLEGVLKSEKEDFILKEEHFEEAKDHMVLSSGPRWPGSQE

SEQ ID NO: 25562 - protein, 81 aa, Rhinopithecus bieti
MVENFKNLVAVGHLPFQPDMVSQLEAEEKLWMMETETQRSSQHQNKMETLQKFALKYLSNQELSCWQIWKQVARELTRCLQ

SEQ ID NO: 25563 - protein, 81 aa, Rhinopithecus bieti
MDSVAFEDVAVSFTQEEWALLDPSQKNLYRDVMQETFRNLTSVGKTWKVQNMEDKYKNPRRNLRWSFALVTQAGVQWCDLG

SEQ ID NO: 25564 - protein, 81 aa, Ursus arctos
VQDPVTFQDVTVEFTRGEWEHLDTYQRALYREVMLENYRSLASLGCQDFKPDVISWLEQGGSPWMVWRDIPRDPSPDQETR

SEQ ID NO: 25565 - protein, 81 aa, Ursus arctos
AQVCVISEDVFVCFSREEWMLLDDSQRLLYQDVMLENFALLASLGITSSRSHLVTQLEQREDPRMPDQVDTTPATEREAQK

SEQ ID NO: 25566 - protein, 81 aa, Ursus arctos
SQELVTYEDVAVDFTQEEWQHLDPAQKTLHRDVMLETYSHLVSVGCSGIKPGIIFKLEREEDPRIIKSELSTWVHSDREKS

SEQ ID NO: 25567 - protein, 81 aa, Ursus arctos
SQESVTFQDVAVDFTEKEWPLLDSSQRKLYKDVMLENYSNLASVGYQVGKPSLISHLEQEEEPRTEERALHRATSPDWEAP

SEQ ID NO: 25568 - protein, 81 aa, Ursus arctos
AHHLVMFRDVAVDFSQEEWECLNPYQRNLYRDVILENYSNLVSVGCSISKPDVITLLEQGKEPWMVVRDERRRSLDLESRY

SEQ ID NO: 25569 - protein, 81 aa, Muntiacus reevesi
MGRLRFQDVTIDFTLEEWECLDLSQLELYRDVMLENYRNLASLGLVVSKPDLVTFLEKMKDPRDVRRMETTAIHPDLASFR

SEQ ID NO: 25570 - protein, 81 aa, Muntiacus reevesi
AWSQMPVTFDDVALYLSREEWGRLDHTQQSYREVLQKRRGLSLGFPFSRPFWASQVQGKGEAPGSSRQLGHEEEEKRGAVE

SEQ ID NO: 25571 - protein, 81 aa, Muntiacus reevesi
EQLTSEDVAIEFTQEEWEFLDPAQRALYRDVMLETYRNLLSVDISPTLVIKHLQPKANNDNKREPFQTLMLGRSESCEIKH

SEQ ID NO: 25572 - protein, 81 aa, Ursus americanus
DPALVSFHDVAVVFTREEWRLLSHAQRLLYRCVMLENYSNLVSLGIPFPKPTLVISLEQGEEPWREESKHLPSPCSADAKP

SEQ ID NO: 25573 - protein, 81 aa, Myotis brandtii
ILESVTFKDVVVDFTQEEWKQLDPVQRDLFRDVTLENYTHLVSIGLQVSKPDVISQLEQGTEPWIVDSGIPVGGSGDCVTG

SEQ ID NO: 25574 - protein, 81 aa, Myotis brandtii
EDPVAIEDVAVNFTLEEWALLDTPQKKLYRDVMKETFRNLDSIGQNWEDHYIEDLYKSQGRKLRSQMVERHYESKEGNQHG

SEQ ID NO: 25575 - protein, 81 aa, Propithecus coquereli
VSVTFEDVAVTFTQEEWGQLDLTQRILYQEVMLETCGLLVSLGDITQPGTPEPTLPQLALPEEVSLEQQLTQGASGDSQLE

SEQ ID NO: 25576 - protein, 81 aa, Propithecus coquereli
LTFSDVAVDFSQEEWECLNSDQRDLYRDVMLENYTNLVSLKRSKTFNFMGFIFRNDSQCRIEFERQQGPNAAYFSQMIFRK

SEQ ID NO: 25577 - protein, 81 aa, Propithecus coquereli
QGTVTFSDVAIDFSQEEWACLTSAQRDLYWDVMLENYSNLVSLDLESSSYDPKGLATGKHIRERNFPKRKESLDGKRKSHS

SEQ ID NO: 25578 - protein, 81 aa, Saimiri boliviensis
AQKVLTFRDVAIEFSLEEWKFLDPAQQNLYRDVMLENYRNLFSVGLSVSKPGLITCLEQRKAPWNLKRREAVDGHPEMEFH

SEQ ID NO: 25579 - protein, 81 aa, Saimiri boliviensis
TFKEAVTFKDVAVVFTEEELELMDPAQRKLYRDVMLENFRSLLSVGHQPLQGDTFYFLQEEKFWMMETRSQREGNSGGRIQ

SEQ ID NO: 25580 - protein, 81 aa, Saimiri boliviensis
VTFEDVAVNFSKEEWCLLSEAQRCLYRDVMLENLALISSLGCWCGLKDEAALSKQSITVQTESQDRTPRAVSPKKAHSCDM

SEQ ID NO: 25581 - protein, 81 aa, Saimiri boliviensis
KPGALSFADVAVYFSPEEWGCLRPAQRALYRDVMRETYGHLGALGFPGPKPALISWMEQESEAWSSAAQDPEKGESLGGAR

SEQ ID NO: 25582 - protein, 81 aa, Vombatus ursinus
MLENYRNLVSLGFVVAKPDVISQSEQEEAPWILEVLFPRSSCSDLDTKPKIKETTLELDISMEESSKKVLSRDSSWILTLG

SEQ ID NO: 25583 - protein, 81 aa, Balaenoptera acutorostrata
TQVSVTFDDVAVTFTREEWRQLDPAQRTLYQEVMLENCRLLVSLGCPVPRPELIFQLEQGQKLWTVKEDLSRSTCPGKRYR

SEQ ID NO: 25584 - protein, 81 aa, Saimiri boliviensis
AQESVIFSDVSIDFSQEEWECLNDDQRDLYRDVMLENYSNLVSMGHSISKPNVISYLEQGKEPWLVDRELTRSQWPVLESR

SEQ ID NO: 25585 - protein, 81 aa, Vombatus ursinus
KGEVPKVPVTFVDIAVYFSEDEWKNLDEWQKELYNNLVKENYKTLMSLDAQSRVEPREEPCVWEQHNSEEREIPMDPTTDG

SEQ ID NO: 25586 - protein, 81 aa, Saimiri boliviensis
MFVTFKDVAVTFTQEEWRQLDLAQRTLYQEVMLETCGLLVSLGDKAQVQTTEPTTYLPVLSKRAFLQGSLTLECSSDSRLG

SEQ ID NO: 25587 - protein, 81 aa, Saimiri boliviensis
VAFEDVAVNFTQEEWALLDPSQKNLYRDVMQETLRNLISIGKGWSNQNAEDKHQNPRRTLRRLIGERLLTLVPDDMWRKKT

SEQ ID NO: 25588 - protein, 81 aa, Saimiri boliviensis
AHVTLAFRDVSIDLSQEEWECLDPAQRDLYKDVMFENYSNLISLGYTIPKPDVIALLEQEKEPWIVMREGTRSWYTDLEYK

SEQ ID NO: 25589 - protein, 81 aa, Balaenoptera acutorostrata
PLESVTFEDVAISFTQEEWTLLDTSQRKLFRDVMLENISHLVSVGYQHCKSDVIFQLDRGEELWIEGRGFFQSHSPGRESA

SEQ ID NO: 25590 - protein, 81 aa, Saimiri boliviensis
AQESVTFEDVAVNFTDGEWQCLTYAQRHLYKDVMLENYGNLVSLGLPFPKPPLISHLERGVELCVQDPQGREPLSCSCLVS

SEQ ID NO: 25591 - protein, 81 aa, Vombatus ursinus
SHGLFLVTFQDVAVTFTPEEWGLLDYPQKELYKEVMLENTWNLLSLGKDTSPGHSISHLLEGKSAGLLCPRDRVPCCLVFL

SEQ ID NO: 25592 - protein, 81 aa, Vombatus ursinus
HQESVTFKDIALGFTQEEQGHLAPSQKELYWEVILENYGHLICLELKVSKPDVISQLERGEHLGLQGEKNRGLCLFPQQRV

SEQ ID NO: 25593 - protein, 81 aa, Balaenoptera acutorostrata
LKGLVMFKDVAIDVSQEEWECLNPAQRNLYKDVMLENYSNLLSLGLSISKPAVISSLEQGKEPWMVMREVIGERFPDLVSK

SEQ ID NO: 25594 - protein, 81 aa, Vombatus ursinus
MPPSLPQDFHFLWAGLAMSKPEVIHQLERGEAPWRPEEKGPQSTCPDGEVRPETKESPPELGISVEQSSGQDRLRRHGLCV

SEQ ID NO: 25595 - protein, 81 aa, Saimiri boliviensis
MLENYRNLVFLGIAVSTPDWITCLEQGKDPWNMKRHSMVATPPVLCSHFGQDLGQRPGIKDSFQKVILREYVKCGHKDLQI

SEQ ID NO: 25596 - protein, 81 aa, Saimiri boliviensis
MPHLLVTFRDVAIDFSQEEWECLDPAQRDLYRDVMLENYSNLISLDLESSHEINKLSPEKEIYEMESLQWENMGKFINHHL

SEQ ID NO: 25597 - protein, 81 aa, Lynx pardinus
KEAVTFKDVAVVFTEEELGLLDPAQKKLYGDVMLENFRNLLSLGGKIQNKMKTVLETEPHKELSCWQIWQQIASDLTQCEG

SEQ ID NO: 25598 - protein, 81 aa, Lynx pardinus
DPVQVNFEDVAVYFSREEWGLLDEAQRLLYRDVMLENLALTASLGSWHGTEDEETAFEQNISVGVSQVRTPKAVPSTQKAH

SEQ ID NO: 25599 - protein, 81 aa, Vombatus ursinus
FQELVTLKDVDPDFTWEEWAQLAPVQQDLYKEVLLENYRNLVFLGLSIPKPDVISQLEREEMPWTLESKTPRAICSYSDTE

SEQ ID NO: 25600 - protein, 81 aa, Balaenoptera acutorostrata
EQLTFKDIDIEFSQEEWECLDPAQRALYRDVMLEIYRNLLSLDISPIHVIKKLQLKVNTGRGEVLQTVMLGRHERNKMKHF

SEQ ID NO: 25601 - protein, 81 aa, Saimiri boliviensis
KSEEAVTFKDVAVVFSDEELRLLDLTQRKLYRDVMLENFRNVVSVGNQFIPDGLPQSEREEKLWMMKTATQRDNSLGGKHL

SEQ ID NO: 25602 - protein, 81 aa, Panthera pardus
FQASVVFEDVAVNFTPEEWALLDHGQRNLFKDVILETCRNLSSVEKQKFHSSGDLTQMQEGLLSSPLLESVCERIEGDPCG

SEQ ID NO: 25603 - protein, 81 aa, Macaca nemestrina
LFQVTFSDVAIDFSHEEWAWLDSAQRDLYKDVMVQNYENLSYVFSGGFISYPFLLITLGKKKSSALWESKELSTKKDIYDE

SEQ ID NO: 25604 - protein, 81 aa, Macaca nemestrina
RNMIPQDNENPPQQGEANQNDSMTFEDVAVNFTPEEWALLDPSQKNLYQEVMQETLRNLASIEVLWKRDYLKVKVISMEKF

SEQ ID NO: 25605 - protein, 81 aa, Myotis brandtii
MLKSVTFEDVAVYFTPTEWDGLSPAQRALYRDVMLENYGNVASLGFPLIKPAVILQLEGGGELRGPSPLAAETGTDPPGLW

SEQ ID NO: 25606 - protein, 81 aa, Propithecus coquereli
GSVMFSDVSVDFSQDEWECLDPVQRDLYREVMLENYSNLVSVGLYIPKPQVISLLEQGKEPWMVGKELTRGLCSDLESMCE

SEQ ID NO: 25607 - protein, 81 aa, Saimiri boliviensis
EMGPLTFRDVAIEFSLEEWQCLDTAQQDLYRKVMLENYTNLAFLAGIAASKPDLITCLEQGKEPWNMKRHEMVDEPPVIYS

SEQ ID NO: 25608 - protein, 81 aa, Propithecus coquereli
SQESVTFQDVAVDFTEKEWPLLDSSQRKLYKDVMLENYSNLTSLGYEVCKPSLISHLEQEEEPRTEERGTQQGPCPDWETP

SEQ ID NO: 25609 - protein, 81 aa, Balaenoptera acutorostrata
AQSLVTFEDVAVHFSKEEWGILDAAQRQLYHSVMLENLELMTSLGCWHGVEDEEVRSKQDASVDVVSQVRIFSAHPSTQKA

SEQ ID NO: 25610 - protein, 81 aa, Propithecus coquereli
ARVLVTFKDVAVTFTREEWRQLDLAQRTLYREVMLETCGLLVSLGHRVPKPELIHLLEHGQELWTVKRGLAHSTCAGDRAQ

SEQ ID NO: 25611 - protein, 81 aa, Vombatus ursinus
FQESVTFEDVAVDFTWEEWGYLDTSQKEVYWEVMLENYRNLVSLGFVVAKPDVISQSEQEEAPWILEVLFPRSSCSDLDTK

SEQ ID NO: 25612 - protein, 81 aa, Saimiri boliviensis
VKGLLSFKDVSVEFTWDEWQLLDSRQKYLYREVILENYHNLISVGYHGAKPDLIFKLEQGEDPWIVNAKISRESCPDGWEE

SEQ ID NO: 25613 - protein, 81 aa, Lynx pardinus
SFGREAENDQVSPFTKEEWQQLDPAQRTLYRDVMLENFSHVISLGHPVSKPDVISKLEQGEEPWIIKRDVSDWIYPERETR

SEQ ID NO: 25614 - protein, 81 aa, Saimiri boliviensis
SFKEAVTFKDVAVVFTEEELGLLDLAQRKLYRDVMLENFRNLLSVGHQPFHQDVFHFLREEKFWMMETATQREGNSGGKIQ

SEQ ID NO: 25615 - protein, 81 aa, Vombatus ursinus
SPELVAFKDVAVEFNQEEWRCLDASQKELYHDVMMENYKNLVCLGKDSFTLSPKICSLEGWEIRPVNKKPITKLGIPVEES

SEQ ID NO: 25616 - protein, 81 aa, Balaenoptera acutorostrata
MLENYSNLVSVGYCVTKPEVIFRLEQGEEPWVLEEEFPRQSFAEVWKTDHMKERSQENQPKHVWEVVFINNKMLTKEQGNV

SEQ ID NO: 25617 - protein, 81 aa, Saimiri boliviensis
SQELVTFEDVAVYFIRKEWKRLEPAQRDLYRDVMLENYGNVFSLDGETRTENDQAVSEDTRSHGVLLGRFQKDMSQGLKFK

SEQ ID NO: 25618 - protein, 81 aa, Saimiri boliviensis
SQGPLTFMDVAIEFSQEEWGCLDPAQRTLYKDVMLENYRNLVSLGVGLPDLSVVSMLEQKREPWTLQSEEKIAWNPDGREC

SEQ ID NO: 25619 - protein, 81 aa, Vombatus ursinus
VLVSVTFDDVIIYFMEQEWRILEEWQEELYKHVMKTNYKNLFSPDYAIPKPDLITQIEQGEKPFIRDWGHLDTSELAIGSR

SEQ ID NO: 25620 - protein, 81 aa, Lynx pardinus
MLVTFDDVAVTFTQEEWGQLDPTQRTLYQEVMLETCRLLVSLGCPLPKPEQIYPLERSPELWTLQRGLSSSNCPGDNVKPE

SEQ ID NO: 25621 - protein, 81 aa, Vombatus ursinus
GKESMTFKDVTVEFTWEEWRQLDHAQRDLYRNVMMENYENLISVGIFVSKLDVISLLERGEASWVSEGEVPRSTYSDSLNL

SEQ ID NO: 25622 - protein, 81 aa, Vicugna pacos
CLQGPVTFKDVAVEFTQEEWMMLDSTQKSMYRDVMLENYINLTSVECQLCKPVVSLLGQEDIRTVKRRISQGTCPDWESQL

SEQ ID NO: 25623 - protein, 81 aa, Propithecus coquereli
VPLPLTFEDVAIYFSEQEWQNLEAWQKELYKHVMRTNYETLISLDDGLPKPELISWIEQGAEPFRDWRESQKSGNIICSSA

SEQ ID NO: 25624 - protein, 81 aa, Propithecus coquereli
ESVTFEDVAVYFSENEWIGLGPAQRALYRDVMLENYGAVASLAFPFPKPALISQLERGEAPWCSAPQGALDGESPRGISSE

SEQ ID NO: 25625 - protein, 81 aa, Vombatus ursinus
SGDSMTFEDVAVYFSQEEWAVLDQQQKELYQDVMRGTYELVTSLGYPAAKPEVICKIEQEEEPWMRDSQNHRRGLNHQWGN

SEQ ID NO: 25626 - protein, 81 aa, Propithecus coquereli
SQASVSFEDVTVEFTCEEWQQMGPAQRNLYRDVMLENDSHMVSVGYCVFKPEVIFGLEQGEEPWFSEEEFSNQSHPKHCRD

SEQ ID NO: 25627 - protein, 81 aa, Propithecus coquereli
QAEVTFEDVAVLLSREEWGRLGPAQRGLYRDVMLETYGNLVSLGTGPAGPKPGVISQLERGDEPWVLDNRRPLDLMFIVSA

SEQ ID NO: 25628 - protein, 81 aa, Propithecus coquereli
MAHLIMLRDVAIELSEEEWECLDLEQRDLYRGVMLENYSSMVSLGLCIYQPDVFSSLEKGKEPWKILRDETREPNPDMHTM

SEQ ID NO: 25629 - protein, 81 aa, Propithecus coquereli
HQEVVTFEDVAMHFTQTEWAGLSPAQRALYRSVMLENYENLTVVEYPVPKPALISFLEGGDLPWGLEAQDEPLTERTRDIY

SEQ ID NO: 25630 - protein, 81 aa, Balaenoptera acutorostrata
AQESVMFSDVSIDFSQEEWEYLNDAQRDLYREVMLENYSNLVSMAGRSISKPDVISFLEQGKEPWLVDRELTRDQWPVLES

SEQ ID NO: 25631 - protein, 81 aa, Saimiri boliviensis
MLENYGHLVSLGLSISKPDVVSLLEQGKEPWLGKRDVKRDLFSVSEPTGDIKDFSSKNVIYDDSSQYLIMERILSQGPVYS

SEQ ID NO: 25632 - protein, 81 aa, Balaenoptera acutorostrata
AQETLSFKDVAVDFTWEEWQLLAPPQKDLYRDVMLENYSNLLSVGYRVSKPDALSKLERGEEPWTIEDEIHSQTCPETGKV

SEQ ID NO: 25633 - protein, 81 aa, Balaenoptera acutorostrata
QGPVLFEDLAVYFSQEECVSLHPAQRSCSRDTPQECLEDMALMGGEGKIEINQKLRLESMGLEELALEKYSIAVPLVYYPE

SEQ ID NO: 25634 - protein, 81 aa, Saimiri boliviensis
VQGLVMFEDVAVYFSREEWGLLNVTQKGLYRDVMLENFALLSSLGLAPSRSPVFTQLVDDEQSCVPSWVDVTLVSRTEASR

SEQ ID NO: 25635 - protein, 81 aa, Saimiri boliviensis
FEESVTFQDVAVDFTPEEWQLLDCAERTLYWDVMLENYRNLISVGCLVTKTKVTLKVEQGQEPWMVEGVNPHQSSPESDCP

SEQ ID NO: 25636 - protein, 81 aa, Vombatus ursinus
KEELVAFKDVAVEFNQEEWRCLDASQKELYHDVMMENYKNLVCLGLVFNKPAVISHLEGKEAPWMAEGQPITKLGIPVEES

SEQ ID NO: 25637 - protein, 81 aa, Balaenoptera acutorostrata
TKDCVTFEDVAIYFSQEEWGLLDEAQRCLYHKVMLENFALTASMVCLHGTENKETPSEQNVSLEALSQVRTPKVGPISQKA

SEQ ID NO: 25638 - protein, 81 aa, Saimiri boliviensis
MLENYWSLVSLGLCHFDMNIISMLEEGKEPWTVKSYMKIARKPRMRKCVKGVVTDIPPKCTIKDLLPKEQSSTEAAFHTVM

SEQ ID NO: 25639 - protein, 81 aa, Balaenoptera acutorostrata
LEGSVTLQDVAVEFTPEEWQLLDCDQRTLYWDVMLENFRNLISMGCPVTKTKVIFKVEQGQEPWMVEGENPCWRSPEADCP

SEQ ID NO: 25640 - protein, 81 aa, Saimiri boliviensis
TQESLTLEDVAVEFSWEEWQLLDTAQKDLYRDVMVENYNHLVALGYQTSKPDALSKVAHGQEPWITDAKIQNKNCPGIRKV

SEQ ID NO: 25641 - protein, 81 aa, Vombatus ursinus
FQNSVTFKDVAVHFTRKEWKQLTPAQRYLYRDVMLENYRNLVSLGLPVSKPKVISQLEQGEGPWIAEEERPTSTYPDWEAR

SEQ ID NO: 25642 - protein, 81 aa, Cervus elaphus
HVHVTFTDVAVTFTEEELGLLDSAQKKLYQDVMVENFWNLVSVDENNQSELRAVQERGLHEELSCWQIWQQIANDLTRYQD

SEQ ID NO: 25643 - protein, 81 aa, Cervus elaphus
ELLTFKDISVDFTQEEWGQLAPAHRNLYREVMLENYGNLVSVGCQLSKPSVISQLEKGEEPWMTEKEGPGDPSSDLKSKTE

SEQ ID NO: 25644 - protein, 81 aa, Colobus angolensis
VHGSVTFRDVAIDFSQEEWECLQPEQRTLYRDVMLENYSHLISLGSSISKPDVITLLEQEKEPWIVVRKETSRWYPDLESK

SEQ ID NO: 25645 - protein, 81 aa, Colobus angolensis
LQESVTFKDVSVDFTQEEWYHVDAAQRSLYRDVMLENYSHLVSLGYQVSKPEVIFKLEQGEEPWISEGEIQRPFCPDWKTR

SEQ ID NO: 25646 - protein, 80 aa, Colobus angolensis
MCGPLQFRDVAIEFSLEEWHCLDTAQRNLYRNVMLENYSNLVFLGIVVSKPDLITRLEQGKNPLTMKRHEMVAKPPGRCE

SEQ ID NO: 25647 - protein, 81 aa, Colobus angolensis
LLKKVTFEDVAIDFTQEEWAMTDTSKRKLYRDVLPGNVSHLESLGYQISKSYIILQLEQGNELWREGREFLQGQNLDKESV

SEQ ID NO: 25648 - protein, 81 aa, Colobus angolensis
MATVVFEDVVVGFTLEEWALLNPAQRNLYRDVMLETFKHLASVRNPRVERPCKSGKGNKRGGTLRKTRNCNRHLRKNHRPG

SEQ ID NO: 25649 - protein, 81 aa, Colobus angolensis
LWDLSFLRDVTVEFSLEEWQCLDAVQKNLYRNVMLENYRNLVFLGIAVSKPDLITCLEQGKEPWNMNRHEMVAKPPVMCSH

SEQ ID NO: 25650 - protein, 81 aa, Rhinopithecus bieti
GTVTFEDVAVNFTWEEWNLLSEAQRCLYRDVMLENLALISSLGCWCGVEDEEAPSKQSIYIQRETQVRIPMAGVSLKKVHP

SEQ ID NO: 25651 - protein, 81 aa, Rhinopithecus bieti
MELLTFRDVAIEFSPEEWKCLDPAQQNLYRDVMLENYRNLVSLGFVISNPDLVTCLEQIKEPYNLKTHETAAKPPVVQHFW

SEQ ID NO: 25652 - protein, 81 aa, Panthera pardus
SLTFQDVAVDFTREEWDQLYPAQKNLYRDVMLENYRNLVALGGENRPDIKKSIPNQNISDENQNHDMIMERLTGDSFWYSI

SEQ ID NO: 25653 - protein, 81 aa, Panthera pardus
APGCVTFEDVAVRFSWEEWGLLDEAQRLLYRDVMLENFALMASLGLASSRTHEISQLEWWRQPSLPPCGVMTAAMPRGLWR

SEQ ID NO: 25654 - protein, 81 aa, Panthera pardus
SYGSLSFEDVTVGFSQEEWQHLDPAQRTLYRDVMLENYSHLVAVGCCVPKPDVIFRLEQGQQPWIVEEESLDQSCPEVCKV

SEQ ID NO: 25655 - protein, 81 aa, Panthera pardus
ESVTFEDVAVGLLREWALLDGARTNLCRYVILDKCRTLAPKDWDSRLKSQASPPVQDTLEGNSSPGLHMGQKAAAQIQRVA

SEQ ID NO: 25656 - protein, 81 aa, Panthera pardus
FQASVVFEDVAVNFTPEEWALLNRGQRKLYRDVMLETCRNLSAVEKQKFHSSGDLTRMQEGLLRSPLVESVCERIEGDPCG

SEQ ID NO: 25657 - protein, 81 aa, Panthera pardus
MLENYSNLISLAGCAIPKPDVFSLLEQGKDPWMVTRAMTRRWSSDLESSCETKKSSPEKGAYEMESLQWENRRKPISHNFD

SEQ ID NO: 25658 - protein, 81 aa, Panthera pardus
SVVFEDVVVDFTQEEWALLKPAQKKLYKDVMLETFRNLVTVDDENQLRTNGSTSQQVISGEKLSNEQKIARFTKNDSWTSL

SEQ ID NO: 25659 - protein, 81 aa, Macaca nemestrina
MLENYRNLVALGLPFTKPKVISLLQQGEDPWKVEKDSSGDSSLGSKSSHKTTKSTQTQDSSFQGLILKRSNRNVPWDLKLE

SEQ ID NO: 25660 - protein, 81 aa, Macaca nemestrina
ITGCIKCEDVAVDFTQEEWRLLSPAQRTLHREVMLETYNHLVSLEIPSSKPKLIAQLERGEEPWREERKCSLDLCPESKPE

SEQ ID NO: 25661 - protein, 81 aa, Muntiacus reevesi
AQLTFKDVAIEFTQEEWECLDPAQRALYRDVMVETLRNLISLDISHILVIKKLQLNAKTDRGEEFQTVILGRHERNKIKDF

SEQ ID NO: 25662 - protein, 81 aa, Ursus americanus
PRGLLTFGDVAIEFSQEEWGCLSHTQRELYRDVMLENYGHLLFLGFILSKPDLIMFLEQEKQLWDVKRETVIFKDNYLWID

SEQ ID NO: 25663 - protein, 81 aa, Ursus americanus
DVAVNFTREEWDQLYPAQKNLYRDVMLENYRNLVALGHQLYKPEVISQLEQEEQWVMERGSPLDTHADGESRPEIKKSTPN

SEQ ID NO: 25664 - protein, 81 aa, Ursus americanus
FFGSISFEDVTVNFTQEEWGQLDPDQRTLYRDVMLENYSIFISLGEILNLEQEAPWVLEKEFAKNMLELTTTNKTYSGKKS

SEQ ID NO: 25665 - protein, 81 aa, Myotis brandtii
PAAHMAFRDVAVDFTQEEWMLLSPAQRSLYREVMLENYSNLVSLGIPFSKPKLITQLEQGKETWREERKCPPATCPGEPKP

SEQ ID NO: 25666 - protein, 81 aa, Myotis brandtii
NFWVLRLPPGSKGEAPKEWGKLDEWQKELYKHVRRGNYETLVSLDYAISKPEVLSQTEPGKEPCGWRRTAPKVPDVPVDPS

SEQ ID NO: 25667 - protein, 81 aa, Myotis brandtii
SQGLVTFRDVALGFSQEEWEWLSPSQKALYRDVMLENYGNLVWLGLSISKPNMISLLEQGKEPWIVEREMSDGQYTDWESW

SEQ ID NO: 25668 - protein, 81 aa, Myotis brandtii
MDFEDVAVAFSREEWGLLDEAQRLLYCDVMLEVFALVSSVGCWHKTDDEEACSEQSVSEQGESLVRASETKPATQRTHVCK

SEQ ID NO: 25669 - protein, 81 aa, Camelus ferus
SQGSLTLKDVAVDFTREEWQLLTPAQKALYREVTLQNYSHLVSVVYQVRNLDTLSKLEQGEPPWTLEHEIHNQPHPGRKRK

SEQ ID NO: 25670 - protein, 81 aa, Colobus angolensis
PQASVCFEDVAMAFTKEEWEQLDLAQRTLYREVTLETWEHIVSLGLFLSKSDVISQLEQEEDLHRAEQVSPRDWKTTLEEN

SEQ ID NO: 25671 - protein, 81 aa, Colobus angolensis
RPESVTFKDVAVCFSENEWIGLGAAQRALYRDVMLENYGAVASLAFPFPKPALISQLERGEAPWCSVPWGALDGEDPRGIS

SEQ ID NO: 25672 - protein, 81 aa, Mustela putorius
MDFTLDWEHLGLDQGDLFWDTALDNYQNIFLLNPSKPKLTSQPDGAEEQKVLERESPESAGPNPAEVKNCLLGQDFLEEGL

SEQ ID NO: 25673 - protein, 81 aa, Mustela putorius
PNEAVTFKDVAVVFTEEELGLLDPAQRKLYGDVMLENFRNLLSVGHQPFIPHVILQCERGEKLQMGKTATQGRGIAGDKNL

SEQ ID NO: 25674 - protein, 81 aa, Mustela putorius
SQGLLTFRDVAIEFSQEEWGRLTHTQRELYRDVMLENYGHLLFLGLTVSKPDLVSFLEQKKDPWDVKRKKTVVFDPAVSSQ

SEQ ID NO: 25675 - protein, 81 aa, Tupaia chinensis
MDVFVDFTWEEWWLLDPAQKCLYISVTLENYSNLVSLGYQHTKPFIISKLEQGEVWMVQAQIPSQGRPAKFIKTAFAEIER

SEQ ID NO: 25676 - protein, 81 aa, Oryctolagus cuniculus
VELVSFDDVAVDFTQEEWTLLDPTQRNLYSDVMLENYKNLATVGCQLIKPDLISWLEQEELKTVQRDMLQGWEMQLEANWS

SEQ ID NO: 25677 - protein, 81 aa, Rhinolophus ferrumequinum
EQVTFEDVVVDFTQEEWGQLEPAQRTLYRDVMLETFGLLVSVGHWLRKPAVISLLELEAEPWEVDEGVPQGVFPDLETTSK

SEQ ID NO: 25678 - protein, 81 aa, Ursus maritimus
MLETCGLLVSLGHPVPKPELTHLLEHGQELWTGKRGLSRSTCSGDNVKLQTRDPSTCQLVLSEGALRQGSLTQGSSRDSRL

SEQ ID NO: 25679 - protein, 81 aa, Ursus maritimus
MLENCGLLVSLGCPVPRPELIYQLEHGRELWTVKRDLSQSAYPGDKGKPKITESTASEPALSEGVFFQEQLTQGFQGNSQV

SEQ ID NO: 25680 - protein, 81 aa, Ursus maritimus
AAGSVTFQDVTMAFTEKEWEQLDPAQRSLYKDVMLENYSNLASMGYQAPKPDMISKLQKGEEPWLGKGKRPKQDGPSELAR

SEQ ID NO: 25681 - protein, 81 aa, Ursus maritimus
RLKREGSSLANLRAMPQEWQHLDPAQKALYRDVMLENYCHLISVGFHMTKPDMIRKLEQGEELWTTERMFPSQSYLEEDGK

SEQ ID NO: 25682 - protein, 81 aa, Ursus maritimus
SQEPVTFEDVAVYFTQNQWASLDPTQRALYREVMLENYANITSLAAFPFPKPDLILQLERGEARWGLDPWIAIEGEALGGV

SEQ ID NO: 25683 - protein, 81 aa, Ursus maritimus
VTFEDVAVIFTDEEWRHLVPIQRDLYKEVMLENYKIIVSLDWGTKPEIHGASEEESEGTARGKLGGEVPVCPKFEAHALEG

SEQ ID NO: 25684 - protein, 81 aa, Ursus maritimus
SQGLLTFKDISVDFTQEEWGHLAPAHRNLYREVMLENYGNLVSVGCQLSKPDVISQLEKGEEPWLIEREISGSPGSDLENK

SEQ ID NO: 25685 - protein, 81 aa, Ursus americanus
RPRAVKFADVAVYFSPEEWGCLRPAQRALYRDVMRETYGHLGALGFPGPKPALISWMEQESEAWSPDAQDPEEGESLGGAL

SEQ ID NO: 25686 - protein, 81 aa, Propithecus coquereli
LQESFSFEDLSVDFTQKEWQLLDPYQKNLYKDVMLENYSSLVSLGYEVMKPDVIFKLEQGEEPWVGEGAVPSSDSPAIIFK

SEQ ID NO: 25687 - protein, 81 aa, Propithecus coquereli
SWGPLSFMDVFVDFTLEEWRLLDPAQKHLYRSVMLENYSNLVSLGYQHTKPNIIFELERGEELWVVHARIPRQGHPDKVWE

SEQ ID NO: 25688 - protein, 81 aa, Saimiri boliviensis
AHALVTFRDVAIDFSQKEWECLDPTQRKLYRDVMLENYSNLVSLGYSGLKPDVITLLEQGKEPCMAVRDMTGRQYPGLLSR

SEQ ID NO: 25689 - protein, 81 aa, Vombatus ursinus
LNELVTFKDVTVNFTQEEWRQLNPAQRDLYRDVMLENYRNLISLGLSISKPDVILQLERGEEPWILNLKRTAEREIPQYTG

SEQ ID NO: 25690 - protein, 81 aa, Propithecus coquereli
MTFEDVTVEFTPWEWGQLDPAQKDLYREVMLENFRNLASLGLPVSKPHVICQLEEGEEPCVLEREISVGAQSDLKRRPKAK

SEQ ID NO: 25691 - protein, 81 aa, Saimiri boliviensis
TQGSLTFKDVAIEFSQEEWKCLDPAQKTLYRDVMLENYRNLGFLGLCLPDLNIISMLEQGKEPWTVVSQVKMTRNPNWGEC

SEQ ID NO: 25692 - protein, 81 aa, Saimiri boliviensis
SQGSVSFKDVTVDFTQEEWQQLDPAQKALYRDVMLENYCHFIAVGFHMTKPDMIRKLEQGEELWTQRIFPSYSYLEEDGKT

SEQ ID NO: 25693 - protein, 81 aa, Balaenoptera acutorostrata
KDQGLLTLEDVAVDFTWEEWQLLAPAQKDLYRDVMLENYSNLLSVGYQASKPDALSRLERGEPWPVEDKIHSRICPEMRKD

SEQ ID NO: 25694 - protein, 81 aa, Balaenoptera acutorostrata
MESVVFEDVAVDFTPEEWALLDPAQRNLYRDVMLETFRNLASVGENWKCHSIEDQHKNQRTHLRWRVVEIPSENNESNQCG

SEQ ID NO: 25695 - protein, 81 aa, Lynx pardinus
PGLLSFKDVAVVFTWEEWQLLEPIQKHLYQDVMLENYSNLVSVDDTWQVDSHTDWHQENQGNLETMESHHINNPFRKILSL

SEQ ID NO: 25696 - protein, 81 aa, Vombatus ursinus
FQGSVTFQDVAVVFTPEEWGHLEPSQKELYREVMLENFRNLVCLGLVVYKPSVIYQLERGGAPWKPGGGGRRSGSSDWETL

SEQ ID NO: 25697 - protein, 81 aa, Balaenoptera acutorostrata
QGHVIFEDVAVSFSQEEWGLLNDAQRLLYCDVMLENLSLIASLGCWRAVGTEEAASEQCVSVELVTQDRNPNPDLSILKTL

SEQ ID NO: 25698 - protein, 81 aa, Balaenoptera acutorostrata
WQGWGTFEDIAVYFSQEEWGLLDEAQRHLYCDVMLENLALVASLDYWCGAEAEGASYEQSVYVAVLQSRTPKAGPSIQKAN

SEQ ID NO: 25699 - protein, 81 aa, Vombatus ursinus
MQLDRPQRALYRDVMLENYRNLLLVSLAGHPISKPDVISRLEQGGVPWVLKKGTTGRAPSDRETKPEAKESASKPFISVEE

SEQ ID NO: 25700 - protein, 81 aa, Lynx pardinus
EPVTMTFDDVALYFSDQEWEILEKWQKEMYQQVMKTNYETLDSLGGVFSKPDLITWMEQGRTLLIRDQGPLEKRMTLSPSA

SEQ ID NO: 25701 - protein, 81 aa, Lynx pardinus
VTFRDVAVAFTEEELGLLDSAQRKLYQDVMLENFRNLVSVGHQSLKQDKWRIEKEKLWSMKTAAQMERNVGGNSQSELRTL

SEQ ID NO: 25702 - protein, 81 aa, Balaenoptera acutorostrata
FYESVTFEDVLINFTQEEWALLDTSQKTLFRNVMLENITHLVSIGYQISKSDVISQLEQGKELWSEATGCLQGQSPDDESP

SEQ ID NO: 25703 - protein, 81 aa, Balaenoptera acutorostrata
GLSSFKDISMEFTWEEWQLLDSAQKHLYRDVTLENYSNLVSLEGWQEWYQKNQDELESVERSYACNAFGKLHLSKSHISSR

SEQ ID NO: 25704 - protein, 81 aa, Balaenoptera acutorostrata
VKSSVWVPEWAAQACPEDQVLNSPFKGWHSRTMLGQESLIYDDMAMKFTWEEWQLLDPNQKDPYRDPVMLENHSNLVSCGV

SEQ ID NO: 25705 - protein, 81 aa, Balaenoptera acutorostrata
TQGLVTFRDVAIEFSQEEWKCLEPAQRDLYKDVTLENFGNLVSLGLSLSKPDVISLLEQGKEPWMVVNDMTGPWCPDLESR

SEQ ID NO: 25706 - protein, 81 aa, Vombatus ursinus
MLENYRNLVRLGLAVSKPDVISQLERREAPWTPGGIQRSGCPDWEATHETKAFAAKLGISVEESSQERGMGEVLHLSTSHE

SEQ ID NO: 25707 - protein, 81 aa, Saimiri boliviensis
YQDSVTFDDVAVDFTQEEWTLLDPSQRDLYRDVMLENYENLASIGHHLFKPSVICWLEKEGQLRAGQRGVLQEWQVKSKGS

SEQ ID NO: 25708 - protein, 81 aa, Lynx pardinus
EEPVTFLDVAVDFSKEEWGLLDPMQRTEYHDVMLETFGHLVSVGWETTLESKELTPKSDIPEEEPAPDLKMEEFSRDDTWS

SEQ ID NO: 25709 - protein, 81 aa, Pteropus alecto
SVTFEDVAVDFTQEEWRQLDPAQKTLHRDVMLEIYSHLVSVGCSSIKPSIIFKLEHETDLWIIDSELSRWIYSVISHEIMT

SEQ ID NO: 25710 - protein, 81 aa, Pteropus alecto
LQKSLTFWDVFMDFTLEEWQQLDSTQKSLYRDVMLENYSHLVSVGYLVAKPDVIFRLGQVEARKADGEPATQSCPEFLQVD

SEQ ID NO: 25711 - protein, 81 aa, Oryctolagus cuniculus
MDSVVSEDVSVNFSREEWALLNPSQKKLYRDVMQETIRNLASCGKAFSCPSSIQIHERTHTGEKPYTCKECGKAFISRTSV

SEQ ID NO: 25712 - protein, 81 aa, Camelus ferus
MKGFLESLRSRWVRPRSEGYRIFLLAPGALVESTGYEVPKPEVIFRLEQGEEPWMSEGETPHQSCSGIAFRFLTSLHLPYP

SEQ ID NO: 25713 - protein, 81 aa, Myotis brandtii
EGQESLEKDIAMDFTWEEWQLLDSAQKYLYRDVTLENYRNLVCTGYHGTKPDLIFKLEQGEEPWIGNAKISHQSCTEDWKE

SEQ ID NO: 25714 - protein, 81 aa, Saimiri boliviensis
LGAVTFEDVAVNFTREEWNILSEAQRCLYRDVMLENLALTSSLGCWCGVEDEEAPSKQSIYVQRETQVRTPTAGVFPEKAH

SEQ ID NO: 25715 - protein, 81 aa, Propithecus coquereli
EAVTFKDVAVVFTEEELGLLDPAQRKLYRDVMLENFRNVVSVGGKNLKEMETLQEIGLRYLPHEELFCSQIWQQVTRELTR

SEQ ID NO: 25716 - protein, 81 aa, Propithecus coquereli
ALALVSFEDVAVTFTGEEWGHLDLAQRTLYQEVMLETCGLFVSLGHPVPKPELIYLLEHGQELRAVQRGLPQSTCASEKPK

SEQ ID NO: 25717 - protein, 81 aa, Vombatus ursinus
MLENYENFVFLVGLPVFKPSMISRLERRETSWIREEEAAFSFEDSLIQKTGSETKKSTPKQGICRGRSSKQRLTKDGPWRS

SEQ ID NO: 25718 - protein, 81 aa, Saimiri boliviensis
AQALVSFEDVVVTFTGEEWGHLDLAQRTLYQEVMLETCRLLISLGHPVPKPELIYLLEHGQEPWTVKRGLSESTCAGEKAK

SEQ ID NO: 25719 - protein, 81 aa, Propithecus coquereli
RLTARSQETVTFKDVAMDFTPEEWGKLDPAQRDVMLENYRNLVSLWLPVSKPENYGLENGKEPLKLERKAPKSTCSELPFC

SEQ ID NO: 25720 - protein, 81 aa, Vombatus ursinus
PKVPLTFDDVAVYFSEQEWGQLEEWQKELYKHVMRGNYEMLVSLDYAVSKPDILSQIERGEKPCHKDQWGSDEEVSCPGKL

SEQ ID NO: 25721 - protein, 81 aa, Saimiri boliviensis
DHELVTFRDVLINFSQEEWEYLDSAQRNLYWDVMMENYSNLLSLDLESKYETKLLSIGTDMIKNTGSQWEVMESSKLCGLE

SEQ ID NO: 25722 - protein, 81 aa, Vombatus ursinus
TKESVTFNDVAMEFTPEEWLHLNPSQKKLYRDVMLENYRNLVSLGFAVSKPDVIYQLERKEAFWMPETDIPRRSCPGDFIK

SEQ ID NO: 25723 - protein, 81 aa, Vombatus ursinus
VRVPIKFEDVAVYFSEPEWKNLDKWQKELYKHVMTVNYEILFSLDSAIPKPDLISHIERGEEPFIRDHGNLMKREMAIRYG

SEQ ID NO: 25724 - protein, 81 aa, Balaenoptera acutorostrata
AQELVTFEDVAVYFIRKEWKRLEPAQRDLYRDVMLENYGNVFSLDGETRTEHGPEISEDTGSHGVLLGRFQKDISQGLKFE

SEQ ID NO: 25725 - protein, 81 aa, Lynx pardinus
MYISQEEWGHQDPSKRALSRDTVQESYENVDSLEAQVPSREALSTQVEQGGKPWDPSVQTCKEGLSPRGPAPGEEKFENQE

SEQ ID NO: 25726 - protein, 81 aa, Balaenoptera acutorostrata
AQGSLTLEDVAVDFTCEEWQLLDPDQKDLYRDVMLENYSNLLSVGYQVSKPDILSKLEQGEPPWTLEDEVHSHPHPEIEKV

SEQ ID NO: 25727 - protein, 81 aa, Saimiri boliviensis
FQEAVTFKDVAVVFSSEELRLLDLTQRKLYQDVMVENFKNLVAVGHLPFQPDMVSQLEAEEKLWMMEAETQRSSKHQNKME

SEQ ID NO: 25728 - protein, 81 aa, Lynx pardinus
EDESLTLEDVAVGFSREEWRLLAPAQKDLYRDVMLENFRNLVSVGHQASKPDVLAKLERGEEPWAIEEEVRSGTSPADPLL

SEQ ID NO: 25729 - protein, 81 aa, Balaenoptera acutorostrata
SRDSVTFADVAVDFTQEEWTLLDPFQRNLYRDVMLENYKNLTTARYQSLKPTLISWLEQDDLRTVERRGVLQGSAIQAAQD

SEQ ID NO: 25730 - protein, 81 aa, Saimiri boliviensis
PQEAVVFEDVAVYFTRIEWSCLDPNQQVLYRDVMLENYRNLASLGFLVAKPALISLLEQGEEPGALILQVAEQRGVKTSLC

SEQ ID NO: 25731 - protein, 81 aa, Saimiri boliviensis
QEGVNFKIVTVDFTQEEQGTWKPAQRSLDGDIILESHRDLVSWDLPAVVGKEDSASKQNISDEEPANGVKTECFTRNDPWL

SEQ ID NO: 25732 - protein, 81 aa, Lynx pardinus
FQASVVFEDVAVYFTPEEWALLNHGQRKLYRDVMLETCRNLSAVEVFWWRVSVNVLNEGDQRRETLNPITSLTVHEGCPTA

SEQ ID NO: 25733 - protein, 81 aa, Balaenoptera acutorostrata
KEAFMAFGDVAVDFTQEEWRLLTPAQRTLHREVMLETYNHLVSLEISFSKPKLISQLERGEEPWIEERQRPLVLCPASGPT

SEQ ID NO: 25734 - protein, 81 aa, Vombatus ursinus
FQGSVTFQDVAVDFTPEEWGRLTPPQKELYQEVMLENYWNLVCLGLALSTQGVIEHLERGEAPWMLERDVPGTRGPVSEIR

SEQ ID NO: 25735 - protein, 81 aa, Saimiri boliviensis
KVPVTFVDIAVYFSEDEWKNLDEWQKELYNNLVKENYKTLMSLDADGPVPKPDAPARAEPREEPCVWEQRHPEEREIPMDP

SEQ ID NO: 25736 - protein, 81 aa, Saimiri boliviensis
REQGSSSGEGSLSLEDVAVDFTREEWQFLDSSQKVLYKEVMLDNYGNLVSVGYQEHPWIVEGAAHSQTCPGFVIQNRRYAE

SEQ ID NO: 25737 - protein, 81 aa, Saimiri boliviensis
PRGSTSFSSVTVAFAQEGWRCLVSTPRDRFKEGIPEKSRNLVLLGLPVSQPGMNSQLELREGAWMLEGKDLRNSSPNWKIV

SEQ ID NO: 25738 - protein, 81 aa, Vombatus ursinus
MLENSQNLLSLGIPLLREDLISPLEEREASRILDRKGPRKSCPDARTRFHVETLAKLNISVEESHQPRFVSDVNLREICDS

SEQ ID NO: 25739 - protein, 81 aa, Colobus angolensis
EGLTFKDVAVVFTEEELGLLDPVQRNLYRDVMLENFRNLLSVGHHPFKHDVFPLEKEKKLDMMKTATQRKRKSADKIQSEM

SEQ ID NO: 25740 - protein, 81 aa, Mustela putorius
QDSVTFEEVAVDFSQEEWALLDPAQKTLYRDVMLENYRNLASVGYPLCKHSLITEVEQEVLGTEEGAILQGAFTDWDIQLK

SEQ ID NO: 25741 - protein, 81 aa, Mustela putorius
TARSQASVTFKDVAMDFTPEEWGKLDPAQREVMLENYKNLVSLWLPVSKPENYSLENGKEPLVLERKAPKSNYDLETKPED

SEQ ID NO: 25742 - protein, 81 aa, Mustela putorius
AQESLTFRDVFVDFTLEEWQQLDSAQRNLYRDVTLENYSHLVSVGYLITKPDEVLRPGQVEEAMGAEGEPPARNHPEFWKV

SEQ ID NO: 25743 - protein, 81 aa, Mustela putorius
WHQLVTFKDVAVYFTRTEWAGLSPTQQALYRSVMLENYGNLTSLGYPVPKPALISLLEGENLPWGLEAQENPSAEGTKDIC

SEQ ID NO: 25744 - protein, 81 aa, Mustela putorius
IPGSISFEDVTVNFTQEEWGQLDPDQRTLYRDVMLENYNIFLSLEELKVDGVIESKENQDKHLWQHAFINNKKVTTEKENV

SEQ ID NO: 25745 - protein, 81 aa, Mustela putorius
FQEAVTFKDVAVVFSEEELGLLDPAQRKLYRDVMLENFRNLVSVGNQPFKPDLIFQLEREEKLLMIETETQRDGYLGAKSQ

SEQ ID NO: 25746 - protein, 81 aa, Tupaia chinensis
PPSRVSPFKDMILCFSEEDWSLLDPAQTGFYGEFIIGEDCGVSMPSSDPTSQPDPSQGEEGEPRLPDLQNLQGKEVPQVSY

SEQ ID NO: 25747 - protein, 81 aa, Tupaia chinensis
TVNGSLTFQDVAVDFTREEWDQLYPAQKNLYRDVMLENYRNLVALGQQLYKPEVITQLEQEEQWTIERDSPLDPPPDGENR

SEQ ID NO: 25748 - protein, 81 aa, Myotis brandtii
AEKPVTLEDVAVRFTPEEWACLDARQRALYQDVMSETFKTLVSVARTALTNPDLVAELEQEVKRWRAALLPLRGGGRPAGE

SEQ ID NO: 25749 - protein, 81 aa, Myotis brandtii
ADMNFEDVAIAFSQEEWDLLDESQRLLYCDAMLEVFALVTSVGCWRKTEDESCPDHSISIQGESQDMNFEDVAIVFSQEEW

SEQ ID NO: 25750 - protein, 81 aa, Myotis brandtii
PLESVTFRDVAVDFTQEEWGQLDSPQRALYRDVMLENYQNLLALGPPVCKPEVISHLERGEEPWQVPREVPGGARPEREPR

SEQ ID NO: 25751 - protein, 81 aa, Myotis brandtii
RKDSVAFEDVNVEFTMEEWAFLDPTQKKLYTDVMLETFWNLASVACILEEKGEDHDTEDKYEYHGMNLSSHMVERLCTRKD

SEQ ID NO: 25752 - protein, 81 aa, Propithecus coquereli
VQGSVTFKDVAVLFTQEEWGHLSPAQRALYRDVMLENYSHLVSLGLLGPKPDLFSQLGKGEEWMPEDASGSFCLDWMTVPV

SEQ ID NO: 25753 - protein, 81 aa, Vombatus ursinus
ARGPMSFADVAVYFSAEEWGRLRPAQRALYRDVMRETYGHLGALGFPGPKPALICWMDEETEVWGPDAQDPEEAGERGTVN

SEQ ID NO: 25754 - protein, 81 aa, Propithecus coquereli
GRVVFEDVAIYFSQEEWGHLDEAQRSLYRDVMLDNMALLSSLGCWQGAQDVEAPSSEQGVSIGMSQVTTPVPHVSTRRIQS

SEQ ID NO: 25755 - protein, 81 aa, Propithecus coquereli
PEELLTFRDVTIEFSAEEWECLNPAQWNLYRDVMLENYRNLVSLGLTASKPDLITCLEQRKEPWNVKRHDKGAEHPAVSSH

SEQ ID NO: 25756 - protein, 81 aa, Lynx pardinus
RLTFRDVAIEFSQEEWECLDPAQRALYRDVMLENYRNLVSVGSLSTGFALMELSPGEDIYKEVFYHLVILERNESHGIKDF

SEQ ID NO: 25757 - protein, 81 aa, Lynx pardinus
PQKSVTFEDVAVYFTQTEWNGLSPAQRALYRDVMLENYGNVASLGFSLLKPAVISQLEGAVDIESQTDNNLTKEIYKEKHN

SEQ ID NO: 25758 - protein, 81 aa, Saimiri boliviensis
DSVAFEDVAINFTCEEWALLGPSQKSLYRDVMQETIRNLDCIGMKWQNLDIEEDKYKNPGRNLRCYMVERSCEIKDNSQCG

SEQ ID NO: 25759 - protein, 81 aa, Vombatus ursinus
FQESVTFKDVAVAFTLEEWRHLGPSQKDLYRDVMLENYRNLVGLGLAISKPYVICQLEQGEAPWTPEGDVPQRHCAGEWGG

SEQ ID NO: 25760 - protein, 81 aa, Lynx pardinus
AQESLTFDDVAVNFTWEEWQLLAPAQKNLYRDVMLENYRNLVSLDFYPRKPDVLTKLDQGKPTGTVEDDIPFRTCSEIWKL

SEQ ID NO: 25761 - protein, 81 aa, Balaenoptera acutorostrata
VKKPVTSEDVAVNFTQEEWECLDASQRVLYQDVMSETFRNLMSVVRIFLSNPDLIAKFEQEEKQWRADLRPPNGEGLHSGM

SEQ ID NO: 25762 - protein, 81 aa, Vombatus ursinus
MLENYRNLVSLGLPVFQPDLISRLERGEVPWIPVGEVLRGSCPDSLIQETTCKIMETALKHNLFVEESSKGRFTNHDPWDS

SEQ ID NO: 25763 - protein, 81 aa, Balaenoptera acutorostrata
PHRLVLFKDVAIDFSQEEWECLELEQRDLYRDVMLENYSNLVSLGFSISKPDVLSLLEQGKDPWKVVRDVTRGLSPDWESR

SEQ ID NO: 25764 - protein, 81 aa, Vombatus ursinus
MLENYKNLVSLGFPISKPKVISKLERGGAHWMLGRRVSRRPFPGRLCQNRGKSKDSTPKQCNYISLKKRLIVNNKECVEAL

SEQ ID NO: 25765 - protein, 81 aa, Saimiri boliviensis
DGLVTFRDVAIDFSPEEWECLDPAQRDLYVDVMLENYSNLVSLDLESTTCDTKKIFSEKDIFEINFSQWEMKEKSKIPGLE

SEQ ID NO: 25766 - protein, 81 aa, Lynx pardinus
MLVKRQKELYRDVMRMNYELLASLGPAAAKPDLILKLERRAAPWIKDPNGPKWGKGRPPGKKKMVAGREADAQALAVESTV

SEQ ID NO: 25767 - protein, 81 aa, Vombatus ursinus
FQESLTFKDVAVYFTQEEWGQLDPGQKYLYRDVMLENYRNLVSLGYHISKPDVISHLEQGEEPWMVGREILRGNSPGGMTR

SEQ ID NO: 25768 - protein, 81 aa, Colobus angolensis
SQTLVTFKDVFVDFTREEWKLLDTAQQSVYRNVMLENYKNLVSLGHQLTKPDVILRLEKGEEPWLVERGIHQEAHPDSETA

SEQ ID NO: 25769 - protein, 81 aa, Colobus angolensis
IQSQVSFEDVAVDFTLEEWRLLNPTQKDLYRDVMLENYSNLIFLEVWLDNPKMWLRDNQDNFKSMERGHKYDVFGKIFNSS

SEQ ID NO: 25770 - protein, 81 aa, Mustela putorius
AQASVSFKDVTVDFTREEWQHLDPAQKTLYMDVMLENYCHLISVGCHMTKPDVILKLERGEEPWTSFTSHTCLEENWKEED

SEQ ID NO: 25771 - protein, 81 aa, Mustela putorius
AYGSLSFGDVAISFSQEEWECLDPAQKALYRDVMLETYSNLVSLESSISKPDMIIFLEQEKEPWVVLRRETSGWYPELESN

SEQ ID NO: 25772 - protein, 81 aa, Tupaia chinensis
MLETFGHLLSVGPDLPKPEVISQLEQGAELWVSERRIAQGHCLGWEPKPECQILPKEQGYPEEEPSYVMKRDAACPSMFGE

SEQ ID NO: 25773 - protein, 81 aa, Tupaia chinensis
MLENYSHLVSVGFCVTKPEVIFRLEQGEEPWILEEEFPSQNFPGEKPYECSECGKTFCQKSQLTQHQRIHMGEKPYDCNEC

SEQ ID NO: 25774 - protein, 81 aa, Vicugna pacos
MLENFRNLVSVGHLPFKPDMVSQLEAEEELWMTERETQRNGCSGENRAAVLSGNRNQNEMENLRKVALKYISWEEPSCWQI

SEQ ID NO: 25775 - protein, 81 aa, Vicugna pacos
AHGSVTFRDVAIDFSQEEWEFLDSAQRDLYRDVMWENYSNFISLAGPSISKPDEITLLDEGKEPWMVVREGTRRLHRGLES

SEQ ID NO: 25776 - protein, 81 aa, Rhinopithecus bieti
ESRPGAVSFADVAVYFSPEEWGCLRPAQKVLYRDVMRHTFGHLGALGEAGIFRPQTREVEAWSPEAQDPEGESPAAVSRGQ

SEQ ID NO: 25777 - protein, 81 aa, Rhinopithecus bieti
TKGCVTFEDIAIYFSQEEWGLLDEAQRLLYLEVMLENFALVASLGCSHGTEDEETPSEQNVSVRVSQSKAGSSTQKTQSCE

SEQ ID NO: 25778 - protein, 81 aa, Ursus arctos
VTFEDVAVYFSWKEWKFLDEAQRRLYHHVMLENFTLISSLGCCCGAEGEEAPFAQSTSVGASQAGTPTAPVSSRKTHPCEM

SEQ ID NO: 25779 - protein, 81 aa, Ursus arctos
AQESVMFSDVSIDFSQEEWECLNDDQRDLYRDVMLENYSHLVSMAGHSVSKPDVISFLEQGKEPWLVDRELTRDHWPVLES

SEQ ID NO: 25780 - protein, 81 aa, Ursus arctos
SVGPVSFKDVAVDFTQEEWQQLEPEQKTTYRDVMLENYRHLVSVGCHIIKPEVIIKLEQGEEPWIVEGEFLPQSYPEEVWK

SEQ ID NO: 25781 - protein, 81 aa, Ursus arctos
FQGSVSFDDVTVGFTQEEWQHLDPAQRSLYRDVMLENYSHLVSVGYCVTKPEVIFRLEQGEEPWILEEEFPSWSFPETWET

SEQ ID NO: 25782 - protein, 81 aa, Ursus arctos
SLDSVTFTDVAIDFSQDEWERLSLAQRTLYKNVMLENYRNLLSLGLCISKPDVISLLEQGREPWMMKGERTRGLCPDLEYV

SEQ ID NO: 25783 - protein, 81 aa, Muntiacus reevesi
PVTFDDVAVYFSQEEWRLLGEAQRLLYHDVMLENFTLVASLGCWHTAENVSVEVPQRNTQKTDLSSQKICPWEMGNLALEG

SEQ ID NO: 25784 - protein, 81 aa, Muntiacus reevesi
MGRLMFQDVAIDFTQEEWECLDLSQRDLYRDVMLETYGNLASLGLVVSKPDLVTFLEQMKNSWDVRRTDTTATYPGELPHR

SEQ ID NO: 25785 - protein, 81 aa, Muntiacus reevesi
RSGFVVFEDVAIYFSQEEWGLLDEAQRLLYCQVMLQNIALLSSVGCWHGTQDEVALSEQHDAAARSQVKTPKPGPCIQKPP

SEQ ID NO: 25786 - protein, 81 aa, Muntiacus reevesi
MGLLTFQDVTVDFTQEEWECLNLGQRELYRDVMLENYGNLACLGLVVSKPDLVTFLEQMKDPWNVRRIETAIYPGMDILHP

SEQ ID NO: 25787 - protein, 81 aa, Ursus americanus
LGLLDPAQRELYRDVMLENFGNLVSVGHQPFRRDVGHLVREEKFWMVKLTTQRKGNSGKNQTIPKAEPHEELSCWQIWQHI

SEQ ID NO: 25788 - protein, 81 aa, Myotis brandtii
MDLEDVAIAFSQEEWGLLDAAQRLLYCEVMLEIFALVASVGCWHKTEADETPGEQSVSVEGESPVGASETAPAAQRTHPCE

SEQ ID NO: 25789 - protein, 81 aa, Camelus ferus
VEMSVSFEDVTVAFTQEEWRHMSPAQRTLYRDVMLENYRHLVSVGRCFTKPYVIFKLERGEDPLLLEEEILKKSLAAESSQ

SEQ ID NO: 25790 - protein, 81 aa, Saimiri boliviensis
VLGPLTFKDVAIEFSQEEWRCLDPAQRTLYRDVMLENYRNLVSLGVSLPDLNINSMLKQRRELWSGENEVKIAKSSDRREG

SEQ ID NO: 25791 - protein, 81 aa, Propithecus coquereli
LKGLLSFTDVSVEFTSEERQLLDSTQKYLYRDVTLENYNNLVSVGYHGTKPGLIFKLEQGEEPWIVNAKISSRSCPEGWEE

SEQ ID NO: 25792 - protein, 81 aa, Propithecus coquereli
MDGKPMEHLTFRDVAIEFSQEEWKCLDPAQRALYRDVMLENYRNLVSLGEDTFPPEPRSVESQVKIARKLKQWERIKGVIT

SEQ ID NO: 25793 - protein, 81 aa, Vombatus ursinus
APVPVTFDDVTMYFTEQEWRNLEEWQKELYKHVVKTNYETLVSLGCAIPKPDLITWIEQGEEPFIRGQENLGTEDLAIGSR

SEQ ID NO: 25794 - protein, 81 aa, Propithecus coquereli
LTFRDVAIEFSLEEWKCLDPAQRALYKAVMLENYSNLVSLDIPPKEKSNAGEVFQTVTLERPESHDIEDFSFREVQKNIHD

SEQ ID NO: 25795 - protein, 81 aa, Vombatus ursinus
MFLFQASVTFQDVAVDFSRDEWKCLDDAQKALYRDVMLENYENLVSLGLPVSKLDVISLLERREAPWRSKEHVPRDPLPGE

SEQ ID NO: 25796 - protein, 81 aa, Vombatus ursinus
SQGLATFKDVTLSFSQEQWGELDPTQKEFYGEYVLQEDCGIVVSLTFPIPRLDEVSQAEEEEESWVPDLEYTQDPEDTEIL

SEQ ID NO: 25797 - protein, 81 aa, Vombatus ursinus
MLENYENLVHLGLAVSKPDVISQLEQREAPWTPGGIQRSGCPDWEATPETKQSVLKLGVSVQDLSQERGTKKNLCFSRLKK

SEQ ID NO: 25798 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSGESFKIP

SEQ ID NO: 25799 - protein, 81 aa, Vombatus ursinus
LSLGELVTFKDVTVGFSQDEWGLDMMLENYRNLVSLGLILAKSEVICHLEQGGELWKLEQGVLCSAWEIKAKTKVLSPKWD

SEQ ID NO: 25800 - protein, 81 aa, Saimiri boliviensis
TGGDVTFSDVAIDFSHEEWGWLDSAQRDLYKDVMVQNYENLVSLAGLSITKPYVITLLEDGKEPWMVEEKLSKGVTPDWES

SEQ ID NO: 25801 - protein, 81 aa, Saimiri boliviensis
MLENYRNLAFLAGIAVSKQNTITCLVQGKEPWNVKRHEMVARPNAMCSYFPKYLWPEQDIKDSFQQVILRRYGKCGHENLQ

SEQ ID NO: 25802 - protein, 81 aa, Saimiri boliviensis
QEQVSFKDVCVDFTQEEWYLLNPAQKMLYRDVILENYSNLVSVERKWKVDDVLESSQENEDDHFWELLFHNNKTVSAESGD

SEQ ID NO: 25803 - protein, 81 aa, Vombatus ursinus
FQEAVTFRDVALDFTWDEWGCLSGVQRELYRDVMLENYRNLVSLGLPGPKPGLISWLEGEGDPHPWESLGHAARSTSLSEA

SEQ ID NO: 25804 - protein, 81 aa, Saimiri boliviensis
SPGSVTFTDVAIDFSQDEWEWLNLAQRSLYKKVMLENYRNLVSVGLCIAKPDVISLLEQEKDPWVIKGEMTRGLCSDLEYV

SEQ ID NO: 25805 - protein, 81 aa, Saimiri boliviensis
MDTVVFEDVVVEFTLDEWALLSPAQRKLYRDVMLETFQNLASVGNETQRKANGSIAQQDNFGEKLSIQQKIEKFIRNNTWA

SEQ ID NO: 25806 - protein, 81 aa, Balaenoptera acutorostrata
CEGSVSFRDVAVDFSREEWQQLDLDQKNLYRDVMLETYSHLLSVEELWQIDDQIESYQQRENKSLRDVTFIKKILTIKRDY

SEQ ID NO: 25807 - protein, 81 aa, Saimiri boliviensis
AQSSVTFEDVAVNFSLEEWNLLNEAQRCLYRDVMLETLTLISSLGCWHGGEEEAAPSKQSTCIHVYKDQRVHNGERPYECG

SEQ ID NO: 25808 - protein, 81 aa, Lynx pardinus
MLENYGNLVSVGYQLSKPGVISQLEKGEEPWLIEREVSGGPRSDLESKAETKESAVKNDTSWEELHHGLMKEQSTRGSTLY

SEQ ID NO: 25809 - protein, 81 aa, Lynx pardinus
PQLPESLEDVAMYISQEEWGHQDPSKRALSRDTVQESYENVDSLEAQVPSREALSTQVEQGGKPWDPSVQTCKEGLSPRGP

SEQ ID NO: 25810 - protein, 81 aa, Cervus elaphus
FQESVTFEDIAVDFTQEEWALLDTSQRKLFRDVMLENISHLVSVGNQLYKPDVISHLEQGEQLSREELGFLQGQSPGELRE

SEQ ID NO: 25811 - protein, 81 aa, Colobus angolensis
MCGLLTFRDVEWQCLDIAQKNLYRNVMLENYRNLAFLGRTGHELWLRELELESWNCFRDHSKGICPHFAQDIWPEQGMEDS

SEQ ID NO: 25812 - protein, 81 aa, Colobus angolensis
QEGVNFKTVTVDFTQGEQGTWNPSQRTLNRDVILENHRDLVSWDLATAVGKKDPTSKQSIFDEELANGVKIERLTRDDPWL

SEQ ID NO: 25813 - protein, 81 aa, Myotis brandtii
VEQDMDFEDVAIAFSQEEWGLLDEAQRLLYCDVMLEVFALVSSAGCGHKTDDEEACPEQSLCVQGESQVRASETEPATQRT

SEQ ID NO: 25814 - protein, 81 aa, Eschrichtius robustus
MPEKSRNLVLLGLPVSQPGMNSQLEQREGSWMLERGGLRSTCPDWKIVSESPPEQDISEESFQDPSVEMPSGESDHRNSEL

SEQ ID NO: 25815 - protein, 81 aa, Eschrichtius robustus
FQNRVSSFKDMIFCFSEEDWSLLDPAQTGFYGEFIIGEDCGVSLPPNDPAAQLDLSQGEENEPRVPELQDLQGKDVSQVSY

SEQ ID NO: 25816 - protein, 81 aa, Myotis brandtii
SALGQLTFSDVAIEFSQEEWACLDPAQRKLYMDVMLQNYRNLVFLGVSKPDLLTFLEHMKEPWELKRKKTIPIQPAISSQV

SEQ ID NO: 25817 - protein, 81 aa, Eschrichtius robustus
QSPGLQEKDVAVYFSLEEWERLDADQRELYKEVMQENYGILVSLGYPIPKPDLIFRLEQGEEPWVPDSPRPEEGDIVTGVY

SEQ ID NO: 25818 - protein, 81 aa, Myotis brandtii
VTFEDIALYFSREEWSLLDEGQRQLYLNVMLENFELISSLGCCCGAENVEAPFEENISVRVSQAMNPKLALSSQKSHPCES

SEQ ID NO: 25819 - protein, 81 aa, Lynx pardinus
FQDFVSFKDVAVNFTEEEWRELDPVQRVLYRDVMLENYRNLVSLVGFPFSKPDIISQLEQAVNPWMQEGEVLRGSCTHSKN

SEQ ID NO: 25820 - protein, 81 aa, Lynx pardinus
SQGLVTFEDVAVYFSLEEWERLDAGERDLYKDVMQENYGILVSLGAWFWTDDIEDHEEEEDEDFLAEVAEEENEPPGLWSA

SEQ ID NO: 25821 - protein, 81 aa, Saimiri boliviensis
CQETVTFEDVAVHFTKTEWTGLSPAQRALYRSVMLENYGNLIAMGYPVPKPALISLLEGGDMAWGLEGTKNICKHAETNTD

SEQ ID NO: 25822 - protein, 81 aa, Lynx pardinus
MLFEDVSVDFTQKEWRLLDPAQRLLCRDVMLENYGHLVSLGRCVTKAELILKLEQGEEPWVPRRELPSQSPPGELTKAAER

SEQ ID NO: 25823 - protein, 81 aa, Lynx pardinus
QESVTFKDVAVDFTLEEWGWLGPGQRELYRDVMLENYQNLLSLGAGPPGFKPDVISRLERGEEPRMEKREGWQMACPDLET

SEQ ID NO: 25824 - protein, 81 aa, Balaenoptera acutorostrata
MAVRCLPTVVQDEWAQLSPAQRALYRDVMLENYSNLVYLGLLGPKPDTFSQLGKGEEWMPEDSLGGFCLDWMTTPVSKKST

SEQ ID NO: 25825 - protein, 81 aa, Lynx pardinus
CQESVTFEDVAVIFTDEEWRHLVPIQKDLYKEVMLENYKSIVSLGLPVPRPEVIFQLKTGDEPWIVDLHGSEERECPENVS

SEQ ID NO: 25826 - protein, 81 aa, Vombatus ursinus
MLENYRNLLYLGLVVSKPDVIYQFERGEVLWRPDRRVPGSICPAGETGPECKESTAKWNISVECSSPNSLTSSGLCVFSLK

SEQ ID NO: 25827 - protein, 81 aa, Saimiri boliviensis
MGVLTFRDVAIEFSPEEWECLDSAQQHLYRDVMLENYRNLVSLGLAIFKPNLITCLEQRKEPWNLKKQETVAKYPAGSFHF

SEQ ID NO: 25828 - protein, 81 aa, Vombatus ursinus
FQESVTFKDVAVEFTREEWVQLNRSQKKLYRDVMLEKYKSLVSLGFAVSKPDVIYQLERKEASWMPEADIPRNSCPGDYIK

SEQ ID NO: 25829 - protein, 81 aa, Balaenoptera acutorostrata
SKGPVSFEDVTMGFTQEEWQHLDPAQRTLYRDVMLENYSHLISVGYCVTKPEAIFKLEQGEEPWMLEEESQSQSHPELIIS

SEQ ID NO: 25830 - protein, 81 aa, Lynx pardinus
VTFEDVVVDFTQEEWGQLEPAQRTLYRDVMLETFRLLVSVDLETRPQTKVSTPTQDITEGIRTSALAERFLWDSLRYSEGD

SEQ ID NO: 25831 - protein, 81 aa, Cervus elaphus
MAFEDVAVHFSQEEWGLLDTAQRSLYRRVMLENFALLASLGLSVSRPHVVTQLERGEEPWVLSGVDVTLPRDAQRRPHRGS

SEQ ID NO: 25832 - protein, 81 aa, Colobus angolensis
LKIQNMTFKDVAVVFSEEELRLLDLAQRKLYREVMLENFRNLLSVGHQPLHRDTFHFLKEEKFWMMETVTQREGNLGKKQA

SEQ ID NO: 25833 - protein, 81 aa, Colobus angolensis
KPGTVSFADVAVYFSREEWGYLRPAQRALYRDVMRETYCHLGALGVGGSKPALISWVEEEAELWDPAARDPEVTKGLTETD

SEQ ID NO: 25834 - protein, 81 aa, Colobus angolensis
DSVTFEDVAVDFTQEEWTLLDQTQRNLYRDVMLENYKNLVAVDWESHINTKWSASQQNFLQGKTSSVVEMERNHFGEELFD

SEQ ID NO: 25835 - protein, 81 aa, Colobus angolensis
MSELLTLEDVTVEFTWEEWQLLDPFQKDLYRDVMLEIYSNLVSVGYQVSKPDALSRLERGEEPWTMEDERHSRICPENNKV

SEQ ID NO: 25836 - protein, 81 aa, Colobus angolensis
TTFKEAVTFEDVAVFFTEEELGLLDPAQRKLYQDVMLENFTNLLSVGHQPFHPFHFLREEKFWMMETATQREGSSGGKTVV

SEQ ID NO: 25837 - protein, 81 aa, Colobus angolensis
TEGRVVFEDVAIYFSQEEWGHLDEAQRLLYRDVMLENLALLSSLGCWHGAEDEEAPSQQGFSVGVPEITTSKSCLPTQKVH

SEQ ID NO: 25838 - protein, 81 aa, Colobus angolensis
KSQESLTLEDVAVDFTWEEWQLLGPIQKDLYRDVMLENYSNLVSVGYQASKPDALSKLEQGEPWTVENEIHSQICPEIKKV

SEQ ID NO: 25839 - protein, 81 aa, Mustela putorius
SQEPVTYEDVAVDFTQEEWQHLDAAQKTLHRDVMLEIYGHLVSVGCSSIKPGVIFKLEHEEDPWIIKSELSTWIHSDREKS

SEQ ID NO: 25840 - protein, 81 aa, Mustela putorius
HWLVTFRDVAINFSQEEWECLNSTQRDLYRDVMLENYSNLISLDLESSCETKKSFPEKGAYEMESLQWENMRKPISHNLDY

SEQ ID NO: 25841 - protein, 81 aa, Tupaia chinensis
KVPVTFVDIAVYFSEDEWKNLDEWQKELYNNLVKENYKTLMSLDAEGPVPKPEAPAQAEPREEPCVWEQRHPEEREIPVDP

SEQ ID NO: 25842 - protein, 81 aa, Tupaia chinensis
VQGSVTFRDVAVLFSQDEWLHLDTAQRTLYREVMLENYSNLVSLGILFSKPKVISQLEQGQDPWKVEHGAPQGTCPGWESL

SEQ ID NO: 25843 - protein, 81 aa, Tupaia chinensis
MYFTQTEWDDLSPAQRALYRDVMLENYGNVASLGFPLLKPAVIAHLEGGGDMGGPFPLATGTEIGSQVLWTVDIYIQTGPE

SEQ ID NO: 25844 - protein, 81 aa, Vicugna pacos
SQEQVSFRDVCVDFTQEEWYLLDPAQKILYRDVILENYSHLVSVGNCITKPEVIFKIEQGEEPWIPEERFPKQCFSEDWKV

SEQ ID NO: 25845 - protein, 81 aa, Vicugna pacos
KGLLTFEDVAVFFTQEEWDYLEPAQRSLYKDVMMENYGNLVSLDVLNRDKEEEPTVKQEIEEIEEEVEPQGVIVTRIKSEI

SEQ ID NO: 25846 - protein, 81 aa, Vicugna pacos
SLGSVSFKDVTVDFSREEWQQLDLAQKSLYTDVMLENYFNLISVGCQVPKPEVIFNLELGEEPCMLDDGTSSQSCLDQSIG

SEQ ID NO: 25847 - protein, 81 aa, Panthera pardus
MVQESVTFKDVVVLFTQDEWAQLSPTQRALYRDVMLENYSNLVSLGLLGPQPDVLSQLGKGEEWVLEDTSAGFCLDWMTMP

SEQ ID NO: 25848 - protein, 81 aa, Panthera pardus
WLTFRDVAIEFSQEEWECLDPAQRALYRDVMLENYRNLVSLALSPKCVIKELPPKENSNTGEVLQTVILERRESRGAEDCG

SEQ ID NO: 25849 - protein, 81 aa, Panthera pardus
SRGSLSFGDVTVDFSWEEWQCLNPAQRTLYRDVMLENYHNFVSVGFLINKPEVIFRLEEGEEPWIVKEEFLYQNYPEDNKA

SEQ ID NO: 25850 - protein, 81 aa, Ursus arctos
SVAFQDLAVRFSEEEWQLLAEGQRALYRDVMRENYDTLRSLGTDELLPLSAFLSPTEAGGAMEGRSSAGEGQEPSRGGGPP

SEQ ID NO: 25851 - protein, 81 aa, Ursus arctos
PQVLVSFEDVAVFLSREEWGCLGPAQRGLYRDVMLETYRNLISLGFQDSKPDVISKLEEGEEPWAPYSPRIEEGWIQSHGS

SEQ ID NO: 25852 - protein, 81 aa, Ursus arctos
IGVVGCQCASRCAEHPGRCGPGGTPSMLGSVVPAPYRSRAPAGGWSDPLFFGGPKLISQLEQGKETWREERTCPLATCPAE

SEQ ID NO: 25853 - protein, 81 aa, Muntiacus reevesi
PQEPVTFADVAVLFTPEEWLFLDSAQKSLYRDVMLENYRNLASVGDQLCKTKMSSHMEQREELCVTERGVFPGAHLGPHLQ

SEQ ID NO: 25854 - protein, 81 aa, Muntiacus reevesi
VSFEDVAVYFSRKEWGLLNWTQRSLYRHVMLENFALIGSLVCAPFPASLSSTVGSSDTCCPTGSWSRTWGVTLLKLWLLCA

SEQ ID NO: 25855 - protein, 81 aa, Muntiacus reevesi
VVFEDVTVNFTLEEWALLDFSQRKLCRDVMGETFRNLALVGTTWEDHDIDDQYRNQGRQLRLCEGKEDIRPWGHKVCGKDL

SEQ ID NO: 25856 - protein, 81 aa, Muntiacus reevesi
EQLTSEDVAIKFTQEEWEFLDPAQRALYRDVMLETYRNLLSVAFTTQSDSDKREPFQTLMLGRPESYEMKHFHLWESQENM

SEQ ID NO: 25857 - protein, 81 aa, Muntiacus reevesi
MGLLTFLDVTVDFTQEEWECLDLGQRELYRDVMLENYGNLACLGLVVSKSDLVTFLEQMKDPWDVWRVETAIYPEHHLPTH

SEQ ID NO: 25858 - protein, 81 aa, Muntiacus reevesi
KPLAVRFADVAVYFSPEEWGCLLPAQRALYRDVMRETYGHLGALGFPGPKPALISWMEQESEAWSPDAQDPEEGESLGGAL

SEQ ID NO: 25859 - protein, 81 aa, Muntiacus reevesi
LRLSVTFDDVAVTFTQEEWGHLDPAQRTLYQEVMLENCGLLVSLGCPVPRPELIYQLEHGQELWTVKRDLSGSTCPGDKGK

SEQ ID NO: 25860 - protein, 81 aa, Ursus americanus
PHGLLISSCNSRTMTDGLVTFRDVAIDFSQEEWECLDPAQRDLYVDVMLENYSNLVSLGKVICLKYFRVFSLHHRLLLWEL

SEQ ID NO: 25861 - protein, 81 aa, Ursus americanus
AAGCVTFEDVAIYFSQEEWVLLDEAQRHLYHDAMLENFALIASLGKAFTLTPPCKAPLSRLVHLIFMGLFLCSLFCSVGLC

SEQ ID NO: 25862 - protein, 81 aa, Balaenoptera acutorostrata
SVTFEDVAVYFSQEEWRLLDEAQRFLYRDVMLETFALVASLGCWHGAEVKETPSEQNVFVEVPRINTSKTNLSTQEAYPWE

SEQ ID NO: 25863 - protein, 81 aa, Vombatus ursinus
MLENYRNLVSLGAECQSAKPKLISQLEQSREPWLLEGEDLRGLCPDGCPKPETLNSGPHQDVSEKPSCREERLEGLRRDGS

SEQ ID NO: 25864 - protein, 81 aa, Saimiri boliviensis
AQVSVTFDDVAVTFTKEEWGQLDLAQRTLYQEVMLENCGLLVSLGCPVPRPELIYHLEHGQEPWTRKEDLSQGTRPGDKGK

SEQ ID NO: 25865 - protein, 81 aa, Lynx pardinus
MLQVTFSDVAIDFSHEEWGWLDSAQRDLYKDVMVQNYENLVSLAGLSIPKPYVISLLEDGKEPWMVQKKLSKDWESRWENK

SEQ ID NO: 25866 - protein, 81 aa, Balaenoptera acutorostrata
LQRPVTFKDVAVDFTQEEWRYLDPSQRDLYRDVMLENYINLISVGYKTIKPAVIHKLEQGEEPWMVEREISSWRYPVYYAS

SEQ ID NO: 25867 - protein, 81 aa, Vombatus ursinus
FQASLTFKDVAVVFTKEEWGQLDYGQKHLYREVMLENYKNLVSLGHKGSKPDVISKLEHERDPWKVEKEITRCTCPGAGQI

SEQ ID NO: 25868 - protein, 81 aa, Balaenoptera acutorostrata
RKVPVSFEDVSVYFTKTEWKLLDLRQRTLYKRVMLENYHHLVSLGFSSSKPHLVSRLERGEGPWVADVHRMETTTGMQAGD

SEQ ID NO: 25869 - protein, 81 aa, Balaenoptera acutorostrata
PQGLLTFGDVAVHFTQEEGARLDPGQRALYRDVMLETYRNLASLGVPGSKPDLISQLEQGKEPWGSDLLGAQEGETAGDPS

SEQ ID NO: 25870 - protein, 81 aa, Vombatus ursinus
QGPRVTFKDVAVDFTQEEWSLLDHPQKALYKGVMLENAWNLLPLGLPVPREDVVSYFEQKEAPWMLEQEGLRSCCLGCISG

SEQ ID NO: 25871 - protein, 81 aa, Balaenoptera acutorostrata
MLENYSNLASVGCQVSKPSLISHLEQEEELRTEEQELHQGPCPDWETPSKTKWSILMEDIFGKETSNGVTMESSRLGEKSS

SEQ ID NO: 25872 - protein, 81 aa, Balaenoptera acutorostrata
TQEPVVFEDVAVDFTQEEWALLDLTQRNLYRDVMLENFRNLASLGYPLHTPYLISQWKQEEDLEIAERGPTQGEHQEGFET

SEQ ID NO: 25873 - protein, 81 aa, Cervus elaphus
FQDLLTFKDVAVDFSQEEWEWLSPAQRGLYRSMMLENYQSLVSLDWESIHETQELPLKQFVCDDTLMERIASYELECPTFG

SEQ ID NO: 25874 - protein, 81 aa, Cervus elaphus
YTEEEGLATGFPTDWLQDSVTFEDVTVEFNQEEWALLDSSQQKLYRDVMLENYGNLALISQLEQEDKVMTEEEGILPGTCP

SEQ ID NO: 25875 - protein, 81 aa, Colobus angolensis
SQHLVTFEDVAVDFIQEEWTLLDQTQRDLYRDVMLENYKNLIILAGSELCKPSLMSGLEQMEELRTGVTGVPQELDLQLKT

SEQ ID NO: 25876 - protein, 81 aa, Myotis brandtii
ESGEPMTFKDIAVNFSRGEWRKLEPFQKEIYKEVLLENCRHLEFLGFPVTKLDVISQLPWVEPGLLEKEVSKGSIPECEPR

SEQ ID NO: 25877 - protein, 81 aa, Myotis brandtii
MEEWAFLDPTQKKLYTDVMLKTFWNLASVACILEEKCEGHVSEDQYENHGRNLSSHMVERLCTRKDGCQCRENFSQIPNHN

SEQ ID NO: 25878 - protein, 81 aa, Myotis brandtii
GLAQVNVEDVFVCFSREEWGLLDEAQRRLYRDVMLENFALLASLGCASSMSRGAAPLELGSEPRASDWAHVSPASTRDAQS

SEQ ID NO: 25879 - protein, 81 aa, Myotis brandtii
SMGSDLFRDVAVLFSREEWEWLAPAQRDLYRDVMLETYTNLRSLDLAISKPDVIAFLEQGKEPWRAEEAAAGGLCPASEAR

SEQ ID NO: 25880 - protein, 81 aa, Myotis brandtii
LQGTVTFKDVAIDFTQEEWQQLEPAQRNLYRHVMLENYNNLITVGCPFTKPDVIFKLEQEEEPWVVEEEVLKRHCPGEISG

SEQ ID NO: 25881 - protein, 81 aa, Myotis brandtii
QMVSLSFEDVTVDFSRDEWQHLDPAQRCLYWDVTMENYSHLLSVGYQVPKPEVIFKLEQDKNIGKTQQQRISGEVSFHCEK

SEQ ID NO: 25882 - protein, 81 aa, Myotis brandtii
LQEPVSFRDVAVDFTQEEWQQLGPEQKTTYRDVMLENYSHLVSVGCHLVKPEVIIKLEQGEEPWRVGEVLLHSRPEVWKVD

SEQ ID NO: 25883 - protein, 81 aa, Myotis brandtii
EVMNFEDVAIAFSQEELGILDEAQRLLYCDVMLEVFAVVSSIGCWHKMEDEEASSDQSVYIQGESQVRASKTAAATQKTFL

SEQ ID NO: 25884 - protein, 81 aa, Vombatus ursinus
AVDFTLEEWGNLRPSQKELYRDVMLENYRNLVWLGKDVSKPDVIYQLEQVEGPWVLEGEAPAVSCPGDKQSPSELDLSMEV

SEQ ID NO: 25885 - protein, 81 aa, Propithecus coquereli
LQGLVTFEDVAVYFSREEWGLLSVTQKSLYRDVMLENFALISSLGKSTLFPSRLSATDSSLPSGCLCRTEDEEAPPKQVKS

SEQ ID NO: 25886 - protein, 81 aa, Propithecus coquereli
SRGSMTFEDVVVDFTQEEWTLLDISQRKLYRDVMLENISHLVSIGKQFCTSGVLSRLEPEGELSREGINVLQGQNPGREGD

SEQ ID NO: 25887 - protein, 81 aa, Saimiri boliviensis
GSVSFTDVTVDFTQEEWEQLDPSQRILYMDVMLENYSNLLSVEVWKADDQMERDHRNPEQQPRQFLILKNQTPMEERGDLF

SEQ ID NO: 25888 - protein, 81 aa, Propithecus coquereli
CWGLLSFTDVSVEFTSEEWQLLDSTQKYLYRDVTLENYSNLVSVGYHGTKPDLIFKLEQGEEPWIVNAKISSQSCPEGWEE

SEQ ID NO: 25889 - protein, 81 aa, Balaenoptera acutorostrata
RIQGPVTFEDVAVYFSQEEWKLLDEAQRFLYHDVMLETFALVASLGLSSSRSHVVQLELRGEPWVHDRVDMTPDRARGAQI

SEQ ID NO: 25890 - protein, 81 aa, Saimiri boliviensis
KSGAVSFGDVAVYFSREEWGCLRPVQRALYRDVMRETYSHLGVLGVGGSKPAFISWVEEEAELWGPAAQDPEVAKHPTEAD

SEQ ID NO: 25891 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSWEIRPVN

SEQ ID NO: 25892 - protein, 81 aa, Lynx pardinus
MLENYGNLTSLGYQVPRPALISLLEAGNLPWGLEAQDNLSAERTKDICEDTETNINSESTSTQGISEERDVMLSHGLQKSV

SEQ ID NO: 25893 - protein, 81 aa, Vombatus ursinus
MFEDVAVYFQKEEWASLDPAQKVLYRDVMLENYRNIESLAYLFPKPLVISKLEQVSGNLQEARDIGQRFVCAGGEVKFEKE

SEQ ID NO: 25894 - protein, 81 aa, Saimiri boliviensis
ITFEDVAIYFSQEEWELLDEAQRFLYCDVMLENFAHVTSLGYCHGTDNEAIASEQSVSLQVRTSKRDTPTQKTHLSEVKVC

SEQ ID NO: 25895 - protein, 81 aa, Saimiri boliviensis
PLTFRDVTVEFSQEEWKCLDPAQKALYKDVMLENYRNLVFLGIIPKCTTKELPPIGNSNTREKFRTMTLERHECYDIEDIY

SEQ ID NO: 25896 - protein, 81 aa, Saimiri boliviensis
AQGPVSFRDVTVGFTQEEWQHLDPAQRTLYRDVMMENYSHLVSVGYCIPKPEVILKLEKGEEPWILEEKFPSQSHLGSTRL

SEQ ID NO: 25897 - protein, 81 aa, Balaenoptera acutorostrata
MLENYRSLVSLGLCVSKPKMISSLEQRKEPWAAKRTLTRDSRALPETKELSSKKNFCEEKSSQAVLMERPTTCSLECSVLG

SEQ ID NO: 25898 - protein, 81 aa, Saimiri boliviensis
WSQMPVTFEDVALYLSQEEWGRLDHTQQNFYRDVLQKRNGLSLGFPFSRPFWAPQVQGKGEASGSSRQAGDEKEDCRGECT

SEQ ID NO: 25899 - protein, 81 aa, Saimiri boliviensis
LVTFEDVAVYFSQEEWGLLDAAQRHLYHNVMVENFELITSLGNALPQHGVLLCSSVGAHLPNCFPNWLPHFTSLSAVYKCC

SEQ ID NO: 25900 - protein, 81 aa, Lynx pardinus
SSQGLLTFRDVAVEFSQEEWGCLNHSQQELYWDVMLETYRHLLFLGLVSKPDLVIFLEQKRELWDVKREETVATHPAVSSN

SEQ ID NO: 25901 - protein, 81 aa, Saimiri boliviensis
QDSVAFEDVAVNFTHEEWALLGPSQKNLYRDVMQETIRNLNCIGMKWENQSTDDQYQNLRRNLRCDVVERFGKSEDGSQCG

SEQ ID NO: 25902 - protein, 81 aa, Saimiri boliviensis
KFLESVSFKDVTVDFSRDEWQQLNIAQKSLYRDVMLENYFNLISVGCQVPKPEVIFNLEQEEPRMLNGGISSQSCPDGKIG

SEQ ID NO: 25903 - protein, 81 aa, Balaenoptera acutorostrata
ESVTFKDVAVDFTQEEWALLDTSQKKLFRDVMLENISHLVSVVISGREDDLRKQEMIFMQHIYKKDTSVISAMQRSHSQED

SEQ ID NO: 25904 - protein, 81 aa, Saimiri boliviensis
SQGHLTFTDVAIEFSQEEWKCLDPAQRALYKDVMLENYRNLVSLGVSLPDLNINSMLKQRRELWSGENEVKIAKSSDRREG

SEQ ID NO: 25905 - protein, 81 aa, Balaenoptera acutorostrata
PKVPVTFDDVAVYFSEPEWGKLDEWQKELYKHVMRGNYETLVSLDYAISKPDILTRMERGEEPCPEGPRGQEEASDREDAC

SEQ ID NO: 25906 - protein, 81 aa, Lynx pardinus
KDQESLTFEDVAVGFSREEWRLLAPAQKDLYRDVMLENFRNLVSVGYVASMPAALSRLERGGRWMTEDETRRGICPEIKKD

SEQ ID NO: 25907 - protein, 81 aa, Balaenoptera acutorostrata
QPQEAVTFKDVEVTFAQDEWGWLDASQRNLYRDVMLENYGNMASLVGPFTKPALISWLEVREPWGLNVQGAHPKGSPSAAP

SEQ ID NO: 25908 - protein, 81 aa, Colobus angolensis
PQGLVTFGDVAVDFSQEEWEWLNPSQRNLYKKVMLENYRNLASLGLCVSKPDVISSLEQGKEPWTVKRKMTRAWCPDLKTM

SEQ ID NO: 25909 - protein, 81 aa, Colobus angolensis
DSVAFEDVAVNFTLEEWALLDPSQKNLYRDVMRETFRNLASIGKQWEDQNIEDPFKIPRRNISHIPERLCESKEGSQGEET

SEQ ID NO: 25910 - protein, 81 aa, Colobus angolensis
RRGHLTFRDVAIEFSQEEWKCLDPVQKALYRDVMLENYRNLVSLGICLPDLSITSMMKQRTEPWTVENEMKVAKNPVRWEG

SEQ ID NO: 25911 - protein, 81 aa, Propithecus coquereli
YEVPVSFEDVTVDFSREEWQQLDSTQRRLYHDVMLENYSHLLSVGFEVPKPEIIFKLEQGEEPWMLEGEAPHQSSSDGKFG

SEQ ID NO: 25912 - protein, 81 aa, Propithecus coquereli
MRNLPCSAAPSEEWQHLDPSQRNLYRDVMLETYSHLLSVGYQVPKEEVVMLEQGKELWALQGENPHQSCPGQKLWDHNQCR

SEQ ID NO: 25913 - protein, 81 aa, Propithecus coquereli
HVTFEDIVVYFSQEEWQLLDEAQRCLYHDVMLENFALLASVGCWHGVEAEEAPPEQTASTEEVSQASSPKPGPSVSNAHPC

SEQ ID NO: 25914 - protein, 81 aa, Propithecus coquereli
KDVAIEFSQEEWTCLDPAQRALYRDVMLENYRNLVSVGVSLPDLTIISILEQGKEPWTVESQAKVARNPHRGKWIKSVNTD

SEQ ID NO: 25915 - protein, 81 aa, Propithecus coquereli
PQDLVTFKDVAIDFSQEEWQWMNPAQKHLYRSMMLENYQSLVSLGLCISKPYVISLLEKGKEPWEMKSEMTRSPFSDWQSI

SEQ ID NO: 25916 - protein, 81 aa, Vombatus ursinus
MSFSQEEWRCLNSTQRVLYRGIVQENYRNVDSVGLPKPLLISPVEHRKDTRIPDLQGCKETEVLSSSCTNENRVQTDEKQA

SEQ ID NO: 25917 - protein, 81 aa, Vombatus ursinus
MLENYRNLVSLGLADSNVEVISQVESGEAHGIPVDSVLRSCRPDGDGKPQTEESTPKLSFSMETLSHPKLLRDDPCISKMK

SEQ ID NO: 25918 - protein, 81 aa, Balaenoptera acutorostrata
EAQETLTFDDVAVDFTWEEWQFLAPPQKDLYRDVMLENYSNLLSVGYKASKSDILSKLDQGEPWTMEDEIHCRTHSVWKVD

SEQ ID NO: 25919 - protein, 81 aa, Lynx pardinus
DAVTFDDVALDFTQEEWILLDLAQRNLYRNVMLENYQNLVTVEWQTQHQSKESPSLQDLGEGKTAREIQKERTHQGAELSE

SEQ ID NO: 25920 - protein, 81 aa, Balaenoptera acutorostrata
RPRAVKFGDVALYFSPEEWECLRPAQRALYRDVMQETYGHLGALGCAGPKPALISWLERNTDDWEPAALDPQECPRRVTVQ

SEQ ID NO: 25921 - protein, 81 aa, Lynx pardinus
AQAPLSFEDVAVSFSREEWRLLVPAQKDLYRDVMLENYRNLVSVGYQASEPDSLFQLEHGGPLWAVEGAAPRPPCPGFVLQ

SEQ ID NO: 25922 - protein, 81 aa, Vombatus ursinus
MLENYGNLVCLGLAVSSPDVVCQLERGEGPWMPEGDVPGSSRAGWETTHQNKEPLSKLGLAIKASFQEGLAGHDSCVSRMG

SEQ ID NO: 25923 - protein, 81 aa, Saimiri boliviensis
PQESVAFDDVAVYFTKKEWAIMVPDQRALYRDVMLENYEAVAFVVPPTSKPALVSHLEQGKEPCFTQPQGVLSRSNWRAGF

SEQ ID NO: 25924 - protein, 81 aa, Balaenoptera acutorostrata
GRVPLTFSDVAVDFSQEEWECLNSDQRNLYRDVMLENYTNLVSLDIDFTSESNKLSSEKSSYEVNSYHRETMNRSKTFNFM

SEQ ID NO: 25925 - protein, 81 aa, Cervus elaphus
RTSAFPFQAPVTFGDLAIYFSQEEWEWLSPIQKDLYEDVMLENYQNLVSLGLCFRRPNVITLLEKGKAPWMVDPVKRRRGL

SEQ ID NO: 25926 - protein, 81 aa, Cervus elaphus
SEGLVTFGDVAVDFSQEEWEWLNPAQRSLYRKVMLDNYRSLVSLGVSVSKPDVISLLEQGKEPWLVKEEGPRGARSDWEYA

SEQ ID NO: 25927 - protein, 81 aa, Cervus elaphus
TSEPVSFADVAVYFSQEEWGCLQPAQRALYRDVMRETYGHLGALGFRGTKPALISWVEEEAELWGPDAGPPEMGECLTEAD

SEQ ID NO: 25928 - protein, 81 aa, Cervus elaphus
KTRKDVTIEFSQEEWECLAPSQRALYRDVMLDTYRNLVSLGEDNFSPDVGILSAGFGINKLSPRENTNVGELYGNENHGIK

SEQ ID NO: 25929 - protein, 81 aa, Cervus elaphus
DSVVFEDVAVNFTLEEWALLNSAQKELYRDVMLETFRNLASVGSFFLVRFVPFLLSDDETQCKANGSVSQQDIYGNKISKE

SEQ ID NO: 25930 - protein, 81 aa, Cervus elaphus
RCQDPVTFEDVAIVFTDEEWRHLVPTQRDLYKEVMLENYKSIVSLDWETKPEIQGASEEEKSEGSLKEKLGRKGSPSPKFE

SEQ ID NO: 25931 - protein, 81 aa, Colobus angolensis
RSMIPQDNENPPQQGEANQNDSMAFEDVAVNFTPEEWALLDPSQKNLYQEVMQETLRNLASIEVLWKRDYLKVKVISVEKF

SEQ ID NO: 25932 - protein, 81 aa, Colobus angolensis
AQMLVTFKDVAVTFTQEEWRQLDLTQRTLYREVMLETCGLLVSLGHRVPKPELVHLLEHGQELWTVKTGLSQPTCAGDRTQ

SEQ ID NO: 25933 - protein, 81 aa, Colobus angolensis
GQVNFEDVFVYFSQEEWVLLDEAERLLYRDVMLENFALTASLGCWRGMEDEEIPFEQSFSIGMSQIRIPKGGPSTQKAYPC

SEQ ID NO: 25934 - protein, 81 aa, Colobus angolensis
AQVSVTFDDVAVTFTQEEWGQLDLAQRTLYQEVMLENCGLLVSLGCPVPRPELIYHLEHGQEPWTRKEDPSQDTCPGDKGK

SEQ ID NO: 25935 - protein, 81 aa, Colobus angolensis
PLQGSVSFRDVAIDFSREEWRHLDLSQRNLYRDVMLETYSHLLSVGYQVPEAEVVMLEQGKEPWALQGERPRQSCPGEKLW

SEQ ID NO: 25936 - protein, 81 aa, Colobus angolensis
QQGYVTFEDVAVYFSQEEWRLLDEAQRLLCRNVMLENFSLLASLGLASSKTHEITQLESWEEPFMPALEVVTSAIPRVWLC

SEQ ID NO: 25937 - protein, 81 aa, Tupaia chinensis
RKELMSFEDVTVDFTWEEWQGLEDAQRILYKDVMLETYSNLVFLGHCIAKPAVILKLEQEGEPWALEELPNQSLPGDKPYE

SEQ ID NO: 25938 - protein, 81 aa, Vicugna pacos
SSQESLTFQDVAVNFTREEWDQLYPAQKNLYRDVMLENYRNLVALGHQLYKPEVITQLEQEEQWMMEGDSPLDTHPDGENR

SEQ ID NO: 25939 - protein, 81 aa, Vicugna pacos
MTEQFSTLKDIAMDFTLDDWEQLGLDQGDLFWDKALDNYQSLFLLDPLRPNLVSHPEAGEALESLVKGSPESTAPDTAEAK

SEQ ID NO: 25940 - protein, 81 aa, Vicugna pacos
PKVPVSFEDVSVYFTKTEWKLLDFRQRVLYKRVMLENYRHLVSLGFSSSKPHLVSLLERGEEPWVADIHRMGAVTGMQTGD

SEQ ID NO: 25941 - protein, 81 aa, Myotis brandtii
GRVSVSLEDVTVDFSREEWQQLNSTQRRLYQEVMLENYSHLLSVGYEVPKPEVIFKLEQGEEPWILEGETPHQSCSDGKFG

SEQ ID NO: 25942 - protein, 81 aa, Myotis brandtii
QEPVTFKDVVVEFSVEEWGQLDSAVKNLYRDVMLENYRNLSSLRKELLFSKPVEAPKLESKIKGWIMEQEIPRTAILGKQH

SEQ ID NO: 25943 - protein, 81 aa, Camelus ferus
YGTVTFEEVAVYFSQDEWRLLDEAQRLLYRDVMLENFVLVASLGCWHRAEDKETTCVQEVSGKGPQVNTSKADLSTQKAYP

SEQ ID NO: 25944 - protein, 81 aa, Saimiri boliviensis
KPDLITCLEQGKEPWNMKRHEMVDEPPAMCSYFVKDLWPEQDIKDSFQEVILRRYGKCGHENLQLKKGSASVDKCKVHKEG

SEQ ID NO: 25945 - protein, 81 aa, Propithecus coquereli
SPGLVTFRDVAIDFSQDEWEWLNLAQRSLYRKVMLENYRNLVSVGLCISKPDVISLLEQEKEPWVMKGEITGGLWPDLEYV

SEQ ID NO: 25946 - protein, 81 aa, Propithecus coquereli
KEALMAFRDVAVAFTQKEWKLLSPAQRNLYREVMLENYSHLVSLGIAFSKPKLIIQLEQGDEPWRGENECLLDLCPGEWEA

SEQ ID NO: 25947 - protein, 81 aa, Propithecus coquereli
RSQESLTFQDVAVDFTKEEWEQLYPAQKKLYRDVMLENYRNLVALGHQLYKPEVIAQLEQEEQWMMERDSPLDTHPDGENR

SEQ ID NO: 25948 - protein, 81 aa, Propithecus coquereli
SQAPVTFEDMAMYLTREEWRPLDPTQRDLYRDVMQENYGNVVSLDFEIRSENEVNPKQEMSEDVEFGTTSERPVGNAEENT

SEQ ID NO: 25949 - protein, 81 aa, Balaenoptera acutorostrata
MLENYSNLVSLGFSISKPDVLSLLEQGKDPWKVVRDVTRGLSPDWESRCENKKLSSKREIYELEASQWETTEQLTGRKCEC

SEQ ID NO: 25950 - protein, 81 aa, Propithecus coquereli
MAITFEDVTIIFTWEEWKFLDSSQKRLYREVMWENYTNVMSVGNWNESHKSQEEIFRHLQYENFSCWQGWRNADTQIYENQ

SEQ ID NO: 25951 - protein, 81 aa, Vombatus ursinus
FSGIVLFSNRNTQIFCLSIWTGHQVSKPDVISQLEQGEEPWTVEREVSTYSCRDWETRNKTKESTLKQDIPEAESSQKVTL

SEQ ID NO: 25952 - protein, 81 aa, Lynx pardinus
SQISLTFEEVAMYFSQEEWEFLDPTQKALYNDVMRENYETVISLALFVLPKPKVISYLEQGEEPWVQGSTELKDSPGELPT

SEQ ID NO: 25953 - protein, 81 aa, Saimiri boliviensis
IQRLLTFGDVAVAFTRIEWRHLDAAQRALYRDVMLENYGNLVSVGLLSSKPKLIAQLEQGAEPWMEARETPSGTRAVPDYW

SEQ ID NO: 25954 - protein, 81 aa, Saimiri boliviensis
MDLVMFRDVAVDFSQEEWECLNSYQRNLYRDVILENYSNLVSLAGCSISKPDVITLLEQGKEPWLVVRNEKRRWSLDLESR

SEQ ID NO: 25955 - protein, 81 aa, Vombatus ursinus
FQESVMFEDVAVYFTQKEWADLAPAQRALYRDVMLENYGNMVSLAFPFPKPAVISKLERGEEPWGLDPQVVPNEEGLKGFP

SEQ ID NO: 25956 - protein, 81 aa, Saimiri boliviensis
MEPLEFRDVAIEFSLEEWNCLDTAQRNLYRDVMLENYRNLVFLGIVVSNPDLITCLEQEKSLNVKSHEMIATSPVTCSHFT

SEQ ID NO: 25957 - protein, 81 aa, Vombatus ursinus
QESLTFRDVAVDFTHEEWRQLDPGQRYLYKDVMLENYRNLVSVGKCGTQVSKPEVIFLLEQGKEPWMVKREIPRVILEYPH

SEQ ID NO: 25958 - protein, 81 aa, Saimiri boliviensis
VTFEDVAVYFSWKEWSLLDEAQKCLYHDVMLENLTLTTSLGGCGTEDEEAPYQQSTSLQRVSQVRIPKALPSPQKTNSCEI

SEQ ID NO: 25959 - protein, 81 aa, Vombatus ursinus
TRFESVTFKNVAVEFTWEWVHLNPFQKKLYGDVMLEFCRSLCSLGFAVSKSDVIYQLERKEASWMPETDIPRSKHISCCVS

SEQ ID NO: 25960 - protein, 81 aa, Saimiri boliviensis
ISFEDVAVDFTLEEWQLLNPTQKNLYRDVMLENYSNLVFLEVWLDNTKMWLQDNHDNLKSMERGHKYGVFGKIFKSSINFV

SEQ ID NO: 25961 - protein, 81 aa, Lynx pardinus
LPHSVTFEDVAVEFTQEEWALLDPSQRTLYRDVMQENCRNLASLGCHVDKPSLTSQLEQQDKVMTQERGILPGTCPGLETV

SEQ ID NO: 25962 - protein, 81 aa, Vombatus ursinus
MLENARNLLSLGLPVPREDLISYFEEREAPWLLELEGLRSCCPGEFRPEMQKTTAKLSISVEQTQGQNFMTDGPRDFTRRQ

SEQ ID NO: 25963 - protein, 81 aa, Vombatus ursinus
LTFRDVAVDFSRDEGRRLSPAQRALYRDVMLQNSGNLRRTSGNGCSQDHKYRERFTEQVGLVESLEKPPVVQTHQCNQCEM

SEQ ID NO: 25964 - protein, 81 aa, Balaenoptera acutorostrata
MDSVTIEDVAVDFTLEEWALLDPSQRKLYRDVMQETLRNLAAVGAKREYHDIEDQYKNQGRKLRTFMVERFCKSKDISLCG

SEQ ID NO: 25965 - protein, 81 aa, Cervus elaphus
EMSLSFRDVAIDLSQEEWECMNPVQRALYRDVMLENYSNLVSLDLESKYFTKKLFPEKDICGPHLFQLQTVDESQTYIHED

SEQ ID NO: 25966 - protein, 81 aa, Colobus angolensis
CQESVTFEDVAVVFTDEEWSHLVPIQRDLYKEVMLENYNSIVSLGLPVPQPDVIFQLKRGDKPWVVDLHGSEEREQPESVS

SEQ ID NO: 25967 - protein, 81 aa, Colobus angolensis
LTFGDVAIEFSQEEWKCLDPAQRTLYRDVMLENYRNLVSLDTSSKCVMKMFSSTGQGNIEVIHTGTLQRHASHHIGDICFQ

SEQ ID NO: 25968 - protein, 81 aa, Vicugna pacos
AQLTVAFDDVALYFSEPEWDILEKWQKELYQQEMKTNYETLDSLGCVFSKPNLITWMEQGRMLFIRDQGRLEKTRVTLSPS

SEQ ID NO: 25969 - protein, 81 aa, Vicugna pacos
LQASVSFRDVTVEFTQEEWRQMDPAQRTLYRDVMLENYSHLVSVGYCFTKPELIFMLEQGEDPWLLEKEFVSGSSPEEPQP

SEQ ID NO: 25970 - protein, 81 aa, Vicugna pacos
MTFRDVAVDFSRQEWEALEPIQRDLYRDVMLENYRNLVTLAVHSTSKPDVADLSEQGKEPWMTLREGTQSQYTNLDLQCEV

SEQ ID NO: 25971 - protein, 81 aa, Odobenus rosmarus
SLDPVTFQDVAVEFTQEEWEHLGTAQRALYREVMLENYRSLASLGCQDFKPDVISRLEQGGLAWMAWRDIPRGPSPDQETR

SEQ ID NO: 25972 - protein, 81 aa, Odobenus rosmarus
PLTFRDVAVVFTEEELRLLDRAQRKLYRDVMLENFRNLLSVGDKNEKEMEYIQERDLKCLSSRELSYWKIWEQVTGELTGS

SEQ ID NO: 25973 - protein, 81 aa, Odobenus rosmarus
MAHLMMFRDVAIDFSQEEWECLSLEQRHLYRDVMLENYSNMISLGLCIYQPDVFSLLEKGKEPWMVLQDETRGPCPDMQSR

SEQ ID NO: 25974 - protein, 81 aa, Odobenus rosmarus
TRDSVTFEDVAVYFSWEEWGLLDEAQRRLYHDVMLEIFALVTTLGCWHGAEDGKAPSEQAASIGVSQVRTHHAGSHPQKAH

SEQ ID NO: 25975 - protein, 81 aa, Vombatus ursinus
FQESGTSENVALYFTRKEWMYLGLHQKALYRDMMQENYGNMVLLGKAVSKPELISQLERGEEPWKSFFQERDWKVLMTHKN

SEQ ID NO: 25976 - protein, 81 aa, Saimiri boliviensis
IQGQVNFEDVFVYFSQEEWVLLDEAQRLLYRDVMLENFALMASLGHTSFTSHIVASPVMGPDWVDVTRAVATGTLSRSCWP

SEQ ID NO: 25977 - protein, 81 aa, Vombatus ursinus
FQESLTFKDVAVDFTQEEWGWLDPAQRGLYRDVMLENYGNLVSLGHQVSKPDMISQLEQGKEPWKVERKASGDICSDLETV

SEQ ID NO: 25978 - protein, 81 aa, Vombatus ursinus
ESVTFKDVAVEFSQEEWVQLNPSQKTLNLVSLEFVYECKECGKVFHWNSVLLRHQRIYTGEKPYEYGVCGKAFSMKANLTR

SEQ ID NO: 25979 - protein, 81 aa, Lynx pardinus
SQISLTFEEVAMYFSQEEWEFLDPTQKALYNDVMRENYETVISLAVPVHQILAFSEKTNAKDWTVAPELVLPKSQSLLTFE

SEQ ID NO: 25980 - protein, 81 aa, Balaenoptera acutorostrata
FQEAVTFKDVAVTFTEEELGLLDSAQRKLYQDVMVENFRNLVSVGHLPFKPDVMSQLETEEKLWMMERETQRNGHSSENRK

SEQ ID NO: 25981 - protein, 81 aa, Balaenoptera acutorostrata
DPEQVTFEDVVVEFTWEEWGQLEPAQRTLYRDVMLETFGLLASVGHWLPKPDVISLLEHEVELWVVDKGAPRGVCTDFETR

SEQ ID NO: 25982 - protein, 81 aa, Saimiri boliviensis
SKGSVMFRDVSIDFSEEEWECLDSDQMNLYREVMLENFSNLVSVGLSSSKPAVISLLEQGREPWMVDRELTRGLCSDLKSM

SEQ ID NO: 25983 - protein, 81 aa, Saimiri boliviensis
CQESVTFEDVAVVFTDEEWSHLVPIQRDLYKEVMLENYKSVVSLGLPVPQPDTIFQLKRGDEAWMVDLHGSEETEWPKSLS

SEQ ID NO: 25984 - protein, 81 aa, Vombatus ursinus
FQESVTFKDVAVDFTWEEWGYLDTSQKELYWEVMLENYRNLVSLGFVVAKPDVISQSEQEEAPWILEVLFPRSSCSDLDTK

SEQ ID NO: 25985 - protein, 81 aa, Saimiri boliviensis
KPGLVTFEDVAVAFTQEEWQYLNPLQRSLYRDVMLETYSNLVFVGQQVTKPDLILKLEVEECPVEGIIPFWSFPEVCQVNE

SEQ ID NO: 25986 - protein, 81 aa, Balaenoptera acutorostrata
VQESLLFEDVAVEFTREEWRLLDPAQKDLYQDVMLENYSNLLSVGYQSPKPIQIFKLKQRNKPWLEKENIHGQNFPEVGEI

SEQ ID NO: 25987 - protein, 81 aa, Saimiri boliviensis
TARSQETVTFKDVAMDFTPEEWGKLDPAQRDVMLENYRNLVSLWLPVSKPDNYTLENGKEPLKLERKAPKNSYSDMKARPE

SEQ ID NO: 25988 - protein, 81 aa, Vombatus ursinus
GARGPVSFADVAVYFSPEEWGRLRPAQRALYRDVMRETYGHLGALGFPGPKPALISWMEQEAWDSDISSPEGEWEKAVTCG

SEQ ID NO: 25989 - protein, 81 aa, Colobus angolensis
GLLTFRDVAIEFSQEEWKCLDPAQRTLYRDVMLENYRNLVSLDISSKCMLKTSSTGKGNTEVIHTGTLQRQASHHTGEFCL

SEQ ID NO: 25990 - protein, 81 aa, Colobus angolensis
MLENYGAVASLEAFPFPKPALISQLERGEAPWCSVPWGALDGEDPRGISSGEILKLPGATIWRLRIKPIPKKTVTKQRETR

SEQ ID NO: 25991 - protein, 81 aa, Colobus angolensis
QDTVAYEDLCVDYTQKKWKGPALSQRALQWNMMLENDHSMASLGESMMKGSELTPKQEIFKGSESSNRTSGGLFGVVPGGA

SEQ ID NO: 25992 - protein, 81 aa, Colobus angolensis
PQDLVTFKDVAIDFSQEEWQWMNTAQKHLYRSMMLENYQSLVSLGLCISKPYVISLLEQGREPWEMTSEMTRSPFSDWESI

SEQ ID NO: 25993 - protein, 81 aa, Colobus angolensis
VTVTFDDVALYFSEQEWEILEKWQKQMYKQEMKTNYQTLDSLGYAFSKPDLITWMEQGRMLFISELGCLDKTRRTTSPPTD

SEQ ID NO: 25994 - protein, 81 aa, Colobus angolensis
GPLTFRDVTVEFSLEEWECLDTVQQDLYWDVMLENYRNLVFLGIAVSKQSNLITCLEQGKEPWNMKRHEMVAKTPVMCSHI

SEQ ID NO: 25995 - protein, 81 aa, Mustela putorius
AECGVTFEDVAVYFSWKEWRLLDEAQRRLYHHVMLENFALVSSLGCCCGAEDEEAPFAQSASVGVSRTWTPRAALSSQKTH

SEQ ID NO: 25996 - protein, 81 aa, Mustela putorius
SKVPVTFGDLAIYFSQEEWEWLSPIQKDLYEDVMLENYQNLVSVGLSFRRPNVITLLEKGRAPWMVEPVRKRRGMDSGSKC

SEQ ID NO: 25997 - protein, 81 aa, Tupaia chinensis
LQELVSFKDVAVDFTQEEWQQLDPDEKTTYRDVMLENYSNLVSVGYDITKPNVIIKLEQGEEPWIIEEVWKIDDLIERIQE

SEQ ID NO: 25998 - protein, 81 aa, Odobenus rosmarus
VAEELLTFRDVAIEFSQEEWGCLNHTQWELYREVMLGNCGHLLFLGLIVSKPDLVSFLEQTKDPWDGKSKKTVAFHPGRWE

SEQ ID NO: 25999 - protein, 81 aa, Odobenus rosmarus
LLTFRDVAIEFSPEEWECLDPAQRALYRDVMVENYRNLVFLDISTRCMSKELPPKDNINNGELFQTLILERHVSHDFDDFG

SEQ ID NO: 26000 - protein, 81 aa, Odobenus rosmarus
MAVSEPGGSAAKEWEQLDPAQRNLYKDVMLENYSNLASMGYQAPKPDMISKLEKGEEPWLGKGKRPRQGGPSEIARPKQIG

SEQ ID NO: 26001 - protein, 81 aa, Odobenus rosmarus
FQEAVTFKDVAVVFTMEELGLLDSTQRKLYQDVMVENFKNLVSVGHLPFKPDMVSQLEAEEELWMMEGEPQRNGKNQNEME

SEQ ID NO: 26002 - protein, 81 aa, Odobenus rosmarus
AQESLTFDDVAVDFTWEEWQLLVPAQKDLYRDVMLENYSNLVSVGFHTSKQDVLSKLDQGEPAWTVEDDIPCQTHSETWKL

SEQ ID NO: 26003 - protein, 81 aa, Odobenus rosmarus
LQESLTFRDVFVDFTLEEWQQLDSAQKNLYRDVTLENYSHLVSVGYLVARPEEVSRLGRGEEARRAEGGPSAPNFPGEPAR

SEQ ID NO: 26004 - protein, 81 aa, Delphinapterus leucas
VKGSVTFKDVTMAFSKKEWEQLDPAQKSLYKDVMLENYSNLASMGYQALKPDMISKLGKGEEPWLGKGKRPRQGGLSEIAR

SEQ ID NO: 26005 - protein, 81 aa, Propithecus coquereli
AQRCVIFEDVFVYFSREEWELLDNAQRLLYHDVMLETFALLASLGIASSRSHVVIQLEPGEELDQVDVTPATKREAQMGAG

SEQ ID NO: 26006 - protein, 81 aa, Propithecus coquereli
IQGQVNFEDVFVYFSQDEWQLLDEAQRLLYRDVMLENFVLMASLGCHGMEYEEIPFEQSISREGWSQMRTPKEGFSAKKVH

SEQ ID NO: 26007 - protein, 81 aa, Propithecus coquereli
ESLTLEDVAVEFTWEEWQLLGPAQKDLYWDVMLENYNHLVSLGYQASKPDALSKLAQGEEPCVIEGKIQNRNCPGIRKADS

SEQ ID NO: 26008 - protein, 81 aa, Vombatus ursinus
MLENAQNLLSLGLPVPREDLISYLEERKAPWLLEREGLRSCCPEGEIRPEMKETTAKLSISVKETHEESSMRDCAYDFTGR

SEQ ID NO: 26009 - protein, 81 aa, Balaenoptera acutorostrata
TAQGSVLFEDVSVDFTQKEWQLLDRAQRLLYRDVMLENYGHLVSLGHCVSKPELILKLEREEPWILKGQLPSESHPEVQRT

SEQ ID NO: 26010 - protein, 81 aa, Saimiri boliviensis
MSQVTFSDVALDFSHEEWGWLDSAQRDLYKDVMVQNYENLVSLGLSITKPYVITLLEDGKEPWMVEEKLSKGVTPDWESRW

SEQ ID NO: 26011 - protein, 81 aa, Saimiri boliviensis
MLENFALIASLGLISFRSYIVSQLEMGKEPWVPDSVDMTSAMARGAYGRPGSDFCHGTEGKEFPSEHNVSVEGAAQDRSPK

SEQ ID NO: 26012 - protein, 81 aa, Balaenoptera acutorostrata
AQGSVSFEDVTVEFTQDEWQYVGPAQRTLYKDVMLENYSHLISLGYCIIKPQVIFKLEHGEEPWSSEEEFLNQKYPGYCRV

SEQ ID NO: 26013 - protein, 81 aa, Colobus angolensis
RVTFKDVAVVFTKEELALLDKAQINLYQDVMLENFRNFISVGDGIKNNILNLQEKGLSFLLQEVLHCWQIWKQRIRDLTVS

SEQ ID NO: 26014 - protein, 81 aa, Colobus angolensis
KSKEPVTFKDVAVVFSEEELRLLNLAQRKLYRDVMLENFRNVVSVEHQSTPDGLPQLEREEKLWMMKMATQRDNSLGGKNL

SEQ ID NO: 26015 - protein, 81 aa, Colobus angolensis
LYEAVTFKDVAVIFTEEELELLDPAQRKLYRDVMLENFRNLLSVGKIQTEVETVPEAGTHEEFSCKQIWGQIASDLTRSQV

SEQ ID NO: 26016 - protein, 81 aa, Colobus angolensis
FQGSVSFKDVTVGFTQEEWQHLDPSQRALYRDVMLENYSNLVSVGYCVHKPEVIFRLEQGEEPWRLEEEFPSQKFPEVWTA

SEQ ID NO: 26017 - protein, 81 aa, Colobus angolensis
VTFDDVAVEFTPEEWVLLDTTQKYLYRDVMLENYMNLASVDFFFCLTSEWEIQPRTKRSSLQQGFLKNQIFTGIQMQTRSY

SEQ ID NO: 26018 - protein, 81 aa, Colobus angolensis
MFKEAVTFNDVAVAFTEEELGLLGPAQRKLYRDVMVENFRNLLSVGHQPFKQDVSPIERNEQLWIMTTATQRQRNLDTLLV

SEQ ID NO: 26019 - protein, 81 aa, Colobus angolensis
SWGPLSFMDVFVDFTWEEWQLLDSAQKCLYRNVMLENYSNLVSLGYQHTKPDIIFKLEEGEELCVVQAQIPNQSCPILKAG

SEQ ID NO: 26020 - protein, 81 aa, Mustela putorius
QQRPVSFKDVVVGFTQEEWHRLNPGQRALYRDVMLETYSNLVSVGYEGTKPYVILKLEQEEAPWICEAACSGCHCQENICQ

SEQ ID NO: 26021 - protein, 81 aa, Mustela putorius
VQGQVNFEDVAVYFSQEEWGLLDEAQRCLYRDVMLENFALMASLRDESSMSHGVPSLELGSKTWMSDWADVIPARTGEAQG

SEQ ID NO: 26022 - protein, 81 aa, Mustela putorius
SLETVTFKDVAVDLTQEEWQQMKPAQRNLYRDVMLENYSNLVTVGYQVTKPDVIFKLEHEEEPWVVEEEMLGRHCPEVWEV

SEQ ID NO: 26023 - protein, 81 aa, Mustela putorius
LQGLLTFRDVAIEFSEEEWGCLTHTQRQLYRDVMLENYGHLHFLGLLLSKPDLIMFLEQEKQLWDVKRKESRGFSPESQCL

SEQ ID NO: 26024 - protein, 81 aa, Mustela putorius
VMAHMAFRDVAVDFSQEEWMLLSPAQRSLYREVMLENYSNLVSLGIPFSKPKLITQLEQGKETWREERTCPPATCPADPKP

SEQ ID NO: 26025 - protein, 81 aa, Tupaia chinensis
KAGALRFADVAVYFSPEEWGCLRPAQRALYRDVMRETYGHLGALGFPGPKPALISWMEQESEAWSPAAQDPEKGESQGGAP

SEQ ID NO: 26026 - protein, 81 aa, Myotis brandtii
TEVGVTFEDVAVYFSRTEWHLLNEAQRHLYLDVMLENFALISSLGCCCGTQDLEASIEQNVSVRVSQAKNNKVALSSQKSH

SEQ ID NO: 26027 - protein, 81 aa, Camelus ferus
GSVCEVSVSFEDVTVDFSREEWQHLDPAQRRLYWDVTLENYSHLCSVGYQVPKPEVIFKLEQGEGPWTLEEETPHQSCSGA

SEQ ID NO: 26028 - protein, 81 aa, Myotis brandtii
MDFEDVAIAFSQEEWGLLDEAQRLLYCDVMLEVFALVSSAGCWHKTDGEEACSEQSVSVHGESQVRAPKTAPATQRTHLCE

SEQ ID NO: 26029 - protein, 81 aa, Myotis brandtii
MNFEDVAIAFSRKEWEILDESQRRLYCDVMLEVFALVSFVGPWHKMNDVEAYSQHSVSVGESHVRASKTAAATQRTHLCKP

SEQ ID NO: 26030 - protein, 81 aa, Propithecus coquereli
FQAEVTFEDVAVLLSQEEWNRLGPAQRGLYRNVMMETYGNVVSLGLPGSKPEVICQLERGEEPWVLDRKGAKKSQGLGSGH

SEQ ID NO: 26031 - protein, 81 aa, Saimiri boliviensis
SSEPVTFEDVTLGFNPEEWGLLDIKQKSLYREVMLENYRNLVSVEHQLSKPEVVSQLEESEDFWPVERGIPQDTIPGFPEL

SEQ ID NO: 26032 - protein, 81 aa, Vombatus ursinus
MRTNYETLTSLDHAVPKPDLISWIEQGKEPFIKDLVDLKRRETVVTCDDDGECNLESTEGWKFFEVSLPLLRADDFPWIKQ

SEQ ID NO: 26033 - protein, 81 aa, Propithecus coquereli
LQESLTFKDVFVDFTLEEWQQLDCAQKNLYRDVMLENYSHLVSVGYLVAKPDVIFGLGPGEESWMADRGTPVRSCPVWQVD

SEQ ID NO: 26034 - protein, 81 aa, Saimiri boliviensis
GWVPALFDEVAIYFSDEEWEVLTEQQKALYREVMRMNYETVLSLEFPFPKPDMITRLEGEEESQNCDEWQLQGGTSAENEE

SEQ ID NO: 26035 - protein, 81 aa, Saimiri boliviensis
LQESFSFDDLSVDFTQKEWQLLDPSQKNLYKDVMLENYSSLVSLGYEAMKPDVIFKLEQGEEPWIGDEEIPSSCSPGTSIV

SEQ ID NO: 26036 - protein, 81 aa, Saimiri boliviensis
MFKEAVTFKDVAVVFTEEELGLLGPAQRRLYRDVMLENFRNLLSVGHQPFHRDTFHLQREETFWMMETATQREGNSGGKIQ

SEQ ID NO: 26037 - protein, 81 aa, Saimiri boliviensis
QGTVTFEDVAVNFTWEEWNLLSEAQRCLYRDVMLENLATTSSLGCWCGVEDEEAPSKQSIYVQRETQVRTPTAGVFPEKAH

SEQ ID NO: 26038 - protein, 81 aa, Saimiri boliviensis
AAGSVTFKDVTMAFTQKEWEQLDPAQRNLYKDVMLENYSNLASMGCQAPKPDMISKLEKGEAPCLGKGKRPSQGCPSKIAR

SEQ ID NO: 26039 - protein, 81 aa, Vombatus ursinus
MSSMFQESVTFKDVAVDFTQEEWRHLNPSQKELYRDVMLENYRNLVFLDVISQLEQRKTPWMLGREDPRGPYMGECTGARP

SEQ ID NO: 26040 - protein, 81 aa, Saimiri boliviensis
FTQLMDVAIEFSQEEWKCLNSAQRTLYRDVMLENYRNLVSLDLSHNGVIKELAPKQKSNMGEVFHTVALEQHETPDMQEFC

SEQ ID NO: 26041 - protein, 81 aa, Vombatus ursinus
MLENYRNLVCLGLSVSKPAVISQLERGEAPWRPEGGGPGAGSADWGMRHEIKESAPQLILSVEESSGKRLTRNGSYASKLG

SEQ ID NO: 26042 - protein, 81 aa, Cervus elaphus
SWGNVTFEDVFVSFSQEEWGLLDEAQRLLYREVMLENFALMASLGYTSSVSHGVSPQELGREPWVSDQADTTPALTREAQS

SEQ ID NO: 26043 - protein, 81 aa, Cervus elaphus
PFKGEGSDEVLQRLLRSQAAEVIERLVSSVPSQTSVPFKDVSVAFTQEEWQHVNPAQRTLNRAVMLENHSHLVALGEPTLL

SEQ ID NO: 26044 - protein, 81 aa, Cervus elaphus
HICNCNSETEDRRGGNGGTPEEWQYLNRPQRTLYKDVMLETYSNLVSVAGHHVTKPDVILKLEVEMQCLPEGKIPVWSFPD

SEQ ID NO: 26045 - protein, 81 aa, Cervus elaphus
PKVPVTFDDVAVYFSELEWGKLDEWQKELYKHVMRGNYEMLVSLDYAISKPDILTRMERGEEPCPEGPWGREEGNEREEAC

SEQ ID NO: 26046 - protein, 81 aa, Cervus elaphus
MEVSVTFDDVAVTFTQEEWGHLDPAQRTLYREVMLETCGLLMSLGCPVPRPELIYQLEHGQELWTVKRDLSGSTCPGPPVL

SEQ ID NO: 26047 - protein, 81 aa, Colobus angolensis
GLLTFRDVAIEFSQEEWKCLDPAQRTLYRDVMVENYRNLVSLDISSKCKMKEFLSTAQSNREVIHTGTLQRHESHHIGDYC

SEQ ID NO: 26048 - protein, 81 aa, Colobus angolensis
GIVTFEDVAVYFSWKEWGLLDEAQKCLYHDVMLENLTLTTSLGGCGAGYEEAPYQQSTSSQRESQVRLPKALPFPQKTSPC

SEQ ID NO: 26049 - protein, 81 aa, Tupaia chinensis
FISFEDVAMDFTWEEWQGLKDAQKILYKDVMLETYRNLVFLGHCIAKPAVILKLEQEGEPWTLGEQLNQSLAGEKPYECKQ

SEQ ID NO: 26050 - protein, 81 aa, Vicugna pacos
SQGLVTFGDVAVDFSQEEWEWLDCAQRTLYRSVMLENYRSLVSLGLCVSKPEMISSLEQRKEPWTVKRKWTRGQCPDSEAV

SEQ ID NO: 26051 - protein, 81 aa, Vicugna pacos
AHGSVTFRDVAIDFSQEEWEFLDSAQRDLYRDVMWENYSNFISLGPSISKPDEITLLDEGKEPWMVVREGTRRLHRGLESR

SEQ ID NO: 26052 - protein, 81 aa, Vicugna pacos
PQEPVAFEDVAVYFTQNQWDSLAPAQRALYREVMLENYANMASLAFPFPKPVLISQLEREEAPWGPDPWEAEVLRDICPGG

SEQ ID NO: 26053 - protein, 81 aa, Odobenus rosmarus
AGVTFEDIAVYFSWKEWKLLDEAQRRLYHHVMLENFTLISSLGCCCGAEDEAPFAQSTSVGMSQTRTPKAAQSSRKTHPCE

SEQ ID NO: 26054 - protein, 81 aa, Odobenus rosmarus
VQGQVNFEDVAVYFSQEEWGLLDEAQRLLYRDVMLENLALMASLGYESSMSLGVASLELGSKLWRSDWADVTPGRTREAQG

SEQ ID NO: 26055 - protein, 81 aa, Delphinapterus leucas
SQELLTFKDISVDFTQEEWGQLAPAHRNLYREVMLENYGNLVSVAGYQLSKPGVISQLEKGEEPWLMEREISGGPTPDLED

SEQ ID NO: 26056 - protein, 81 aa, Vombatus ursinus
MYDIQGVTVDFTWKEWGQQDPSQKELYREVMLENYGNLACLGLAVSKPDVIGSWNEGKHLGSYAWLPPDNHSATAVLPVTK

SEQ ID NO: 26057 - protein, 81 aa, Propithecus coquereli
CQESVTFEDVAVVFTDEEWRHLVPIQRDLYEEVMLENYKSIVSLDWETKPEIQNASEEEKSEGASRERLGRQGLLCPKFED

SEQ ID NO: 26058 - protein, 81 aa, Propithecus coquereli
IPGGSVSFRDVVIDFSREEWQHLDPSQRNLYRDVMLETYSHLLSVGYQVPKEEVVMLEQGKELWALQGENPHQSCPGQKLW

SEQ ID NO: 26059 - protein, 81 aa, Propithecus coquereli
TKGYVTFEDVAIYFSQEEWGLLDETQRLLYLEVMLKNFALVASLGCDHGTEDEETPSEQNVSVGVSQSKTGLSTQKTQPCE

SEQ ID NO: 26060 - protein, 81 aa, Vombatus ursinus
FQELLTFRDVAVDFTQEEWGHLHPSQKDLYRDVMLENYRNLVYLGLVISKPDMIYHLERGGKPWMPEGDVLRSTCPGSCNW

SEQ ID NO: 26061 - protein, 81 aa, Vombatus ursinus
TQESVTFRDVAVDFTGEEWRRLDPAQRALYRDVMWETYESLVFLGIPVCMLDVIFLLEGRETPWRSEGEVHRGLCPDSLHV

SEQ ID NO: 26062 - protein, 81 aa, Lynx pardinus
LQESLTFRDVFVDFTLEEWRCLDSAQKNLYRDVMLENYSHLVSVGQLVPKPDVVIRLGQGEEARMAEGETPTQNPPEFWQV

SEQ ID NO: 26063 - protein, 81 aa, Vombatus ursinus
VPKVPGTFENDGVYFSEQEWENLDDWQKELYRNVMKSNFETLVSLDCAISNPELLAHQEEESGTEELGDLAGESPGGPHPA

SEQ ID NO: 26064 - protein, 81 aa, Saimiri boliviensis
SRSLENDGVCFTEQEWENLEDWQKELYRNVMESNYETLVSLKVLGQPEGEAELGTEMLGDLEEEGPGGAQPAGGVMIKQEL

SEQ ID NO: 26065 - protein, 81 aa, Vombatus ursinus
FQESVTFEDVAVDFTREEWGHLGPAQKELYWEVMLETCRNLVSLGLAVSKLDAISQLMQEEPPWMPAHSVPRTSCPACDTR

SEQ ID NO: 26066 - protein, 81 aa, Balaenoptera acutorostrata
AQVLVTFKDVAVTFTREEWGQLDLDQRTLYQEVMLEICGLLVSLGHPVPKPELIRLLEHGQELWTGTRGLPRSTCPGDRAK

SEQ ID NO: 26067 - protein, 81 aa, Lynx pardinus
MLENYSHLVSLGYQDTKPDIIFKLEQGEELWMLQAQIPSQGHPEKVLEIDDHMDWHQENQGKLESMAKNYECTAFGKLCLL

SEQ ID NO: 26068 - protein, 81 aa, Vombatus ursinus
MTFRDVAVTFSPEEWGQLGPSQKELYRQVMLENYGNLVCLGLVLSKPDVIEQLERSEAPWSPEAAVPGSSHAGQKPRAEAK

SEQ ID NO: 26069 - protein, 81 aa, Saimiri boliviensis
ELLTFRDVAIEFSPEEWKCVDPGQQNLYRDVMLEDYRSLVSLYVSYYNQGILPEQSKEDSFKTATLGRYGSCGLDTLCLWK

SEQ ID NO: 26070 - protein, 81 aa, Saimiri boliviensis
VMFRDVAIDFSQEEWEYLDTAQRDLYRDVMLENYSNLLSLDLPSRCARKDLSPEKNTYETELSQWEMSDRLEKCDLEESNS

SEQ ID NO: 26071 - protein, 81 aa, Balaenoptera acutorostrata
MDSGGFEDVAVNFTAEEWALLDPAQRKLYRDVMLETFRNLASVGSCPQVKTTRSSAHWDILETGLCSEEKIVRFTRNDSCS

SEQ ID NO: 26072 - protein, 81 aa, Vombatus ursinus
MTLTFQDVAVDFTWEEWGQLDPAQQNLYRDVMLDNYQNLIFLAGFPVSKPDVISQLEQGEVPWALEREVAKSSCPGEKSRN

SEQ ID NO: 26073 - protein, 81 aa, Vombatus ursinus
GQLDPAQRDLYRDVMLENYGNLVSLGFPVSKPYVISQLEQGEEPWVVEREVSRGICLDLGTRTEIKETAKQDVSEEGLSQE

SEQ ID NO: 26074 - protein, 81 aa, Lynx pardinus
GSVSFKDVMVDFSREEWQRLDLAQKSLYRDVMLENYFNLISVGRRGARPGCGSGAQPAAGESGSLPGELRDNGDIGFETLQ

SEQ ID NO: 26075 - protein, 81 aa, Saimiri boliviensis
EEALMAFWDVAVAFTQKEWKLLSSAQRTLYREVMLENYSHLVSLGIAFSKPKLIAQLEQGDEPWREESKHLLDLCPEPRTE

SEQ ID NO: 26076 - protein, 81 aa, Saimiri boliviensis
NDHNQVTFKDVAVVFTEEELGLLDPAQRKLYQDVMLDNFRNLLSVGNQPFHQDTFHFLRKEKFWMMKTTSQREGNLGGKIQ

SEQ ID NO: 26077 - protein, 81 aa, Balaenoptera acutorostrata
PLTFEDVALFFTDEEWQLLDPSQKILYNNVMQENYATVTSLGLKLKNDTGNEQRVSLSTLEIQASGRKVLRKARMKVAQKT

SEQ ID NO: 26078 - protein, 81 aa, Saimiri boliviensis
YQEFVTFEDVAVHLTREEWGYLDPVQRDLYREVMLENYGNVVSLGILLRLPTTRIHSVNSCPALSHTQASAFSGETLAVLT

SEQ ID NO: 26079 - protein, 81 aa, Balaenoptera acutorostrata
DSLAIEDVVVNFTLEEWALLDPSQKKLYRDVMQEIFWNLASVGKTREDHDIGDQYKNQGGNLRQENLKMRDECLSFQDAVV

SEQ ID NO: 26080 - protein, 81 aa, Vombatus ursinus
FQESVTFEDVALDFSWEEWGYLDTSQKEVYWEVMLENYRNLVSLGLADSNVEVISQVESGEAHGIPVDSVLRSCRPDGDGK

SEQ ID NO: 26081 - protein, 81 aa, Saimiri boliviensis
LQISVSFEDVTVDFSKEEWQHLDPAQRRLYWDVTLENYSHLLSVGYQVPKLEATFKLEQGEGPWTLEGEAPHQSCSGEATG

SEQ ID NO: 26082 - protein, 81 aa, Mustela putorius
PKVPVTFDDVAVYFSEQEWGKLDEWQKELYKHVMRGNYETLVSLDYAISKPDILTRMERGEEPCPGGPWGQEEGSRREVAQ

SEQ ID NO: 26083 - protein, 81 aa, Mustela putorius
QAQEFLTFDDVAVDFTWEEWQLLAPAQKDLYRDMMLENYRNLVSVGYHASKPDALSKLERGEFWTREDEMHSQICPEIRNV

SEQ ID NO: 26084 - protein, 81 aa, Mustela putorius
MDAVVFADVAVNFTPEEWALLDHGQRQLYRDVMLETCRNLASLDCCTQVNPFGSGTQLNILENELSSEDKIVTFTRNDSWA

SEQ ID NO: 26085 - protein, 81 aa, Mustela putorius
VRGSMSFEDVIVKFTQDEWQYMSPAQRTLYRDVMLENYSHLISVGCYTIKPEMIFKLEQGEEPWSLEEEFLNQRYPGYFSV

SEQ ID NO: 26086 - protein, 81 aa, Mustela putorius
AQEPLTLEDVAVDFTWEEWQLLAPAQKGLYRDVILENYSNLVSVGYQASKPDALSRLERGEEPWAKQEEVPSGTRQEPSKV

SEQ ID NO: 26087 - protein, 81 aa, Tupaia chinensis
GFVSFEDVAVHFTWEEWQNLEDAQRTLYKDVMLETYSSLVFLGHCIAKPAVIFKLEQGEPWTLELCNQNLPVHLRCTEKSY

SEQ ID NO: 26088 - protein, 81 aa, Vicugna pacos
AQGSVTFEDVSVYFSWEEWALLDEAQKLLYCDVMLENFALMASLGYWHGVEDEDAPSEQSVSVEGVSQVSMTFKYLAMTFT

SEQ ID NO: 26089 - protein, 81 aa, Vicugna pacos
SEGLVTFRDVAVDFSQEEWEWLSPSQRTLYRRVMLENYRSLVSLGVSVSKPDVISLLEQGKEPWKVKKEWTGGTRPDWEYV

SEQ ID NO: 26090 - protein, 81 aa, Vicugna pacos
MAVRRLSPVVQEEWAELSPAQRALHRDVMLETCGNLVSLGLLGPKPDTLSQLGRGEGWTLEDSLGGFCLDWVTMPVSKKST

SEQ ID NO: 26091 - protein, 81 aa, Vicugna pacos
QGSVTFEDVALYFSWEEWDLLDEAQRCLYHDVMLENLALTSSLGCWHGVRDKEAPSEQTVSAEGMSQIRTVKAGSSPQKAQ

SEQ ID NO: 26092 - protein, 81 aa, Saimiri boliviensis
AQEQVTFRDVAIYFSREEWECLEPSQRALYRDVMLDNFSNVAVLGFCSPRPDLVSRLEQWEEPWVEDRERPELQAVPRGPR

SEQ ID NO: 26093 - protein, 81 aa, Cervus elaphus
SQGLVTFEDVAVYFSLEEWERLDEDQRELYKEVMRENYGILVSLGYPVPKPDLIFRLEQGEEPWVPDSPRPEEGDIVTGVY

SEQ ID NO: 26094 - protein, 81 aa, Cervus elaphus
SRLQLNDVTIQFSPEEWECLDPAQRALYVDVMSETFRNLLSVDIYHIHIWKLQLKSHTDRGGVCQTVIWGRNEIPEIKHFN

SEQ ID NO: 26095 - protein, 81 aa, Colobus angolensis
SLTLEDVAVDFTWEEWQLLGPAQKDLYRDVMLENYSNLVAVGYQASKPDALSKLEQGEEPCTTEDEIYTRICCGGQPQTCS

SEQ ID NO: 26096 - protein, 81 aa, Colobus angolensis
WSQNSVTFREVAVDFSQEEWALLDPAQKNLYKDVMLENFRNLASVGYQLCRHSLISKVDQEELKTDERGILQGDCADWEIQ

SEQ ID NO: 26097 - protein, 81 aa, Colobus angolensis
QGRVTFQDVAIEFSLAEWKCLNPAQRALYREVMLENYRNLESVDISSKCMKKEVLSTGQGNTEVFYPGTLQSPESHHIGDF

SEQ ID NO: 26098 - protein, 81 aa, Colobus angolensis
MEPLTFKDVAIEFSLEEWQCLDTAQRDLYRNVLLENYRNLVFLVMSFHFAQDLWPEQNIKDSFQKVTLRRYGRCEYENLQL

SEQ ID NO: 26099 - protein, 81 aa, Mustela putorius
PCRLVLFKDVAVDFSQEEWECLDLEQKDLYRDVMLENYSNLVSLGFSISKADVLSLLKQGKEPWKVVQDVSRNQSSDWESR

SEQ ID NO: 26100 - protein, 81 aa, Mustela putorius
LVRALRVHAVVSLAARYASAGLHSCQRGEHRGRDYGCRGFFQLDLWLAVSKPDMISHLEAGKGPWVVVREIARTPYPELET

SEQ ID NO: 26101 - protein, 81 aa, Mustela putorius
MAVTLEDVTVIFTWEEWKFLDSSQKKLYREVMWENYTNVMSVGNWKESYKPQEERFRYLKHENLPCWQGWRNASTQIYENR

SEQ ID NO: 26102 - protein, 81 aa, Tupaia chinensis
LQESVTFQDVAVDFTSEEWKLLDCDQRTLYWDVMMENYRNLNSVGCPVTKTKLTFKVRQGQESLMVEGENPHWSDPDRNRD

SEQ ID NO: 26103 - protein, 81 aa, Tupaia chinensis
LQKSLTLEDVAVEFTWEEWQLLGPAQKDLYWDVMLENYSHLVSLGYQASKPQALTNLEEWEEPSTIEDKIHNRTCPGIRKI

SEQ ID NO: 26104 - protein, 81 aa, Odobenus rosmarus
MLENYKSIVSLGLPVPRPDVIFQLKRGDEPWIVDLHGSEERECPENVSLVVPTPGKKLQLYFLSIPDWETKPEIHGASEEE

SEQ ID NO: 26105 - protein, 81 aa, Odobenus rosmarus
PQVLVSFEDVAVFLSQEEWGCLGPAQRGLYSNVMLETYRNLISLGLQDSKPDVISRLEKGEEPWAPYSPRIEEGWIRSHRS

SEQ ID NO: 26106 - protein, 81 aa, Odobenus rosmarus
PCRLVLFKDVAVDFSQEEWECLDLEQKDLYRDVMLENYSNLVSLGFSISRADVLSLLKQGKEPWKVVQDVTRSQSSDWESR

SEQ ID NO: 26107 - protein, 81 aa, Odobenus rosmarus
TKESVTFRDVAVFFSQDEWLRLDSAQRTLYREVMLENYGTLVSLGIPFSRPKVICQLQEGEDPCVVDGELPWDACLGLKTR

SEQ ID NO: 26108 - protein, 81 aa, Odobenus rosmarus
PWEPVTFADVAVLFTPEEWMFLDSAQRSLYRDVMLENYRNLASVAGGQLGKPSTFSHLEPGEELWPPERRSFPGTHPEPQH

SEQ ID NO: 26109 - protein, 81 aa, Odobenus rosmarus
LQDTFSFEDLSVDFTQKEWQLLDPSQKDLYKDVMLENYSSLVSLGYEVMKPDVIFKLEQGEEPWIGDGEVPSSDCPEQVLQ

SEQ ID NO: 26110 - protein, 81 aa, Odobenus rosmarus
SKVPVTFGDLAIYFSQEEWEWLSPIQKDLYEDVMLENYQNLVSLGLSFRRPNVITLLEKGKAPWIVEPVRKRRGVDSGSKS

SEQ ID NO: 26111 - protein, 81 aa, Delphinapterus leucas
LIREVSSLANIKAMPQEEWQQLDPAQKALYRDVMLENYFHLISVGFHMTKPDMIHKLEQGKELWTTEKIFPSQSYLEEDWK

SEQ ID NO: 26112 - protein, 81 aa, Oryctolagus cuniculus
MTAFEDLAVYFTWEEWQKMNNAQKILYRDVMLETYSSLFSLGHCITKPDLIFKLEQGAEPWMVDECLNESLPVGMKRDDLI

SEQ ID NO: 26113 - protein, 81 aa, Rhinopithecus bieti
EKETLTFRDVAIEFSLEEWECLNPAQQNLYMNVMLENYKNLVFLGIAVSKQDPVTCLEQEKEPWNMKRHEMVDEPGYMCRM

SEQ ID NO: 26114 - protein, 81 aa, Ursus americanus
QAEVTFEDVAVLFSREEWGRLGPAQRGLYRDVMLETYRNLVSLGAGPAAPKPGVITQLERGDEPWVLDAQGAKGKERLRVS

SEQ ID NO: 26115 - protein, 81 aa, Ursus americanus
WDVAVVFTEEELGLLDPAQRKLYRDVMLENFRNLLSVGEGNVWVMDTYLDWQLKCLSYRELSYWKIWEHVAGELTENQDHR

SEQ ID NO: 26116 - protein, 81 aa, Ursus americanus
IIEPVTFKDVAVVFSEEELGLLDSTQRKLYRDVMLENFGNLVSVGNQPFKPELIFQLEREEKLLMMEAETQGEGYLGKNRP

SEQ ID NO: 26117 - protein, 81 aa, Ursus americanus
LQESLTFGDVFVDFTLEEWQQLDSTAQKNLYRDVTLENYSHLVSVGYLVPKPDEVLRLGRGEEARRAEGEPPTRSYPGEHA

SEQ ID NO: 26118 - protein, 81 aa, Camelus ferus
PKVPVTFDDISIYFSTPEWEKLEEWQKELYKNIMKGNYESLISMDYAMNQPDVLSQIQPEGDHNTGDQTGPEESEIPTDPS

SEQ ID NO: 26119 - protein, 81 aa, Myotis brandtii
VGVTFEDIALYFSREEWSLLDEGQRQLYLNVMLENFELISSLAFIINREVTLKKSLINAVNVENLLSLRRSFIDIREFTLE

SEQ ID NO: 26120 - protein, 81 aa, Propithecus coquereli
SCEPVTFEDVTLGFTREEWGLLDLKQKSLYREVMLENYRNLVSVEHQLSKPDVVSQLEEAEEFWLVERGIPQDTFPEYPGP

SEQ ID NO: 26121 - protein, 81 aa, Propithecus coquereli
NRCLVTFSDVAIDFSHEEWRWLDSAQRDLYKDVMVQNYENLVSLAGLSITKPYVITLLEDGKEPWIVDKKLSKGMFPDWES

SEQ ID NO: 26122 - protein, 81 aa, Propithecus coquereli
QVPITFKDLAVRFSEEEWRLLEEGQREFYRDVMRENYETLVSVGTAELLPLSAFLSPTEPGGATGRGGCTAERPEPAGGGV

SEQ ID NO: 26123 - protein, 81 aa, Propithecus coquereli
FQGSLSFKDVTVGFTQEEWEHLDPSQRSLYRDVMLENYSNLVSVGYCVTKPEVIFRLEQGEEPWILKEEFSSQSYPDIWKA

SEQ ID NO: 26124 - protein, 81 aa, Propithecus coquereli
WSQMPVTFEDVALYLSREEWGRLDHAQQNFYRDVLQKRNGLSLGFPFSRPCWVPQVQGKGEASSSSQQRDEPEERGVSTGA

SEQ ID NO: 26125 - protein, 81 aa, Propithecus coquereli
ARGQGPLTFGDVAVALTQIEWRHLDAAQRALHRDARLENWESGLLSSKPKLIAQLEQGAQPWMEEYWFETKMSALKQNTSE

SEQ ID NO: 26126 - protein, 81 aa, Balaenoptera acutorostrata
SQGPVSFEDVAIDFTQEEWQQLDPAQRTLYRDVMLENYSHLVSVGYPVSKPGVISKLEQGEEPWIMKRDVSNWIYPDRETR

SEQ ID NO: 26127 - protein, 81 aa, Vombatus ursinus
MLTDTDISFPPIGLPISKPDVIFQLEQGKEPWLLGLPRAKERELPNNSSLDWKSCDTRKSSPKQKIPEEVESLGTLTVDSA

SEQ ID NO: 26128 - protein, 81 aa, Lynx pardinus
MPGLPVPRPEVIFQLKTGDEPWIVDLHGSEERECPENVSLDWETKPEPQGASEEERPGRIVRERLGRKVPLCPKFEARALE

SEQ ID NO: 26129 - protein, 81 aa, Vombatus ursinus
TQESVMFEDVAVDFTREEWSHLDPAQRALYREVMLENYENLVSLGLPVSKLDVISLLERGEAPWRPEGGGPRCSCPDPFIE

SEQ ID NO: 26130 - protein, 81 aa, Saimiri boliviensis
TESFMAFGDVTVDFTQKEWRLLSPTQRALYKEVTLENYSHLISLGILHSKPELIRRLEQGEAPWGEERRCQPGPHAGIYAE

SEQ ID NO: 26131 - protein, 81 aa, Vombatus ursinus
FQESVTFQDVAVDFTWEEWGHLGPAQKELYREVMLENYRNLVCLGLEVSKPDVVCQLERGEAPWMPEGAVPRSCSQNWGAR

SEQ ID NO: 26132 - protein, 81 aa, Vombatus ursinus
WIESVTFKDVAVEFSQEEWVQLNPSQKTLYKDNSYPFGVLIYTAFSSKKHLAVQQRIRTGEFVYECKECGKVFHWNSANLT

SEQ ID NO: 26133 - protein, 81 aa, Saimiri boliviensis
VQESVTFRDVAVFFSPDEWLHLDSAQRALYREVMLENYRSLVSLGILFSKPKVISHLEQGEDPWMVESGVPQGTHLGWERM

SEQ ID NO: 26134 - protein, 81 aa, Balaenoptera acutorostrata
AHDLVMFRDVTVDFSQEEWECLNSNQRNLYRDVILENYSNLVSLGCSISKPDVITLLEQGKEPWMVVRDEKRRWSLDLESR

SEQ ID NO: 26135 - protein, 81 aa, Lynx pardinus
MYFSWEEWEILDEAQRHLYCDVMLENLALVASLAEHGLLVWNEKAPLEQCVSGVFQFRTPKAGPSTQKDMCGLPPTCDMCG

SEQ ID NO: 26136 - protein, 81 aa, Vombatus ursinus
QVSVTFRDVAVDFTREEWRCLEPAHRALYRDVMLETYENLVSLGVSVPVSKLDLIFLLERGRSLSRPVGRVPSDSCPDSFI

SEQ ID NO: 26137 - protein, 81 aa, Vombatus ursinus
SQGLVTFEDVAVYFSLEEWGRLNEAQKDLYKEVMQENYGILVSLGYPIPKPDVISRMERGEELWVPDSPVLEEGDIVTGVY

SEQ ID NO: 26138 - protein, 81 aa, Tupaia chinensis
SVTFEDVAVVFTDEEWNHLVPIQKDLYREVMLETYSSIASLEWEIKSEIQDTFEEEKPEELWREIFIKQSPLGDSFQGHDP

SEQ ID NO: 26139 - protein, 81 aa, Vombatus ursinus
MLENSQNLLSLGIPLLREDLISHFEEREPSWIRDQKGPRNSCPGAETEFEITKSTAKLRISVEESQQQRFMRDGPCDFNLR

SEQ ID NO: 26140 - protein, 81 aa, Colobus angolensis
QLTFRDVAIEFSQEEWKCLNSTQRTLYRDVMLENYRNLVSLDLSRNCMIKELAPQWESNREEVFHAVTLEQHEKHDIEEFC

SEQ ID NO: 26141 - protein, 81 aa, Colobus angolensis
KKKPVTFEDVAVNFTQEEWDCLDASQRVLYQDVLSEIFKNLASVARIFLHKPELITKLEQEEEQRREFVHRPNTEGLSEGE

SEQ ID NO: 26142 - protein, 81 aa, Colobus angolensis
MIQSQVSFEDVAVDFTLEEWRLLNPTQKDLYRDVMLENYSNLIFLGYQILKPDAIFKLEQQDPWIIGQEILNQNFSEVWLD

SEQ ID NO: 26143 - protein, 81 aa, Colobus angolensis
TQVRLTFRDVAIEFSQEEWKCLDPAQRTLYRDVMLENYWNLVSLGLCHFDMNIISMLEEGKEPWTVKSCVKIARKPRMREC

SEQ ID NO: 26144 - protein, 81 aa, Colobus angolensis
PQGLLTFRDVAIEFSQEEWKCLDSAQRTLYREVMVENYRNLVSLDISSKCMTEFLSTAQSNREVIHTETLERHESHHIGDF

SEQ ID NO: 26145 - protein, 81 aa, Colobus angolensis
FVAFEDVAIYFSQEEWELLDETQRLLYHDVMLENFAVMASLGCWCGAEDEGVPSAESISVAELSQGRTPKADTSTDKSHPC

SEQ ID NO: 26146 - protein, 81 aa, Colobus angolensis
MGPLTFRDVAIEFSLKEWQCLDTAQRNLYRNVMLENYRNLVFLVMCSYFAQDLWPEQNIKDSFQKATLKRYGTCRHENLPL

SEQ ID NO: 26147 - protein, 81 aa, Colobus angolensis
AQGSVSFNDVTVDFTQEEWQHLDHAQKTLYMDVMLENYCHLISVGCHMTKPDVILKLERGEEPWTSFTGHTCLEENWKAED

SEQ ID NO: 26148 - protein, 81 aa, Colobus angolensis
FQKPVTFEDVAVNFTQEEWDCLDASQRVLYQDVLSEIFKNLASVARIFLHKPELITKLEQEEEQRRETQVLQASQAGPPFF

SEQ ID NO: 26149 - protein, 81 aa, Mustela putorius
SQESVTFDDVAVDFTQEEWTLLDRSQRKLFRDVMLENISHLVSIGRQLYKSETISHLEPGEHLSKGLGLLQCQSLDREDDL

SEQ ID NO: 26150 - protein, 81 aa, Mustela putorius
CEVSVSFEDVTVDFSKEEWQHLDPAQRRLYRDVTLENYSHLRSVGCQVPKPEVIFKLEQGEGPWTMEGETPHQSWSDEDIG

SEQ ID NO: 26151 - protein, 81 aa, Mustela putorius
MLENYRNLVSVGFHSGKPDALSKLDPGDPTWTGEDDIPCRTLSGIWKLDDYLPEHLQTEIMENSIERWHKQRTFESNVRQR

SEQ ID NO: 26152 - protein, 81 aa, Tupaia chinensis
VTGSVTFWDVAVLFSQDEWLHLDAAQRTLYREVMLENYSNLVSLGIPSSKPKVICQLQQGEDPCVVERDVPPDTCPGLKTR

SEQ ID NO: 26153 - protein, 81 aa, Vicugna pacos
RPESVTFEDVAIYFSENEWTGLAPAQRALYRDVMLENYGALASLAFPFPKPALIFQLEQGEAPWSSAPQGALDGEGPRGIS

SEQ ID NO: 26154 - protein, 81 aa, Vicugna pacos
GPQGLMTFEDVAVNFTQEEWQYLNPPQKTLYRDVMLETYSHLVSVGQQITKPDLILKLEVEEPCLTEGKIPVWSFPEEAFQ

SEQ ID NO: 26155 - protein, 81 aa, Vicugna pacos
QQDSVTFEDVAVYFSREEWCLLDEVQICLYLDVMLENFALVSMLGSCHGVEDEQPPCEQSSPVGVSQIRTSGAGVSPEKGQ

SEQ ID NO: 26156 - protein, 81 aa, Vicugna pacos
QDSVTFEDVAVYFSWEEWCLLDEVQIRLYLDVMLENFALVSMLGSWHGVEDEEVPSKRRVSVEGVSQIRTSRAGVSPEKAQ

SEQ ID NO: 26157 - protein, 81 aa, Vicugna pacos
NFWILRLPPGSKGEAPKEWGKLDEWQKELYKHVMRGNYETLVSLDYAISKPEVLSQIEQGKEPCSWRRPGPKVPDVPVDPS

SEQ ID NO: 26158 - protein, 81 aa, Vicugna pacos
WLTFKDVAIEFSPEEWECLDPAQRTLYRDVMLETYRNLISVDTAPKCVIKEPPPKESHNTGKTLHTASLESQEHRALQEDG

SEQ ID NO: 26159 - protein, 81 aa, Vicugna pacos
MFQVTFSDVAIDFSHEEWGWLDSAQRDLYKDVMVQNYENLVSLAGLSIPKPNVIALLEEGKDPWMVERKLSTDWDSRWENK

SEQ ID NO: 26160 - protein, 81 aa, Vicugna pacos
LIPVDFTPAQLTFRDAATDFSQEEWECLDPAQRAFYVDVLLELVSLGSQMVSMLLLRGHTWSSKGLNWRMRFFTGLLRGKD

SEQ ID NO: 26161 - protein, 81 aa, Vicugna pacos
MTSSLETVTFKDVAVDLTQEEWQQMKPAQRDLYRDVMLENYSNLVTVGYQVTKPDVIFKLEQEEEPWVVEEEIFGRHYPGK

SEQ ID NO: 26162 - protein, 81 aa, Vicugna pacos
QESVTFRDVAVDFTLEEWGQLGPGQRELYRDVMLENYQNLLSLGAGLPGSKPDVISRLERGEEPRMEAREDWRVTCSDVET

SEQ ID NO: 26163 - protein, 81 aa, Vicugna pacos
SLGPVSFKDVAVDFTQEEWQQLDPEQKTTYRDVMLENYSHLVSVGCHVMKPEVITKLEQGEEPWMVEGGFLLQSYPEVWKV

SEQ ID NO: 26164 - protein, 81 aa, Delphinapterus leucas
MDSVTIEDVAVDFTLEEWALLGPSQRKLYRDVMQETLRNLAAVGAKREYHDIEDQYKNQGRKLRTFMVERLCKSKDISLCG

SEQ ID NO: 26165 - protein, 81 aa, Carlito syrichta
VTEPVTFRDVAVLFSQDEWLRLDSAQRILYREVMLETYSSLAALGIPFSMPKAIRQLKQGEDPCTLGRDVPSDPCLGFKIW

SEQ ID NO: 26166 - protein, 81 aa, Mustela putorius
QGLLTLRDVTIEFSEEEWGCLTHTQRQLYRDEMLENYGHLHFLETGLTVSKPNLIMFLEQDKELRDVKRKDTVALHAAVSS

SEQ ID NO: 26167 - protein, 81 aa, Tupaia chinensis
RDQDFGASLLPSAPQQEQWRHLDSTQKEQYWDLMLETYGKMVSGGISNSKPNLTNSTEYGEELAGLHLHISEKIPRLTCIG

SEQ ID NO: 26168 - protein, 81 aa, Tupaia chinensis
QQEEVTFKDVAVYFTWTEWADLSPAQRALYRNVMLENFGNLTSLGYPIPKPALISLLEKGDLSLGLEAQGDPPEKRTKDSS

SEQ ID NO: 26169 - protein, 81 aa, Odobenus rosmarus
CRKGCVTFEDVAIYFSQEWVLLDEAQRHLYHDVMLENFALIASLVCWHGMEDEEAPFEQSVSGEVLSWVRTPKAGPPTQKT

SEQ ID NO: 26170 - protein, 81 aa, Odobenus rosmarus
AVTFKDVAVVFTMEELGLLDSTQRKLYQDVMVENFKNLVSVGSKNQNEMETLRKVALKYLSHEGLSCWQIWKQVASDLTRC

SEQ ID NO: 26171 - protein, 81 aa, Odobenus rosmarus
VLGRVTFRDVAVDFSEEEWECLDPAQRALYRDVMLENYRNLVSLGIPLPDLNINVILEQGKEPQTGEQEKSLVKNLLKIKN

SEQ ID NO: 26172 - protein, 81 aa, Carlito syrichta
LQVSVSFEDVTVDFSREKWQHLDRAQRHLYWDVTLENYSHLLSVEYQIPKPEATFKLEQGEGTWMLEGEAPHQSCSASRTV

SEQ ID NO: 26173 - protein, 81 aa, Ornithorhynchus anatinus
VEVTFKDVAIFLTQQEWESLADAQRELYTTVMLENYGHLQSLGKDTESLIRGFPNLRLTTDGFSPKKPGKVSPNVSDLDTN

SEQ ID NO: 26174 - protein, 81 aa, Tupaia chinensis
QPGAVRFADVAVYFSPEEWGCLRPVQRALYRDVMRETYSHLVALGVGGTKPKLISWVEEEAELWGPEAQDLEGAKCLTEAN

SEQ ID NO: 26175 - protein, 81 aa, Vicugna pacos
MASRSPPPEPKEEWDYLEPAQRSLYKDVMMENYGNLVSLDVLNRDKEEEPTVKQEIEEIEEEVEPQGVIVTRIKSEIDQDP

SEQ ID NO: 26176 - protein, 81 aa, Odobenus rosmarus
MASGPELPKPEVISQLEQGAELWAAERGIAQGYCPGREPGPQSQVPPKELGLPEVETSCVTEREGFLRDASCPTILGEDWE

SEQ ID NO: 26177 - protein, 81 aa, Odobenus rosmarus
SVTFRDVTVDFTQEEWQQLEPAQKDLYRDVMLENYRNLVSLDLETRPEMKESGPKEDSAEDRPSVGVVVEGPPRNGAHGLA

SEQ ID NO: 26178 - protein, 81 aa, Odobenus rosmarus
AQESLTLEDVAVDFTWEEWQLLGPAQKDLYRDVMLENYSNLVSVGCQATKPDALSKLEHRDEPWITEDEIQNRTHLEFRKL

SEQ ID NO: 26179 - protein, 81 aa, Odobenus rosmarus
LLTFRDVAIEFSPEEWECLDPAQRALYKDVMLENYRNLVSLDISVRSMIKELSPKEDISKEELFQTLMLERHKRNDIKDLG

SEQ ID NO: 26180 - protein, 81 aa, Delphinapterus leucas
DGVAFEDIALYFSWEEWKLLDEAQRRLYHDVMLENFALISSLGCCCGAEDAEAPFQRSISISMSQARTHREGSFSQKSHPC

SEQ ID NO: 26181 - protein, 81 aa, Carlito syrichta
YYQDSVTFDDVAVDFTQEEWTLLDTSQRHLYSDVMMENYKNLATVGCQIIKPSLISWLEQEESRTVQGGVLQGRKSEWRGT

SEQ ID NO: 26182 - protein, 81 aa, Carlito syrichta
VQEPVTFKDVAVDFTQEEWGQLDLVQRTLYRDVMLETYGHLLSVGNQITKPEVISLLEQGEEPWSMEQAYPQSTCPEWMRS

SEQ ID NO: 26183 - protein, 81 aa, Carlito syrichta
KVPVTFVDIAVYFSEDEWKNLDEWQKELYNNLVKENYKTLMSLDAEGPVPKPDAPAQVEPREEPCVWEQRHTEEREIPVAP

SEQ ID NO: 26184 - protein, 81 aa, Carlito syrichta
FEGSVSFRDVAIDFSREEWQHLDPSQRNLYQDVMLETYNHLLSVAGYQVPEPEVFMLEQGKEPWTLQRESPHQSCPGEKLW

SEQ ID NO: 26185 - protein, 81 aa, Carlito syrichta
MLENYGNVASLGFPLLKPAVILQLEGGGELGGPSPLAVGTRTDSQDLWNVDIDIQTDNNLTKEMCEEKGNTLFELQKNFSQ

SEQ ID NO: 26186 - protein, 81 aa, Gulo gulo
QGQVTFEDVAVYFSQEWRLLDVTWRHLYHDVMLENFELIGSLGESLHPPTVYWLPSAVSHGKFCLSQSWTTRAASFPGFPM

SEQ ID NO: 26187 - protein, 81 aa, Gulo gulo
PKVPVSFEDVSVCFTKTEWKLLDVQQRILYKTVMLENYHHLVSLGFLSTKPHLVSWLEQGEGPWATDIWRSTSTGDADRRR

SEQ ID NO: 26188 - protein, 81 aa, Erinaceus europaeus
MAFTEKEWKQLDPSQKNLYKDVMRENYNNLASMAGNQLTKSDVISQLEKGEEPHLGMWKRPSKGQGGPCEIGRPKQIDSSK

SEQ ID NO: 26189 - protein, 81 aa, Erinaceus europaeus
MAVFQVSLDVAIEFSAEEWECLSQAQRDLYRDVMLENYGHLVFLDLTLSKSDLVTFLELQVNPWAENRKEKLPIAEDISSY

SEQ ID NO: 26190 - protein, 81 aa, Gulo gulo
DQESVTFKDVAIDLTQEEWTLMDRSQRKLYIDVMLENITHLVSVGCQFFQADVISQWEQGGELWREDRGLAQSWNPGLENS

SEQ ID NO: 26191 - protein, 81 aa, Erinaceus europaeus
PVTFEDVKVNFSQEEWGCLDINQRTLYKDVMSETLKNLLSVGKRLHFPQQAPCPRLLVTSVNPGQVDYLNKKENSGVKISV

SEQ ID NO: 26192 - protein, 81 aa, Cervus elaphus
KRDQELKPRRDMLADANLPQRPQFLGSEEQDGSCEGLVSFEDVTMDFSKEEWQQLDPAQRHLYQDVMLEIYSHFFSVGEHT

SEQ ID NO: 26193 - protein, 81 aa, Colobus angolensis
ACESITFGDVAIDFSHQEWEYLNLVQKTLYQEVMMENYDNLVSLAGHSISKPDLITLLEQGKEPWMIMREETGGECTDLDS

SEQ ID NO: 26194 - protein, 81 aa, Colobus angolensis
VQESVTFRDVAVFFSHDEWLHLDSAQRALYREVMLENYSSLVSLGILFSKPKVISQLEQGEDPWMVDSGVPQGAHLGWESL

SEQ ID NO: 26195 - protein, 81 aa, Colobus angolensis
CWGLLSFKDISMEFTWDEWQLLDSTQKYLYRDVILENYHNLISVGYHGTKPDLIFKLEQGEDPWIINAKISRQSRPDGWEE

SEQ ID NO: 26196 - protein, 81 aa, Colobus angolensis
PQASVCFEDVAMAFTKEEWEQLDLAQRTLYREVTLETWEHIVSLGLFLSKSDVISQLEQEEDLHRAEQVSPRDTSGLSQVT

SEQ ID NO: 26197 - protein, 81 aa, Colobus angolensis
GLLTFRDVVIEFSLEEWQCLDTAQRNLYKNVILENYRNLVFLGIAVSKPDLITCLEQEKEPLTMQRHEMVDEPPGNFAPVA

SEQ ID NO: 26198 - protein, 81 aa, Colobus angolensis
GSVTFEDVAIYFSQEEWGLLDEAQRLLYRDVMLENFALITALVCCHGMEDEETPEQSVSVERVAQVRTPEASPSTQKTQSC

SEQ ID NO: 26199 - protein, 81 aa, Colobus angolensis
YPDSVTFDDVAVDFTPEEWALLDTTEKYLYRDVMLENYMNLASVEWEIQPRIKRSSLQQGFLKNPVFSGIQMTRGYSGWKL

SEQ ID NO: 26200 - protein, 81 aa, Mustela putorius
FQEAVTFNDVAVVFSEEELGLLDSTQRKLYRDVMLENFRNLVSLGHSSSKPDMISQLEREEEKLCMKEIRTERGGRNPNEA

SEQ ID NO: 26201 - protein, 81 aa, Mustela putorius
ALALVSFQDVAVTFTGEEWRHLDLAQRTLYREVMLETCGLLVSLGHPVPKAELISLVEQGQELWTVTRGLSKSTYTGEKAK

SEQ ID NO: 26202 - protein, 81 aa, Mustela putorius
GNYETLVSLDYAISKPDILTRMERGEEPCPGGPWGQEEGSRREVAQPRRPSPGVPPRPEHNLGPVSPAREEPKEEQVTRRQ

SEQ ID NO: 26203 - protein, 81 aa, Tupaia chinensis
MLETYSNLVSLGHCITKPELILKMEQGAEPWMVEEPPNQSLPDVQKVDDLNETSEKSQDKTLWQLVITNNNISTKERIELE

SEQ ID NO: 26204 - protein, 81 aa, Vicugna pacos
PESVTFEDVAIYFSENEWTGLAPAQRALYRDVMLENYGALASLEGVLKSKKKDFILKNIFEEAQDHMVLSSGPQWYDSQEF

SEQ ID NO: 26205 - protein, 81 aa, Delphinapterus leucas
VQESVTFKDVAVLFTQDEWVQLSPAQRALYRDVMLENYSNLVSLGLLGPKPDMFSQLGKGEEWMPEDSLGGFCLDWMTTPV

SEQ ID NO: 26206 - protein, 81 aa, Delphinapterus leucas
RLTFEDVAIEFTQEEWECLDPAQRALYRDVMVETYRNLISLDISPIHVIEQLQPKVNSDKGEVFQTPMLGRPESCKIKHFH

SEQ ID NO: 26207 - protein, 81 aa, Erinaceus europaeus
SLESVTFMDVVVDFSQGEWERLTLAQRTLYKKVMLENYRNLVSLGLCASKPNVISLLEQGKEPCLVKGEMTKGQCSNLEYV

SEQ ID NO: 26208 - protein, 81 aa, Erinaceus europaeus
SQTPVTFEDMAMYLTREEWRPLDPTQRDLYRDVMQENYGNVVSLDFEIRSENDVNPKQEISEDVEFGTTSERPVENTEENP

SEQ ID NO: 26209 - protein, 81 aa, Vicugna pacos
MESVTLEDVAVGLMQEWALLDDARRKLCRYVLLDNCRTLAPRGTSPCKPSLVSQGALREELRAVERGILCSTGEDWESQLK

SEQ ID NO: 26210 - protein, 81 aa, Vicugna pacos
GQESVSFKDVTVTFTRDEWLQLTGTQRTLYRDVMLENYSHLVSVGCCITKPEVIFKLEQGEEPWPREGELPGWRDPDRSQE

SEQ ID NO: 26211 - protein, 81 aa, Odobenus rosmarus
QSRGPLSFVDVFVDFTWEEWRLLDPTQKHLYRSVMLENYSNLVSLGYQDSKPDIVFKLEQEELWMMQAQIPSQGHPEKVWE

SEQ ID NO: 26212 - protein, 81 aa, Delphinapterus leucas
ASVTLEDVAVYFSWEEWSLLDKAQRHLYHDVMLEIFTLISSLGCLCGIEDDKTPSGQSVSQERMPQIRTLKPDLSTQKAHL

SEQ ID NO: 26213 - protein, 81 aa, Delphinapterus leucas
KVPVTFVDIAVYFSEDEWKNLDEWQKELYNNLVKENYKTLMSLDSEGPVSKPDAPPQAEPREEPCVWEQRDPEEREVLMDP

SEQ ID NO: 26214 - protein, 81 aa, Carlito syrichta
MPGPKEEWDYLDPAQRSLYKDVMMENYGNLVSLDVLNRDKDDEPTVKQEIEEIEEEVEPQGVIVTRIKSEIDQDPMGRETF

SEQ ID NO: 26215 - protein, 81 aa, Gulo gulo
SQDLVTFKDVAIDFSQEEWEWLNPAQRNLYKNMMLENYQNLVSLGLCISKPYVISLLEQGKGPWEMKTEMTRSPFPDSGSV

SEQ ID NO: 26216 - protein, 81 aa, Erinaceus europaeus
QKTFDDVAVTLPQEEWEQLRPAQRALYHEVMLASPPLLGRACQKIGSRQGTPEDFCVSHIKNQDGPSEIREHLRPEGDPQK

SEQ ID NO: 26217 - protein, 81 aa, Mustela putorius
SQGQLTFRDVVIELSQEEWGCLTHTQRQLYRDVMLENYGHLCFLGLTVSKPDLITFLEQEKQLWDMKRKETGGFHPAVSSH

SEQ ID NO: 26218 - protein, 81 aa, Tupaia chinensis
VQEPVTFKDVAVDFSQEEWGQLDLVQRTLYRDVMLETYGHLLSVGNQIAKPEVISLLEQGEEPWLVEQAYPQSTGPAKIIT

SEQ ID NO: 26219 - protein, 81 aa, Odobenus rosmarus
QESVTFQDVAVDFTEKEWPLLDSSQRKLYKDVMLENYSNLASVDWETPSKSKWSILMEGIFGKETSSGVTVERTRLGEKST

SEQ ID NO: 26220 - protein, 81 aa, Odobenus rosmarus
GTFEDVAVYFSREEWELLDETQRHLYHNVMLENLALVASLDILHLAMHQGIYPRQKPYKCATCGRGFWLSTNSHQRQKEHS

SEQ ID NO: 26221 - protein, 81 aa, Odobenus rosmarus
DSESVTFKDVIVDFTQEEWKQLDPVQRDLFRDVTLENYTHLVSIGLQVSKPDVISQLEQGTEPWIVEPGIPIGTLGEAESV

SEQ ID NO: 26222 - protein, 81 aa, Delphinapterus leucas
MLENYRNLVALGHQLYKPEVITQLEQEEQWMMERDSPPDSHPDGENSPEIKKSNQNISDENKTCDMLMERLTGDSFWYSIL

SEQ ID NO: 26223 - protein, 81 aa, Carlito syrichta
AQGSLTFDDVLLDFTWEEWQLLGPDQKDLYRDVMLENYSNLVSLGYEASKPNILSKLEQGEEQWTTEDEVCSRVCSEVGKT

SEQ ID NO: 26224 - protein, 81 aa, Gulo gulo
GQGSVSFRDVTVDFTRDEWLQLTGTQRTLYRDVMLENYSHLVSVGCHLTKPEVIFRLEQGEEPWPSDAEFPDQGDPDPPQS

SEQ ID NO: 26225 - protein, 81 aa, Erinaceus europaeus
KFQAVTFRDVAVVFTEEEQGLLDPTQRQLYRDVMLENFRNLLSVGAQHFKPELIFQLESEEKFWMETEAQRHGCPGPKNQH

SEQ ID NO: 26226 - protein, 81 aa, Erinaceus europaeus
KVPVTFVDIAVYFSEDEWKNLDEWQKELYNNLVKENYKTLVSLDTEAPVPKSDALTQVEPREEPCAWEPREPEEREILMDP

SEQ ID NO: 26227 - protein, 81 aa, Erinaceus europaeus
TGDWEMAAALLAAGSQEEWRSLDPSQTDFYGEYVMQENCGIVVSLRFPIPKLDMLSQLEGGEEQWVPDTQDMEERDILKVT

SEQ ID NO: 26228 - protein, 81 aa, Ornithorhynchus anatinus
MLENYGNLASLAGCPVPKPEVISQLEEGKDLWGLVLQEPDNRETLRDPYTDCRTGTETESIITKQDIYEEGDFRRPLLVRR

SEQ ID NO: 26229 - protein, 81 aa, Mustela putorius
ILQKMNKSQESVSFTDVTVDFTQEEWEQLDPSQRILYMDVMLENYSNLLSVEVWKADDQMERDRSGPDEQARPFIIFKNQT

SEQ ID NO: 26230 - protein, 81 aa, Vicugna pacos
ARMPVTYEDVAVTFTREEWGHLDPAQKTLYQEVMLETCGLLASLGCSLPKPELVYSLEHSPGSRTSKTGLSPGSCAGDGAE

SEQ ID NO: 26231 - protein, 81 aa, Vicugna pacos
AQETLSFKDVAVDFTWEEWQLLAPAQKALYRDVMLENYSHLLSVGCQVRRPDALAELERGEDPWAREEGTGSGPCPGEGGP

SEQ ID NO: 26232 - protein, 81 aa, Vicugna pacos
MLENFGHLVSLAGLNISKPDVVSLLEQGREPWLGKGDMSRGLFPASESNAEIREFSPENVLCEDDSSRCLIMDRFLSQGSE

SEQ ID NO: 26233 - protein, 81 aa, Vicugna pacos
VQGKVNFEDVFVYFSQEEWGLLDEAQRLLYREVMLENFALMVSLGYVSSMPHGVAPRELGSEPWGSDWADVTPAVTREAQG

SEQ ID NO: 26234 - protein, 81 aa, Vicugna pacos
MIMTFEDVAVDFTQEEWQQLDLAQKTLHRDVMLEICSHLVSVGCSDIKPDIISKLEHGEDKWIIESELSRWIYSDSLTCNR

SEQ ID NO: 26235 - protein, 81 aa, Delphinapterus leucas
MMKSQEEWQQLDPAQKTLYRDVMLENYSHLVSMGHPVSKPDVISKLEQGEDPWIIKRDIPNWIYPYEDQADGRQDRKSNLD

SEQ ID NO: 26236 - protein, 81 aa, Carlito syrichta
GWVPALFDEVAIYFSDEEWEVLTEQQKALYREVMRMNYETVLSLEFPFPKPDMITRLEGEEESQNSDEWQLHGGTFADTAK

SEQ ID NO: 26237 - protein, 81 aa, Erinaceus europaeus
SLGMVSFEDVAVTFSREEWQQLDEAQRTLYREVMLEAYSNLKTVGCCWSKPEVIIRLEQGVEPWTVEGVTNQRFSDVLTVD

SEQ ID NO: 26238 - protein, 81 aa, Erinaceus europaeus
DIVTYEDVTVIFTQEEWALLNPSEKKLYRDVMWETFMNFLSIEKLQGDHSTEEQHNHQGSKQSNIISITGAKKRSQKPQEC

SEQ ID NO: 26239 - protein, 81 aa, Cervus elaphus
SQAFMAFRDVAVGFTQEEWKLLSPAQRTLHREVMLEIYNHLLSLDILFSKPELICKLEQGEEPWIEERQRSLGLCPASPHP

SEQ ID NO: 26240 - protein, 81 aa, Colobus angolensis
PQASVCFEDVAMAFTKEEWEQLDLAQRTLYREVTLETWEHIVSLGLFLSKSDVISQLEQEEDLHRAEQVSPRGARSSKEQR

SEQ ID NO: 26241 - protein, 81 aa, Colobus angolensis
AQGLVTFADVAIDFSQEEWACLNSAQRDLYWDVMLENYSNLVSLDLESAYESKGLPTGKNIHEIRASRRNSDRRSKSLGRN

SEQ ID NO: 26242 - protein, 81 aa, Colobus angolensis
AQGRVVFEDVAIYFSQEEWGHLDEAQRLLYRDVMLENLALLSSLGCCHGAEDEEAPLEPGVSLGVSQVMAPKPCLSPQKTQ

SEQ ID NO: 26243 - protein, 81 aa, Colobus angolensis
QGTVTFEDVAVHFSWEEWGLLDEAQRCLYRDVMLENLALLTSLDVHHRKQHLGEKHFRSNVGRALFVKTCTFHVSGEPSTC

SEQ ID NO: 26244 - protein, 81 aa, Carlito syrichta
CFQDSVTFDDLAVDFTPEEWTLLDPTQRNLYRDVMLENYKNLATVGCQLFKPSLISWLEQEESRTFQRGVVQEWKVQLKTK

SEQ ID NO: 26245 - protein, 81 aa, Carlito syrichta
LQELLSFEDLSVDFTQKEWQLLNPYQKNLYKDVMLENYSSLVSLGYEVIKPDVIFKLEQGEEPWIRDAEMPSSPSLEVWQV

SEQ ID NO: 26246 - protein, 81 aa, Carlito syrichta
IPGLLSFKDVAIEFSPEEWECLDSPQRILYRTVMLEIHRNLVFLGLADSKSDLIMHLEQRKEPWDVKRHDILAKLPAVTSH

SEQ ID NO: 26247 - protein, 81 aa, Carlito syrichta
AQGSVSFEDVNVELTRDEWQQMGPGERSLYRDVTLENYGHLVALGCCITKPKVILMLEQGEEPWSLEVKFLNRKYPGYYKI

SEQ ID NO: 26248 - protein, 81 aa, Delphinapterus leucas
MLENYGHLVSLGHCVSKPELILKLEQEEPWTLKGQLPSESHPEVQRTNNMEEISQENEGKYLRQGLFINNKTLTEDRNKTF

SEQ ID NO: 26249 - protein, 81 aa, Delphinapterus leucas
MLENFRNLISVGCPVTKTKVIFKVEQGQEPWMVEGENPHWRSPEVICLLDDELEGQEGEGSKDSFLNQGMFTFKKTLTNET

SEQ ID NO: 26250 - protein, 81 aa, Carlito syrichta
FQELVTFRDVAIDFSRQEWEYLDPNQRDLYRDVMLENYSNLVSLGHSISKPDVVDLLEQGKEPWMLLGEETQYSGSNPEPV

SEQ ID NO: 26251 - protein, 81 aa, Carlito syrichta
LQESVTFKDVSVDFTQEEWHHVDPAQRSLYRDVMLENYSHLVSLGCQVSKPEVIFKLEQGEEPWISEGEIQRPFCPDWKTR

SEQ ID NO: 26252 - protein, 81 aa, Carlito syrichta
MSQVTFSDVAIDFSHEEWTWLDSAQRNLYKDVMVQNYKNLVSLAGLSVTKPYVITLLEDGKEPWMVEKKLSKGMFPDWESR

SEQ ID NO: 26253 - protein, 81 aa, Carlito syrichta
DSVVFEEVAVNFTPEEWALLDGAQRTLYRDVMLETCRNLASLDCCIYVRTRGSSPQRGIFGNEMPSDEKIVQFTRNGSWSV

SEQ ID NO: 26254 - protein, 81 aa, Carlito syrichta
REGLLTFKDVAIEFSPEEWECLDAPQRILYKNVMLENHRNLVFLGLAVSKPDLIKCLEQKKKPWVVKRHSTLAKPPTVTSH

SEQ ID NO: 26255 - protein, 81 aa, Carlito syrichta
AHDLVVFRDVSVDFSQEEWECLNSYQRNLYRDVILENYSNLVSLGCSISKPDVITLLEQGKEPWMVVRNEKRRWNLDLESK

SEQ ID NO: 26256 - protein, 81 aa, Carlito syrichta
FQEPVTFEDVAVYFTQNEWATLDPTQRALYREVMLENYANVASLPFPFPKPDVIFQLEQGEAPWDLDPWASVVGAAPRAMC

SEQ ID NO: 26257 - protein, 81 aa, Carlito syrichta
EIGFLSFKDVAIEFSPEEWECLDSPQRLLYRTVMLENHRNLVFLGIAVSKPDLIMCLEQRKEPWSVKGHGTLAKLPAVTSH

SEQ ID NO: 26258 - protein, 81 aa, Erinaceus europaeus
SQMALTFRDVFIEFSQEEWECLDQSQRDLYKDVMLENYANLVSLGFAVSKEEILTLLEEEKRSCVGRTENAEISCDKVFLP

SEQ ID NO: 26259 - protein, 81 aa, Erinaceus europaeus
MVSFEDVTVTFSSEEWQNLDGAQRSLYMDVMLETYSSLVSLGPSLTKPVVIVKLEEGTESQLVEEPPSQSLSDALPVDGLA

SEQ ID NO: 26260 - protein, 81 aa, Erinaceus europaeus
SRGLVTFEDVAVYFSLEEWERLDMMQRDLYRDVMQENYGILVSLGYPIPKPDLIVRLEQGEEPWAHDSPCPEEGDIVTGVY

SEQ ID NO: 26261 - protein, 81 aa, Carlito syrichta
MAGSQGLLTFKDVAIEFSPEEWECLDRAQQILYRDTMLENHRNLVFLGLVVSKPDLITCLEQRKEPWNVKKHSTLARPPGR

SEQ ID NO: 26262 - protein, 81 aa, Carlito syrichta
VHGSVTFRDVAIDFSQEEWECLEPTQRSLYRDVMLENYSNLISLGSFISKPGVITLLEQEKEPWMVVRKETSRWYPDLESN

SEQ ID NO: 26263 - protein, 81 aa, Carlito syrichta
VRELLTFKDVAIEFSPEEWECLYPTQRILYRNVMLENHRSLVFLGLAVSKPDLITCLEQRKNPWDMRRLSMLAKTPAVTSH

SEQ ID NO: 26264 - protein, 81 aa, Carlito syrichta
EMRLLTFRDVAIDFSLEEWKCLDPAQRNLYRDVMLENYRNLVSLGLVIFKPDVITSLEQRKEPWNVNRCDIGAKHPAVSSY

SEQ ID NO: 26265 - protein, 81 aa, Delphinapterus leucas
TKGCVTFEDVAIYFSQEEWGLLDEAQRRLYHKVMLENFLLTASMVCLHGTEKKETPSEQNVSLEVLSQVRTPKVGPISQKA

SEQ ID NO: 26266 - protein, 81 aa, Delphinapterus leucas
PQELVTFKDIAVDFTQEEWALLDTSQRKLFRDVMLESISHLVSVGYQLRKSYVTSQLEQRVELWREGKGVHQCLSPDMTAV

SEQ ID NO: 26267 - protein, 81 aa, Carlito syrichta
SQGPLTFRDVAIEFSQEEWKCLDRTQRALYKDVMLETYRHLVSLGMSCFDLSIISMLEQGRNPWTVESLVKMARKSKGWEW

SEQ ID NO: 26268 - protein, 81 aa, Carlito syrichta
RDMGLLTFKDVTIEFSPEEWECLDPPQRILYRNVMLENHKNLVFLGLTVSKPDLIRCLEQRKEPWDVKRHSTLAKPPGRWE

SEQ ID NO: 26269 - protein, 81 aa, Delphinapterus leucas
PLESVTFEDVAISFTQEEWALLDTSQRKLFRDVMLENISHLVSVGYQHCKSDVIFQLDRGEELWIEGRGFFQSHSPGRESA

SEQ ID NO: 26270 - protein, 81 aa, Carlito syrichta
CEMSVSFEDVTVDFSREEWQHLDRAQRHLYWDVTLENYSHLLSVGYQIPKPEATFKLEQGEGLWTLEVEAPHQSCSEELWQ

SEQ ID NO: 26271 - protein, 81 aa, Carlito syrichta
MAFEDVAVYFSQEEWGLLDTAQRALYRCVILENFALVSSLGLSTSRPHVVTQLERGEEPWVPHGADTAPTPARNAHRRHNL

SEQ ID NO: 26272 - protein, 81 aa, Carlito syrichta
GAFELREAAESWKAGDPQDSLAFEDVAVTFTQEEWALLDPSQKNLYRDVMRETFKNLASIGNKWEDQNIKDQYENSWRNLR

SEQ ID NO: 26273 - protein, 81 aa, Carlito syrichta
MDLVAFEDVAVNFTQEEWALLDPSQKNLYKDVMQETFRNLASIGTKWEDQIIEDQYKNSWRNLRYMKEFILERNPMNVKNV

SEQ ID NO: 26274 - protein, 81 aa, Carlito syrichta
SLEPMTFKDVVVDFTQEEWALLDTSQRQLFRDVMLENISHLVSIGKQPCKSVVLSHLEQGEELSREEISFLQGQNPGEEGN

SEQ ID NO: 26275 - protein, 81 aa, Gulo gulo
MDFTLDWEHLGLDQGDLFWDTALDNYQNLFLLNPSKPKLTSQPDGAEEQKVLERESPESAGPNPAEVKNCLLGQDFLEEGL

SEQ ID NO: 26276 - protein, 81 aa, Erinaceus europaeus
PKVPVTFDDISIYFSTPEWEKLEEWQKELYKNIMKGNYESLVSTDYAMNQPDVLSQIQPEGEHQAEAQAAPPESEIPADPS

SEQ ID NO: 26277 - protein, 81 aa, Erinaceus europaeus
RPRAVRFADVAVYFSAEEWGCLRPAQRALYRDVMRETYGHLGALGCAGPKPALISWLERNTDDWELAALDPQECPKGLTVQ

SEQ ID NO: 26278 - protein, 81 aa, Erinaceus europaeus
MDSVTFKDITVEFSPEEWQLLDAAQRTLYKDVMQENYRLLISVGYGLSKPTAVFKLKQGKEPWILEIKCPRRKKPEDIWKS

SEQ ID NO: 26279 - protein, 81 aa, Erinaceus europaeus
ARAGVLFRDVAVCFSWEEWRLLDESQRKLYRDVMLENFELLSSLGCCFGVENVEIPLEQSLSLNVLQSSTSQPALSSLETH

SEQ ID NO: 26280 - protein, 81 aa, Erinaceus europaeus
YQELVTFRDVAVDFSQEEWDCLNSTQRHLYSNVMLENYRVLVSLGLCFSKPSVILLLEQGKEPWMVKQELTRGLCTGWKAT

SEQ ID NO: 26281 - protein, 81 aa, Ornithorhynchus anatinus
SQVAVTFEDVAVPLTGAEWRCLGPAQRRLYRDVMLENYAHVVWLGFPGPKPAVISQLERGAGPSGAQDPMAPGGARHEGEA

SEQ ID NO: 26282 - protein, 81 aa, Ornithorhynchus anatinus
GPLEDVPVVFAELPVTFEDVAVYFTREEWGMLDKRQKELYRDVMRVNYELLASLGEPRSRSPPPLPRGPRAVASSSWRTPS

SEQ ID NO: 26283 - protein, 81 aa, Vicugna pacos
DSWGPLSFMDVFVDFTWEEWRLLDPAQKHLYRSVMLENCNNLASLGHQHTKPSVVFQLEQEELWTMRIPSQGRADEVQEID

SEQ ID NO: 26284 - protein, 81 aa, Vicugna pacos
YQEFVTFEDVAVHLTREEWGCLDPVQRDLYREVMLENYGNLVSLGILLRLPTTRIPSVNSCPALSHTQASAFSGETLAVLS

SEQ ID NO: 26285 - protein, 81 aa, Vicugna pacos
LQGLVMFRDVAVDFSQEEWEGLDSTQRGLYRDVMMENYSNLALLGPSIPKPDVIFLLEQGKEPWMVLRSLAGGWHPGEQIE

SEQ ID NO: 26286 - protein, 81 aa, Vicugna pacos
SQQLMVFRDVAVDFSPEEWECLDLEQRGLYRDVMLENYSNMVSLGLCIYQPDVFSLLEKGKEPWMVLKNETGGPCPDMQSR

SEQ ID NO: 26287 - protein, 81 aa, Vicugna pacos
LVPFTFRDVAVFFTEAEWERLSSEQRNLYREVMLENYRNLLSLAEPKPDIYPCSSCLLAFSCLPFLHQHALQIFPGVCVEN

SEQ ID NO: 26288 - protein, 81 aa, Vicugna pacos
WQGRVVFEDVAIFFSQEEWGLLDEAQRHLYHAVMTENLALLSSLGFWPGAQDEEALSEQGVSVRVSEVRTLKPGLSTRKAL

SEQ ID NO: 26289 - protein, 81 aa, Vicugna pacos
YQRPVSFKDVVVGFTQEEWHRLNPAQRALYRDVMLETYSNLVSVGYEGTKPYVILRLEQEEAPWICEAACPGCHCRENIWQ

SEQ ID NO: 26290 - protein, 81 aa, Odobenus rosmarus
FQLPLTFEDVAIYFSEQEWQNLEAWQKELYKRVMRTNYEILVSLDDGLPKPELISWIEQGKEFFKNWGESQKSGNIICSSA

SEQ ID NO: 26291 - protein, 81 aa, Odobenus rosmarus
YQEVVTFEDVAVYFTWTEWAGLSPAQRALYRSVMLENYGNLTSLGYPVPKPALISLLEGGNLPWGLEAQDNPSAERTKDIC

SEQ ID NO: 26292 - protein, 81 aa, Odobenus rosmarus
PQEPVTFEDVAVYFTQNQWASLDPTQRALYREVMLENYASVASLVAFPFPKPDLVSQLERGEAPWSPDPWEAEVLKGTCPG

SEQ ID NO: 26293 - protein, 81 aa, Carlito syrichta
SLGPVSFKDVAVDFTQEEWQQLDPEQKITYRDVMLENYSNLVSVGYHIIKPDVIIKLEQGEEPWIVEGEFLLQSYPGEVWR

SEQ ID NO: 26294 - protein, 81 aa, Carlito syrichta
GLVTFRDVAIDFSQEEWECLDPAQRDLYVDVMLENYSNLVSLDLESTYETKNIFSEKDIFEINFPPWEIKEKSKTLGLEPS

SEQ ID NO: 26295 - protein, 81 aa, Carlito syrichta
LLTLKDVAIEFSPEEWECLDPTQRVLLKQFPVNLTEKLLNIQSRGFVGLEALHPSLLKTSKSQEEPDETDLQLQRDKQRLI

SEQ ID NO: 26296 - protein, 81 aa, Delphinapterus leucas
FQGSVTFRDVAIAFAQREWESLDSAQRDVDRDVMLENYRNLVSLARHSCSKPHEITLLEQWKEPWMIVKKDQGRQYTEFQL

SEQ ID NO: 26297 - protein, 81 aa, Carlito syrichta
SQGLLTFRDVAIEFSPEEWECLDPAQRVLYRNVMLENHRNLFFLGLAVSKPDLITCLEQRKEPWNVKRHITLVKPPGRWEE

SEQ ID NO: 26298 - protein, 81 aa, Carlito syrichta
GETGKAPVTFDDITVYLLQEEWMLLSQQQKKICGSDKLVAPLGPTVANSELFYKFEQGPEPWLGSIQHQRRLLEHHPRKSH

SEQ ID NO: 26299 - protein, 81 aa, Delphinapterus leucas
SQEMLTFRDVFVDFTLEEWQQLDATQKNLCRDVMLENYSHLVSVGFLVAQPGRISRLGQGEEEARMAAGESATRRCPEFWQ

SEQ ID NO: 26300 - protein, 81 aa, Carlito syrichta
VVFEDVAIYFSQEEWGHLDEAQRLLYHDVMLENLALLSSLGCWHGAENEEPLSDQGVSVAASEVMSPVPYLSTQKVQPSET

SEQ ID NO: 26301 - protein, 81 aa, Gulo gulo
MFQESMTFKDVAVDITQEDWEIMRPVQKELYKTVTLQNYWNMVSLGLTVYRPTVIPLLEEPWMVIKEILEGPSPEWKTEAQ

SEQ ID NO: 26302 - protein, 81 aa, Ornithorhynchus anatinus
LGPGRDVSVELSREEWGLLDRARRELYRDVMLDNYPRAGAAGGRRGRTSPDLPPSVERGRSPRATARRPRLFPGAGHVAGA

SEQ ID NO: 26303 - protein, 81 aa, Colobus angolensis
KKVTFEDVAIDFTQEEWAVMDTSKRKLYRDVLLENVSHLVSLGYQTSKSYIILQLEQGKEEFLQGQNLDKESALKKKHTIS

SEQ ID NO: 26304 - protein, 81 aa, Colobus angolensis
MASPSPPPESKEEWDYLDPAQRSLYKDVMMENYGNLVSLGLTVLPRLVCSDANMACCSLNLLDLSDQSSHLSYLSSWDYRC

SEQ ID NO: 26305 - protein, 81 aa, Colobus angolensis
MELLTFRDVAVEFSLEEWEHLEPAQKNLYQDVMLENYRNLVSLGLTVSKPELISRLEQRQEPWNVKRHETIVKPSAVSSRY

SEQ ID NO: 26306 - protein, 81 aa, Colobus angolensis
VTFEDVTIIFTLEEWKFLDSSQKRLYREVMWENYTNVMSVENWNESYKSQEEKFRYLEYENFSCWQGWWNAGAQMCENQNY

SEQ ID NO: 26307 - protein, 81 aa, Tupaia chinensis
DVAIEFSQGEWKRLDPAQRALYREVMLENYRNLVSVGEKPYKCNECGKAFMERSSLTQHKRIHSGEKPYKCKECGKAFNQS

SEQ ID NO: 26308 - protein, 80 aa, Vicugna pacos
MAPSQGRLTFEDVAIEFSQEEWECLDPAQRALYGEVMLETYRNLVSLGLTSKDSCSLRKKPRRRRRGQKRTREWPLLRYH

SEQ ID NO: 26309 - protein, 81 aa, Vicugna pacos
VQGRVVFEDVAIFFSQEEWGLLDEAQRHLYHAVMTENLALLSSLGCWPGAQDEEVPSEQGVCVEVSEVRTPKLGPSTRKAL

SEQ ID NO: 26310 - protein, 81 aa, Vicugna pacos
LTFEDVAITFSQEEWECLVPAQRTLYRDVMLETCRNLLSVDMSHILVIKKLQVKANMDKKLLQTAMTERHERTERKHFDPR

SEQ ID NO: 26311 - protein, 81 aa, Vicugna pacos
AHGSVMFSDVSIVFSQEEWEYLDLKQRDLYRDVMLENYSNLVSLDLETRYETKKLSSENDVYEMNLTQWKIMERIKNCGLK

SEQ ID NO: 26312 - protein, 81 aa, Vicugna pacos
PKVPVTFDDISIYFSTPEWEKLEEWQKELYKNIMKGNYESLISMDYAMNQPDVLSQIQPEGDHNTGNQAGPEESEIPTDPS

SEQ ID NO: 26313 - protein, 81 aa, Vicugna pacos
TQDPVVFEDVAVDFTQEEWALLDLAQRNLYRDVMLENFQNLVSLGYPLHTPSLISQWKQEEEPETVKKGPTQEEHQEGFET

SEQ ID NO: 26314 - protein, 81 aa, Vicugna pacos
MLENYSSLVSLGYKVTKPGVILKLERGEEPWVGDGGAPRADAVEQVLQVNGHMTWHKDNQEELKNMKQDHECDAFGKHFNL

SEQ ID NO: 26315 - protein, 81 aa, Carlito syrichta
EMELLTFKDVAIEFSPAEWECLDPPQRILYRNVMLENHKHLVFLGLAVSKPDLIIRLEEKKEPWNVKRHSVLAKPTAVTSS

SEQ ID NO: 26316 - protein, 81 aa, Delphinapterus leucas
MLENYGHLVSLAGLNISKPHVVSLLEQGKEPWLGKDASRGLFSASESNGEIKEFSPKNVIYEDDSSQYLIRSSDLSFERFL

SEQ ID NO: 26317 - protein, 81 aa, Erinaceus europaeus
FQDFVTFGDVAVDFSQEEWEWLTPVQRNLYKKVMLENYRSLVSLGVSVSKPDVISLLEQGKEPWMMKEEARGICHDWKYAF

SEQ ID NO: 26318 - protein, 81 aa, Erinaceus europaeus
TESLNVEDVTVIFTQEEWALLNSSEKKLYRDVMCENLRNFLSIEKIQEHSTKGQHILHGSKQSNTTVNISEGKDSQNAGIS

SEQ ID NO: 26319 - protein, 81 aa, Erinaceus europaeus
SPGPVSFRDVAVDFTRDEWQQLDREQRATYRDVMLENYSHLEAVGWHIIKPEVIIKLEQGEELWGAGGDSLLQSCPEVWNI

SEQ ID NO: 26320 - protein, 81 aa, Erinaceus europaeus
SVEPVTFWDVAVDFSQEEWGQLDPVQRTLYRDVMLETYGHLLSVGPELPKPDVISQLERGAELWALQRGVSPACRAGENTR

SEQ ID NO: 26321 - protein, 81 aa, Erinaceus europaeus
TAKSQASLTFKDVAMDFTPEEWGKLDPAQRDVMLKNYKNLVSFWLPVSKAKNCSLEKEKEPLMLERKKTQNSCSGLETKPE

SEQ ID NO: 26322 - protein, 81 aa, Saimiri boliviensis
AQMFVTFKDVAVTFTQEEWRQLDLAQRTLYQEVMLETCGLLVSLGYWVPKPELVHLLEHGQELWTVKRDHSHPTCAGDKAQ

SEQ ID NO: 26323 - protein, 81 aa, Lynx pardinus
SQVPVTLEDVAAYLSQEEWECLDPAQRGCVWDVLPDSGGLGLQLEDGEGARQDVPTRREQDRELVGGMTRPEQSLEGGRPR

SEQ ID NO: 26324 - protein, 81 aa, Tupaia chinensis
LVKIEDVADVAVSFILEEWGHLDQSQKSLFRDNRKENYGSITSMGYESRENNMELIVKQISDEAESQWMASGSTDRNVTQN

SEQ ID NO: 26325 - protein, 81 aa, Tupaia chinensis
CQVSVSFEDVTVDFSREEWQHLNPAQRHLYWNVTLENYSHLLSVGCQVPKTAAIFKLEQGEGPWMLERETPHQSYSDEDIR

SEQ ID NO: 26326 - protein, 81 aa, Vicugna pacos
ALALVSFEDVAITFTGEEWRHLDLAQRTLYQEVMLETCGLLVSLGHPVPKLELIHLPEHGQELWTVKRGLSRSTYSGEKAK

SEQ ID NO: 26327 - protein, 81 aa, Vicugna pacos
KEAFVVFGDVAVDFTQEEWRLLSPAQRTLHREVMLETYSHFISLEIPFSKPKLISQLERGEEPWKEERQSLLRLCPGSKLE

SEQ ID NO: 26328 - protein, 81 aa, Vicugna pacos
AFKEALTFKDVAVVFTEEELRLLDSTQRELYQDVMLENFRNLVSVGCHPFKHDIFHLEKADGLWWVKTAAQRERKSEGKIP

SEQ ID NO: 26329 - protein, 81 aa, Odobenus rosmarus
MVMFKDVAIDVSQEEWECLNPTQRNLYKDVMLENYSNLVSLGLSISKPAVISSLEQGKEPWMVVRKVTGGRCPDLMSRCEA

SEQ ID NO: 26330 - protein, 81 aa, Odobenus rosmarus
MLENYGNLLFLGLVVSKPDLVIFLEQKRELWDVKGKETVAIHPDLIVWKPNLVLFLEQEKELWDMKRKKRVAIHPAVSSNG

SEQ ID NO: 26331 - protein, 81 aa, Carlito syrichta
RCQEAVTFEDVAVVFTDEEWKHLVPVQRDLYKEVMLENYESIASLDWETKPEIQDALENAKSEDALGEPLGRQSPLCAKSE

SEQ ID NO: 26332 - protein, 81 aa, Carlito syrichta
SFETVTFKDVAVDLTQEEWEQMKPAQRNLYRDVMLENYSNLVIVGCQITKPDVIFKLEQEEEPWVMEEVFGRPCPEVWEVD

SEQ ID NO: 26333 - protein, 81 aa, Gulo gulo
FQEAVTFKDVAVVFSEEELGLLDPAQRKLYRDVMLENFRNLVSVGHSSSKPDMISQLEREEKLCVKEIHTERGGRNPNEAE

SEQ ID NO: 26334 - protein, 81 aa, Gulo gulo
SLETVTFKDVAVDLTQEEWQQMKPAQRNLYRDVMLENYSNLVTVGYQVSKPDVIFKLEHEEEPWVVEEEMLGRHCPEESRR

SEQ ID NO: 26335 - protein, 81 aa, Erinaceus europaeus
SSEPVIFRDVAVDFSPEEWQLLEPEQKALYREVMLENFQNLASLGHHCWRPRLIVRLEGAAQLCASERSAPAAPPQGDGGL

SEQ ID NO: 26336 - protein, 81 aa, Ornithorhynchus anatinus
MEVTFEDVAIFLTRREWESLAGTQKKLYTTVMLENYGHLQSLGAGHPKPHCIRKLQKGEGPWIPEPPSHPKWTFPEEAWTE

SEQ ID NO: 26337 - protein, 81 aa, Ornithorhynchus anatinus
SQTPVTFEDVAAYLTREEWRPLDPAQRDLYREVVQENFGDMVSLDFTIGGENEVIPKQEVVDEAYGALPGRPKGGGSQELE

SEQ ID NO: 26338 - protein, 81 aa, Vicugna pacos
CEVSVSFEDVTVDFSREEWQQLDSTQRRLYQDVMLENYSHLLSLGYEVPKPEVIFRLGQGEEPWMSEGETPHQSCSDGKFG

SEQ ID NO: 26339 - protein, 81 aa, Vicugna pacos
QLTFEDVAIEFSQEEWECLDAAQRALYRDVMLETCRNLLSLDISPSHVTKKLQPKENTNTTDVFQTVIWGRLGSHEVRDVH

SEQ ID NO: 26340 - protein, 81 aa, Vicugna pacos
MLETYRNLASLGGPGSKPDLISQLEQGKEPWGLEMLETKERETPGDPGTDSDWGSLCKQVTSRVKMTQGAEPEGGGPESCS

SEQ ID NO: 26341 - protein, 81 aa, Vicugna pacos
DSQESVTFEDVAVDFTQEEWALLDTSQRKLFRDVMLENISHLVSVAIYFFPVISDREDDLKKQMISMQHINKKDAPLIRTV

SEQ ID NO: 26342 - protein, 81 aa, Vicugna pacos
MLENYGHLVSVGYQLSKPGVISQLEKGEEPWLTEREVSGGPSPDLESKTETKESTLKNDISWEELHHGLMMERSTRGSTLI

SEQ ID NO: 26343 - protein, 81 aa, Carlito syrichta
MLENYSNLVSLGIPFSKPKLITQLEQEKETWREERKCPLATCPAEPEPELHLHPFCPPDFSSQKLPMQHVPCNHPPWLFTC

SEQ ID NO: 26344 - protein, 81 aa, Carlito syrichta
QGSVTFRDVAIDFSQEEWKWLQPAQRDLYRCVMLENYGHLVSLVSNCEIKDFSSKNVIYDGSSQYFIMGRILSQGPVYSSF

SEQ ID NO: 26345 - protein, 81 aa, Carlito syrichta
YQDSVTFDDVAVDFTQEEWTLLDTSQRHLYSDVMMENYKNLATVGCQIIKPSLISWLEQEESRTVQGGVLQGWEMPLETKL

SEQ ID NO: 26346 - protein, 81 aa, Carlito syrichta
GSQGLLTFKDVAIEFSPEEWECLDYSQRILYRTVMLENHRNMVFLGLAVSKPDLITCLEQRKEPWDVKRHSTLAQMPGRWE

SEQ ID NO: 26347 - protein, 81 aa, Carlito syrichta
MLENYGNLVSVGYQLPKPGVIFHLEKGEDPWLRDRDISGGPSSDLESKAETKESNLKNDISWENLPCDVMTEKATRGSTLY

SEQ ID NO: 26348 - protein, 81 aa, Carlito syrichta
LQGLVTFEDVAVEFTQEEWVLLDPSQRTLYRDVMLENCRNLASLGCHVDKPRLISQLEEEDKMMTEERDILPSACPDLEAL

SEQ ID NO: 26349 - protein, 81 aa, Carlito syrichta
SQELLTFRDVAIEFSQEEWEFLDPAQRTLYRDVMMENYRNLVSVGISFSNLNIISILEQGKEPWTVESKVKITKISDGWEC

SEQ ID NO: 26350 - protein, 81 aa, Carlito syrichta
YQTPVSFKDVVVGFTQEEWHRLNPAQRALYRDVMLETYSNLVSVGYEGTKPDVILRLEQEEAPWICEAACSGCHCWEDSWQ

SEQ ID NO: 26351 - protein, 81 aa, Carlito syrichta
SLGSVTFTDVAIDFSQDEWEWLNLAQRSLYRKVMLENYRNLVSVGLCISKPHMISLLEQEKEPWVTKGEMTRGLCPDLEYV

SEQ ID NO: 26352 - protein, 81 aa, Carlito syrichta
QAEVTFEDVAVLLSREEWGRLGPAQRGLYRDVMLETYGNLVSLGTGHAGPKPGVISQLERGDEPWVLDGQGASGREHLRVT

SEQ ID NO: 26353 - protein, 81 aa, Carlito syrichta
LQVLVSFEDVAVLLSEEEWDCLGPAQRGLYRDVMLETYGNLVSLGLQGSKPNVISRLEQGDKPWTLYSLGTGGSWSWKHRR

SEQ ID NO: 26354 - protein, 81 aa, Gulo gulo
PNEAVTFKDVAVVFTEEELGLLDPAQRKLYGDVMLENFRNLLSVGHQPFTPHVILQCERGGKLWMIKTATQGHGISGDKNL

SEQ ID NO: 26355 - protein, 81 aa, Gulo gulo
YQQIAVTFEDVAVDFTQEEWLLLDLTQRNLYRNVMLENYQNLVAVEYQLSKPKLIAWLEQQELRTVEKGVFQEWETRPQTK

SEQ ID NO: 26356 - protein, 81 aa, Gulo gulo
AQEPVTYEDVAVDFTQEEWQYLDAAQKTLHRDVMLEIYGHLVSVGCSRIKPGIIFKLEHEEDPWIIKSELSTWTHSDREKS

SEQ ID NO: 26357 - protein, 81 aa, Ornithorhynchus anatinus
PKVPVIIDDVAVYFSEQELGNLDQGQKELYKNATKGNYETLVSLDYAISKPDLLTQMERGEEPCGRDQPGAVEAGIPPHPA

SEQ ID NO: 26358 - protein, 81 aa, Mustela putorius
IQVLVTFKDVAVTFTQEEWGHLDLDQRALYQEVMLETCGLLVSLGHPVPKAEFAHLLEHGQELWTGKGGLSHSTCSGDSMR

SEQ ID NO: 26359 - protein, 81 aa, Mustela putorius
SQGQLTFRDVAIEFSEEEWGRLTHTQRQLYRDVMLESYGHLLFLGLTVSKPDLIMFLEEGKWLWDVKRKETVRFHPGPPVA

SEQ ID NO: 26360 - protein, 81 aa, Mustela putorius
CQESVTFEDVAVIFTDEEWRHLVPIQRDLYKEVMLENYKSIVSLGLPVPQPDIIFQLKRGDEPWVVDLHGSEERECPEDVS

SEQ ID NO: 26361 - protein, 81 aa, Mustela putorius
SQGLVTFRDVALDFSQEEWEWLDPSQKDLYRDVMLENYRNLVWLGLSISKPNMISLLEQGKEPWMVQKEMSDGQYTDWESW

SEQ ID NO: 26362 - protein, 81 aa, Tupaia chinensis
PKVPVAFDDVAVYFSEQEWGRLEDWQKELYKHVMRGNYETLVSLDYAISKPEVLSQVEQGKEPCSWRRTGPKIPDVPVDPS

SEQ ID NO: 26363 - protein, 81 aa, Vicugna pacos
MLENYCHFVSVGFHMTKPDMIHKLEQGKELWTTGRIFPSRSYPEDDGKAEDVLVKFKEYQERHSRSAVFLNHKGLMKERSN

SEQ ID NO: 26364 - protein, 81 aa, Vicugna pacos
PHRLVLFKDVAIDFSREEWECLDLEQKDLYRDVMLENYNNLVSLGISISKPDVLSLLEQGKEPWKVVQDETRGQSPDWESR

SEQ ID NO: 26365 - protein, 81 aa, Vicugna pacos
LQETLTFRDVFVDFTLEEWQLLDAAQKNLYRDVTLENYGHLLSVGYLMAQPGAIFRMGQVEEEARMADGQTPKRSCPEVWQ

SEQ ID NO: 26366 - protein, 81 aa, Carlito syrichta
YQELVTFRDVAVDFSQEEWDCLDSSQRHLYSNVMLENYRILVSLGLCFSKPSVILLLEQGKEPWMVKRELTKGLCSGWEPM

SEQ ID NO: 26367 - protein, 81 aa, Carlito syrichta
MAFMDVAVDFTQEEWRLLSPAQRTLYREVMLENYSNLVSLGIPFSKPKLITLLEQEKVTWREKRKCPLATCPAEPEPEPEL

SEQ ID NO: 26368 - protein, 81 aa, Carlito syrichta
GKALLSFEDVAMYFTREEWNHLDWAQKDLYRDVMLENYMNMVLLGFQFPKPEVICQLENWDEPWILDLPRAGNRKASSSAC

SEQ ID NO: 26369 - protein, 81 aa, Gulo gulo
QGQLTFRNVAIEFSQEEWGRLTHTQWELYRDVMLENYGNLLSLETGLVVSKPDLVIFLERKRELWDVKGKETVAIHPAAAA

SEQ ID NO: 26370 - protein, 81 aa, Erinaceus europaeus
FRDPVTFEDVTLIFTPEEWEKLSLEQKCLYREVILENYRNLVSVEHQLSKPDVVSQLEEAEELWSVERGIEDKSADSARMQ

SEQ ID NO: 26371 - protein, 81 aa, Tupaia chinensis
CQGYVSFEDVAVNFTWAEWQNLDDAQKTLYKDVMLETYSNLVFLGHCVAKPVVIFSLEQGGEPWTLEELPNQSLPGEKLYE

SEQ ID NO: 26372 - protein, 81 aa, Vicugna pacos
MFQVTFSDVAIDFSHEEWGWLDSAQRDLYKDVMVQNYENLVSLGLSIPKPNVIALLEEGKDPWMVERKLSTGMFPDWDSRW

SEQ ID NO: 26373 - protein, 81 aa, Vicugna pacos
CEESVTFKDVAVDFTQEEWGQLDSPQRALYRDVMLENYQNLLALGPPVCKPDVISHLERGEEPWRVPREVLGGVHPERGPR

SEQ ID NO: 26374 - protein, 81 aa, Vicugna pacos
FEMSVSFEDVTVAFTQEEWRHVSPAQRTLYRDVMLENYRHLVSVGYWFTKPDIIFKLERREDPLLLENEFLTKSQAGCCVD

SEQ ID NO: 26375 - protein, 81 aa, Vicugna pacos
PQKSVTFEDVAVYFTQTEWDGLSPAQRALYRDVMLENYGNVASLGFPLLKPAVISQLEGGDIDIQTDNNLTEEMYEEKHNT

SEQ ID NO: 26376 - protein, 81 aa, Vicugna pacos
GVSFLDVAVHFSWEEWRLLDEAQRRLYLDVMLENYALVSSLGCCCGAGDAEAPFEQMAPLGGSQARTPKAALSSQKTHPCE

SEQ ID NO: 26377 - protein, 81 aa, Vicugna pacos
FEMSVSFEDVTVAFTQEEWRHMSPAQRTLYRDVMLENYRHLVSVGHCLTKPYVIFKLERGEDPLLLEEEILKKSLADCQLD

SEQ ID NO: 26378 - protein, 81 aa, Odobenus rosmarus
FQGSFSFEDVTVGFTQEEWQHLDPAQRILYRDVMLENYSHLVSVGCCIPKPEVILKLEQGEQPWTLGEESPSQSYPEVCRV

SEQ ID NO: 26379 - protein, 81 aa, Carlito syrichta
SQILVTFKDVLVEFSREEWKLLDITQQIMYKDVMLENYKNLVSLGYQLPKPDVILWLEKGQEPWLVERRIHQKTHPNLETA

SEQ ID NO: 26380 - protein, 81 aa, Carlito syrichta
QKGLVSFEDVVVYFTWEEWQDLNDAQRTLYRDVMLETYRSLVSLGCCITKPEVIFKLEQGAEPWPGEEPRQQSHPDVLTVS

SEQ ID NO: 26381 - protein, 81 aa, Delphinapterus leucas
LRGWGTFEDIAVYFSQEEWGLLDEAQRHLYCDVMLENLALVASLDYGCGAEAEEASYEQSVYVAVLQSRTPKADPSIQKAN

SEQ ID NO: 26382 - protein, 81 aa, Carlito syrichta
RTDTVTFKDVAVVFTEEELGLLDSAQRKLYRDVMLENFRNVVSVGHQFFTPDGIPELEREEKLCMVKTVIQSGNTSGGKNL

SEQ ID NO: 26383 - protein, 81 aa, Carlito syrichta
MSQGSVTFQDVVIDFSKEEWEFLNPAQRDLYTTVMLNYHNLVWLGLSISKSVISLLEHRKLPWMIGKKGIRNPLPDESGGE

SEQ ID NO: 26384 - protein, 81 aa, Carlito syrichta
ELVTFRDVVISFSQEEWEYLDSAQRDLYWDVMMENYSNLVSLDLESRFETKNLSVGMDIIENNRSQWKVMESSKFCGLKNS

SEQ ID NO: 26385 - protein, 81 aa, Carlito syrichta
SRSLENDGVCFSEQEWENLEDWQKELYRNVMESNYETLVSLKVLGQPEGEAELGTEMLGDLEEEGPAGAHPADGVMIKQEL

SEQ ID NO: 26386 - protein, 81 aa, Carlito syrichta
IKGTRDGHYVAVYFSPEEWGCLRPAQRALYRDVMRETYGHLGALGVGGTKPALISWVEEEAEVWGPDAQDPVAAKCPTEVD

SEQ ID NO: 26387 - protein, 81 aa, Carlito syrichta
MAQGSVSFEDVTVELTREEWQLMGPRERSLYRDVTLENYGHLIAVGCCIAKPQVILKLEQGEPWPLEVKFLNRKYTGYYKI

SEQ ID NO: 26388 - protein, 80 aa, Gulo gulo
MQGLLTFRDVAIELSQEEWGHLTHTQRRLYRDVMLENYGHLCFLGLTVSKPDLIIFLEQEKQLWDMKRKETVGFHPGRWE

SEQ ID NO: 26389 - protein, 81 aa, Ornithorhynchus anatinus
RSRGSDVSVELSREEWGLLDRARRELYRDVMLDNYPRAGAAGGRRGRTSPDLPPSVERGRSPRATARRPRLFPGAGHVAGA

SEQ ID NO: 26390 - protein, 81 aa, Mustela putorius
RLTFRDVAIEFSREEWECLDPAQRALYRDVMVENYRNLVSLNISTRCMNKELPPKDNINNGELFQTLILKRRISHDFDFGL

SEQ ID NO: 26391 - protein, 81 aa, Mustela putorius
LVSFEDVAMDFSREEWQQLDPAQRCLYRDVMLEIYSHLLSVEGALGLKTSQQKIFEKASFHNGKESEVTRGGMWCSISEDL

SEQ ID NO: 26392 - protein, 81 aa, Mustela putorius
SHGPLSFEDVAIAFTKEEWQQLDRTQRTLYRDVMLENFSHLVSLGHPMSKPDVISKLEQGQEPWIVKRDISSWIYPGPALL

SEQ ID NO: 26393 - protein, 81 aa, Tupaia chinensis
MSFKDVIVDFTQDEWLRLNGTQRTLYRDVMLENYSHLISVGYCITKPDMIFKLEQGEEPLDIRGRILRLGLSKGKTVVFLK

SEQ ID NO: 26394 - protein, 81 aa, Odobenus rosmarus
SQSLVTFGDVAVDFSQEEWEWLNSAQRNLYRSVMLENYRNLVSLGLCVSKPDVISSLEQRKEPWMVKRKLTRGRCPDLKTV

SEQ ID NO: 26395 - protein, 81 aa, Odobenus rosmarus
QGHVTFEDVAVYFSQEEWALLDEAQRHLYRTVMLENLALIASLGCWHGVKAEEAFSEQCVFMERVSQARTPDPGLSVPKAH

SEQ ID NO: 26396 - protein, 81 aa, Odobenus rosmarus
AQDSVTFEDVAVRFSSGEWQCLTRAQRHLYADVMLENYGNMISVGFAVPEPPLISHLEQGAEPCLQDLQDGGFLSCSFPVS

SEQ ID NO: 26397 - protein, 81 aa, Odobenus rosmarus
QAQESLTFDDVAVDFTWEEWQLLAPAQKDLYRDMMLENYRNLVSVGYQASKPDALSKLERGELWMIEDEIHSRICPEIRKV

SEQ ID NO: 26398 - protein, 81 aa, Delphinapterus leucas
TQVSVTFDDVAVTFTQEEWRQLDPAQRTLYQEVMLENCRLLVSLGCPVPRFELIFQLEQGQKLWTVKKDLSRSTCPGKRCR

SEQ ID NO: 26399 - protein, 81 aa, Gulo gulo
TARSQASVTFKDVAMDFTPEEWGKLDPAQREVMLENYKNLVSLWLPVSKSENYNLENGKEPLMLERKGPKSNYSDLETKPE

SEQ ID NO: 26400 - protein, 81 aa, Gulo gulo
MAHLMMFRDVAVDFSQEEWECLNLEQRHLYRDVMLENYSNMISLGLCIYQPDVFSLLEKGKEPWIVSQDETGGPCPDMQSR

SEQ ID NO: 26401 - protein, 81 aa, Erinaceus europaeus
SQELLTFQDVYVDFTQEEWEQLTPAYRNLYREVMLENYWNLVSVGYQLSKPGMTSQLNKGELPLIEQDVSGVSSSDMKNKE

SEQ ID NO: 26402 - protein, 81 aa, Erinaceus europaeus
SQELLTFRDVAIEFSAEEWECLNQAQRDLYRDVMLENYGHLVFLDLTLSKSDQITFLELQVNPWAEKRKKKLPILQNISSY

SEQ ID NO: 26403 - protein, 81 aa, Mustela putorius
AHGLVMFKDVAIDVSQEEWECLNPTQRNLYKDVMLENYSNLVSLGLSISKPAVISSLEQGKEPWMVVREMTGRRCPELVSR

SEQ ID NO: 26404 - protein, 81 aa, Mustela putorius
QESLTFKDVAVDFTLEEWGQLGPGQRELYRDVMLENYQNLLSLGAGPPGSKPDVISRLERGEEPRMENREAQLAACPALDT

SEQ ID NO: 26405 - protein, 81 aa, Mustela putorius
QQSAVTFEDVAVDFTQEEWLLLDLTQRNLYRKVMLENYQNLVAVEYQLSKPKLIAWLEQQELRTVEKGVFQEWETQPQTKG

SEQ ID NO: 26406 - protein, 81 aa, Mustela putorius
MLENYSHLVSVGYDSTKPKVILKLEQGEEPWVAEGEVPCQSQPEEVWKADDPIERIPGSEDEHSRQAISINSKTPVEEREN

SEQ ID NO: 26407 - protein, 81 aa, Mustela putorius
SQGSVSFEDISVAFTQKEWQLLDPAQRLLYREVMLENYRQLVSLGHCVATPELILKLEQGEEPWVPKRELPSPSRPEVHKT

SEQ ID NO: 26408 - protein, 81 aa, Mustela putorius
QAEVTFEDVAVLFSREEWGRLGPAQRGLYRDVMLETYRNLVSLGAGPAGPKPGVITQLERGDEPWVLDAQGAEGKERLRVS

SEQ ID NO: 26409 - protein, 81 aa, Mustela putorius
RDSVTFEDVAVRFSGGEWRRLTRAQRRLYAAVMLDNYGLVVSLAQPGFAGPKPPLISCLERGAEPRVRDLQDWGLLSCSFP

SEQ ID NO: 26410 - protein, 81 aa, Mustela putorius
FQEAVTFKDVAVVFTVEELGLLDSTQRKLYRDVMLENFKNLVSVGHLPFKPEMVSQLEAEEELWMMEGEPQKSVTSEDHMA

SEQ ID NO: 26411 - protein, 81 aa, Tupaia chinensis
MLETYSSLVSLGHCITKPEVIFKLEEAAEPWTVEEPPNQSLPDVPIVGDLIERNQESHRRQLWQLLTNSRTSTEKRIELGK

SEQ ID NO: 26412 - protein, 81 aa, Tupaia chinensis
MEFTWEEWQLLNSAQKHLYTDVMLENYNSWVSVEGWEEWYQKSQDDFESVERKYTCNMFGKLHPNKTDIFPRQRLHKYNAH

SEQ ID NO: 26413 - protein, 81 aa, Tupaia chinensis
FQGFISFEDVAMDFTWEEWQDLEDAQKILYKDVMLETYSNLMFLGQSIAKPAVIFKLEQGEDPWTLEELPSLSLPGEKPYE

SEQ ID NO: 26414 - protein, 81 aa, Vicugna pacos
SRSLENDGVCFSEQEWENLEDWQKELYTNVMKSNYETLVSLKVLGQPEGDSELGTEMLGDLEEEGPGRVHPAGAAMIKQEI

SEQ ID NO: 26415 - protein, 81 aa, Vicugna pacos
GSVTFEDVSVYFSWEEWALLDEAQKLLYCDVMLENFALMASLGYWHGVEDEDAPSEQSVSVEGVSQVSMTFKYLAMTFTWE

SEQ ID NO: 26416 - protein, 81 aa, Vicugna pacos
DPPQVSVTFEDVAIYFSQTEWGLLDEAQKFLYRDVMLENFALTRSLDCWRGAEDEVVLSEQSVSISESQIRISKPVPLNLK

SEQ ID NO: 26417 - protein, 81 aa, Odobenus rosmarus
QQIAVTFEDVAVDFTQEEWLLLDLTQRNIYRNVMLENYQNLVAVEYQLSKPKLIAWLEQQELRTVEKGVFQEWETQPQTKG

SEQ ID NO: 26418 - protein, 81 aa, Delphinapterus leucas
MLENYSHLVSVGCHIIKPEVITKLEKGEEPWIVGGEFLLQSYPEEDWEAHDLIEGAQENEDKHSRQTEFVNNKTLIEERGN

SEQ ID NO: 26419 - protein, 81 aa, Carlito syrichta
MLENYRNLVSLGFLFTTPRVISLLQRGEDPWKVGKEGSGGSSLGCKNSPKTTKSSQTQDSFQGLMRKRLKRNETWDCVLQK

SEQ ID NO: 26420 - protein, 81 aa, Erinaceus europaeus
SLTCEDVTVNFSQEEWTLLNPSQKKLYKDVMLEIFHNLVSIGKLQENLFIEQQQDHERNKQRNIEKTLSEKAESLYRQKPH

SEQ ID NO: 26421 - protein, 81 aa, Mustela putorius
QGHVTFEDVAVYFSQEEWGLLDEAQRCLYHIVMLETLALIASLGCRHGVKAEEAFSEQCVFVERVSHSRTPDPALSIPGAC

SEQ ID NO: 26422 - protein, 81 aa, Mustela putorius
IQEPVTFKDVAVDFTQEEWGQLDSVQRTLYRDVMLETYGHLLSVGNHIAKPEVISLLEQGEEPWSVEQAYPQSTCPEWMRN

SEQ ID NO: 26423 - protein, 81 aa, Mustela putorius
WLTFRDVAIEFSREEWECLDPAQRALYRDVMVENYRNLVSLAISPKCMIKELPPKENSNTEELSQRVKLERYKSCDTEDYA

SEQ ID NO: 26424 - protein, 81 aa, Tupaia chinensis
KNGYGAEYQERKAILVISPCGCELHQEEWRLLCPVQRTLNRDVMLENYRNLASLGIPFSKPTPAILLEQGDEPWREERQVL

SEQ ID NO: 26425 - protein, 81 aa, Tupaia chinensis
MLENYSHLVSVGYCIFRPEVIFKLEQGEEPWMSEEEFLNKSYSSLEDYEGEDLIKRSKKSKHLQQVVFINNKTLTREEEKV

SEQ ID NO: 26426 - protein, 81 aa, Tupaia chinensis
SEESVTFKDVAVDFTQEEWGQLDSPQRALYRDVMLENYQNLLALAGRPVHKPDVISHLERGEEPWQVQTTVPGAAGPEWEP

SEQ ID NO: 26427 - protein, 81 aa, Tupaia chinensis
EQVTFKDVAIEFSKTEWKRLDPAQRALYREVMLENYRNLVSVGTSPPDVTVISMLEQGEEPWTAESRVQRPEVPGGREWTQ

SEQ ID NO: 26428 - protein, 81 aa, Odobenus rosmarus
SSQELLTFRDVAIEFSQEEWRCLNHTQRELYRDVMLENYGHLLFLGLIVSKPDLVSFLEQTKDPWDGKSKKTVAFHPGRWE

SEQ ID NO: 26429 - protein, 81 aa, Odobenus rosmarus
KDQESLTLEDVAVDFTWEEWQLLAPTQKDLYRDVMLENYSNLVSVGYVASKPGALSRLEQGELWTTEHEIPSRICPEIKKD

SEQ ID NO: 26430 - protein, 81 aa, Delphinapterus leucas
PALGSVTFEDVAVYFSQEEWRLLDEAQRFLYHDVMLETFALAASLGLSSSRYHVVQLELRGEPWVHDRVDMTPDRARGAQI

SEQ ID NO: 26431 - protein, 81 aa, Carlito syrichta
SFETVTFKDVAVDLTQEEWEQMKPAQRNLYRDVMLENYSNLVIVGCQITKPDVIFKLEQEEEPWVMEEVFGRPCPVWEVDE

SEQ ID NO: 26432 - protein, 81 aa, Carlito syrichta
WSQMPVTFEDVALYLSQEEWGRLDHTQQNFYRDVLQKRNGLSLGFPFGRPFSPQVQDKGEAAGSSGQTGDGKEEKRGVCAA

SEQ ID NO: 26433 - protein, 81 aa, Carlito syrichta
QPQEAMTFKDLEVTFSQDEWEWLDSTQRNLYRDVMLENYRSVASLVGPFTKPAIISWLEAREPWGLNIQAAQPNANPGSTP

SEQ ID NO: 26434 - protein, 81 aa, Carlito syrichta
MMENYKNLATVGCQIIKPSLISWLEQEESRTVQGGVLQGWEMPLETKLSALEQDFSEGETSIGIQTEGSQNGGELCDNKQC

SEQ ID NO: 26435 - protein, 81 aa, Delphinapterus leucas
QSLVTFEDVAVHFSKEEWGLLDAAQRQLYHSVMLENLELMTSLGCWHGVEDEEVCSKQDASVDVVSQVRIFSAHSSTQKAD

SEQ ID NO: 26436 - protein, 81 aa, Carlito syrichta
ASVMVTFDDVALYFSEQEWGILEKWQKEMYKQEMKTNYETLDSLGYAFSKPDLITWIEQGRMLLIRDRGCLEETRMTVSPS

SEQ ID NO: 26437 - protein, 81 aa, Carlito syrichta
PKVPVTFDDVAVYFSEQEWGKLENWQKELYKHVMRGNYETLVSLDYAISKPDILTRIERGEEPCPEDQWGQEKGNEAEATH

SEQ ID NO: 26438 - protein, 81 aa, Delphinapterus leucas
EEVPVVFEDVAVYFTREEWGTLDKQQKELYRDVMRMNYELLASLGPAAAKPDLISKLERRAAPWIKDPNGPKWGKGRPPGG

SEQ ID NO: 26439 - protein, 81 aa, Carlito syrichta
EEMPLTFQDVAVYFSQAEGQQLGPQQRALYRDVMLENYGNMASLGFPVPKPELISQLEQGEELWILDLLGAEESEVLKSFQ

SEQ ID NO: 26440 - protein, 81 aa, Carlito syrichta
EMGLLSFKDVAIEFSSEEWECLDSPQRILYRTVMLENHRNLVFLGLAVSKPDLIMCLEQRKETWDVKRNGTLAKLPAVTSY

SEQ ID NO: 26441 - protein, 81 aa, Delphinapterus leucas
MLENYSNLLSVGFQASKPNVLSKLGQGEPWTMEDEIHCQTRSEIWKVDDHLLEHLQNESMEKRLEKWHEQNPLEYFVHQSR

SEQ ID NO: 26442 - protein, 81 aa, Saimiri boliviensis
KPVTFEDVAVNFTQEEWDCLDASQRVLYQDVMSETFKNLASVARMFLHKPELITKLEQQEKQWRVFLHLPNTEGLSEGKKK

SEQ ID NO: 26443 - protein, 81 aa, Cervus elaphus
SQDLVTFEEVSVDFSQEEWALLAPAQKILYRDVMLENFRNLASVGYHLCKHSPITEVAQEELRPEGRGILQSACTDGATQL

SEQ ID NO: 26444 - protein, 81 aa, Cervus elaphus
GQGPVTFEDVAVYFSREEWGLLNLTQRSLYRHVMLENFALIGSLGFAPSKSPKVAQMEGEEEAWVPNMVDSVVSRAEARKG

SEQ ID NO: 26445 - protein, 81 aa, Cervus elaphus
QRETRSQVSVTFEDVAVLFTRDEWRKLAPSQRNLYQDVMLENYSNLVSLGLPFSKPEVISLLQQGEDPWKVEKEGPEGPSL

SEQ ID NO: 26446 - protein, 81 aa, Colobus angolensis
MTFEDVAVEFTQWEWGQLNPAQKDVYREVMLENFRNLAFLGLLVSKPYVICQLEEGGEPFIVERDVSTGAHSDWERRSKSN

SEQ ID NO: 26447 - protein, 81 aa, Colobus angolensis
LAFREEWRHLDLSQRNLYRDVMLETYSHLLSVGYQVPEAEVVMLEQGKEPWALQGERPRQSCPGEKLWDHNQCRKILSYKQ

SEQ ID NO: 26448 - protein, 81 aa, Colobus angolensis
EEALMAFRDVAVAFTQKEWKLLSSAQRTLYREVMLENYSHLVSLGIAFSKPKLIEQLEQGNEPWREENEHLLDLYLEPRTE

SEQ ID NO: 26449 - protein, 81 aa, Colobus angolensis
THGQLLFRDVAIEFSQEEWKCLNPGQKALYRDVMLENYRNLVSLGICLPDLSVISMLEQKRDPWTLQRDVKIANNPNGREY

SEQ ID NO: 26450 - protein, 81 aa, Colobus angolensis
MGPLQFRDVAIEFSLEEWHCLDTAQRNLYRNVMLENYRNLVFLGIVVSKPDLITCLEQGEKPLTMKKHDMVTNPSETGFHH

SEQ ID NO: 26451 - protein, 81 aa, Colobus angolensis
FQASVSFKDVTVEFSQEEWQHLGPVERTLYRDVMLENYSHLISVGHCFTKPELIFTLEQGEDPWLLEKEKGFLSRNSPEDS

SEQ ID NO: 26452 - protein, 81 aa, Mustela putorius
MFQVTFSDVAIDFSYEEWGWLDSAQRDLYKDVMVQNYENLVSLGLSIPKPYVITLLEDGKEPWMVEKKDWESRWENKELVT

SEQ ID NO: 26453 - protein, 81 aa, Mustela putorius
ESVSFTDVTVDFTQEEWEQLDPSQRILYMDVMLENYSNLLSVEVWKADDQMERDRSGPDEQARPFIIFKNQTPMEERGSLF

SEQ ID NO: 26454 - protein, 81 aa, Tupaia chinensis
LQRFISFEDVTMDFTREEWQDLEDAQKTLYKDVMLETYSNLVFLGYCIAKPSVILKLEQGGDPWTLEECPILSLTGEKPYE

SEQ ID NO: 26455 - protein, 81 aa, Tupaia chinensis
MAFRDVAVAFTQEEWRLLSSAQRTLYREVMLENYSNLVSLGPKPDVHLSVSCPLDFSSEKFPMQHELCNHHPWIFTCLCAE

SEQ ID NO: 26456 - protein, 81 aa, Tupaia chinensis
MLENYRNLASLGLCVSKPDMISSLEQGREPWMLKKMMTRGRGSDLKAMQETKEVPPKKDLCEEKLSQAVITEKLTNCSLEY

SEQ ID NO: 26457 - protein, 81 aa, Tupaia chinensis
FSGFISFKDVAMDFTREEWQDLEDAQKILYKDVMLETYSSLMFWGQSIAEPAVIFKLEQGGEPWTLEELPSLSLPGEKPCE

SEQ ID NO: 26458 - protein, 81 aa, Carlito syrichta
PHWLVTFKDVAIDFSQEEWECLDSAQRNLYRDVMLENYSNLISLDLESICEPKKSFPEWGIYEMKSLQWQNMRKLINHNLQ

SEQ ID NO: 26459 - protein, 81 aa, Erinaceus europaeus
SLGADLFRDVAVVFSQEEWEQLAPAQRNLYRDVMLETYSNLVSLGLAVSKPDVIYFLEQGREPWRSKKAVNRGPSPVLESR

SEQ ID NO: 26460 - protein, 81 aa, Ornithorhynchus anatinus
SQGLVTIKDVSLCFSQEEWGSLDPGQTDFYGEYVMQENCGIVVSLRFPIPKLDGFSQVEGGEDQWMPDSQDSEILRVTYPG

SEQ ID NO: 26461 - protein, 81 aa, Tupaia chinensis
MASPSPSPDPKEEWDYLDPAQRSLYKDVMMENYGNLVSLDVLNRDKDEEPTVKQEMEEIEEEVEPQGVIVRRIKSEIDQDP

SEQ ID NO: 26462 - protein, 81 aa, Vicugna pacos
MGPVTFEDVAVSFSQEEWGLLSDAQRLLYHDVMLDTLSLLASLAWTVGAADSLMSWHLAVSPSCVRAVSPEAVRRRRWAPR

SEQ ID NO: 26463 - protein, 81 aa, Carlito syrichta
MLETYSSLVFLGHCIARPEVIFKLERGAEPRTVEERPKQNSDVQIVNDIIERNLETHGRHLWQVVITNSKTSTEERVELGK

SEQ ID NO: 26464 - protein, 81 aa, Carlito syrichta
MFTQEEWGQLDLTQRSLYLEVMLDTCGLLVSLGDSAEPSTTEPPSCHFTLPEKVSLQEQLTQGASRDSQLGQAKVQDGPSE

SEQ ID NO: 26465 - protein, 81 aa, Carlito syrichta
SQESVTFEDVAVYFTKKEWASLVPAQRALYRDVMLENYGAVAFLVPHTSKPALISQLEQGKEPWFSKPQGALSRKGQRAGS

SEQ ID NO: 26466 - protein, 81 aa, Delphinapterus leucas
QGLLTFRDVAIEFSQEEWECLDPAQRALYRDVMLETYGNLLSLDISISFLTKELLKKKNINNRELYQPVVLGRHGSCGIED

SEQ ID NO: 26467 - protein, 81 aa, Gulo gulo
SQGSVSFEDVSVDFTQKEWQLLDPAQRLLYREVMLENYRQLVSLGHCVTTPGLILKLEQGEEPWVPKRKLPSPSRPEVQKT

SEQ ID NO: 26468 - protein, 81 aa, Gulo gulo
PLESVTFEDVVIDFTKEEWALLDISQRKLFRDVMLENIRHLVSLGYQHCKSDLIFQLEQGQELWSEGTGFLRGQSPGRGSA

SEQ ID NO: 26469 - protein, 81 aa, Erinaceus europaeus
FWVPVTFDDVAVYFSEQEWGKLDEGQKELYKHVMRGNYETLVSLDYAISKPDLLARIERGEEPCSQEDSLEEVAEPRQSGA

SEQ ID NO: 26470 - protein, 81 aa, Erinaceus europaeus
PQESLTFEDVAVDFTQEEWHHMNPAQRCLYKDVMLENYSHLVSLGYQVSKPEVIFKLEQGEEPWISEGEIQRTLCPDWKTR

SEQ ID NO: 26471 - protein, 81 aa, Ornithorhynchus anatinus
GSQPVLFEDVAVSFSREEWECLDPSQKVLYQDVMGENYRNVVLLGIPCPEVDLKTWIEFSEEPGGPNLPTVEEGENARTAP

SEQ ID NO: 26472 - protein, 81 aa, Ornithorhynchus anatinus
LQMAVTFEDVALYFSLEEWAHLDSSQRKLYRNVMWENYKNVVSLGILLPKPDLIALIEQGEELWGLEFHVAKERGSPKAIR

SEQ ID NO: 26473 - protein, 81 aa, Colobus angolensis
SLGSVTFTDVAIDFSQDEWEWLNLAQRSLYKKVMLENYRNLVSVGLCLSKPDVISLLEQEKDPWVIKGEMTRGLCPDILKM

SEQ ID NO: 26474 - protein, 81 aa, Colobus angolensis
MELFTFRDVAIEFSPEEWKCLDPAQQNLYRDVMLENYRNLVSLGFVISNPDLVTCLEQIKEPYNWKIHETAAKPPAVCSPF

SEQ ID NO: 26475 - protein, 81 aa, Colobus angolensis
YQTPVSFKDVVVGFTQEEWHWLSPAQRALYRDVMLETYSNLVSVGYEGTKPDVILRLEQEEAPWIGEAACPGCHCWGISKL

SEQ ID NO: 26476 - protein, 81 aa, Colobus angolensis
MGLLTFMDVAVEFSLEEWQCLDTAQQNLYRNVMLENYRNLVFLAMCSHFAKGLRPEQYIKNSFQQMILRRYGKCGYQNLQL

SEQ ID NO: 26477 - protein, 81 aa, Colobus angolensis
QGRLTFRDVAIEFSFMEWKCLNPAQRALYREVMLENYRNLDFVDSSLKSMMELSSHEHSNTGEGFYTGTLERCKSYHIGDF

SEQ ID NO: 26478 - protein, 81 aa, Colobus angolensis
MYFSQEEWELLDSTQKALYNEVMQENYETVISLALFVLPKPKVISCLEQGEEPWVQVSPEFKDSAGKSPTGLKLKNDTENH

SEQ ID NO: 26479 - protein, 81 aa, Colobus angolensis
KEAFVAFRDVAVDFTQEEWRLLSPAQRTLHREVMLETYNHLVSLEIPSSKPKLIAQLEQGEEPWREERKCSLDLCPESKPE

SEQ ID NO: 26480 - protein, 81 aa, Colobus angolensis
FEELVTFEDVFVDFSPEELSSLSAAQRNLYREVMLENYRNLVSLGYQFSKPDIISCLEAEESHAVETDSRHRVICQRQSHD

SEQ ID NO: 26481 - protein, 81 aa, Colobus angolensis
PQSLLTFRDVAIEFSQEEWKCLDPAQRTLYRDVMLENYRNLVSLDISSKCMLKTLSSTGQGNTEVILTGTLQRQANHHTRD

SEQ ID NO: 26482 - protein, 81 aa, Delphinapterus leucas
PHWLVTFRDVAINFSQEEWECLDPIQRDLYREVMVENYSHLISLAGCSIPKPDVFSLLERGKEPWMVVRAMTRWSSGSGRA

SEQ ID NO: 26483 - protein, 81 aa, Carlito syrichta
MGLLSFKDVAIEFSPEEWECLNSPQRILYRTVMLENHRNLVFLGLAVSKPDLIMCLEQKKEPWDMKRHGTLVKLPAVTSHY

SEQ ID NO: 26484 - protein, 81 aa, Carlito syrichta
TQGSVTFEDVAIYFSQEEWGLLDEAQRFLYRDVMLENFALITSLVCWHGKEDEEIPSEQSVSLEGMSQIRTPKASPSTQKT

SEQ ID NO: 26485 - protein, 81 aa, Carlito syrichta
LLQGSLTFDDVLLDFTWEEWQLLGPDQKDLYRDVMLENYSNLVSLGCQASKSDALSMLEREETWTTEDEIRSQVCAEIRKI

SEQ ID NO: 26486 - protein, 81 aa, Carlito syrichta
SLVLVSFEDVAVDFSLEEWQDLDSAQKTLYRDVMLETYSSLLSLGHCMTKPEVIFRLEQGAEPWTVCEPSHRSLSDVQKVD

SEQ ID NO: 26487 - protein, 81 aa, Carlito syrichta
MEVVTFGDVAVHFSREEWQCLDPGQRALYREVMLENHSSVAGLGFLVFKPELISRLEQGQEPWFLDLQGAERTETPRTSKT

SEQ ID NO: 26488 - protein, 81 aa, Gulo gulo
QGSVTFRDVAIDFSQEEWEWLQPAQRDLYRHVMLENYGHLVSLGLNISKPYVVSLLEQGRDPWLEKDVRRDLFSESSGEIR

SEQ ID NO: 26489 - protein, 81 aa, Erinaceus europaeus
KPAAVRFADVAVYFSPEEWGCLRPAQRTLYRDVMRETYGHLGALGFPGPKPALISWMEQESEVWSPAAQDPEEGESLGGAR

SEQ ID NO: 26490 - protein, 81 aa, Erinaceus europaeus
SKAPVTFGDLAVYFTQAEWEWLSPVQKALYQDVMLENYQVLVSLGLCLRRPNLISLLEKGKAPWVAEPVRRRRGPDSASKF

SEQ ID NO: 26491 - protein, 81 aa, Erinaceus europaeus
QDTVIFEDVAVNFTPDEWALMDHGQRKLYRDVMLETCRNLALVDCCTQVKSSVSSLRHEILKSNICSEKNIVILTRNDSWY

SEQ ID NO: 26492 - protein, 81 aa, Tupaia chinensis
MSFEDVAVDFTWEEWQDLEDVQKILYKDVMPATYGSLMSLGHCIAKPAVIFIVYHRVLQTVHTNIQKLRYGVSELMVTAAY

SEQ ID NO: 26493 - protein, 81 aa, Tupaia chinensis
PKVPVTFDDVAVYFSEQEWGRLEDWQKELYKHVMRGNYETLVSLDYAISKPDILTRIERGEEPCPGDLWGQEKGDEEDSAR

SEQ ID NO: 26494 - protein, 81 aa, Tupaia chinensis
FQEMVTFRDVAVVFTEEELGLLDSAQRTLYRDVMLENFQNLLSVDHQPFKPDLISQLEREEELLMVETETQRAGCSDHQPF

SEQ ID NO: 26495 - protein, 81 aa, Vicugna pacos
TVTFKDVAVVFTEEELALLDKAQINLYQDVMLENFRNLVSVGDRIKNNISNLQEKGLSYLSQEVLYFWQIWKQRISEFTVS

SEQ ID NO: 26496 - protein, 81 aa, Vicugna pacos
FRGPVTFKDITVEFTREEWQLLDAAQRTLYREVMQENYRHLISVGYRVNRPNAVFKLKQGKEPWILEVEFPHRNYPEDLWN

SEQ ID NO: 26497 - protein, 81 aa, Vicugna pacos
SQESVTFEDVAVDFTQEEWALLDTSQRKLFRDVMLENISHLVSVVISDREDDLKKQMISMQHINKKDAPLIRTVQSSHTQE

SEQ ID NO: 26498 - protein, 81 aa, Vicugna pacos
AQGSLTFRDVAIDFSQEEWEWLQPAQRDLYRHVMLENFGHLVSLGLNISKPDVVSLLEQGREPWLGKGDMSRGLFPASESN

SEQ ID NO: 26499 - protein, 81 aa, Vicugna pacos
KDQGSLTLEDVAVDFTWEEWQLLAPAQKALYRDVMLENYSHLVSVGYQASKTDVLSRLGRGELWTVEDEVCGHICPEMRKG

SEQ ID NO: 26500 - protein, 81 aa, Vicugna pacos
SCEGSVSFRDVAVDFSREEWQQLDLDQKILYRDVMLETYSHLLSVGYQVPEPEVFMLEQAEEPWAMQSESLRQSCPEEFWQ

SEQ ID NO: 26501 - protein, 81 aa, Vicugna pacos
SQHLVTFEDVAVNFTQEEWTLLDQTQRDLYRDVMLENYQNLMALAGSESCKPHVNSPLEGAEELRTRARRILQKSDLQLKT

SEQ ID NO: 26502 - protein, 81 aa, Vicugna pacos
SQGLFTLKDVAIEFSQEEWECLVPAQRALYRDMMLETCRNLLSLGEENVPPEVAGSLSAGFAIKELVPREAIHKEELYHLV

SEQ ID NO: 26503 - protein, 81 aa, Odobenus rosmarus
VTLEDVAVYFSWEEWGLLDEAQRRLYHDVMLENLALITSLENEEVPSGQNVFLGRMPQIRSSEPNPSTEKVHFCEMCVSVM

SEQ ID NO: 26504 - protein, 81 aa, Odobenus rosmarus
ARGLVTFEDVAVYFSREEWGLLNLTQRSLYRDVMLENFALIGSLGFAPSRSHVVAQLESEEELWVPSMVDLTLGSRAEARR

SEQ ID NO: 26505 - protein, 81 aa, Odobenus rosmarus
AQESLTLEDVAVDFTWEEWQLLAPAQKDLYRDVTLENYSNLVSVGYQASKPDALSKLERGEEPCAKQEEVPSGTRPEPSKV

SEQ ID NO: 26506 - protein, 81 aa, Carlito syrichta
AAGSVTFKDVTMAFTQKEWKQLDPAQRNLYKNVMLENYSNIASMGCQASKPDIISKLEKGEEPWLGKEKRPSQGHLSKTAG

SEQ ID NO: 26507 - protein, 81 aa, Carlito syrichta
FQESVTFQDVAVDFTPEEWQLLGGAERTLYWDVMLENYRNLVSVGSPVAKTEVTLKVEQGQKPWLVEEENPHWSHPEADCP

SEQ ID NO: 26508 - protein, 81 aa, Carlito syrichta
SCEPVAFDDVTLGFTPEEWGLLDLKQKSLYREVTLENYRNLISVEHQLSKPDVVSQLEAAEEFWPVKRVPQDIVPECPGPQ

SEQ ID NO: 26509 - protein, 81 aa, Gulo gulo
AQGLVTFRDVAIEFSQEEWKCLEPAQRDLYRDVTLENFSNLASLGLSISKPDVISLLEQGREPWMITSDMTGPWCPELESR

SEQ ID NO: 26510 - protein, 81 aa, Erinaceus europaeus
SEGSISFKDVTMDFSIEEWQCLDSSQRRLYREVTLENYGHLLSLGYTSPKPEIVCKLEKGEEPWVLEEEAPHQSYSDEKFE

SEQ ID NO: 26511 - protein, 81 aa, Ornithorhynchus anatinus
MPKPELISSLEQGEEAWFPAPQEYEKIPRPSPTEPELRSETKKEVPGQPVHLEELVPGATLSENSNKEVPKRTESAEVQAS

SEQ ID NO: 26512 - protein, 81 aa, Mustela putorius
LQEPVTFRDVAVDFTQEEWGQLGPAQRTLYRDVMLETFGHLLSVGPELPKPEVISQLEQGTELWAAERGIAQGYYPGWESG

SEQ ID NO: 26513 - protein, 81 aa, Mustela putorius
SKVLVTFGDVAVDFSQEEWKWLNPAQRNLYRKVMLENYRSLVSLGVSVSKPDVISLLEQGKEPWMVKKEGTRGTCPDWEYT

SEQ ID NO: 26514 - protein, 81 aa, Mustela putorius
SQELVTFEDVAVYFIRKEWKRLEPAQRDLYRDVMLENYGNVFSLDGETRTEHDQEISEDTGSHGVLLGRFQKGISQGLKFK

SEQ ID NO: 26515 - protein, 81 aa, Tupaia chinensis
MLEIYSSLVFLGHCIAKSAVIFKLEQGGEPWTLELCNQKLPVHLRSTESYASKEKSFFRASDGAVSQRIFTREKPYEYNKC

SEQ ID NO: 26516 - protein, 81 aa, Tupaia chinensis
MVLLLLLDEWQQLDPCQRSLYRDVMLENYSHLVSVGFCVTKLEMIFRLEQGEEPWILEEEFPSQTFQISQSAMYSRKAMYK

SEQ ID NO: 26517 - protein, 81 aa, Tupaia chinensis
GSVSFTDVTVDFTQEEWEQLDPSQRVLYMDVMLENYSNLLSVEVWKADDQMEKKDQRNPDQPAKQFLILKNQTPIEERGNL

SEQ ID NO: 26518 - protein, 81 aa, Vicugna pacos
MFQVTFSDVAIDFSHEEWGWLDSAQRDLYKDVMVQNYENLVSLGLSIPKPNVIALLEEGKDPWMVERKLSTDWDSRWENKE

SEQ ID NO: 26519 - protein, 81 aa, Delphinapterus leucas
GQGSVSFKDVTVDFTWDEWLQLTCMQRTLYQDVMLENYSHLVSVGYCVSKPEVIFKLEQGEEPWPLERAFPCRSDPAQGTI

SEQ ID NO: 26520 - protein, 81 aa, Delphinapterus leucas
PGIYLFRREQKMMKSQEEWQQLDPAQKTLYRDVMLENYSHLVSMGHPVSKPDVISKLEQGEDPWIIKRDIPNWIYPYEDQA

SEQ ID NO: 26521 - protein, 81 aa, Gulo gulo
MLENYSNLVSLGIPFPKPTLVILLEQGEEPWTEEGEALPSSCTADAKPEIQLGSSSALDFCSWQRQHRLPICPGLLAGTLC

SEQ ID NO: 26522 - protein, 81 aa, Gulo gulo
VEDHVTFEDVAVHFSWEEWGLLDEAQRLLYRDVMLENFALMASLGLASSSARAVTQLEWWREPFVPPCAVLTAAAPRGWRR

SEQ ID NO: 26523 - protein, 81 aa, Gulo gulo
CQKSVTFEDVAVIFTDEEWRHLVPIQRDLYKEVMLENYKSIVSLGLPVPQPDVIFQLKRGDEPWVVDLHGSEERECPENVS

SEQ ID NO: 26524 - protein, 81 aa, Gulo gulo
MLENFRNLVSVGNQPFKPDLIFQLEREEKLLMMEMETETQRDGYLGAKSQHNMESSQEVGLHYISPKEVSSRQTWQQGAGG

SEQ ID NO: 26525 - protein, 81 aa, Gulo gulo
QDSVTFEEVAVDFSQEEWALLDPAQKTLYRDVMLENYRNLASVGYPLCKHSLITEVEQEVLGTEEGAILQGACTDWDIQLK

SEQ ID NO: 26526 - protein, 81 aa, Erinaceus europaeus
MDAISSEDVTVNFSQEEWELLNPSEKKLYNDVMWEIFHNLVSIGKLLEDSFIEQSEDQEGSKQRNIEDKTSEKKEGSLYRE

SEQ ID NO: 26527 - protein, 81 aa, Ornithorhynchus anatinus
VPVTFVDIAVYFSEDEWKNLDEWQKELYNNLLRENYKTLMSLGEDPEESVPKPDTLSRAEPRDESCAWEQNEPQAREIPMD

SEQ ID NO: 26528 - protein, 81 aa, Ornithorhynchus anatinus
NFWILRLPPATNGEVPKELGNLDQGQKELYKNVMKGNYETLVSLDYAISKPEILSRLEQGKEPCDVDRRGSKGPAAPSDSS

SEQ ID NO: 26529 - protein, 81 aa, Mustela putorius
RSQDSLTFQDVAVNFTREEWNQLYPAQKILYRDVMLENYRNLVALGHQLYKPEVISQLEKEEQRGMERDSAVDAHADGESR

SEQ ID NO: 26530 - protein, 81 aa, Mustela putorius
FSFEDLSVDFTQKEWQLLDPSQKDLYRDVMLENYSSLVSLGYEVVKPEVIFKLEQGEEPWTGDGEAPSTGGPEQVLQVNGH

SEQ ID NO: 26531 - protein, 81 aa, Mustela putorius
GCQGLLTFSDVALEFSDDEWGRLTHSQRQLYRDVMLENYGHLLFLGLLLSKSDLIIYLEQEKVLWDVKRKETGGFHPGRWE

SEQ ID NO: 26532 - protein, 81 aa, Mustela putorius
SQESVTFQDVAVDFTEKEWPLLDSSQRKLYKDVMLENYSNLASVGYQVGKPSLISHLEQEEELRTEERTRHRATSPDWETP

SEQ ID NO: 26533 - protein, 81 aa, Mustela putorius
VTFTDVAVNFTREEWALLDSRQRILYRDVMLENCRNLASLDLLKQHQTKNSTPQPDILAKKTPVEAKRVCTVSHASQQSLL

SEQ ID NO: 26534 - protein, 81 aa, Mustela putorius
ARGLVAFEDVAVYFSREEWGLLNLTQRSLYRDVMLENFALIGSLGFAPSRSHVVAQLESEEELWVPNMVDLTLGSRTESRR

SEQ ID NO: 26535 - protein, 81 aa, Vicugna pacos
PQDLVSFKDVAIDFSQEEWEWLSPAQRRLYRRMMMENYQNLLSLGLCTSKPYVISLLEQGKEPWGMKSEVRNPFSDWDSVC

SEQ ID NO: 26536 - protein, 81 aa, Vicugna pacos
CEGSVSFEDVTMDFSREEWQQLDPAQRRLYQDVMLEIYSHLFSVGYHIPSPEITVRMGKGKEPRMGEADLPQHRCPGELGL

SEQ ID NO: 26537 - protein, 81 aa, Vicugna pacos
MLENYFNLISVGCQVPKPEVIFNLELGEEPCMLDDGTSSQSCLDQSIGFETSQQGMSEEVSVHFERMNLFTRDDPYSVLEE

SEQ ID NO: 26538 - protein, 81 aa, Vicugna pacos
SMTFEDVAVHFSWEEWRPLDDVQRHLYLSVMLENFALMSSLGCCCATENTESPFQSSVSIDMSPAKTPKANQSSQKSHPCE

SEQ ID NO: 26539 - protein, 81 aa, Vicugna pacos
MVADCVRNRPQDSVTFADVAVGFTQEEWILLDSFQRNLYRDVMLENYKNLTTAGYQWFKPTLISWLEQEELRTEERGAVQG

SEQ ID NO: 26540 - protein, 81 aa, Vicugna pacos
RGSLSFRDVAVVFTWEEWQLLDLIQKNLYQDVMLENYSNLVSVEDTWQADSHRDWHEENQGNLETMGSHHEANTFGKIPSL

SEQ ID NO: 26541 - protein, 81 aa, Odobenus rosmarus
SPGAVSFADVAVYFSPEEWGCLRPAQRALYRDVMPETYGLLGALGFSGPKPAFISWVEGEVEAWSPEAQDPEGETPAAVTR

SEQ ID NO: 26542 - protein, 81 aa, Delphinapterus leucas
IQGSLTFGDVAVAFTQIEGRHPDAAQRALYRDVILENYGNLVFVGLLSSKPKLITQLDAEEPRMEVAGVPSGTYTVQEYIF

SEQ ID NO: 26543 - protein, 81 aa, Carlito syrichta
MLDNFRNLATLGFRSSRPDFVFHREQWDEPWVEDWGRPEFQKVQRGPCPGARKSLAHKRHCDRLTWAHEKIHMRERVKEGG

SEQ ID NO: 26544 - protein, 81 aa, Delphinapterus leucas
GQLTLNDVVIEFSQEEWECLDPAQRALYRDVMLETYRNLIFVDISHIHVIKKLQLKSNTDKGGVFQTLMLERHESQGIKHF

SEQ ID NO: 26545 - protein, 81 aa, Gulo gulo
RQEPVTFEDVAVYFTQNEWVILDPSQRALYREVMLENYANVASLAFLFTRPVLVSQLERGELPWGLEPWEPAGRETLRGIC

SEQ ID NO: 26546 - protein, 81 aa, Gulo gulo
DEALMAFRDVAVAFTQKEWKLLSPAQRTLYRDVMLENYSHLVSLGIAFSKPKLITQLEQGDEPCREESECLLDLCPADPGT

SEQ ID NO: 26547 - protein, 81 aa, Erinaceus europaeus
VTFEDVALHFSWEEWELLDEAQRLLYCSVMRDNFALAASLDCWHAVASEETPSEQSISVKGESHIRTLEVVATSPQKTQPL

SEQ ID NO: 26548 - protein, 81 aa, Erinaceus europaeus
MLETYGHLLCVGSQTVKPKVISLLERGAEPWPVGQAAAPGSCPEWMRNLESKALLTPQNAFEEEQSHSMRLERYIWNDPWF

SEQ ID NO: 26549 - protein, 81 aa, Delphinapterus leucas
SRDSVTFADVAVDFTQEEWTLLDPIQRKLYRDVMLENYKNLTTAGYQSLKPTLISWLEQEDDLRTVERRGVLQGSAIQQDN

SEQ ID NO: 26550 - protein, 81 aa, Carlito syrichta
MTEDFVTLKDVAMDFTCEDWEHLGLDQEGLFWDMALDNYQDLFLLNPSKPNLTSHPDDREELEALVRGSPEATPDVAETKN

SEQ ID NO: 26551 - protein, 81 aa, Carlito syrichta
AGPQGSTSFSSVTVAFAQDRWRYLVPTPRDRFKEGISETSRNLFLLVSQPRMNSQLEQREGPWMLEGEDLRSTCPDWKTVS

SEQ ID NO: 26552 - protein, 81 aa, Carlito syrichta
MLENYGAVASLAFPFPKPALISQLEQEEAPWCSTFWGAVNGEGLSGISSGYPFLKPAGVSHLEQVEESLNLKLQGKGPSLI

SEQ ID NO: 26553 - protein, 81 aa, Carlito syrichta
MLENYRNLVSLGISLSDLNIISMLEQGKEPWTVESQMQIARKPNRGEWIKGVNSDISPKCVIKELPTIENRDAVETFQTVM

SEQ ID NO: 26554 - protein, 81 aa, Carlito syrichta
AVVSVTFDDVAVTFTQEEWGQLDPAQRTLYQEVMLENCGLLVSLGCPVPRPELIYQLEHGQELWTDKKDLFQGTCLGDEAK

SEQ ID NO: 26555 - protein, 81 aa, Carlito syrichta
VSFEDVAVYFTQEEWTLLDSAQRDLYRDVMLETCENLASIGNLLNHSVMYWLEGEENLGTVQEGDPQEWRLKTKGSTLRPD

SEQ ID NO: 26556 - protein, 81 aa, Delphinapterus leucas
QPQEAVTFKDVEVTFSQDEWGWLDASQRNLYRDVMLENYGNVTSLVGPFTKPALISWLEAREPWGLNVQGAHPKGSPSAAP

SEQ ID NO: 26557 - protein, 81 aa, Gulo gulo
SQESVTFQDVAVDFTEKEWPLLDSSQRKLYKDVMLENYSNLASVGYQVGKPSLISHLEQEEEPRTEERTLHRATSPDWETP

SEQ ID NO: 26558 - protein, 80 aa, Gulo gulo
LQGLLTFRDVAIEFSQEEWGAAAAAAAELYRDVMLENYGHLLFLGLVVWKPDLVIFLEQEKQLWDVKRKESVAFHPGRWE

SEQ ID NO: 26559 - protein, 81 aa, Erinaceus europaeus
SLGTVSFEDLAVTFTLEEWRQLDGAQRSLYREVMLETYSSLAVVGHCRSKPEVIVKLEQGAEPWTVGDPPPRSLSDTLDDP

SEQ ID NO: 26560 - protein, 81 aa, Tupaia chinensis
LQESLTLEDVAVEFTCEEWQLLDPAQKDLYRDVMLENYGNLVSLGYQYRKPDVFSKLERGEEPWAVEDEIQSQVCPENGKD

SEQ ID NO: 26561 - protein, 81 aa, Vicugna pacos
LSFEDVALYFTREEWSRLDWAQKDLYRDVMLENYRNMIVLGSETRFKMRELTPKQNISEDLESHKISVVKQKKAKKPSEEL

SEQ ID NO: 26562 - protein, 81 aa, Vicugna pacos
AQGPVLFEDLAVYFSQEECVSLHPAQRSLSRDTAQECFMDNALMGEGKIEINQQLSLESMGLEELALEKYSITVPLVYCPE

SEQ ID NO: 26563 - protein, 81 aa, Carlito syrichta
CWGLLSFKDISMEFTWEEWQLLDSTQKYLYRDVILENYNNLVAVGYHGTKPDLIFKLEQGEEPWIINATISSQNCPEDWEE

SEQ ID NO: 26564 - protein, 81 aa, Delphinapterus leucas
EQLTFKDIDIEFSQEEWECLEPAQQALYRDVMLETYRNLLSLDISPTHVIKKLQLKVNTGRGEVLQTVMLGRHERNKVKRF

SEQ ID NO: 26565 - protein, 81 aa, Delphinapterus leucas
LVMFKDVAIDVSQEEWECLNPAQRNLYKDVMLENYSNLVSLDLVSKCEAKKLSPKRNIYETESSQWAIMEPFKSHSPEKSI

SEQ ID NO: 26566 - protein, 81 aa, Carlito syrichta
SQGSVTFRDVAIDFSQEEWKWLQPAQRDLYRCVMLENYGHLVSLAGLSVSKPDVVSLLEQGKEPWLGKGDVRGDLFSVSNC

SEQ ID NO: 26567 - protein, 81 aa, Carlito syrichta
MGLLTFRDVAIEFSPEEWECLDPTQRILYRNVMLENHRNLVSLGLAVSKPDLITCLEQRKEPWSVKRYSTLAKPLVVSGCF

SEQ ID NO: 26568 - protein, 81 aa, Carlito syrichta
MTFSDVAVDFSQQEWECLDPVQKTLYRDVMMENYGNLVSLGHSISKPDVIALLEQGKEPWVVTKEETRRCCTDLESRYEII

SEQ ID NO: 26569 - protein, 81 aa, Carlito syrichta
RETFMTFGDVIVDFTQKEWRLLNPAQRTLYREVMLENYSHLVSVEIAHSKPEFIRLLEQGRAPWEDKKRQPLGHCAGLYTE

SEQ ID NO: 26570 - protein, 81 aa, Delphinapterus leucas
LKEVVTFKDVAVVFTEEELGLLDSAQKKLYQEVMLENFQNLVSVGHQSFTPDVISQSKREEKLWMIKIATQSRRSLGDKNL

SEQ ID NO: 26571 - protein, 81 aa, Delphinapterus leucas
PKVSRSLENDGVCFSEQEWENLEGWQKELYTNAMKSSYETLVSLMEGVMIKQEIQYTQDGSADLPGEFSGIAEEHALLSPE

SEQ ID NO: 26572 - protein, 81 aa, Delphinapterus leucas
WLQGPVSFEDVTVEFTQEEWVMLDSAQRSMYRDVMLENYMNLTLVEYQLCKPVISLSGQEDIRTVKRRIPQGTCLDWEIQL

SEQ ID NO: 26573 - protein, 81 aa, Carlito syrichta
SQEPVTFADVAVVFTPEEWVFLDPSQRSLYRDVMLENYRNLASVGDHLCKPSTLSHLEQRRGLWTTERGVISDTCPEPQLQ

SEQ ID NO: 26574 - protein, 81 aa, Delphinapterus leucas
VSVNFEDVAVTFSWEEWGLLDEAQRYLYHDVMLENLALITSLGCCHEVENEKASFEQRTSIQRVSQIRSPKANLSFKKAHP

SEQ ID NO: 26575 - protein, 81 aa, Carlito syrichta
TGMSVTFEDVAVMFTQEEWGQLDVTQRTLYWEVMLEICHLLFSLGCPLSKQELIYQLEHSEELWMVKKDTSHNSCPGHSRK

SEQ ID NO: 26576 - protein, 81 aa, Carlito syrichta
WLDAVSFADVAVYFSPEEWGCLRPAQRALYRDVMRETYGHLGALGFSGPKPAFISWVEAEVEAWSPEAQDSEGKSLAAVSR

SEQ ID NO: 26577 - protein, 81 aa, Delphinapterus leucas
LLTFEEVAIYFSQEEWELLDPTQKALYNDVMQENYETVISLEIKMKNDTENHQPICFSDLEIQAPGDIVSKKASVNVHQKT

SEQ ID NO: 26578 - protein, 81 aa, Delphinapterus leucas
EEGRVTFEDVAVYFSQEEWGLLDKTQRLLYRSVMLEIFSLMASLGLTSSRTQEFTQLEQWGEPFVPACGVVITATPRGCWC

SEQ ID NO: 26579 - protein, 81 aa, Gulo gulo
MTIKDVVVSFSRGEWRRLEPFQKELYKEVLLENSRSLEFLGFPVSKLDLISQFKWIELPRLLEKEISKGSRPECEPRGELK

SEQ ID NO: 26580 - protein, 81 aa, Ornithorhynchus anatinus
PLSQPRRGSPSRPGLVTFKDVTMSISQEEWEQLDPDQVDFYGEYVPQENCDFVVSLGKNSPAPHPPILEIREQSRDPTDQG

SEQ ID NO: 26581 - protein, 81 aa, Delphinapterus leucas
PGPVKFEDVVVIFTEAEWKRLSLEQRNLYKEVMLENFRNLVLLDSKPEVHPWPLCFCPLAFDGQQFLSHHELCSHLIPYSY

SEQ ID NO: 26582 - protein, 81 aa, Carlito syrichta
EMGLLSFKDVAIEFSPEEWACLTNPQRIMYWTVMLENHRNLVFLGLAVSKPDLITCLEQRKEPWDVKRHGTLAKLPAVTSH

SEQ ID NO: 26583 - protein, 81 aa, Carlito syrichta
FKGLVTFGDVAIDFSKEEWEYLGPAQRDLYRDVMLENYSCFVSLGLATSKPSVIFLLEQGKEPWMVGEAGWYADLPSRHET

SEQ ID NO: 26584 - protein, 81 aa, Carlito syrichta
FQEAVTFKDVAVAFTEEELGLLDSAQRKLYRDVMLENFRNLVSVGHQFFKPDMISQLEKEEKLWLREFQTPRGRHSGDSHQ

SEQ ID NO: 26585 - protein, 81 aa, Delphinapterus leucas
MTLSQALLTFRDVAIEFSQEEWECLDPAQRALYRDVMLENYRNLVSLDMSTRCVIKELSPKQDINNGDLFQTLAFERLGFP

SEQ ID NO: 26586 - protein, 81 aa, Carlito syrichta
FQETVTFKDMAMVFTQEDLGLLDSAQRKLYQDVVLENFGNLLSVGYQPFSLDMVLWLVREEKFSMMETETQGDGYSGHRNQ

SEQ ID NO: 26587 - protein, 81 aa, Gulo gulo
QAMVKIEDMAVSLILEEWGCQNLARRNLNRDNRQENYGNVFSQGCENRSENEESTSKAEIAEDSASRGEPTGRFQKDFGEK

SEQ ID NO: 26588 - protein, 81 aa, Gulo gulo
QSRGPLSFVDVFVDFTWEEWRLLDPSQKHLYRSVMLENYSNLVSLGYQDSKPDIIFKLEQEEPWMMPAQIPSQGHPEKVGG

SEQ ID NO: 26589 - protein, 81 aa, Gulo gulo
PPDSVTFMDVAIDFSQDEWEWLNLAQRALYKKVMLENYRNLLSLGLCLSKPDVISLLEQGREPWMLEGEMTRGLCSDLEYV

SEQ ID NO: 26590 - protein, 81 aa, Colobus angolensis
IQGQVNFEDVFVYFSQEEWVLLDEAERLLYRDVMLENFALTASLGYTSFMSHIVASLVMGSEPWVPDWVATETPGGSCWRG

SEQ ID NO: 26591 - protein, 81 aa, Colobus angolensis
DSISLEDVAVNFTLEEWALLDPGQRNIYRDVMRATFKNLACIGEKWKDQDIEDDPKNQGRKLSSPTVETLCENKDDHPCEK

SEQ ID NO: 26592 - protein, 81 aa, Tupaia chinensis
NCVTFEDVAIYFSREEWDLLDESQRLLYLDVMMENFTLVNSLVCCHGMQDEVTPEQSVPVERVSRVWTPKAGFSNQKTHPC

SEQ ID NO: 26593 - protein, 81 aa, Tupaia chinensis
MAFEDVAVYFSREEWELLDTAQRALYRHVMLENFALVASLGFSPSRPCVVIQLESGKEPWLHSGMDTTMSRHAHKRPSSGS

SEQ ID NO: 26594 - protein, 81 aa, Vicugna pacos
AHGSVMFSDVSIVFSQEEWEYLDLKQRDLYRDVMLENYSNLVSLGCFISKPDVISLLEQGKEPWKVMRKGRGRYPDLETRY

SEQ ID NO: 26595 - protein, 81 aa, Vicugna pacos
DPEQVTFEDVAVDFTWEEWGQLEPAQRTLYRDVMLETFRLLVSVGHWLPKLDVISLPEQEVELWAVDKGVPQGVCPDLETR

SEQ ID NO: 26596 - protein, 81 aa, Vicugna pacos
SQESVTFEDVAVDFTQEEWALLDTSQRKLFRDVMLENISHLVSVGNQFYKSDVISHLEQGEQLSRERLDFLQGQTIYFFPV

SEQ ID NO: 26597 - protein, 81 aa, Vicugna pacos
MAVTFEDVTVIFTWEEWRFLDSSQKKLYREVMWENYTNVMSVGNWRQRYKPQEKRFRYLTHDNLSCWHGWRNASTQIYENR

SEQ ID NO: 26598 - protein, 81 aa, Vicugna pacos
AQVLVTFKDVAVTFTQEEWGQLDLDQRTLYREVMLETCGLLVSLGHPVPKAELMHLLEPGPKVWTVTRGLSRSTCSGDRAE

SEQ ID NO: 26599 - protein, 81 aa, Carlito syrichta
TVTFEDVAVYFSWEEWGLLDETQRCLYRDVMLENLALITFLDVHQHPKQHFGEKRFRNNVNRGLFVKSCKFYVSEEPFTCG

SEQ ID NO: 26600 - protein, 81 aa, Carlito syrichta
EMRLLMFRDVAIEFSPEEWECLDPAQRNLYRDVMLENYRNLVSLGLTIFKPALVTFLEHWQESWNVKRKETVAKHLELYSH

SEQ ID NO: 26601 - protein, 81 aa, Carlito syrichta
LKGSVSFEDVIVELTQEEWRRMGPRDRSLYRDVMLENYGHLVAVGCCITKPKVILKLEQGEEPWSLEVKFLNQKYPGYYKI

SEQ ID NO: 26602 - protein, 81 aa, Gulo gulo
MHKDVMLENYSNLASVGLCVAKPEMIFKLERGEELWILEEESPGRGYPGSLSLLCENSSVGGNALGHDNDLGHQKIQTLDQ

SEQ ID NO: 26603 - protein, 81 aa, Erinaceus europaeus
PRPLESEDVYFSEEQWENLEDWQKELYRNVMASNYETLVSLKVLGQPEEEAELGPEMSGDLEGHPADGVVVKPESQDALAG

SEQ ID NO: 26604 - protein, 81 aa, Ornithorhynchus anatinus
MYNFISPLVGFSMVKPVVICRLEEGKDPWGQDLPETEDRETLGDPHTDCKTKPETESVPPQQEVSEEADFKRASLERCQQN

SEQ ID NO: 26605 - protein, 81 aa, Mustela putorius
SQVSVTFEDVAVLFTRDEWRKLCPSQRNVYQEVMLENYSNLVSLGLLFSKPRVISLLQQGEDPWKVEKESPGGPSLGWKSG

SEQ ID NO: 26606 - protein, 81 aa, Mustela putorius
AQVPLTFSDIAIDFSLEEWECLNSDQRDLYRDVMLENYTNLVSLDFDFTTETNKLSSEKSSYQVNSYHRETMKRNKTFNLM

SEQ ID NO: 26607 - protein, 81 aa, Vicugna pacos
LQNLVNFEDVAVRFCKEEWGLLDAAQRHLYHSVMLENLELVTSLGCWHGVEDKEVRSKQNASVEVVSQARIPSVHPSTQKA

SEQ ID NO: 26608 - protein, 81 aa, Vicugna pacos
FQEPVLFKDVAVVFTEEELGLLDPAQRELYRDVMLENFRNLLSVGKQLFKPELIFQLEREEELLMMETETQRDGCSGTKSQ

SEQ ID NO: 26609 - protein, 81 aa, Vicugna pacos
RLTFKDVAIEFSQEEWECLDPAQRAFYVDVMLETYRNLVSLDVSHIHVIKKLQPTTNSDSGEVFQAVMLERQESPEVKHFY

SEQ ID NO: 26610 - protein, 81 aa, Vicugna pacos
SQDAVTFGDVAVNFTQEEWALLDLSQRNLYRDVMLENYNNLITTGYQSVKPALISWLEQGEFRTVERGALQEWEMNQKVKD

SEQ ID NO: 26611 - protein, 81 aa, Vicugna pacos
GPVLFEDLAVYFSQEECVSLHPAQRSLSRDTAQECFMDNALMGKIEINQQLSLESMGLEELALEKYSITVPLVYCPEKSSE

SEQ ID NO: 26612 - protein, 81 aa, Vicugna pacos
VTFEDVAVYFSWEEWCLLDEVQICLYLDVMLENFALVSMLGSCHGVKDGETSSEQSIFVGVSQTRTPKAGVSPEKSQPCRM

SEQ ID NO: 26613 - protein, 81 aa, Vicugna pacos
AAGSVTFKDVTMAFTKKEWEQLDPAQRSLYKDVMLENYSNLASMVGYQALKPDMICKLEKGEGLWLGKGKSPTRGGLSETA

SEQ ID NO: 26614 - protein, 81 aa, Vicugna pacos
SHGLVSFKDVAVDFTQEEWQQLDPAQRTLYRDVMLENYSHLLSVGHPVSKPDVISKLEQGEDPWIIKRDMPNWVYPGENQA

SEQ ID NO: 26615 - protein, 81 aa, Vicugna pacos
VTFEDVAVYFSREEWCLLDEVQIRLYLDVMLENFALVSMLDSLHGVEGEETPSEQSIFVGMSQTRTPKAAVSPEKSQPCRM

SEQ ID NO: 26616 - protein, 81 aa, Carlito syrichta
MVTFKDVAVYFSQTEWAGLSHPQRALYRTVMLENYENLTTVGYLIPKPALISLLDGGDLPWVLESQDDIPAERTKIICKDA

SEQ ID NO: 26617 - protein, 81 aa, Carlito syrichta
SVTFKDVAVIFTKEELALLDKAQISLYQDVMLENFRNLVSVGDGIKTNIFNLQEKGLKILSQEVFHCWQIWKQKICKLTAG

SEQ ID NO: 26618 - protein, 81 aa, Carlito syrichta
QGHVTFEDIAVYFSQEEWELLDEAQRCLYHAVMLENFSLMASVGSWHLVEAEEAPSDQTVSTENVSQARTPKANPSIPNTY

SEQ ID NO: 26619 - protein, 81 aa, Delphinapterus leucas
GTGGAGPSPGPCLGAGPGDAGMAPRPPTARPQESVTFKDVAVNFTQEEWHHMDPAQRRLYRDVMLENYSHLVSLEFLRIKA

SEQ ID NO: 26620 - protein, 81 aa, Delphinapterus leucas
KISVCTDSTASEEQQKMSKSQGFVSFKDVTVDFTQEEWQQLDSAQRNLYKDVMLENYSNLVSVVNLDGKKMDTASCSFFRG

SEQ ID NO: 26621 - protein, 81 aa, Carlito syrichta
PQELVTFRDVAVDFTQEEWGQLDPTQRTLYRDVMLETFGHLLSVGPELPKPEVISQLEQGAELWVAEIGTTQGRHSGWQPQ

SEQ ID NO: 26622 - protein, 81 aa, Carlito syrichta
SQASVSFKDVTVEITQEEWQQMGPVQRTLYRDVTLENYSHLVSVGNCISKPEMIFKLEQGEEPLFSEEEFSNQSHPKDYKG

SEQ ID NO: 26623 - protein, 81 aa, Carlito syrichta
AHRSVMFNDVSIDFSREEWEYLNLEQRDLYRDVMLENYSNLVSLGYFISKPDVISLLEQGEEPWKVVRKGRRRYPDLKTNY

SEQ ID NO: 26624 - protein, 81 aa, Carlito syrichta
MVENFKNMVAVGHLLFKPDMVSQLEAEEKLWMMEAEAQRRNKNQHEMETLRKFAFKYFSHEELSCWQIWKQVASELTRCLQ

SEQ ID NO: 26625 - protein, 81 aa, Gulo gulo
AQELVTFKDIAIDFTQEEWALLDTSQRQLYRDVMLENISHLVSVGYHLCKSDVISQLEQGVELWRDGREFLQGLNPDRKSG

SEQ ID NO: 26626 - protein, 81 aa, Erinaceus europaeus
SQGLVTFKDVAVYFSQDQWSDLDPTQKEFYGEYVLEEDCGIVVSLSFPIPRLDEISHVGEGEPLIQEPQEPQEPEILSFTY

SEQ ID NO: 26627 - protein, 81 aa, Erinaceus europaeus
NQKSVTFEDVAVYFTQTEWDGLSPAQRALYRDVMLENYGNVASLGFSLLKPAVILQLEEGGELGATFPLATQTDTGPHTLW

SEQ ID NO: 26628 - protein, 81 aa, Erinaceus europaeus
EAVPLTFQDVAVYFSPSEGQQLGPDQRALYRDVMLENYGHVASLGLPVPKPELISQLEQGEELWVLNLMGTEEPEPLSSSK

SEQ ID NO: 26629 - protein, 81 aa, Erinaceus europaeus
CQDTVTFEDVAVIFTDEEWNLLDPIQRDLYKEVMLENYKSIVSLGLPVPQPDRIFHLKREDETWMVDLHGSEKKKCPQKVS

SEQ ID NO: 26630 - protein, 81 aa, Ornithorhynchus anatinus
MEVTFKDVAIFLTQWEWGSLADAQRELYTSVMLENYGHLRSLGAGRPKPQCIRQLEKGEDPWVPEPPAHHKWIFLKEAWTE

SEQ ID NO: 26631 - protein, 81 aa, Ornithorhynchus anatinus
RAEELETFEDAAIPLARRERGHLVPARCNMHWGMMLGNYRKRSSLRRSIARPNLISQLKEEDPCNLDMREAEESETRRDAF

SEQ ID NO: 26632 - protein, 81 aa, Delphinapterus leucas
MLENYSTLFSLGILFSKPKVILQLEQGEDPWMVENGVSQSTCLGWESLFETTVSEEENQEVMNQLIGDGPFYFKLGEIYIN

SEQ ID NO: 26633 - protein, 81 aa, Carlito syrichta
AQESLTFEDVAVNFTDWEWQCLTYTQRHLYKDVMLENYENLVSLGFPFSKPPLISHLEQRVEPCIQDLQDRESLSCSYPVS

SEQ ID NO: 26634 - protein, 81 aa, Carlito syrichta
AYEGSVSFRDVAIDFSREEWHHLNPSQRNLYWDVMLETYSHLLSLGYQVPEAEVFMLEQGKEPWALQGESPRQSYPGEKLW

SEQ ID NO: 26635 - protein, 81 aa, Carlito syrichta
AHDLVVFRDVSVDFSQEEWECLNSYQRNLYRDVILENYSNLVSLAGCSISKPDVITLLEQGKEPWMVVRNEKRRWNLDLES

SEQ ID NO: 26636 - protein, 81 aa, Carlito syrichta
TVAERIVTDCLTNYYQEEWTLLDTSQRHLYSDVMMENYKNLATVGCQIIKPSLISWLEQEESRTVQGGVLQGWEMPLETKL

SEQ ID NO: 26637 - protein, 81 aa, Carlito syrichta
SQGLLTFKDVAIEFSPEEWEYLDPPQRMLYRTVMLENHRNLVFLGLAVSKPDLIMCLEQRREPWNVKSHSKLAKSPAVTSH

SEQ ID NO: 26638 - protein, 81 aa, Gulo gulo
LQGPVSFKNVAVDFTQEEWQYLDLPQRHLYKDVMLENCINLILVGYQTTKPSVIHKLEQGEEPRKMEREIPSWSHADFVSS

SEQ ID NO: 26639 - protein, 81 aa, Erinaceus europaeus
MFRDVSVDFSQEEWECLDSYQRNLYRDVTLENYSNLVSLGCPISKPDVITLLEQGKEPWIIVRDEKRRWSLDLKSKYDTKM

SEQ ID NO: 26640 - protein, 80 aa, Colobus angolensis
MLPECSVRFHNQQTMNKSLTWEEWQDLDDAQRTLYRDVMLETYSSLVSLGHCVTKPEVIFKLEQGAEPWLGEEWANRCLS

SEQ ID NO: 26641 - protein, 81 aa, Colobus angolensis
EMGPLTFMDVAIEFSVEEWQCLDTAQQNLYRNVMLENYRNLVFLGIAVSKPDLITCLEQGKEPWNVERPEMVAKPPGINWD

SEQ ID NO: 26642 - protein, 81 aa, Colobus angolensis
LSFEDVAMYFTREEWGHLDWGQKDLYRDVMLENYRNMVLLGSEARHKMKKLTPKQKFSEDLESYKVSVVMQESAEKLSEKL

SEQ ID NO: 26643 - protein, 81 aa, Colobus angolensis
MEHLTFRDVAIEFSPEEWKCLDPAQQNLYRDVMLENYRNLVSLGVAISNSDLVTFLEQRKEPYNVKIHETVAKHPAKCSHF

SEQ ID NO: 26644 - protein, 81 aa, Colobus angolensis
PQGSTFFSSVTVAFAQEGWRYLVSTPRERYKERVPEKSRNLVLLGLPVSQPGMNSQLEQREGTWMLEGEDLRSPSPGWKIV

SEQ ID NO: 26645 - protein, 81 aa, Colobus angolensis
EMGLLTFRDIAIEFSLAEWQCLDHAQRNLYRDVMLENYRNLVSLGVAVSKPDLITCLEHNKEPRNIKRNEMVSKHPVTCSH

SEQ ID NO: 26646 - protein, 81 aa, Colobus angolensis
RDVAIEFSLEEWKCLDPAQQNLYRDVMLENYRNLFSIGLTVSKPGLITCLEQRKEPWNVKRQEAVDGHPEMGFHHATQACL

SEQ ID NO: 26647 - protein, 81 aa, Delphinapterus leucas
MLENYSNLVSLGLLFSKPEVISLLQQGEDPWKVEKESPGGSSVGCKSSPKTTKSTQTQDSSFWGPVRKRLQKNEPWNFISE

SEQ ID NO: 26648 - protein, 81 aa, Carlito syrichta
VVQEPVTFEDVAVLFTHEEWGRLSPAQRALHGEVMRENCGHLLSLGLLGPKPDMSPQLGKREDWTPEAAPGGFSLDWLTVP

SEQ ID NO: 26649 - protein, 81 aa, Carlito syrichta
MLETYSNLVSVGYEGTKPDVILRLEQEEAPWICEAACSGCHCWEDSWQVNTQRKRWQDILLKQGAFISKKTLPTEKSRECN

SEQ ID NO: 26650 - protein, 81 aa, Carlito syrichta
QDFVTFEDVAISFSQEEWKLLDEAQKFFYRDVMLENFALITSQGCWYGAETEEVSSEYSVSVEGLSQIRTPKASPFTQKNY

SEQ ID NO: 26651 - protein, 81 aa, Carlito syrichta
PQEAVAFEDVAVYFTRIEWSCLAPDQRALYRDVMLENYGNLTSLGFLVTKPALISLLEQGEEPGALIRQMTEKTGTKASLC

SEQ ID NO: 26652 - protein, 81 aa, Delphinapterus leucas
MFKDVAIDVSQEEWECLNPAQRNLYKDVMLENYSNLVSLGLSISKPAVISSLEQGKEPWMVMREVIGDQFPDLVSKCEAKK

SEQ ID NO: 26653 - protein, 81 aa, Carlito syrichta
TQGPLTFRDVAIEFSLEEWKCLDPAQQTLYRNVMMENHRNLVSLGLDVSKPDLIMCLKRRNKPWNVKRHNMLEKPTESHSV

SEQ ID NO: 26654 - protein, 81 aa, Carlito syrichta
MDSVAFEDVAVNFTEEEWALLDPSQRNLYRDVMQETFRNLASVGNKCEDQNTGDQYKNSWRNLRSHTVEILAKSQTGSQCG

SEQ ID NO: 26655 - protein, 81 aa, Gulo gulo
FTGSLSFGDVAISFSQEEWECLEPAQKALYRDVMLETYSNLVSLESSISKPDTITLLEQEKEPWVVLRREASGWHPDLESN

SEQ ID NO: 26656 - protein, 81 aa, Gulo gulo
QGPMLFEDLAVYFSQEEYVSLHPVQRSLSRDTTQECFKDMVLMGGEGKTETSQQLNLECTGFEELAAENSSITVPLVYYPE

SEQ ID NO: 26657 - protein, 81 aa, Myotis brandtii
VTFEDVALYLSREEWGQLDHAQQSFYRDVLQKRNGLALGFPFSRTFWASQVQGKGEASSSCLQMGDEEEKRGAVEVRKEDP

SEQ ID NO: 26658 - protein, 81 aa, Myotis brandtii
SKTSVTFKDVAVTFTQDEWEQLDLAQRTLYREVMLEICRLLVSLGYPVPKSELVHLSEHRQELWIVKRGLSQSACAGAREK

SEQ ID NO: 26659 - protein, 81 aa, Myotis brandtii
MVFEDVAVYFSREEWGLLDSAQRALYRQVMLENFALVASLGLSASRPRIILQLERGEEPWVLSGLDVALARDAQRRPSPAQ

SEQ ID NO: 26660 - protein, 81 aa, Propithecus coquereli
VSVTFEDVAVTFTQEEWGQLDLTQRTLYREVMLETWGLLVSLGDSTQPWTPEPTLPHLALPEEVSLEQQLTQGASGDSQLE

SEQ ID NO: 26661 - protein, 81 aa, Propithecus coquereli
SQGSVTFRDVAIDFSQEEWKWLQPAQRDLYRCVMLENYGHLVSLGLSISKPDVVALLEQGKEPWLGKGDVRRDLFSVSQSN

SEQ ID NO: 26662 - protein, 81 aa, Propithecus coquereli
AQGSVSFKDVTVDFTQEEWQHLDPAQKTLYMDVMLENYCHLISVGCHMTKPDVILKLEQGEEPWASFAGLTCLEENWKAED

SEQ ID NO: 26663 - protein, 81 aa, Propithecus coquereli
WKELLSFEDVAMYFTREEWGHLDWAQKDLYRDVMLENYRNMILLGFQFPKPEVICQLEQWDEPWILDLLRAGNRKASSSAY

SEQ ID NO: 26664 - protein, 81 aa, Balaenoptera acutorostrata
LQGSFSFEDLSVDFTQKEWQLLDPYQKDLYKDVMLENYSSLVSLGYEVMKPGVILKLEHGEEPWTGDGEIPGSDSPEQVLQ

SEQ ID NO: 26665 - protein, 81 aa, Lynx pardinus
MLEIYSHLVSVGCSGISPGIIFKLEHEEDPWTMKSELSRWIHSDREKSLDSSQQIISEELSFQKEILEKAPKDNSLYYLLK

SEQ ID NO: 26666 - protein, 81 aa, Balaenoptera acutorostrata
MDPAQRRLYRDVMLENYSHLVSLGYQVSKPEVIFKLEQGEEPWIAEGEIQRPFCPDWKTRPEAKSSRLQQSISEVSLSTDD

SEQ ID NO: 26667 - protein, 81 aa, Vombatus ursinus
MLENYKNLVSLGLLDPKPDLISRLEQGEPQSWDVQERPSSSVCAQAGGHPSRESGARGSRPAASEGWGGAAWNIKLENEES

SEQ ID NO: 26668 - protein, 81 aa, Saimiri boliviensis
MDSVAFEDVSVNFSQEEWALLAPSQKKLYRDVMQETFKNLVSISHKVERLCESKEGSQCGETFSPSLCVTKKTARVKLDEC

SEQ ID NO: 26669 - protein, 81 aa, Saimiri boliviensis
AHGSVTFRDVAIDFSQEEWEFLDPAQRDLYRDVMWENYSNFISLGPSISKPDVITLLDEEGKEPGMVVREGIRRYYPDLDS

SEQ ID NO: 26670 - protein, 81 aa, Vombatus ursinus
KKESVAFKGVVVDFIQEEWGQLDLPQKDLYKDLMLEKYRNLVLLGLPVFKPDVNSELEQGEDSWIPRKEDPGSNCSDWPGL

SEQ ID NO: 26671 - protein, 81 aa, Vombatus ursinus
MLENYRNLLSLGLPVPKPDVISQLERGAAPGMLEREGPRASCPDWETRPETSESLPKMAISMDESSPERHSPQDFKLGEVK

SEQ ID NO: 26672 - protein, 81 aa, Lynx pardinus
FQGSVSFRDVAISFSQEEWACLDPAQRALYRDVMLENYSHLLSLGRSISKPDVITFLEQEKEPWVVVRKETSGWYPDLESN

SEQ ID NO: 26673 - protein, 81 aa, Balaenoptera acutorostrata
PLTFKDVAVTFTEEELGLADSTQRKLYRDVMLENFRNLLSVEDKDEKDMEYIQEKELRLLLHRELSYWKILEQVAGELTQN

SEQ ID NO: 26674 - protein, 81 aa, Saimiri boliviensis
RESGKAPVTFDDITVYLLQEEWVLLSQRQKELCGSDKLVPPLGPTVANPELFRKFGRGPEPWLGSVQGQGSLLEQHPGKKQ

SEQ ID NO: 26675 - protein, 81 aa, Lynx pardinus
VSFEDVPVYFIKTGWKLLDLSQRILYKRVSLENYRHFVSLGQGITPLSGWPHSPPTWGSPCPPGPHASKVHASRVHGGAHA

SEQ ID NO: 26676 - protein, 81 aa, Lynx pardinus
PAATSFHPPRIQEEWGLLDRSQKELYWDAMLEKYGTVVSLAGLPAPLPEARVESEPGVLRSGTEGQRSLHPGDESESHCEG

SEQ ID NO: 26677 - protein, 81 aa, Delphinapterus leucas
WSQMPVTFEDVAVYLSREEWGRLDHTQQSFYRDILQKRHGLSLGFPFSRPFWASQVQGKGEASGSCQQMGDEEEEKRGAVE

SEQ ID NO: 26678 - protein, 81 aa, Colobus angolensis
VAFEDVAVNFTQEEWALLDISQRNLYREVMLETFRNLTSIGKSWKDQNIEYECQNPRRNFRSLIEDKVNEIKEDSHCGETF

SEQ ID NO: 26679 - protein, 81 aa, Mustela putorius
VTESVTFRDVAVLFSQDEWLHLDATQRTLYREVMLENYGTLVSLGIPCSTPKVICQLQQGEDPCLVDRKLPQDASLGLKAQ

SEQ ID NO: 26680 - protein, 81 aa, Mustela putorius
DGGLVVFTDVAIHFSREEWGLLDEAQRSLYHSVMLETLALLSSLGCWHGAQDEAAPLEQGDSVGGSQVRTPTQKSQPWERC

SEQ ID NO: 26681 - protein, 81 aa, Mustela putorius
QGLLTFSDVAIEFSEEEWRRLTHSQRQLYLDVMLENYGHLLFLETGLLLSKPDLIIYLEQEKVLWDVKRKETGGFHPALSS

SEQ ID NO: 26682 - protein, 81 aa, Tupaia chinensis
GLVTFEDVAVDFTKEEWQYLNPPQRTLYRDVMLENYSNLVSAGRQVAKPDLILKLEVEEPHPAEVKIPTWSFLEVCQVGEQ

SEQ ID NO: 26683 - protein, 81 aa, Odobenus rosmarus
KQEAIVFEDVAVYFTRIEWSCLAPDQRALYRDVMLENYGHMASLGFLVAKPALISLLEQGEEPGALILQGTEEQGSTASLC

SEQ ID NO: 26684 - protein, 81 aa, Odobenus rosmarus
MEEWALLDPSQKKLYRDVMQETFRNLASIEEKWEIHDREDQNENRGTDLRCQMVERLCKSKECSQCEEIFSQIPYHNQKKK

SEQ ID NO: 26685 - protein, 81 aa, Odobenus rosmarus
MLENYRNLASLEKQLSKPTLITQMEQEDEMKTETGNHQDTCSNGMVLLKTKQSQHKQGILEKEALSAKKEQTHGGRSIEKN

SEQ ID NO: 26686 - protein, 81 aa, Odobenus rosmarus
MLETYSHLLSVGYEVPQPEVFMLEQGKEPWAVQGESTHQSCPGEKLWDHNQCGKILSYKQAPSQHQKIHTGEKSYECAEFG

SEQ ID NO: 26687 - protein, 81 aa, Odobenus rosmarus
VTFEDVAVIFTDEEWRHLVPIQRDLYKEVMLENYKSIVSLDWETKPEIHGASEEESEGTARGKLGGEVPVCPKFGTLEGES

SEQ ID NO: 26688 - protein, 81 aa, Odobenus rosmarus
APDSITFEDVAMDFTQEEWVLLNSRQRKLYRDVMLENYRNLASLEKQLSKPTVITQMEQEDEMKTETGNHQDTCSNGMVLL

SEQ ID NO: 26689 - protein, 81 aa, Odobenus rosmarus
ACGSLSFGEVAISFSQEEWECLDPAQRALYRDVMLETYSNLVSLAGSSISKPDVITLLEQEKEPWVVVRRETSGWYPDLES

SEQ ID NO: 26690 - protein, 81 aa, Carlito syrichta
GPELLTFWDVAIEFSPEEWECLDPVQRNLYRDVMLENYRNLASLGFTVFKPDLVTFLEHMQEPWNVKRKETVAKHPDAHSH

SEQ ID NO: 26691 - protein, 81 aa, Delphinapterus leucas
RESGKAPVTFDDITVYLLQEEWMLLSQQQKEICGSDELVAPLGPTIANPELFYKFERGPEQWLANVQGQRSLLSLHRGKNK

SEQ ID NO: 26692 - protein, 81 aa, Carlito syrichta
SQGLLTFKDVAIEFSPEEWECLDYSQRILYRTVMLENYRNLGFLGLAVSKPDLITCLEQRKEPLDVKRHSTLAKLSVVTSH

SEQ ID NO: 26693 - protein, 81 aa, Carlito syrichta
MLENYSHLISVGYCTPKPEVILKLEKGEEPWILEEEFPSQSHPELINTSRSYSRKKFNEFNKGGKRLHDEKHEGIYSQEKP

SEQ ID NO: 26694 - protein, 81 aa, Carlito syrichta
HGSVTFRDVAIDFSQEEWEFLDPAQRDLYRDVMWENYSNFISLAGPSISKPGVITLLDEEGKEPGMIVREETRRYCADLES

SEQ ID NO: 26695 - protein, 81 aa, Carlito syrichta
AQGSVTFEDVAIYFSQEEWRVLDEAKRLLYLEVMLENFELVASLGCGHGTAEDEETLSEQNVCVGVSQSKAASSTQKTYPC

SEQ ID NO: 26696 - protein, 81 aa, Carlito syrichta
MMENFSNLVSVGYQVTKADAFFQLKQGKPWIIEEEIQSQFHLEDVWQDNNHTDGHQENQSNLESMKNHHRYHTFGKIMSHL

SEQ ID NO: 26697 - protein, 81 aa, Gulo gulo
AAASVSFKDVTVDFTREEWQHLDPAQKTLYMDVMLENYCHLISVGCHMTKPDVILKLERGEEPWTSFTGHTCLEENWKEED

SEQ ID NO: 26698 - protein, 81 aa, Cervus elaphus
VGRLLGPRGPMAEPAPQEWQNLEAWQKELYKQVMRANYEILLSLDNGLPKPELISWIEQGEELYKKWGESQESRSIICSSA

SEQ ID NO: 26699 - protein, 81 aa, Cervus elaphus
VSVNFEDVAVTFSWEEWDLLDEPQRCLYRDVMLENLALITSLGCCHEVETKKTSFEQNVYFQRMSQIRTPKADLSSKKAHP

SEQ ID NO: 26700 - protein, 81 aa, Cervus elaphus
MEELALLDSAQINLYQDVILENFRNLVSVEMLYFWQIWNQRISELIVSHDYVIMNLQGDCSQYLGDISLCEEWTGVSLQIS

SEQ ID NO: 26701 - protein, 81 aa, Colobus angolensis
LQASVSFEDVTVDFSREEWQHLDPAQRRLYWDVTLENYSHLLSVGYQVPKSETAFKLEQGEGPWTLAGEAPHQSCSGEAIE

SEQ ID NO: 26702 - protein, 81 aa, Colobus angolensis
SQHLVTFEDVAVDFIQEEWTLLDQTQRDLYRDVMLENYKNLIILAGSELCKPSLMSGLEQMEELRTGVTGVPQGQKQYCRE

SEQ ID NO: 26703 - protein, 81 aa, Mustela putorius
SYEGSVSFRDVAVDFSREEWQHLDLAQRNLYRDVMLETYSHLLSVGYEVPQPEVFMLEQGQEPWALQCDPHQSCPALDFLE

SEQ ID NO: 26704 - protein, 81 aa, Mustela putorius
PQVLVSFEEVAVFLSREEWGCLGPAQRGLYSDVMLETYRNLISLGLQGSKPDVISRLEKGEEPWAPYSPRIEEGWIWSHGS

SEQ ID NO: 26705 - protein, 81 aa, Mustela putorius
MAFTQKEWERLDPAQRDLYKDVMLENYSNLASMGFQAPKPDMISKLEKGEEPWLGKGKRPRQGGPSEIARPKQIRTNGNEV

SEQ ID NO: 26706 - protein, 81 aa, Tupaia chinensis
LQGLVSFEDVAVNFSWEEWQDLDDAQRTLYKDVMLETYSCLVSLDVQLDDDVIERSQEIHCRHLWQVVINNSNTTTKERVE

SEQ ID NO: 26707 - protein, 81 aa, Odobenus rosmarus
AWAPLSFEDVAVGFSWEEWQLLAPSQKDLYRDVMLENYRNLVSVGYQASKPDSVFQLEQGEPPWIVEGAAQSQTCQEEIWE

SEQ ID NO: 26708 - protein, 81 aa, Odobenus rosmarus
KYGQLTFRDVAIEFSQEEWECLDPAQRELYKDVMLENYRNLVSLGISVSDLNIMSFWSKGKSLDCGGQRANSIKPNGWECV

SEQ ID NO: 26709 - protein, 81 aa, Odobenus rosmarus
VQGSMSFEDVIVKFTQDEWQYMSPAQRTLYRDVMLENYSHLISVGYCTTKPEMIFKLEQGEEPWSLEEEFLNQRYPGYFSV

SEQ ID NO: 26710 - protein, 81 aa, Odobenus rosmarus
MGAVGCQCASGCAEHPGRCGPGARPRMLDSVVPAPYRSRSPAGGWSDPLFFGGPKLITQLEQGKETWREERTCPPATRPVE

SEQ ID NO: 26711 - protein, 81 aa, Delphinapterus leucas
QEPVVFEDVAVDFTQEEWALLDLAQRNLYRDVMLENFRNLASLGFETQLKTNELVAAQDIYGEKISSEQNVVRFKRSASSL

SEQ ID NO: 26712 - protein, 81 aa, Carlito syrichta
AEGSVMFSDVSVDFSQEEWECLDPIQKDLYRDVMLENYNNLVSVGLYIPKPQVISLLEQGKEPWMVGRELTRGLCSDLESM

SEQ ID NO: 26713 - protein, 81 aa, Delphinapterus leucas
MAFSKKEWEQLDPAQKSLYKDVMLENYSNLASMGYQALKPDMISKLGKGEEPWLGKGKRPRQGGLSEIARPKGIGTNGKEV

SEQ ID NO: 26714 - protein, 81 aa, Carlito syrichta
FVTFEDVAVHLTREEWGYLDPVQRDLYREVMLENYGNVVSLDGETREENKLLIPKKISEEVHSHRVRVGRLKQNIAQVPET

SEQ ID NO: 26715 - protein, 81 aa, Cervus elaphus
EYQVGKRPALVMSIQLSIEDVDIQFIPEEWECLDPAQRALYWDMMVETYRNLLSVAEEDPWIVENEVQMSRNLMNCKVSTV

SEQ ID NO: 26716 - protein, 81 aa, Cervus elaphus
AYIHESESPLSSKDHSCPQDVDLFACNGLEPHTSTSVEPPQESVTFQDVAVDFTEKEWPLLDSTQRKLYKDVMLENYSNLA

SEQ ID NO: 26717 - protein, 81 aa, Cervus elaphus
IQRLLTFRDVTIDFTLEEWGCLDLSQRELYRDVMLENYRNLASLGLVVFKPDLVTFLEQRKHLWDVRRVETTATYPAVSSH

SEQ ID NO: 26718 - protein, 81 aa, Colobus angolensis
SQGRVTFEDVTVNFTKGEWQRLNPEQRNLYRDVMLENYSNLVSVGREETTKPNVILRLEQGKEPWLVEEEVLGSGRPEKNG

SEQ ID NO: 26719 - protein, 81 aa, Mustela putorius
SQGQLTFKDVAIEFSQEEWGHLTHTQRQLYRDVMLENYGHLCFLGLTVSKPDLITFFGAKEAALGCEEKGDRRLPSREDAH

SEQ ID NO: 26720 - protein, 81 aa, Mustela putorius
FEGSVSFEDVAVDFTRQEWHRLDPAQRTMHKDVMLENYSNLASVGLCVAKPEMIFKLERGEELWILEEESPGPGYPGSLSL

SEQ ID NO: 26721 - protein, 81 aa, Mustela putorius
FQELLSFKDISMEFTWEEWQLLDSTQKYLYRDVILENYSHLVSLGYHGTKPDLIFKLEQGEEPWIINARVSRPSCPEGWKE

SEQ ID NO: 26722 - protein, 81 aa, Mustela putorius
LVSFEDVAVNFSWEEWQDLDDAQRTLYRAVMLETYRSLVSLDVQSAGDLTETRQDHQSRHVGQVGFSSNKRSTTKRTALGK

SEQ ID NO: 26723 - protein, 81 aa, Tupaia chinensis
MLENYSNLVSLGFSISKPEVLSLLAQEKELWKVVRDLTRGQSPDGGSKCQVKKLSSKRKNYETESSQWEQLTSHNKECKDL

SEQ ID NO: 26724 - protein, 81 aa, Vicugna pacos
ESVTFEDVAVDFTQEEWALLDTSQRKLFRDVMLENISHLVSVVISDREDDLKKQMISMQHINKKDAPLIRTVSSHTQEDPL

SEQ ID NO: 26725 - protein, 81 aa, Odobenus rosmarus
FQEAVTFKDVAVVFTMEELGLLDSTQRKLYQDVMVENFKNLVSVGHLPFKPDMVSQLEAEEELWMMEGEPQRNGYSREDHV

SEQ ID NO: 26726 - protein, 81 aa, Odobenus rosmarus
FQETVTFKDVAVVFSEEELGLLDSTQKKLYRDVMLENFRNLVSVGHSSSKPDMISQLEREEKLCIKEIHTERGRHLGGRNQ

SEQ ID NO: 26727 - protein, 81 aa, Odobenus rosmarus
QDPVAFEDVTVNFTLEEWALLNPSQKKLYRDVMQETLRNLASVVCILEEKWEDHDNEDQDENSGTNLSRHTVERLAKRKQG

SEQ ID NO: 26728 - protein, 81 aa, Odobenus rosmarus
AQGLMAFEDVAVYFSQEEWELLDTAQRALYCHVMLENFTLVASLGLSASRPRVVIQLERGEEPWVLGGTVATPARNAHRKP

SEQ ID NO: 26729 - protein, 81 aa, Carlito syrichta
LQELLTLEDVSVEFTSAEWQLLDPAQKDLYRDVMLENYRNLVSVGYQASKTDALSKLEQGEEPWTGENEMHCEICPENDKF

SEQ ID NO: 26730 - protein, 81 aa, Gulo gulo
AAGSVTFKDVTMAFTQKEWERLDPAQRDLYKDVMLENYSNLASMGFQAPKPDMISKLEKGEEPWLGKGKRPRQGGPSEIAR

SEQ ID NO: 26731 - protein, 81 aa, Gulo gulo
SQESVTFEDVAVDFTREEWTLLDRSQRKLFRDVMLENISHLVSVGRQLYKSDTISHLEPGEHLSKEGLGLLQCAISDREDD

SEQ ID NO: 26732 - protein, 81 aa, Erinaceus europaeus
SQCSITYEDVAVIFTQEEWALLNSTEKKLYRNVMWENFRNFLLIGKLQGEHSIKEHYNDQGSKSNIMKISEAEKQSQNSGK

SEQ ID NO: 26733 - protein, 81 aa, Mustela putorius
VRETVTFKDVAVVFSEEELALLDPAQRKLYGDVMLENFRNLISVGGKIQSKMKTVLETEPSEELSCWQIWQQIASDLTRCQ

SEQ ID NO: 26734 - protein, 81 aa, Mustela putorius
RQEPVTFEDVAVYFTQNEWVILDPSQRALYQEVMLENYANVASLAFLFTRPVLVSQLERGELPWGLEPWEPADREALRGIC

SEQ ID NO: 26735 - protein, 81 aa, Tupaia chinensis
LQGFISFEDVAMDFTREEWQDLDDAQKILYKDVMLETYSNLMFLGEKPYECKECKKTFSQNSDLTVHQRRHIEEKSYENKI

SEQ ID NO: 26736 - protein, 81 aa, Tupaia chinensis
SVTFEDVIINFTQEEWALLDTSGRKLYKDVILENISHLVSVGREVAHKMQEIIPTQQISREDTPTVISMKNQSSKIYECHL

SEQ ID NO: 26737 - protein, 81 aa, Tupaia chinensis
MESVTFEDVAVYFSENEWTGLAPAQRTLYRDVMLENYGAVASLAFPFPKPALISQLERGEAPWRLTPQGALDGQCPRGTSC

SEQ ID NO: 26738 - protein, 81 aa, Tupaia chinensis
MVKIEDMAVSLILEEWGCQNLARRNLSRDNRQDNYGNVFSQDCENRNENEESASKAEDSASRGETAGKFQKELGEKREQQG

SEQ ID NO: 26739 - protein, 81 aa, Odobenus rosmarus
AQGMNFEDVAIDFSQEEWGLLDETQRLLYCDVMLENFALVASLGFGHGMEDEEAPSKQTMSVGEYQLRAFQTGLSTQKIHP

SEQ ID NO: 26740 - protein, 81 aa, Odobenus rosmarus
GVTFEDIAVYFSWKEWRLLNEAQRRLYHHVMLENFTLISSLGCCCGAEDEAPFAHSTSVGVSQTRTPKAAQSSRKTHPCEM

SEQ ID NO: 26741 - protein, 81 aa, Odobenus rosmarus
MPVTFEDVAVTFTQEEWGQLDPAQRTLYQEVMLETCGLLVSLGCPLPKPELFYPLDHSPELHTLKRGLSPNSCPGDSTKPG

SEQ ID NO: 26742 - protein, 81 aa, Odobenus rosmarus
WLQVPVTFKDVAVEFTQEGWMMLDSGQRRIYRGVMLENYMNLTSMEYQLWKPTMISPLGQEEIRTMKRRLLAGTYPDWEIQ

SEQ ID NO: 26743 - protein, 81 aa, Odobenus rosmarus
MLENYANVASLAFLFTRPVLVSQLERGELPWGLEPWEPAGREALRGICPGGETRAEKEESTPKEHISKETESHRLTLGGLP

SEQ ID NO: 26744 - protein, 81 aa, Delphinapterus leucas
CMNSVTFEDVAMDFTQEEWALLNSSQRKLYRDVMLENYRNLVSLGHQLSKPPLITQMEQEDEMEIAERRIHQDTCSGAHQA

SEQ ID NO: 26745 - protein, 81 aa, Delphinapterus leucas
VTFRDVAVFFSRDEWLHLDSAQRTLYQEVMLENYSTLFSLGWESLFETTVSEEENQEVMNQLIGDGPFYFKLGEIYINEEK

SEQ ID NO: 26746 - protein, 81 aa, Carlito syrichta
GTAAYEDLFGDCTQKEAKGLSLSQKSLYASMILVNYCSMVSLADANIMEHSELTLKQEISKGLESSDRTSGGLFGVVPGEP

SEQ ID NO: 26747 - protein, 81 aa, Carlito syrichta
IQELLTFEDVAVDFTHEEWQYLNPPQRTLYRDVMLETYSNLVFVGKQVTKPDLILKLEVEECPAEVKIPVWSFPEEVFQGE

SEQ ID NO: 26748 - protein, 81 aa, Carlito syrichta
AQGSVSFEDVTVELTREEWQQMGPRERSLYRDVTLENYGHLVAVGCCITKPKVILKLEEGEEPWSLEVTFLNRKYPGLNSN

SEQ ID NO: 26749 - protein, 81 aa, Carlito syrichta
SQESVTFQDVAVDFTEKEWPLLDSSQRKLYKDVMLENYSNLTSLGYQVGKPSLISHLEQEEESRTEERGTHQSTYPDWETP

SEQ ID NO: 26750 - protein, 81 aa, Mustela putorius
SQGLLTFRDVAIEFSKEEWGRLTHTQRQLYKDVMLENYGHLHFLGLLLSKPDLIMFLEQEKQLWDVKRKESGGFHPALSSH

SEQ ID NO: 26751 - protein, 81 aa, Mustela putorius
QVSVAFQDLAVRFSEEEWQLLGEGQRALYRDVMRENYETLRSLGTDGLLPLSAFLSPAEPGGAVAGRRYAGEGQETPRGGG

SEQ ID NO: 26752 - protein, 81 aa, Tupaia chinensis
MLETYGILVSLGHSIIKPEVIFKLEQGAEPWIVDLPNQSLPCQLAHTGEEGWHEESSADIGRVELFSPFVFPGLKSEDSWS

SEQ ID NO: 26753 - protein, 81 aa, Tupaia chinensis
RPRAVKFPDVAVYFSPEEWGCLRPEQRALYRDVMRENYGHLGALGCAGPKPALISWLERNTDDWEPAALDPQEYPRGITIQ

SEQ ID NO: 26754 - protein, 81 aa, Tupaia chinensis
LQGFVSFEDVAVDFTWEEWQDLEDAQKTLYKDVMLETYSNLVFLGHCIAKPAVIFKLEQGKEPWTLEELPNQRLSGEKPYE

SEQ ID NO: 26755 - protein, 81 aa, Tupaia chinensis
YSGFVNPGFISFEDVAMDFTWEEWQVLEDAQKTLFKDVMLETYNSLMFLGQSIAKPAVIFKLEQGGDPWTLEELPSLSLPG

SEQ ID NO: 26756 - protein, 81 aa, Odobenus rosmarus
LPDLVTFEDVAVEFTREEWALLDPSQRTLYRDVMRENCRNLASLGYHIDKPSLISHLEQEDKVMTEERGILPGTCPDLETV

SEQ ID NO: 26757 - protein, 81 aa, Delphinapterus leucas
DPEQVTFEDVVVEFTWEEWGQLEPAQRTLYRDVMLETFGLLASVGHWLPKPDVISLLEHKAELWVVDKGAPQGVCTDFETR

SEQ ID NO: 26758 - protein, 81 aa, Carlito syrichta
LVTFGDVALDFSQEEWEWLNPSQKDLYRDVMLENYRNLVWLDWESWCEIKELSPKWFTDEDEISQGMEMESLTSHDLECSN

SEQ ID NO: 26759 - protein, 81 aa, Carlito syrichta
MLENHRNLVFLGLAVSKPDLITCLEKKKEPWDVKRHGTLVKLPAVTSHYTEGLLPENSIEDSLSKVPMGKYVIHTGKKPYK

SEQ ID NO: 26760 - protein, 81 aa, Carlito syrichta
MDTSQRNLFRDVMLENIKHLVSIGYELCKSDMIFQLEQGKELWREGVLLQGQSLGRKSALKQEMTFMHQMSRKHTPAIRST

SEQ ID NO: 26761 - protein, 81 aa, Carlito syrichta
MQENYGILVSLGYPIPKPDLIFRLEQGEEPWVPDSPRPEEGDIVTGVYTGAWFWTDDIEDHEEEDDEDFLAEVAEEENEPP

SEQ ID NO: 26762 - protein, 81 aa, Carlito syrichta
FQGLLSFKDVAIEFSPEEWACLNSPQRILYRTVMLENHRNLVFLGLAVSKPDLIAFLEQRKEPWDVKSHDTLAKLPAVNSH

SEQ ID NO: 26763 - protein, 81 aa, Carlito syrichta
SWGSLSFMDVFVDFTWEEWQLLDPTQKHLYRSVMLENYSNLVSLGYQHTKPDVIFKLEQEELCVVQSKTPSQGHPDKVWKT

SEQ ID NO: 26764 - protein, 81 aa, Carlito syrichta
VAGSVSFTDVTVRFTQEEWQHLNPGQRTLYEDVMLENYSHVVSVRCCVTKPELVFKLEQGEEPWIAEEESSSQSHPEFWKV

SEQ ID NO: 26765 - protein, 81 aa, Carlito syrichta
NAGLLTFRDVSIEFSEEEWVFLDPTQRVLYRNVMLENHRNLVFLGLTASKPDLITCLEQRKEPWKMKKHSTSAKPPGLAVS

SEQ ID NO: 26766 - protein, 81 aa, Carlito syrichta
MLENYRHLVSVGYRVNKPNAIFKLKQGKEPWILEVEFPHQNFPEDLWDIHDLEAGYQESQAGNSRSGELNKHQKTHTGEKT

SEQ ID NO: 26767 - protein, 81 aa, Carlito syrichta
QDGVTFEDVAVNFSREEWSLLNEDQRCLYREVMLENVALIFSLGHWHGAEDEEAPSKQSISIQRESQVRTPRTGVSPRKSH

SEQ ID NO: 26768 - protein, 81 aa, Gulo gulo
SQSLVTFGDVAVDFSREEWEWLSSAQRNLYRTVMLENYRNLVSLGLCISKPEMISSLEQRKEPWMAKRRLTRGRCPDLKIV

SEQ ID NO: 26769 - protein, 81 aa, Gulo gulo
FQESVTFKDVTVDFTQEEWKQLDPVQRDLFRDVTLENYTHLVAIGLQVSKPDVISQLEQGTEPWTVEPGIPGGAFRDCETR

SEQ ID NO: 26770 - protein, 81 aa, Erinaceus europaeus
SLGMVSFDDVMVTFSLEEWQLLSTSQRTLYRTVMLDTYSSLAALGHCAVKPGVIIKLEQGAEPWMGAQAPPRSLSDPCGPS

SEQ ID NO: 26771 - protein, 81 aa, Erinaceus europaeus
GQEPVTFWDVAVDFSQEEWGQLDPVQRTLYRDVMLETYGHLLCVGSQTVKPKVISLLERGAEPWPVGQAAAPGSCPEWMRN

SEQ ID NO: 26772 - protein, 81 aa, Mustela putorius
QGPMLFEDLAVYFSQEEYVSLHPAQRSLSRDTTQECFKDVVLMGGEGKTETSQRLNLESTGFEELAAENSSITVPLVYYPE

SEQ ID NO: 26773 - protein, 81 aa, Mustela putorius
KSQGLLSFSDVAVDFTWEEWQLLDTVQRNLYRDVMLENFSNLMSLGYQVTRSEAMVHLEKEQGVLEREFPSSSSPERPRQC

SEQ ID NO: 26774 - protein, 81 aa, Mustela putorius
AEDHMTFEDVAVHFSWEEWGLLDEAQRLLYRDVMLENFALMASLGLASSSAHAITQLEWWREPFVPPCAVLTAATPRGWHH

SEQ ID NO: 26775 - protein, 81 aa, Mustela putorius
MAHLMMFRDVAVDFSQEEWECLDLEQRHLYRDVMLENYSNMISLGLCIYQPDVFSLLEKGKEPWMVSQDETGGPCPDMQSR

SEQ ID NO: 26776 - protein, 81 aa, Mustela putorius
LEESVTFKDVVVLFTRDEWAQLSPTQRALYRDVMLENYSNLVSLGLLGPQSDVFSRLGKGEEWMLEDTSGSFCLDWMTMPV

SEQ ID NO: 26777 - protein, 81 aa, Mustela putorius
RPELVTFEDVAVYFSENEWTSLAPTQRVLYRDVMLENYGAVASLAVPFPKPALISQLERGEAPWCKAPQGALDGEGPRGIS

SEQ ID NO: 26778 - protein, 81 aa, Mustela putorius
TQGNVTFEDVALYFSWEEWDLLDEDQRCLYHDVMLENFALTSSLGCWLGVKDEHAPSEESIPIGVSEIGTLKADSPSQKAQ

SEQ ID NO: 26779 - protein, 81 aa, Mustela putorius
TVTFRDVTVDFTQEEWQQLEPAQKDLYRDVMLENYRNLVSLDLETRPEMKESGPQEDSAEDRPPAGVVTERPPRHGARGVA

SEQ ID NO: 26780 - protein, 81 aa, Tupaia chinensis
SQGSLSFGDVAVGFTRREWQQLDPTQRTLYRDVMLENYSHLVSVGCQGSKPAVISRLEQEKDPWMEEEEMYRWSFSEEVWQ

SEQ ID NO: 26781 - protein, 81 aa, Tupaia chinensis
MLENYNHLVSLGLSISKPDVVSLLEQGKEPWLGKGDVRRDLFSVSESNGEIKEFLPKSVIYKGDSSQYLIMEKILSQSPRY

SEQ ID NO: 26782 - protein, 81 aa, Vicugna pacos
AHDLVMFRDVTVDFSQEEWECLNSNQRNLYRDVILENYSNFVSLDLESRYDARKLSQVKDICEMNLSQWEIMERIRSCGLE

SEQ ID NO: 26783 - protein, 81 aa, Vicugna pacos
KCQEVTFSDVAVTFTREELGLLDSAQRELHRDVMLENFRNLLSVGHPSFRLGLILQVGREEKLWAMETETQGGHRNPNELE

SEQ ID NO: 26784 - protein, 81 aa, Carlito syrichta
PKVPVSFEDVSVYFTKAEWKLLDLRQKILYKQVMMENYSHLVALGFSFSKPHLISQLERGAGPWVANFRISRATTGPQAGD

SEQ ID NO: 26785 - protein, 81 aa, Carlito syrichta
KAQESLTLEDVAVPFTWEEWQLLGPAQKDLYRDVMLENYKNLVSVGYQASKPDALSKLEQGEPWTVEDEIHSQVNSEIKNS

SEQ ID NO: 26786 - protein, 81 aa, Carlito syrichta
ALEAVTFRDVTVDFTQEEWQQLEPAQKDLHREVMLENYRNLVSLETIIERQKMEKETMKDKRFSTVKKRSHILINRNGQQL

SEQ ID NO: 26787 - protein, 81 aa, Carlito syrichta
EMGLLSFKDVAIEFSPEEWECLDSPQRILYRTVMLEIHRNLVFLGIAVSKPDLITCLEQRKEPWDVKRRGTLAKLPAVTSH

SEQ ID NO: 26788 - protein, 81 aa, Carlito syrichta
YEESVTFKDVAVDFTQEEWGQLDSPQRALYRDVMLENYQNLLALGPPVHKPDVIFYLERGEEPWYVQREVPGGPCPEWEPR

SEQ ID NO: 26789 - protein, 81 aa, Carlito syrichta
PKVPVTFDDVAVYFSEQEWGKLEDWQKELYKHVMRGNYETLVSLDYAISKPEVLSQIEQGKEPCNWRRTGPKIPDVPVDPS

SEQ ID NO: 26790 - protein, 81 aa, Carlito syrichta
FQGRLTFSDVAIEFSQEEWKCLDPAQRALYRDVMLKNYRNLVSLGISLSKMNIVSMLEHLIFCVNLKNKPIGNQNKLTFWS

SEQ ID NO: 26791 - protein, 81 aa, Carlito syrichta
MAHLMMFRDVAIDFSQEEWECLDLKQRDLYKDVMFENYSNMVSLGLCIYQPNVFSLLEKGKEPWKILRNETRRLCPDLQSR

SEQ ID NO: 26792 - protein, 81 aa, Delphinapterus leucas
CEGSVSFEDVTIDFSREEWQQLDPAQRRLYQDVMLEIYSHLFSVGYHIPNPEIIFRMEKRKEQWMREAELPRQRYHEGESG

SEQ ID NO: 26793 - protein, 81 aa, Carlito syrichta
EMVLLTFRDVAIEFSLEEWDCLDPAQRNLYRDVMLENYRNLVSLDLAMSTPDLITCLEQSKEPWNLERQEIVAKHPVSSHF

SEQ ID NO: 26794 - protein, 81 aa, Carlito syrichta
MFEDVFVYFSREEWELLDNAQRFLYQDVMLENFALLASLGIAFSRSHVIMQLKEGEEPSVPAQMNVTPATEREALRGPGPG

SEQ ID NO: 26795 - protein, 81 aa, Carlito syrichta
SEHLVTFEDVAVDFTQEEWTLLDQTQRDLYRDVMLENYKNLVTLGSELCKPNLMSRLERVEELRTGGRGVLHELDLQLKTK

SEQ ID NO: 26796 - protein, 81 aa, Gulo gulo
PRDSVTFEDVAVRFSGGEWRRLTRAQRRLYAAVMLENYGLLVSLGFAGPKPPLISCLERGEPRVRDLQDWGLLSCSFPVSA

SEQ ID NO: 26797 - protein, 81 aa, Cervus elaphus
MKGPVTFKDVTVEFTHEEWKLLDTAQRTLYREVMQENYSHLISVGYCANRPNAIFKLKQGKEPWILEVQFPRQNNPGLTHH

SEQ ID NO: 26798 - protein, 81 aa, Cervus elaphus
VFLQVSFEDVTVDFSQEEWQHLDPVQRCLYRDVTLETYSHLCAVGYQVPKPEVIFRLEQGEESWTLGKETPHHSCSDEDIG

SEQ ID NO: 26799 - protein, 81 aa, Colobus angolensis
ELVMFRDVAIDVSQEEWECLNPAQRNLYKEVMLENYSNLVSLGLSVSKPAVISSLEQGKEPWMFVREETGRWCSDLASRDE

SEQ ID NO: 26800 - protein, 81 aa, Colobus angolensis
QDTVAYEDLSVGYTQKKWKGLALSQRALQWNMMLENDHSMASLGRNMMESSELIPKQEIFKGSESSNSTSGGLFGVVPGEA

SEQ ID NO: 26801 - protein, 81 aa, Colobus angolensis
LEDVAVDFTWEEWQLLGPAQKDLYRDVMLENYSNLVAVGYQASKPDVFFKLERGEPPWTTEDGLHGGACSEIWKVDDHVLK

SEQ ID NO: 26802 - protein, 81 aa, Colobus angolensis
YVGLQFQGSVTFEDVAIAFSQQEWESLDCSQRGLYRDVMLENYRNLMSMGHSLSKPHVITLLQQWKEPEVTVRTDERRWCT

SEQ ID NO: 26803 - protein, 81 aa, Mustela putorius
VQSRVVLEDVAICFSQEEWGLLDEAQRFLYHAVMLETCALLSSVGCWHGAQDEESPSEQGDPIGGSQVRTLTPGPPTQKSQ

SEQ ID NO: 26804 - protein, 81 aa, Mustela putorius
HELVTFRDVVITFSPEEWEYLDSAQRNLYWDVMMENYSNLVSLDLDSNYDKKCLSTRKDITENSGSQCKVTESKFIGLESS

SEQ ID NO: 26805 - protein, 81 aa, Mustela putorius
EMSNGSQIVRSQDSLTFQDVAVNFTREEWNQLYPAQKILYRDVMLENYRNLVALGHQLYKPEVISQLEKEEQRGMERDSAV

SEQ ID NO: 26806 - protein, 81 aa, Mustela putorius
AQGLVTFRDVAIEFSQEEWKCLEPAQRDLYRDVTLENFSNLASLGLSISKPDVISLLEQGKEPWMITNDMTGPWCPGEQGV

SEQ ID NO: 26807 - protein, 81 aa, Mustela putorius
RPQELIAFQDVAIDFSQEEWGQLSPGQKVLYWDVMLENYRNLISLGICGFENFISDWGTGSDNRIPSKHNISEESPQKKGH

SEQ ID NO: 26808 - protein, 81 aa, Mustela putorius
PLESVTFEDVAIDFTKEEWALLDISQRKLFRDVMLENIRHLVSLGYQHCKSDLIFQLEQGQELRSEGTGFLQGQSPGRGNA

SEQ ID NO: 26809 - protein, 81 aa, Mustela putorius
FQGSVTFRDVAIDFSQEEWEWLQPAQRDLYRHVMLENYGHLVSLGLNISKPHVVSLLEQGRDPWPDNGAVGGGLFSESKGE

SEQ ID NO: 26810 - protein, 81 aa, Mustela putorius
SQALVSFKDVAVDFTQEEWQQLDPAQRTLYRDVMLENFSHLVSMGYPVSKPDVISKLEQGEDPWIIKRDMPDWIYLDENQA

SEQ ID NO: 26811 - protein, 81 aa, Mustela putorius
AQISVTFDDVAVTFTQEEWGQLDPAQRTLYQEVMLENCGLLVSLGCPVPRPELIYQLEHRQELWMLKGHLSQSAYADVKGK

SEQ ID NO: 26812 - protein, 81 aa, Mustela putorius
LQGQLTFRDVAIEFSEEEWRCLTHTQRQLYRDMMLENYRHLLFLGLIVSKPDLVSFLEQKKDPWDVKRKKTVVFDPGRWEW

SEQ ID NO: 26813 - protein, 81 aa, Mustela putorius
ELLSFEDVAMYFTREEWNKLDWAQKDLYRDVMLENYRNMILLGSEIRCRMKKPTPKQKISEDSESCKTSVVKQTLAKRPAE

SEQ ID NO: 26814 - protein, 81 aa, Mustela putorius
WAGSVTFRDVAIDFSQEEWEFLDSAQRDLYRDVMWENYSNFISLAEPSISKPDVITLLDEGKEPWMVVREGTRRHCSDLES

SEQ ID NO: 26815 - protein, 81 aa, Tupaia chinensis
LQGLVSFEDVAVVFTWEEWQDLNDAQKTLYRDVMLETYSILVSLYVQKVDEQIERSQQNQGRCLHQVVITNINMSTNKTTE

SEQ ID NO: 26816 - protein, 81 aa, Odobenus rosmarus
AVTFKDVAVVFTEEELALLDKAQINLYQDVMLENFRNLVSVGDRIKNNISHLQGKGLSYLSQEVLYCWQIWKQRINELTVS

SEQ ID NO: 26817 - protein, 81 aa, Odobenus rosmarus
DPVTFEDVAVEFTQEEWILLDQTQRRLCRDVMLENYKSLAAIDWEICLNTKWSAPQQNILQGKTPNVVEMERSHTGEELFN

SEQ ID NO: 26818 - protein, 81 aa, Odobenus rosmarus
SQESVTFEDVAIDFIEEEWALLDISQRKLFRDVLLRGLTFKSSFYSSLVKPTLDLVIAKVNLHRTQVHILFFLHKRNKICK

SEQ ID NO: 26819 - protein, 81 aa, Odobenus rosmarus
LEVCVISEDVFVSFSREEWMLLDDSQRLLYQDVMLENFALLASLGIVSSRSHSVAQLEQKEDPQMPAQVDMTPVSEREAQK

SEQ ID NO: 26820 - protein, 81 aa, Carlito syrichta
IQDSVVFEDVAVDFTQEEWALLDLAQRNLYRDVMLENFRNLASLGYPLHTPYLISQWKQEEDLETIKRELLHGICTGEHLE

SEQ ID NO: 26821 - protein, 81 aa, Carlito syrichta
GGPVSFEDVAVVFTEAEWKRMSLEQRNLYREEMLENARNLVSLAESKPAEVHFWLSCPLAFGSQQFLSQDELHNHPIPCFH

SEQ ID NO: 26822 - protein, 81 aa, Delphinapterus leucas
GVMESVTLEDVAVGLIQEWALLDDTRRNLYRYVLLDNCRTLAPRGTPSCKACLVSQVGPREELMTAEQGILCATGVDWESQ

SEQ ID NO: 26823 - protein, 81 aa, Delphinapterus leucas
LSFEDVALYFTREEWDTLDWAQKDLYRDVMLDNYRNVLSLGPEARFKMKDLTPKQNISEDLESCKMSLVKQKMARKPLEKL

SEQ ID NO: 26824 - protein, 81 aa, Carlito syrichta
MSKDLVTFGDVAVNFSQEEWEWLNPAQRNLYRRVMLENYRSLVSLDVISLLEQGKEPWMVKKEGTRGACPDWEYVFKSRQF

SEQ ID NO: 26825 - protein, 81 aa, Carlito syrichta
SQELVTFEDVAVYFIRKEWKRLEPAQRDLYRDVMLENYGNVFSLDGETRTENDQEISEDTGPHGVLLGRFQKDISQGLKCK

SEQ ID NO: 26826 - protein, 81 aa, Mustela putorius
MDPSQRNLHKDVMLENYRNLVSLGLAVSKPDMISHLEAGKGPWVVVREIARTSYPEFETKPATKNALSTEDVFEDVSQETI

SEQ ID NO: 26827 - protein, 81 aa, Tupaia chinensis
PKVPVAFDDVSIYFSTPEWEKLEEWQKELYKNIMKGNYESLISMDYAMNQPDVLSQIQPEGGHNTEDPAGPEESEIPADPS

SEQ ID NO: 26828 - protein, 81 aa, Tupaia chinensis
EAVTFGDVAVLFTQEEWGRLSPAQRALYRDVMLENYSNLVSLGKEIGSQQVLHSHQSSPLGAGEQEGVEPGKGCLLGSSRV

SEQ ID NO: 26829 - protein, 81 aa, Odobenus rosmarus
AQESVTFRDVAVFFSQDEWLRLDSAQRTLYREVMLENYDTLVSLGILFSKPKVIFQLQQGEDPWMVENGVSQGPCVGWERL

SEQ ID NO: 26830 - protein, 81 aa, Odobenus rosmarus
FQGSVTFRDVAIDFSQEEWEWLQPAQRDLYRHVMLENYGHLVSLGLDISKPYVVSLLEQGREPWLVKGDVRRDPFSVSESN

SEQ ID NO: 26831 - protein, 81 aa, Odobenus rosmarus
TQDSVVFEDVAVDFTQEEWALLDFAQRSLYRDVMLENFQNLASLGYPLQTPYLISQWKQEEDLETVERGPIQGEHQEGFEI

SEQ ID NO: 26832 - protein, 81 aa, Carlito syrichta
AQGCVTFEDVTIYFSQEEWGLLDEAQRLLYYDVMLENFALIASLGLRSFRSHIIAQLEMGKEPWVPDSVDMTLAMARGAYS

SEQ ID NO: 26833 - protein, 81 aa, Carlito syrichta
KEAFVAFRDVVVDFTQEEWTLLSPAQRTLHREVMLETYNHLVSLEIPFSKPKLIAQLEQGEEPWRKEGKQQLDFWAAGSKP

SEQ ID NO: 26834 - protein, 81 aa, Carlito syrichta
FKEAVTFKDVAVAFTEEELGLLDSAQRKLYRDVMLENFQNLLSVGHQSFPADIFHFLREEKFYMRNTANQREGNLGGKIQT

SEQ ID NO: 26835 - protein, 81 aa, Delphinapterus leucas
SQRPVTFKDVAVDFTQEEWQYLDPPQRDLYRDVMLENYINLISVGYKTTKPALIYKLEQGEEPWMVEREISSWRYPEKVWQ

SEQ ID NO: 26836 - protein, 81 aa, Carlito syrichta
MEFTWEEWQLLDSTQKYLYRDVILENYNNLVAVGYHGTKPDLIFKLEQGEEPWIINATISSQNCPEDWEEWYQESQDEFES

SEQ ID NO: 26837 - protein, 81 aa, Delphinapterus leucas
HVIFEDVAVSFSQEEWGLLNDAQRLLYCDMMLENLSLIASLEQVTEDRNPKLEPSILKPLYSDTSVLVEKDVLYLADNMFT

SEQ ID NO: 26838 - protein, 81 aa, Delphinapterus leucas
RSQESLTFQDVAVEFTREEWDQLYPAQKNLYRDVMLENYRNLVALGHQLYKPEVITQLEQEEQWMMERDSPPDSHPDGENS

SEQ ID NO: 26839 - protein, 81 aa, Carlito syrichta
TQDLMTFEDVAVEFSWWEWRQLDPAQKELYREVMLENFRNLAFLGLPVSKPYVICQLEEGEEPCVLEKEISTGAHSDWEKR

SEQ ID NO: 26840 - protein, 81 aa, Carlito syrichta
ERGLLSFKDVAIEFSPEEWECLDPPQRILYRTVMLENHRNLVFLGLAVSKPDLITCLEQRKEPWDVKRHGTLAKLPAVTSH

SEQ ID NO: 26841 - protein, 81 aa, Carlito syrichta
MASACSKRFVQMCNVGELWSFGLTGMQGLILNLFHFLQAGLSVSKPDVVSLLEQGKEPWLGKGDVRGDLFSVSNCEIKDFS

SEQ ID NO: 26842 - protein, 81 aa, Carlito syrichta
MLAAALLKAKSQEWKRLEPAQRDLYRDVMLENYGNVFSLDGETRTENDQEISEDTGPHGVLLGRFQKDISQGLKCKEAYEQ

SEQ ID NO: 26843 - protein, 81 aa, Carlito syrichta
IQELLTFEDVAVDFTHEEWQYLNPPQRTLYRDVMLETYSNLVFVGKQVTKPDLILKLEVEECPAEVKIPVWSFPEVFQGEE

SEQ ID NO: 26844 - protein, 81 aa, Carlito syrichta
MLENINHLISVGYQLQKSDVIFHLKQGEMLWMVEGIEFPQGQSPGRKSAHKEQEMITTQHITMKDTATIKSVKSYTQDLFK

SEQ ID NO: 26845 - protein, 81 aa, Gulo gulo
AHGSVMFNDVSIVFSQEEWEYLDLEQRDLYRDVMLENYSNLVSLGCFISKPDVISLLEQGKEPWKVVRKGRRQYPDLETRY

SEQ ID NO: 26846 - protein, 81 aa, Gulo gulo
TVTFRDVAVVFTEEELALLDRAQINLYQDVMLENFRNVVSVGDRIKNNTSHLQGKALGSLSQEVLYCWQIWKQRISEFTVS

SEQ ID NO: 26847 - protein, 81 aa, Erinaceus europaeus
SQGSVTYEDVTVIFTQEEWALLNPSEKKLYRDVMWENFRNFLSIGKKHQECEVYNKLFTYSGHRQKHERTHKGVKPYECKQ

SEQ ID NO: 26848 - protein, 81 aa, Bacillus weihaiensis
TAVVVDEAFIHFVRSEFEDLTSLQKTYDNLILLRSLTKIFSIPGLRLGYVIAHEKIIRTLKGNQIPWSINSVVINLLPTLF

SEQ ID NO: 26849 - protein, 81 aa, Roseimicrobium sp. ORNL1
PICQDERQYVGLNGQEWTTLETMQRGGWKNVFKEQEPNVIGIGTEPKMGIGQRTLLLRTPKGNILWDCVSYLDEDTIREVK

SEQ ID NO: 26850 - protein, 81 aa, Anopheles stephensi
PNGFAGKEAWLQFNICLQQSSNWPQHVHLRQGLGEAARRGQGARDGSAGKEHLQEPVAFAEVAVYFSREEWALLDPAQRAL

SEQ ID NO: 26851 - protein, 81 aa, Ixodes ricinus
LDPAQRDLYRDVMLENYSNLLSMGLYIPKPQVISLLEQGKEPWMVGRELTRGPCSDLESMCETKLLSLKKEVYEIESCQRE

SEQ ID NO: 26852 - protein, 81 aa, Ixodes ricinus
SEVSVSFKDVTVDFSREEWQHLDPAQRRLCRDVTLENYSHLLSVGYKVPKPEVIFKLEQGEGPWTLEGETPHQSCSDEDVG

SEQ ID NO: 26853 - protein, 81 aa, Trichomonas vaginalis
GNDYMFANSTIPFTKQEMNVINTAERRQDVEIEMHNDVSRVNLAKQINAQSKIEFETLLQRQQEEANLKKKQAMLFKDPEG

SEQ ID NO: 26854 - protein, 81 aa, Homo sapiens; identical to SEQ ID NO: 2893

SEQ ID NO: 26855 - protein, 81 aa, Homo sapiens; identical to SEQ ID NO: 2894

SEQ ID NO: 26856 - protein, 81 aa, Homo sapiens; identical to SEQ ID NO: 2895

SEQ ID NO: 26857 - protein, 81 aa, Homo sapiens; identical to SEQ ID NO: 2896

SEQ ID NO: 26858 - protein, 81 aa, Syntrophorhabdus sp. PtaU1.Bin058
FWTVDVYVMMSKKKWDSLDPSQRDALTKIMAEYEHKTYEAQIKGQDDITKDLLAKGMKEIKFSPADEKWYINMAYEEGWKA

SEQ ID NO: 26859 - protein, 81 aa, Oryctolagus cuniculus
MMMAFEDLAVYFAWEEWQNMNKVQKILYRDVMLETYSSLLFLGHCITKPDLIFKLEQGAQPWMVSEFLNQNLPKPYECNDC

SEQ ID NO: 26860 - protein, 81 aa, Oryctolagus cuniculus
VAFEDVAVYFSQEEWGHLDEAQRLLYCDVMLENLALLSSLGCWHGAENEKVPSEQDVFVGLSQIMTPKPGLSTPKAHLSEM

SEQ ID NO: 26861 - protein, 81 aa, Pteropus alecto
YEDSVALDDVNVKFTLEEWAFLDRTQKKLYRDVMQETFRNLASIACILEEKWEDHDNDDQHKNHGTNLRLCPASQEYPQNH

SEQ ID NO: 26862 - protein, 81 aa, Ursus maritimus
MPQRCPPVCGLVALEAGFLVFKPELISRLEQGQEPWVLDLKGVEGREGARTFLTDSAVGTASEQACADMGVLKPEPCVAVV

SEQ ID NO: 26863 - protein, 81 aa, Ursus maritimus
ALALVSFKDVAVTFTGEEWRHLDLAQRTLYREVMLETCGLLVSLGHPVPKPELIYLVEHGQELWTVKRGLSKSTFTGASHY

SEQ ID NO: 26864 - protein, 81 aa, Ursus maritimus
FQEPVTFRDVAVDFTQEEWGRLGPAQRTLYRDVMLETFGHLLSLGPELPKPEVISQLEQGAELWAAERGIAQGYCPGGDPG

SEQ ID NO: 26865 - protein, 81 aa, Rhinopithecus bieti
RLESVTFEDVAVYFTQNQWASLDPAQRALYGEVMLENYANVASLVAFPFPKPALISHLERGEAPWGPDPWDTEIQRGISQG

SEQ ID NO: 26866 - protein, 81 aa, Ursus arctos
LQESLTLEDVAVDFTWEEWQLLAPAQKELYRDVMLENYSNLVSVGYQASKPDALAKLERGEEPWAKQEEVPSGTRPELSKV

SEQ ID NO: 26867 - protein, 81 aa, Muntiacus reevesi
AQGSVMFTDVSIDFSQEEWEFLNPDQRDLYKDVMLENYSNLVSMGLYIPKPQVISLLEQGKEPWMIGRELTRGLCSALESM

SEQ ID NO: 26868 - protein, 81 aa, Muntiacus reevesi
EPATFEDVAVDFTQEEWQQLPGNTQEDCQDQGNCNFSLTGCSDLKVDIISKLEHGKDPCIIDVCGKGFIKKSQLVIHQRVH

SEQ ID NO: 26869 - protein, 81 aa, Muntiacus reevesi
ESVTFEDVAVDFTQEEWSLLDKSQKNLFRNVMVETITHLVSVGQSPGECQGPELQGKTVSAGVLRSFLNAQGHIHSRGKLC

SEQ ID NO: 26870 - protein, 81 aa, Muntiacus reevesi
ELLTLEDVAVEFNWEEWQLLDSAQKDLYWDVMLENYNNLVSLEYQGTKSGMLSKLEHGKEPCIIENEMQNRICPGLGKGDS

SEQ ID NO: 26871 - protein, 81 aa, Muntiacus reevesi
GLLTFQDVTIDFTQEEWECLDLGQRELYRDVMLENYGNLACLGLVVSKPDLVTFLEQMKDPWNVRRIETAIYPGMDILHPG

SEQ ID NO: 26872 - protein, 81 aa, Ursus americanus
GCGMNFEDVAIDFSQEEWGLLDETQRLLYCDVMLENFALVASLGCRHGMAPSEQTVPIGESQARASQAGLSQQKIHPCETC

SEQ ID NO: 26873 - protein, 81 aa, Ursus americanus
LLTFGDVAIEFSQEEWGCLSHTQRELYRDVMLENYGHLLFLGEDDSCQISQAPLGVSFLLMPSIEGSSQKVSILENLESYL

SEQ ID NO: 26874 - protein, 81 aa, Ursus americanus
MYFTREEWNRLDWAQKDLYRDVMLENYRNMILLGFQFPKPEVICLLEQWEEPWILDLPRAGTRKASSSACPGSEARCKMKK

SEQ ID NO: 26875 - protein, 81 aa, Ursus americanus
QGCVTFEDVTIYFSQEEWGLLDEAQRLLYCDVMLENFALIASLGKAFAPTRGSELVSDRKLQAALSNQKDYSCDTCGLHLK

SEQ ID NO: 26876 - protein, 81 aa, Ursus americanus
EVISLLEQGEEPWSVEQAYPQSTCPEWMRNLESKPLIPTQSIFEEELSHSMKLERYIWDDPWFSRLEVLGCKDQLEMYHMN

SEQ ID NO: 26877 - protein, 81 aa, Ursus americanus
NFWILRLPPGSKGEIPKEWGKLDEWQKELYKHVMRGNYETLVSLDYAISKPEVLSQTEQGKEPCSWRRTGPKVPDVPVDPS

SEQ ID NO: 26878 - protein, 81 aa, Myotis brandtii
ASLDMKFEDVVIAFSQEQWVLLDEVQRLLYRDVMLEVFTLVSICSPATLLIRPFSCQMCCGCQSRAVWRELTPIVSQNTGS

SEQ ID NO: 26879 - protein, 81 aa, Myotis brandtii
FQASVSFKDVTVGFTQEEWQHLDPTQRSLYRDVMLENYSNLVSVGYCVTKPEVIFRLEQGEEPWILEEEFPSQRLPAIWKP

SEQ ID NO: 26880 - protein, 81 aa, Myotis brandtii
DMNFEDLAIAFSQEEWNLLDEDQRLLYCEEMLEVFALVSSVGCWHKMDEEEVPPEQSVSVGESQVGVSKTAPATQKTYLCK

SEQ ID NO: 26881 - protein, 81 aa, Propithecus coquereli
ELLTFRDVTIEFSPEEWACLDPAQWNLYRDVMLENYRNLFSLGLAASKPDLITCLEQRKEPWKVKRRETVAEHPAVSSHST

SEQ ID NO: 26882 - protein, 81 aa, Propithecus coquereli
VKESVTFKDVAVDFTLEEWRLMDPTQRNLHKDVMLENYRNLVSLGLAVSKPDMIFYLENGKGPWATVKEISRTSYPNLETK

SEQ ID NO: 26883 - protein, 81 aa, Propithecus coquereli
VTFEDVAIYFSQEEWEFLDETQRRLYHNVMLENLALIKSQGCWYGTADDKAPSALSVFEELSQGRTPKAGPSSHKTQPCET

SEQ ID NO: 26884 - protein, 81 aa, Propithecus coquereli
FQEPVIFEDVAVYFTQNEWASLDSMQRALYKEVMLENYANVASLPFPVLKPDLIFQLEQGEAPWVPDPWMSAGGEALRGMC

SEQ ID NO: 26885 - protein, 81 aa, Lynx pardinus
QEPVTFEDVAVYFTQNQWASLDPMQRALYREVMLENYTNMASLGGESRIRNEEPAGKREASEDAEWHRMPGGGLLRNVSQH

SEQ ID NO: 26886 - protein, 81 aa, Saimiri boliviensis
AQESLTLEDVTVDFTWEEWRLLGPTQKDLYRDVMLENYSNLVAVGYQASKPDALLKFERGEESCCRTEDEIYTHVCSEIRK

SEQ ID NO: 26887 - protein, 81 aa, Lynx pardinus
SQGLLTFEDVAIEFSQEELIYLNYSQRELYRDVMLENYGHLLFLGLVVSKPDLVIFLEHKKGVWAVERKETVATHPAVFSP

SEQ ID NO: 26888 - protein, 81 aa, Balaenoptera acutorostrata
MDSLAFEDVAVNFTLEEWVLLDSSQRKLYRDVMRENFQNLVSVETKQEDHDIEDQYKNQGRKLRSPRVEILSGSKGSIFCE

SEQ ID NO: 26889 - protein, 81 aa, Vombatus ursinus
MLENYGNVLLLGFPIPKPDLISQLERGEIPCVPFLPRMKIQVICFDYGSENKVSIPKQDIAKEGKAQRILSAKVPRTICHS

SEQ ID NO: 26890 - protein, 81 aa, Saimiri boliviensis
EEGYVTFEDVAVCFSQEEWRLLDEAQRLLYRNVMLENFSLMASLGLASSKTREITQLESWEEPFMPAWEVMTSAIPRGCWH

SEQ ID NO: 26891 - protein, 81 aa, Saimiri boliviensis
KDVAVVFTEAEWKRLSLEQRNLYKEVMLENLRNLVSLESKPEVHTCPSCPVVFGSQQFLSQDELHNHPIPGFYAGNQPTQE

SEQ ID NO: 26892 - protein, 81 aa, Balaenoptera acutorostrata
QQRPVSFKDVVVGFTQEEWHRLNPAQRALYRDVMLETYSNLVSVGYEGTKPYVILRLEQEEAPWICEASCSGCHCFENIWQ

SEQ ID NO: 26893 - protein, 81 aa, Balaenoptera acutorostrata
SQESVSFEDVAVYFTQNQWASLASAQRTLYREVMLENYANVTSLAAFPFPKPDLIFQLERGEAPGGLDPWTSIRREVRGVC

SEQ ID NO: 26894 - protein, 81 aa, Saimiri boliviensis
MKPGVISHAPDTVVPAAFPFSKPDLIFRLEQGEAAWGSDPWTLAGEEAPRGLCTGGKTKTKTEEQTAQLNISEESESHRLI

SEQ ID NO: 26895 - protein, 81 aa, Oryctolagus cuniculus
SQASVSFKDVSVEFTPEEWQHVSPAQRTLYRDVMLENYSHLVSLGYCIFKPEVIFKLEQGEEAWFSEGDFSSQDLPVLEDY

SEQ ID NO: 26896 - protein, 81 aa, Oryctolagus cuniculus
PKVPVTFDDVAVYFSEQEWGKLEDWQKELYKHVMRGNYETLVSLDYAISKPEVLSQIEQGKEPCTWRRTGPKIPDVPVDPS

SEQ ID NO: 26897 - protein, 81 aa, Oryctolagus cuniculus
FQGAVSFKDVTVGFTQEEWQHLDSSQRSLYRDVMLENYSHLVSVGFCVTKPEVIFRLEQGEEPWILEEEFSNQSFPGIWKA

SEQ ID NO: 26898 - protein, 81 aa, Oryctolagus cuniculus
LQVMIAFEDLAVYFSWEEWQNMNNAQKILYRDVMLETYSSLLSLGHCTTKPDLIFKLERGAEPWMVEECLNQSLPVAMKRD

SEQ ID NO: 26899 - protein, 81 aa, Oryctolagus cuniculus
STVMIAFEDLAVYFTWEEWKKMNNAQKILYKDVMLETYSSLFSLGYCTTKPDLIFKLERGAEPWMVDECLNRSLPVVMKRD

SEQ ID NO: 26900 - protein, 81 aa, Pteropus alecto
GSAAYEFLSVDYSERKWKGPALSQRARRRNVMPETHRSVASWAGDIRMENSELPLKQEISKGSESSDGTSGGLYGVVPGGQ

SEQ ID NO: 26901 - protein, 81 aa, Oryctolagus cuniculus
SQAPVTFEDMAMYLTREEWRPLDPTQRDLYRDVMQENYGNVVSLDFEIRSENEVNPKQEISDDVEFGTTSERPVGNAEENP

SEQ ID NO: 26902 - protein, 81 aa, Oryctolagus cuniculus
MSTLVTFKDVLVDFTKEEWKLLDTVQQMIYKDVMLENYKNLLSLGHPLPKPDVILRLEKGEEPWLVERGFRCKAHSDSETE

SEQ ID NO: 26903 - protein, 81 aa, Oryctolagus cuniculus
SVTFKDVAVDFTQEEWSQLDSPQRALYRDVMLENYQNLLALEGAPRPEVEEAEPPQRRAACQGEAFQEPIMQPARPPGETW

SEQ ID NO: 26904 - protein, 81 aa, Rhinolophus ferrumequinum
SQGPVSFHDVAVDFTQEEWQQLDPEQKTTYRDVMLENYSHLVSVGYDSTKPNVIVKLEQGEEPWIAEGDLPCQSPEEVWKV

SEQ ID NO: 26905 - protein, 81 aa, Rhinolophus ferrumequinum
ARVSVMFSDVSIDFSQEEWESLNDDQRDLYRDVMLENYNNLVSMAGHSISKPDVISFLEQGKEPWLVDREVTGSQCPVLGS

SEQ ID NO: 26906 - protein, 81 aa, Rhinolophus ferrumequinum
MTRPWIEFWGTHHNWVACFFSQPDLAISKPDVISFLEQGKEPWMVERAATRGVCPVLESSYDTKVLSPKQPICEVQSPEWQ

SEQ ID NO: 26907 - protein, 81 aa, Ursus maritimus
QEPVIFRDVAMYFTQKEWQLLKPAQKDLYREVMLENYGNLASLGKDNVPTDRPLRSRRCPSRPPPPTTSQSTPRGTKTLKR

SEQ ID NO: 26908 - protein, 81 aa, Ursus maritimus
LQASVSFKDVTVEFTQEEWQQMGPIQRTLYRDVMLENYNNLVSVGNCIFKPAVIVKLEQGEEPWFLEEKFSNQSHQEDYGD

SEQ ID NO: 26909 - protein, 81 aa, Ursus maritimus
IFRPSQMKVIIFAEGLLDCFIVALLKIYLHFFLQCSQSQFLCDFHLIGYPVSKPDVISKLEQGEDPWTIKRDIPNWIYPDE

SEQ ID NO: 26910 - protein, 81 aa, Ursus maritimus
MDPAPEEWRLLNKAQRHLYRDVMLEVFAIVTSLGCRHGAEDEAAPSEQSISVGRSQINSTQKAYAQEYGMASEGSLRPAEN

SEQ ID NO: 26911 - protein, 81 aa, Ursus maritimus
RLTFRDVAIEFSAEEWECLDPAQRALYRDVMVENYRNLVSLGEENVPPEVGICPNSSARFMIKELLPKKERKNRELCQPVV

SEQ ID NO: 26912 - protein, 81 aa, Ursus maritimus
PQGSAAYQFLSVDYTERKWKGPALSQRAVHQSIMPGNYCSMASLGETRMRRSELPAKQEVSKGPASCDGTSRGVRGVVSEE

SEQ ID NO: 26913 - protein, 81 aa, Ursus maritimus
FQGSVSFRDVAIDFSQEEWEWLQPAQRDLYRHVMLENYGHLVSLAGLNISKPYVVSLLEQGREPWLEKAEVRRDLFSESDG

SEQ ID NO: 26914 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMVRFRRYNLLPS

SEQ ID NO: 26915 - protein, 81 aa, Camelus ferus
PSFHRLRFQFIRSMGWKTRVTREECEKVPRIKSGLEKLGFFFTISGEEGYDSTKPNVIVKLEQGEEPWTVAGELPRPAHPG

SEQ ID NO: 26916 - protein, 81 aa, Myotis brandtii
SRGLVKVKDVPVTWEEWEHLDPVQRDFYRESTLKDYGNTVLPSLETRTENKELIPKQEILEVEPQMQLQERSQGNAPLLSK

SEQ ID NO: 26917 - protein, 81 aa, Myotis brandtii
SDVPQKEQEKMTKFQEAVTFKDVAVVFTEEELALLDPSQRKLYRDVMLENFRNLVSVGEDGRPVTLNDVAVVFTEEELALL

SEQ ID NO: 26918 - protein, 81 aa, Myotis brandtii
DSQVVTFGDLAIYFSQEEWEGLSPEQRGLYKGVMLENYQTLVSLGLCGRKPSMIALLEKGQAPWMERFVRLPCGLGSKCET

SEQ ID NO: 26919 - protein, 81 aa, Propithecus coquereli
IQDSVVFEDVAVDFTQEEWALLDPSQRNLYRDVMLENFRNLASLGYPLHTPHLISQWEQEEDLQPVKRGLSQGICTGEHRE

SEQ ID NO: 26920 - protein, 81 aa, Propithecus coquereli
QAQESLTLEDLAVEFTWEEWQLLGPAQKDLYRDVMLENYSNLVSVGYQASKSDTLSKLERGELWMIEDEICGQICSDIRKI

SEQ ID NO: 26921 - protein, 81 aa, Propithecus coquereli
SVTFKDVAVVFTEEELALLDKAQINLYQDVMLENFWNLVSVGDGIKNNILNLEEKGFSYLLQEMLHCWQIWKQKLHELTVN

SEQ ID NO: 26922 - protein, 81 aa, Propithecus coquereli
YYQDLVTFDDVAVDFTQEEWTLLDTTQRNLYSDVMLENYNNLATVGCQLIKPSLITWLEQEELKAVQGGVFQGWEMQFETK

SEQ ID NO: 26923 - protein, 81 aa, Propithecus coquereli
RPRAVKFVDVAVYFSPEEWGCLRPAQRALYRDVMRETYGHLGALGCAGPKPALISWLERNTDDWEPAALDPQEYPRGVTVQ

SEQ ID NO: 26924 - protein, 81 aa, Vombatus ursinus
MLVTFDDITVYLLQEEWMLLGEQQKEICGSDKLVAPLGTPIANPELFSKLEREVEPWLGDAPGRRKLLSHHLGNKKRRSMG

SEQ ID NO: 26925 - protein, 81 aa, Vombatus ursinus
MLENYGHLVCLGLVVSSPDVISQLERGDAPWTAARDPPRRSRPDGDIRTGTSESAPKLGPSVEEASFERLTRGGSCISSFR

SEQ ID NO: 26926 - protein, 81 aa, Saimiri boliviensis
MGPLQFRDVAIEFSLEEWHCLDTAQRNLYTDVMLENYRNLVFLGIVVSKPDLITCLEQGKKLLTMKKHEMIANPPVICSHL

SEQ ID NO: 26927 - protein, 81 aa, Balaenoptera acutorostrata
SQEQLTFKDVAIEFSQEEWECLDPGQRALYRDVMVETYRNLLSLVISVPDLNIICIVEQEEDPLTVKSDMKIAKNQWVGMY

SEQ ID NO: 26928 - protein, 81 aa, Saimiri boliviensis
SQNAVTFQEVAVDFSQEEWALLDLAQKNLYKDVMLENFRNLTSVGYQLCRHNLIPKVDQQKLKTDEGGILQSDCAEWETQL

SEQ ID NO: 26929 - protein, 81 aa, Saimiri boliviensis
LVTFEDVAVYFSQEEWGLLDAAQRHLYHNVMVENFELITSLGCWHGVEGEEAHPKKNASVEEVLKVRIANADPSTQKANPC

SEQ ID NO: 26930 - protein, 81 aa, Vombatus ursinus
FQEPLTFKDVAVEFTQEEWGQLNSSQKNLFRDVMLENYKNFVYLGLPVSMPAVILLLERGEVPWMSEGEVPRGIHSDSVSQ

SEQ ID NO: 26931 - protein, 81 aa, Vombatus ursinus
ESLTFKDGAVDFTPEEWGCLGPSEKELYRNVMLENYGHLVYLGPLLQTSAYSAPENSCRKERLPIHSRPFKINLRKTSSKE

SEQ ID NO: 26932 - protein, 81 aa, Rhinolophus ferrumequinum
MLENYGNVVSLGFPIFKPDGISQLEQDLLVFDLETKNREVLRDDCSDGETREENKLLIPKQKISEEVHSYKVRVGRLKKDI

SEQ ID NO: 26933 - protein, 81 aa, Rhinolophus ferrumequinum
QESVTFKDVAVDFTVEEWGWLGPGQRELYWDVMLENYQNLLSLGAGLPGSKPDVISRLERGEEPRIEKREAQRVTCPELET

SEQ ID NO: 26934 - protein, 81 aa, Rhinolophus ferrumequinum
AHGSVMFSDVSVVFSQEEWDYLDVEQRDLYRDVMLENYNNLVSLGCFISKPDVISLLEQGKEPWKVVRKERRRYPDLETRH

SEQ ID NO: 26935 - protein, 81 aa, Ursus maritimus
FQELVTFRDVAIDFSRQEWEYLDPIQRDLYRDVMLENYRNLVSLGHSISKPDVITLLEQGKDPWMVVKEDTRRWCTDLESR

SEQ ID NO: 26936 - protein, 81 aa, Ursus maritimus
FNSNTHFLDISVDFTQKEWQLLDPAQRLLYKEVMLENYRQLVSLGHCVTKPELVLKLEQGEKPWAPKRELPSQSCPGEFTR

SEQ ID NO: 26937 - protein, 81 aa, Ursus maritimus
MFGISSTGHSISKPDVITLLEQGKDPWMVVKEDTRRWCTDLESRYEIISCDKVHIYKKHSSFTLHQKIHTREKPYECDTCG

SEQ ID NO: 26938 - protein, 81 aa, Ursus maritimus
FQELVTFRDVAIDFSRQEWEYLDPIQRDLYRDVMLENYRNLVSLAGHSISKPGVVDLLEQGKEPWIILREETQRQYTDLDL

SEQ ID NO: 26939 - protein, 81 aa, Ursus arctos
FQEAVTFKDVAVVFSEEELGLLDPAQRELYRDVMLENFRNLVSVGHSSSKPDVISQLEREEKLCMKETHSERGDRHQKEME

SEQ ID NO: 26940 - protein, 81 aa, Ursus arctos
RPHPRHHLPMDVPEEPVTFEEVSTQFSGEQWQCLDPDQQALSRDMMLDNFGSSASLGSPISLPQPEAMQPHVVPGHSPSRP

SEQ ID NO: 26941 - protein, 81 aa, Ursus arctos
GQGSVSFRDVTVDFTRDEWLRLTGTQRTLYRDVMLENYSHLVSVGCHLSKPEVIFRLEQGEELWPSEGGFPDQCDQDRSRE

SEQ ID NO: 26942 - protein, 81 aa, Ursus arctos
KPGAVSFADVAVYFSPEEWGCLRPAQRALYRDVMRETYGHLGALGFPGPKPALISWMEQESEAWSPDAQDPEEGESLGGAL

SEQ ID NO: 26943 - protein, 81 aa, Ursus arctos
WVESVTFKDIAVDFTQEEWALLDTSQRKLYRDVMLENISHLVSVGYHLCKSDVISQLEQGVELWREGGGFLQGLNPDRKSG

SEQ ID NO: 26944 - protein, 81 aa, Ursus arctos
MQVRFVSVRESCALVGAGPAGPKPGVITQLERGDEPWVLDAQGAKGKERLRVSVSGHETRTEYKELSSGETLDGEELDQLQ

SEQ ID NO: 26945 - protein, 80 aa, Muntiacus reevesi
LSKDPLCHPEGKIEADRMVSKCLRDCSQDSVTFADVAVYFTQEEWTLLNPFQRKLYRNVMLENYKNLTTADTKSQWTGTV

SEQ ID NO: 26946 - protein, 81 aa, Muntiacus reevesi
MDFKDVVIYFSQKEWECLHSAQKDLYRDVMLENYNNLISLAIVISLLEQGKEPWVVKGKDTEAWCPGEENDVISTLQKSIV

SEQ ID NO: 26947 - protein, 81 aa, Myotis brandtii
SLLTFEEVAVYFSQEEWELLDISQKTLYNDVMQENYETVISLAVPTHQILYFPEQTNTKDWTVAPELILPESQTLLTFEEV

SEQ ID NO: 26948 - protein, 81 aa, Myotis brandtii
DMNFEDVAIAFSQEEWGLLDEDQRHLYCDVMLEVFALVSSVGCWHKTEKEDTCSDESISVQGESKFMASKTATATQKTHLC

SEQ ID NO: 26949 - protein, 81 aa, Propithecus coquereli
FQEAVTFKDVAVAFTEEELGLLDSAQRKLYREVMLENFRNLVSVGHQSFKPEMISQLEREEKLWVKEIQTQMGRCRGGRNQ

SEQ ID NO: 26950 - protein, 81 aa, Propithecus coquereli
SQGSVTFRDVAIDFSQEEWKWLQPAQRDLYRCVMLENYGHLVSLAGLSISKPDVVALLEQGKEPWLGKGDVRRDLFSVFSA

SEQ ID NO: 26951 - protein, 81 aa, Propithecus coquereli
SKNLVTFGDVAVNFSQEEWEWLNPAQRNLYRKVMLENYRSLVSLGVSVSKPDVISLLEQGQEPWMVKKEGTKGTSPGWEYV

SEQ ID NO: 26952 - protein, 81 aa, Propithecus coquereli
NFWILRLPPGSKGEVPKEWGKLEDWQKELYKHVMRGNYETLVSLDYAISKPEVLSQIEQGKEPCSWRRAGPKIPDVPVDPS

SEQ ID NO: 26953 - protein, 81 aa, Propithecus coquereli
CQESVTFEDVAVVFTDEEWRHLVPIQRDLYEEVMLENYKSIVSLGLPVPQPDVIFRLKREDWPWIVDLHRSEEKECPQSVS

SEQ ID NO: 26954 - protein, 81 aa, Propithecus coquereli
SQEQVSFTDVCVDFNQEEWSLLDPAQKILYRDVILENYSNLVSVGHCVTKPEVIFKIEQGEEPWILEKGFPRQCYPERKWK

SEQ ID NO: 26955 - protein, 81 aa, Propithecus coquereli
NPGSWEMKLVTFSDVTINFSLCGWACLDPAQRDLCRNVMFENYRNLVFLGLAAFMLDLIACLEQRKEPWDVKRHEIVAKHP

SEQ ID NO: 26956 - protein, 81 aa, Propithecus coquereli
VQEPVTFKDVAVDFTQEEWGQLDLVQRTLYRDVMLETYGHLLSVGNQITKPEVISLLEQGEEPWSVEQAYPQSTCPEWMRN

SEQ ID NO: 26957 - protein, 81 aa, Propithecus coquereli
SQTLVTFDDVLVDFTREEWKLLDAAQQIMYKDVMLENYKNLLSLGHQLPKPDVVLRLEKGEEPWLAERGIHQETPPDLETA

SEQ ID NO: 26958 - protein, 81 aa, Propithecus coquereli
RGIVTFEDVAVYFSWEEWDLLDEAQKHLYFDVMLENFALTSSVGKALTLILVPWTRFCISPFPQEQLCCWHGVEHEEAPSK

SEQ ID NO: 26959 - protein, 81 aa, Propithecus coquereli
PKVPVAFDDVSIYFSTPEWEKLEEWQKELYKNIMKGNYESLVSMDYAMNQPDVLSQIQPEGEQNTEHQAGPEESEIPTDPS

SEQ ID NO: 26960 - protein, 81 aa, Propithecus coquereli
AAQGMTFEDVAICFSQEEWMLLDGAQRLLYCSVMLENFALVASLGYCHGTENEVITSEQKVSVEGMSQVRISEAGPSTQKT

SEQ ID NO: 26961 - protein, 81 aa, Balaenoptera acutorostrata
MIKSQISFEDVAVDFTLEEWQLLNPTQKTLHRDVMLENYSNLVFLGYQMIKPEAIFKLEQEEPWILGEEILSQNFPEEVWL

SEQ ID NO: 26962 - protein, 81 aa, Saimiri boliviensis
MGLLTFRDVAIEFSVEEWEHLEPAQKTLYWDVMLENYRNLVSLGLTVSKPDLITFLEQRKEPWNVKSAETVASQPDMFSHD

SEQ ID NO: 26963 - protein, 81 aa, Lynx pardinus
MLENYSNLASVGYQVGKPSLISHLEQEEELRTEERGLHRATSPDWETPSKSKWSILMEDIFGKETPRGVTVERTRLGEKPA

SEQ ID NO: 26964 - protein, 81 aa, Saimiri boliviensis
QVNFEDVFVYFSQEEWVLLDEAQRLLYRDVMLENFALMASLGKAITSTPVTWTGPSVATGTLSRSGPGNTNLHQHQKQHSG

SEQ ID NO: 26965 - protein, 81 aa, Vombatus ursinus
EQYITFKEMAMKFAAEEWVQLNPSQKKLYRDVMLEYYRKLVSLGFAIYLECQRQIFQETQGDIPDTVHRRIHTGENPYEGS

SEQ ID NO: 26966 - protein, 81 aa, Balaenoptera acutorostrata
MWCWRTTAAASRWGINVSKPDVIFRLEQGEEPWTAEEFSNQNYSEAGDALKEDKEIQGKHLRQIVFFCNKTLITERATVFG

SEQ ID NO: 26967 - protein, 81 aa, Vombatus ursinus
MEICDVAVYLTQKEWEALTPFQQALYRHVVLENYSNMISLAFLFPKPAVISQLEQGGDPWVLDPQGPLDREGTCYTGECTK

SEQ ID NO: 26968 - protein, 81 aa, Balaenoptera acutorostrata
EEGQVTFEDVAVYFSQEEWGLLDEAQRLLYRSVMLENFSLMASLGLTCSRTHEVTQLEQWGEPFMPACGVVITAMPRGCWC

SEQ ID NO: 26969 - protein, 81 aa, Vombatus ursinus
VAFKDVAVEFNQEEWRCLDASQKELYHDVMMENYKNLVCLGKDSFTLSPKICSLEGLCYCKLHSHLQSFRFKVKYFISCND

SEQ ID NO: 26970 - protein, 81 aa, Saimiri boliviensis
YQDSVTFDDVAVEFTPEEWALLDTTQKYLYRDVMLENYKNLASVEWEIQPRTQGLSLQQSFLKNEIFSGIQMTSYSGWKLC

SEQ ID NO: 26971 - protein, 81 aa, Saimiri boliviensis
RQEPVTFEDVAVYFTQNEWTSLDPAQRALYREVMLKNYANMASLAFPFTTPVLVSQLEQGERPWGLDPWEPVGREARRGVC

SEQ ID NO: 26972 - protein, 81 aa, Vombatus ursinus
LQTSLMFKDVAVYLTREEWGCLGPAQRGLYRDVMLENYRNLVSLGFSVSKPDIISQLEKGEEPWVLDIQGAGGREIMKSDY

SEQ ID NO: 26973 - protein, 81 aa, Lynx pardinus
VGDQDFTASVLQAAPQEPWRHLESVQKEQYWDLMLETYGKMVSGGISSSKPDPTGPTEYGEEPAGRHPHLSEKIPRPACLG

SEQ ID NO: 26974 - protein, 81 aa, Saimiri boliviensis
IQGQVNFEDVFVYFSQEEWVLLDEAQRLLYRDVMLENFALMASLGCWPGTKDEEIPFEQSFSIGLSQIKIPKGSPFTQKAY

SEQ ID NO: 26975 - protein, 81 aa, Balaenoptera acutorostrata
GVTFEDIAVYFSWEEWRLLDEAQIRLYLDVMLENYTLISSLGCCCGAEDAEAPFEQIASLGVSQARTPKAALCSQKTHPCE

SEQ ID NO: 26976 - protein, 81 aa, Rhinolophus ferrumequinum
MLETYSHLLSVGYQVPEPEVFMLEQGKKSWTLQDESPHQSCSEKLWQIGDQIESHQQRGNKYLRDGAFIQEIMSTKRDYEY

SEQ ID NO: 26977 - protein, 81 aa, Rhinolophus ferrumequinum
AQGRVVFEDVAIHFSQEEWELLDEAQRRLYHRVMTENVALLSAIGWCHGAQDEEAPSEQGDSVGESQVRTPKPDLSTHRAQ

SEQ ID NO: 26978 - protein, 81 aa, Rhinolophus ferrumequinum
MLENFRNMVSVGHQPFTPDVVPPLEREEKLWMTKPASQSHGSLGDKNLNDTKIVQEVGLRYLSHEELFCSQIWQQVTKELA

SEQ ID NO: 26979 - protein, 81 aa, Rhinolophus ferrumequinum
ALLDPSQKKLYRDVMRETFRNLASVGMPDNLIFTLLEAKCFLSHKIERLCESKEGSQCEKNFSRVPNLNLKRKTLSRVEPW

SEQ ID NO: 26980 - protein, 81 aa, Rhinolophus ferrumequinum
AQGYVTFEDVAVYFSWEEWGLLEEAQRLLYRSVMLENFALVASLGLASSGTHEITQLERWGEPFLPAPGVMTMAAPKGCWY

SEQ ID NO: 26981 - protein, 81 aa, Rhinolophus ferrumequinum
QDTVVFADVAVNFTREEWALLDGAQRKLYREVMLETCRNLASVDCFTQVKTSASCPQQDNLEKEISSEQKIVKFTRNDFCS

SEQ ID NO: 26982 - protein, 81 aa, Ursus maritimus
SVTFRDVTVDFTQEEWQQLEPAQKDLYRDVMLENYRNLVSLDLETRPEMKESGPKEDSAEDRPSAGVVVEGPTRNGAHGLA

SEQ ID NO: 26983 - protein, 81 aa, Ursus maritimus
MLENYGNLVSVGLLSSKPKLITQLEQGAEPWMEVQQIPSDTCSVQEYWFETKMSTLKQHASEGSDLGEQTKSDVMERDLDW

SEQ ID NO: 26984 - protein, 81 aa, Ursus maritimus
PGGLLTFGDVAIEFSQEEWRCLSHTQRELYRDVMLENYGHLLFLGLIASKPDLVSCLEQKKEPWDLKRRKTVVIHSGSFMP

SEQ ID NO: 26985 - protein, 81 aa, Rhinopithecus bieti
TQGQVTFKDVAIEFSQEEWTCLDPAQRTLYRDVMLENYRNLASLGISCFDLSIISMLEQGKEPFTVESQVQIARNPDGWEW

SEQ ID NO: 26986 - protein, 81 aa, Rhinopithecus bieti
RNVMLENYKNLVFLGIDVSKQDPITSLEQEKEPWNMKRHEMVDESPGYMCRMCSYVFLFYQRPLARARHKRFFSTSDTEKV

SEQ ID NO: 26987 - protein, 81 aa, Ursus arctos
STEPVIFRDVAMYFTQKEWQLLKPAQKDLYREVMLENYGNLASLGYRLFKPKLITRLEQGDEPCVKERDVPRAPLQGDAGI

SEQ ID NO: 26988 - protein, 81 aa, Ursus arctos
MDSVAFEDVTVKFTMEEWALLDPSQKKLYRDVMQETFRNLASIECISEEKWEIHDREDQDEDHGTNLSSQMVERLCKSKEY

SEQ ID NO: 26989 - protein, 81 aa, Ursus arctos
SQGRLTFRDVAIEFSPEEWECLDPAQRALYRDVMVENYRNLVSLGEDSFPPEVVSSCCIKKCFLKTPGRVVSMSQDAEMEG

SEQ ID NO: 26990 - protein, 81 aa, Ursus arctos
SHGPLSFEDVAIAFTKEEWQQLDPAQRTLYRDVMLENFSHLVSLGHPVSKPDVISKLEQGEDPWIYPGRETRLENPQLDIL

SEQ ID NO: 26991 - protein, 81 aa, Ursus arctos
LVMFEEVSVCFTSEEWECLGPIQRALYWDVMLENYGNVTSLEWETMTENEEVTPKPSISQRADSQKGTSRRLQGGAPQTPG

SEQ ID NO: 26992 - protein, 81 aa, Muntiacus reevesi
SQSLLTFEEVAIYFSQEEWELLDPAQKALYNDVMHENYETVISLLLFVLPKPKAISCLEQGEEPYIQGSPVFKDNPGALLS

SEQ ID NO: 26993 - protein, 81 aa, Ursus americanus
MDRSQRKLYIDVMLENITHLVSVGCQFFQSDVISQWEQGGELWREDRGFAQGWNPGLENSHKKEETISMQDIFKEDPSNYN

SEQ ID NO: 26994 - protein, 81 aa, Ursus americanus
RRPSGHVTFEDVAVYFSQEEWRLLDEAQRHLYRTVMLENLALIASLGWWHGVKAEEALSEQCVFVERVSQASTPDPGLSIP

SEQ ID NO: 26995 - protein, 81 aa, Myotis brandtii
ELLQESLTFHDVAVDFTWEEWQLLDSEQKDLYRDVMMETYSHLVSVGEDSSHVSLKRRPDSASPGRSGSFWTPSRRTCTGT

SEQ ID NO: 26996 - protein, 81 aa, Eschrichtius robustus
FQGPVTFKDVTVEFTQEEWQLLDAAQRTLYREVMQENYRHLISVGYCVNKPNAVFKLKQGKEPWILEVEFPCRNYPEDLWN

SEQ ID NO: 26997 - protein, 81 aa, Myotis brandtii
FQESVTFEDVAVYFTQNQWASLDPVQRALYRDVMLENYANVAALVAFPAPKPDLISQLERGSAPWRPDPWEAEVLRGICPG

SEQ ID NO: 26998 - protein, 81 aa, Myotis brandtii
QLTFSDVAIEFSQEEWACLDPAQRKLYRDVMLQNYRNLVFLALSSQVTQGLFLKSDVEDSFQKMQQSSHNEERSNQCNDYF

SEQ ID NO: 26999 - protein, 81 aa, Propithecus coquereli
HLVTFEDVAVDFAQEEWTLDLYRNAMLENYRNLITLGKSGIVSSLSPSENECSLNFFSKPIFFILFSELNLQIKTKGSTLL

SEQ ID NO: 27000 - protein, 81 aa, Propithecus coquereli
FQESVTFQDVAVDFTPEEWQLLDCAERTLYWDVMLENYRNLISVGCPVTKTKVIFRVEQGQEPWMVEGGNSCWSHPKADCP

SEQ ID NO: 27001 - protein, 81 aa, Propithecus coquereli
EGMAAGLLTAGPHFAQEGWRYLVPTPRDRFKEGIPEKSRNLVLLGLPVSQSGMNSQLEQREGPWMLEGEDLRSSCPDWKII

SEQ ID NO: 27002 - protein, 81 aa, Vombatus ursinus
MALLLPILSHFFPLSSGLPVFKPDVISQLERGEGPWTPEAEVPQVSCPESLVQKQRCETMNLTSKQGISMGRSCMGRLTKN

SEQ ID NO: 27003 - protein, 81 aa, Lynx pardinus
LFQGWLTFRDVAIEFSQEEWECLDPTQRALYRDVMLENYRNLVSLGEDNFSPEYINCVENRIGLSLQAHLAELQRFHSEEK

SEQ ID NO: 27004 - protein, 81 aa, Balaenoptera acutorostrata
ALAPVTFKDVVVTFTPEEWELLDPAQRTLYRKVMLVTYRLLVSLGHPVPKPELTYLLNPGQKLWMVKRGFSQSSSSGDKAK

SEQ ID NO: 27005 - protein, 81 aa, Saimiri boliviensis
DVALDFSHEEWGWLDSAQRDLYKDVMVQNYENLVSLAGLSITKPYVITLLEDGKEPWMNAFHILFLIVFFFCILFYPLPIF

SEQ ID NO: 27006 - protein, 81 aa, Balaenoptera acutorostrata
FRGSVMFRDVSINFSQEEWECLDSGQMNLYKEVMLENFSNLVSVGLSSSKPAVISLLEQGKEPWMVDRELTRGLCSDLESM

SEQ ID NO: 27007 - protein, 81 aa, Saimiri boliviensis
FFGQVTFRDVAIEFSQEEWTCLDPAQRSLYRDVMLENYRNLASLAGISCFDLSIISMLEQGKEPFTLDSQVQIAGSPNGWE

SEQ ID NO: 27008 - protein, 81 aa, Panthera pardus
SQGLLTFRDVAIEFSQEELRCLNHSQWELYRDVMLENYGHLLFLGLVVSKPDLVIFLEHKKDVWAMERKETVATHPAVFSP

SEQ ID NO: 27009 - protein, 81 aa, Panthera pardus
TQDSVVFEDVAVDFTQEEWALLDLAQRNLYRDVMLENFQNLASLGYPLYTPYLISQWKQEEDLETVERGPIQGEHQEGFET

SEQ ID NO: 27010 - protein, 81 aa, Panthera pardus
MDSSQEEWTLLDQTQIALYRDAMLENYQNLITLGYKSCKPDLSSALEGAELLRTGGRGVLQDLRPSEVDRDSLEREADGHN

SEQ ID NO: 27011 - protein, 81 aa, Macaca nemestrina
KKKPVTFEDVAVNFTQEEWDCLDASQRVLYQDVMSEIFKNLASVARIFLHKPERITKLEQEEEQWREFVHLPNTEGLSEGK

SEQ ID NO: 27012 - protein, 81 aa, Macaca nemestrina
GTVTFEDVAVNFTQEEWNLLSEAQRCLYRDVTLENLALISSLGCWCGVEDEEGPSKQSIYIQRETQIRIPMAGVSLKKVHP

SEQ ID NO: 27013 - protein, 81 aa, Ursus arctos
MAVTFEDVTVIFTWEEWKFLDSSQKKLYREVMWENYTNVMSVGNWKESYKPQEERLRYLEHENRLSWQGWRNASAQIYENR

SEQ ID NO: 27014 - protein, 81 aa, Ursus arctos
WAQVPVTFKDVAVEFTQEEWMMLDSGQRRICRDVILENYMSLTSVEYQLWKPTVISPLAAEEIRTMKRRILQGTYPDWEIQ

SEQ ID NO: 27015 - protein, 81 aa, Ursus arctos
MQKNLYRDVMLETFQNLVSVDYETLFKASGLVSQQDRHEEKNASEQKMAKFTRNHSCAYILEKNWEDHSIEDQHGNHSRHL

SEQ ID NO: 27016 - protein, 81 aa, Muntiacus reevesi
ETVTLKDIAIDFTQEEWALLDTSQKKLFREVMLESISHLVSVGYQLRKSDVISQLEQGAELWKEEKGFPQCPSSGELQAPA

SEQ ID NO: 27017 - protein, 81 aa, Muntiacus reevesi
SWGPLSFMDVFVDFTWEEWQLLVPAQKCLCRSVMLENYSNLVSLGYRHTKPSIIFQLEQEELRMMQILSQGHPGKLRQKTV

SEQ ID NO: 27018 - protein, 81 aa, Muntiacus reevesi
MGRLTFWDVAIDFTQEEWECLDLGQRELYTDVMVENYRNLASLGLVVSKPDLVTFLEQMKDLRNIRRMQTTGIYPVLLLYR

SEQ ID NO: 27019 - protein, 81 aa, Muntiacus reevesi
CQDPVTFEDVAIVFTDEEWRHLVPTQRNLYKEVMLENYKSIVSLGLPIPGPDVIFQLKRGDEPWLVEFHGFEGKEGAENVS

SEQ ID NO: 27020 - protein, 81 aa, Ursus americanus
MFFNPITLLCSEGSIKLILFFLLCTIMFFQAGCSISKPDVITLLEQGKEPWMVVRDERRRSLDLESRYDTKKLFQEKDIYE

SEQ ID NO: 27021 - protein, 81 aa, Myotis brandtii
QGPLTFKDVAIDFSQEEWECLDPAQRKLYLDVMVENCSNLASLAMASEDNQAFLLKPTLQSLSSEIILGPVTFRDVAIDFS

SEQ ID NO: 27022 - protein, 81 aa, Myotis brandtii
MSEMNFEDVAIAFSEEEWGLLDAAQRLLYCEEMLEIFALVASVGCCHKTDDEEACSEQSVSVEGESQVRESETAPAAEKTH

SEQ ID NO: 27023 - protein, 81 aa, Myotis brandtii
GNDVNKDSVAFEDVAVNFTLEEWALLDSSQKKLYRDVMRETFRNLASIDVNICLMECCKWWAAKKEDSVAFEDVAVNFTLE

SEQ ID NO: 27024 - protein, 81 aa, Propithecus coquereli
SQGLVTFEDVAVYFSLEEWERLDADQRGLYQEVMEENYGILVSLGYPIPKPDLIFRLEQGEEPWVPDSPRPEEGDIVTGVY

SEQ ID NO: 27025 - protein, 81 aa, Propithecus coquereli
KDVAIEFSQEEQACLDPAQQNLYRDVMLENYRNLVFLGLVVSKPDLITFLEQRQGPWNVKRHETVAKLQGIFSHYTQGLWK

SEQ ID NO: 27026 - protein, 81 aa, Propithecus coquereli
MEHLTFRDVAIEFSQEEWKCLDPAQRALYRDVMLENYRNLVSLDISPKCVIKELSPTGESATGEVFHTVMLERHESHPIAD

SEQ ID NO: 27027 - protein, 81 aa, Propithecus coquereli
YQTPVSFKDVVVGFTQEEWHRLSPAQRALYRDVMLETYSNLVSVGYEGTKPDVILRLEQEEAPWICEVACPGCHRWEDIWQ

SEQ ID NO: 27028 - protein, 81 aa, Propithecus coquereli
SQVLVSFKDVTVGFTQEEWQHLGPAQRALYRDVTLENYSHLVSVGCCVTKPEVVFKLEQGEEPWIGEEESPSQSHPEFWKV

SEQ ID NO: 27029 - protein, 81 aa, Vombatus ursinus
MLENYRNLVSLGLKEDKPDLVSWLEQGEEPSASDLQGEGPRSPCPWEGDTSARCRGASGCHSPAGPSAWDTGTENQEESLH

SEQ ID NO: 27030 - protein, 81 aa, Saimiri boliviensis
ELLTFRDVAIEFSPEEWTCLDPAQQNLYRDVMLENYRNLVSLGVAISNPDLVTCLEQRKEPCNVKIRETVAKPRAVCSHFT

SEQ ID NO: 27031 - protein, 81 aa, Saimiri boliviensis
FQELLTFRDVTIEFSLEEWEFLNPAQQNLYRNVMLENYRNLVSLGLGWISEPVLVPRDLEQASVFLFNHTMSCHYTEDFLP

SEQ ID NO: 27032 - protein, 81 aa, Saimiri boliviensis
METHSQLVPPQASVCFEDVAMAFTQEEWEQLDLAQRTLYREVTLETWEHLVSLGLLLSKPDVVSQLEQEEDLYRAEQVALQ

SEQ ID NO: 27033 - protein, 81 aa, Propithecus coquereli
FEGSLSFEDVAVDFTRQEWHRLDPAQRTMHKDVMLETYSNLASVGLCVAKPEMIFKLERGEELWILEEESSSHGYSGSLSL

SEQ ID NO: 27034 - protein, 81 aa, Vombatus ursinus
DHELVAFKDVAVEFNQEEWRCLDASQKELYHDVMMENYKNLVCLGKDSFTLSPKICSLEVTKFPITKLGIPVEESSQETLT

SEQ ID NO: 27035 - protein, 81 aa, Balaenoptera acutorostrata
AQESVMFSDVSIDFSQEEWEYLNDAQRDLYREVMLENYSNLVSMGRSISKPDVISFLEQGKEPWLVDRELTRDQWPVLESR

SEQ ID NO: 27036 - protein, 81 aa, Saimiri boliviensis
TQDRVVFEDVAIYFSQEEWGHLDEAQRLLYRDVMLENLALLSSLGCCHGAENEEAPLEQGVSVGVSQVMAPKPCLSTQKTQ

SEQ ID NO: 27037 - protein, 81 aa, Balaenoptera acutorostrata
KSQGSLSFKDVAVVFTWEEWQLLDRVQKNLYQDVMLENYINLISVGYQVTKADAFYRLEQETPWIIEEESQSHIHPEDTWQ

SEQ ID NO: 27038 - protein, 81 aa, Balaenoptera acutorostrata
DETLMAFKDVAVAFTQKEWKLLSPAQRTLYRDVMLENYSHMVSLGIAFPKPKLITQLEQGDEPWREESESLLDLCPEPGTE

SEQ ID NO: 27039 - protein, 81 aa, Saimiri boliviensis
MAFEDVAVYFSQEEWGLLDTAQRALYRRVMLDNFALVASLGLSTTRPRVVIQLERGEEPWVPSGTDMTMSRNAHRRRNPGS

SEQ ID NO: 27040 - protein, 81 aa, Oryctolagus cuniculus
MLETYSSLQSLGHCITKPDLIFKLEQGAEPWLVKECLNQSLPVAQRRDDVIRTKQESEDTNLRQELITNSTSTHKKVDSRK

SEQ ID NO: 27041 - protein, 81 aa, Rhinolophus ferrumequinum
AQGSLSFEDVTVEFTQEEWPYLGPAQRALYRDVMLENYSHLVSVGYCITKPQVIFKLEQEEEPWSLGEEFLNQRYPGHYKV

SEQ ID NO: 27042 - protein, 81 aa, Rhinolophus ferrumequinum
LLTFRDVAIEFSQEEWECLDPAEQKLYMDVMSENYRNLLSLDISTSCVVKESSPKEDVNNGELFQTLILERQVSHDLNDFD

SEQ ID NO: 27043 - protein, 81 aa, Macaca nemestrina
EMGLLTFRDIAIEFSLAEWQCLDRAQQNLYRDVMLENYRNLVSLGIADSKPDLITCLEQNKESWNIKRNEMVCEVHKGGYN

SEQ ID NO: 27044 - protein, 81 aa, Macaca nemestrina
QLLFRDVAIEFSQEEWKCLNPGQKALYRDVMLENYRNLISLGEDNVPPEAWICSGICLPDLSQKRDPWTLQQTIQEWQEYI

SEQ ID NO: 27045 - protein, 81 aa, Macaca nemestrina
SQHLVTFEDVAVDFTQEEWTLLDQTQRDLYRDVMLENYKNLIILAGSEFCKPSLMSGLEQMEKLRTGVTGVLQELDLQLKT

SEQ ID NO: 27046 - protein, 81 aa, Ursus arctos
SLELVSFEDVAVNFSWEEWQDLDDAQRTLYRVVTLETYSSLVSLGHCITKPEVIVKLEQGAEPWTVEEAPTQSLPDVQTSG

SEQ ID NO: 27047 - protein, 81 aa, Ursus arctos
LVTFKDVSGGFTEEERGCRDPTQRKLHRAVMLENYSQLVSVGDLNENSMENLQEKVLRDLLRRLFCWLILGDTASTITEYY

SEQ ID NO: 27048 - protein, 81 aa, Ursus arctos
QQIAVTFKDVAVDFTQEEWLLLDLTQRNLYRNVMLENYQNLVAVEYQLSKPKLIAWLEQQELRTVEKGVFQEWETQPQTER

SEQ ID NO: 27049 - protein, 81 aa, Ursus arctos
AQAPVTFKDVLVTFTQEEWELLDLPQRTLYWKVMGETCRLLVSLGKNLCTDDLQEQVSPGDALLECESHRSRRDPLIHGGK

SEQ ID NO: 27050 - protein, 81 aa, Muntiacus reevesi
PQESVTFEDVAVNFSHEEWQCLTHAQRHLYKDVMLENYGNMVSLGFSFSKPPLISDLEQGTEPYVQDRQDWEFLSCSYPAA

SEQ ID NO: 27051 - protein, 81 aa, Muntiacus reevesi
MTFKDVFIDFTPEEWECLDPAQRNLYKDVMVETLRNLLSVDMSHMHTIKKLQAKANSVKGEIFQRVMFGRAESLDIKDFHL

SEQ ID NO: 27052 - protein, 81 aa, Muntiacus reevesi
HLTFKDVAVEFSQEEWECLDPAQRALYRDVMLETYRNLLSVAVSHIHVIKKLKPKANSDTGVFQTVMLGRYESHEIRDFYF

SEQ ID NO: 27053 - protein, 81 aa, Muntiacus reevesi
GSVSFTDVTVDFTQEEWEQLDPSQRILYMDVMLENYSNLLSVEVWKADDQMETDHRSPDEQARPFVIFKDQTTIEERDNNL

SEQ ID NO: 27054 - protein, 81 aa, Muntiacus reevesi
TFRDVAIHFSQQEWECLNPVQKNLYRDVMMKNYDNLVSLGHSISKPDVISLLEQGKEPWMVVGEETRRWCTVEACELLVKA

SEQ ID NO: 27055 - protein, 81 aa, Muntiacus reevesi
WFSHSISFEDVAVNFTLEEWQLLNPTQKTLYRDVMLENYSNLVLLGYQVIKPEMIFKLEQEKPWLLDEEILSQNFSEKVWL

SEQ ID NO: 27056 - protein, 81 aa, Ursus americanus
TQEEWQHLDPAQRSLYRDVMLENYSHLVSLGYSISKPEVILKLEQGEEPWILEEEFPSQSDPELINSRNYSRKKFNEFNKG

SEQ ID NO: 27057 - protein, 81 aa, Ursus americanus
VDFTQEEWQHLDPAQKTLHRDVMLETYSHLVSVGCSGIKPGIIFKLEREEDPRIIKSELSTWVHSDREKSLDSPQQIISEE

SEQ ID NO: 27058 - protein, 81 aa, Ursus americanus
PKVPVSFEDVSVYFTKTEWKLLDLRQRILYKRVMLENYRHLVSLGFLSSKPHLVSWLEQGEGPWAADICRTPAATGRQTGE

SEQ ID NO: 27059 - protein, 81 aa, Propithecus coquereli
PLTFKDVAVVFTEEELGLLDSAQRKLYRDVMLENFRNLLSVGDQNGKDMEYIQEKELRFLSHKELSSWKIWEQVAGELTRS

SEQ ID NO: 27060 - protein, 81 aa, Saimiri boliviensis
AEGSVMFSDVSIDFSQEEWDCLDPVQRDLYRDVMLENYSNLASMGLYTPKPQVISLLEQGKEPWMVGRELTRGLCSDLESM

SEQ ID NO: 27061 - protein, 81 aa, Saimiri boliviensis
IQDSVVFEDVAVDFTQEEWALLDLAQRNLYRDVMLENFQNLASLGYLLHTPHLICQWEQEEGLQTVNRELLQGICVREHQE

SEQ ID NO: 27062 - protein, 81 aa, Balaenoptera acutorostrata
SQALLTFRDVAIEFSQEEWECLNPAQRALYRDVMLENYRNLVSLDMSTRCMIKELSPKEDINNGDLFQTLVFERLTSHVLP

SEQ ID NO: 27063 - protein, 81 aa, Balaenoptera acutorostrata
APLPMAFDEVALYFLEQEWEILEKWQKEMYQQEMKTNYETLDSLGCISSKPDLITWMEQGRMLLIRDQGHLEKTQMTLGLS

SEQ ID NO: 27064 - protein, 81 aa, Lynx pardinus
EVSVSFEDVTVNFSREEWQHLDPAQRRLYRDVTLENYSHLRSVGEDIGKVQQQRISGKVPLPCEKFGQSIRKAPLCSILEE

SEQ ID NO: 27065 - protein, 81 aa, Balaenoptera acutorostrata
MAVTFEDVTVNFTWEEWKFLDSSQKKLYREVMWENYTNVMSVGNWKESYRPQEERFRYFEHEHLSCWQGWRNASTQTYDNQ

SEQ ID NO: 27066 - protein, 81 aa, Vombatus ursinus
FWESVTFQDVAVDFTWEEWGHLGPAQKELYREVMLENYRNLVCLGLAVSKPDVICQLEQGGAPWWPEGGVPGSSCAVWDTR

SEQ ID NO: 27067 - protein, 81 aa, Lynx pardinus
MLENYSNMISLGLCIYQPDVFSLLEKGKEPWIFLQDETRGHCPDMPFRCQTKELSQKSVTFERELSQLEICKKHNLEYSCF

SEQ ID NO: 27068 - protein, 81 aa, Saimiri boliviensis
RVTFKDVAVVFTKEELALLDKTQINLYQDVMLENFRNLISVGDRIENNLLNLQEKGLSYLSQEVLHCWQIWKQRIWDLTVS

SEQ ID NO: 27069 - protein, 81 aa, Vombatus ursinus
MMWLGMSGRSGLSGPCPENPLQGCRPAGLEEWALNRISRPTVISQLEQKEEPWVLDLQSLEEGEILRAAHTAFENQVEKLN

SEQ ID NO: 27070 - protein, 81 aa, Saimiri boliviensis
FEASVSFEDVTMDFSREEWQQLDPAQKRLYQDVMLELYSHLFSVGYQIPNPDVIFRRLKEKEPCMEEAELSRQKCQGEKPL

SEQ ID NO: 27071 - protein, 81 aa, Vombatus ursinus
GLESVTFQDVAVTFTAEEWEQLGPPQKALYREVMLENYGNLVCLGFAACKPEVIDQLEQGQAPWKPGAGESRSSQAGECLK

SEQ ID NO: 27072 - protein, 81 aa, Saimiri boliviensis
SQASVSFQDVAVEFTQEEWQRLGPVEWTLYRDVMLENYSHLISVGYCITKPKVISQLEQGEEPWSLEDEFLKQRYPGHFKV

SEQ ID NO: 27073 - protein, 81 aa, Lynx pardinus
DRNIVTFEDVCIYFSREEWDLLDEAQKCLYCHVVLENFLLVTSLGLTISRYHLIPQPQTENKDASSGQGVFIRQSQVRTLT

SEQ ID NO: 27074 - protein, 81 aa, Saimiri boliviensis
EPGAVTFGDVAVYFSREEWSCLRPAQRALYRDVMRETYSHLGALGVGGSKPALISWMEEEAELWGPAAQDPELAECPTEAD

SEQ ID NO: 27075 - protein, 81 aa, Vombatus ursinus
MLENARHLLSLGLPVPREDVVSYFEQREAPWMLEQEDLRSRCPGEIRVEVKTMAELNLSVEETQEQRSMDDGPCDITWREI

SEQ ID NO: 27076 - protein, 81 aa, Balaenoptera acutorostrata
QESVTFKDVAVDFTQEEWALLDTSQKKLFRDVMLENISHLVSVGREDDLRKQEMIFMQHIYKKDTSVISAMQRSHSQEDPL

SEQ ID NO: 27077 - protein, 81 aa, Saimiri boliviensis
QESVAFEDVAVYFTQNQWASLDPAQRALYREVMLENYANVASLGGESCIKNEGPVIKQEASEETELHRMPVGGLLRNVSQH

SEQ ID NO: 27078 - protein, 81 aa, Balaenoptera acutorostrata
PVVFEDVAVDFTQEEWALLDLTQRNLYRDVMLENFRNLASLGFETQLKTNELVAPQDIYGEKISSEQNVVRLKRSASSLSI

SEQ ID NO: 27079 - protein, 81 aa, Saimiri boliviensis
KESVSFKDVAVDFTQEEWGQLDSPQRALYRDVMLENYQNLLALGAGPPLHKPDVISHLERGEEPWCMQRDVPGGPCPEWEM

SEQ ID NO: 27080 - protein, 81 aa, Panthera pardus
LFQGLLTFRDVAIEFSQEEWGCLNHSQRELHRDVMLETYGHLLFLGLIVSKPDLVIVLEQEKELWGVKRKETVASHSGRWE

SEQ ID NO: 27081 - protein, 81 aa, Macaca nemestrina
VQGLLTFRDVAIEFSQDEWKCLDPAQRSLYRDVMLENYRNLVSLEFQSVTQAKVQWCDLGSLQPPLPRFKQFSCLSLPSSW

SEQ ID NO: 27082 - protein, 81 aa, Macaca nemestrina
SYQDSVTFDDVAVDFTPEEWALLDTAEKYYRDVMLENYINLASVEWEIQPRIKGSSLQQGFLKNPIFNGIQMVRFMTSIEQ

SEQ ID NO: 27083 - protein, 81 aa, Ursus arctos
MLENYSNLMSLGYQATRPEATVHLEKEQRMVEREFPSQRSPERPLQCFSRGIKLKSDSKFQSKNYAEMNSDEPNSHGKPFF

SEQ ID NO: 27084 - protein, 81 aa, Muntiacus reevesi
SESLSFEDVTVGFTQEEWQKLDPAQRTLYRDVMLENYSHLISVGEQPWVLETESPSQIYPAEKREGAFAGWVETENVVSYS

SEQ ID NO: 27085 - protein, 81 aa, Muntiacus reevesi
TARSQASVTFKDVAMDFTPEEWGRLDPAQRDVMLENYRNLVSLWLPVSKPENHSLENGKEPLLLERKAPRSSCSDSETSPR

SEQ ID NO: 27086 - protein, 81 aa, Ursus americanus
DTISVTFDDVAVTFTQEEWGQLDPAQRTLYQEVMLENCGLLVSLGCPVPRPELIYQLEHGQELWTVKRDLSQSAYLGDKGK

SEQ ID NO: 27087 - protein, 81 aa, Myotis brandtii
EAEPVAFEDVSLGFDLEEWELLDPEQKSLYRQVVLENYRNLASVEYQLSKPEVVSRLEEEEELWSVERGIPQDTFSALPAP

SEQ ID NO: 27088 - protein, 81 aa, Balaenoptera acutorostrata
MDFTQEEWALLNSSQRQLYRDVMLENYRNLVSLRHQLSKPPLITQMEQEDEMETLPDTARPDPTEPVSGPPARAAVNVSTL

SEQ ID NO: 27089 - protein, 81 aa, Balaenoptera acutorostrata
GMKFEDVAIDFSQEEWGLLDEAQRLLYYNVMLENFALVASLGCCHGTEDEEAPSEQSISVDGESQVRASKAGPSTQKTHPY

SEQ ID NO: 27090 - protein, 81 aa, Lynx pardinus
MFSDVSIVFSQEEWEYLDLEQRDLYRDVMLENYSNLVSLGCFISKPDVISLLEQGKEPWKVVRKGRRRYADLETRYETKKL

SEQ ID NO: 27091 - protein, 81 aa, Saimiri boliviensis
MKPAQRNLYRDVMLENYSNLVTVEVWEVDEQIKKQQETLVRKVTSISKKILIKEKVIEYKKVAQIFPLSSDIVTSRQSFYE

SEQ ID NO: 27092 - protein, 81 aa, Saimiri boliviensis
MLENYGNVASLGFPLLKPAVISQLEGGGELGGPSPLAAGTGLRGLWTGKGVDTQTDSDFTEEMYDGKEDVSFELQRDFSQE

SEQ ID NO: 27093 - protein, 81 aa, Balaenoptera acutorostrata
QAMVKIEDMAVSLILEEWGCQNLARRNLNRDARQENYGNVISQGCENRNENEESTSKAEIAEDSASHGETTGKFQKDFGEK

SEQ ID NO: 27094 - protein, 81 aa, Saimiri boliviensis
MAEEFVTLKDVAMDFTLEDWEQFGLDQGDPFWDTALDNYQNLFLLNPPRPNLTSHPDGSEDLEPLAQGSPEATGPDLAETT

SEQ ID NO: 27095 - protein, 81 aa, Lynx pardinus
FKFKDVAIYFSQKEWECLHPSQKGLYRDVMLENYNNLISLDWESRGETNNLFPKTDSYEIKSLQLKIKRLESSHLECTKVR

SEQ ID NO: 27096 - protein, 81 aa, Balaenoptera acutorostrata
KILVPVTFRDVAVVFTEAEWKRLSSEQRDLYREVLLENYRNLLSLAEPKPEIYPCSSCLLAFFCQQFLSQHTLQIFPGVCV

SEQ ID NO: 27097 - protein, 81 aa, Lynx pardinus
MTESQEEWQQLDLAQRNLYRNVMLENYNNLITVGCPFTKPDVIFKLEQEEEPWVVEEEVLRRHCPGEVWGIDERQKIQDRL

SEQ ID NO: 27098 - protein, 81 aa, Pteropus alecto
MAFPQKEWEQLDPAQRNLHKDVMLENYSHLASMGYQAAKRDMISKLEKGEEPWLGKGKTPRQGGPNETARPKQTEANGSKF

SEQ ID NO: 27099 - protein, 81 aa, Oryctolagus cuniculus
MAVAFTQEEWQLLGPAQRDLYWDVMLENYSNLVSVGWRASKPDLLSQLERGEPWTIEGENHCGTPPEIWKADGVLEHLQNG

SEQ ID NO: 27100 - protein, 81 aa, Pteropus alecto
PQDLVTFKDVAVDFSQEEWDWLNSAQRSLYRSMMLENYQSLVSLGLCISKPYVITLLEQGKEPWRMKSDMTSPFSDWESSC

SEQ ID NO: 27101 - protein, 81 aa, Rhinopithecus bieti
MELLTFRDVAIEFSPEEWKCLDPSQQNLYRDVMLENYRNLVSLGVAISNPDLVTCLEQRKEPYNFKIRETAARPSEFCFSF

SEQ ID NO: 27102 - protein, 81 aa, Rhinopithecus bieti
SQGLLIFRDVAIEFSPEEWSYLDPAQQNLYRDVMLENYRNLLSLGIAVSKPDLITCLEQRNEPWNVKKHETIGRHPAVSSH

SEQ ID NO: 27103 - protein, 81 aa, Rhinopithecus bieti
LEMGPLTFRDVAVEFCLEEWQCLDTAQQDLYRKVMLENYRNLVLGIAVSKPNLITCLEQGKDPWNMKRHSMVVKPPVICSH

SEQ ID NO: 27104 - protein, 81 aa, Panthera pardus
RPRAVKFADVAVYFSTEEWGCLRPAQRALYRDVMRETYGHLGALETRTRKKNGDKEVFPPKEAPRKGKRGRRPSKPRLIPR

SEQ ID NO: 27105 - protein, 81 aa, Macaca nemestrina
QGLLTFRDVAIEFSQEEWKCLDPAQRTLYRDVMLENYRNLVSLDISSKCTMKDFLSTVQGNTEVIHTRTLERHHIGDFCFQ

SEQ ID NO: 27106 - protein, 81 aa, Macaca nemestrina
LEMGPLTFRDVAIEFSLEEWQCLDTAQQDLYRKVMLENYRNLVLGIDVSKPNLITCLEQGKYPWNMKRHSMVVKPPVICSH

SEQ ID NO: 27107 - protein, 81 aa, Macaca nemestrina
VAFEDVAVNFTQEEWALLDIFQKNLYREVMLETFRNLTSIGKSWKDQNIEYEYQNPRRNFRSLIEEKVNEIKENSHCGETF

SEQ ID NO: 27108 - protein, 81 aa, Ursus arctos
AQGPVLFEDISVDFTQKEWQLLDPAQRLLYKEVMLENYRQLVSLGHCVTKPELVLKLEQGEEPWAPKRELPSQSCPGNKPY

SEQ ID NO: 27109 - protein, 81 aa, Muntiacus reevesi
EQVTFEDVVVDFTQEEWGHLEPAQRTLYRDVMLETFGLLVSVGHWLPEPDALSLLEQEAELRAADEGGPRGVCPDLETRPQ

SEQ ID NO: 27110 - protein, 81 aa, Muntiacus reevesi
DLVTFEEVSVDFSQEEWALLAPAQKILYRDVMLENFRNLASVGYHLCIHSPITEVVQKELRPEGRGILQSACTDGATQLKS

SEQ ID NO: 27111 - protein, 81 aa, Muntiacus reevesi
LQEAAELEFLSVNYTQKKWKGTALSQRALYWNIMLENCCSLAPLGENRMASSQLSQKQDISEELKSADRTSGILCGLILGG

SEQ ID NO: 27112 - protein, 81 aa, Ursus americanus
FQKPVTFDDVAVNFTQEEWVCLDAGQRVLYQDVMSETFRNLMSVVRIFLSNPDLIIKLEQEEKQWRAGAPAQPASPARPPF

SEQ ID NO: 27113 - protein, 81 aa, Myotis brandtii
RSKESLTFQDVAVDFTGEEWDQLCPAQKNLYRDVMLENYRNLVALGHQLYKPEVITQLEQEEQWMMERDSPLDTHPGEKPY

SEQ ID NO: 27114 - protein, 81 aa, Myotis brandtii
MAVPLTFEDIAIYFSEQEWQDLEAWQKELYKRVMRTNYEILVSLDGGLPKPELISRIEQGRELFRNLGEPQKSGNVIFNPA

SEQ ID NO: 27115 - protein, 81 aa, Propithecus coquereli
MINAQESLTPEDVAVEFTWEEWQLLGPAQKDLYRDVMLENYSNLVSVGYQARKPDALSKLERGEGPWTIEDETCSRICPGE

SEQ ID NO: 27116 - protein, 81 aa, Propithecus coquereli
MYFSQEEWELLDPTQKALYSDVMQENYETVISLALFVLPKPKVISCLEHGEDPWVQVSLELKDSAGESSTGLKLKSDTENH

SEQ ID NO: 27117 - protein, 81 aa, Propithecus coquereli
GTVTFEDVAVYFSWEEWGLLDEAQRCLYRDVMLENLALITSLDVYQHQKEHFGEKHFRSSVGKTLFVKTCTFHVSGEPFTC

SEQ ID NO: 27118 - protein, 81 aa, Propithecus coquereli
SLGSVSFKDVTVDFSREEWQQLDLAQKSLYRDVTLENYFNLISVGCQVPKPEVIFNLEQGGELCVLDGGLSCQNCSDGDIG

SEQ ID NO: 27119 - protein, 81 aa, Propithecus coquereli
PKVPVSFEDVSVYFTKTEWKLLDLRQRILYKRVMLENYGHLVSLGFSFSKPHLISQLERGEGPWVAGIRRTGAAAGLQEGD

SEQ ID NO: 27120 - protein, 81 aa, Propithecus coquereli
VHGSVTFRDVAIDFSQEEWECLDPAQRNLYRDVMTENYSNLVSLAENFISKPDVITVLEQEPEPWMVIGSHIMELRKYLQK

SEQ ID NO: 27121 - protein, 81 aa, Propithecus coquereli
LQGSVSFKDVTVDFTQEEWQHLDPAQKALYRDVMLENYCHLISVGFHMTKPDMIRKLEQGEELWTQGIFPSQSYLEGGKAE

SEQ ID NO: 27122 - protein, 81 aa, Propithecus coquereli
KPWAVRFADVAVYFSPEEWGCLRPAQRALYRDVMRETYGHLGALGVGGTKPALISWVEEEAELWGLDAQDPEVAKCTTEAD

SEQ ID NO: 27123 - protein, 81 aa, Propithecus coquereli
TQMSVTFDDVAVTFTKEEWGQLDPAQRTLYQEVMLENCGLLVSLGCPVPRPELIYQLEHGQELWTVRKDLFQGLCPGDKEK

SEQ ID NO: 27124 - protein, 81 aa, Pteropus alecto
GLSVPEPHQDSALCYQESTQEGMAAAAPTAGCQSIVTFADVAVIFTDEEWRHLVPIQRDLYKEVMLETYESIVFLGKENTP

SEQ ID NO: 27125 - protein, 81 aa, Pteropus alecto
KNENKEGGELSVLSGTGDFRDVAIGFSHEEWECPDPAQRDLYQDVMLEDYSNLVSLDLGSNYGAEKLSPETDVYEINLPRV

SEQ ID NO: 27126 - protein, 81 aa, Pteropus alecto
KQVSISFEDVTVDFSREEWQHLDPAQRCLYRDVTLENYSHLLSVGYQVPKPEIIFQLEQGEGPWMLERETPHQSCSDEDIG

SEQ ID NO: 27127 - protein, 81 aa, Rhinolophus ferrumequinum
LLFQGRLTFRDVSIDFSQEEWECLHPADRKLYMDVMLENYRNLYLAVSTPDVVIFLERMKEAWDVKRKKTVSIHPVFRESS

SEQ ID NO: 27128 - protein, 81 aa, Rhinolophus ferrumequinum
DFAFVSFPDVAVDFTQEEWQLLNHAERTLYRDVMLENYSNLFSLGIPFSKPTLVFLLEQGEEPWREEREHLPSCCSADPKP

SEQ ID NO: 27129 - protein, 81 aa, Rhinolophus ferrumequinum
MEFTWEEWQLLNSAQKYLYRDVILENYSNLVSVGYHGNKPDLIFKLEQGEEPWTVNAKVSHQSCAESWKEWFWKNQDELES

SEQ ID NO: 27130 - protein, 81 aa, Rhinolophus ferrumequinum
GEGTDLLTFENGAVYFSREEWCLLNLTQRSLYRDVMLENSALTVSLGMSLTRSPSKLTEEPWVPSIMDMTLVSRAEAKRGP

SEQ ID NO: 27131 - protein, 81 aa, Ursus maritimus
MDFSREEWQQLDPAQRRLYQDVMGEVYSHLLSLGYHIPNPEIISRMEKGEKLWLREAQLPHQRQGEGVFGLKTSQQKMFEK

SEQ ID NO: 27132 - protein, 81 aa, Ursus maritimus
TVGFTQEEWQHLDPAQRSLYRDVMLENYSHLVSVGYCVTKPEVIFRLEQGEEPWILEEEFPSWSFPETWETDHTKERSHEN

SEQ ID NO: 27133 - protein, 81 aa, Ursus maritimus
MDFTPEEWGKLDPTQREVMLENYRNLVSLWLPVSRPENYNLENGKEPLMLERKAPKSSYPDLETKPEGKDSTSVQDISKDE

SEQ ID NO: 27134 - protein, 81 aa, Ursus maritimus
AQISVTFDDVAVTFTQEEWGQLDPAQRTLYQEVMLENCGLLVSLGCPVPRPELIYQLEHGRELWTVKRDLSQSAYPGDKGK

SEQ ID NO: 27135 - protein, 81 aa, Ursus maritimus
MLENFSHLVSLGHPVSKPDVISKLEQGEEPWIYPERETRLENPQLDILGGVSLHKEILESVTRDHSLYSIFKVWQGDDQLE

SEQ ID NO: 27136 - protein, 81 aa, Ursus maritimus
LQNSITFEDVAMDFTQEEWALLNSRQRKLYRDVMLENYRNLASLEKQHSKPTLITQMEQEDEMKTETGSHQDICSNGMVLL

SEQ ID NO: 27137 - protein, 81 aa, Ursus maritimus
FPEAVTFKDVAVVFTLEELGLLDSTQRKLYRDVMLENFKNLVSVGHLPFKPDMVSQLEAEENLWVMEGETQRNGYSSEDHV

SEQ ID NO: 27138 - protein, 81 aa, Ursus maritimus
AQAPVTFKDVLVTFTQEEWELLDLPQRTLYWKVMRETCRLLVSLGKNLCTDDLQEQVSPGDALLECESHRSRRDPLIHGGK

SEQ ID NO: 27139 - protein, 81 aa, Rhinopithecus bieti
ETELEVPQWHREQILHRLHSLLQFCIAVSKPDLITCLEQGKEPWNMNRYEMVAKPPVMCSHIAEDLWPEQDIKDFPQKVIL

SEQ ID NO: 27140 - protein, 81 aa, Rhinopithecus bieti
AQGLVTFADVAIDFSQEEWACLNSAQRDLYWDVMLENYSNLVSLDLESAYENKGLPSEKNIHEIRAAKRNSDRRSKSLGRN

SEQ ID NO: 27141 - protein, 81 aa, Rhinopithecus bieti
EKGPLTFRDVVIEFSQEEWQCLDTAQQDLYRKVMLENFRNLVFLAGIDVCKPDLITCLEQGKDPWNMKRHSTVATPPVKCF

SEQ ID NO: 27142 - protein, 81 aa, Ursus arctos
MLENYGHLLFLGLIVSKPDLVSFLEQTKEPWDVKRRKTVVFDPVLTSHGALSFLPEPCKEASFQNVSVGRYKHSALEKLHL

SEQ ID NO: 27143 - protein, 81 aa, Muntiacus reevesi
CLGNVTFEDVFVSFSQEEWGLLGEAQRLLYREVMLENFALMASLGYTSSVSHGVSPQELGREPWVSDRADTSPALTRGAQS

SEQ ID NO: 27144 - protein, 81 aa, Muntiacus reevesi
SQSPLTFGDVAVEFSGDEWAWLDSAQRSLHRSVMLENYRNLASLGLCMSKPEMISSLEQSKEPWAVKAKSTRGRCPGLEAI

SEQ ID NO: 27145 - protein, 81 aa, Muntiacus reevesi
GRLTFRDVAIDFTQEEWECLDLGQRELYRDVMLENYGNLASLGLVSKLDLVAFLEQLKAPRNIRRMETATSYLGKFIQEGN

SEQ ID NO: 27146 - protein, 81 aa, Ursus americanus
VLLTRRSILDVAVGFTQKEWQQLEPAQRTLYRDVMLENYSHLVSVGEESFPCFLILLEQGQEPWMEEEEILRWSFPGERGS

SEQ ID NO: 27147 - protein, 81 aa, Ursus americanus
EEWEWLDPSQKDLYRDVMLENYRNLVWLGLSISKPNMISLLEQGKEPWMVEKEMSDGQYADWESWYEIKELSPKWYIDEEE

SEQ ID NO: 27148 - protein, 81 aa, Ursus americanus
MLETYSHLLSVGYEVPQPEVFMLEQGKEPWALQGESPHQNCPGEKLWDHNQYGKILSYKQAPSQHQKIHTGEKSYECAEFG

SEQ ID NO: 27149 - protein, 81 aa, Ursus americanus
LMAFEDVAVYFSQEEWELLDAAQGALYCHVMLENFALVASLGKALGSPWEAQLSPALTPCLLTAEASPPREKALMTRPMPG

SEQ ID NO: 27150 - protein, 81 aa, Ursus americanus
SPGCVTFEDVTIYFSQEEWGLLDEAQRLLYCDVMLENFALIASLGKAFAPTRGSELVSAGPLFLPTARPMGTASFPTLPGC

SEQ ID NO: 27151 - protein, 81 aa, Camelus ferus
PARRKGSRELTLLFPAKRFQKIKWVRVSWKPGASTVLYPVSITAGPPVCKPDVISHLERGEEPWRVPREVPGGVRPERGPR

SEQ ID NO: 27152 - protein, 81 aa, Eschrichtius robustus
MLENYSNLVSVGYQASKPDAVSRLERGEQLWPVEDDSHGRICPEIRKVDDPLQHHLPNHSIQNTVEQCCEHNTFADIVNQS

SEQ ID NO: 27153 - protein, 81 aa, Myotis brandtii
TARSQASVTFKDVAMDLTPEEWGKLDPAQRDVMLENYRNLVSLWLPVSKPENYNLENGKETLMLERKVPRSSYSGESNRWE

SEQ ID NO: 27154 - protein, 81 aa, Propithecus coquereli
TRDSVTFDDVAVGFTREEWALLDSAQRDLYRDVMLENYRNLASVGSRLFKPSVIRWLEEAEWMAVQRGELHEWQLKTSGSA

SEQ ID NO: 27155 - protein, 81 aa, Propithecus coquereli
RQEPVTFEDVAVYFTQNEWASLDPVQRALYREVMLENYANVASLAFPFTIPVLVSQLEQGELPWGLDPWEPVGREALRGVC

SEQ ID NO: 27156 - protein, 81 aa, Propithecus coquereli
LQDLVTFKDVAVEFTQEEWALLDPSQRTLYRDVTLENCRNLASLGCHVDNPNLISQLEQEDKVMTEERGILPSTCPDVGTL

SEQ ID NO: 27157 - protein, 81 aa, Saimiri boliviensis
LLVSLTFEDVAVLFTRDEWKKLAPSQRNLYRDVMLENYRNLVSLGLPFTKPKVISLLQQGEDPWKVEKDGSGGPCPGLKSI

SEQ ID NO: 27158 - protein, 81 aa, Oryctolagus cuniculus
AQVSVTFEDVAVTFTQEEWRQLEPAQHNLYREVMLDVCGLLVSLGCPVPRPELICHSEHRPELWTVKKHLFQSTCLDDKRE

SEQ ID NO: 27159 - protein, 81 aa, Rhinolophus ferrumequinum
LFQGRLTFRDVAVDFSQEEWECLHPAERKLYTDVMLENYRNLCSLGLAVSKPDLVIFLERMKDAWDVKRKKTVSIHPGRWE

SEQ ID NO: 27160 - protein, 81 aa, Ursus maritimus
VFQGLVTFEDVAVYFSLEEWERLDVDQRDLYKDVMQENYGILVSLGEQGECVFPSFLHRCQSLWAPEGTEAGKTKTNICGE

SEQ ID NO: 27161 - protein, 81 aa, Ursus maritimus
IPKVPVTFDDVAVYFSEPEWGKLDEWQKELYKHVMRGNYEIWVADYAISKPDILTRMERGEDPCPEGPWGQEERSKKEAVR

SEQ ID NO: 27162 - protein, 81 aa, Ursus maritimus
FQEALTFKDVAVVFSEEELGLLDPAQRKLYRDVMLENFRNLVSVGHSSSKPDVISQLEREEKLCMKETHSERGDRHQKEME

SEQ ID NO: 27163 - protein, 81 aa, Ursus maritimus
VKDSVTFKDVAIDFTLEEWRLMDPSQRNLHKDVMLENYRNLVSLGLAVSKPDMISHLEDGKGPWVVVREIARAPYPELETK

SEQ ID NO: 27164 - protein, 81 aa, Ursus maritimus
FQEPVTFKDVAVVFSEEELGLLDSTQRKLYRDVMLENFGNLVSVGNQPFKPELIFQLEREEKLLMMEAETQREGYLGTKSQ

SEQ ID NO: 27165 - protein, 81 aa, Ursus maritimus
MLENFALIASLGLTAFRSHIVAQLQMGAEPWVPDRVDMTSAMARGVYSGPVSGFCYETEGECNVSAEGVSQDRKLQVALSN

SEQ ID NO: 27166 - protein, 81 aa, Rhinopithecus bieti
EKGPLTFRDVAIEFSLEEWQCLDTAQQDLYRRVMLENYRNLVFLAGIAVSNPDLITCLEQGKEPWNMKRHAMADEPPVMYS

SEQ ID NO: 27167 - protein, 81 aa, Ursus maritimus
VKIEDVADVAVSFILEEWGHLDQSQKSLYRDDRKENYGSITSMDYESGHDNVELAVKQISDDAEPHWMTSGSPERNVPQSQ

SEQ ID NO: 27168 - protein, 81 aa, Rhinopithecus bieti
PQGLLTFRDVAIEFSQEEWKCLDPAQRTLYRDVMLENYRNLVSLAISSKCMMKMFSSTAQGNSEVIYTGALQRHASHHIGE

SEQ ID NO: 27169 - protein, 81 aa, Ursus arctos
MGMAGPVSEGFIQRCHVGELQELGLSISKPNMISLLEQGKEPWMVEKEMSDGQYADWESWYEIKELSPKWYIDEEEISQGM

SEQ ID NO: 27170 - protein, 81 aa, Ursus arctos
VTFEDVAVYFSWEEWGLLDEAQRCLYQDVMLENLALINSLGLRHGAEDEDAPEHRVSVQAASQVGTRKAVVSPQKAHPREV

SEQ ID NO: 27171 - protein, 81 aa, Ursus arctos
MDLVVFEDVAVDFTLEEWALLDSAQRKLYREVMLENLKNLASVDDEIQFKASGSVSQQDIYGKKISKEHKMAKFIRNDSWA

SEQ ID NO: 27172 - protein, 81 aa, Ursus arctos
LLETSSPLDISMEFTWEEWQLLDSTQKYLYRDVILENYSHLVSVGYHGTKPDLIFKLEQGEEPWIINAKVSRQSYPEGWKE

SEQ ID NO: 27173 - protein, 81 aa, Ursus arctos
MPQEEWQHLDPAQKALYRDVMLENYCHLISVGFHMTKPDMIRKLEQGEELWTTERMFPSQSYLEEDGKAEDVLVKFKEYQD

SEQ ID NO: 27174 - protein, 81 aa, Ursus arctos
SQRLLTFGDVAIEFSQEEWRCLSHTQRELYRDVMLENYRHLLFLGLIVSKPDLVSLLEQRKEPWDVKRKKTVVSSHGALSF

SEQ ID NO: 27175 - protein, 81 aa, Muntiacus reevesi
MLETCGLLVSLGHPVPKPELTHLLEHGQKLWTGTRGLPRGSGPGDRAKCQTREPSNSQPVLSEEALLRGSLTLGSSWDSRL

SEQ ID NO: 27176 - protein, 81 aa, Ursus americanus
WQDLDDAQRTLYRVVMLETYSSLVSLGHCIMKPEVIVKLEQGAEPWTVEEAPTQNVQTSGDLIETCQEHQSRHVWQAGVAN

SEQ ID NO: 27177 - protein, 81 aa, Ursus americanus
LKNMPHWLVIFRDVAIDFSLEEWECLNATQRDLYRDVMLENYSNLISLVLFRNTNGPKTVAQSHDLSLSLYFSGSYSEVSV

SEQ ID NO: 27178 - protein, 81 aa, Myotis brandtii
SQVSVTFEDVAVTFSQEEWGQLDVAQRTLYQEVMLENCRLLASLGCPVPRPQLICQPESGRELWMVKTDLSRGACPDHVYF

SEQ ID NO: 27179 - protein, 81 aa, Eschrichtius robustus
MSLGHQLPKPEVILQLEKGEEPWLVERGIHQETHPGEDQTARFGQESLARVVTSSLHFEDLETAVEVKSSTSSKSISKDKH

SEQ ID NO: 27180 - protein, 81 aa, Myotis brandtii
METYSHLVSVGYHVSKPDALFKLEREEEPWTVQHGLHCLVSPEGTVGDSLQYPLQSRSIQSLETCCENSMFGDIVNQSKGN

SEQ ID NO: 27181 - protein, 81 aa, Myotis brandtii
EQLSFMDVAIDFSQEEWECLDPAQRKLYLDVMSENYSNLVSVECDKAFRWPSTLSIHQRIHTEEKPYKYRKCGTSSINFAN

SEQ ID NO: 27182 - protein, 81 aa, Myotis brandtii
NKMPQISFEDVAVDFTLEEWQLLNPIQKNLYRDVMLENYSNLVFLGHEIIEPDAVWKLEQEEPWKINEEILNHDFSDVAYR

SEQ ID NO: 27183 - protein, 81 aa, Propithecus coquereli
AHSSVTFRDVAIDFSQEEWEFLDPAQRDLYRDVMWENYSNFISLGPSISKPDVITLLDEEGKEPGMLVREGTRRYCPGDLE

SEQ ID NO: 27184 - protein, 81 aa, Propithecus coquereli
VLVTFKDVAVTFTREEWRQLDLAQRTLYREVMLETCGLLVSLGDRAQLQTREPTTCLPILFEGAFLQGSLSLGSSRDSRLG

SEQ ID NO: 27185 - protein, 81 aa, Propithecus coquereli
SRSLENDGVCFSKQEWENLEDWQKELYRNVMESNYETLVSLKVLGQPDGEAELSTEILGDLEEEGPVGAHPADGVVIKQEL

SEQ ID NO: 27186 - protein, 81 aa, Balaenoptera acutorostrata
AAVFEFLSVDYTQQKWKGPALSQKAALYRNIMLENCRSLASLAGENRMESDLPPKKEISKVLKSSDRTSVVLCGMIPGGPE

SEQ ID NO: 27187 - protein, 81 aa, Balaenoptera acutorostrata
SRSLENDGVCFSEQEWENLEDWQKELYTNVMKSNYETLVSLKVLGQTEGEAELGTEMLGDLEEEDSRGVHPVEGVMIKQEI

SEQ ID NO: 27188 - protein, 81 aa, Panthera pardus
VVFEDVAVNFTPEEWALLNRGQRKLYRDVMLETCRNLSAVGCRSQGNTSASRLQWSILLNEPPGEDKTGIFTRKDSCSVFG

SEQ ID NO: 27189 - protein, 81 aa, Macaca nemestrina
MELLTFRDMAIEFSPEEWKCLDPSQQNLYRDVMLENRNLVSLGVTISNPDLVTCLEQRKELYNFKIHETAARPSVYRESRC

SEQ ID NO: 27190 - protein, 81 aa, Macaca nemestrina
MEEWQQLNPAQKTLHRDVMLEIYSHLVSVGCSGIKPDVIFKLEHGKDPWIIESELSRWIYSDRVKGLESSQQIISGELLFQ

SEQ ID NO: 27191 - protein, 81 aa, Ursus arctos
MFQVTFSDVAIDFSPEEWGWLDSAQRDLYKDVMVQNYENLVSLGLSIPKPYVISLLEDGKEPWMVEKKLSKGMFLDWESRW

SEQ ID NO: 27192 - protein, 81 aa, Ursus arctos
SSLQRPALPSLDSAYLQEKNPENQSVLTVLKNMPHRLVTFRDVAIDFSPEEWECLNATQRDLYRDVMLENYSNLISLENRI

SEQ ID NO: 27193 - protein, 81 aa, Ursus arctos
AHGSVTFRDVAIDFSQEEWEFLDSAQRDLYRDVMWENYSNFISLEPSISKPDVITLLDEGKEPWMVVREGTRRHYSDLESR

SEQ ID NO: 27194 - protein, 81 aa, Ursus arctos
PPGQVTFDDVAVDFTQEEWGLLGPAQRTLYHDVMLETLRHLVTVGPWNPTPDIVAHLELRIDQWMMGRGLTQDSCLEWEKR

SEQ ID NO: 27195 - protein, 81 aa, Muntiacus reevesi
MTFKDVAIEFTQEEWECLDPAQRALYRDVMVETLRNLVSLDKEPWSVESEVNAFGGVSKCEHGSDLRRVRGSLTRQRHGRR

SEQ ID NO: 27196 - protein, 81 aa, Muntiacus reevesi
QAEVTFEDVAVLLSQEEWGLLGPSQKGLYREVMLETYRNLLSLGVGLADPKPEVIVQLERGDELWVLDMHGAEQPSVDGSA

SEQ ID NO: 27197 - protein, 81 aa, Muntiacus reevesi
KGSVTLQDVAVEFTPEEWLLLDCDQRTLYWDVMLENFRNLISVGTGCPVTETTVIFKVEQGQEPWMVEGENSCWSSPEADC

SEQ ID NO: 27198 - protein, 81 aa, Muntiacus reevesi
MGLLTFQDVTVDFTQEEWECLDLGQRELYRDVMLENYGNLACLGVLVSKPDLVTFLEQMKHPWDVRRMETAIHPAVSSHDT

SEQ ID NO: 27199 - protein, 81 aa, Ursus americanus
MPNIDVAIDFSPEEWGWLDSAQRDLYKDVMVQNYENLVSLAGLSIPKPYVISLLEDGKEPWMVEKKLSKGMFLDWESRWEN

SEQ ID NO: 27200 - protein, 81 aa, Myotis brandtii
MYFTREEWNKLDWAQKDLYRDVMLENYRNMILLGSEARYQMIKLTPKQKISENTESCKISVVKQKTAMTPSEKLLKFNKFV

SEQ ID NO: 27201 - protein, 81 aa, Vombatus ursinus
MLENYRHLVFLGLPVSKPELISQLECGGGPWMPLEEEPRNPHADQNSSPKTKKTVLKQGILVGKSSQERLSRDHRKDFKFG

SEQ ID NO: 27202 - protein, 81 aa, Eschrichtius robustus
MGAGGPRRQVPAGFLVFKPELISRLEQGQEPWVLDLQGAEGREAARTSEADSTIGTESEQACEDIDRLKSESHVVMVKTPS

SEQ ID NO: 27203 - protein, 81 aa, Propithecus coquereli
AQVYLAFRDVAIDLSQEEWECLDPVQRDLYKDVMLENYSNLVSLGCAIPKPDVITLLEQEKEPWVVIREGTRNWYPDLEGK

SEQ ID NO: 27204 - protein, 81 aa, Vombatus ursinus
ELPDSRPRDVAMDFTQREWGCLQPTQKALYWDMTLENFKNLVCLGLTFSKPCVICQLEQGDAPWGPEGDAPRIDDADQESK

SEQ ID NO: 27205 - protein, 81 aa, Lynx pardinus
FKEVVTFKDVAVVFTEEELGLLDPTQRKLYREVMLENFGNLVSVGDKIQHKMETIPKVEPHEELSCWQIWQHIADDLTWCH

SEQ ID NO: 27206 - protein, 81 aa, Vombatus ursinus
MSFRDVAVDFTEEEWGCLSPAQWQLYKEVMLENYRNLVSLGLKEDKPDLVSWLEQGEEPSASDLQGEGPRSPCPWEGDTSA

SEQ ID NO: 27207 - protein, 81 aa, Rhinolophus ferrumequinum
PEPPGWDVSIDFSQEEWECLHPADRKLYMDVMLENYRNLCSLGEGDFLPELLPHRRVVFPSSVQSMSFEDTLDLLPNPSIG

SEQ ID NO: 27208 - protein, 81 aa, Rhinolophus ferrumequinum
MLETCSFLVSLGHPVPKTELTHLLEHGQKLWTVERGISRSTCPGDRTKLQTSEQSTSQPALYEGALFKGSLTPGSPRDSKL

SEQ ID NO: 27209 - protein, 81 aa, Rhinolophus ferrumequinum
RPQESVTFEDVAVYFTEEERAWLVPGQRALYRDVMLENCGAVSSASSTSKPALICQLEQGKEPCFTEPQGDLSRRAGPERY

SEQ ID NO: 27210 - protein, 81 aa, Rhinolophus ferrumequinum
FQEAVTFGDVAVHFSREEWQCLDPGQRALYKEVMLENHSSVAGLAGFLVFKPELISRLEQGQEPWVIDLQGAEGREAPRTP

SEQ ID NO: 27211 - protein, 81 aa, Ursus maritimus
LEPAQRTLYRDVMLENYSHLVSVGCQVTKPAVISRLEQGQEPWMEEEEILRWSFPEILQVDHQVDRQQEHQDKLLRHVAFL

SEQ ID NO: 27212 - protein, 81 aa, Ursus maritimus
AQGDVTFEDVAVYFSQDEWSLLNEAQRRLYCDVMLENFALISSLGCCCRAEAVETPFEQSISVGVSQARTPKEPRSSQKTH

SEQ ID NO: 27213 - protein, 81 aa, Ursus maritimus
MLENYGHVASLGFLVAKPALISLLEQGEEPGALILQVTEERGFAASLCPDSRMEAGIKESSLKRVPSKQLGLLGTVWGRLP

SEQ ID NO: 27214 - protein, 81 aa, Macaca nemestrina
MNKAGLLFHFAQRTLYKDVMLENYSHLVSVGYHVNKPNAVFKLKQGKEPWILEVEFPHWVLPYLWSIHDLESRYRESQAGN

SEQ ID NO: 27215 - protein, 81 aa, Muntiacus reevesi
RLTFRDVAIDFTQEEWECLDLGQRELYRDVMLENYANLASLELVSKLDLVAFLEQLKDPRNIRRLETTAIYPALSPQDTQD

SEQ ID NO: 27216 - protein, 81 aa, Myotis brandtii
RQDPVTFDDVAVYFSRREWRLLDEAQRGLYQEVMLENLALASSLGSCCGSEDADAPCEQSVSVGVSPSSPSKVAVSSLKTH

SEQ ID NO: 27217 - protein, 81 aa, Myotis brandtii
HPRTRISSWDQMAASQEEWECLDLAQRKLYMDVMLENYGNLASVAMSSEDAQAFFLKPRIQDLFSEIVLGLLTFRDVAIDF

SEQ ID NO: 27218 - protein, 81 aa, Myotis brandtii
VTFEDIALYFSRKEWNLLDESQRQLYLNVMLENFELISSLGCCCGVENVEAPTKQKVCVKVSQARKPKVAFSSRKSHPCES

SEQ ID NO: 27219 - protein, 81 aa, Myotis brandtii
FQEAVTFGDVAVHFSREEWMCLDPGQRALYKEVMLENHSSVAGLGFLLFKPELISRLEQGQEPWVLDLQGTEAREARRTLQ

SEQ ID NO: 27220 - protein, 81 aa, Propithecus coquereli
PKAPVTFGDVAIYFSKEEWECLSPNQKDLYEDVMMENYQNLASIGFSCRRPNVITLLEKGEAPWMAEPLRRRQGPDSGSKK

SEQ ID NO: 27221 - protein, 81 aa, Propithecus coquereli
SQELLTFKDISVDFTQEEWGQLGPAHQNLYREVMLENYRNLVSVGYQLSKPSVISQLEKGEEPWMTEKEGPGDPSSDLKSK

SEQ ID NO: 27222 - protein, 81 aa, Vombatus ursinus
NQVAVTFDDVTMYFTEQEWGTLEEWQKELYKHVMKTNYENLFSLGYAIPKPDLITQIEQGEEPFIRDEGHLDRELAIGSRA

SEQ ID NO: 27223 - protein, 81 aa, Propithecus coquereli
EAVTFKDVAVVFTEEELGLLDSAQRELYRDVMLENFRNLLSVGHQPFHRDAFHFLREEKFWMMRTSTRREGNSGKNKATVC

SEQ ID NO: 27224 - protein, 81 aa, Macaca nemestrina
FRGMVTFKDVAVVFTREELGLLDLAQRKLYQDVMLENFRNLLSVGYHPFKLDVILQLGREDKLSLMETEIQRDGCSGENHA

SEQ ID NO: 27225 - protein, 81 aa, Macaca nemestrina
GMEPLQFRDVAIEFSLEEWHCLDTAQQNLYRDVMLENYRNLVFLGIVVSKPDLITRLEQGENPLTVKRHKMTANPSGPGMV

SEQ ID NO: 27226 - protein, 81 aa, Ursus arctos
MKMHLHPPSEALSSDNLAHVLCHFPLTGLCVAKPEMIFKLERGEELWILEEESSGRGYPGSLSLLCGNSSVGGNALRHDND

SEQ ID NO: 27227 - protein, 81 aa, Ursus arctos
QEAVVFADVAVDFTPEEWALLDGGQRRLYRDVMLETCRNLASLDCCTQVKPCGSRTQLSILENELSSEEKIVRFIRNDSWA

SEQ ID NO: 27228 - protein, 81 aa, Ursus arctos
MLENYGNLVSVAGYQLSKPSVISQLEKGQEPWMTEKEGPGDPRSAYNTENNKSCHDLLEDLKNKTESDASAAKNDILQEQL

SEQ ID NO: 27229 - protein, 81 aa, Myotis brandtii
AEDSVAFEDVAVNFTQEEWALLNPSQKKLHRDVMRETFRNLAFLGKKWEDHDIEENQGRKQKSLMLEKLGEGENGSQCGEN

SEQ ID NO: 27230 - protein, 81 aa, Myotis brandtii
LPESLTVHDVAVDFTWEEWQLLGPEQKDLYTDVMLETYSHLVSVGYEASKPDILSKLDHGEAPWTVAGELLCGTCSDIWKL

SEQ ID NO: 27231 - protein, 81 aa, Myotis brandtii
LDAPVTFEDVAVYFSENEWTCLTCPQRALYRDVMLENYGAVASLAFLFPKPALISRLERGEAPWCSAPQGALDGEGWKGVS

SEQ ID NO: 27232 - protein, 81 aa, Eschrichtius robustus
LQGPVSFKDVAVDFTQEEWQQLDPDEKTTYRDVMLENYSHLVSVGYDSTKPNVILKLEQGEEPWVADGEFPRQFHPEEVWK

SEQ ID NO: 27233 - protein, 81 aa, Myotis brandtii
PAGLVSFKDVTVDFTQEEWQHLDPAQKTLYMDVMLENYCHLISVGCHMTKPDVILKLERGEEPWTSLTGQTCLEKNWKPED

SEQ ID NO: 27234 - protein, 81 aa, Myotis brandtii
FQLPVSFKDVVVSFTREEWGQLDLVQRTLYRDVTLETCDHLVSLGLLLPTVDVISCLERGAGPWRAEQELPPGEWKTSLAK

SEQ ID NO: 27235 - protein, 81 aa, Myotis brandtii
MNFEDMAIAFSQEEWGLVDEAQRLLYCDVMLEVFALVSSVGCYHKTDDAEDCSEQSVSVQGESQDSASKTAPETQRTHLCG

SEQ ID NO: 27236 - protein, 81 aa, Myotis brandtii
AQGRVVFEDVAVRFSREEWGLLDEAQRHLYHNVMLENVALLCSVEPTHLRDRSLPAASGAAGKPRLQKRDGMYPDQSLRIC

SEQ ID NO: 27237 - protein, 81 aa, Propithecus coquereli
PQASVCLEDVAVTFTQEEWRQLDLAQRMLYCDVTLETCGHLVSLGLLLSKPEVISQLERDDLCRVGQPPPRDCKATLEKKR

SEQ ID NO: 27238 - protein, 81 aa, Propithecus coquereli
EDVAVNFTRGEWALLNPSQKNLYRDVMRETLMNLLKPINTCKLHESKEGRQRGEASSQILEHVLNKKTPPAVKACESSVYG

SEQ ID NO: 27239 - protein, 81 aa, Propithecus coquereli
KVPVTFVDIAVYFSEDEWKNLDEWQKELYNNLVKENYKTLMSLDAEGPVPKPDAPAQAEPREEPCVWEQRHPEEREIPMDP

SEQ ID NO: 27240 - protein, 81 aa, Propithecus coquereli
SQGLVTFGDVAVDFSQEEWEWLNPAQRHLYSRVMLENYRNLVSLGLCVSKPAVISSLEQGKEPWTAQRKMTRGGCPDLNAV

SEQ ID NO: 27241 - protein, 81 aa, Propithecus coquereli
VQKPVTFEDVAVNFSQEEWECLGASQRVLYQDVMSETFRNLASVARIFLHKPDLISKLEQEEEQWRACLRPPDREGLLSED

SEQ ID NO: 27242 - protein, 81 aa, Saimiri boliviensis
ELLTFRDVAIEFSPEEWKCLDPTQQNLYRDVMLENYRNLVSLGVAFSNPDLVTCLEQRKEPYNVKIHEAVARPPVYRESQC

SEQ ID NO: 27243 - protein, 81 aa, Saimiri boliviensis
PQASVCFEDVAMAFTQEEWEQLDLAQRTLYREVTLETWEHLVSLGLLLSKPDVVSQLEQEEDLYRAEQVALQDWKATLENN

SEQ ID NO: 27244 - protein, 81 aa, Saimiri boliviensis
FQGQLTFNDVAIEFSLEEWQCLDKTQQNLYRDVMLENYRNLIFLGIAVSKPDLVTCLKQGKEPWNMRRHEMVTKPPAMCSH

SEQ ID NO: 27245 - protein, 81 aa, Balaenoptera acutorostrata
SVCEVSFEDVTVDFSREEWQHLDPAQRRLYRDVTLENYSHLCSVGYQVPKPEVIFKMEQGEGPWTLEEETPHQSSSDEDNG

SEQ ID NO: 27246 - protein, 81 aa, Saimiri boliviensis
FQRSVSFRDLTVNFNKEEWQQLDPAQRLLYRDVMLENYSNLVSVGYPVSKPDVIFKLEQGEEPWIVEEFSNQNYPEVDDAL

SEQ ID NO: 27247 - protein, 81 aa, Balaenoptera acutorostrata
SVTFEDVALYFSWEEWALLDEAQRCLYHDVMLENFALTSSLGCWHGVEDKEAPSQQSISVDGVSQIWILKAGSSPQKAQPF

SEQ ID NO: 27248 - protein, 81 aa, Vombatus ursinus
MAQRDLYKDVTLENYKNLISLGFPICKPVVISQLERGDGSWMLRKDIPRSTSPGPLCQVSTCETNHSTLKQDNCMEESSKK

SEQ ID NO: 27249 - protein, 81 aa, Balaenoptera acutorostrata
SEELVTFKDVAVDFSQEEWGQLDSPQRALYRDVMLENYQNLLALGPPVCKPDVISHLERGEEPWWAPRAVPGGAGPEPERE

SEQ ID NO: 27250 - protein, 81 aa, Lynx pardinus
MDSAQRTLYRDVMLENYSHLVSVGYCFTKPELIFTLEQGEDPWLFKKEFLRKGFPEEYQPNQLSEKSLENQSKYLWQVLFT

SEQ ID NO: 27251 - protein, 81 aa, Vombatus ursinus
FQGSLTFRDVAVEFTQTEWRHLAPFQKELYRDVMLENYRNLVCLGLAVSKPDVISQLERREAPWTPGGIQRSGCPGEWVIV

SEQ ID NO: 27252 - protein, 81 aa, Rhinopithecus bieti
PQGRLTFRDVAIEFSLEEWKCLNPAQRALYRAVMLENYRNLESVDSSFKTMMEYSSTGQGNTEVFHTEMLERHESHHFGDF

SEQ ID NO: 27253 - protein, 81 aa, Rhinopithecus bieti
GLVTFGDVAVDFSQEEWQWLNPNQRNLYRKVMLENYRNLASLGKGDCISVWTPDVISSLEQGKEPWTVKRKMTRAWCPDLK

SEQ ID NO: 27254 - protein, 81 aa, Rhinopithecus bieti
IQGPLTFGDVAVAFTRIEWRHLDAAQRALYRDVMLENYGNLVSVVQDYWFETKMSALKQSTSAGSVLGERRKSVMTEKGLD

SEQ ID NO: 27255 - protein, 81 aa, Rhinopithecus bieti
TQGHLTFRDVAIEFSQEEWKCLDPVQKALYRDVMLENYRNLVSLGICLPDLSIISMMKQRTEPWTVENEMKVAKNLVRWEG

SEQ ID NO: 27256 - protein, 80 aa, Ursus americanus
MTRSQVLLTFRDVAVEFSAEEWECLDPAQRALYRDVMLENYSNLVSLGEDNVSLNVGICPSEFLGGPCPARLIEAILTLN

SEQ ID NO: 27257 - protein, 81 aa, Muntiacus reevesi
MGLLTFQDVTADFTQEEWECLDLGQRELYRDVMLENYGNLACLGLVVSKQDLVMFLEQMKDPWDVWRIETAIYPGMNVLHP

SEQ ID NO: 27258 - protein, 81 aa, Ursus americanus
TQEEWGQLEPDQRTLYRNVMLETFRLLVSVGKATTEPPVNISIFFLSDLETQPKTKLSAPKQDITEERASSVLVERFLWDS

SEQ ID NO: 27259 - protein, 81 aa, Myotis brandtii
FQLPESLEDVAMYISQEEWGHQDPSKRALSRDTVQESYENVDSLESQVPNQEALSIQVEQGRKPWEPSAQTCKEGLSPRNP

SEQ ID NO: 27260 - protein, 81 aa, Myotis brandtii
TVVFADVAVCFTREEWALLDGAQRKLYREVMLETFRNLASVGNQCGDTLNQITDLPVDETHIPGVKHYECTKCGKVFTDCS

SEQ ID NO: 27261 - protein, 81 aa, Propithecus coquereli
NSRCVTFSDVAIDFSHEEWRWLDSAQRDLYKDVMVQNYENLVSLGLSITKPYVITLLEDGKEPWIVDKKLSKDWESRWENK

SEQ ID NO: 27262 - protein, 81 aa, Propithecus coquereli
AQESVMFSDVSIDFSQEEWECLNDDQRDLYRDVMLENYSNLVSMAGHSISKPSVISYLEQGKEPWLVPREPTRGQWPVLES

SEQ ID NO: 27263 - protein, 81 aa, Propithecus coquereli
LVFEDVAVNFTLEEWALLEPSQKNLYRDVMQETFRNLASIGKDGNVPSLSKLENKSHIPERLCERKEDSQCGETFIQIPDH

SEQ ID NO: 27264 - protein, 81 aa, Propithecus coquereli
SQVSLMFEDVAVLFSRDEWRKLDPSQRNLYREVMLENYSHLVSLGLPFTKPKVISLLQQGEDPWKVERESPGRPSLGWNTK

SEQ ID NO: 27265 - protein, 81 aa, Propithecus coquereli
GHVTFEDVAVCFSQEEWKLLDEAQRLLYRSVMLENFALTASLGLASSRSHEIIQLESWGEPFMPAWGFLAPALPKGCWHGV

SEQ ID NO: 27266 - protein, 81 aa, Propithecus coquereli
KAQESLTPEDVAVEFTWEEWQLLGPAQKDLYRDVMLENYSNLLSVGYQANKPDVLSKLERGELWTAEDEIHSRIYPEIKKV

SEQ ID NO: 27267 - protein, 81 aa, Propithecus coquereli
AAGSVTFKDVTMAFTQKEWEQLDPAQKNLYKDVMLENYSNLASMGCQAPKPDMISKLEKGEEPWLGKEKRPTQCHSNKIAR

SEQ ID NO: 27268 - protein, 81 aa, Saimiri boliviensis
AQESMTFRDVAVFFSQDEWLHLDSAQRALYREVMLENYSTLVSLGIPFSMPKVIHQLQQGQDPCMVEGEVPSDTCLGFKTW

SEQ ID NO: 27269 - protein, 81 aa, Propithecus coquereli
GLLTFKDVAIEFSQEEQACLDPAQQNLYRDVMLENYRNLVFLGLVVSKPDLITFLEQRQGPWNVKRHETVAKLQGIFSHYT

SEQ ID NO: 27270 - protein, 81 aa, Propithecus coquereli
SQELVTFEDVAVYFIRKEWKRLEPAQRDLYRDVMLENYGNVFSLDGETRTENDQEISEDTGSHAVLLGRFQKDISQGLKFE

SEQ ID NO: 27271 - protein, 81 aa, Propithecus coquereli
EDVAVDFSREEWQFLDPSQKVLYKEVMLENYSNLVSVGYQGTKPDSLFKLEEGKPPWIVEAAHSHTCPGLVIQNRRHAGKD

SEQ ID NO: 27272 - protein, 81 aa, Propithecus coquereli
MLTFRDVTIEFSLEEWECLNPAQQNLYRDVMLEYYGNLISLCEDNFSLAVSKQDLITCLEKRKEPWNVKKPETVVEHPAIS

SEQ ID NO: 27273 - protein, 81 aa, Propithecus coquereli
ASVTVTFDDVALYFSEQEWEILEKWQKEMYKQEMKTNYETLDSLGCAFSKPDLITWMEQGRMLLIGDQECLDGRRMTISPS

SEQ ID NO: 27274 - protein, 81 aa, Vombatus ursinus
MLENYGNLVCLGLAVSSPDVVCQLERGEGPWMPEGDVPGSSCAGWETKFSAPKLGIALKESSQETLTRVDICVSKLGEAWK

SEQ ID NO: 27275 - protein, 81 aa, Balaenoptera acutorostrata
RSQEPLTFQDVAVDFTREEWDQLYPAQKNLYRDVMLENYRNLVALGHQLYKPEVITQLEQGEQWMMETDSPPDTHPGDQSH

SEQ ID NO: 27276 - protein, 81 aa, Saimiri boliviensis
LANVTFDDVAVEFTPEEWALLDTTQKYLYRDAMLESYKNLVSVGCHLTSWLKQEELKTEIQPRTKGSLLQQGFLKNQIFNG

SEQ ID NO: 27277 - protein, 81 aa, Balaenoptera acutorostrata
RLTFEDVAIEFTEEEWECLDPGQRALYRDVMLETYRNLLSLDIFPIHVIKQLQPKVNSDKGEVFQTPMLGRPESCKIKHFH

SEQ ID NO: 27278 - protein, 81 aa, Vombatus ursinus
FQESMAFQDVAVDFTQEEWGYLDPAQRDLYREVMLENYRNLVFLGLVVSKPDVICHLEQRKELWNLEGVDKRRVPRDPCPG

SEQ ID NO: 27279 - protein, 81 aa, Saimiri boliviensis
VYSFFEKETLTFRDVAIEFSLEEWQCLNPAQQNLYRNVMLENYRNLVFLDIAVSKQNPISGLEQKKEPCSMKSHEMVARPS

SEQ ID NO: 27280 - protein, 81 aa, Saimiri boliviensis
SQTLVTFKDIFVDFTREEWKLLDTAQQIVYRNVMLENYKNLVSLGCQLTKPDVILRLEKGEEPWVVERGIHQETHPDSETA

SEQ ID NO: 27281 - protein, 81 aa, Balaenoptera acutorostrata
MESVTLEGVAVGLIQEWALLDDARRNLCRYVLLDNCRTLAPRGTPPCKACLVSQVGPREELRTAERGILCATGVDWESQLK

SEQ ID NO: 27282 - protein, 81 aa, Vombatus ursinus
MLENAQTFLSLGLPVPREDLISYLEEREAPWLLELEGLRSCCPEGEVRPEMKETSAKLSISVEQTYEQNHVSEGPCDFTRR

SEQ ID NO: 27283 - protein, 81 aa, Balaenoptera acutorostrata
SVTFEDIAVYFSWEEWRLLNETQRRLYLDVMLENFALISSLGCCCGAEDAEAPFEQIASLGVSQARTPKAALSSQKTHPCE

SEQ ID NO: 27284 - protein, 81 aa, Lynx pardinus
GLAVFKDVAIDFTQGEWNYLGAAQKDLSRDVMLENYHNLVSVGLSRSKPDVISLLEQEKQPWMVTKAMTGGPCPDLQCMCD

SEQ ID NO: 27285 - protein, 81 aa, Saimiri boliviensis
SKNGEHIETMKKLAQNHEAKGLPSNDTDWPQEKEGKAQIVVPVTLRDVTVIFTEAEWKRLSPEQRNPYKEVMLENYRNLLS

SEQ ID NO: 27286 - protein, 81 aa, Rhinopithecus bieti
MESVTLEDVAVEFIQEWALLGSARRSLCRYGMLDQCRTLTSRGAGAVPEDAVGALYRSEGDTVDSRGPASSPGAALVSGMH

SEQ ID NO: 27287 - protein, 81 aa, Panthera pardus
PQVSVSFEDVAVLLSWEEWGCLGPAQKGLYRDVMLETYRNLVSLGLQRSKPDVISRLEKGEEPWAPQSLRIEESWIRNHRS

SEQ ID NO: 27288 - protein, 81 aa, Panthera pardus
ESVTFKDVAVDFTQEEWGQLDSPQRALYRDVMLENYQNLLALEGEPGHEVKDESCQRQGVHKEEPYQEPITEPLVKSSIHS

SEQ ID NO: 27289 - protein, 81 aa, Panthera pardus
QEPVTFEDVAVYFTQNQWASLDPMQRALYREVMLENYTNMASLGGESRIKNEEPAGKREASEEAEWHRMPGGGLLRNVSQH

SEQ ID NO: 27290 - protein, 81 aa, Panthera pardus
CWGLLSFKDVSVEFTRDEWQLLDSAQKYLYRDVILENYSHLVSVGYHGTKPDLIFKLEQGEEPWIINAKVSRQSCPEDWKE

SEQ ID NO: 27291 - protein, 81 aa, Macaca nemestrina
MAFEDVAVYFSQEEWGLLDTAQRALYRRVMLDNFALVASLGSWSVAEDGDVSGEWPRAFSDTPPGMTTSIFPVAGAYHSVK

SEQ ID NO: 27292 - protein, 81 aa, Macaca nemestrina
FQEPVTFEDVAVYFTQNEWASLHPMQRALYREVMLENYANVTSLWGFPLSTERFLGCSLPSFLPSSVPELPVFLSPLHAFP

SEQ ID NO: 27293 - protein, 81 aa, Macaca nemestrina
GRVTFRDVAVEFSLAEWKCLNPVQRALYREVMLENYRNLEFVDSSLKSMMEFSSHEHSNTGEGFHTGTLERHKSYHIGDFW

SEQ ID NO: 27294 - protein, 81 aa, Muntiacus reevesi
SVTFPDVAVYFSWEEWRLLDEAQRCLYLDVMLENYALISSLGCCCGTENAEAPSEQITSLGVSQARTTKAALSTQKTHPCE

SEQ ID NO: 27295 - protein, 81 aa, Ursus americanus
RRAESVTFKDVAIDLTQEEWTLMDRSQRKLYIDVMLENITHLVSVGESATSDVISQWEQGGELWREDRGFAQGWNPGELWT

SEQ ID NO: 27296 - protein, 81 aa, Ursus americanus
GLLTFGDVAIEFSQEEWGCLSHTQRELYRDVMLENYGHLLFLGEDDSCQISQAPLGVSIEGSSQKVSMHRYKNSAVEILHL

SEQ ID NO: 27297 - protein, 81 aa, Ursus americanus
FQDLVTFKDVAVDFSQEEWEWLNPAQRNLYKNMMLENYQNLVSLGLCVSKPYVISLLEQGKEPWETKTEMTRNSGSIYETQ

SEQ ID NO: 27298 - protein, 81 aa, Ursus americanus
VLVTFKDVAVTFTQEEWGQLDLDQRALYQEVMLETCGLLVSLGDNVKLQTRDPSTCQLVLSEGALRQGSLTQGSSRDSRLA

SEQ ID NO: 27299 - protein, 81 aa, Ursus americanus
PTHSPGSSDISVDFTQKEWQLLDPAQRLLYKEVMLENYRQLVSLGHCVTKPELVLKLEQGEKPWAPKRELPSQSCPEIQKA

SEQ ID NO: 27300 - protein, 81 aa, Ursus americanus
KGAFVAFRDVAVDFTQEEWRLLSPAQRTLHWEVMLETYNHLVSLEIPFCKPKLISQLEQGEEPWIEERQHPLGLCPAGSKL

SEQ ID NO: 27301 - protein, 81 aa, Ursus americanus
LHGLLTFRDVAIEFSQEEWRCLSHTQRELYRDVMLENYRHLLFLGLIVSKPDLVSLLEQRKEPWDVKRKKTGLWCNENHLE

SEQ ID NO: 27302 - protein, 81 aa, Myotis brandtii
SDVNFEEVVIAFSQEEWGLLDEAQKLLYYNVMLEVFAFVSSVGCWHKMDDEEACSAQSVSIQGESQVGASKTATATQKTLL

SEQ ID NO: 27303 - protein, 81 aa, Myotis brandtii
MSVTFKDVAVLFTRDEWRKLRPPQRHLYQDVMLENYSNLVSLGLLFSKPKVISLLQQGEEPWKVEEESPGGAPLGWKSNHK

SEQ ID NO: 27304 - protein, 81 aa, Camelus ferus
MLRALEPLGAKAREMPWFVQGCSALIRISRPSVISQLEQKEEPWVLPLQNFEARKILRESHTAVLDNERLTAEEMDERRRQ

SEQ ID NO: 27305 - protein, 81 aa, Vombatus ursinus
MLENYRNLVSLGLLGPKPDLISWLEQGEETEFWDPLGCLARCTCLCEGGRSTWQSGSRGRSNSACHPCADILEALDGAAWE

SEQ ID NO: 27306 - protein, 81 aa, Propithecus coquereli
SQELLTFKDISVDFTQEEWGQLGPAHRNLYREVMLENYGNLVSVGYQLSKPGVISQLEKGEEPWLMEREISGCPGSDLESK

SEQ ID NO: 27307 - protein, 81 aa, Propithecus coquereli
SLGSELFRDVAIVFSQEEWQWLAPAQRDLYRDVMLETYSNLVSLGLAISKPDVISFLEQGKEPWMVERVATGDLCPVLESG

SEQ ID NO: 27308 - protein, 81 aa, Vombatus ursinus
MLENSQNLLSLGIPVLREDLTSHLMEREASWILDGKGPKNSSPGPVSLPSRTPRKHKSKRRPWMPFTTAQRLALEQKFQQK

SEQ ID NO: 27309 - protein, 81 aa, Propithecus coquereli
MAFRLLKAMYQLCFSKPGVILLLEQGKEPWMVKRELTKGLYSDWEPICETEELTPKQDLFKEQQSQKIIEKLTSYGLEYSS

SEQ ID NO: 27310 - protein, 81 aa, Saimiri boliviensis
TSKEAVTFKDVAVVFTEEELGLLGPAQRRLYRDVMLENFRNLLSVGHQPFNRDTFYFLREEKFWMMDVGTQREGNSGGKIQ

SEQ ID NO: 27311 - protein, 81 aa, Lynx pardinus
SQEPVTFEDVAVYFTRNQWTGLDPVQRALYREVMLENYANITSLGAFPFPKPELILRLERGEAPRGLDPWTPTGGEAPGDV

SEQ ID NO: 27312 - protein, 81 aa, Balaenoptera acutorostrata
AQGLMAFEDVAVYFSREEWGLLDAAQRALYRCVMLENFTLLASLGLSVSRPRVVIQLECGEEPWVLNGTDVTLASTAQRRP

SEQ ID NO: 27313 - protein, 81 aa, Vombatus ursinus
KGFLGSKPDVISQLERGEESWVLDIEKPEERELSSRKGAYGGYKKKYKEKLSLRQEVPKGRKIYKNASVKYPWDTSQVLDF

SEQ ID NO: 27314 - protein, 81 aa, Saimiri boliviensis
ADISGLVTFRDVAVEFSLEEWKCLEPAQRDLYREVTLENFGHLVSLGKEIVSHGPDGKQGTWDYNHFERQVSEECYFKQVN

SEQ ID NO: 27315 - protein, 81 aa, Vombatus ursinus
PQESVTFWDVAVTFTEEEWGCLAPPQRELYQEVMLENYQNLACLGLATSTPEMIIQLEQGEVPSTPGGGGPGICPPDGGTK

SEQ ID NO: 27316 - protein, 81 aa, Vombatus ursinus
SQELVTFKDVAVDFTWEEWELLEPGQKALYRDVTLENYRNLVSLGHPVSKPNVIFQLEQSDTPWLLEREAPRSIFPGEGMD

SEQ ID NO: 27317 - protein, 81 aa, Saimiri boliviensis
AQGSVSFNDVTVDFTQEEWQHLDHAQKTLYMDVMLENYCHLISVEENWKAEDFLVKFREHREKYSRSVVSINHKKLVKEKS

SEQ ID NO: 27318 - protein, 81 aa, Vombatus ursinus
SRGSVTFQDVAVTFTPEEWGRLAAPQKELYREVMLENFGHLACLGLVISKPDVICQLERGEGPWKPEGDAPLSSCAGGSKN

SEQ ID NO: 27319 - protein, 81 aa, Saimiri boliviensis
QGTVTFEDVAVHFSWEEWGLLDEAQRCLYRDVMLENLALLTSLDVHYQKQHPGEKHFGSNVDRALFVKTCIFHVLGETSTC

SEQ ID NO: 27320 - protein, 81 aa, Vombatus ursinus
GQLDPAQQNLYRDVMLDNYQNLIFLVRITHKKNPNTVKDHECNTLQRNSSPRSILVTQQTGPAGKSFHQCGAREKTLQKLS

SEQ ID NO: 27321 - protein, 81 aa, Panthera pardus
KSPGLLSFKDVAVVFTWEEWQLLDPIQKHLYQDVMLENYSNLISVGCQVTKADAFYQLEQGPPWITEEEIQSQIHPDDTWQ

SEQ ID NO: 27322 - protein, 81 aa, Panthera pardus
MLENYQNLLSLGAGPPGFKPDVISRLERGEEPRMEKREGWQMTCPDSETRSAPTQETLVKKSISAEAASPVGKTGGGLRAA

SEQ ID NO: 27323 - protein, 81 aa, Panthera pardus
FQGSVSFKDVTVGFTQEEWQCLDSSQRSLYRDVMLENYSHLVSVGSCATKPEVIFRLEQGEEPWIWEEEFPSQSLPEVWET

SEQ ID NO: 27324 - protein, 81 aa, Macaca nemestrina
MLENYKNLVFLGIDISKQDPITSLEEEKEPWNMKRHEMVDESPGYMCWMCSYVFLFYQRPLARARHKRFFPTSDTEKIQKM

SEQ ID NO: 27325 - protein, 81 aa, Macaca nemestrina
PAQGMTFEDVAIYFSQEEWELLDESQRFLYCDVMLENFAHVTSLGYCHGTENEVIAPEQSVSTQVRTSKGDTPTQKSLSEI

SEQ ID NO: 27326 - protein, 81 aa, Macaca nemestrina
MGPLQFRDVAIEFSLEEWHCLDTAQRNLYKNVMLENYSNLVFLGIVVSKPDLITRLEQGENPLTVKRHKMTANPSVMCSHF

SEQ ID NO: 27327 - protein, 81 aa, Ursus arctos
RLTFRDVAIEFSQEEWECLDPAQRELYRDVMLENYRNLVSLDVSPTHVMKKLQPKENSNTREVFQTAMLERHEGHEIKDFY

SEQ ID NO: 27328 - protein, 81 aa, Muntiacus reevesi
MGRLTFWDVAIDFTQEEWECLDLGQRELYTDVMVENYRNLASLGLVVPKPDLVTFLEQMKDLRNIRRMQTALIYPAISPQD

SEQ ID NO: 27329 - protein, 81 aa, Muntiacus reevesi
SMTLEDVAVNFTQKEWALLDAAQRQLYRDVILETCGHLAYSTPRQNNLAKRTFQEVNRAHLASSGRTLKQVAVAHEKDAFP

SEQ ID NO: 27330 - protein, 81 aa, Muntiacus reevesi
SIAFQDLAVRFSEDEWRLLGEGQRALYLDVMRENYDTLASLGTAEPLPLSAFLSPSELGGAVGARSRVGDRKEPTQGGGPV

SEQ ID NO: 27331 - protein, 81 aa, Muntiacus reevesi
DCVVFEDVAVYFSQEEWGLLDEAQRHLYRAVMTENLALVTSLGCWHGAQGEEPSSEQGVSVGMSEVRTAKPDPSSRKAQPS

SEQ ID NO: 27332 - protein, 81 aa, Ursus americanus
WVKSWGGSDVAIDFSPEEWGWLDSAQRDLYKDVMVQNYENLVSLAGLSIPKPYVISLLEDGKEPWMVEKKLSKGMFLDWES

SEQ ID NO: 27333 - protein, 81 aa, Muntiacus reevesi
KLGQVTFEDVAVYFSWEEWGLLDEAQRLLYHGVMLETFSLMASLGLTSFRTHDMTQMEQRGEPCVPAEGVSATATPAGCWC

SEQ ID NO: 27334 - protein, 81 aa, Muntiacus reevesi
MFGLVTFRDVAVEFSQEEWKCLEPAQRDLYREVTLENFGNLASLGLSISKPDVVSLLEQGKEPWMVVNDMTGPWCPDLESR

SEQ ID NO: 27335 - protein, 81 aa, Muntiacus reevesi
SSETLTFRDVFVDFTQEEWQQLNAAQKNLHRDVMLENYSHLVSVGYLVAQPHGIFRLGQEEEEAGMAAGESPLWSCPGEPM

SEQ ID NO: 27336 - protein, 80 aa, Ursus americanus
MKQLTEGRDVAIEFSQEEWGCLSHTQRELYRDVMLENYGHLLFLGLTVWKPDLVIFLEQEKQLWDVKRKETVAFHPGRWD

SEQ ID NO: 27337 - protein, 81 aa, Ursus americanus
PLGLLTFGDVAIEFSQEEWRCLSHTQRELYRDVILENYGHLLFLGVIVSKPDLVSLLEQRKEPWGEKRNKTVLFDPVRMCL

SEQ ID NO: 27338 - protein, 81 aa, Myotis brandtii
LSEESLTLEDVAVDFTWEEWQLLGPEQKDLYRDVMLETYSHLVSVGYPASKPDTLSRLERGEPWTREGGLHSGICSETKKN

SEQ ID NO: 27339 - protein, 81 aa, Myotis brandtii
MAFTQKEWEQLDPAQRSLYKDVMLENYSNLTSMGYQAAKPDMISKLEKGEEPCLGKGKRPRQGGPGEIARPKQIGANRKEM

SEQ ID NO: 27340 - protein, 81 aa, Myotis brandtii
AEFWDMNFEDVAIAFSQEEWGLLDEAQRLLYCDVLLEGFALVSSVARGSSAGGLNYIEASEAVSLLCKDMNFEDVSIAFSQ

SEQ ID NO: 27341 - protein, 81 aa, Eschrichtius robustus
ELLTFKDISVDFTQEEWGQLAPAHRNLYREVMLENYGNLVSVGCQLSKPSVISQLEKGEAPWMTEKEGPGDPSSAGGILVP

SEQ ID NO: 27342 - protein, 81 aa, Propithecus coquereli
SYEGSVSLRDVSIDFSREEWQHLDPSQRNLYRDVMLETYSHLLSVGYQVPKEEVVMLEQGKEPWALQGENPHQSCPGQKLW

SEQ ID NO: 27343 - protein, 81 aa, Propithecus coquereli
GRLTFRDVAIEFSLEEWKCLDPAQRALYKAVMLENYRNLVSLGISPFDLRIISLLEQGKEPWTVESQVQIARKSDGWKRIK

SEQ ID NO: 27344 - protein, 81 aa, Propithecus coquereli
CEKSVSLEDVTVDFSREEWQQLDPSQRHLYQDVMLEICNHLISVGYHIPSPEVIFRIVKGQGQWMGEAELPHQRCQEGKFG

SEQ ID NO: 27345 - protein, 81 aa, Lynx pardinus
FQGSVSFRDVAISFSQEEWACLDPAQRALYRDVMLENYSHLLSLAGRSISKPDVITFLEQEKEPWVVVRKETSGWYPDLES

SEQ ID NO: 27346 - protein, 81 aa, Saimiri boliviensis
VTFEDVAVVFTDEEWSHLVPIQRDLYKEVMLENYKSVVSLDWETKPEIYDASEEKAEGLLRESLGRQSPLCPKFEVHAPDG

SEQ ID NO: 27347 - protein, 81 aa, Balaenoptera acutorostrata
MFSDVSIDFSQEEWDYLDLEQRDLYRDVMLENYSNLVSLGCFVSKPDVISLLEQGKEPWKVVRKGRRRYPDLETNSETKKL

SEQ ID NO: 27348 - protein, 81 aa, Vombatus ursinus
AQASVSFKDVAVDFSQEEWCFLDASQKKLYKEVMLENYRNLVSLGLPVGKADVIFQLEQGQVPGTLEGEDPAASRPDWELR

SEQ ID NO: 27349 - protein, 81 aa, Saimiri boliviensis
LQGPVSFKDVAVDFTQEEWQQLDPDEKITYRDVMLENYSHLVSVGCDITKPNVIIKLEKGEEPWIMEDEFPCQHNPEVWKV

SEQ ID NO: 27350 - protein, 81 aa, Saimiri boliviensis
SWGPLSFMDVFVDFTREEWQLLDPAQKCLYRSVMLENYSNLVSLGYQHTKPDIIFRLEQEELCMVQTPIPNQCCPVLEAGK

SEQ ID NO: 27351 - protein, 81 aa, Ursus americanus
GLLDPAQRKLYRDVMLENFRNLLSVGEGNVWVMDTYLDWRCKKLDRQDIVYKHEGDSYGFSWISRCHDAHRLPERETPCNW

SEQ ID NO: 27352 - protein, 81 aa, Ursus americanus
AQGRTFQDVAVVFSEEELGLLDSTQRKLYRDVMLENFGNLVSVGEDRRSVTESQVLIIPIQQQDVSVLRSMELGKLWSCPV

SEQ ID NO: 27353 - protein, 81 aa, Ursus americanus
WGLLDEAQRLLYRDVMLENFSLMASLGLASSRTHEITQLEWWREPFLPPCEVLTAAMPRGTWRAEAEAEEAPREQSVYIAG

SEQ ID NO: 27354 - protein, 81 aa, Eschrichtius robustus
VPVTFDDISIYFSTPEWEKLEEWQKELYKNIMKGNYESLISMDYAMNQPDVLSQIQPEGDHNTEDQAGPEGSAIPTDPSEE

SEQ ID NO: 27355 - protein, 81 aa, Myotis brandtii
MNFEDVAIVFSQEEWGLLDEAQRLLYWDVMLEVFALVSSVGCWHKIDGDEACSVFIQGESLVRASKTAPSTQKIPLCKRCF

SEQ ID NO: 27356 - protein, 81 aa, Myotis brandtii
VTFEDIALYFSREEWSLLDEGQRQLYLNVMLENFELISSLGCCCGAENEEAVTEQNFFVRVSQARNPQLPLSSQKSHPCES

SEQ ID NO: 27357 - protein, 81 aa, Propithecus coquereli
SLVTVTFKDVAVDLTQEEWQQMKPAQRNLYRDVMLENYSNLVTVGCQVTKPDVIFKLEQEEEPWVMKEEMFGRHCPEPRRG

SEQ ID NO: 27358 - protein, 81 aa, Vombatus ursinus
ASVPVKFDDVAIYFSEQEWDILDDWQKDLYKHVMRANYSTLVSLDYTIPKPDLIFRIELGEVLFVGNWGDLEQAEIGVSLN

SEQ ID NO: 27359 - protein, 81 aa, Saimiri boliviensis
EMGPLTFRDVAIEFSLEEWQCLDTAQQDLYRKVMLENYTNLAFLAGIAVSKPDLITCLEQGKEPWNMKRHEMVDEPPAMCS

SEQ ID NO: 27360 - protein, 81 aa, Propithecus coquereli
SQGLVSFKDVAVDFTQDEWQQLDPAQRTLYRDVMLENYSHLVSMGYPVSKPDVISKLEQGEDPWIIKRDISNWIYPDENQA

SEQ ID NO: 27361 - protein, 81 aa, Propithecus coquereli
MVTFKDVAVVFTEEELGLLDSAKRKLYRDVMLENFRNLLLVAHQPFKPDLISQLEREEKLLMVETDTQRDGCSENKNQQKT

SEQ ID NO: 27362 - protein, 81 aa, Vombatus ursinus
MLENYQNLVFLGLVVSKPAVIDQLERGEEPWIPEGDVPRGPRPGWESWPEIKESVPKLGISMEEYQERLASYGPQASHLEE

SEQ ID NO: 27363 - protein, 81 aa, Vombatus ursinus
FQESVTFEDVAVDFTWEEWGCLDTSQKELYWEVMLETCRNLVSLGLADSNVEVISQVESGEAHGIPVDSVLRSCRPDGDGK

SEQ ID NO: 27364 - protein, 81 aa, Vombatus ursinus
VWIFQKSLTFQDVAVEFTQEEWGLLEPAQKDLFREVMLENYENFVSLGLPVSKPDVTSHLERRETFRLPEGEVPRGTYLGE

SEQ ID NO: 27365 - protein, 81 aa, Saimiri boliviensis
HPGSWETGPLTFRDVAIEFSLEEWQCLDTAQQDLYRKVMLENYRNLVFLGIAVSTPDWITCLEQGKDPWNMKRHSMVATPP

SEQ ID NO: 27366 - protein, 81 aa, Saimiri boliviensis
MNSVSFEDVAVNFTLEEWALLDSSQKKLYKDVMRETFKNLVCLGKSWEDQDVEDDHSNLGRNQRGYMVERLCESRKGTKSR

SEQ ID NO: 27367 - protein, 81 aa, Saimiri boliviensis
MAEGEEEWQQLNPAQKTLHRDVMLETYSHLDSVGCSGIKPDVIFKVEHRKDPWIKDSELSRWIYPDRQKGLKSSQQIISGE

SEQ ID NO: 27368 - protein, 81 aa, Vombatus ursinus
FQELVIFEDVSIYFTLKEWKLLIPTQRVLYRNVMLENYGNVVSVGFPFSKPALISHLEQEEEPLVQYLQETERKDAQKGLC

SEQ ID NO: 27369 - protein, 81 aa, Saimiri boliviensis
PSEGVTFEDVAVYFSWEEWDLLDETQKHLYFDVMLQNFVLTSSLGLVSSWSHVVAQLGVGEVSSVLHRMFMTPASHEEAPS

SEQ ID NO: 27370 - protein, 81 aa, Balaenoptera acutorostrata
QAQETLTFDDVTVDFTWEEWQLLTPPQKDLYQEVMLENYSNLLSVGYQARKPDILSKLDQGKPWTMEDEIHCQTHSGYQAS

SEQ ID NO: 27371 - protein, 81 aa, Lynx pardinus
QPQEAVTFKDVEVIFSQDEWGWLDPAQRNLYRDVMLENYGNMVSLVGPFTKPVLISWLEAREPWGLNVQGAQPKGNPGVAP

SEQ ID NO: 27372 - protein, 81 aa, Lynx pardinus
FQGSLSFEDVTVGFSQEEWQHLDPAQRTLYRDVMLENYSHLVAVGCCVPKPDVIFRLEQGQQPWLVEEESLDQIWPEVCRV

SEQ ID NO: 27373 - protein, 81 aa, Saimiri boliviensis
MGLLTFRDVAIEFSLEEWEHLDSNQKNLYGDVMLENYRNLVCLGLTVSKPDLITFLEQRKEPWNVKSAETVASQPDVFSRD

SEQ ID NO: 27374 - protein, 81 aa, Vombatus ursinus
MLENSQNLLSLGIPVLREDLISHFEEREASWILDQIDLRNSCPDAQTRSEVNEPTTKLSISVEESHQQRYLSDSPCDLNLR

SEQ ID NO: 27375 - protein, 81 aa, Balaenoptera acutorostrata
RLTFKDVVIEFSPEEWECLDPAQRALYRDVMLETYRNLVFIMKAYLSHIHMIKKLQLKSNTDIGEIFQTVMLGSHGSCEIK

SEQ ID NO: 27376 - protein, 81 aa, Lynx pardinus
PQVSVSFEDVAVLLSWEEWGCLGPAQKGLYRDVMLETYRNLVSLGLQHSKPDVISRLEKGEEPWTPHSLRIEESWIRNHRS

SEQ ID NO: 27377 - protein, 81 aa, Balaenoptera acutorostrata
LQEAVTFEDVAVNFSNEEWQCLTHAQRHLYKDVMLENYGNVVSLGFPFPKPPLISHLEQEAELCAQDRQDREFLSCSYPVS

SEQ ID NO: 27378 - protein, 81 aa, Cervus elaphus
QPKAKKSWGHLSFMDVFVDFTWEEWQLLDSAQKHLYRSVMLENYRNFVSLGYQYTKPSIIFQLEQEELWMMHSPSQDHSGE

SEQ ID NO: 27379 - protein, 81 aa, Colobus angolensis
MELFTFRDVAIEFSPEEWKCLDPAQQNLYRDVMLENYRNLVSLAVCSPFSQDLSPVQGIEDSFQKLVLRRYEKCGYKNLQL

SEQ ID NO: 27380 - protein, 81 aa, Oryctolagus cuniculus
VTIYQLGSIPYRGWSNISLGSWLFLYGFRVSPIERPHGVFITSHNSVTMTDGLVMFRGVAVDFSQEEWECLDLVRGPCTWA

SEQ ID NO: 27381 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMSHTLSPRLEYS

SEQ ID NO: 27382 - protein, 81 aa, Macaca nemestrina
QELLTFRDVTIEFSLEEWEFLKPAQQNLYRKVMLENYRNLVSLAVSSHCTEDFLPEQGMKDSFQKVILRRYGSCGLEDLHL

SEQ ID NO: 27383 - protein, 81 aa, Macaca nemestrina
QGRVTFRDVAIEFSLAEWKCLNPAQRALYREVMLENYRNLEAVDISSKCMMKEILSTGQGNTEVFHTGTLQRHESHHIGDF

SEQ ID NO: 27384 - protein, 81 aa, Macaca nemestrina
MGPLTFRDVAIEFSLKEWQCLDTAQRNLYRNVMLENYRNLVFLVMCSHFAQDLWPEQNIKDSFQKVTLKRYGTCRHENLPL

SEQ ID NO: 27385 - protein, 81 aa, Macaca nemestrina
PQGHLTFMDVAIEFSQEEWKCLDPGQRALYRDVMLENYRNLVSLGICLPDLSIISMLKQRREPLTLQSGVKIVKNPDGREC

SEQ ID NO: 27386 - protein, 81 aa, Ursus arctos
MCDSVFPSWPCAGFLVFKPELISRLEQGQEPWVLDLKGVEGREGARTFLTDSAVGTASEQACADMGVLKPEPCVAVVRSPP

SEQ ID NO: 27387 - protein, 81 aa, Ursus arctos
VMAHMAFRDVAVDFSQEEWLLLSPAQRSLYREVMLENYSNLVSLGIPFSKPKLISQLEQGKETWREERTCPLATCPEPKPE

SEQ ID NO: 27388 - protein, 81 aa, Ursus arctos
AQESVTFRDVAVFFSQDEWLRLDSAQRTLYREVMLENYGTLVSLGILFSTPKVIFQLQQGEDPWMVENGVSRGPRVGWERL

SEQ ID NO: 27389 - protein, 81 aa, Ursus arctos
PKVPVTFDDVAVYFSEPEWGKLDEWQKELYKHVMRGNYEMLVSLDYAISKPDILTRMERGEDPCPEGPWGQEERSKKEAVR

SEQ ID NO: 27390 - protein, 81 aa, Muntiacus reevesi
APVTFDDITVYLLQEEWVLLSQQQKNICGSDKMVAPLGPSIASPELFYKFEQGPEPWLASVQGQRSHLSPNPGKNKMGFME

SEQ ID NO: 27391 - protein, 81 aa, Muntiacus reevesi
MGLLTFQDVTIDFTQEEWECLDLGQRELYRDVMLENYGNLACLGLVVSKPDLVTFLEQMKDPWDARRVETAIYPGIIHDEM

SEQ ID NO: 27392 - protein, 81 aa, Muntiacus reevesi
PQDLMTFEDVAVEFTWWEWGQLDPAQKDLYREVMLENFKNLASLDWERRPQAKEAMLSQGLSKEELLQRASEEKHIRDELR

SEQ ID NO: 27393 - protein, 81 aa, Muntiacus reevesi
LGLLTFEDVAVHFTQEEGARLDAGQRTLYRDVMLETYRILISLGEPFPPPHPQYPSELRWDLGGARLAVTLGPEVGHSAPR

SEQ ID NO: 27394 - protein, 81 aa, Muntiacus reevesi
GSVTFEDVAVNFSWEEWGLLDESQKRLYHDVMLENLALISSLGCWPGEEDKEAFSEQSISDQGCSQIRIAKAGLSPQKANL

SEQ ID NO: 27395 - protein, 81 aa, Ursus americanus
HCIMKPEVIVKLEQGAEPWTVEEAPTQSLPDVQTSGDLIETCQEHQSRHVWQAGVANNETSTKERTDLGKPFNLSAIHISN

SEQ ID NO: 27396 - protein, 81 aa, Ursus americanus
DQMAVTFEDVTVIFTWEEWKFLDSSQKKLYREVMWENYTNVMSVGNWKESSKPQEERLRYLEHENRLSWQGWRNASAQIYE

SEQ ID NO: 27397 - protein, 81 aa, Myotis brandtii
PSSPVTFEDVAVFFSQEEWGLLDEARRRLCRDVMLEIFELMASLGCWHEVEDEEACSKQNASVEGVSQVRIPNAHPSTEKT

SEQ ID NO: 27398 - protein, 81 aa, Eschrichtius robustus
EEWDYLDPAQRSLYKDVMMENYGNLVSLDVLNRDKDEEPTVKQEIEEIEEEVEPQGVIVTRIKSEIDQDPMGRETFELVGE

SEQ ID NO: 27399 - protein, 81 aa, Myotis brandtii
MEEWAFLDPTQKKLYTDVMLETFWNLASVACILEQCDDHDNEDQYKKHGMNLSNHIVKRLCTRKDGSQYRENFSQIPNNNE

SEQ ID NO: 27400 - protein, 81 aa, Myotis brandtii
PRESVTFKDVAVLFTQDEWAQLSPAQRALYRDVMLENYSHLVSLGLLGPKPDLFAQLGKGEEWTPEDTSRGFCLGKTLYVG

SEQ ID NO: 27401 - protein, 81 aa, Propithecus coquereli
FQEVVTFGDVAVHFSREEWQCLDPGQRALYREVMLENHSSVAGLAGFLVFKPELISRLEQGQEPWVLDLQGVEGTEAPRTS

SEQ ID NO: 27402 - protein, 81 aa, Propithecus coquereli
PQETIVFEDVAVYFTRIEWSCLAPDQRALYRDVMLENYGNLAALGFLITKPALISLLEQGEEPGALILQVAEERGTKASLC

SEQ ID NO: 27403 - protein, 81 aa, Oryctolagus cuniculus
CEVSVSFEDVTVDFSKEEWQQLDFTQRSLYQDVMLENYSHLLSVGFEVPKPEVIFKLEQGQEPWMLEEEAPHQRCSDGIKA

SEQ ID NO: 27404 - protein, 81 aa, Oryctolagus cuniculus
MLPLTFEDVAIYFSEQEWQSLEAWQRELYGHVMRTNYETLASLDGGLPKPELITWIEQQGEFGSCTESQKPRNIICSSADT

SEQ ID NO: 27405 - protein, 81 aa, Pteropus alecto
SQRQLTLSDVFIEFSQEEWECLSPAEQALYREVMLESYRNLLFLGISVSDLYIVSILEQGKAPWTQESELKLAQKPDWWEH

SEQ ID NO: 27406 - protein, 81 aa, Pteropus alecto
SAASVSFKDVTVEFTPDEWQYLGASQSTLYRNVMLENYSHLVSPGYCSIKPEVIFKLEQGEDPWLVEDEFLNRSFSAIHQR

SEQ ID NO: 27407 - protein, 81 aa, Oryctolagus cuniculus
SKAPVTFGDLAIYFSQEEWEWLSPIQKDLYEEVMLENYQNLVSLGLSFRRPNVITLLEKGKAPWMVELLRRHRGPDKGSKC

SEQ ID NO: 27408 - protein, 81 aa, Rhinopithecus bieti
ISGVLTFRDVAVEFSLEEWQCLDTAQQNLYRNVMLENYRNLVFLGIAVSKPDLITCLEQGKKPWNMKRHEMVAKPPGWSAV

SEQ ID NO: 27409 - protein, 81 aa, Ursus americanus
FVCSMTFRDVAIDFSRQEWEYLDPIQRDLYRDVMLENYRNLVSLGHSISKPGVVDLLEQGKEPWIILREETQRQYTVYNSI

SEQ ID NO: 27410 - protein, 81 aa, Ursus americanus
RPGAVSFADVAVYFSPEEWGCLRPAQRALYREVMRETYGHLGALGFPGPKPALISWMEQESEAWSPDAQDPEEGESLGGAL

SEQ ID NO: 27411 - protein, 81 aa, Propithecus coquereli
SCEGSVSFRDVVIDFSREEWQHLDPSQRNLYQDVMLETYSHLLSVGYQVPKAEVVMLEQGKEPWALQGESLHQSCPGEKLL

SEQ ID NO: 27412 - protein, 81 aa, Propithecus coquereli
TQGQLTFRDVAIEFSQEEWKCLDPAQRALYRDVMLENYWNLVYLGISSFDMNIIYILEEGKEPWTVESQVKIARKPHRWEG

SEQ ID NO: 27413 - protein, 81 aa, Propithecus coquereli
FASFQEQQKMSKSLDVAVDFTWEEWQDLDDAQKTLYRDVMLETYSSLVSLGHCVTKPEVIFKLERGAEPWMVEESSKQSLP

SEQ ID NO: 27414 - protein, 81 aa, Saimiri boliviensis
QGSLTFRDVTIEFSPEEWRCLDPAQRTLYRDVMLENYRNLVSLDISPKYKMKELFSTAQGDTEVFHGGILDRRESHHIGDF

SEQ ID NO: 27415 - protein, 81 aa, Propithecus coquereli
MDVMLENYCHLISVGCHMTKPDVILKLEQGEEPWASFAGLTCLEENWKAEDFLVKFREQQDKYFRSVVCINHKKLVNKKNN

SEQ ID NO: 27416 - protein, 81 aa, Propithecus coquereli
RFQGSVTFGDVAIDFSQQEWESLDSAQKDLYRDVMLETYRNLVSMDLHLKEEIISYEEMPTSEKCTSLALHQKVLNQEKPC

SEQ ID NO: 27417 - protein, 81 aa, Propithecus coquereli
CEVPVSFEDVTVDFSREEWQHLDPAQRRLYWDVTLENYSHLLSVGYRVPKPEAIFQLEQEEGLWTLEGKAPHQSDSGEALG

SEQ ID NO: 27418 - protein, 81 aa, Propithecus coquereli
SQVSLMFEDVAVLFSRDEWRKLDPSQRNLYREVMLENYSHLVSLGLPLTKPKVISLLQQGEDPWKVERESPGRPSLGCKSS

SEQ ID NO: 27419 - protein, 81 aa, Lynx pardinus
MDTSQRMLYRDVTLENISHLVSVGCHFFRSDVISPWEQRGELWREERGPPQGWSPGMKKSHNKQEIISMQDIYMKDPPNCW

SEQ ID NO: 27420 - protein, 81 aa, Saimiri boliviensis
DAEQVTFEDVVVDFTKEEWGQLAPAQKTLYCDVMLDTFRLLVAVGHWLPKPNIISLLEQEAELAVDPGVPQGVYQESKGHF

SEQ ID NO: 27421 - protein, 81 aa, Vombatus ursinus
MLENYQNFVSLGGLPAPKPHVISQLERGEAPWIAEREALGGVCQDSFIQNTRYEIKEPSINYGIFMGASAKERLSKNPIWN

SEQ ID NO: 27422 - protein, 81 aa, Balaenoptera acutorostrata
KTWGPLSFMDVFVDFTWEEWQLLDPAQKHLYRSVMLENYSNLVSLGYQHTKPNIIFQLEQEELWMMQIPSEGHPDEVWEID

SEQ ID NO: 27423 - protein, 81 aa, Balaenoptera acutorostrata
AQACVTFEDVAIYFSQEEWGLLDEAQRFLYHDVMLENFTLTTSLDCQCGGEDEEIPSEQSVSGGESQVRTSQSVPSTQKTH

SEQ ID NO: 27424 - protein, 81 aa, Saimiri boliviensis
PQDLMTFEDVAVEFTQWEWGQLNPAQKDLYREVMLENFRNLTLLGLLVSKPYVICQLEEGGECFMVRREISIGAHSDWERR

SEQ ID NO: 27425 - protein, 81 aa, Vombatus ursinus
PKVPVTFDDVAVYFSEKEWGNLDKWQKELYKHVMTGNYEMLVSLDYALSKPEFLTRIEQGEEPCVQNQLDSEEAEVAASPD

SEQ ID NO: 27426 - protein, 81 aa, Balaenoptera acutorostrata
PKVPVTFDDVAVHFSEQEWGNLSEWQKELYKNVMRGNYESLVSMDYAISKPDLMSQMERGERPVMQEPEDSEEGEAPADPS

SEQ ID NO: 27427 - protein, 81 aa, Balaenoptera acutorostrata
FQGSVSFKDVTVGFTQEEWQHLDPTQRSLYRDVMLENYSNLVSVGYCVTKPEVIFRLEQGEEPWVLEEEFPRQSFAEVWKT

SEQ ID NO: 27428 - protein, 81 aa, Saimiri boliviensis
FQASVSFQDVAVEFTQEEWQHMGPVERTLYRDVMLENYSHLVSVGYCFTKPELIFTLEQGEDPWLLEKEKGFLSRTSPEDS

SEQ ID NO: 27429 - protein, 81 aa, Balaenoptera acutorostrata
SQSLVTFGDVAVEFSPEEWAWLDSAQRSLYRSVMLENYRSLVSLGLCVSKPKMISSLEQRKEPWAAKRTLTRGGCPDSRAL

SEQ ID NO: 27430 - protein, 81 aa, Balaenoptera acutorostrata
WLTFKDVVIEFSQEEWECLDPAQRALYRDVMLETCRNLLSLDICPIHVVKQLQPKGNSDPGEVFQRVILGRSKSREIKHFY

SEQ ID NO: 27431 - protein, 81 aa, Lynx pardinus
MDTSQRTLYRDVTLENISHLVSVGCHFFRSDVISQWEQRGELWREERGPPQGWSPGMKNSHNKQEIIPMQDICMNDPPNCW

SEQ ID NO: 27432 - protein, 81 aa, Balaenoptera acutorostrata
KPAAVSFADVAVYFSVEEWGCLRPAQRALYRDVMRETYGHLGALGFPGPKPALISWMEQESEAWSPAAQDPEEGESLGGAL

SEQ ID NO: 27433 - protein, 81 aa, Saimiri boliviensis
SQDSMTFEDIVVDFTREEWALLDTSQRKLFRDVMLENISHLVSIGNQFCKSVVFSHLEQVEKLSTQGISLLQGKEGDIKHQ

SEQ ID NO: 27434 - protein, 81 aa, Saimiri boliviensis
VTFEDVAVYFIRKEWKRLEPAQRDLYRDVMLENYGNVFSLDPIRVSLTIQKVMLAWFTGTLTVVRGLCPSELASVEPPDTE

SEQ ID NO: 27435 - protein, 81 aa, Oryctolagus cuniculus
SLNRCAFEDLAVYFTWEEWQKMNNAQKILYRDVMLETYSSLFSLGSCITKPDLIIKLEQGAEPWMVEEYLNESLPGQCAHN

SEQ ID NO: 27436 - protein, 81 aa, Oryctolagus cuniculus
GSVSFTDVTVDFTQEEWEQLDPAQRILYMDVMLENYSNLLSVEVWKADDQMEGHPRSPEEQARQFIIHKSPVEERGNPFGK

SEQ ID NO: 27437 - protein, 81 aa, Oryctolagus cuniculus
KGQVTFEDVFVHFSWEDWGLLDEAQKHLYRDVMLENFALVASLGKDLISTPASFPPGARSFLLVSHAGAGPKDLGHPPLPS

SEQ ID NO: 27438 - protein, 81 aa, Oryctolagus cuniculus
SQASVSFKDVSVEFTLEEWQHVSPAQRTLYRDVMLENYSHLVSLGYCFTKPGLIFILEQGEDPWLLDKEFLSRSSPEDFQP

SEQ ID NO: 27439 - protein, 81 aa, Rhinopithecus bieti
MLENYGNLVSVGYQLSKPGVISQLEKGEEPWLMEREISGVPSSDLESKTKTKESALQNDISWEELHCGLMMERSTKGSTMY

SEQ ID NO: 27440 - protein, 81 aa, Panthera pardus
ESGAQVPVSFEDVSMYFIKTEWKLLGLSQRILYKRVLLENYRHLVSLGQGITPLSCWPQSPPAWGSPGPAWPPCIQSPLLP

SEQ ID NO: 27441 - protein, 81 aa, Panthera pardus
MLETYSHLLSVGYEVPQPEVFMLEQGKEPWALQGESPHQSCSEELWQIDDQTESYQQRENKSLRDVVFIKKILTTKKDYEY

SEQ ID NO: 27442 - protein, 81 aa, Panthera pardus
MLENYSHLVSVGYDSTKPKVILKLEQGEEPWVVEGDLPCRRRPEVWKVDDLIERIPENGDDISRQAVSANSKTPNEEREDA

SEQ ID NO: 27443 - protein, 81 aa, Panthera pardus
MFFVITSPLTKIVMNTLNVPLLKLYLPSHSETVKPVQLTQVLNYFPFTGYCFTKPELIFTLEQGEDPWLLKKEFLRKGSPE

SEQ ID NO: 27444 - protein, 81 aa, Panthera pardus
GERTVTRCLTNYSQDLVILEDVAVEFIQEEWTLLDPTQRNLYRDVMLENHKNLVAVDWEICLNTKWSAPQQNILQGKTPNG

SEQ ID NO: 27445 - protein, 81 aa, Panthera pardus
LREPTQDTVTFEDVAVYLSRQEWGLLDEFQRHFYHDVMLENFELTVFLGGWCGGDHEEEHFCRRATSEDSKAGVSAQKACS

SEQ ID NO: 27446 - protein, 81 aa, Panthera pardus
PCRLVLFKDVAIDFSQEEWECLDLEQKDLYRDVMLENYNNLVSLAGFSISKTNVLSLLKQGKEPWKVVQDVTRSQSSAWES

SEQ ID NO: 27447 - protein, 81 aa, Macaca nemestrina
QGLLTFRDVAIEFSQEEWKCLDPAQRTLYRDVMVENYRNLVSLDISSKCTMKDFLSTVQGNTEVIHTRTLERHHIGDFCFQ

SEQ ID NO: 27448 - protein, 81 aa, Macaca nemestrina
ADVSLAFRDVSIDLSQEEWECLDPAQRDLYKDVMLENYSNLVSLGYTIPKPDVITLLEQQKEPWIVMREGTRSWYTDLEYK

SEQ ID NO: 27449 - protein, 81 aa, Ursus arctos
QGTVTFEDIAVSFSWEEWDLLDDTQRHLYQDVMLENLALITSLGCWHGAEDEEAPSEQSVSVEGVSHVRTPETALFPQKAN

SEQ ID NO: 27450 - protein, 81 aa, Ursus arctos
APLPLTFEDVAIYFSEQEWQNLEAWQKELYKHVMRTNYEILVSLDDGLPKPELISWIEQGREFFKNWGESQKSGNIICSSA

SEQ ID NO: 27451 - protein, 81 aa, Ursus americanus
MELTQVLNYFPFTGYCFTKPELIFTLEQGEDPWLLKKEFLRKSSPEDSQPNQLSEKSLGNQGKYLWQVLFTNKSLTTEEEI

SEQ ID NO: 27452 - protein, 81 aa, Ursus americanus
TSESLTLEDVAVDFTWEEWELLAPTRKELYWDVMLENYRNLVSVGYQASQPDVLSELEQGEPPWILEDEDEVQSQTHPQIQ

SEQ ID NO: 27453 - protein, 81 aa, Myotis brandtii
LQGSVSFEDVAVELTRDEWQCLGPGQRTLYREVMLENYSHLVSTGYCITKPPVILKLEQGEEPWSLEEEFLSQTHPARPSQ

SEQ ID NO: 27454 - protein, 81 aa, Myotis brandtii
FQGSVTFQDVAVDFTSEEWQLLDCDQRTLYWDVMLENFRNLISVGGAVTKTKVVVKMQQGQELQVVEGENPHWSHPEADCP

SEQ ID NO: 27455 - protein, 81 aa, Myotis brandtii
DPVTFDDVVVYFSLEEWGLLDEAQRRLYHEVMLDNLALVSSLGGCCGAEDAQANCEQSVSGGGSPSSPSKAALSLLKTHFC

SEQ ID NO: 27456 - protein, 81 aa, Myotis brandtii
LFQGSTPFSNVTAAFTHKEWRHLVRAPREGFEEIPEKSRNLVLLGLPVSQPGMNSQLEQGKSPWMLEGEGLRSTCPDWKTV

SEQ ID NO: 27457 - protein, 81 aa, Propithecus coquereli
MADLVLFRDVAVDFSQEEWECLNSHQRNLYRDVILENYSNLVSLAGCSISKPDVIALLEQGKEPWMVVRDEQRARSPGECP

SEQ ID NO: 27458 - protein, 81 aa, Propithecus coquereli
AQGLVTFRDVAVEFSQEEWKCLEPAQRDLYRDVTLENFSNLVSLGLSISKPDVISLLEQGKEPWMTANDMTEPWCPDLESR

SEQ ID NO: 27459 - protein, 81 aa, Ursus americanus
SAGLLTFRDVAIEFSQEEWRCLSHTQRELYRDVMLENYRHLLFLGLIVSKPDLVSLLEQRKEPWDVKRKKTGGRFLLSYFV

SEQ ID NO: 27460 - protein, 81 aa, Ursus americanus
VLGLVTFGDVAIDFSREEWEWLNSAQRTLHRDVMLENYRNLVSLGLCVSKPDMISSLEQRKEPWMVKRKLTRGRCPDLKTM

SEQ ID NO: 27461 - protein, 81 aa, Ursus americanus
PVPQVPALPHEGSPGDQAATLLTARYQAVLFQEFVTFEDVAVHLTREEWGCLDPVQRDLYREVMLENYGNVVSLVGLWQPP

SEQ ID NO: 27462 - protein, 81 aa, Propithecus coquereli
QDSVTFEDVAVNFTLEEWTLLDPFQKNLYRDVMQETFRNLAAIGKKWKDQNIEDQCKNPRRKIRSLIEERVCESKEGSQRG

SEQ ID NO: 27463 - protein, 81 aa, Propithecus coquereli
GCVVFEDVAIYFSQEEWGHLDEAQRSLYRDVMLENMALLSSLGCCHGAEDVEVPSEQGVSVGMSQVTTSKALLSTKKTQPC

SEQ ID NO: 27464 - protein, 81 aa, Propithecus coquereli
ELVTFEDVAVYFIRKEWKRLEPAQRDLYRDVMLENYGNVFSLDWIYISLTIQKAMLAGSPGILSVGWGLCPSQLASVEPAD

SEQ ID NO: 27465 - protein, 81 aa, Propithecus coquereli
MVAGWSTNYSQDSVTFEDVAVDFTQEEWTLLDPTQRNLYRDVMLENYRNLVAVDWEICINTKCSAPQQNFLQGKTSNVVEM

SEQ ID NO: 27466 - protein, 81 aa, Propithecus coquereli
YQDSVTFDDVALDFTQEEWVLLDKTQKILYRDVMLENYKNLATVGCQFIKPSLISCLEQKEELRTVQGGVLQDWEILLQTN

SEQ ID NO: 27467 - protein, 81 aa, Propithecus coquereli
AQGPMLFEDLAVYFSQEECVSLHPVQRSLSRDATQECFEDVALMGVEGETEMNQQLSLESMELEELSLEEYPIPTSPVQYP

SEQ ID NO: 27468 - protein, 81 aa, Vombatus ursinus
DFSGIVLFSNRNTQIFCLSIWTGHQVSKPDVISQLEQGEEPWTVEREVSTYSCRDWETRNKTKESTLKQDIPEAESSQKVT

SEQ ID NO: 27469 - protein, 81 aa, Saimiri boliviensis
SFKEAVTFKDVAVVFTEEELGLLDLAQRKLYRDVMLENFRNLLSVGHQPFNRDTFYFLREEKFWMMDVGTQREGNSGGKIQ

SEQ ID NO: 27470 - protein, 81 aa, Balaenoptera acutorostrata
QGSVTFEDVAVYFSWEEWCLLDEVQIHLYLDVMVENFALVCMLGSLPGVEDEETPSEQSVSAEGVSQMRTPRAGLSPEKTQ

SEQ ID NO: 27471 - protein, 81 aa, Vombatus ursinus
SQELVTFKDVAVDFTWEEWELLEPGQKALYRDVTLENYRNLVSLGHPVSKPSVIFQLEQSDTPWLLEREAPRSIFPGEGMD

SEQ ID NO: 27472 - protein, 81 aa, Saimiri boliviensis
RNTIPQDNESPPQQGKANQNDSVAFEDVAVNFTSEEWALLDPSQKTLYREVMQETLRNLASIEVLWKRDSLKAKVISIEKF

SEQ ID NO: 27473 - protein, 81 aa, Lynx pardinus
MAFTQKEWEQLDPAQRNLYKDVMLENYSNLASMGYQAPKPDMISKLEKGEEPWLGKGKKPRQGGPSEIARPKQIGTNGKEV

SEQ ID NO: 27474 - protein, 81 aa, Balaenoptera acutorostrata
LAFEDVAVYFTREEWDALHWPQKALYRDVMLDNYRNVLSLGPEARFKVKELTPKQNISEDLESCKMSLVKQKMARKPLEKL

SEQ ID NO: 27475 - protein, 81 aa, Balaenoptera acutorostrata
VKESMTFKDVAIDFTLEEWRLMDPTQRKLHKDVMLENYRNLVSLGLAVSKPDMISHLEDGKGPWAVVRETSKTPYSELETK

SEQ ID NO: 27476 - protein, 81 aa, Vombatus ursinus
MLENYRNLVFLGLTVWKPDVISHLEEGEAPWIQDREVPKTISPGESLKIRQMGIFMSYTLAGLLWEISFLEFSLEVSISGA

SEQ ID NO: 27477 - protein, 81 aa, Balaenoptera acutorostrata
PKVPVTFDDISIYFSTPEWEKLEEWQKELYKNIMKGNYESLISMDYAMNQPDVLSQIQPEGDHNTEDQAGPEGSEIPTDPS

SEQ ID NO: 27478 - protein, 81 aa, Saimiri boliviensis
YQDSVTFDDLAVDFTPEEWTLLDPTQRNLYRDVMLENYKNLATVGCQLFKPSLISWLEQEESRTAQRGDFQEWKVQLKTKE

SEQ ID NO: 27479 - protein, 81 aa, Vombatus ursinus
SQIGVTFKDVAVFFSQEEWCSLDPSQQKLYKDVMLEISQNMLSLGLPVPKADWISKLDKREAPWLLEHKDPRNSCLGRRNR

SEQ ID NO: 27480 - protein, 81 aa, Saimiri boliviensis
ASVTVTFDDVALYFSEQEWEILEKWQKQMYKQEMKTNYETLNSLGYAFSKPDLITWMEQGRMLLISDQGRLHKTKRTTGPP

SEQ ID NO: 27481 - protein, 81 aa, Balaenoptera acutorostrata
TRVSVTFDDVAVTFTREEWGQLDPAQRTLYQEVMLENCGLLVSLGCPVPRPELIYQLEQGQELWTVKKDLSQSTCPGDKGK

SEQ ID NO: 27482 - protein, 81 aa, Saimiri boliviensis
SLEMGPLTFMDVAIEFSLEEWQCLDTGQQNLYRNVMLENYRNLAFLGIAVSKPDLIACLEKEKEPWKTKRHAVVDEPPGLQ

SEQ ID NO: 27483 - protein, 81 aa, Lynx pardinus
MEWGLLDEAQMCLYHNVMLENLALMTSLGCRCGVEDKAICFEQCISARVLSQDGTSKAGMSPQKICGPILRDILHLIEHQD

SEQ ID NO: 27484 - protein, 81 aa, Saimiri boliviensis
PQKSVTFEDVAVYFTQAEWDGLSPAQRTLYRDVMLENYGNVASLGFPLLKPAVISQLEGGGELGGPSPLAAGTGLRGLWTV

SEQ ID NO: 27485 - protein, 81 aa, Balaenoptera acutorostrata
PLESVTFEDVAINFTQEEWALLDTSQRNLFRNVMLENISHLVSIGYQISKSDVISQLKQGKELRKSTVSKQCGKSLSQGSF

SEQ ID NO: 27486 - protein, 81 aa, Balaenoptera acutorostrata
SQSLLTFEEVAIYFSQEEWELLDPTQKALYNDVMQENYETVISLALFVLPKTKVICCLEQGEEPWFQGSPVLKDSPGELFS

SEQ ID NO: 27487 - protein, 81 aa, Colobus angolensis
AQGQVNFEDVFVYFSQEEWVLLDEAERLLYRDVMLENFALTASLGYTSFMSHIVASLVMGSEPWTPGGSGPGCWRGMEDEE

SEQ ID NO: 27488 - protein, 81 aa, Colobus angolensis
RCQESVTFEDVAVVFTDEEWSHLVPIQRDLYKEVMLENYNSIVSLDWETKPEIHDASDEKSEGSLRERLGRQSPLCPKFEV

SEQ ID NO: 27489 - protein, 81 aa, Colobus angolensis
EPLRFRDVAIEFSLEEWQCLDTIQQNLYRNVMLENYRNLVFLGIAVSKPDLITCLEQEKEPCTRKRHRMVAKPPVTCSHFA

SEQ ID NO: 27490 - protein, 81 aa, Colobus angolensis
DVAVEFSQEEWKCLDPVQRTLYRDVMLENYRNLVSLGICLPDLSVISMLEQKKDPWILQSEEKIANNPDGRECSKGVKTVP

SEQ ID NO: 27491 - protein, 81 aa, Colobus angolensis
AQESITLEDVAVDFTWEEWQLLGPAQKDLYRDVMLENYSNLVAVGYQASKPDVFFKLERGEPPWTTEDGLHGGACSEIWKV

SEQ ID NO: 27492 - protein, 81 aa, Colobus angolensis
MGVLTFRDVAIEFSPEEWECLDSAQQCLYRDVMLENYRNLVSLGLAIFKPDLMTCLEQRKEPWKVKRQKAVVKHPAGSFHF

SEQ ID NO: 27493 - protein, 81 aa, Colobus angolensis
SKAPITFGDLAIYFSQEEWEWLSPIQKDLYEDVMLENYRNLVSLGLSFRRPNVITLLEKGKAPWMVEPVRRRQAPAPCLYS

SEQ ID NO: 27494 - protein, 81 aa, Colobus angolensis
VTFEDVAVYFIRKEWKRLEPAQRDLYRDVMLENYGNVFSLDWIHISLTMQKVMLAWFTGTLSVGRGLCSSELASVEPPDTF

SEQ ID NO: 27495 - protein, 81 aa, Oryctolagus cuniculus
FQGSVTFRDLAIDFCQQEWECLDLTQKTLYRDVMMENYANLLSLGYAISKPDVITLLEQGKEPWMIVKEETRWCADLESRC

SEQ ID NO: 27496 - protein, 81 aa, Oryctolagus cuniculus
GTNEEELRLLDTAQRALYRAVMLENFRNLLSVGEDGRARILGVTLCSDLVCPGIKALESSALRVHQRAHRGERRCKCAECG

SEQ ID NO: 27497 - protein, 81 aa, Pteropus alecto
AEVLVTFKDVAVTFTQEEWGQLDLDQRTLYWEVMLETCRFLVSLGHPVPRPELIHPLEHRQELWMAKRGFSRSTCPGDGAK

SEQ ID NO: 27498 - protein, 81 aa, Pteropus alecto
VMFSDVSIDFSQEEWECLNDEQRHLYRDVMLENYNNLVSMVLGSRCQTKKLFLKKEIFEIESAQWEIMGRLTRHDLQCSSF

SEQ ID NO: 27499 - protein, 81 aa, Pteropus alecto
FQLPESLEDVAMYISQEEWGHQDPSKRALSRDTVQESYENVDSLEPQVPSQEPLSTQVEQGGKPWDPSVQSCKECLSPRNQ

SEQ ID NO: 27500 - protein, 81 aa, Rhinolophus ferrumequinum
MLENYRNLCSLDLAVSTPDVVIFLERMKEAWDVKRKKTNIHTGEEHYKCNPCGRVFSRLPSLNRHKKIHAGVKPYKCRECD

SEQ ID NO: 27501 - protein, 81 aa, Rhinolophus ferrumequinum
SQHLVTFKDVTVDFTQEEWTLLDQTQRDLYRDVMLENYENLIAVAGYESCTPSVCSGMEGAEELRTGTRGVLQGEKCRSET

SEQ ID NO: 27502 - protein, 81 aa, Rhinolophus ferrumequinum
MFQESLTFQDVAVNFTREEWDQLYPAQKNLYRDVMLENYRNLVALGHQLYKPEVITQLEQEEQWMMERDSPLDIHPDGENR

SEQ ID NO: 27503 - protein, 81 aa, Rhinolophus ferrumequinum
LGGRLTFRDVSIDFSQEEWECLHPADRKLYMDVMLENYRNLCSLDLAVSTPDVVIFLERMKEAWDVKRKKTVRQMTQVRGI

SEQ ID NO: 27504 - protein, 81 aa, Rhinolophus ferrumequinum
AQESVMFRDVAVDFSQEEWECLGPAQRALYRDVMLENYSNLLSMGLYIPKPQVISLLEQGKEPWMVGRELTRGLCSDLESM

SEQ ID NO: 27505 - protein, 81 aa, Rhinolophus ferrumequinum
FQEPVTFRDVAVDFTQEEWGQLGPAQRTLYRDVMLETFGHLLCVGPELPKPEVISQLEQGAELWVADRGITQRCCPGWEPG

SEQ ID NO: 27506 - protein, 81 aa, Rhinolophus ferrumequinum
MLDNYQNLLFLGLSYRRPNVITLLEEGRAPWMVEPVRRRRGLDLGSKCETKKLPSNHCNKSGQSICQKPVSVSQKVLTGKR

SEQ ID NO: 27507 - protein, 81 aa, Ursus maritimus
VTFEDVAVYFSWEEWGLLDEAQRCLYQDVMLENLALINSLGRRHGTEDEEAPEHRVSVQGASQVGTRKAVVSPQKAHPREV

SEQ ID NO: 27508 - protein, 81 aa, Ursus maritimus
MLFQKPVTFDDVAVNFTQEEWVCLDAGQRVLYQDVMSETFRNLMSVDLIIKLEQEEKQWRAGLQLRPPNGEGLPSGGRRKT

SEQ ID NO: 27509 - protein, 81 aa, Rhinopithecus bieti
NQQTKNKSLFVSFEEVAVHFTWEEWQDQDDAQRTLYRDVMLETYSSLVSLGHCVSKPEVIFKLEQGSEPWLGEEWANQCLS

SEQ ID NO: 27510 - protein, 81 aa, Rhinopithecus bieti
GDVAVNFTREEWALLGPCQKNLYKDVMQETIRNLNCVGMKWKDQNIEDQYKYSRKNLRCRMLERFGENKDGSKWGETSNQI

SEQ ID NO: 27511 - protein, 81 aa, Rhinopithecus bieti
RAEEAVTFKDVAVVFTEEELGLLDPAQKKLYRDVMLENFRNLLSVGHQPFHGDTFHFLREEKFWVMETTSQREGNSGKSQT

SEQ ID NO: 27512 - protein, 81 aa, Ursus americanus
EWQLLAPAQKDLYRDMMLENYRNLVSVGYQASKPDALSKLEQGEELWTIEDEIHSRICPGEGELNPGELRKVDDPLQCHLQ

SEQ ID NO: 27513 - protein, 81 aa, Ursus americanus
FGWLTFRDVATEFFQEEWECLDPAQRALYRDVVVENCRNLVSLGEENVPLEMRVCPWVSLYFPLIPLGRHLSLDSCFLGDF

SEQ ID NO: 27514 - protein, 81 aa, Ursus americanus
QCGLLTFGDVAIEFSQEEWRCLSHTQRELYRDVMLENYGHLLFLGLIVSKPDLVSLLEQSKEPWDVRRKKTQRPSVLMGHV

SEQ ID NO: 27515 - protein, 81 aa, Ursus americanus
SLDWGTFEDVAVYFSREEWELLDETQRHLYHNVMLENLALMASLELKTFRPCAVAHLEQDKEPWEPERVDISPYTAQEDGR

SEQ ID NO: 27516 - protein, 81 aa, Propithecus coquereli
RLTFRDVAIEFSLEEWKCLDPAQRALYKAVMLENYRNLVSLGREAGNKLTKNQCGVIFKSHVPQRKLLQSKRKVDECNQIK

SEQ ID NO: 27517 - protein, 81 aa, Vombatus ursinus
LTFQDVAVDFTWEEWGQLDPAQQNLYRDVMLDNYQNLIFLGKGNTLYQSFVPTEEKSYTCNEYKEDFSQKEYLNQPEKSPI

SEQ ID NO: 27518 - protein, 81 aa, Vombatus ursinus
FQELVAFKDVAVEFNQEEWRCLDASQKELYHDVMMENYKNLVCLGLVFNKPAVISHLEGKEAPWMAEGQVQRNSCPGEPVN

SEQ ID NO: 27519 - protein, 81 aa, Balaenoptera acutorostrata
PLTFRDVAIEFSREEWECLDPTQKAFYVDVMLETYRNLLSLDISHIHVIRKLQPRANSDRGEVFQTVMLERQESHEMKHFY

SEQ ID NO: 27520 - protein, 81 aa, Lynx pardinus
LTDSVSFEDVAVYFSWEEWRLLDEAQRCLYHDVMLENFALISSLGCCCGAEDAEAPLEQSVSVGVSQAGTPKAALSSRKTH

SEQ ID NO: 27521 - protein, 81 aa, Vombatus ursinus
FQELVTFKDVSVDFTREEWGQLDPAQKNLYRDVMLENYRNLVSLGLQVFKPDVIARLERTEAPWTLDSKVFRLSCPDWERK

SEQ ID NO: 27522 - protein, 81 aa, Saimiri boliviensis
TSQESLTLEDVSVEFTWEEWQLLGASQKDLYRDVMLENYSNLVSVGYQAGKPDALSKLEQGEPWTTENEIHSQICPEIKRV

SEQ ID NO: 27523 - protein, 81 aa, Lynx pardinus
LLQEGALRAPQHPAFANDGSHGDWPGANTTLDAVTFEDVAVCFSSGEWQCLTRAQRHLYTDVMLENYGNMLSAGEDTLCLA

SEQ ID NO: 27524 - protein, 81 aa, Lynx pardinus
AQESVKFRDVAVIFSPDQWAYLSPEERQLYKDVMLDNCDYLVSLGHWTYKAEVISSLKQGKDLLMVEREVTGAPCPACQPA

SEQ ID NO: 27525 - protein, 81 aa, Lynx pardinus
HQELVTFEDVAVYFTGTEWTCLSPGQKALYRSVMLENYGNLTSLGYQVPRPALISLLEAGNLPWGLEAQDNLSAERTKDIC

SEQ ID NO: 27526 - protein, 81 aa, Balaenoptera acutorostrata
DQGSVSFRDVTVDFTWDEWLQLTCMQRTLYRDVMLENYSHLVSVGYCISKPEVVFKLEQGEEPWPLERAFPCRSDPGCCPP

SEQ ID NO: 27527 - protein, 81 aa, Saimiri boliviensis
PKVPVTFDDVAVYFSELEWGKLEDWQKELYKHVMRGNYETLVSLDYAISKPDILTRIERGEEPCLNQWGQEKGSEVEVAHS

SEQ ID NO: 27528 - protein, 81 aa, Cervus elaphus
PQDLMTFEDVAVEFTWWEWGQLDPAQKDLYREVMLENFKNLASLGFPVSKPYMICQLEEGEEPCILEREISTGVHSDWERR

SEQ ID NO: 27529 - protein, 81 aa, Colobus angolensis
TEGLVMFEDVAVYFSREEWGLLNVTQKGLYQDVMLENFALVSSLGLAPLRSPVFSQLENDEQLWVPSWVDETPVSRAEARR

SEQ ID NO: 27530 - protein, 81 aa, Colobus angolensis
AQESVTFEDVAVNFTNREWQSLTYAQRHLYKHVMLENYGNMVSLGFPFPKPPLISHLERGVEPCMQDPQDRESLSCSYPVS

SEQ ID NO: 27531 - protein, 81 aa, Colobus angolensis
QASVCFEDVAMAFTKEEWEQLDLAQRTLYREVTLETWEHIVSLDWKTTLEENRLNSEKDGAREELSHHVEVKQCVQEEPPC

SEQ ID NO: 27532 - protein, 81 aa, Colobus angolensis
AKGLPSNDTDWPQEKEGKAQIVVPVTFRDVAVIFTEAEWKRLSPQQRNLYKEVMLENYRNLLSLGQEIETILANMVKPRLY

SEQ ID NO: 27533 - protein, 81 aa, Rhinopithecus bieti
DSVTFDDVAVDFTPEEWALLDTTQKYLYRDVMLENYMNLASVEWEIQPRIKRPSLQQGFLKNPIFNGIQMTRGYSGWKLCD

SEQ ID NO: 27534 - protein, 81 aa, Rhinopithecus bieti
MFKEAMTFKDVAVVFTEEELGLLDPAQRKLYQDVMLENFRNLLSVGHQAFHRDTFHFLREEKIWMMKTATQREGNSGDKIQ

SEQ ID NO: 27535 - protein, 81 aa, Rhinopithecus bieti
QGRLTFRDVAVEFSLAEWKCLNPAQRALYREVMLENYRNLESVDISSKCMMKEVLSTGQGNMEVFYTGTLQRHESHHIGDF

SEQ ID NO: 27536 - protein, 81 aa, Rhinopithecus bieti
DSVTFEDVAVDFTQEEWTLLDQTQRNLYRDVMLENYKNLVAVDWESHINTRRSAPQQNFLQGKTSSVVEMERNHFGEELFD

SEQ ID NO: 27537 - protein, 81 aa, Rhinopithecus bieti
EPGIVSFADVAVYFCREEWGCLRPAQRALYRDVMRETYGHLSTLGIGGNKPALISWVEEEAELWGPAARDPEVMKCPTETD

SEQ ID NO: 27538 - protein, 81 aa, Panthera pardus
KDQESLTLEDVAVDFTQEEWRLLAPAQKDLYRDVMLENFRNLVSVGYVVSMPAALSRLERGGRWMTEDETRRRICPEIKKD

SEQ ID NO: 27539 - protein, 81 aa, Panthera pardus
GLGSMSFKDVTVDFTWDEWLQLTGTQRTLYRDVMLENYSHLVSVGCRLTKPEVIFKLEQGEELWPSRGESPDQGDQGSLQS

SEQ ID NO: 27540 - protein, 81 aa, Macaca nemestrina
PQVSLTFEDVAVLFTRDEWRKLVPSQRNLYRDVMLENYRNLVSLGLPFTKPKVISLLQQGEDPWKVEKDSSGDSSLGCKST

SEQ ID NO: 27541 - protein, 81 aa, Macaca nemestrina
GLTFRDVAIEFSQEEWKCLDPAQRTLYRDVMLENYRNLVSLDLSRNCMIKELAPQRESNREEVFHTVTLEQHEKHDIEEFC

SEQ ID NO: 27542 - protein, 81 aa, Macaca nemestrina
MVFEDVAIYFSREEWGILNDAQRQLHSNVMLENFALLSSVGCWHGAKDEEVLSKQCVSVRVLQVTAPKPALPTLKAQPCKT

SEQ ID NO: 27543 - protein, 81 aa, Macaca nemestrina
MDVAIEFSQEEWKCLEPAQRTLYRDVMLENYRNLVSLGICLPDLSVISTLEEKKDPWILQSEEKIANNPDGRECIKGVNTV

SEQ ID NO: 27544 - protein, 81 aa, Macaca nemestrina
TVTFEDVAVNFSQEEWSLLSEVQRCLYRDVMLENLALISSLDCWCGSKDKEAPSTQSISVQRQSQNRTPRAVVSPKKAHPC

SEQ ID NO: 27545 - protein, 81 aa, Macaca nemestrina
GLLTFRDVAIEFSQEEWKCLDPAQRTLYRNVMLENYRNLVSLGIFSKYEIKELPTKKESNTGEILQTVMLERHESHDIEDF

SEQ ID NO: 27546 - protein, 81 aa, Ursus americanus
MTKPDMIRKLEQGEELWTTERMFPSQSYLEEDGKAEDVLVKFKEYQDRHSKSVIFINHKRLIKERSNIFGKTLTVGKNRII

SEQ ID NO: 27547 - protein, 81 aa, Myotis brandtii
DVNFEGVAIAFSEEEWVILDEAQRLLYCDVMLEVFALVSSVGCWHKMEDEEACSDQRVCIQGESQVRTSKTAPATHKNHLC

SEQ ID NO: 27548 - protein, 81 aa, Myotis brandtii
VTFEDIALYFSREEWSLLDEGQRQLYLNVMLENFELLSSLGCCCDAENVEAPTEQKVSVRLSQARNPKLALSSQKSHPCES

SEQ ID NO: 27549 - protein, 81 aa, Saimiri boliviensis
MTKDWNYLEASQKDYYRDTMLDSYENIVPQGSFLQFSMMPQRAGNDPPGASNASEMEMEISNMREKFLMSVTKLVESKSYN

SEQ ID NO: 27550 - protein, 81 aa, Propithecus coquereli
RESGKAPVTFDDITVYLLQEEWMLLSQQQKEICGSDKLVAPLGPTVANPELFYKFGQGPEPWLGNVQDQRSLLDHHPGKNQ

SEQ ID NO: 27551 - protein, 81 aa, Saimiri boliviensis
YQELVTFRDVAVDFSQEEWDCLDPSQRHLYSNVMLENYRILVSLGLCFSKPSVILLLEQGKAPWMVKRELTKGLCSGWEPL

SEQ ID NO: 27552 - protein, 81 aa, Propithecus coquereli
DSVVFEDVAVEFSLEEWALLDSAQRDLYRDVMLETFQNLASVDDETQFKANGSVSKQDIYGEKILKEPKIAKFIRNVSWAS

SEQ ID NO: 27553 - protein, 81 aa, Vombatus ursinus
MLENYRNLACLGLAFSKPHLISQLERGEAAWTPAEESQRVVCADWKSKPSNKKSDPNIGISVEASPQEKLISNVFNLRETL

SEQ ID NO: 27554 - protein, 81 aa, Lynx pardinus
PQDLMTFKDVAVEFTQWEWGQLDPAQKDLYREVMLENFKNLASLGLPVSKPYVICQLEEGGEPCVVEGEISTDWEKRPKAK

SEQ ID NO: 27555 - protein, 81 aa, Vombatus ursinus
FQVSVTFKDVAVDFTQEEWGHLDPTQRALYRDVMLENYRNLVSLGCQVFKPDVISQLEQGKEPWMVEAEILRGSCPANTSL

SEQ ID NO: 27556 - protein, 81 aa, Lynx pardinus
MDFTEEEWVLLNPRQRKLYRDVMLENYRNLASLEKQLSRPALITQMQQEDEMKSETRNHQDTCSNGIVLPKTTQSQHKQDV

SEQ ID NO: 27557 - protein, 81 aa, Saimiri boliviensis
PQAKLTFEDVAVLLSQDEWNRLGPAQRGLYRNVMMETYGNVVSLGLPITKPDLISQLERGEDPWVLDGKGAKESQDLWSGH

SEQ ID NO: 27558 - protein, 81 aa, Saimiri boliviensis
PQESVSFKDVTIEFTQEEWQQMAPVERNLYRDVMLENYSHLVSVGYCLFKPEVIFKLEQGAEPWFSEEEFSNKSHPKDYRG

SEQ ID NO: 27559 - protein, 81 aa, Vombatus ursinus
MLENYKNLVSLRLPVFKPHVICQLERGEGPWISETDVPQVICPDSIMLKTRCENLEWTSNLVGSLGESAKEISSKNNPFTS

SEQ ID NO: 27560 - protein, 81 aa, Lynx pardinus
LVKIEDVADVAVSFILEEWGHLDQSQKSLYRDDRKENYGSIPSMDYESRNDNVELTVKQISDDAEAHWMTSASTERNVPQG

SEQ ID NO: 27561 - protein, 81 aa, Saimiri boliviensis
MFENYRNLAFLGIAVSKPHLITCLEQGKEPWNRKRQEMIAKPPVMCSHFAEDLWPEHRIKDSFQKMILRGYGKCGHENLQL

SEQ ID NO: 27562 - protein, 81 aa, Vombatus ursinus
FQEPVTFKDVVVDFSQEEWGLLNPGQRHLYRDVMLENYRNLVFLGLILTKPEVVCHLEQGGELWKPERGVLCSAWEIKAKT

SEQ ID NO: 27563 - protein, 81 aa, Cervus elaphus
ALALISFEDVAITFTGEEWRHLDLAQRTLYQEVMLETCGLLVSLGHPVPKAELIHLLEYGPGLWMVKRGLSRNTCTGECHG

SEQ ID NO: 27564 - protein, 81 aa, Cervus elaphus
VKKPVTFEDVAVTFTQEEWKCLDASQRVLYQDVISETVRNLMSVDGIFLSNLDLIAKLEQEEKQWEADLCSPNGEGFHSGG

SEQ ID NO: 27565 - protein, 81 aa, Cervus elaphus
MFPQPFPGSRERQSASRSAPRGILGGDVAGLGSLGGFPEPGTPGGLSISKPNMISLLEQGKEPWMVEREMSDGQHADWESW

SEQ ID NO: 27566 - protein, 81 aa, Cervus elaphus
EAMFLPVSWKGLLSFEDVALYFTREEWDTLDWAQKALYRDFPKPEVICQLEQWEEPWILEVPRAGTRKASGSACPDLEARF

SEQ ID NO: 27567 - protein, 81 aa, Cervus elaphus
TPQTLKPRAPGACSRARSPGPGIQDSDAVGSVTFEDVAVYFSWEEWALLDEAQRCLYHDVMLENFALTSSLGGPTGGGRVV

SEQ ID NO: 27568 - protein, 81 aa, Cervus elaphus
AWGPITLRDVVIEFFPHQWEFLNPLQKKLYCSVMMENYSNLVSIGHFISKPDIIVLLEERRDPWMVVREETRSWNTDPKVK

SEQ ID NO: 27569 - protein, 81 aa, Colobus angolensis
GLLTFRDVAIEFSQEEWKCLDPAQRTLYRDVMLENYRNLVSLGIFSKYEIKELPTKNESNTGEIFRTVMLERHESHDIEDF

SEQ ID NO: 27570 - protein, 81 aa, Colobus angolensis
DSVTFEDVAVDFTQEEWTLLDQTQRNLYRDVMLENYKNLVAVDWESHINTKWSASQQNFLQGKTSSVVEMSHTLSPRLECS

SEQ ID NO: 27571 - protein, 81 aa, Rhinopithecus bieti
APKVSRSLENDGVCFTEQEWENLEDWQKELYRNVMESNYETLVSLTSVILLYMFGPEETKAGGVMIKQELQYTQEGPADLP

SEQ ID NO: 27572 - protein, 81 aa, Muntiacus reevesi
GLLTFQDVTIDFTQEEWECLDLGQRELYRDVMLENYGNLACLGLVVCKPDLVTFLEQMKDPWDVRRIETAKYPGIGTSIVE

SEQ ID NO: 27573 - protein, 81 aa, Muntiacus reevesi
MLENYVNLTSLAFPLPKPDLIFWLERGEEPGHPDPWTLVGGEDLRGICRGGKAKTEYRGQTTELSISKGPEYHKLITEVPL

SEQ ID NO: 27574 - protein, 81 aa, Muntiacus reevesi
EEWECLDLSQRELYRDVMLENHGNLACLGLVVSKPDLVTFLEQMKDPWGVRRLETAIHPARIEIYEKFHLGNVHLSKDWIY

SEQ ID NO: 27575 - protein, 81 aa, Muntiacus reevesi
KSWGHLSFMDVFVDFTWEEWQLLDSAQKHLYRSVMLENYRNLVSLGYQYTKPSIIFQLEQEELWMMHSPSLDHSDEVWEID

SEQ ID NO: 27576 - protein, 81 aa, Ursus americanus
MYISQEEWGHQDPSKRALSRDTVQESYENVDSLESQVPSQEALSTQVEQGGKPWDPSVQTCKEGLRPRSPAPGEEKLENQE

SEQ ID NO: 27577 - protein, 81 aa, Myotis brandtii
SLALVTFKDVLVNFTREEWKLLDAAQQVMYRDVMLENYRNLVSLGHRLPKPDVILQLEKGEEPWLVERGTHQDAHPDWDTA

SEQ ID NO: 27578 - protein, 81 aa, Propithecus coquereli
QGHLTFRDVAIEFSQEEWKCLNPAQRALYRDVMLENYRNLASLDISPKCVIKELPPTGKSTTGEVFHTLMLGRHESHPIGK

SEQ ID NO: 27579 - protein, 81 aa, Propithecus coquereli
MKPGVISHAPDSMVPAFPVLKPDLIFQLEQGEAPWVPDPWMSAGGEALRGMCTGGKTKTKKEEQAPQLNISKGSESHGLPA

SEQ ID NO: 27580 - protein, 81 aa, Propithecus coquereli
PKVPVTFDDVAVYFSEVEWGKLEDWQRELYKHVMRGNYEMLVSLDYAISKPDILTRIERGEQPCPKDHWDQEKGNEEEAAC

SEQ ID NO: 27581 - protein, 81 aa, Propithecus coquereli
AQGCVTFEDVTIYFTQEEWGLLDEAQRLLYCDVMLENFALIASLGLTSFRSHVLAQLEMGKEPWVPDSVDMTSAMARGAYG

SEQ ID NO: 27582 - protein, 81 aa, Propithecus coquereli
KFKEAVTFKDVAVAFTEEELGLLDSAQRELYRDVMLENFRNLLSVGHQPFKRDTSHMEIEKKLWMMKTATQRDRNLEELSC

SEQ ID NO: 27583 - protein, 81 aa, Propithecus coquereli
PQELVTFEDVAVDFSQEEWQYLNLPQRTLYRDVMLETYSNLVSVGQQVTKPDLILKLEVKEFPEEGRIPIWSFPEEVCQVD

SEQ ID NO: 27584 - protein, 81 aa, Propithecus coquereli
ALSQGLFTFKDVAIEFSQEEWKCLDSAQKASYRDVMLENYRNLLSLDVSEELSSKEDNKEELYHLVILERNESHGIKKVWK

SEQ ID NO: 27585 - protein, 81 aa, Propithecus coquereli
LQETVTFRDVAVDFTQEEWGRLDPTQRTLYRDVMLETFGHLLSIGPELPKPEVISQLEQGAELWVAERGTTQGHCPVWEPR

SEQ ID NO: 27586 - protein, 81 aa, Vombatus ursinus
FQKSMTFKDVAPDFTWEERTQLNPVEQALCREVLLETYRNLVFLGLSTTSKPDVISQLEDGKVPGMLGSETPKGTSSYWDT

SEQ ID NO: 27587 - protein, 81 aa, Saimiri boliviensis
MDSVVFEEVAVRFTPEEWALLSHAQRRLYRDVMLEICRNLASLDNCVRVRTSGSSSQREVFRNETSSEGEIAKFTRSDSWS

SEQ ID NO: 27588 - protein, 81 aa, Balaenoptera acutorostrata
LQGTVTFKDVAIDFTEEEWQQLDSAQRNLYRNVMLENYNNLITVGCPFTKPDVIFKLEQEEEPWVVEEEVSKRHCPGEIWG

SEQ ID NO: 27589 - protein, 81 aa, Balaenoptera acutorostrata
FQEPVSFKDVAVTFTKEELGLLDSTQRKLYLDVMLENFQNLVSVGYQPFKLDMILQLGRKEKLWVMEPETQGAGCSGHGNQ

SEQ ID NO: 27590 - protein, 81 aa, Vombatus ursinus
PLTFRDVAVDFSRDEGRRLSPAQRALYRDVMLIYLYICVYKEIRLGMRGSTAKPSIFVEQSQQQRFVNHSHCDLNLRETRD

SEQ ID NO: 27591 - protein, 81 aa, Lynx pardinus
SKVPVTFGDLAIYFSQEEWEWLSPIQKDLYEDVMLENYQNLVSLGLSFRRPNVITLLEKGRAPWMVEPVRKRRVLDSRSKY

SEQ ID NO: 27592 - protein, 81 aa, Lynx pardinus
RKGCVTFEDVAIDFSQEEWGLLDEAQRRLYHDAMLENLALTASLVCWHGMEDEETPFEQSVSIEVLSQKTHPCEKCVPILK

SEQ ID NO: 27593 - protein, 81 aa, Cervus elaphus
AQLTFKDVAIEFTQEEWECLDPAQRALYRDVMVETLRNLVSLVEQGTRILAKPQQVMCLSSYVETSLHWQSSSQSTEIRAD

SEQ ID NO: 27594 - protein, 81 aa, Colobus angolensis
PLTFMDVAIEFSQEEWKCLDPGQRALYRDVMLENYRNLVSLGRSCILGSNAENKPIKNQLGFTLESHLSELQLFQAGRKIY

SEQ ID NO: 27595 - protein, 81 aa, Colobus angolensis
NKGPVTLKDVIVEFTKEEWKLLTPAQRTLYKDVMLENYSHLVSVGYHVNKPNAVFKLKQGRKPWILEVEYPHWGFSEDLWS

SEQ ID NO: 27596 - protein, 81 aa, Rhinopithecus bieti
EMGPLTFRDVAVEFCLEEWQCLDTAQQDLYRKVMLENYRNLVLAGIAVSKPNLITCLEQGKDPWNMKRHSMVVKPPGFLLP

SEQ ID NO: 27597 - protein, 81 aa, Eschrichtius robustus
MLENFRNLISMGCPVTKTKVIFKVEQGQEPWMVERENPCWRSPEADCPLIDESDKNQESKDNFLNSVLFMFNKILTVKRLH

SEQ ID NO: 27598 - protein, 81 aa, Myotis brandtii
PVTFEDVALHFSKEEWRLLAEAQRSLYLDVMLENFALVSSQGCCCGTKNVEAPSEQSIPVGVSQARTSRESQSSQKTHPCE

SEQ ID NO: 27599 - protein, 81 aa, Myotis brandtii
PVTLEDMAVYLSQKEWGCLDPAQQDRSQDMLPESEGRGMQFKDEEDTQMRTEWDRVLSARCRGPSSPFLGHKPAPVRGLTK

SEQ ID NO: 27600 - protein, 81 aa, Propithecus coquereli
MLENYGAVASLAAFPFPKPALISQLERGEAPWCSAPQGALDGESPRGISSGFPFLTLAGIFHLEQAEELLNLKLQGERPSL

SEQ ID NO: 27601 - protein, 81 aa, Propithecus coquereli
TKLELSFKDVAVDFTQEEWQQLDPEQKITYRDVMLENYSNLVSVGYHIIKPDVIIKLEQGEEPWIVEGEFLLQSYPDEAWQ

SEQ ID NO: 27602 - protein, 81 aa, Propithecus coquereli
ESVTFEDVAVGLLQEWALLDGARRNLCRYVILDNCRTLASRGTPPCKPSLVPQLGPRAEPLAVTGAGEYQADWESQLKPKE

SEQ ID NO: 27603 - protein, 81 aa, Balaenoptera acutorostrata
MLENYGNLVSLGLPFSKPEVISLLQQGEDPWKVEKESPGGSSLGCKSSPKTTKSTQTQDASFWGPVRKRLKKNEPWNFISE

SEQ ID NO: 27604 - protein, 81 aa, Propithecus coquereli
MRSVSFRDVTVSFTREEWQHLDPAQRNLYRDVMLENYSHLVSVGYCIPKPEVILKLEKGEEPWILEEEFPSQSCPELINSS

SEQ ID NO: 27605 - protein, 81 aa, Propithecus coquereli
SQGPVSFKDVAVDFTQEEWQKLDPDEKITYRDVMLENYSNLVSVGYDITKPNVIIKLEQGEEPWIIEGEFSCQSHPEEVLK

SEQ ID NO: 27606 - protein, 81 aa, Vombatus ursinus
MDVMMENYGNVASLGVPVSKPDLISQLEQTDLPLVPHLPQTEIEDLFDEKLDITFIMSSKRPSDGSGPSEKKAQRKSISLE

SEQ ID NO: 27607 - protein, 81 aa, Vombatus ursinus
GSRRPPAQELVTFKDVAVDFTKELYKEVMLENAQNLLLLGLSVPREDLFSYLEERESPWLLEQEDLRSCCPEREIRPEMKE

SEQ ID NO: 27608 - protein, 81 aa, Saimiri boliviensis
MAFRDVAVDFTQDEWSLLSPAQRTLYREVMLENYSNLVSLGISFSKPEIITQLEQGKETWREEKKCPPATCPDPGPELYLD

SEQ ID NO: 27609 - protein, 81 aa, Saimiri boliviensis
ARDLVMFRDVAVDFSQEEWECLNSYQRNLYRDVILENYSNLVSLGCSISKPDVITLLEQGKEPWLVVRNEKRRWSLDLESR

SEQ ID NO: 27610 - protein, 81 aa, Saimiri boliviensis
QGRLTFRDVAIEFSLVEWKCLTPAQRALYREVMLENYRNLESVDISSKCMVKMGSSTGQGNTEMFHTGTLETHKSHHTGDF

SEQ ID NO: 27611 - protein, 81 aa, Balaenoptera acutorostrata
VAGNLDLQDVFVDFTLEEWQKLDATLKNLRRDVMLENYSHLVSMGFLMAQPGRIFRLGQGEEEARMAAGESPTRRCPEFWQ

SEQ ID NO: 27612 - protein, 81 aa, Lynx pardinus
MPKSQEEWQYLDLPQRDLYKDVMLENYINLISVGYQTTKPSVIHKLEQGEEPWMVEREIPNWSYAEETWQLDGHMEQHQEN

SEQ ID NO: 27613 - protein, 81 aa, Lynx pardinus
MMENYDNLVSLEHSISKPDVITLLEQRKEPWMVVREDTKRWCTDLESKYEIISCEKVHVYKKHSPLTLRQKIHTREKPCEC

SEQ ID NO: 27614 - protein, 81 aa, Balaenoptera acutorostrata
QGSVTFEDVALYFSWEEWALLDEAQRCLYHDVMLENFALTSSLGCWHEVEDKEASPEQSISVEGVSQIRTPKAISSPQKAQ

SEQ ID NO: 27615 - protein, 81 aa, Balaenoptera acutorostrata
QGSVTFEDVAVYFSWEEWCLLDEVQIHLYLDVMLENFAVVCMLGSFPAVEDEETPSEDSVSAEGVSQMRTPRAGLSPEKAQ

SEQ ID NO: 27616 - protein, 81 aa, Vombatus ursinus
SQESVTFQDVAVDFTQEEWGRLEPAQKDLYREVMLENYQNLVSLGLPFSKPHVISQLERGEAPWITEKDVPRVSCQDFFIQ

SEQ ID NO: 27617 - protein, 81 aa, Saimiri boliviensis
VQESVTFKDVAVLFTQEEWGQLSPAQRALYRDVMLENYRNLVSLGLLGPKPDIFSQLEKREEWMPEDPSGGFCLDWMAVPV

SEQ ID NO: 27618 - protein, 81 aa, Saimiri boliviensis
MAFEDVAVYFSQEEWGLLDTAQRALYRHVMLENFTLVTSLGLSTSRPLVVIQLERGEEPWVPSVKDMTLARNVYGRCNTGE

SEQ ID NO: 27619 - protein, 81 aa, Balaenoptera acutorostrata
QALLTFRDVAIEFSQEEWECLDPAQRALYRDVMLETYRNLISLDISISFMTKELLKKKNINNRELYQSVVLGRHGSHGIED

SEQ ID NO: 27620 - protein, 81 aa, Vombatus ursinus
DIFPRKHQKEWGCLGPSEKELYRNVMLENYGHLVYLELDLTLSVQQTVRTGKIHHECDENGRGFRQYSDLIQFKKITSGNG

SEQ ID NO: 27621 - protein, 81 aa, Lynx pardinus
MDTSQRTLYRDVTLENISHLVSVGMKNSHNKQEIIPMQDICMNDPPNCWTVQKCHTGEDLSVYSGFDEVFTHTYTLTQHVL

SEQ ID NO: 27622 - protein, 81 aa, Saimiri boliviensis
VRLTFRDVAIEFSQEEWKCLDPTQRALYRDVMLENYWSLVSLGLCHFDMNIISMLEEGKEPWTVKSYMKIARKPRMRKCVK

SEQ ID NO: 27623 - protein, 81 aa, Saimiri boliviensis
SVASEDVAVNFTLEEWALLDPSQKKLYRDVMRETFRNLACVGKKWEDQSIEDWYKNQGRILSNHVEVGLSESKEHNQCGEA

SEQ ID NO: 27624 - protein, 81 aa, Saimiri boliviensis
AQVSVTFEDVAVTFTQEEWGQLDATQRTLYQEVMLETCGLLVSLGCPLSKPELICPLDHRQELWMGKEDLSQSSYPGDSTK

SEQ ID NO: 27625 - protein, 81 aa, Saimiri boliviensis
MEWRHLDPSQRNLYRDVMLETYSHLLSVGYQVPEAEVVMLEQGNEPWALQGERPHQSCPGEKLWDHNQCRKILNYKQASSQ

SEQ ID NO: 27626 - protein, 81 aa, Cervus elaphus
EALTFKDVAVTFTEEELGLLDLAQRKLYRDSSKPDMISQLEREEKLWTTEIPPQRGGRSGVRCLSLGELSCWQIRHVVSKS

SEQ ID NO: 27627 - protein, 80 aa, Cervus elaphus
IEPKFQGSVSFKDVTVGFTQEEWQHLDSTQRSLYRDVMLENYRNLVSVGYCITKPEVIFRLEQGEEPWILEEEFPSQNFS

SEQ ID NO: 27628 - protein, 81 aa, Cervus elaphus
SVTFKDVIVDFTQEEWKQLDPVQRGLFRDVTLENYTHLVSIGKDDFSELISGGVEEEGTHLEQGTEPWIVEPSIPAGTPGD

SEQ ID NO: 27629 - protein, 81 aa, Cervus elaphus
VPVTFDDISIYFSTPEWEKLEEWQKELYKNIMKGNYESLISMDYAMNQPDVLSQIQPEGDRNTEDQAGQEESGIPTDPSEV

SEQ ID NO: 27630 - protein, 81 aa, Cervus elaphus
FQEPVTFEDVAVYFTQNQWASLDSAQRALYREVMLENYVNITSLAAFPLPKPDLIFWLERGEEPGRLDPWTLVGEEDLRGI

SEQ ID NO: 27631 - protein, 81 aa, Colobus angolensis
EDVAVDFTLEEWALLDSAQRNLYREVIFEMWERTKTQFKVNGSVSQQDIYGEEKSKEQTTPNFTRNNSCAYTLEKTCEGYG

SEQ ID NO: 27632 - protein, 81 aa, Colobus angolensis
SVAFEDVAVTFTQEEWALLDPSQKTLYRDVMQETFRNLASVGKKWKVQNIYVEYENLKRNLRIFVGERLESKEGHQHGEIL

SEQ ID NO: 27633 - protein, 81 aa, Muntiacus reevesi
CNMSLSFSDVAVDLSQEEWECMSPAQRALYRDVMLENYSNLVSLGCSTPKPDMITLLEQEKEPWMILREGTGSWFTDLESE

SEQ ID NO: 27634 - protein, 81 aa, Muntiacus reevesi
SETQLTIEDVDIKFTPEEWECLNPAQRALYWDVMEETYRNLLSVDVSHIHMTKKLQAKGNSGKGEILQRVMFRRTETHETK

SEQ ID NO: 27635 - protein, 81 aa, Muntiacus reevesi
LYGSLLFEDVAVEFTWEEWRLLDPAQKHLYQDVMLENYSNLLSVGYQSPKPIEIFKLKQGDKPWIERESIHDPDLVNQNRS

SEQ ID NO: 27636 - protein, 81 aa, Muntiacus reevesi
QLTSEDVAIEFTQEEWEFLDPAQRALYRDVMLETYRNLLSVDISPTHVIKHLQPKANSDKRELFQTLMLGRSESCEIKHFY

SEQ ID NO: 27637 - protein, 81 aa, Muntiacus reevesi
PKVPVSFEDVAVYFTKAQWKLLDHRQRKLYKQVMLDNYHNLVSLGFSSSKPQLVIQLEQGEKPWVADAQRMRITTGMQEGD

SEQ ID NO: 27638 - protein, 81 aa, Muntiacus reevesi
EQVSFKDVCVDFTQEEWYLLDPAQKILYRDVILENYSHLVSVGNCTTKPEVVFKIEQGEEPWILKERCPKQCRSEDWKVDD

SEQ ID NO: 27639 - protein, 81 aa, Ursus arctos
RPGAVSFADVAVYFSPEEWGCLRPAQRALYRNVMRETYGHLGALGFAGPKPALISWLERKKEVWSPEAEDPEAGARHPGSG

SEQ ID NO: 27640 - protein, 81 aa, Muntiacus reevesi
SPTLEDVAVAFTWEEWQLLVPAQKALYWDVTLENYSDLVSVSYQVSKPDVLFNSPQDIFEIVLFHLMLIKCSSFSFLDIKE

SEQ ID NO: 27641 - protein, 81 aa, Ursus americanus
WALLDSAQRKLYREVMLENLKNLASVDDETQFKASGSVSQQDIYGKKISKEHKMAKFIRNDSWASVLGKIWEELSTEDQRT

SEQ ID NO: 27642 - protein, 81 aa, Ursus americanus
FWILRLPPGSKGEIPKPEWGKLDEWQKELYKHVMRGNYEMLVSLDYAISKPDILTRMERGEDPCPEGPWGQEERSKKEAAR

SEQ ID NO: 27643 - protein, 81 aa, Ursus americanus
WALLDSAQRILYRDVMLENCRNLASCPFISDSVTQHKAKNSTRQQDILARKTPDEASRVCAVSHSSRPSPSGEDWKCPRTD

SEQ ID NO: 27644 - protein, 81 aa, Myotis brandtii
LIGDQDFGTSLLHTAPQEHWKHLDSIQKEQYWDLMLETYGKMVSGGISNSKPDLTNSTECGEELAGLHLHVSEKIPRPTCR

SEQ ID NO: 27645 - protein, 81 aa, Myotis brandtii
RHDDMDFEDVAIAFSEEEWGLLDEAQRLLYCDVMLQVFALVSSAGCWHKKDDAEACSEQSVSVQVESQVSAFKSAPATQKS

SEQ ID NO: 27646 - protein, 81 aa, Propithecus coquereli
AQVSVTFDDVAVTFTQEEWGQLDPAQRTLYQEVMLENCGLLVSLGCPIPRSELIYQLEHGQEPWTVRKDLSQGLCPDDKGK

SEQ ID NO: 27647 - protein, 81 aa, Balaenoptera acutorostrata
QDPVTFEDVAVYFSQEEWKLLDEAQRLLYRDVLLETFALVASLGCWHGAEHKEITSEHNVSIEVPRINTSKTDLSIWKSYP

SEQ ID NO: 27648 - protein, 81 aa, Vombatus ursinus
PHLLWFRSALGETPEWGHLGPSQKELYRQVMLENYGNLVCLGEDPRCRGHGEGTGGQGTGPPSEPWHGASLEVPAQALLNA

SEQ ID NO: 27649 - protein, 81 aa, Saimiri boliviensis
EPVTFEDVAVDFTQEEWQQLNPAQKTLHRDVMLETYSHLDSVGCSGIKPDVIFKVEHRKDPWIKDSELSRWIYPDRQKGLK

SEQ ID NO: 27650 - protein, 81 aa, Ursus americanus
WDVAVVFTEEELGLLDPAQRKLYRDVMLENFRNLLSVGEGNEMEYIQGRELKCLSYRELSYWKIWEHVAGELTENQDHRVN

SEQ ID NO: 27651 - protein, 81 aa, Ursus americanus
EWQLLDPAQRLLYKEVMLENYRQLVSLGHCVTKPELVLKLEQGEKPWAPKRELPKIQKAKNMKERTQEKEDKYSRQALFFN

SEQ ID NO: 27652 - protein, 81 aa, Myotis brandtii
FMDSVTFEDVNVEFTMEEWAFLDSTQKKLYTDVMLETFWNLASVACILEEKCEDLDSEDQYENHGMNHSSHTVERLCTRND

SEQ ID NO: 27653 - protein, 81 aa, Myotis brandtii
LPESLTFHDVAVDFTWEEWQLLGPEQKDLYRDVMMETYSHLVSLGCQASKPDALSKLERGEEPWTVQRGRHCPVSPELRKV

SEQ ID NO: 27654 - protein, 81 aa, Myotis brandtii
PPDAVTFPDVAIDFSQDEWECLNLSQRILYRKVMLENYRTLVSVGLCVSKPDVISLLEQGEEPWVTDGKMAGGLCPPLPYG

SEQ ID NO: 27655 - protein, 81 aa, Myotis brandtii
MDFEDVAVAFSQEEWGLLDEAQRLLYCDVMLEVFALVSSAGCRHKMGDAEACSEQSVSVQGESKVSASKTAPATQRTLLCG

SEQ ID NO: 27656 - protein, 81 aa, Propithecus coquereli
AAALVGRVQDCVTFEDVFVYFSREEWELLEEAQRFLYRDVMLENFALVATLGKGRKPWVSDRADISPPTVREDFFAFLSGC

SEQ ID NO: 27657 - protein, 81 aa, Myotis brandtii
MDFEDVAIAFSQEEWGLLDEAQRLLYCDVMLEVFALVSCADCWHKMDDEEVRPVPFVSIQGESQVRASKTAPATQSTHLCK

SEQ ID NO: 27658 - protein, 81 aa, Propithecus coquereli
VTFQDVAVDFTEKEWPLLDSSQRKLYKDVMLENYSNLTSLDWETPSKTKWSILMEDIFGKETSSSVTMERARLGEKSTEYA

SEQ ID NO: 27659 - protein, 81 aa, Propithecus coquereli
AQGSVTFRDVAVLFSQDEWSHLDSAQRTLYQEVMLENYGNLVSLGIVFSKPKVISQLEQGEDPWMMENGIPQGPLLGWESL

SEQ ID NO: 27660 - protein, 81 aa, Saimiri boliviensis
FQGLLAFRDVAIEFSLEEWQCLDCAQQNLYRDVMLENYRNLVSLGIAVSKPDLITYLEQNKEPWNIKRNEMVLPILCLSVM

SEQ ID NO: 27661 - protein, 81 aa, Propithecus coquereli
PQESVTFKDVSVDFTQEEWHHIDPAQRRLYRDVMLENYSHLVSVGYQVSKPEVIFKLEQGEEPWISEGEIQRPFCPDWKIR

SEQ ID NO: 27662 - protein, 81 aa, Propithecus coquereli
QAEVTFEDVAVLLSREEWGRLGPAQRGLYRDVMLETYGNLVSLGTGPAGPKPGVISQLERGDEPWVLDVQGTSGRGRLRVN

SEQ ID NO: 27663 - protein, 81 aa, Propithecus coquereli
MGSVTFRDVAIDFSQEEWECLDPAQRNLYRDVMTENYSNLVSLENFISKPDVITVLEQEPEPWMVVKKETNWESYYGTEEI

SEQ ID NO: 27664 - protein, 81 aa, Propithecus coquereli
VMFRDVAIDFSQEEWECLDSVQRDLYRDVMLENYSNLVSLDFPLCCASKDLSPKKDPYETELSQWEMSERLENCNLEESNF

SEQ ID NO: 27665 - protein, 81 aa, Lynx pardinus
EERDLVTFQDVAVEFTQEEWEHLGTTQRTLYQEVMLENYRSLASLVKSGPGPTICTGLGGSTRQHPGKDRGHSCHLLRLSA

SEQ ID NO: 27666 - protein, 81 aa, Saimiri boliviensis
AQGSVTFEDVTVCFSEEEWGLLDEAQRLLYCDVMLENFALIASLGLISFRSYIVSQLEMGKEPWVPDSVDMTSAMARGAYG

SEQ ID NO: 27667 - protein, 81 aa, Balaenoptera acutorostrata
IAVHTAFSVLSQKEQKKNKSPGSISFEDVTVNFTQEEWGQLDPDQRTLCRALHYQTRGDLQVRARSTMDIRGRICKPLLPR

SEQ ID NO: 27668 - protein, 81 aa, Balaenoptera acutorostrata
FQESVTFRDVAIAFAQQEWESLDSAQRVLDRDVMLENYRNLVSLAGHSCSKPHVITLLEQWKEPWMIVKKDQGRQYTEDDS

SEQ ID NO: 27669 - protein, 81 aa, Vombatus ursinus
MAVEFTLEEWEQLDPAQRNLYRDVMLERYRNLVLLGLPISKPDVISQLERGKEPWMLERKDPKGGHLDWDIRPETEKLISR

SEQ ID NO: 27670 - protein, 81 aa, Vombatus ursinus
LVFQESVTFKDVAMDFTPEEWGQLDPAQRDVMLENYRNLVSLWLPVSKPDGSSNFDQGENQWMMERRVPRGTRPDWDTRSE

SEQ ID NO: 27671 - protein, 81 aa, Balaenoptera acutorostrata
SQGLVSFKDVAVDFTQEEWQQLDPAQKTLYRDVMLENYSHLVSMGHPVSKPDVISKLEQGEDPWIVKRDIPNWIYPYEDQA

SEQ ID NO: 27672 - protein, 81 aa, Saimiri boliviensis
MSENYRNLVSVGYQGTKPDSLFKLERGEPPWVVEGAAHSQTCAGFVIQNTRYAGKDSDAFGGYGKSRLHIKHDKTLTGIKY

SEQ ID NO: 27673 - protein, 81 aa, Saimiri boliviensis
MLSHGPCLCIYQPDVFSSLEKGKEPWKILRNETRGRCPDMRSKCPIKKLLPKNGIFEREIAQLEIRKICKKHSLECLCFRG

SEQ ID NO: 27674 - protein, 81 aa, Saimiri boliviensis
VQSCVTFEDVFVYFSREEWDLLEEAQRFLYRDVMLENFALPFVCFTAFIFPPWVPNRADITPATIRETWGGPVLAEWELGR

SEQ ID NO: 27675 - protein, 81 aa, Saimiri boliviensis
ISFEDVAVDFTLEEWQLLNPTQKNLYRDVMLENYSNLVFLGYQIIKPDAISKWEQQDPWIVDQEILSQNFSEVWLDNTKMW

SEQ ID NO: 27676 - protein, 81 aa, Balaenoptera acutorostrata
VTFEDIALYFSWEEWKLLDEAQRRLYHDVMLENFALVSSLGCCCGAEDAEAPFQRSISISMSQARTPRAGSFSQKSHPCKK

SEQ ID NO: 27677 - protein, 81 aa, Vombatus ursinus
MVLSGYQISKPDVISKLQQGEEPCIVEREIPRGICPDWKTNPGIKKSTIKQEEELTQEAMMERFTRDGLWYSKLGKPFEWD

SEQ ID NO: 27678 - protein, 81 aa, Vombatus ursinus
MLENYENVVSLGFPVSKPDVISQLERGEEPWVVHTQEKVSLKGNCSDFETRPENERLSQKQKIPQEMELQATALERFTGHL

SEQ ID NO: 27679 - protein, 81 aa, Saimiri boliviensis
QGHVTFEDIAVYFSQEEWGLLDEAQRYLYHDVMLENFSLMTSVAGLSQNNHKDSCLQWKVPVSMNNCVAQCAPDEVHYTPL

SEQ ID NO: 27680 - protein, 81 aa, Lynx pardinus
SQGPVSFKDVVVNFTQEEWQYLDLPQRDLYKDVMLENYINLISVGYQTTKPSVIHKLEQGEEPWMVEREIPNWSYAEETWQ

SEQ ID NO: 27681 - protein, 81 aa, Colobus angolensis
PVTFRDVAVIFTEAEWKRLSPQQRNLYKEVMLENYRNLLSLAEPKPDIYPCSSCLLAFSCQQFLSQHVLQIFLGLCAENHF

SEQ ID NO: 27682 - protein, 81 aa, Colobus angolensis
AQESVTFRDVAVFFSQDEWLHLDSAQRALYREVMLENYSSLVSLGSPFSTPKLIHQLQQGEDPCLVEREVPPDTCLGFKTW

SEQ ID NO: 27683 - protein, 81 aa, Myotis brandtii
SFGPLTFRDVAIDFSQEEWECLDPAQRKLYLDVMSENYSNVASLAILSEDNQAILQKPKIRDLFPKIILVRYGRYGFDNVH

SEQ ID NO: 27684 - protein, 81 aa, Myotis brandtii
AKESVTFMDVAVIFTDEEWRHLIPIQRDLYKEVMLENYQSIISLGLPVPQPDVIFQLKREDKPWIIDLHGPDEGRWPENIS

SEQ ID NO: 27685 - protein, 81 aa, Myotis brandtii
FQEVVTFEDVAVHFTQAEWAGLSSAQRALHRSVMLENYGNLTSLGYTVPNSALISLLEGRDLPWGLEAQNDPPAERSTHVC

SEQ ID NO: 27686 - protein, 81 aa, Myotis brandtii
SQESLTFRDVFVDFTLEEWQQLDFSQKNLYRDVMLENYGHLVSVGYLVDTPDVIFRFGQGEEARREDGEPIIQSCPEFWKV

SEQ ID NO: 27687 - protein, 81 aa, Myotis brandtii
DPELLTLEDVAVEFSWEEWQLLDPAQKELYRDVMLETYNNLVSLGYHTAKPDALSKLEHGKEARIEDEIYSGSCPGIRKVD

SEQ ID NO: 27688 - protein, 81 aa, Myotis brandtii
DSVAFGDVAVKFTLEEWALLDSSQKKLYRDVMRETFRNLASIGKRWEEHDIEDQYKNQRRKLRNPMVEKFCESKEVSQYGE

SEQ ID NO: 27689 - protein, 81 aa, Myotis brandtii
AEVGVTFEDIALYFSRKEWNLLDESQRQLYLNVMLENFELLSSLEALTFVVIREFTLEKGHISAVNVAKLLAVVIASAIIK

SEQ ID NO: 27690 - protein, 81 aa, Eschrichtius robustus
AQGKVNFEDVFVYFSQEEWGLLDEAQRLLYREVMLENFALMASLGYASSMFHGVAPLELDSEPWLSDWADMTPAMTREAQS

SEQ ID NO: 27691 - protein, 81 aa, Propithecus coquereli
CEESVTFKDVAVDFTQEEWGQLDSPQRALYRDVMLENYQNLLALGPPVHKPDVISHLERGEEPWQVQREGPGGVPTNEWIL

SEQ ID NO: 27692 - protein, 81 aa, Vombatus ursinus
GWVPALFDEVAIYFSDEEWEVLTEQQKALYREVMRMNYETVLSLEFPFPKPDVISQLEVEESPWAPYPQNSEDWKLQGGTF

SEQ ID NO: 27693 - protein, 81 aa, Vombatus ursinus
MYRDVMLENYENFVFLGLPVSKPDVISHLERRETPWMTENEVLISTYLDSFIQKTGFEIKESIPKQYIAMGESFNERLTKE

SEQ ID NO: 27694 - protein, 81 aa, Saimiri boliviensis
GRVTFEDVTVNFTKGEWQQLNPEQRNLYRIVMLENYSNLVSVGREETTKPNVILRLEQGKEPWSEGEEVLRGGHPEKNWDI

SEQ ID NO: 27695 - protein, 81 aa, Balaenoptera acutorostrata
QGSVTFEDVVVYFSWEEWGLLDEAQRCLYHDVMLENFALVTSLGCWYGMEDEEAFSVQSVSVEQMSLRKTPTPDPSIQKTH

SEQ ID NO: 27696 - protein, 81 aa, Balaenoptera acutorostrata
MLENYGNLVSVVGCQLSKPSVISQLEKGEAPWMTEKEGPGDPSSDLKGKTETAASTAKNDVLQEQFYHGMMMERFMRDDVI

SEQ ID NO: 27697 - protein, 81 aa, Vombatus ursinus
LLELVAFKDVAVEFNQEEWRCLDASQKELYHDVMMENYKNLVCLGLVFNKPAVISHLEGKEAPWMAEGQRTQLIQHFKILT

SEQ ID NO: 27698 - protein, 81 aa, Saimiri boliviensis
SQEPVTFADVAVVFTPEEWVFLDSTQRSLYRDVMLENYRNLASVGDQLCKPNALSYLEQRGEQWTTERGVISDTCPEPQLQ

SEQ ID NO: 27699 - protein, 81 aa, Saimiri boliviensis
WQESVTFQDVAVGFTPEEWQLLDCADRTLYWDVMLENYRNLFSVGCPVTQTKVILKAEQEQEPWMAEGVNPHHSSPESDCP

SEQ ID NO: 27700 - protein, 81 aa, Vombatus ursinus
FQESVTFKDVAVDFTQEEWAQLDPPQRNLYRDVMLENYEHFVFLGLPVAKPEVISQLERGEVPLFPEQPEFSTSICPDSLN

SEQ ID NO: 27701 - protein, 81 aa, Vombatus ursinus
FQQLVTFEDVAVYFSKEEWGQLDLAQRELYRDVMLENYENLLSLGFPVSKPDIITQLEQRKEAWIRDIQGPKEREFSQNAC

SEQ ID NO: 27702 - protein, 81 aa, Vombatus ursinus
FQESVTFKDVAVEFTGEEWRQLDRAQRSLFRDVMLENYRNLVSLGLTVAKPNLIFLLERGEAPWTLQRQIPGGTSSDCPCW

SEQ ID NO: 27703 - protein, 81 aa, Cervus elaphus
LTVEDVDIKFTPEEWECLDPAQRALYWDVIEETYRNLLSVGEDHFPEKLESDVSCIDMTMKLQAKGNSGKGEIFQRVIFER

SEQ ID NO: 27704 - protein, 81 aa, Cervus elaphus
FQGLLTFEDVAVHFTQEEGARLDAGQRTLYRDVILETYRNLVSLEVPGSKPDLISQLEQGREPWGSDLLGTQEAETVGDAG

SEQ ID NO: 27705 - protein, 81 aa, Colobus angolensis
LKGLVTFEDVAVEFTQEEWTLLDPAQRTLYRDVMLENFRNLASLGNQVDKPGLISQLEQEDKVMTEERGIFPGACPDVENL

SEQ ID NO: 27706 - protein, 81 aa, Colobus angolensis
QGLLTFRDVAIEFSQEEWKCLDPAQRTLYRAVMLENYRNLVSLAISSKCMKKEFSSAAQGNREVLHAGTLQRHESHHIGDF

SEQ ID NO: 27707 - protein, 81 aa, Colobus angolensis
MGQESVTFKDVAVLFTQEEWGQLSPAQRALYRDVMLENYSNLVSLGLLGPKPDMFSQLEKREVWMPEDAPGSFCLDWMTRP

SEQ ID NO: 27708 - protein, 81 aa, Colobus angolensis
MGPLQFRDVAIEFSLEEWHCLDTAQRNLYRDVMLENYRNLVFLGIPVSKQDLITCLEQGKKPLTMKRHEMVAKSTVSFLQV

SEQ ID NO: 27709 - protein, 81 aa, Colobus angolensis
PQESVAFEDVAVYFTTKEWAIMVPAERALYRDVMLENYEAVAFVVPPTFKPALVSHLEQGKESCFIQPQGVLSRSDWRAGL

SEQ ID NO: 27710 - protein, 81 aa, Colobus angolensis
RAQSCVSFEDVFVYFSREEWELLEEAQRFLYRDVMLENFALVATLAFIFPVPCSCPVGGGRKPWVPDRADITAATVKETYR

SEQ ID NO: 27711 - protein, 81 aa, Colobus angolensis
DGLVTFRDVAIDFSQEEWECLDPAQRDLYVDVMLENYSNLVSLDLESTTYETTKIFSEKDIFEINFSQWEMEEKSKTLGLE

SEQ ID NO: 27712 - protein, 81 aa, Colobus angolensis
AGWLTNYSQDSVTFEDVAVDFTQEEWTLLDQTQRNLYRDVMLENYKNLVAVDWESHINTKWSASQQNFLQGKTSSVVEMNE

SEQ ID NO: 27713 - protein, 81 aa, Mustela putorius
SQELLTFRDVAIEFSEEEWGRLTHTQQQLYRDVMLENYGHLHFLGLLLSKPDLIMFLEQEKKLGNVKRKETVAVHPAVSSH

SEQ ID NO: 27714 - protein, 81 aa, Mustela putorius
GHLTFRDVAIEFSQEEWECLDPAQRALYRDVMVENYRNLVSLGSLSAGFAIKKLSPKEDINKGESYHLVILEGNESQGIKD

SEQ ID NO: 27715 - protein, 81 aa, Mustela putorius
IRRRGRSRRLGFVLRALPFSKKSPEDNQPFSANTKAMAQESVMFSDVSIDFSQEEWECLNDDQRDLYRDVMLENYSHLVSM

SEQ ID NO: 27716 - protein, 81 aa, Mustela putorius
GLVTFSDVAINFSQEEWACLNSSQRDLYWDVMLENYSNLVSLDLESPYGTKSLPTEKGLYEMNLSKWNSNGKSKSLGLDWM

SEQ ID NO: 27717 - protein, 81 aa, Mustela putorius
VTFEDVAVYFSWKEWRLLDETQRRLYHHVMLENFALVSSLGCCCGAEDEEAPFAQSASVGVSQTGTPRAALSSQKTHPCQM

SEQ ID NO: 27718 - protein, 81 aa, Myotis brandtii
MLENYRHLLSLGHCVAKPELIFKLEQGEEPRIVKGEFPSQSHPAYNRTSDSQYDALITSNLVPMYEAFQKIWDYFHSVLLL

SEQ ID NO: 27719 - protein, 81 aa, Camelus ferus
LTFKDVAIEFSQEEWECLDAAQRALYRDVMLETCRSLLSLGAASPRGAPLCPTAPSTALRLQVHPLPWPLHSVVPRQARTW

SEQ ID NO: 27720 - protein, 81 aa, Myotis brandtii
EAEDMDFEDVAIAFSQEEWGLLDEAQRLLHCEVMLENFALVASVGCWHKSEDEETSSKQSVSVTAESQVKASKTALPTQKT

SEQ ID NO: 27721 - protein, 81 aa, Myotis brandtii
DMIFEDLAIAFSQEEWGLLDEDQRLLYCDVMLGVFALLSSLGCWHKMDEKEVPPEQSVSVGESQVRASKTAPATQKAYLCK

SEQ ID NO: 27722 - protein, 81 aa, Myotis brandtii
FQEPLTLEDVAVDFTWEEWQLLGPDQKILYRDVMLETYSHLLSVGYQVSKPDALSKLELGEEPWTIDNELHRLVCPDTGKV

SEQ ID NO: 27723 - protein, 81 aa, Myotis brandtii
VTFEDIALYFSREEWSLLDEGQRQLYLNVMLENFELISSLGCCCGAENVEETTEQKVSVRLSQARNPKVGVTFEDIALYFS

SEQ ID NO: 27724 - protein, 81 aa, Myotis brandtii
QEALTFKDVEVTFSQDEWAWLNPAQRNLYRDVMLENYGSLASLGGELQIKSSKLILNPKPLEDAQALAVSSGCRVMSVSEE

SEQ ID NO: 27725 - protein, 81 aa, Propithecus coquereli
SQERVTFEDVAVYFSREEWEYLDSGQRALYRDVMLDNFRIFATLGFCSPRPDLVSCLQQWDEPWVEDWERLESQKVRRGPY

SEQ ID NO: 27726 - protein, 81 aa, Propithecus coquereli
VSFEDVAVDFTWEEWQLLNPTQKNLYRDVMLENYSHLVFLGCQIVRPDGICKPEQEEAWMIDEEILSQNLSEVWLDNKSKM

SEQ ID NO: 27727 - protein, 81 aa, Propithecus coquereli
QEHLTFRDVAIEFSQEEWKCLDPAQRALYRDVMLENYRNLVSLDIPPKCVVKELPPTGKSSREVFHTVMLERHESHPIGDI

SEQ ID NO: 27728 - protein, 81 aa, Propithecus coquereli
VTFKDVAVDFTQEEWGQLDSPQRALYRDVMLENYQNLLTEESSQRQDVYKEEPSREPAVGRVLGDAWAWESQAGALRPSPA

SEQ ID NO: 27729 - protein, 81 aa, Saimiri boliviensis
CYQDSVTFDDVAVDFTQEEWTLLDPTQRSLYSDVMLENYKNLATVGGQIIKPSLISWLEQEESRTVQGGVLQGRKPQWKET

SEQ ID NO: 27730 - protein, 81 aa, Balaenoptera acutorostrata
MAFQDLAVRFSEDEWRLLGEGQRALYLDVMRENYETLASLGTVELLPLSAFLSPSEPGGATGGGSCAGDGPEPPRGGGPLG

SEQ ID NO: 27731 - protein, 81 aa, Saimiri boliviensis
FFSREPICFFEEKTKVERTVVDYLANGYQDSVTFDDVAVEFTPEEWALLDTTQKYLYRDVMLENYKNLASVADKLQWMETL

SEQ ID NO: 27732 - protein, 81 aa, Lynx pardinus
AQVSVTFDDVAVTFTQEEWGQLDLAQKTLYQEVMLENCGLLVSLGCPVPRPELICQLERGQEPWTAKRGLSQNTYPGDKDK

SEQ ID NO: 27733 - protein, 81 aa, Saimiri boliviensis
DSVTFEDVAVNFTQEEWALLDSSQKHLYRDVIQETINNLMSVGIIWQGQNTEYHCKDSRRNPRNHMAERLCECKDGQCDET

SEQ ID NO: 27734 - protein, 81 aa, Vombatus ursinus
MLENYRNLVCLGLAASSPEVIGQLERGDGPWRLEGKVQKGLCADQKTSNGTQEITTKQGLSIEESSQERLKNDISYVSQLR

SEQ ID NO: 27735 - protein, 81 aa, Saimiri boliviensis
MLENYFNLISVGCQVPKPEVIFNLEQEEPRMLNGGISSQSCPDGKIGFESLQQRMSEEVSFQSERINLFTRDDPYSILEKL

SEQ ID NO: 27736 - protein, 81 aa, Balaenoptera acutorostrata
QLTFKDVAIEFSQEEWECLDPGQRALYRDVMLETYRNLLSLGISPTHVIKKLQPKENTNSTDIFQTVILGRHESHEVKSFY

SEQ ID NO: 27737 - protein, 81 aa, Vombatus ursinus
MFEDVAVYLTEEEWGCLSPAQRGLYKDVMLENYGNLVSLGFPVSKPDVISQLERGEEPWVLNMLQRAEKREILRGSCSDYV

SEQ ID NO: 27738 - protein, 81 aa, Saimiri boliviensis
MEGLVRFQDLSIDFSQEEWECLNSAQKDLYRDVMMETYNSLLSLGLSIPKPDVISLLEQGKEPWMVSRDVLGGWCPDLEFR

SEQ ID NO: 27739 - protein, 81 aa, Saimiri boliviensis
FQESVTFEDVAVYFSENEWIGLGPARRALYRDVMLENYGSVASLAFPFPKPALISQLEQGEAPWCLAPRGALDGEGQRGIS

SEQ ID NO: 27740 - protein, 81 aa, Balaenoptera acutorostrata
VTFPDVAVRFSWGEWRLLDEAQRRLYLSVMLESYELISSLGCCCGAESEETTCEETVAVGVSQAGSPKAAPFSQKTHPCEM

SEQ ID NO: 27741 - protein, 81 aa, Vombatus ursinus
ALVSVTFDDVIMYFMEQVWRTLEEWQKELYKDKMNINYKTLVSLGCAIPKPDLNIQIEQGKEPFFRDQGHLEITDLAICSS

SEQ ID NO: 27742 - protein, 81 aa, Cervus elaphus
ERESVTFRDVAVVFSRDEWLHLDAAQRSLYREVMLENYSTLVSLGIPFSMPKLICQLQQGEDPCMVEREIPQDACLGFKTW

SEQ ID NO: 27743 - protein, 81 aa, Cervus elaphus
KGSVTLQDVAVEFTPEEWQLLDCDQRTLYWDVMLENFRNLISVGTGCPVTETTVIFKVEQGQEPWMVEGENSHRSSPEADC

SEQ ID NO: 27744 - protein, 81 aa, Colobus angolensis
QAMVKIEDMAVSLILEEWGCQNLARRNLSRDHRQENYGSTFPQANVFTAFQHAVHVFCFLEEKGHVQSCHGPEACPACSKG

SEQ ID NO: 27745 - protein, 81 aa, Colobus angolensis
VAFEDVAVNFTQEEWTLLDISQKNLFREVMLETFRNLTSIGKKWKDQNIEYEYQNPRRSFRSLIEEKVNEIKEDSHCGETF

SEQ ID NO: 27746 - protein, 81 aa, Colobus angolensis
MLENYENLATVGCQLFKPSLISWLEQEESRTVQRGDFQASEWKVQLKTKESALQQDFLGEPNSSGIQMIGSHSGGEANDVK

SEQ ID NO: 27747 - protein, 81 aa, Colobus angolensis
QELVTFEDVSVDFSQEEWELLEPAQKNLYREVMLENYRNVVSLDCMTILRNQDSTYKKVALQEEPASGLKMIKLIREDGGW

SEQ ID NO: 27748 - protein, 81 aa, Colobus angolensis
QGQLTFKDVAIEFSQEEWKCLDPAQKTLYRDVMLENYRNLVSLDISCKCVNKDLPPKGKNNMGEAFHMVKLERLESHDEVL

SEQ ID NO: 27749 - protein, 81 aa, Colobus angolensis
DSVAFEDVAINFTCEEWALLGPSQKSLYRDVMQETIRNLDCIGMIWQNHNIEEDQYKDLRRNLRCHMVERSCEIKDDSQCG

SEQ ID NO: 27750 - protein, 81 aa, Oryctolagus cuniculus
VMFRDVAIDFSQEEWECLDSAQRDLYRDVMLENYSNLVSLDLPSIYGSKDFSPKRDTYETELSQWEISDKPGNRDLQESNS

SEQ ID NO: 27751 - protein, 81 aa, Pteropus alecto
RPEPVSFAEVAVYFSPEEWGCLRPAQRALYRDVMRETYGHLGALGFRGTKPALISWVEEEAELWGPDARDPEIEECMTEAD

SEQ ID NO: 27752 - protein, 81 aa, Pteropus alecto
FQASVSFKDVTVELTQEEWQQMGPLQRTLYRDVMLENYNNLVSVGSCIYKPELIFKLEQGEEPWLLEEEFSNQSYQVLEHY

SEQ ID NO: 27753 - protein, 81 aa, Rhinolophus ferrumequinum
CVTFEDVAIYFCQEEWGLLDEAQRFLYRDVMLENFALTASLGKTFTFLSVSVSGLSLSPKTHPCEKCVPALKDILHLTKLQ

SEQ ID NO: 27754 - protein, 81 aa, Rhinopithecus bieti
HLTFMDVAIEFSQEEWKCLDPGQRALYRDVMLENYRNLVSLGRSCILGSNAENKPIKNQLGFTLESRLSELQLFQAGRKIY

SEQ ID NO: 27755 - protein, 81 aa, Ursus arctos
RSQESLTFQDVAVNFTREEWDQLYPAQKNLYRDVMLENYRNLVALGHQLYKPEVISQLEQEEQWVMERGSPLDTHADGESR

SEQ ID NO: 27756 - protein, 81 aa, Ursus arctos
VTFEDVAVYFSWEEWGLLDEAQRCLYQDVMLENLALINSLGRRHGTEDEEAPEHRVSVQAASQVGTRKAVVSPQKAHPREV

SEQ ID NO: 27757 - protein, 81 aa, Ursus arctos
SSQGLLTFGDVAIEFSQEEWRCLSRTQRELYRDVMLENYGHLLFLGFILSKPDLIMFLEQEEQFWDVNRKKTVAFHPGRWE

SEQ ID NO: 27758 - protein, 81 aa, Ursus arctos
QDSVTFEEVAVDFSQEEWALLDAAQKILYRDVMLENYRNLASVDWDIQLKSKDGIPMQNVPGEKTCNGIKPAPTQPGKKPL

SEQ ID NO: 27759 - protein, 81 aa, Ursus arctos
AQVPLTFSDVAIDFSQEEWECLNSDQKDLYRDVMLENYTNLVSLDFDFTTETNKLSSEKSSYEVNSYHRETMKRSKIFSPT

SEQ ID NO: 27760 - protein, 81 aa, Muntiacus reevesi
SEDPVTFQEVLVDFSQEEWAQLAPAQKILYQDMMLENCRNLTSVGYHLCKPRLLTQGELRTRKRRFLQDTCADQNSQLKTK

SEQ ID NO: 27761 - protein, 81 aa, Ursus americanus
WCWGLLTFGDVAIEFSQEEWRCLSHTQRELYRDVMLENYGHLLFLGLIVSKPDLVSFLEQRKEPWDEKRNKTAGFDPGTWE

SEQ ID NO: 27762 - protein, 81 aa, Propithecus coquereli
FQGPVTLKDVTVEFTKEEWKLLTPAQRTLYKDVMLENYSHLVSVGYRVNKPNGVFKLKQGKKPWILEVEFPRRSFPEDLWN

SEQ ID NO: 27763 - protein, 81 aa, Propithecus coquereli
ETRERRQGAVSFADVAVYFSPEEALYRDVMRETYGHLDALGFSGSRPAFVSWVEGQVEAWIPEAQDPSGSRDGNEEKARLK

SEQ ID NO: 27764 - protein, 81 aa, Balaenoptera acutorostrata
AAGSVTFKDVTMAFTKKEREQLDPAQKSLYKDVMLENYSNLASLVTYQALKPDMISKLGKGEEPWLGKGKRPRQGGLSEIA

SEQ ID NO: 27765 - protein, 81 aa, Vombatus ursinus
FQKSMTFKDVSVDFTQGEWGQLDPSQRDLYRDVMLENYRNLVSLELQVIKPEVISRLERGEAPCMLEREGLIGSCPDNDTR

SEQ ID NO: 27766 - protein, 81 aa, Lynx pardinus
MEPLTFKDVAVVFTEEELRLLDPTQRKLYRDVMLENFQNLLSLGQQAFKPDKAPPWNKIQKKCLGSYDTHRWILLQAVTGD

SEQ ID NO: 27767 - protein, 81 aa, Balaenoptera acutorostrata
SQGLLSFNDVALDFTWEEWQLLDTVQKNLYRDVMLENYSNLMSLGYQVTKPEPVMHLEKGKEKEKAVVEREFPIQCGPEVM

SEQ ID NO: 27768 - protein, 81 aa, Balaenoptera acutorostrata
ISETSVSFKDVTVEFTQEEWQCMNSAQRTLYRDVMLENYSHLVSLGYYFTKPDVIIKLEQDDPLLLEEEFLNKSHTDSKLD

SEQ ID NO: 27769 - protein, 81 aa, Lynx pardinus
MLENYQNLITLGYKSCKPGLSSALEGAELLRTGGRGVLQEVDLQLQTKGSTPLREIPWEKTPNGIQLLKITQKQGRISVHL

SEQ ID NO: 27770 - protein, 81 aa, Cervus elaphus
FQGSLSFRDVAVGFTRKEWQQLDPTQRTLYREVMLENYSHLLSVGEKGCQCPHPCLCLSSFLSSYRRPLKQREHREEPLKQ

SEQ ID NO: 27771 - protein, 81 aa, Colobus angolensis
REDRGTSESQEMEEWALLDIFQKNLYREVMLETFKNLTSIGKSWKDQNIEYEYQNPRRNFRSLIEEKVNEIKEDSHCGETF

SEQ ID NO: 27772 - protein, 81 aa, Colobus angolensis
PQGLLTFRDVAIEFSQEEWKCLDPAQRTLYRDVMLENYRNLVSLEFRSVTQAKVQWLGSLQPPLPRFKQFSCLSLPSSWDY

SEQ ID NO: 27773 - protein, 81 aa, Sus scrofa
PFQGLLTFEDVAIDFSPEEWECLDLGQRHLYRDVMLEICRHLVSLGEDPFLPEFLFSHWVGFACVQKHFIFHSSPQWRCYR

SEQ ID NO: 27774 - protein, 81 aa, Neophocaena asiaeorientalis
QGHVIFEDVAVSFSQEEWCLLNDAQRLLYGDMTLENLSLIASLGCAHGVEAEEAVSEQCVSVEQVTEDRNPKLEPSILKPL

SEQ ID NO: 27775 - protein, 81 aa, Neophocaena asiaeorientalis
PHWLVTFRDVAINFSQEEWECLDPIQRDLYRQVMVENYSHLISLAGCSIPKPDVFSLLERGKEPWMVVRAMTRWSSDLEYS

SEQ ID NO: 27776 - protein, 81 aa, Bos mutus
MCIPAFCCWLVLPRPPAPRGKQSLASRSTGEGAAGNCITKPEVIFKIEQGEEPWILEERFPKQWHSEDWKVDDLIDSTQEN

SEQ ID NO: 27777 - protein, 81 aa, Neophocaena asiaeorientalis
QGSVTFEDVAVYFSWEEWCLLDEVQMHLYLDVMLENFALVCMLGSFPAVEDEETSSEQSVSAEGVSQMRTPRAGSSPERAQ

SEQ ID NO: 27778 - protein, 81 aa, Nomascus leucogenys
VTFEDVALYLSREEWGRLDHTQQNFYRDVLQKENGLSLGFPFSRPFWAPQAHGKGEASGSSRQTGDEEWRGACTGAVEMGQ

SEQ ID NO: 27779 - protein, 81 aa, Nomascus leucogenys
VVFEDVAVDFTLEEWALLDSAQRNLYRDVMLETFRNLASVDDETQFKANGSVSQQDMYGQDKSKEQTIPTFTGNNSCAYTL

SEQ ID NO: 27780 - protein, 81 aa, Bos mutus
LTFKDLAIEFSQEEWECLDLAQRALYRNVMVEICGFMTKELLQKKYINNRELYQPVVLGRFGNHGIEESDFSEVWGNTFEF

SEQ ID NO: 27781 - protein, 81 aa, Nomascus leucogenys
TQEHVTFRDVAVFFSQDEWLHLDSAQRALYREVMLENYSSLVSLGIPFSMPKLIHQLQQGEDPCMVEREVSADTCLGFKTW

SEQ ID NO: 27782 - protein, 81 aa, Nomascus leucogenys
AEGSVTFSDVSIDFSQEEWDCLDPVQRDLYRDVMLENYSNLVSMGLYTPKPQVISLLEQGKEPWMVGRELTRGLCSDLESM

SEQ ID NO: 27783 - protein, 81 aa, Nomascus leucogenys
AVLTDRAQVSVTFDDVAVTFTKEEWGQLDLAQRTLYQEVMQENCGLLVSLAPSQTHPGSIRCILQSNQVDTLIKIPEHTEH

SEQ ID NO: 27784 - protein, 81 aa, Nomascus leucogenys
LSFRDVAIEFSQEEWKCLDPGQKALYKDVMLENYRNLVSLCEENVPSRRICLPDLSVISMLEQKKDPWTLQSEVKIAKNPN

SEQ ID NO: 27785 - protein, 81 aa, Nomascus leucogenys
SQESLTFKDLFVDFTLEEWQQLDSAQKNLYRDVMLENYSHLVSVGYLVVKPDVIFRLGPGEESWMADGGTPVRTCAGEDRP

SEQ ID NO: 27786 - protein, 81 aa, Nomascus leucogenys
CYQDSVTFDDLAVDFTPEEWTLLDPTQRNLYRDVMLENYKNLATVGCQLFKPSLISWLEQEESRTVQRGDFQALEWKMQLK

SEQ ID NO: 27787 - protein, 81 aa, Bos indicus
FQEAAELEFLSVNYTLKNWKGTALSQRALYWNIMLENCCSLAPLGENRMASSQLSPKQDISEESASADRTSGILCGLILRG

SEQ ID NO: 27788 - protein, 81 aa, Bos indicus
WLQGPMSFKDVAVEFTQEEWMMLDSAQRSMYRDVMLENYINLTLVEYQLCKPVISLSGQEDIRTVKSRIAQGTCPDWEIQF

SEQ ID NO: 27789 - protein, 81 aa, Bos indicus
VTFRDVAVFFSRDEWLCLDSAQRTLYQEVMLENYSTLFSLGWESLFETAISEEENQEVMNQLLGDGPFDFRLGKIYINEET

SEQ ID NO: 27790 - protein, 81 aa, Muntiacus muntjak
MLENFALIASLGLTSFRSHIVAQLEMGAEPWVPDQVDMTSAMARGVYRDFYCGTEGENSPAELSVSVEVSQNMNPKAVPST

SEQ ID NO: 27791 - protein, 81 aa, Muntiacus muntjak
PQESVTFEDVAVNFSHEEWQCLTHAQRHLYKDVMLENYGNMVSLGFSFSKPPLISSLEQGTEPYVQDRQDWEFLSCSYPAA

SEQ ID NO: 27792 - protein, 81 aa, Muntiacus muntjak
PQACVTFEDVAVYFSQEEWRLLNETQRFLYCDVMLENFALTTSLEDEVIPSEQSLSVGESQVRPSQSGPSTQKIHLCEKSV

SEQ ID NO: 27793 - protein, 81 aa, Muntiacus muntjak
SREQVTFEDVVVDFTQEEWGHLEPAQRTLYRDVMLETFGLLVSVGHWLPKPDALSLLEQEAALRAADEGGPRGVCPDLETR

SEQ ID NO: 27794 - protein, 81 aa, Muntiacus muntjak
CQAPVTLKDVIVTFTQQEWKLLDLTQRTLYQEVVLETSRLLVSLGDKAKTKPTETTAAQQALFKGHLLQRSVSQEGCSVSP

SEQ ID NO: 27795 - protein, 81 aa, Ailuropoda melanoleuca
ESLTFEDVAVGLIQEWALLDGARRNLCQFVILDKCRILAPRGVGSPPCKPSLGSQVGPEEELRTPRVSEKDLFRCLSLYWE

SEQ ID NO: 27796 - protein, 81 aa, Gorilla gorilla
EADGSPEVRMTFQDMAMDFTREEWVMLENYRNLVTLGEGGIPPEVITQLELQEEWVIERYSPLDTHPGKDGENRPEIKKST

SEQ ID NO: 27797 - protein, 81 aa, Ailuropoda melanoleuca
IQEPVTFKDVAVDFTQEEWGQLDLVQRTLYRDVMLETYGHLLSVGNQIAKPEVISLLEQGEEPWSVEQAYPQSTCPEWMRN

SEQ ID NO: 27798 - protein, 81 aa, Ailuropoda melanoleuca
FQGSLSFKDVAVVFTWEEWQLLDPIQKNLYQDVMLENYSNLVSVVGYQVTTADAFYQLENGTPWITEEEIQSQIHPVTNVS

SEQ ID NO: 27799 - protein, 81 aa, Myotis lucifugus
MNIEDVAIVFSQEEWGLLDEAQRLLYYDVMLEVFALVSSVGCWHKMDDKEACSSQSVSIQGESQVRASKTAAATQKTLLCK

SEQ ID NO: 27800 - protein, 81 aa, Myotis lucifugus
DDMNFEDVAIAFSRKEWEILDESQRRLYCDVMLEVFSLVSFVGPWHKMNDVEAYSQHSVSVGESHVRASKTAAATQRTHLC

SEQ ID NO: 27801 - protein, 81 aa, Oryctolagus cuniculus
MYFTQKEWQLLKPAQKVLYKDVMLENYENLAFLVGHPVFKPKLIANLEQGIKPYVKKKAVPRDHQRGDEGISGSNIASDKK

SEQ ID NO: 27802 - protein, 81 aa, Oryctolagus cuniculus
YQELVTFKDVAVCFTQAEWAELSPAQRALYRSVMLENYGTLTMLGYPVPKPALISLLERGDLPWNLEVQEEPPAERTRELC

SEQ ID NO: 27803 - protein, 81 aa, Oryctolagus cuniculus
VQGLVTFKDVAVLFTQEEWGRLSPAQRTLYRDVMLENYSHLVSLGLLGAKPDIFSQLGKGEEWVPEDGSGSFCLDGMTLPV

SEQ ID NO: 27804 - protein, 81 aa, Rhinolophus ferrumequinum
CSGFSGLCASPVEEPHGALINSCNSRAMTNGSVTFRDVAIDFSQEEWECLDPAQRALYMDVMLENYSNLVSLDTSFLSQMG

SEQ ID NO: 27805 - protein, 81 aa, Rhinolophus ferrumequinum
SQGPLSFTDVCVHFTWEEWQLLDAVQKHLYRIVTLENYGHLVSLGYQHTKPDIILKLEQEGEQWMTQSHVPSQGQPDKVWE

SEQ ID NO: 27806 - protein, 81 aa, Rhinolophus ferrumequinum
SLGSDLFRDVAVVFSQEEWERLVPAQRDLYRDVMLETYSNLVSLDLAISKPDVISFLEQGKEPWMVERAATRGVCPVLESS

SEQ ID NO: 27807 - protein, 81 aa, Ursus maritimus
MLENFKNLVSVGHLPFKPDMVSQLEAEENLWVMEGETQRNGYSSEDHVAVPSGSKTQNEMETLQKVALKYLSHEELSCWQI

SEQ ID NO: 27808 - protein, 81 aa, Ursus maritimus
MKPDVIFKLEQGEEPWIGDGEVASSECPEQVLQVNGHMTWHQDNQEKFRNMKQDHECDAFGKKFNLSMNFVPVRKSNSEDD

SEQ ID NO: 27809 - protein, 81 aa, Ursus maritimus
VKFSKDEWKRLVPTQRALYREVMLENYQGFISLGLLVPKPDVIFQLKRGEEPWKLDFQEDEKSEVPGSTFPGMCELGGWDF

SEQ ID NO: 27810 - protein, 81 aa, Ursus maritimus
FLPWPSFPKLALRSFPCLPVLCQLWPGTFPREHRRGENGSCASNSQTAGLLVPKPDVIFQLKRGEEPWKLDFQEDEKSEVP

SEQ ID NO: 27811 - protein, 81 aa, Ursus maritimus
GQGSVSFRDVTVDFTRDEWLRLTGTQRTLYRDVMLENYSHLVSVGCHLSKPEVIFRLEQGEELWPSEGGFPDQRDQDRSRE

SEQ ID NO: 27812 - protein, 81 aa, Ursus maritimus
MTFEDVAVEFTQWEWGQLDPAQQGLYREVMLENFKNLASLGLPVSKPYVITQLDEPCVLDGEISTDWEKRPKAKESILNQG

SEQ ID NO: 27813 - protein, 81 aa, Ursus maritimus
VTESVTFRDVAVLFSRDEWLRLDSAQRTLYREVMLENYGTLVSLGIPFSMPKVICQLQQGEDPCVVDRELPRDACPGLKTQ

SEQ ID NO: 27814 - protein, 81 aa, Ursus maritimus
QEPLTFRDVAVVFTEEELGLLDPAQRKLYRDVMLENFRNLLSVGEGNPTGDKNEKEMEYIQGRELKCLSYRELSYWKIWEH

SEQ ID NO: 27815 - protein, 81 aa, Rhinopithecus bieti
FQGLLTFRDVAIEFSLEEWQRLDAAQQNLYRNVMLENYRNLVFLGIAVSKPDLITCLEQGKEPWNMKRHEMVDESPGLHFS

SEQ ID NO: 27816 - protein, 81 aa, Gorilla gorilla
YQDSVTFDDVAVDFTQEEWTLLDPSQRDLYRDVMLENYENLASVGHHLFKPSVIYWLEEEEELRAGRRGVLQEWRLKTKGP

SEQ ID NO: 27817 - protein, 81 aa, Ailuropoda melanoleuca
EMEPHSHAVPCQPSMSFKDVAVTFTQEEWGQLNLAQRRLYRNVTLETWSHLVSLGLLLSKPDVISWLEQGQDPWRAEQGPP

SEQ ID NO: 27818 - protein, 81 aa, Gorilla gorilla
EYSYFEKGPLTFRDVVIEFSQEEWQFLDTAQQDLYRKVMLENFRNLVFLGIDVSKPDLITCLEQGKDPWNMKRHGMVATPP

SEQ ID NO: 27819 - protein, 81 aa, Ailuropoda melanoleuca
QGPVSFKDVAVDFTQEEWQYLDLPQRDLYRDVMLENYINLISVGYQTTKPSVICKLEQGEEPWMVEREIPSWSYAEEVWQL

SEQ ID NO: 27820 - protein, 81 aa, Ailuropoda melanoleuca
SDESVTFEDVAVYFSENEWTGLAPAQRVLYRDVMLENYGAVASLAFPFPKPALISQLERGEAPWCKAPQGALDDIPRLLTV

SEQ ID NO: 27821 - protein, 81 aa, Phyllostomus discolor
EDTQTMKKSTQSHQAKGVPSKDTDWPREREGKPKISLPVTFRDISVVFTKAEWRWLSPKQRSLYKEVMLENCRNLLALATP

SEQ ID NO: 27822 - protein, 81 aa, Myotis lucifugus
LRQDMNFEDVAIAFSQEEWGLLDEAQRLLCYDVMLEVFAVVSSVGCWHKTDDVEACSEQNASIEGESQVSASKTAPTTQKS

SEQ ID NO: 27823 - protein, 81 aa, Puma concolor
QDVNFEDVAIDFSQEEWGLLDETQRLLYCDVMLETFALVASLGCRHGTEDEGAPSEQTVSVGESQFRASQAGPSTHPPAEM

SEQ ID NO: 27824 - protein, 81 aa, Puma concolor
PLTFKDVAVVFTEEELRLLDPTQRKLYRDVMLENFQNLLSLGDKNEKDLEYIQERELKCLSYRELSYWKIGEQAAGELTGS

SEQ ID NO: 27825 - protein, 81 aa, Puma concolor
AQDSVSFEDVAVYFSWEEWRLLDEAQRCLYHDVMLENFALISSLGCCCGAEDAEAPLEQSVSVGVSQASTPKAALSSRKTH

SEQ ID NO: 27826 - protein, 81 aa, Puma concolor
GRLTFRDVAIEFSQEEWECLDPAQRALYRDVMLENYRNLVSLGIPSDGFAIKELSPTEDINKGEFYHLVILERNESYGIKD

SEQ ID NO: 27827 - protein, 81 aa, Puma concolor
LQGSVTFQDVAVDFTPEEWQLLDCDQRTLYWDVTLENFRNLTAVEVICLLDDALERQEGSKDNFLNQDMFTFKKTLTMKRV

SEQ ID NO: 27828 - protein, 81 aa, Sapajus apella
MLENYQNLLALGAGPPLHKPDVISHLERGEEPWCVQRDIPGGPCPEWEMKEVPSQQQGMCKEELAQEPTLEWPLGGAQAWG

SEQ ID NO: 27829 - protein, 81 aa, Sapajus apella
MLENFALLASLGIAFSRSDAVMKLEQGEEPWLYDQVDMTSATGRESQRGPRPGCWHGVEDEVVSSEQSISAAGVSQVRTLM

SEQ ID NO: 27830 - protein, 81 aa, Sapajus apella
GPLTFMDVAIEFCLEEWQCLDTAQQNLYRNVMLENYRNLVFLVTCSHFAQDFWPEQHLKDPFQKVTLRYKNCEHKNLHLKK

SEQ ID NO: 27831 - protein, 81 aa, Sapajus apella
MSDYTPGPGSILVVGLSARTRGCPPTEPHAGFLVFKPELISRLEQGQEPWVLDLQGAEGTEAPKTSKTDSTIRTDNEQACE

SEQ ID NO: 27832 - protein, 81 aa, Sapajus apella
ASETLTFRDVAIEFSLEEWQCLNPAQQNLYRNVMLENYRNLVFLGIAVSKQNPVTCLEHGKEPWNMKRYEIMAKPTAMCSY

SEQ ID NO: 27833 - protein, 81 aa, Sapajus apella
ALALVSFEDVVVTFTGEEWGHLDLAQRTLYQEVMLETCRLLISLGHPVPKPELIYLLEHGQELWTVKRGLSQSTCAGEKAK

SEQ ID NO: 27834 - protein, 81 aa, Sapajus apella
SQGSVTFRDVAIDFSQEEWKWLQPAQRDLYRCVMLENYGHLVSLAGLSISKPDVVSLLEQGKEPWLGKRDVKRDLFSAHFF

SEQ ID NO: 27835 - protein, 81 aa, Sapajus apella
SYEGSVSFRDVAIDFSREEWRHLDPSQRNLYRDVMLETYSHLLSVGYQVPEAEVVMLEQGNEPWALQGERPRQSCPGEKLW

SEQ ID NO: 27836 - protein, 81 aa, Sapajus apella
MDVAIEFSQEEWKCLDLAQRTLYKDVMLENYRNLVSLGVGLPDLSVVSMLEQKREPWTLQSEEKIARNPDGRECIKGVNTE

SEQ ID NO: 27837 - protein, 81 aa, Sapajus apella
MLENYSNLVAVGYQASKPDALLKLERGEEPCCTTEDEIYTQICSEIRKIDDPLQHHLQNQSIQKSVKQFHEQNMFGNIVNQ

SEQ ID NO: 27838 - protein, 81 aa, Sapajus apella
MLENYRNLGFLAGLCLPDLNIISMLEQGKEPWTVVSQVKITRNPNWGECMKDVITGISPKCVIKELPPIQNSNTREKFQMV

SEQ ID NO: 27839 - protein, 81 aa, Sapajus apella
AQGSVTFEDVAVTFTQEEWGQLDATQRTLYQEVMMETCGLLVSLGCPLSKPELIYQLDHRQELWRSKKDLSQSSYPGDSTK

SEQ ID NO: 27840 - protein, 81 aa, Oryctolagus cuniculus
DQMAVTFEDVTVTFTWEEWNFLDSSQKKLYREVMWENYTNVMSVGKVIPAGNWNQSYKPQEERFRYLECENSSCWQGWKNA

SEQ ID NO: 27841 - protein, 81 aa, Oryctolagus cuniculus
GWVPALFDEVAIYFSDEEWDVLTEPQKALYREVMRMNYETVLSLEFPFPKPDMIARLEREEESQTSDEWPLQGGTFAENED

SEQ ID NO: 27842 - protein, 81 aa, Rhinolophus ferrumequinum
MEDAPSCSIPGWALGRISRPNIISQLEQKKEPWILQLQNFEARTILRESHTDFNNQVEKLNRDISEPAEHSRTSSETANRD

SEQ ID NO: 27843 - protein, 81 aa, Ursus maritimus
TKAMAQESVMFSDVSIDFSQEEWECLNDDQRDLYRDVMLENYSHLVSMDVISFLEQGKEPWLVDRELTRDHWPVLESRCET

SEQ ID NO: 27844 - protein, 81 aa, Ursus maritimus
FQESVIFRDVSVDCTWEEWIHLDSAQRNLYGTVMLENYRDVVSLGHQLSKPNVISQLELKELSWMKKELSACLSPDFLQCY

SEQ ID NO: 27845 - protein, 81 aa, Ursus maritimus
CLGLLTFGDVAIEFSQEEWRCLSHTQRALYRDVMLENYGHLLFLGFILSKPDLIMFLEQEEQFWDVNRKKTVAFHPGTSSH

SEQ ID NO: 27846 - protein, 80 aa, Rhinopithecus bieti
MCGPLQFRDVAIEFSLEEWHCLDTAQRNLYRNVMLENYRNLAFLGIVVSKPDLITCLEQGEKPLTMKKHDMVTNPSGRCE

SEQ ID NO: 27847 - protein, 81 aa, Macaca fascicularis
QDLVTFDDVVWYLTTGEWFKLDPEQRVLAYYRNVTYVGVPVLNPALVPHLAQGQVLLVSDPSPNTDPAKYSENTSATRHQT

SEQ ID NO: 27848 - protein, 81 aa, Macaca fascicularis
QDTVAYEDLSVGYTQKKWKCPALSQRALQWNMMPENDRSMASLGENMMKGSELTPKQEIFKGSESSNKTSGGLFGMVPGGA

SEQ ID NO: 27849 - protein, 81 aa, Phascolarctos cinereus
AQELVTFQDVAVDFTQEEWGLLDHPQKELYKEVMLENAQNLVSLGLPVPREDLMSYFEEKEAPWLLEHEGLRSCYPEGEIR

SEQ ID NO: 27850 - protein, 81 aa, Phascolarctos cinereus
MWLWTSPQREWRQLAPSQKELYREVMLENYRNLVCLGLALSTQGVIEHLERGDMPWMLERDVPGTHGPVSEIRPQTRVSAP

SEQ ID NO: 27851 - protein, 81 aa, Phascolarctos cinereus
PQESVTFKDVAVDFTQEEWRLLDHPQKLLYKEVMLENAQNLLSLGLPVPREDVVSYFEQREAPWMLEQEGLKSCCPEREIR

SEQ ID NO: 27852 - protein, 81 aa, Phascolarctos cinereus
CQPSITFEDIVVDFTWEEWEYLDMAQRNLYKDVTLENYKNLISLGFPICKPVLISQLERGDGSWMLRKDIPRITSPGPLCQ

SEQ ID NO: 27853 - protein, 81 aa, Phascolarctos cinereus
PQEQVTFSDVAVDFTVEEWGRLAPAQKELYRSVMLENYRNLVCLGLAASSPDVIGQLERGEGPWRVEGKVRKGLCADQKTS

SEQ ID NO: 27854 - protein, 81 aa, Myotis lucifugus
MAAPSSPLDPKEEWDYLDPAQRSLYKDVMMENYGNLVSLDVLNRDKDEEPTVKQEIEEIEEEMESKGIIVTRIKSETDQDP

SEQ ID NO: 27855 - protein, 81 aa, Puma concolor
EGTVTFEDVAVYFSREEWGLLEEAQRRLYQDVMLENLALVTSLGCQHGAENEEAPSEQSVSVEGVPHVRTPKAGLSPQKAS

SEQ ID NO: 27856 - protein, 81 aa, Puma concolor
WSQMPVTFEDVALYLSREEWGRLDHAQQNFYRDVLQKRNGLSSGFPFSRPFWASQGQGKGEASGSCRQMGDEEKTGACRGA

SEQ ID NO: 27857 - protein, 81 aa, Puma concolor
NPQELLTFKDVAIEFSQEEWGFLNHSQRELYRDVMLENYGHLLLLGLVSKPDLVNFLEQKKEAWDVNGKGTVATHPAVSSH

SEQ ID NO: 27858 - protein, 81 aa, Puma concolor
AHRSVTFRDVAIHFSQQEWEYLDSVQKNLYRDVMMENYDNLVSLAEHSISKPDVITLLEQRKEPWMVVREDTKRWCTDLES

SEQ ID NO: 27859 - protein, 81 aa, Sapajus apella
GSREMGLLAFRDVAIEFSLEEWQCLDHAQQNLYRDVMLENYRNLVSLGIAVSKPDLITYLEQNKEPWNIKRNEMVAKHPGK

SEQ ID NO: 27860 - protein, 81 aa, Oryctolagus cuniculus
YCVMIAFEDLAVYFSWEEWQNMNNAQKTLYRDVMLETYSSLFSLGHCITKPDLIFKLERGEEPWMVDECLNQSLSVVIKRD

SEQ ID NO: 27861 - protein, 81 aa, Ursus maritimus
ASCGLLTFRDVAIEFSQEEWRCLSHTQRELYRDVMLENYGHLLFLGLIVSKPDLVSFLELRKDPWDVKRRKTAGFDPGRWQ

SEQ ID NO: 27862 - protein, 81 aa, Ursus maritimus
LQESLTFGDVFVDFTLEEWQQLDSAQKYLYRDVMLENYSHLVSVGYLVPKPDEVLRLGREEEARRAEGEPPTRSYPGGKLP

SEQ ID NO: 27863 - protein, 81 aa, Ursus maritimus
AGSQGLLTFKDVAIEFSQEEWRCLSHTQRELYRDVMLENYGHLLFLGFILSKPNLIMFLEQEKQFWDVKRETVAFHPGRWD

SEQ ID NO: 27864 - protein, 81 aa, Ursus maritimus
MIKSQISFEDVAVDFTSEEWQLLNPTQKSLYRDVMLENYSNLVFLGYQIIKPDAIFKLEQEEPWIIDEQVLSQSFSEVWLD

SEQ ID NO: 27865 - protein, 81 aa, Ailuropoda melanoleuca
GQGSVSFRDVTVDFTRDEWLRLTGTQRTLYRNVMLENYSHLVSVGCHLSKPEVIFRLEQGEELWPSEGRFPDQRDQGELVI

SEQ ID NO: 27866 - protein, 81 aa, Gorilla gorilla
IQGQVNFEDVFVYFSQEEWVLLDEAQRLLYRDVMLENFALMASLGCWHGMEDEEIPFEQSFSIGMSQIRIPKGDPSTQKAY

SEQ ID NO: 27867 - protein, 81 aa, Ailuropoda melanoleuca
LLTFEDVAMYFSQEEWELLDPTQEALYNDVMRENYETVISLALFVLPKPKVISYLERGEEPWVQGPLEFKNSPGDLPAVEK

SEQ ID NO: 27868 - protein, 81 aa, Ailuropoda melanoleuca
VSFHDVAVDFTREEWRLLSHAQRLLYRCVMLENYSNLVSLGIPVPKPTLVISLEQGEEPWREESKHLPSPCAADAKPEIQR

SEQ ID NO: 27869 - protein, 81 aa, Ailuropoda melanoleuca
HLVTFEDVAVNFTQEEWTLLDQTQRDLYRDVMLENYQNLIILAGYESCGPDLNSPVGGAEELRTGGRGILQELDLQLKTKG

SEQ ID NO: 27870 - protein, 81 aa, Macaca fascicularis
VQESVTFRDVALFFSQDEWLHLGSAQRALSREVMLENYSSLVSLGILFSKPKVISQLEQGEDPWMVESGVPQGAHLGWESL

SEQ ID NO: 27871 - protein, 81 aa, Phascolarctos cinereus
ILESWAGHFHSILKRPRTSTVVATGHLPQELVTYKDVAVDFTQEQWSFLDHPQELYKEVMLENAQNLLSLASCQRRFDLLF

SEQ ID NO: 27872 - protein, 81 aa, Phascolarctos cinereus
MLENAQNLLSLGLPVTREDLISSFQKGEAPWILEPKGPRNFYLDIETKFKVNEMPRKLGIFVEERDLQRFMSDHPWDFKLR

SEQ ID NO: 27873 - protein, 81 aa, Phascolarctos cinereus
PQELVTFKDVVVDFTEEEWGLLDHSQKELYKEVMEENAQNLLTLGLPVPREDLISPFHQGEAPGTLGQKGPRNSWPGAETR

SEQ ID NO: 27874 - protein, 81 aa, Phascolarctos cinereus
PQESVAFKDVAVEFTQEEWRCLDTSQKELYHDVMMENYKNLVCLGLVLNKPAVISQLEGKEAPWMTERQVQRNSCPGWEIR

SEQ ID NO: 27875 - protein, 81 aa, Phascolarctos cinereus
PQELVTFKDVAVDFTCEEWGQLGPAQKELYKDVTLENYRNLVCLGLAVSKPDVISQLERGGARWIPEGKGPRCRCAGWETR

SEQ ID NO: 27876 - protein, 81 aa, Myotis lucifugus
VTFEDIALYFSREEWSLLDEGQRQLYLNVMLENFELISSLGCCCGAENVEALTEQKVSVRLSQARNPKLALSSQKSHPCES

SEQ ID NO: 27877 - protein, 81 aa, Puma concolor
VVFTDVAVCFSQEEWGLLDEAQRRLYHSVMLETFALLSSLGHSVSVGASQVRTPKPGPSFQEAQPCETCSSLLKDLLHLAE

SEQ ID NO: 27878 - protein, 81 aa, Puma concolor
PMLFEDLAVFFSQEERVCLHSVQRSLSRDTTQECFEEMALMGGKGKTEITQQLNLDSMGVEELAPENSSIAVPLVYYPEKS

SEQ ID NO: 27879 - protein, 81 aa, Sapajus apella
ARGCVVFEDVFVYFSREEWELLDDAQRLLYHDVMLENFALLASLGIAFSRSDAVMKLEQGEEPWLYDQVDMTSATGRESQR

SEQ ID NO: 27880 - protein, 81 aa, Oryctolagus cuniculus
SPVLVSFEDVAVDFSWEEWQNLDNAQRTLYRDVMLEIYSNLLSLGYCITKPEVIFKLEQGAEPWIVEGPLSPSLPAVQKMD

SEQ ID NO: 27881 - protein, 81 aa, Ursus maritimus
SQGLLTFGDVAIEFSQEEWRCLSHTQRELYRDVMLENYGHLLFLGLIVSKPDLVSVLEQSKEPWDVRRKKTVVFDPAVSSH

SEQ ID NO: 27882 - protein, 81 aa, Ursus maritimus
KPQGLVTFEDVAVDFTPEEWQYLNPPQKTLYREVMLETYSNVVSVGPQATKPDLVLKLEVEEPCPAETKISFWSFPEAACQ

SEQ ID NO: 27883 - protein, 81 aa, Ursus maritimus
MFRAVAVDFSQEEWEFLDLKQRNLYRDVMLENYSHLVSLDVKSQCATKELSSNDDNYEIKLSHRKIMERLTSHEFGCSIFQ

SEQ ID NO: 27884 - protein, 81 aa, Canis lupus
PQASVSFKDVTVEFTHEEWRQMDSAQRTLYRDVMLENYSHLVSVEDSQPNHLSKKSLESQGKYLWHVLFTNKSLPTEEEIS

SEQ ID NO: 27885 - protein, 81 aa, Canis lupus
SQGLVSFKDVAVDFTQEEWQQLDPAQKTLYKDVMLENFSHLVSMGYPVSKPDVISKLEQGEDPWIIKRDIPNWMYPDENQA

SEQ ID NO: 27886 - protein, 81 aa, Canis lupus
KETVTFKDVAVVFTEEELGLLDPAQRKLYGDVMLENFRNLISVGGKIQNKMKTVLEAEPPEEHSCWRIWQQIASDLSRCQG

SEQ ID NO: 27887 - protein, 81 aa, Canis lupus
FQESVTFEDVAIYFSENEWTGLAPAQRVLYRDVMLENYGAVAALGYPFLKPAGISHFKQVEEPLNLKLQGEGPSLTCTEGV

SEQ ID NO: 27888 - protein, 81 aa, Canis lupus
ELLSFDDVAMYFTREEWNRLDWAQKDLYRDVMLENYRNMILLGSEARCKMKKPTPKQKISEDVESCKTSVKQKMAKRLGEK

SEQ ID NO: 27889 - protein, 81 aa, Muntiacus muntjak
RPRAVKFGDVALYFSREEWGCLRPAQRALYRDVMQETYGHLGALGCAGPKPALISWLERNTDDWEPAALDPQQCPKGVAVQ

SEQ ID NO: 27890 - protein, 81 aa, Gorilla gorilla
SLKKVTFEGVAIDFTQEKWAMMDTSKRKLYRDVMLENISHLVSLGYQISKSYNPGKQQGPVESALKKKHMISMHPIIRKDV

SEQ ID NO: 27891 - protein, 81 aa, Ailuropoda melanoleuca
QELLTLEDVAVDFTWEEWQLLGPAQKDLYRDVMLENYSNLVSVGTGCQATKPDALSKFEHRDELWLTEDEIQNRTHPVNEK

SEQ ID NO: 27892 - protein, 81 aa, Gorilla gorilla
SVAFKDVAVTFTQEEWALLDPSQKNLYRDVMQETFRNLASIGKKWKHQNIYVEYENLRRNLRIVGERLFESKEGHQHGEIL

SEQ ID NO: 27893 - protein, 81 aa, Phyllostomus discolor
AHDSVTFGDVAIDFSQEEWEFLDAAQRDLYRNVMWENFSNFISLDLESRYKTSTLSPGKDIYETYLFQWEIMETTKSYCLQ

SEQ ID NO: 27894 - protein, 81 aa, Phyllostomus discolor
MDFTLEDWEQLGLDQEDLFWDKALENYQNLFLLNPLRPSLTNPDGGEELKTLVRGSPEVTGPDTAEAKISMLQEFSEEGLS

SEQ ID NO: 27895 - protein, 81 aa, Phyllostomus discolor
VVFADVAVNFTQEEWALLDGAQRKLYREVMLETFRNLASVVVTDCFTQVKTHPSRPGQDTLENKISSEEKILRFTRNDSWP

SEQ ID NO: 27896 - protein, 81 aa, Puma concolor
MLENYGVVASLGKAFPFPKPALISQLERGEAPWCKAPQGALDGECPRGVSTGYPFLKPAAISHLEQVEEPLNLKLQGEGPS

SEQ ID NO: 27897 - protein, 81 aa, Sapajus apella
MLENYRNLVCLGLAVSKPDLITFLEQRKEPWNVKSAETVAIQPDIFSHDTQALLRKKCIEASFQKVILDGYGSCGLQNLHL

SEQ ID NO: 27898 - protein, 81 aa, Sapajus apella
FQGVLTFMDVAVEFSLEEWQCLDTAQQNLYRNVMLENYRNLVFLADIAASKPDLITCLEQGKEPWNVKRHEMVAKAPGWSH

SEQ ID NO: 27899 - protein, 81 aa, Sapajus apella
AQESVMFSDVSIDFSQEEWECLNDDQRDLYRDVMLENYSNLVSMGHSISKPNVISYLEQGKEPWLVDREITSGQWPVLESR

SEQ ID NO: 27900 - protein, 81 aa, Oryctolagus cuniculus
FSTVMIAFEDLAVYFSWEEWQNMNNAQKILYRDVMLETYSSLFSLVGMKRDDLIRINQESQDTNLNQDFMKNNKTSALKRV

SEQ ID NO: 27901 - protein, 81 aa, Oryctolagus cuniculus
AFVSFEDVAVSFTWEEWQELDNAQRALYKDVMLETYNSLMLETYNSLGCCISKPEVIFKLEQGAEPWVMEEPLTQSLPVVQ

SEQ ID NO: 27902 - protein, 81 aa, Oryctolagus cuniculus
SQETLTFQDVAVDFTREEWDQLHPTQKHLYRDVMLENYQNLVALGHQLYKPEVLVQLEHEEPQTTEASPLNTLPDEKNRPE

SEQ ID NO: 27903 - protein, 81 aa, Pteropus alecto
LTLSDVFIEFSQEEWECLAPAQRALYKEVMLESYQNLLFLGISLSDLHIVSFLERGNVPWTLESKLKRAQKPNQWEHIERV

SEQ ID NO: 27904 - protein, 81 aa, Pteropus alecto
MLENYSSLVSLGIPLSTPKVICQLQRGKDPCLVEGEACQGACQDFKTWPEIEALPPRQDIFIEEASQGIITKKSTKFGHWG

SEQ ID NO: 27905 - protein, 81 aa, Pteropus alecto
RVEAVTFKDVAVVFTEEELGLLDSAQRKLYRDVTLENFRNLVSVGHQSSKPDVISQLEREEKLRTTEASQAEAGVLRSIQL

SEQ ID NO: 27906 - protein, 81 aa, Oryctolagus cuniculus
LLDLVTFDDVAVDFTHEEWTLLDSTQRNLYRDVMVENYKNLAIVGYQLFKPSLISWLEEEVEQCVHQEWVMDLNTKGTALQ

SEQ ID NO: 27907 - protein, 81 aa, Oryctolagus cuniculus
KPAAVSFADVAVYFSPEEWGCLRPAQRALYREVMRETYGLLGALGGGGTKPALICWVERDAELWGPDAQDPAAAAARGYGT

SEQ ID NO: 27908 - protein, 81 aa, Oryctolagus cuniculus
QGLVTFRDVAVEFSQEEWKCLKPAQRDLYRDVTLENFGNLVSLDLASRCETFPQREIFEIDSFNWEIMESLRCCDLEITSF

SEQ ID NO: 27909 - protein, 81 aa, Pteropus alecto
KPSDRMTFQDVALDFTPEEWQLLDCDQRTLYWDVMLENFRNLISVGGPVTKTKVIFKQGQEPQMVERENPYWSHPEAECPH

SEQ ID NO: 27910 - protein, 81 aa, Ursus maritimus
QETVTFKDVAVVFTEEELALLDKAQINLYQDVMLENFRNLVSVGEDNSPLFKPHTVFQGEHKEKLWPLNPCGRESVWMCSV

SEQ ID NO: 27911 - protein, 81 aa, Ursus maritimus
SVTFEDVAVLFTRDEWRKLGPSQRNVYQEVMLENYTNLVSLGKGTVPVDEKVRRYLSRFSLPDRRTLYDASLNGKKESPGG

SEQ ID NO: 27912 - protein, 81 aa, Ursus maritimus
SVAFQDLAVRFSEEEWQLLAEGQRALYRDVMRENYETLRSLGTDELLPLSAFLSPTEAGGAMEGRSSAGEGQEPSRGGGPP

SEQ ID NO: 27913 - protein, 81 aa, Ursus maritimus
MGLLTFGDVAIEFSQEEWRCLSHTQRELYRDVMLENYRHLLFLGLIVSKPDLVSLLEQRKEPWDVKRKKTVFLGGWLIYFV

SEQ ID NO: 27914 - protein, 81 aa, Ursus maritimus
PKLKLVTFKDVAVDFTQEEWEHLDPSQRHLYREVMLENYGNLILGHLLCKPEMIFHFEQEDDVWVEEEMPGNSYSGMRMMR

SEQ ID NO: 27915 - protein, 81 aa, Rhinopithecus bieti
EKGPLTFRDVVIEFSQEEWQCLDTAQQDLYRKVMLENFRNLVFLGIDVCKPDLITCLEQGKDPWNMKRHSTVATPPESGLL

SEQ ID NO: 27916 - protein, 81 aa, Myotis lucifugus
AWVPALFDEVAIYFSDEEWEVLTESQKALYREVMRMNYETVLSLEFPFPKPDMISRLDGEEEPQNADRWPLPGGSVAENEE

SEQ ID NO: 27917 - protein, 81 aa, Myotis lucifugus
FQESVTFKDVVVDFTREEWKQLDPVQRDLFRDVTLENYTHLVSIGLQVSKPDVISQLEQGTEPWIVDSGIPVGGSGDWVTG

SEQ ID NO: 27918 - protein, 81 aa, Puma concolor
WQTLSLKPVTFEDVAVNFTQEEWMYLDASQRALYQDVMSETVRNLMSVDLVTKLEEEEQWRIELQLQPPNGEGLPSGSRKQ

SEQ ID NO: 27919 - protein, 81 aa, Puma concolor
QAQESLTFEDVAVGFSREEWRLLAPAQKDLYRDVMLENYRNLVSVGYLTSKPDALSKLEGGELWTTEDEIDSRICPEIRKV

SEQ ID NO: 27920 - protein, 81 aa, Sapajus apella
IQGLLTFGDVAVAFTRIEWRHLDAAQRALYRDVMLENYGNLVSVGLLSSKPKLIAQLEQGAEPWMEMREAPSGTCAVPDYW

SEQ ID NO: 27921 - protein, 81 aa, Sapajus apella
MELLTFRDVTIEFSLEEWEFLKPAQQNLYRNVMLENYRNLVSLAMSCHYTEDFLPEQGMKDSFQKVILRRSGSCGLENLHL

SEQ ID NO: 27922 - protein, 81 aa, Sapajus apella
IRDQDLGTSLLPAAPQEQWRHLDSTQKEQYWDLMLETYGKMVSGAGISHSKPDLTNSIEYGEELAGLYLHVNEKIPRPSCI

SEQ ID NO: 27923 - protein, 81 aa, Sapajus apella
GTVTFEDVAVHFSWEEWGLLDEAQRCLYRDVMLENLALLTSLDVHYQKQHLGEKHFRSNVDRALFVKTCIFHVSGETSTCK

SEQ ID NO: 27924 - protein, 81 aa, Sapajus apella
FQGVLTFMDVAVEFSLEEWQCLDTAQQNLYRNVMLENYRNLVFLDIAASKPDLITCLEQGKEPWNVKRHEMVAKAPGWSHD

SEQ ID NO: 27925 - protein, 81 aa, Oryctolagus cuniculus
MLDNFTLVASLGFASSQIRVVVRLEAGEGTWAPGRAGVGPAAALGTWRGPGPGCWFRMENAEAPLQAVPRIRTPGSGSATH

SEQ ID NO: 27926 - protein, 81 aa, Pteropus alecto
ITFEDVSMDFTQEEWALLNSSQRKLYRDVMLENYRNLASLGKLIGNFLLYEYERGSKKAKLREIDTTQRAAVAFGLCTGNS

SEQ ID NO: 27927 - protein, 81 aa, Oryctolagus cuniculus
MITFEDLAVYFTWEEWQNMNQAQKILYRDVMLETYSSLFSLVAMKRDDLISKNQKSQDKNLNQNVMKNNKTSTPKIIELRK

SEQ ID NO: 27928 - protein, 81 aa, Oryctolagus cuniculus
PCEPVTYEDVTLGFTPEEWGLLDVKQKSLYREVMLENYRNLVSVEHQLSKPNVVSQLEEAEDFWPVGRGILQDPFPECSET

SEQ ID NO: 27929 - protein, 81 aa, Oryctolagus cuniculus
AQESVAFGDVAVFFSQDEWLHLDSAQRHLYREVMLENYSNLLSLGTPFSTPKVIYQLQQGEDPSVVEREVPPDTSPDFKTC

SEQ ID NO: 27930 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCAGDEVWQ

SEQ ID NO: 27931 - protein, 81 aa, Oryctolagus cuniculus
MLENYGHLVSLAGLSISKPDLVSLLEQGKEPWLGKGDIRRNLFSASPSQDSPVIQESAIKDKKGMEAEWLSAQSQTLVTFK

SEQ ID NO: 27932 - protein, 81 aa, Oryctolagus cuniculus
DQRCVTLKDVFVYLSHEEWKLLDEDQKCLYYDVMLNIFLYVLSLRLPISRSCLLTQPEPESQPRQPDSADVAPVNAKTTKR

SEQ ID NO: 27933 - protein, 81 aa, Pteropus alecto
LQEPVTFRDVAVDFTQEEWGQLGPAQRTLYRDVMLETFGHLLSVGPELPKPEVISQLEQGAELWVAERGIARGSCAGWETG

SEQ ID NO: 27934 - protein, 81 aa, Pteropus alecto
PQVSLAFRDVAVEFSQEEWACLDPAQRALYRDVMAENYRTLLSLGHSIPKPDVITLLEQEKEPWMFVTEGTRVWHADSESK

SEQ ID NO: 27935 - protein, 81 aa, Rhinolophus ferrumequinum
FQELVTFEDVAVYFIRKEWKRLEPAQRDLYRDVMLENYRNVFSLDGESRTEHDQEISEETGSHGVLLGRFQKDISQGLKFE

SEQ ID NO: 27936 - protein, 81 aa, Rhinolophus ferrumequinum
VTESVTFGDVAVLFSQDEWLCLDPAQRALYREVMLENYSSLVSLGIPFAMPKVICQLQEGKDPCMVERERPQDTCLDFKTW

SEQ ID NO: 27937 - protein, 80 aa, Ursus maritimus
LQGLLTFGDVAIEFSQEEWQCLSHTQRELYRDVMLENYGHLLFLGLVVSKPDLVIFLEQKRELWDVRRKETVFIHPGRWE

SEQ ID NO: 27938 - protein, 81 aa, Ursus maritimus
MTFKDVAVDFTQEEWVQLDSPQRALYRDVMLENYQNLLALGKTAPRSSRTHLTRHQRIHTGEKPYQCGACGKAFNQRTHLT

SEQ ID NO: 27939 - protein, 81 aa, Ursus maritimus
MGLLTFGDVAIEFSQEEWRCLSHTQRELYRDVMLENYGHLLFLGLIVSKPDLVSFLEQTKEPWDVKRRKTGLHNQRAFPLH

SEQ ID NO: 27940 - protein, 81 aa, Ursus maritimus
AYGSLSFGDVAISFSQEEWECLDPAQRALYRDVMLETYSNLVSVGSSISKPDVIALLEQEKEPWVVLRRETSRWYSDLESS

SEQ ID NO: 27941 - protein, 81 aa, Rhinopithecus bieti
LQFRDVAIEFSLEEWHCLDTAQRNLYRSVMLENYRNLVFLECEECGKAFKRSSILTIHKRIHTGEKPYECEECGKTFKYLS

SEQ ID NO: 27942 - protein, 81 aa, Desmodus rotundus
AQVSVTFEDVAVTFTREEWGQLDLDQRTLYQEVMVETCRLLVSLGCPLSKLELIHLLERSLELQMLKRGLSPSSFPGDSTK

SEQ ID NO: 27943 - protein, 81 aa, Desmodus rotundus
WLQTPVTFKDVAVEFTQEEWMMLDSAQRSIYRDVMLENYINLTSLAYQLCKPSVISQLGQEEIRTMKRRIPKGTYLDWEIQ

SEQ ID NO: 27944 - protein, 81 aa, Desmodus rotundus
QRSTPFGNVTVAFTHKEWERSVLAPRRGFKEETPDKSRNLVLLGLLVSQPGMNSQLEQRESPWILEREGLRTTYPDWRTVF

SEQ ID NO: 27945 - protein, 81 aa, Desmodus rotundus
VMFRDVVIDFSQEEWECLDFAQRHLHRDVMLENYSNLVSLDLPSRCANKYLPLRKDTYETELSQWEMSNKLQNDDLKESSS

SEQ ID NO: 27946 - protein, 81 aa, Desmodus rotundus
FQDLVTFGDVAIDFSQEEWEWLNLAQRNLYRKVMLENYRNLVSLGVSVSKPEVISLLEQGKEPWMVKEVGTGGMYSDWEYA

SEQ ID NO: 27947 - protein, 81 aa, Desmodus rotundus
AHDSVTFGDVAIDFSQDEWEFLDAAQRDLYRNVMWENYSNFISLDLESRYRINTLSPEKDIYETYLFQWEIMETTKSYCIQ

SEQ ID NO: 27948 - protein, 81 aa, Macaca fascicularis
LQASVSFQDVTVEFTQEEWQHLGPAGRTLYRDVMLENYSHLISVGYCFTKPKVISRLEQGEEPWSLEDEFLNQKHQGYFKV

SEQ ID NO: 27949 - protein, 81 aa, Phascolarctos cinereus
RQGSLTFQDVAVDFTWEEWGQLGPTQKELYREVMLENYGNLVCVAGLAGSKPDVICRLEQGEAPWRPGEGFSGSGRPDWET

SEQ ID NO: 27950 - protein, 81 aa, Macaca fascicularis
QGTVTFEDVAIHFSWEEWGLLDEAQRCLYRDVMLENLALLTSLDVHHRKQHLGEKHFRSNVGTALFVKTCTFHVSGEPSTC

SEQ ID NO: 27951 - protein, 81 aa, Phascolarctos cinereus
SQEPVTFKDVAVDFSQDEWGHLDTAQRHLYRDVMLENYRNLVSLGLVRAQSEVVSHLERGDEPWRPERGELRGTHPVQLIQ

SEQ ID NO: 27952 - protein, 81 aa, Phascolarctos cinereus
FQELVTFKDVAVNFTQEEWRQLNSAQRDLYRDVMLENYRNMISLGLSISKPDVILQLERGEEPWMLNLKRTAEREIPQYMS

SEQ ID NO: 27953 - protein, 81 aa, Phascolarctos cinereus
VPVAVTFDDVTVYFTEQEWGTLEEWQKELYKHVMKTNYENLFSLGYAIPKPDLITQIEQGEEPFIRDGGHLNTRELTIGSK

SEQ ID NO: 27954 - protein, 81 aa, Phascolarctos cinereus
CQESVTFNDVAVDFTQEEWRHLDPSQKDLYRDVILENYRNLVCLAGLAASKPEVIDQLERGEAPWMPEGDVPGSACLDSET

SEQ ID NO: 27955 - protein, 81 aa, Phascolarctos cinereus
TQELVTFKDVAVDFTQEEWGLLDHPQKELYKEVMLENAQNLLSLGLPVPREYLISYLEEREAPWLLEQEGLRSCCPGEIRP

SEQ ID NO: 27956 - protein, 81 aa, Phascolarctos cinereus
AQGLLTFEDVAVIFSQEEWRHLDCVQRALYKDVMWENYRNLASVGFPFPKPELISSLERGEEPWLPDVLGSSERRRILFFC

SEQ ID NO: 27957 - protein, 81 aa, Myotis lucifugus
ESQDMNFEDVAIAFSQEEWGLLDEAQRHLYCDVLLEVFALVSFIGHWHKMDDVEAYSEHSVSVGESQVRASKTAVATQRTH

SEQ ID NO: 27958 - protein, 81 aa, Puma concolor
DQGLVTFEDVAVDFTHEEWQYLNPSQKSLYREVMLETYSNLVSVAGQQVTKPDLILKLEVEEQCLAETKISIWNFPEAYQV

SEQ ID NO: 27959 - protein, 81 aa, Puma concolor
FQDSVVFVDVAVNFTPEEWALLDSSQRNLYRDVMLETCKNLASVGKDGSIPSLVFGENQTFRSRGDYLQTQERRLRSPFVE

SEQ ID NO: 27960 - protein, 81 aa, Sapajus apella
MLENYSNLVAVGYQASKPDALFKLEQGQPPWTIKDGIHSGGCSEIWKFDDHVHLQHESLVNRRKQCHENDAFENILHWSKS

SEQ ID NO: 27961 - protein, 81 aa, Oryctolagus cuniculus
TPVPVTFEDVAVTFTQEEWRQLDPAQRSLYQEVMLENCGLLVSLGCPVPRPELICQLERVQEPWTLKNDLSQSSRSGPKGR

SEQ ID NO: 27962 - protein, 81 aa, Oryctolagus cuniculus
MAFKDVAVDFTQEEWSLLSPAQRTLYREVMLENYSNLVSLGIPFSKPKLITQLEQGKETWREDRRCPLAACPAGTKPELHL

SEQ ID NO: 27963 - protein, 81 aa, Oryctolagus cuniculus
SEESVTFKDVAVDFTQEEWSQLDSPQRALYRDVMLENYQNLLALGPPVCKPDVISHLERGEEPWRVQREVPGGACPEGAPR

SEQ ID NO: 27964 - protein, 81 aa, Oryctolagus cuniculus
SQVLVSFKDVAVDFTQEEWQQLDPAQRTLYRDVILENYSHLVSMGYPICKPDVISKLEQGEDPWIIQRDISHWIYADEHQA

SEQ ID NO: 27965 - protein, 81 aa, Oryctolagus cuniculus
SQESVTFQDVAVDFTEKEWPLLDSSQRKLYIDVMLENYSNLTSLDWETPSKTKWSVLMENIFGKQTSSSVTMERTPPGEKS

SEQ ID NO: 27966 - protein, 81 aa, Pteropus alecto
LFESVSFKDVTIDFSWEEWQQLDFAQKSLYRDVMLENYFNLISVGCQVPKPEVIFNLEQVENPCMLHRKISRQSCLDGDIG

SEQ ID NO: 27967 - protein, 81 aa, Pteropus alecto
KIDLVTFEDVAVEFTQEEWALLDPSQRKLYRDVMLETCRNLASLGYHVNEPSLISHLEQEDKVMAEQRGILPGTCPVFSTK

SEQ ID NO: 27968 - protein, 81 aa, Ursus maritimus
SGLLTFGDVAIEFSQEEWRCLSHTQRELYRDVMLENYGHLLFLAVSSHGSLSFQPEPCKEASFQNVLVGRYQHSVLEKLHL

SEQ ID NO: 27969 - protein, 81 aa, Ursus maritimus
SQGWLTFRDVAIEFSPEEWECLDPAQRALYQDVMVENYRNLVSLGEDSFPPEVVSSCCIKKCFLKTPGRVVSMSQDAEMEG

SEQ ID NO: 27970 - protein, 81 aa, Ursus maritimus
MLENYGHLLFLGLTVWKPDLVIFLEQEKQLWDVKRKETVAFHPAISSNGTQSFLPTLCIEASFQNVAVRRYKHTALENLHF

SEQ ID NO: 27971 - protein, 81 aa, Rhinopithecus bieti
INQKLSFKDVTVEFTQEEWQHMGPVERTLYRDVMLENYSHLVSVGYCFTKPELIFTLEQGEDPWLLEKEKGFLSRNSPEDS

SEQ ID NO: 27972 - protein, 81 aa, Ailuropoda melanoleuca
PMLFEDLAVYFSQEEYVSLHPAQRSLSRDTIQECFEDMALMGKNSPGDNKAISNNQVVSLLSPLTGSPTARCSGKSVEPAG

SEQ ID NO: 27973 - protein, 81 aa, Gorilla gorilla
SQGLLTFRDVAIEFSQEEWKCLDPAQRTLYRDVMLENYRNLVSLDISSKCMMKEVSSTAQGNTEVIHTGTLQRHEHHHIGD

SEQ ID NO: 27974 - protein, 81 aa, Ailuropoda melanoleuca
PQVLVSFEDVAVFLSREEWGCLGPAQRGLYRDVMLETYRNLISLGFQDSKPDVISKLEKGEEPWAPYSPRIEEGWIWSHGS

SEQ ID NO: 27975 - protein, 81 aa, Ailuropoda melanoleuca
SVTFEDVAVYFSWEEWSLLDEAQRHLYHDVMLENFALVTAVGCWHGAEDGKSPSKQAVSVGVSQVRTHHAGPYPQKAYPCG

SEQ ID NO: 27976 - protein, 81 aa, Ailuropoda melanoleuca
SLTFGDVAVSFTQFEWKHLDATQQALYRDVMLENYGNLVFVGTGLLSSKPKLITQLEQGAEPWMEVQQITSDTCSVLISII

SEQ ID NO: 27977 - protein, 81 aa, Phascolarctos cinereus
SHESVTFKDVAVDFTWEEWGYLDTSQKELYWEVMLENYRNLVSLGLADSNVDMISQLESGEAHGIPVDSVLRSCWPDGDTR

SEQ ID NO: 27978 - protein, 81 aa, Myotis lucifugus
LQGLVSFKDVTVDFTQEEWQHLDPAMLENYCHLISVGCHMTKPDVILKLERGEEPWTSLTGQTCLKKNWKPEDFLVKFKEH

SEQ ID NO: 27979 - protein, 81 aa, Myotis lucifugus
VQEPLTVHDVAVDFTWEEWQLLGPEQKDLYTDVMLETYSHLVSVGYEASKPDILSKLDHGEAPWTVAGELLCGIRSDIWKL

SEQ ID NO: 27980 - protein, 81 aa, Puma concolor
KSNDPCVRAPENDQLPEEWQLLDCDQRTLYWDVMLENFRNLTAVGKDITKTKVIFKEEQGQESWMVEGENPCWRYPEADWL

SEQ ID NO: 27981 - protein, 81 aa, Puma concolor
MLENFSHVISLGYPVSKPDVISKLEQGEDPWIIKRDSNSRKNPDESLGCGKSSSYGASDSNLEKMHNGVMPCNNNQCGNIF

SEQ ID NO: 27982 - protein, 81 aa, Puma concolor
MAFTQKEWEQLDPVQRNLYKDVMLENYSNLASMGYQALKPDMISKLEKGEEPWLGKGKKPRQGGPSEIARPKQIGTNGKEV

SEQ ID NO: 27983 - protein, 81 aa, Sapajus apella
EPGAVSFGDVAVYFSREEWGCLQPAQRALYRDVMRETYSHLGALGVGGSKPALISWMEEEAELWVPAAQDPEVAKCPTEAD

SEQ ID NO: 27984 - protein, 81 aa, Sapajus apella
TQGQVTFRDVAIEFSQEEWTCLDPAQRSLYRDVMLENYRNLASLGISCFDLSIISMLEQRKEPFTLESQVQIAGNPDGWEW

SEQ ID NO: 27985 - protein, 81 aa, Sapajus apella
MAMYLTREEWRPLDPAQRDLYRDVMQENYGNVVSLDFEIRSESEVNPKQEISEDVQFGTTSERPVENAEENPESEEAFESR

SEQ ID NO: 27986 - protein, 81 aa, Oryctolagus cuniculus
KVPVTFVDIAVYFSEDEWKNLDEWQKELYNNLVKENYKTLMSLDSEGSVPKPDPPAQVEPREEPCVWEQRHPEERDVPMDP

SEQ ID NO: 27987 - protein, 81 aa, Pteropus alecto
VAIDDVAVNFTLEEWALLDPSQKKLHKDVMQEIFRNLDSIGKKWEDHNIEDQYKHQGRKLRSQMVEILCENKEESQRGENS

SEQ ID NO: 27988 - protein, 81 aa, Pteropus alecto
EVVTFKDVAVYFTQAEWDGLSSAQKALYRSVMLENCGNLTSLGYPVPKPALISLLEGGDLPWGLEAQSDPSAERTTDFCKD

SEQ ID NO: 27989 - protein, 81 aa, Pteropus alecto
LQELLKPEDVAVEFNREEWQLLAPDQKDLYRDVMLENYYNLMSLGYQTKKPNALPKLEHGEEPQLIEDELQNGTCPGIGKV

SEQ ID NO: 27990 - protein, 81 aa, Pteropus alecto
FQGRLTLGDVFIEFSLEEWKCLSPAQRALYREVMLESYRNLLFLGISVSDLYIVSILEQGKAPWTLESEWKIPQEPNWREH

SEQ ID NO: 27991 - protein, 81 aa, Rhinolophus ferrumequinum
MFQVTFSDVAIDFSHEEWGWLDSAQRDLYKDVMVQNYETLVSLAGLSIPKPYVITLLEDGKEPWMVEKKLTKAMFPDWESR

SEQ ID NO: 27992 - protein, 81 aa, Rhinolophus ferrumequinum
QDTVVFADVAVNFTREEWALLDGAQRKLYREVMLENFRNLASVDDETQFKANGSVSQRDIYGNKISKEDKIEFSGNDPCIS

SEQ ID NO: 27993 - protein, 81 aa, Rhinolophus ferrumequinum
MLENYANVASLAAFPFSKPDLIFQLERGEAPRDLDPWTPGEAEALRSVCTGGKTKTENEEQMLKLNMPKEPEWARLTAEML

SEQ ID NO: 27994 - protein, 81 aa, Rhinolophus ferrumequinum
AQGSVSFEDVTVEFTQEEWPYLGPAQRAVYRDVMLENYSHLVSVGYCITKPQVIFKLEQGEQPWSLGEEFLNQRYPEYYKV

SEQ ID NO: 27995 - protein, 81 aa, Ursus maritimus
AEGHVTFEDVAVYFSWEEWGLLDEAQRLLYRDVMLENFSLMASLGLASSRTHEITQLEWWREPFLPPCEVLTAAMPRGWRH

SEQ ID NO: 27996 - protein, 81 aa, Ursus maritimus
SQGLLTFGDVAIEFSQEEWGCLSHTQRELYRDVMLENYGHLLFLGFILSKPDLIMFLEQEKQLWDVKRKETRAFHPGILLQ

SEQ ID NO: 27997 - protein, 81 aa, Desmodus rotundus
AEVGVTFADIAVYFSRKEWCLLDEDQRRLYLDVMLENFELVSSLGCCCGTEDVEVPIEQNVSVGVSQGKNSKVASSSRKNH

SEQ ID NO: 27998 - protein, 81 aa, Macaca fascicularis
TDVAVEFSLEEWQCLDTAQQNLYRNVMLENYRNLVFLGITVSKPDLITCLEKEKEPWNMKRYEMVDEPPVICSHFAEDFWP

SEQ ID NO: 27999 - protein, 81 aa, Macaca fascicularis
EMGLLTFRDIAIEFSLEEWQCLDRAQRNLYRDVMLENYRNLVSLGIAVSKPDLITCLEQNKEPRNIKRNEMVSKHPVTCSH

SEQ ID NO: 28000 - protein, 81 aa, Macaca fascicularis
DSVTFEDVAVDFTQEEWTLLDQTQRNLYRDVMLENYKNLVAVDWESHINTKWSAPQQNFLQGKTSSVVEMSHTLSPRLECS

SEQ ID NO: 28001 - protein, 81 aa, Macaca fascicularis
VAFEDVAIYFSQEEWELLDETQRLLYHDVMLENFAVMASLGCWCGADEGAPSAESISVSELSQGRTPKADTSTDKSHPCEI

SEQ ID NO: 28002 - protein, 81 aa, Phascolarctos cinereus
RRQILTFQDVTVDFTREEWRLLGPAQKDLFRKVMLENYENFVFLVGMPVFKPSVISKPERRETSWMREEEAAFSFEDSLIQ

SEQ ID NO: 28003 - protein, 81 aa, Phascolarctos cinereus
PEESVTFKDVAVEFTQEEWVQLNPSQKKLYKDVMLENYRNLVSLGFPVSKPDVIYQLERREASWMPEADISGSSCPGSREF

SEQ ID NO: 28004 - protein, 81 aa, Phascolarctos cinereus
EEAVTFRDVAVDFTEEEWGCLSPAQRELYWEVMLENYRNLVSLVWDTRLENQKLVETQEVSSGTFMGRGNILQNDLVEESP

SEQ ID NO: 28005 - protein, 81 aa, Phascolarctos cinereus
VQESVTFRDLAVDFDMEEWGYLCPSQKELYREVMLENYRHLVSLGLLEAKPDLISRLEQEEPQVWEVQEGASGSVCACTGG

SEQ ID NO: 28006 - protein, 81 aa, Phascolarctos cinereus
SQESLTFKDVAVDFTQEEWRQLDPGQRYLYKDVMLENYRNLVSVGHQVCKPDLISQLEQGKEPWIAETEIPRGTFSDWEIT

SEQ ID NO: 28007 - protein, 81 aa, Phascolarctos cinereus
AQELVTFKDVAVDFTQEEWGLLDHHQKELYKEVMLENVQNLLSLGLPVPREDLISYFEEKEAPWLLEHQGLRSCCPEGEIR

SEQ ID NO: 28008 - protein, 81 aa, Phascolarctos cinereus
SQESLTFKDVAVDFTQEEWGKLDSGQRYLYRDVMLENYRNLVSLGHQGSKPYVISQLEQGQEPWIVEREISRGNCKDWGTR

SEQ ID NO: 28009 - protein, 81 aa, Phascolarctos cinereus
PLKPVTFRDVAVTFSPEEWGHLGPSQKELYRQVMLENYGNLVCLGLALSKPDVIEQLERGEAPWRPEADVPGGSHADWEAR

SEQ ID NO: 28010 - protein, 81 aa, Oryctolagus cuniculus
ITFEDLAVYFTWEEWQHMNKAQKILHRDVMLETYSSLLFLGECDFFCLISVAMKSDDIIRTNQEIREKNVKQNVITNNKTS

SEQ ID NO: 28011 - protein, 81 aa, Oryctolagus cuniculus
SQRSVTFRDVAIDFSQEEWKWLQPAQRDLYRCVMLENYGHLVSLGLSISKPDLVSLLEQGKEPWLGKGDIRRNLFSVSEPT

SEQ ID NO: 28012 - protein, 81 aa, Oryctolagus cuniculus
MSYLTAAQRKLHREVTLENYRNLVSFGYQFAKPYIISCLEEEESCTIEEGSNAVIEEESHAVEEGSSTVRYQGYEKKPETK

SEQ ID NO: 28013 - protein, 81 aa, Oryctolagus cuniculus
LQAKVTFDDVAVLLSQEEWDQLGPAQRGLYRNVMMETYGNVVSLGIPGSKPIVISQLERGEDPWVLDGQGAEKSQRPGSNY

SEQ ID NO: 28014 - protein, 81 aa, Oryctolagus cuniculus
WKGLLSFKDISMEFTWEEWQLLDSTQKYLYRDVILENYSNLVSVGYHGTKPDLIFKLEQGEEPWIIAKISSQSCPEGWEEW

SEQ ID NO: 28015 - protein, 81 aa, Rhinolophus ferrumequinum
PVTFEDMAMYLTREEWRPLDPTQRDLYRDVMQENYGNVVSLDFEIRSENEVNPKQEISEDVEFGTASERPDGNTEENHESE

SEQ ID NO: 28016 - protein, 81 aa, Rhinolophus ferrumequinum
NFWVLRLPPGSKGEVPKEWGKLDEWQKELYKHVMRGNYETLVSLDYAISKPDILTRMERGEEPCPEGVWCQEEGKEREAAC

SEQ ID NO: 28017 - protein, 81 aa, Rhinolophus ferrumequinum
HQEMVTFEDVAVYLTQAEWAILSSTQRALYRSVMLENYGNLTSLGYPVPRPALISLLERGDLPWGLEAQDDPPAERTTLIY

SEQ ID NO: 28018 - protein, 81 aa, Rhinolophus ferrumequinum
MLENFRNLLSVGNQPFKPDLISQLEREEKTEKRLLTTETETQRDGCSGTKNQHNTERTQEVGLNYPSPEELSSWQTCQQGT

SEQ ID NO: 28019 - protein, 81 aa, Rhinolophus ferrumequinum
HTAGRLTFRDVAIDFSQEEWECLYTAERKLYTDVMLENYRNLCSLGLAVSKPDLVIFLERMKLAWAVKRKKTVSIHPGRWE

SEQ ID NO: 28020 - protein, 81 aa, Canis lupus
AQGQVNFEDVAVYFSPEEWGLLDEAQRLLYRDVMLENLALMASLGYESSMSHGFASLELGSKPWGSDWADVTPARTRDTQG

SEQ ID NO: 28021 - protein, 81 aa, Canis lupus
KDQELLTLEDVAVDFTWEEWQLLAPAQKNLYRDVMLENYSNLVSVGYVAGKPDALFRLEQGEPWATEDEIRSQIHPEIKKD

SEQ ID NO: 28022 - protein, 81 aa, Muntiacus muntjak
SQGPVTFEDVAVYFSQEEWRLLDETQRRLYCYVMLETFALVASLGLASSRSHVIVPLELGGEPWVQDRVDMTPGTARGAQS

SEQ ID NO: 28023 - protein, 81 aa, Muntiacus muntjak
SLGRLTFWDVAIDFTQEEWECLDLGQRELYTDVMVENYRNLASLGLVVSKPDLVTFLEQMKDLRNIRRMQTAVIYPAISPH

SEQ ID NO: 28024 - protein, 81 aa, Gorilla gorilla
PQGRLTFRDVAIEFSLEEWKCLNPVQRALYRAVMLENYRNLEFVDSSLKSMMEFSSTGQGNREVFHIGTLERHENHHTGDF

SEQ ID NO: 28025 - protein, 81 aa, Gorilla gorilla
SPDSMTFEDIIVDFTQEEWALLDTSQRKLFQDVMLENISHLVSIGKQLCKSVVLSQLEQVEKLSTQRISLLQGREFGIKHQ

SEQ ID NO: 28026 - protein, 81 aa, Ailuropoda melanoleuca
QGAVSFKDVTVDFSREEWQQLDLAQKSLYRDVMLENYFNLISVENLDKIIGCGNIFTHMNSHTETNACEYNQYKKLLSHKQ

SEQ ID NO: 28027 - protein, 81 aa, Ailuropoda melanoleuca
NQITVTFNDVAVDFIQEEWILLDLTQRSLYRHVMLENYQNLVAIGYQLPKPKLITWLEQQELRTVEKRVFQGELETSLVNE

SEQ ID NO: 28028 - protein, 81 aa, Phyllostomus discolor
VTFADIALYFSREEWRLLDEAQRCLYLDVMLENFELISSLGCCCGAKDVEEVTQQNVSVRMVKSENPKVALSSQKSHPCES

SEQ ID NO: 28029 - protein, 81 aa, Phyllostomus discolor
MAASQESLTFKDVSVDFSGEEWECLDPGQRKLYSDVMLENYSNLVSLGLVVSKPVLVTFLEEMRECWNVCRKKVISDPPGR

SEQ ID NO: 28030 - protein, 81 aa, Oryctolagus cuniculus
PFDRHAFEDLAVYFSWEEWQKMNNAQKILYRDVMLETYSSLFSLGHCTTKPDLIFKLERGAEPWMVEECLNQSLPGQSAHS

SEQ ID NO: 28031 - protein, 81 aa, Rhinopithecus bieti
RVETTKPDVILRLEQGKEPWLVEEEVLRNGRPEKNGDVGGQIWKPQDVKESLAREVPPINKEMLTTQKAVERTGSKKILEL

SEQ ID NO: 28032 - protein, 81 aa, Rhinopithecus bieti
VGQESVTFKDVAVLFTQEEWRQLSPAQRALYRDVMLENYSNLVSLGLLGPKPDMFSQLEKREAWMPEDTPGGFCLDWTTQP

SEQ ID NO: 28033 - protein, 81 aa, Rhinopithecus bieti
TFKEAVTFKDVAVVFTEEELGLLDSAQRKLYRDVMLENFRNLLSAGHQPFHQDTFHFLREDKFWMMETVTQREGNSGGKIQ

SEQ ID NO: 28034 - protein, 81 aa, Panthera pardus
MPFSSVTVAFTQDGWRRLIPAPKDRFKEGIPENTRNLVLLGLPVSQPGMNSQLEQREEGPWMLEGGGLRSTCTDWKIMSES

SEQ ID NO: 28035 - protein, 81 aa, Ailuropoda melanoleuca
VLFKDVAVDFSQEEWECLDLEQKDLYRDVMLENYSNLVSLDLPSRSANKDLSPKKDTYETELSQWEMSARLENCDLEESSS

SEQ ID NO: 28036 - protein, 81 aa, Ailuropoda melanoleuca
KVSRSLENDGVCFSEQEWENLEDWQKELYRNVMKSNYETLVSLKVLGQPEGEAELGAGMLGDLEEEGPAAEGVMIKQEIQY

SEQ ID NO: 28037 - protein, 81 aa, Ailuropoda melanoleuca
MLFEDLAVYFSQEEYVSLHPAQRSLSRDTIQECFEDMALMGGEGKTEISQQLNLESTGFEELAPGNSSITVPLVYYPEKSD

SEQ ID NO: 28038 - protein, 81 aa, Ailuropoda melanoleuca
GTVTFEDIAVSFSWEEWDLLDETQRHLYQDVMLENLALITSLDLQQQQKQHMSDKPFGNNRGRASVVKSCRLQVSGKPFIC

SEQ ID NO: 28039 - protein, 81 aa, Puma concolor
TFKEVVTFKDVAVVFTEEELGLLDPTQRKLYREVMLENFGNLVSVGHQPFKRDMVHLVREGKFWMMKLATQGKGNSGDKIQ

SEQ ID NO: 28040 - protein, 81 aa, Puma concolor
HQISVTFDDVALDFTQEEWILLDLSQRNLYRNVMLENYQNLVTVEYQLSKPKLIAWLEQQELRAVEQGILQEWETGLQTKG

SEQ ID NO: 28041 - protein, 81 aa, Sapajus apella
MDTVALEDVAVNFTQEEWALLGPSQKNLYRDVMQETIRNLDCIKMIYEDQNIEDQYKNPRRNLRCHMAERLSESKDNSQCG

SEQ ID NO: 28042 - protein, 81 aa, Sapajus apella
DSVAFEDVAINFTCEEWALLGPSQKSLYRDVMQETIRNLDCIGMKWQNLDIEEDEYKNPGRNLRCFMVERSCEIKDNSQCG

SEQ ID NO: 28043 - protein, 81 aa, Sapajus apella
MLENYRNLVFLGIAVCKPDLIICLEQEKEVWSRKSQEIMVAKPPVMRSHFAQHLWPGKNVKDSFQKVTLERYGKCRRENLP

SEQ ID NO: 28044 - protein, 81 aa, Sapajus apella
WLHEPMTFKDVAVEFTQEEWIMLDSAQRSLYKDVMLENYQNLTSVEYQLCKLTVISPLHQKEIRNMKKRNLQGLCPDQKIQ

SEQ ID NO: 28045 - protein, 81 aa, Sapajus apella
LQEPLEFMDVAIEFSLEEWHCLDTAQRNLYRDVMLENYRNLVFLGIVVSKPDLITWLEQGKKPLTVKRRGMIAAPPGMSSH

SEQ ID NO: 28046 - protein, 81 aa, Rhinopithecus bieti
MLFITTWDVAIEFSLKEWQCLDTAQRNLYRNVMLENYRNLVFLGIAVSKPDLIACLEQGKEAWSMKRHEIMVAKPPGWSAV

SEQ ID NO: 28047 - protein, 81 aa, Rhinopithecus bieti
SVMESVTLEDVAVEFIQEWALLGSARRSLCRYGMLDQCRTLTSRGTPPCKPSRVSQLGPRAEPRATERGILHATGIAWESQ

SEQ ID NO: 28048 - protein, 81 aa, Rhinopithecus bieti
MLENYRNLVFLGIVVSKPDLITCLEQGKKPLTMKRHEMIAKPPVMCSHFAQDVWSEQSIKDSFQKVILRRYEKCGHDNLQL

SEQ ID NO: 28049 - protein, 81 aa, Panthera pardus
RESGKAPVTFDDITVYLLQGEWMLLSQQQKEICGSDKLVAPLGPTIANPELFYKFERGPEPWVGSAQGQRNVLRHHPGPAA

SEQ ID NO: 28050 - protein, 81 aa, Panthera pardus
QESRMTLSQELLTFRDVAIEFSQEEWECLDPAQRALYRDVMLENYRTLVSLGEDSFPAEVGNCSRLPLCFFWEALESPCPV

SEQ ID NO: 28051 - protein, 81 aa, Panthera pardus
TVGLVSFKDVSVSFTQVERQWLDSAQKILYRVVMLENYSKLVSVGCLTIKPDVISQLERGEEPWIIEVMFSSQSLPAIHST

SEQ ID NO: 28052 - protein, 81 aa, Panthera pardus
LQGLLTFRDVAIEFSQKELRCLNHSQWELYRDVMLENYGHLHFLGLVVSKPDLVIFLEHKKDVWAMKRKETVATHPGIKPY

SEQ ID NO: 28053 - protein, 81 aa, Panthera pardus
LSQEPQKMNTPQDITVEFTQEEWQQMDSAQRTLYRDVMLENYSHLVSVASLFRSIWTYLRDFAGSIPDHHNEMNTTIQQVK

SEQ ID NO: 28054 - protein, 81 aa, Panthera pardus
IQGSLTFGDVAVAFTQIEWKHLDAAQRALYKDVMLENYGNLVSVGLLSSKPKLITRLEQGSEPRMEVQQVPSGTCSVQEYW

SEQ ID NO: 28055 - protein, 81 aa, Panthera pardus
PLTFKDVAVVFTEEELRLLDPTQRKLYRDVMLENFQNLLSLGDKNEKDLEYSQERELKCLSYRELSYWKIGEQAAAELTGS

SEQ ID NO: 28056 - protein, 81 aa, Panthera pardus
MLEDYRNLVSVGHQASKPDVLAKLERGEEPWAIEEEVRSGTSPETGKVDNHLQGHWEDERMLKGMELYPKHDAFGSIVPQS

SEQ ID NO: 28057 - protein, 81 aa, Panthera pardus
AQVSVTFDDVAVTFTQEEWGQLDPAQKTLYQEVMLENCGLLVSLGCPVPRPELICQLERGQELWTAKRGLSQNTYPGDKGK

SEQ ID NO: 28058 - protein, 81 aa, Panthera pardus
VQKFVSFKDVTVDFTWEEWQQLDSAQRNLYRDVMLENYSNLVSVDFETGMKELTTQKSISEEVVLYNMIVYSTFEDWKLED

SEQ ID NO: 28059 - protein, 81 aa, Macaca nemestrina
QAEVTFEDVAVFLSREEWGRLGPAQRGLYRDVMLETYGNLVSLGVGPAGPKPGVISQLERGDEPWVLDVQGTSRREHLKVN

SEQ ID NO: 28060 - protein, 81 aa, Macaca nemestrina
MVSFEDVAVLLSQEEWDCLIPAQRGLYRDVMLETYGNLVSLGLQASKPDVISRLEQGDKPWTPHILRTQRSWSWRHKRECY

SEQ ID NO: 28061 - protein, 81 aa, Macaca nemestrina
TCDEAVTFKDVAVVFTEEELELLDPAQRKLYRDVMLENFRNLLSVGYQPFHGDTFHFLREEKFWVMETTSQREGTSGKIQT

SEQ ID NO: 28062 - protein, 81 aa, Ursus arctos
QGSVTFEDVVVYFSWEEWGLLDETQRCLYHDVMLENFALVISLGCWYGMEDEEAVSVQQMSLGRTPSPEPSLWKVQPCEKC

SEQ ID NO: 28063 - protein, 81 aa, Muntiacus reevesi
HCGLMTFEDVAVDFTQEEWQYLNPPQRTLYRDVMLETYSNLVSVGHHITKPDLILKLEVEERCLLEGKIPIWSFPAPWPQG

SEQ ID NO: 28064 - protein, 81 aa, Muntiacus reevesi
LSTQLTVEDVDIKFTPEEWECLDPAQRTLYRDVMEETYRNLLSVGIGPRLPDCSSCIHMTKKLQAKENSGKGEILQRVMCG

SEQ ID NO: 28065 - protein, 81 aa, Muntiacus reevesi
GSFSFEDLSVDFTQKEWQLLDPYQKDLYKDVMLENYSSLVSLGYEIMKPGVILKLEQGEEPWTGDGEIPSSDSLDQVFQVN

SEQ ID NO: 28066 - protein, 81 aa, Muntiacus reevesi
VSVTFEDVAVYFSWEEWGLLDDAQRCLYHSVMLENLSLVISLGCWHGVEDEEAPSEQNISIHGLSQVRIPKAGMFSQKAHF

SEQ ID NO: 28067 - protein, 81 aa, Muntiacus reevesi
LERLTSEDVAIEFTQEEWEFLDPAQRALYRDVMLETYRNLLSVDISPTHVIKHLQLKVNSDKREPFQTLMLGRSESHEIKH

SEQ ID NO: 28068 - protein, 81 aa, Eschrichtius robustus
YQTPKPDSLSQLEQGEPPWTVEGAGQSQTYPEEIWEIDPMQWHPENQNGIKTLERYQQSYALGNNFDLCKSLLPLTQRYNN

SEQ ID NO: 28069 - protein, 81 aa, Myotis brandtii
MLENYGHLVSLGFNISKPDVVSLLEQGKEPWLGKGDVRTDFFPVSESNGEIRKFSPKNVIYEEDFPQYLIKENHRSQGPEH

SEQ ID NO: 28070 - protein, 81 aa, Camelus ferus
MPEAVIVLSVFAFGLDSKAETLFPLAPEGIPFSKPKLITQLEQGRETWKEERKGPPGPCPEQGIGSYRRTRQSGFGSSVSI

SEQ ID NO: 28071 - protein, 81 aa, Myotis brandtii
DKTIIAFGDVAVAFTEREWKLLSPAQRTLYRDVMLETYSHLVSLGIAFSKPKFITQLEQGDEPWREESECLLELCPEPRTE

SEQ ID NO: 28072 - protein, 81 aa, Propithecus coquereli
LELLTFRDVAIEFSPEEWECLDTAQQNLYRDVMSENYRNLVSVELAVYKLDLLTFLKQMKEAWNVKREETVAKHPETRSRL

SEQ ID NO: 28073 - protein, 81 aa, Propithecus coquereli
EAVTFKDVAVVFTEEELGLLDSAQRRLYRDVTLENFRNLLSVGCQPFKLDTPLQLGREEKLWVTEAETQGDGCSGHRNQNE

SEQ ID NO: 28074 - protein, 81 aa, Propithecus coquereli
TFKEAVTFEDVAVVFTQEELSLLEPGQRKLYRDVMLENFRNLLSVEHQPFLQDTFHVLREEKFWMMKTATHREGNSGKNQA

SEQ ID NO: 28075 - protein, 81 aa, Oryctolagus cuniculus
VTITFKDLAVRFSEEEWRLLEERQREFYREVMRENYETLVSVGGKPQHSLHLTALVQLVKEIPEFLFREVKGTVDSPESRG

SEQ ID NO: 28076 - protein, 81 aa, Pteropus alecto
AQGLMVFEDVAVYFCEEEWDLLDAAQRALYCHVMLENFALVASLGLSASRPRVVIQLERGEEPWVLSGTDVTLARNAQRRP

SEQ ID NO: 28077 - protein, 81 aa, Pteropus alecto
ILPESQSLLAFEEVAVYFSQEEWELLDPSQRALYNDVMQENYETVISLDNVERTDYLKEADAFVALAGPLRSSALVVVMLT

SEQ ID NO: 28078 - protein, 81 aa, Oryctolagus cuniculus
MGYCTTKPDLIFKLERGAEPWMVDECLNRSLPVVMKRDDLIRINQENQDKNLNQDFMENNKTSALKRVELRKTPSLNSSHI

SEQ ID NO: 28079 - protein, 81 aa, Pteropus alecto
HTESVTFEDVAVTFTLEEWALLDPSQKKLQRCDAGNHQEPDLSGSHKVKRICEEKKGSQCGENFSSMPNLNLKKKTLPGVK

SEQ ID NO: 28080 - protein, 81 aa, Macaca nemestrina
MESLTLRDVAVDFTWEEWQLLGPAQKHLYRDVMLENYSNFVSVGFQASKPDALTKLEQGEPLWALEDEIHSPTHPEIEKAD

SEQ ID NO: 28081 - protein, 81 aa, Macaca nemestrina
MDTVVFEDVVVGFTLEEWALLNPAQRNLYREVMLETFKHLASVDNKTHFKASGSVSQQDTYREEKSKEQTIPNFTRNNSCA

SEQ ID NO: 28082 - protein, 81 aa, Muntiacus reevesi
ESVTFEDIAVDFTQEEWALLDTSQRKLFRDVMLENISHLVSVGNQLYKSDVISHLEQGEQLSRKKLGFLQGQSPVISDRED

SEQ ID NO: 28083 - protein, 81 aa, Muntiacus reevesi
EAPKVPFDDVAVYFSEQEWSKLDEWQKELYKHVMRGNYETLVSLDYAISKPEVLSQIEQGKEPCSWRRAGPKVPDVPVDPS

SEQ ID NO: 28084 - protein, 81 aa, Ursus americanus
RNIVTFEDVCIYFSPEEWELLDEAQKRLYCNVILENFLLVTSLGLAISRYHLIPQLLSVTMGNGPPTGVVAISRGTWPLLN

SEQ ID NO: 28085 - protein, 81 aa, Ursus americanus
NLDWGTFEDVAVYFSREEWELLDETQRHLYHNVMLENLALMASLGKALPPPMEEAPLEQSVSVEGALHLRTPKVCPSTQKA

SEQ ID NO: 28086 - protein, 81 aa, Myotis brandtii
MSFEDVTIAFSQEEWGLLDAAERLLYCEVMLEICTLVASVGYWHKPADEEAPCEQIASADPEPQPALGTEEPHSVIESWQP

SEQ ID NO: 28087 - protein, 81 aa, Myotis brandtii
SVDITPLSGRLGMELLQEPLTFHDVAVDFTWEEWQLLGPEQKDLYRDVMLETYSHLVSVGEDSSPVSVRWASVSGLSILSF

SEQ ID NO: 28088 - protein, 81 aa, Camelus ferus
ESVTFRDVAVFFSRDEWLHLNPAQRALYREVMLDNYSALVSLVGGRAGVRLGGAVCGAGAVGQEAVRCARLDITGPRDTRG

SEQ ID NO: 28089 - protein, 81 aa, Myotis brandtii
AQGLVTFEDVAVDFTQEEWQYLNSPQRILYRDVMLETYSNLVSVAGKQATKPDLILNLEVEEPCLAEGKIPIWSFPEETCQ

SEQ ID NO: 28090 - protein, 81 aa, Myotis brandtii
PQGQLTFSDVAIEFSQEEWACLDPAQRKLYVDVMLQNYRNLVFLGLVVSKPDLVTFLEHMMEPWELKRKETISSQPVMSSQ

SEQ ID NO: 28091 - protein, 81 aa, Oryctolagus cuniculus
KKVMITFEDLAVYFTWEEWQHMNKAQKILYRDVMLETYSSLLFLGHCITKPDLIFKLEQGAEPWMVNEFLNQNLPVAMKSD

SEQ ID NO: 28092 - protein, 81 aa, Oryctolagus cuniculus
LQDLVTFEDVAVEFSQEEWALLDPSQRMLYRDVMLENRKNLASLGCHVDKPKLITHLEQEDRLIPEERSLLPDTCPDLEPV

SEQ ID NO: 28093 - protein, 81 aa, Pteropus alecto
KGSVTFEDVAVYFSQEEWRLLDEAQRLLYRDVMLEVFALAVSLGTWHGTESPSEQNGFEEESQENTSQACPWKLCGLALES

SEQ ID NO: 28094 - protein, 81 aa, Pteropus alecto
VLFEDVAVDFSQEEWALLDLTQKSLYRDVMLENFQNLASLGFETRFKANESVTSQDIHGEKKSSEQGIVRFRRNDSWSSIL

SEQ ID NO: 28095 - protein, 81 aa, Pteropus alecto
TVLLTPASQKSVLIGDMAEALTQWGQRHPPRGHMQEKHRNLVLLGLPISKPGVISQVEHGEELERKVPKATSPGEPVVEMG

SEQ ID NO: 28096 - protein, 81 aa, Pteropus alecto
MQRTLYRDVMLENYSHLVSVGCQVTKPAVISRLEQGQEPWVEEEEILGWGFPEEVLQVDTQVDRQQKHQDKLLRQVSFLDR

SEQ ID NO: 28097 - protein, 81 aa, Pteropus alecto
SQGLLIFRDVAIEFSQEEWECLDTAQRALYRDVMSENYRNLVFLGLAVSKSDPIIFLEQMKEPWDLKRKKTISIHPGPVLF

SEQ ID NO: 28098 - protein, 81 aa, Rhinolophus ferrumequinum
SLGLVSFKDVTVDFSREEWQQLDLTQKSLYRDVMLENYFNLISVGCGVPKPKVIFNLEQVEKPCMLDGEASSQSCLDGDIG

SEQ ID NO: 28099 - protein, 81 aa, Rhinolophus ferrumequinum
GVMESVTFEDVAVRLIQDWALLDGARRNLCRYGKLDNCRTLAPGGTPPCKPRLVSQVGPREEQRAAERGILRAMGVDWESQ

SEQ ID NO: 28100 - protein, 81 aa, Panthera pardus
AHHLVMFRDVAVDFSQEEWECLNSYQRNLYRDVILENYSNLVSVGYTISKPDVITLLEQGKEPWMVVRDERRRRSLALRSL

SEQ ID NO: 28101 - protein, 81 aa, Rhinopithecus bieti
RDVAIDFSQEEWEFLDPAQRDLYRDVMWENYNNFISLGPSISKPDVITLLDEEGKEPGMVVREGTRRYCPDLESRYKTNTL

SEQ ID NO: 28102 - protein, 81 aa, Panthera pardus
RKVQESRMTLSQELLTFRDVAIEFSQEEWECLDPAQRALYRDVMLENYRTLVSLAVQELGLVYGKAAGHHLPVSMSARPSF

SEQ ID NO: 28103 - protein, 81 aa, Panthera pardus
LQSPVTFEDVAVYFSKEEWGLLDAGQRDLYHNVMLENFQLMTSLGCWHGVEDEGAHSKKNASIQGMLQVRIPTANPSTQKA

SEQ ID NO: 28104 - protein, 81 aa, Panthera pardus
TQASVSFKDVTVEFTQEEWQQMGPIQRTLYRDVMLENYNNLVSVGNCIFKPAVIFKLEQGEEPWFLEEEFLNQSHQEDYRD

SEQ ID NO: 28105 - protein, 81 aa, Panthera pardus
VQGQVNFEDVAVYFSREEWGLLDEAQRLLYRDVMLENLALTASLGSRHGTEDEETAVEQNISVGVSQVRTPKAGPSTQKAH

SEQ ID NO: 28106 - protein, 81 aa, Panthera pardus
SSQTLLTFRDVAIEFSQEEWGCLNHSQRELFRDVILETYGHLLFVGLVSKPDLVIVLEQKKELWGVKRKETVASHPGRVHA

SEQ ID NO: 28107 - protein, 81 aa, Macaca nemestrina
GTVTFEDVAVNFTQEEWNLLSEAQRCLYRDVTLENLALISSLGCWCGVEDEAPSKQSIYIQRETQVRILMAGVSLKKVHPC

SEQ ID NO: 28108 - protein, 81 aa, Macaca nemestrina
SQEPVTFADVAVVFTPEEWVFLDSTQRSLYRDVMLENYRNLASVADQLCKPNASSYLEQRGEQWTTDRGILADTCAEPQLQ

SEQ ID NO: 28109 - protein, 81 aa, Macaca nemestrina
MNSVAFEDVAVNFTQEEWALLDPSQKSLYRDVMQETFRNLASIGNKGKDQSIEDQYKNSSRNLSSFQMHQRNHTGEKPYEC

SEQ ID NO: 28110 - protein, 81 aa, Ursus arctos
VTFEDVAVYFSWKEWRLLDEAQRRLYHRVMLENFTLTSSLGCCCGAEGEEAPFAQSTTVGASQAGTPAAAVSSRKTHPCEL

SEQ ID NO: 28111 - protein, 81 aa, Ursus americanus
FQGSLSFRDVAVGFTQKEWQQLEPAQRTLYRDVMLENYSHLVSVGEEITKPAVISRLEQGQEPWMEEEEILRWSFPGERGS

SEQ ID NO: 28112 - protein, 81 aa, Eschrichtius robustus
MTFEDVAVDFTQEEWQYLNPPQRNLYRDVMLETYSNLLSVGYEGTKPYVILRLEQEEAPWICEASCSGCHCWENIWQGNVQ

SEQ ID NO: 28113 - protein, 81 aa, Myotis brandtii
MAMYLTREEWRPLDPTQRDLYRDVMQENYGNVVSLDFEIRSENEVNPKQEISEDVELGTASERPVGNTEENPESEEAFESR

SEQ ID NO: 28114 - protein, 81 aa, Myotis brandtii
PLVGLKFEDVAIFFSQKEWECLHSTQKDLYRDIMLENYNNLISLGLCYSMPDVISLLEQGKEPWIVKRKEAKEWCPDWESR

SEQ ID NO: 28115 - protein, 81 aa, Myotis brandtii
LQGSVTFKDVIVEFTKEEWQLLDEAQRALYKEVMRENYRHLVSVGYFVNKSNAVLKLKQGKEPWILEVEFPHQNYTGLENP

SEQ ID NO: 28116 - protein, 81 aa, Rhinopithecus bieti
MDTVAFEDVAVNFTQEEWALLGPSQKNLYRYVMQETIRNLDCIRKIWEGQNTEDQNKNPRRNLPGAGHLSLNSHIRVDAGY

SEQ ID NO: 28117 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPREKRVLGSFL

SEQ ID NO: 28118 - protein, 81 aa, Panthera pardus
AHRSLMFSDVSIVFSQEEWEYLDLEQRDLYRDVMLENYSNLVSLGCFISKPDVISLLEQGKEPWKVVRKGRRRYAAPMSIA

SEQ ID NO: 28119 - protein, 81 aa, Panthera pardus
SSQGLLTFRDVAVEFSQEEWGCLNHSQKELYWDVMLETYGHLLFLGLVVSKPDLVIFLEQKRELWDIKREETVATHPGRWE

SEQ ID NO: 28120 - protein, 81 aa, Panthera pardus
AHQLMMFRDIAVDLSQEEWECLDLEQRHLYRDVMLENYSNMISLGLCIYQPDVFCLLEKGKEPWIFLQDETRGHCPDMPFR

SEQ ID NO: 28121 - protein, 81 aa, Macaca nemestrina
GTVTFEDVAVNFTQEEWNLLSEAQRCLYRDVMLENLALISSLGCWCGVEDEEGPSKQSIYIQRETQIRIPMAGVSLKKVHP

SEQ ID NO: 28122 - protein, 81 aa, Ursus arctos
VTFEDIAVYFSWEEWRLLDEAQRCLYHDVMLETFTLISSLGCCCGAEDAEAPFAQSTSVGASQTGTPTAAVSSRKTHPCEM

SEQ ID NO: 28123 - protein, 81 aa, Muntiacus reevesi
ISGRLMFQDVAIDFTQEEWECLDLGQRDLYRDVMLETYGNLASLGLVVSKPDLVTFLEQMKTPWGVRRTDTTATYPGLSLN

SEQ ID NO: 28124 - protein, 81 aa, Myotis brandtii
DVNFEDVAIAFSQEEWGLLDEPQRLLYCDVMLEVFALISSVGTWHLHCTASWDADSPLRGSGAETSTRTSVPGLQQPSAFT

SEQ ID NO: 28125 - protein, 81 aa, Myotis brandtii
QELPVVFEEVAVYFTREEWGVLDQRQKELYRDVMRMNYELLASLGPVATKPDLISKLEHRAAPWIKDPKGTKWGKGCSPGK

SEQ ID NO: 28126 - protein, 81 aa, Myotis brandtii
LPDPVTFDDVAVYFSLEEWGLLDEAQRRLYHEVMLENLALASSLGPCCGSEDADAPCEQSASVGGSPSSPSKAAVSSLKTH

SEQ ID NO: 28127 - protein, 81 aa, Myotis brandtii
SQGPLTFRDVAVDFSQKEWECLDPSQRKLYVDVMLDNYENLVSMGLAVSEPDLATFFEQMMENWDAKGKMTVLTHPAMPSE

SEQ ID NO: 28128 - protein, 81 aa, Myotis brandtii
GQRDMNFEDVAIAFSQEEWGLLDEAQRLLCYDVMLEVFAVVSSVGCWHKTDDVEACSEQNASIEGESLVSASKTPPTTQKS

SEQ ID NO: 28129 - protein, 81 aa, Propithecus coquereli
FQESVTFKDVIVDFTQEEWKQLDPVQRDLFRDVTLENYTHLVSIGLQVSKPDVISQLEQGTEPWVIESGIPVGTFADWETR

SEQ ID NO: 28130 - protein, 81 aa, Pteropus alecto
NFWVLRLPPGSKAEAPKEWGKLDEWQKELYKHVMRGNYETLVSLDYAISKPEVLSQTEQAKEPCSWRRAGPKVPDVPVDPS

SEQ ID NO: 28131 - protein, 81 aa, Pteropus alecto
SMTFTDVAIDFSQDEWEWLNLAQRTLYKKVMLENYRNLVSVDLEYVWIVKELSADFDIHEEKLSQAMIMERLTSYDLECST

SEQ ID NO: 28132 - protein, 81 aa, Pteropus alecto
FYELVTFEDVAVYFSENEWTCLAPAQRVLYKDVMLENYGAVASLAFPFPKPALISQLGRGEAPWCSATQGALDGEAPRAIS

SEQ ID NO: 28133 - protein, 81 aa, Oryctolagus cuniculus
FEELVMFSDVAIEFSEEEWECLGPAQRDLYRDVMLENYGNFVSLGLAISKPSVISLLEQGKEPWMAEKAEWYPELPSRYET

SEQ ID NO: 28134 - protein, 81 aa, Panthera pardus
QDSVTFEEVAVDFSQEEWALLDPTQKILYRDVMLENYRNLASVGLDIQLKSKDAFPVQNVPREKTCNDIKTQVPTKPSKKP

SEQ ID NO: 28135 - protein, 81 aa, Panthera pardus
AQGCVISEDVFVYFSWEEWMLLDDSQRLLYQDVMLENFALLASLGIAPSTSRLVAQPKQREDPWVPDRVDVTPATEREAQK

SEQ ID NO: 28136 - protein, 81 aa, Panthera pardus
FQEPVMFKDVAVVFSEEELGLLGPTQRKLYRDVMLENFRNLVSVGNQPFKPELVSQLEREEKLLMMETETQRDGCLGAKSQ

SEQ ID NO: 28137 - protein, 81 aa, Macaca nemestrina
PQGLLTFRDVAIEFSQEEWKCLDPAQRTLYRDVMLENYRNLVSLAISSKCMMNMFSSTGQGNTEVIHTGTLQRQASHHIGD

SEQ ID NO: 28138 - protein, 81 aa, Macaca nemestrina
QDSVTFDDVAVDFTPEEWALLDTAEKYYRDVMLENYINLASVGKSNITLLEWEIQPRIKGSSLQQGFLKNPIFNGIQMVRF

SEQ ID NO: 28139 - protein, 81 aa, Ursus arctos
SQGLLTFKDISVDFTQEEWGHLAPAHRNLYREVMLENYGNLVSVGCQLSKPGVISQLEKGEEPWLIEREISGSPGSDLENK

SEQ ID NO: 28140 - protein, 81 aa, Ursus arctos
VTFEDVAVIFTDEEWRHLVPIQRDLYKEVMLENYKIIVSLDWATKPEIHGASEEESEGTARGKLGGEVPVCPKFEAHALEG

SEQ ID NO: 28141 - protein, 81 aa, Muntiacus reevesi
RAETLSFKDVAVDFTWEEWQLLAPAQKTLYRDVMLENYSNLVSMGYRVSKSDVLSKIEQGEGQWMTEDEIHSHTWPETGSV

SEQ ID NO: 28142 - protein, 81 aa, Muntiacus reevesi
FKVSVSFEDVAVDFTRQEWHRLDLAQRTMHRDVMLENYSNLVSVGLCVAKPEMIFKLERGEELWILEEESSDHGYTGGNSS

SEQ ID NO: 28143 - protein, 81 aa, Ursus americanus
LTFRDVAIEFSQEEWECLDPAQRELYRDVMLENYRNLVSLGEENVPPEVGVYPWVSLHFPLSVFWGPLSCLTEIEALLTQK

SEQ ID NO: 28144 - protein, 81 aa, Ursus americanus
CGVTFEDVAVYFSWKEWRLLDEAQRRLYHRVMLENFTLISSLGKGLTVWSSLESTFPRLAGAHAKSQQQQEEHTEEKPFRC

SEQ ID NO: 28145 - protein, 81 aa, Ursus americanus
KSGLVTFEDVAVYFSLEEWERLDVDQRDLYKDVMQENYGILVSLGYPIPKPDLIFRLEQGEEPWVPDSPPPPIPTPSATWQ

SEQ ID NO: 28146 - protein, 81 aa, Ursus americanus
AGYQAPKPDMISKLQKGEEPWLGKGKRPKQDGPSELARPKQIGTNRNELQQGNAQLGNDQESQNKLLKEVTFKKKSLTKKK

SEQ ID NO: 28147 - protein, 81 aa, Myotis brandtii
AKVPVSFEDVSVHFSKTEWKLLDLKQRILYKQVMLENYRHLVSLGFSSSKPHLVSLLERGEWPWVTDSRTRAAVGTQADER

SEQ ID NO: 28148 - protein, 81 aa, Saimiri boliviensis
PQVSLTFEDVAVLFTRDEWRKLAPSQRNLYRDVMLENYRNLVSLGLPFTKPKVISLLQQGEDPWKVEKDSSGGCSPGCKSN

SEQ ID NO: 28149 - protein, 81 aa, Oryctolagus cuniculus
LPGLMAFEDVAVYFSQEEWGLLDAVQRALYRHVMLENFALVASLGLSASPPHVVIQLQRGEEPWVPSGLDMTSARNGHRRP

SEQ ID NO: 28150 - protein, 81 aa, Oryctolagus cuniculus
STVMIAFEDLAVYFTWEEWQNMNKAQKILYRDEMLETYSSLLFLGHCITKPDLIFKLEQGAEPWMVSEFLNQNLPVAMKTS

SEQ ID NO: 28151 - protein, 81 aa, Oryctolagus cuniculus
TARSQTTVTFKDVAMDFTLEEWEKLGPTQRAVLLENYRNLVSLWLPISKPESYNLENGKEPLMLERKVPSSSYLGENLNSF

SEQ ID NO: 28152 - protein, 81 aa, Rhinolophus ferrumequinum
PQGSVSFKDVTVDFTQEEWQQLDPDQKALYRDVMLENYCHLISVGFHMTKPDMIRKLEEGEELWTTERIFPNQSYLEEDGK

SEQ ID NO: 28153 - protein, 81 aa, Rhinolophus ferrumequinum
GEPRRAPVTFDDITVYLLQEEWMLLSQQQKICGSDKMLAPLGPTIANPELFCKFKRGPGPWLGNVRGQRDLLRCHPGKNKM

SEQ ID NO: 28154 - protein, 81 aa, Rhinolophus ferrumequinum
EAFVSFPDVAVDFTQEEWQLLNHAERTLYRDVMLENYSNLCCSADPKPETQPYSSCPLDFCSQRLCQQVLHDHRLSSSPGM

SEQ ID NO: 28155 - protein, 81 aa, Rhinolophus ferrumequinum
MGHRVMWPLRQHLLLRALKAEQLVQVHVHFPLTGYDSTKPNVIVKLEQGEEPWIAEGDLPCQSPEEVWKVDDMTNRIQETE

SEQ ID NO: 28156 - protein, 81 aa, Rhinopithecus bieti
TFKEAVTFKDVAVVFTEEELGLLDSAQRKLYRDVMLENFRNLLSAGHQPFHGDTFHFLREEKFWVMETTSQREGNSGKSQT

SEQ ID NO: 28157 - protein, 81 aa, Rhinopithecus bieti
MLENYGHLVSLGLSISKPDVVSLLEQGKEPWLGKRNVKRDLFSASESSGEIKDFSPKNVIYDDSSQYLIMERILSQGPMYS

SEQ ID NO: 28158 - protein, 81 aa, Panthera pardus
SQGLLTFRDVAIEFSQEELRCLNHSQWELYRDVMLENYGHLLFLGLVVSKPDLVIFLEHKKDVWAVERKETVVTHPGHQRI

SEQ ID NO: 28159 - protein, 81 aa, Panthera pardus
MAFEDVAVYFSQEEWELLDAAHVMLENCHVMLENFALVSSLGLSASRPRVVLQLERGEEPWVLSGTVVTPARNAQRKPSPG

SEQ ID NO: 28160 - protein, 81 aa, Macaca nemestrina
WSQMPVTFEDVALYLSREEWGRLDHTQQNFYRDVLQKGNGLSLGFPFSRPFWAPQALGKGEASGSSRQTGDEKEEWRGAYS

SEQ ID NO: 28161 - protein, 81 aa, Ursus arctos
RKGFVIFRDVSIDFSQEEWECLDSTQRNLYKYVMLENYSNLVSVGLCIPKPDVISLLEQGKEPWSVFDSELTRGLYLEEET

SEQ ID NO: 28162 - protein, 81 aa, Ursus arctos
QLVTFKDVAVDFTQEEWQQLEPAQRDLYRDVMLENFQNLSSLDLESRPDRDGPEEAMEELGGSRLWHSKGGGPRDPRNPDW

SEQ ID NO: 28163 - protein, 81 aa, Muntiacus reevesi
SQDSVTFADVAVNFTQEEWTLLDCFQRKLYRDVMLENYKNLTTAGYQVFKPTLISWLEEEELSTVERGILQEWGMQLKAKD

SEQ ID NO: 28164 - protein, 81 aa, Muntiacus reevesi
FQGSVSFKDVTVGFTQEEWQHLDSTQRSLYRDVMLENYRNLISVEVCKTDGMKERSQENQPKHIWKVVLINNKSLTKEQGN

SEQ ID NO: 28165 - protein, 81 aa, Muntiacus reevesi
ALNRVTFEDVAVYFSQEEWCLLDEAQIQLYLDVMLENFALVCMLGSWSGAGDEDTPFEQSKSVGVSQIGTPRADSSAENVQ

SEQ ID NO: 28166 - protein, 81 aa, Muntiacus reevesi
AVTFTDVAVDFSQDEWEWLTLAQRTLYKKVMIENYSNLASLGLCVSKPDVICLLEQDKEPWTMKGELTRGPCADLEYVWMK

SEQ ID NO: 28167 - protein, 81 aa, Muntiacus reevesi
MGRLTFRDVAIDFTQEEWECLDLGQRELYRDVMFENYGNLASLGLVSKLDLVAFLEQLKAPRNIRRMKTATSYLAITPQDT

SEQ ID NO: 28168 - protein, 81 aa, Ursus americanus
LLTFGDVAIEFSQEEWGCLSHTQRELYRDVMLENYGHLLFLGEDDSCQISQAPLGVSLRNEQSTKWGPYERCFTEGSTPQN

SEQ ID NO: 28169 - protein, 81 aa, Ursus americanus
SNWGLLTFGDVAIEFSQEEWQCLSHTQRELYSDVVLENYGHLLFLGLIVSKPDLVSFLEQRKELWDEKRNKTVVFDPGRWE

SEQ ID NO: 28170 - protein, 81 aa, Oryctolagus cuniculus
CQGSVTFDDVAVVFTDEEWRHLIPVQRDLYKEVMLENYKSIVSLGLPVPQPDVIFQLKRRDETWIADLHGPEQREWPESIS

SEQ ID NO: 28171 - protein, 81 aa, Oryctolagus cuniculus
MPVTFEDVALYLSREEWGRLDHTQQDFYRDVLPKRNGLALGFPFGRPFWAAHVPGKGEALSSGRPAGEAKEKRGACAESLE

SEQ ID NO: 28172 - protein, 81 aa, Rhinolophus ferrumequinum
SQASVTFKDVTVEFTQEEWQRLGPAQRALYRDVMLEIYSHLVSVGNCIYKPGVIFKLEQREDPWFLEEEVSNQSHQEHYRD

SEQ ID NO: 28173 - protein, 81 aa, Rhinolophus ferrumequinum
AGYQVSKPEVIFKLEQGQEPWLSEGEIRRPFCPDWKTRPEAKSSNLQQNISEVSLSTDDLSHATSEDAWDTSSRLERHQEN

SEQ ID NO: 28174 - protein, 81 aa, Panthera pardus
MDSSQEEWTLLDQTQIALYRDAMLENYQNLITLDLRPSEVDRDSLEREADGHNGATQDHHRSLSGSGYNSPNEHFQLFPLP

SEQ ID NO: 28175 - protein, 81 aa, Panthera pardus
CEVSVSFEDVTMDFSREEWEQLDPAQRCLYWDVMLEICSHLLSLGYPIPRPEMIFRMEKEEEPWIREAQLPHQWRPEGEFG

SEQ ID NO: 28176 - protein, 81 aa, Panthera pardus
MQENCRNLASLGCHVDKPSLTSQLEQEDKVMTQERGILPGTCPGLETVLKAKWLTPKKHVFRKEHSNGIKAERNHLGVKVN

SEQ ID NO: 28177 - protein, 81 aa, Panthera pardus
MAQESVMFSDVSIDFSQEEWECLNDDQKDLYRDVMLENYSHLVSMDVISFLEQGKEPWLVDRELTRDQWPVLESRCETKKL

SEQ ID NO: 28178 - protein, 81 aa, Panthera pardus
QELVTFEDVAVAFSREEWALLDPAQKRLYREVMLETYRNLAALDLAAILKSQESSCKKVVWGEEPPSGIVKLPKGDWGCGQ

SEQ ID NO: 28179 - protein, 81 aa, Macaca nemestrina
MGPLQFRDVAIEFSLEEWHCLDTAQRNLYRNVMLENYRNLVFLETGFHHVGKAGLKLLTSDDLPALASESTGITGMRHAFP

SEQ ID NO: 28180 - protein, 81 aa, Macaca nemestrina
MGALTFRDVAIEFSLEEWQCLDTEQQNLYRKVMLENYRNLVFLGIAVSKRDLIPCLEQEKEPWNVKTHDMVAKPPVICSRI

SEQ ID NO: 28181 - protein, 81 aa, Macaca nemestrina
MLETYSHLLSVGYQVPKPEVVMLEQGKEPWALQGERPRQSCPGEKLWDHNQCRKILTYKQVSSQPQKVYPGEKPYECAEFE

SEQ ID NO: 28182 - protein, 81 aa, Macaca nemestrina
AHELVMFRDVAIDVSQEEWECLNPEQRNLYKEVMLENYSNLVSLGLSVSKPAIISSLEQGKEPWMVVREETGRWCPDLASR

SEQ ID NO: 28183 - protein, 81 aa, Ursus arctos
MLENYSHLVSLGYSISKPEVILKLEQGEEPWILEEEFPSQSDLELIKSRNYSRKKFNEFNKGRNWLHNKYERIHSEEKPYE

SEQ ID NO: 28184 - protein, 81 aa, Ursus americanus
QGRLTFRDVAIEFSPEEWECLDPAQRALYRDVMVENYRNLVSLGEDSFPPEVGNYFCMPLRFVLRAPDLICMNFRSPFLRE

SEQ ID NO: 28185 - protein, 81 aa, Ursus americanus
MLFVSSPELPNPCPFLYLLLCTGHQLPKPDVILQLEKGEEPWLVERGIHRETHPDLETTVEIKSSISSKSISKNKQSYGIK

SEQ ID NO: 28186 - protein, 81 aa, Pteropus alecto
SVTFRDVTVDFTQEEWQQLEPAQKALYRDVMLETYRNLVSLDLETRPDMKESDPKEAILEDRPSMGVVVEGPTRTGVWGSA

SEQ ID NO: 28187 - protein, 81 aa, Rhinolophus ferrumequinum
EAVTFGDVAVHFSREEWQCLDPGQRALYKEVMLENHSSVAGLGSMISTEGEQSREDADALQSESPATMFRSAPQACPRSPG

SEQ ID NO: 28188 - protein, 81 aa, Rhinolophus ferrumequinum
ILVPVTFRDVAVVFTEAEWKRLSSEQRNLYKEVMLENYRNLLSLGEAVFFPSLIQWRFIYHLLVSSRVSLLAESKPETDPC

SEQ ID NO: 28189 - protein, 81 aa, Rhinopithecus bieti
RPWEGKPRYLGPVTFEDVAVLFTEAEWKRLNLEQRNLFEEVMLENLRNLVSLGEDIYQECFSIIQHLDHLKFFCKFESGFR

SEQ ID NO: 28190 - protein, 81 aa, Rhinopithecus bieti
TKVSITFKDLAVRFSEEEWRLLEEGQREFYRDVMRENYETLVSVGTAELLPLSAFLSPSEPGGAVVGGSHADEGQEPAGGG

SEQ ID NO: 28191 - protein, 81 aa, Panthera pardus
SQEPVTFEDVAVYFTRNQWTSLDPMQRALYREVMLENYANITSLGGKNKTAKGEQTPRPDVSGASAAQRLAVEGLLPDGPQ

SEQ ID NO: 28192 - protein, 81 aa, Macaca nemestrina
MGLLTFRDVAIEFSLEEWQCLDTAQKNLYRNVMLENYRNLAFLGIAVSKPDLITCLEQGKEPWNMKRHEMVDKPPAICPHF

SEQ ID NO: 28193 - protein, 81 aa, Macaca nemestrina
MDSVAFEDVAVNFTREEWALLGPSQKTLYRDMMWETIRNLNCIGMKWEDTDVEDQHKNPRRSLRCLIVERFSESNQIPGST

SEQ ID NO: 28194 - protein, 81 aa, Ursus arctos
ALGLVTFEDVAVYFSREEWGLLNLTQRSLYRDVMLENFALIGSLGFAPSRSHVVAQLDSEEELWVPSMVDWTMGSRAEARR

SEQ ID NO: 28195 - protein, 81 aa, Ursus arctos
SEESVTFKDVAVDFTQEEWVQLDSPQRALYRDVMLENYQNLLALGPPVCKPDVISHLERGEEPWQMPREVPGGAYLEGEPR

SEQ ID NO: 28196 - protein, 81 aa, Ursus arctos
PVTFEEVSTQFSGEQWQCLDPDQQALSRDMMLDNFGSSASLGSSEDRESCLHWRPELTPELCSANPPSADRASRAVRARVS

SEQ ID NO: 28197 - protein, 81 aa, Ursus arctos
MLETYNHLVSLEIPFCKPKLISQLEQGEEPWIEERQHPLGLCPGSKLNIQPCPHCLLAFTSQQGLSQHVWFSHLPQLFSSL

SEQ ID NO: 28198 - protein, 81 aa, Muntiacus reevesi
QLTFKDVAVEFSQEEWECLDPAQRAFYMDVMVETLRNLISVDISHIHVVKKLQPTSSSDTGDAFQTVTLERQKIPEMKYFC

SEQ ID NO: 28199 - protein, 81 aa, Muntiacus reevesi
VVTFKDVAVTFTREEWGQLDLDQRTLFREVMPETCGLLVSLGADTRVAPLTVIHSEALWDTFAFRPHEVLTKVGGRKESRK

SEQ ID NO: 28200 - protein, 81 aa, Oryctolagus cuniculus
SQVMIAFEDLAVYFTWEEWQNMNQAQKILYRDVMLETYSSLFSLGHCRTKPDLIFKLEQGADVYITGREAKAEAVQQILTG

SEQ ID NO: 28201 - protein, 81 aa, Oryctolagus cuniculus
DVMSFEDVAMDFTREEWQFLNPYQRDLYKEVMLANYSNLVAVGEDITATPGSHHSIGLCSCLVCMESYRIGLSAAGLFYSV

SEQ ID NO: 28202 - protein, 81 aa, Ursus maritimus
ALLDSAQRILYRDVMLENCRNLASCPFISDSVTQHKAKNSTRQQDILARKTPDEANRVCAVSHSSRPSPSGEDWKCPRTDE

SEQ ID NO: 28203 - protein, 80 aa, Ursus maritimus
LQRLLTFGDVAIEFSQEEWRCLSHTQRELYRDVMLENYRHLLFLGLIVSKPDLVSLLEQRKEPWDVKRKKTVVFDPGRWE

SEQ ID NO: 28204 - protein, 81 aa, Ursus maritimus
AQGPVLFEDISVDFTQKEWQLLDPAQRLLYKEVMLENYRQLVSLGHCVTKPELVLKLEQGEKPWAPKRELPSQSCPEIQKA

SEQ ID NO: 28205 - protein, 81 aa, Ursus maritimus
AQMPVTFDDVAVTFTQEEWGQLDPAQRTLYREVMLETCGLLVSLGCPLPKPELIYALDHSPELQTLKRGLSLNSCPGDSTK

SEQ ID NO: 28206 - protein, 81 aa, Ursus maritimus
MVPVSLGILFSTPKVIFQLQQGEDPWMVENGVSRGPRVGWERLFETTVSEEENQEVMNKLLGDGPFDFRLGKVYKNEDKLE

SEQ ID NO: 28207 - protein, 81 aa, Ursus maritimus
CVTFEDVFVYFSREEWELLEEAQRLLYRDVMLENFALVASLGCWRVTDNEDTPSEQSVCIGVSQLRTPESGAFIQKAHPCE

SEQ ID NO: 28208 - protein, 81 aa, Macaca nemestrina
FFISFTGQLTFRDVAIEFSQEEWKCLDPAQRTLYRDVMLENYRNLVSLEYYLMWEHRKESWTMESQVQIARKPKGWEWIKG

SEQ ID NO: 28209 - protein, 81 aa, Ursus arctos
GAPEQVTFEDIVVDFTQEEWGQLEPDQRTLYRNVMLETFRLLVSVGCWLPRLDVISLLEQEEWWAADMCLGEGRAPEIRNI

SEQ ID NO: 28210 - protein, 81 aa, Ursus arctos
VTFTDVAVNFTREEWALLDSAQRILYRDVMLENCRNLASVDSVTQHKAKNSTRQQDILARKTPDEANRVCAVSHSSRPSPS

SEQ ID NO: 28211 - protein, 81 aa, Muntiacus reevesi
ECLDLEQRHLYSDVILENYSNLVSLGLCFYHPEVFSLLEKEREPWMALKDETCPDIQSRCQTKKLSPKNGIFDTEVSQWEI

SEQ ID NO: 28212 - protein, 81 aa, Muntiacus reevesi
EVQETLTFDDVAVAFTWEEWQLLAPAQKALYRDVMLENHSNLVSAGFQASTPEVLSKLDQGEPWTMDDEVHCQTRSEVWKF

SEQ ID NO: 28213 - protein, 81 aa, Muntiacus reevesi
DLVTFKDVAVDFSQEEWEWLSPAQRGLYRSMMLENYQSLVSLGLCISKPYVISLLEQGKEPWMMMENEMRSPFPDWESIHE

SEQ ID NO: 28214 - protein, 81 aa, Muntiacus reevesi
AQLTFKDLFIDFTLEEWECLDPAQRTLYKDVMVETLMNLLSVDMSHIHMVKKLHAEANSGKGEIFQRVIFGRTESLEVKGF

SEQ ID NO: 28215 - protein, 81 aa, Ursus americanus
MINNTELLTLEDVAVDFTWEEWQLLGPAQKDLYWDVMLENYSNLVSVGCQATKPDALSKFEHRDELWVTEDEIQNRTHPGE

SEQ ID NO: 28216 - protein, 81 aa, Ursus americanus
TLGSLMFRAVAVDFSQEEWEFLDLKQRNLYRDVMLENYSHLVSLGLSLPKPTLISFLEQDNEPWIVEKKGRCPCATKELSS

SEQ ID NO: 28217 - protein, 81 aa, Ursus americanus
AVDFTQEEWHHVDPAQRRLYRDVMLENYSHLVSLGYQVSKPEVIFKLEQGEEPWISEGEIQRPFCPDWKTRPEAKSSHLQQ

SEQ ID NO: 28218 - protein, 81 aa, Ursus americanus
GSLSFGDVAISFSQEEWECLDPAQRALYRDVMLETYSNLVSVGKSISPNSSSFYRLIKITIKGRLGGSVGEQPVTGSYYVL

SEQ ID NO: 28219 - protein, 81 aa, Ursus americanus
MNFEDVAIDFSQEEWGLLDETQRLLYCDVMLENFALVASLGKIVTLLLELYSGEYRENTGFTGSGPHEWQLISLLSGCRHG

SEQ ID NO: 28220 - protein, 81 aa, Macaca fascicularis
QGPLTFRDVAIEFSQEEWKSLDPVQKALYWDVMLENYRNLVFLGKHNFALEVKICPCAFLCFLSWEPFRHLTETEALLTHR

SEQ ID NO: 28221 - protein, 81 aa, Myotis lucifugus
KGKNMNFEDVAIVFSEEEWGLLDEAQRLLYCNVMLEVFALVSSAGCLHKMDDEEACPEQRVSVRGESQVRASTSEPGTQRT

SEQ ID NO: 28222 - protein, 81 aa, Puma concolor
FQDFVSFKDVAVNFTEEEWRELDPVQRVLYRDVMLENYRNLVSLGFPFSKPDIISQLEQAVNPWMHEGAVHQRIHTGEKPY

SEQ ID NO: 28223 - protein, 81 aa, Sapajus apella
MLENYGNVVSLGFPISKPDGISQLEQDLQVFDLETKTKEVLRDDCSDGETREENKLLIPKQKISEEVHSYKVRVGRLKHDI

SEQ ID NO: 28224 - protein, 81 aa, Sapajus apella
VQESMTFRDVAVFFSQDEWLHLDSAQRALYREVMLENFSTLVSLGIPFSMPKVIHQLQQGQDPCMVEGEVASDTCLGFKAW

SEQ ID NO: 28225 - protein, 81 aa, Sapajus apella
MFQNYENLVSLAGLSITKPYVITLLEDGKEPWMMEKNLSKGVTPDWESRWENKELSTKKDIYDEDSPQTVIIEKVIKQSYE

SEQ ID NO: 28226 - protein, 81 aa, Sapajus apella
AQVSVTFDDVAVTFTKEEWGQLDLAQRTLYQEVMLENCGLLVSLGCPVPRPELIYHLEHGQEPWTRKEDLSQGTHPGDKGK

SEQ ID NO: 28227 - protein, 81 aa, Sapajus apella
MDFSREEWQQLDPAQKRLYQDVMLELYSHLFSVGYQIPNPDVIFRRLKEKEPCMEEAEFSHQRCQEGELQEISKKASFQKD

SEQ ID NO: 28228 - protein, 81 aa, Oryctolagus cuniculus
VLVTFRDVAVTFTREEWRQLDPSQRTLFREVMLETCELLVSLGEPQHQTRKPTTFLSVTSEGGLLRGSLTQGSSRDSKLGQ

SEQ ID NO: 28229 - protein, 81 aa, Oryctolagus cuniculus
PLESVTFEDIVIDFTKEEWALLDTSQRKLYRDVTLENISHLVSLGYQIYKLDVISYLEQEEDLWSQGRRVFQDQSSGSALN

SEQ ID NO: 28230 - protein, 81 aa, Rhinolophus ferrumequinum
MLENYANVASLAFPLPKPVLISQLEKGEAPWGPDPWEAEVLRGVCPGGESWIKNEEPAVKQEASEETELPGVPAGGLLRNV

SEQ ID NO: 28231 - protein, 81 aa, Ursus maritimus
QDLDDAQRTLYRVVMLETYSSLVSLGHCITKPEVIVKLEQGAEPWTVEEAPTQNVQTSGDLIETRQEHQSRHVWQAGVANN

SEQ ID NO: 28232 - protein, 81 aa, Ursus maritimus
EQDEFVPLGDAAMDFTLEDWEHLGLDQGDLFWDTALDNYQNLFLLNPSKPKLTSHPDGTEEPKVLVRESPESAGPDTAEVK

SEQ ID NO: 28233 - protein, 81 aa, Ursus maritimus
AHRSMTFSDVAIDFSQQEWEYLDSVQKNLYRDVMMENYDTLVSLGHSISKPDVITLLEQGKDPWMVVKEDTRRWCTDLESR

SEQ ID NO: 28234 - protein, 81 aa, Rhinopithecus bieti
GPLTFRDVAIEFSQEEWKCLDPVQKALYWDVMLENYRNLVFLGILPKCMTKELPPIGNSNTGEKFQTVMLERHECYDIENF

SEQ ID NO: 28235 - protein, 81 aa, Phyllostomus discolor
AQVSVTFEDVVVTFTREEWGQLDLAQRTLYQEVMLETCMLLVSLGCPLSKPELIYLWEHSLKLQMLKRGLSPSSCPGDSTK

SEQ ID NO: 28236 - protein, 81 aa, Desmodus rotundus
RVTFEDVAVYFSLEEWNLLNEAQRHLYHDVMLENLALITSLGCWHGAQNEEVPSEHRDSLQGVSQVWTPKAGVSPQKAHPC

SEQ ID NO: 28237 - protein, 81 aa, Desmodus rotundus
GLLTFRDVSVDFSQEEWECLDPGQQELYSDVMLENYRNLVSLGLVVSKPDLITFLEQIKERWDMQRKKSISTHPAVSSEDN

SEQ ID NO: 28238 - protein, 81 aa, Desmodus rotundus
FQGSVTFRDVAIDFSQEEWEWLQPAQRNLYRRVMLENYGHLVSLAGLNMSKPDVVSLLEQGKEPWLGKDVRTDFFSVSGSN

SEQ ID NO: 28239 - protein, 81 aa, Macaca fascicularis
EMGLLTFRDIAIEFSLAEWQCLDRAQQNLYRDVMLENYRNLVSLGIADSKPDLITCLEQNKESWNIKRNEMVAKQPVTCSH

SEQ ID NO: 28240 - protein, 81 aa, Phascolarctos cinereus
GKESVTFKDVAVEFTQEEWVQLNPSQKKLYRDVMLENYRNLVSLGFAASKPNESDQLERKEVSSLPEADISRISCPESQEF

SEQ ID NO: 28241 - protein, 81 aa, Phascolarctos cinereus
HQESVTFKDVAVDFTWEEWGRLRPAQKQLYRDVMLENYRNLVWLGLAVSKPAVIGHLERGEVVWVSEGEGPRSTCADWDSR

SEQ ID NO: 28242 - protein, 81 aa, Phascolarctos cinereus
AQELVTFQDVAVDFTQEEWGLLDHPQKELYKEVMLENAQNLVSLGVPVPREDLISYFEEKEAPWLLEHEGLRSCYPEGEIR

SEQ ID NO: 28243 - protein, 81 aa, Phascolarctos cinereus
AQELLTFKDVSVDFTQEEWGLLDHPQKELYKEVMLENAKNLLSLGLAVSTEDLISYFEEEEAPWLLEHEGLRSCYPEGEIR

SEQ ID NO: 28244 - protein, 81 aa, Phascolarctos cinereus
WEESVTFKDVAVDFTQEEWDHLDPSQKELYRDVMQENYTNLVCLGLAVSKPDVIYQLEQGGVPWRAEEEVLRWSCPVLATK

SEQ ID NO: 28245 - protein, 81 aa, Phascolarctos cinereus
SQEVVTFKDVAVDFSPEEWGLLDCSQKELYKDVMVENAQNLLSLGLPVPREYLISHFEQEGLRNSCSDSETRFDVKESTAK

SEQ ID NO: 28246 - protein, 81 aa, Phascolarctos cinereus
SQESVTFQDVAVDFTPEEWGRLGPAQKELYQEVMLENYRNLVCLGLSVSKPALISRLERGEAPWRPEGGGHGAGCADRGMR

SEQ ID NO: 28247 - protein, 81 aa, Phascolarctos cinereus
YQTILTFQDVAVDFTQEEWGLLEPAQKDLFRDVMLENYENFVSLGLPVSKTDVLSQLEKREALRLPEREIPRSPYLEFLQK

SEQ ID NO: 28248 - protein, 81 aa, Phascolarctos cinereus
IQELVTFKDVAVDFTQEEWGLLNNPQKELYKEVMLENAQNMLSLGLPVPREDLFSYFEEREAPWLLEQEGLRSCCAEREIR

SEQ ID NO: 28249 - protein, 81 aa, Puma concolor
MLENYSHLVSLGYQDTKPDIIFKLEQGEELWMLQAQIPSRGRPEKVLEIDDHMDWHQENQGKLESMAKNYECTAFGKLCLL

SEQ ID NO: 28250 - protein, 81 aa, Puma concolor
ISFEDVAVDFTLEEWRLLNPTQKNLYRDVMLENYSNLVFLEVWLDNSLKMWHQDNQDELRSMERGDECDVFRKIFHSSINF

SEQ ID NO: 28251 - protein, 81 aa, Puma concolor
MAIDFTQGEWNYLGAAQKDLSRDVMLENYHNLVSVGLSRSKPDVISLLEQEKQPWIVTGHDRRTLPRECGKAFIQLSSLIR

SEQ ID NO: 28252 - protein, 81 aa, Sapajus apella
CGASVLFEDVTMDFSREEWQQLDPAQKRLYQDVMLELYSHLFSVGYQIPNPDVIFRRLKEKEPCMEEAEFSHQRCQEGELQ

SEQ ID NO: 28253 - protein, 81 aa, Oryctolagus cuniculus
DRVMTAFEDLAVYFTWDEWQKMNNAQKILYRDVMLETYSSLFSLGHCITKPDLIFKLERGEEPWMVDECLNQSLSGQSAHN

SEQ ID NO: 28254 - protein, 81 aa, Oryctolagus cuniculus
LLDTAQRALYRAVMLENFRNLLSVGFQLSLCEAVVRHRFFHVPGCSRSQCAASALRVHQRAHRGERRCKCAECGKEFSQSC

SEQ ID NO: 28255 - protein, 81 aa, Oryctolagus cuniculus
LQMMLTFEDLAIYFTWEEWQNMNKAQKILYRDVMLETYNSLLFLGHCITKPDLIFKLEQGGEPWMVNKCLNQSLPVAMKSD

SEQ ID NO: 28256 - protein, 81 aa, Oryctolagus cuniculus
METVPLQNLAVYFSWEEWQHMNKAQKILYRDVMLETYSSLFSLGHCITKPDLIFKLEQGEEPWMVDECLHQSLSGIQKNQS

SEQ ID NO: 28257 - protein, 81 aa, Rhinopithecus bieti
MLENYRNLFSLGLAMSKPELIICLEARKEPWNVNTEKTAKHSALSSYLTEDILPEQGLQIAFQKVMLRRYERCCLEKLRLR

SEQ ID NO: 28258 - protein, 81 aa, Rhinopithecus bieti
TVTFEDVAVKFTWEEWNLLSEAQRCLYRDVMLENLALISSLGKLLIETPSQKAPSKQSIYIQRETQVRIPMAGVSPKKADP

SEQ ID NO: 28259 - protein, 81 aa, Rhinopithecus bieti
RHGLLTFRDVAIEFSQEEWKCLDPAQRTLYRDVMLENYRNLVSLDISSKCMLKTLSSTGEGNTEVILTRTLQRQANHHTGD

SEQ ID NO: 28260 - protein, 81 aa, Puma concolor
ERMGSVSFKDVMIDFSREEWQRLDLAQKSLYRDVMLENYFNLISVGCQVPKPEVIFNLEQEEPCVLDGDISSHNCLNGDIG

SEQ ID NO: 28261 - protein, 81 aa, Sapajus apella
EMTKFQKAVTFKDVAVVFSSEELRLLDLTQRTLYRDVMVENFKNLVAVDMVSQLEAEEKLWMMEAETQRSSKHQNKMETLQ

SEQ ID NO: 28262 - protein, 81 aa, Sapajus apella
EKETLTFRDVAIEFSLEEWQCLNPAQQNLYRNVMLENYRNLVFLDIAVSKQSPITGLEQKKESCNMKRHEMVARPTAMCSY

SEQ ID NO: 28263 - protein, 81 aa, Oryctolagus cuniculus
SQGTVTFKDVAIDFTQEEWKQLDPTQRNLYRNVMLENYNNLITVGYPFTKPDVIFKLEQEEEPWVAEEEALRRHCPGDIWG

SEQ ID NO: 28264 - protein, 81 aa, Oryctolagus cuniculus
MTHAQKILYREVMLEIYSSLLSLGFCVTKPELIFKLEQGGEPWILEEDLNQSLPVTMRRDCLIMNNQENKGKNLNQDVIKY

SEQ ID NO: 28265 - protein, 81 aa, Oryctolagus cuniculus
MFASLTGGSIRHLWDSGSCAVLSQCASAVSRSILFTGCCITKPDVIFKLEQGEEPWTLDAGFAGWAYSKVQKLNDLIKRSQ

SEQ ID NO: 28266 - protein, 81 aa, Oryctolagus cuniculus
VLQVLSFEDLAVDFTQEEWQELNSAQRTLYRDVMLEVYSSLLSLGYCITKPDLIFWLEQGEELWLKASGTNVHGPSFSCWE

SEQ ID NO: 28267 - protein, 81 aa, Oryctolagus cuniculus
KPGAVRFADVAVYFSSEEWGCLRPAQRALYRDVMRENYGHLGALGQVPNKKEEEEEPQEAAGVKGPANAPEDLVTHSPDPP

SEQ ID NO: 28268 - protein, 81 aa, Pteropus alecto
FQGSVSFTDVTVDFTQEEWEQLDPSQRILYMDVMLENYSNLLSVAKGLTKYFVCFFLEVWKADDQMEREHRSPDEQARPFI

SEQ ID NO: 28269 - protein, 81 aa, Rhinolophus ferrumequinum
FQGRLTFRDVSIDFSQEEWECLHPADRKLYMDVMLENYRNLCSLDLAVSTPDVVIFLERMKEAWDVKRKKTVSIHPGSTCN

SEQ ID NO: 28270 - protein, 81 aa, Rhinolophus ferrumequinum
AQESLTFDDVAVHFTWEEWQLLVPEQKDLYRDVMLENYSHLVSVGYQVSKPDVFCKLERGECTIDKIHSQNCPEIRKVNDP

SEQ ID NO: 28271 - protein, 81 aa, Rhinolophus ferrumequinum
VKESVTFKDVAVDFTLEEWRLMDPPQRDLHKDVMLENYRNLVSLGLAVSKPDMIAHLEDGKGPWVVVREISRIPYPELETK

SEQ ID NO: 28272 - protein, 81 aa, Rhinolophus ferrumequinum
DLGSVTFKDVAVEFTQEKWVRLDAAQRSAYRDVMLENYMNLTTVELQLCKPPVLSLLGEEEMIPSDRSNLLLQRDMGGNSV

SEQ ID NO: 28273 - protein, 81 aa, Ursus maritimus
SQELLTFKDISVDFTQEEWGHLAPAHRNLYREVMLENYGNLVSVAGYQLSKPSVISQLEKGQEPWMTEKEGPGDPRSDLKN

SEQ ID NO: 28274 - protein, 81 aa, Ursus maritimus
SGLLTFGDVAIEFSQEEWRCLSHTQRELYRDVMLENYGHLLFLATSSHDIQSFMPKPSIEASFQKVSMGRHKSSDVEDLHL

SEQ ID NO: 28275 - protein, 81 aa, Ursus maritimus
IKQDLSLQESLTLEDVAVGFTWEEWQLLAPTQKELYQDVMLENYRNLVSVGEDKWEVTSRKPVWIEQSAQKGKLLEMKLME

SEQ ID NO: 28276 - protein, 81 aa, Rhinopithecus bieti
SQHLVTFEDVAVDFTQEEWTLLDQTQRDLYRDVMLENYKNLIILAGSEICKPSLMSGLEQMEELRTGVTGVLQEILCSSFI

SEQ ID NO: 28277 - protein, 81 aa, Panthera pardus
PQDLMTFKDVAVEFTQWEWGQLDPAQKDLYREVMLENFKNLASLGLPVSKPHVICQLEEGEEPCVVEGEISTGEGSYKSDT

SEQ ID NO: 28278 - protein, 81 aa, Panthera pardus
SVTYKDVAVDFTQEEWALMDTSQRTLYRDVTLENISHLVSVGMKNSHNKQEIIPMQDICMNDPPNCWTVQKCHTGEDLSVY

SEQ ID NO: 28279 - protein, 81 aa, Panthera pardus
MAEGFKFKDVAIYFSQKEWECLHPSQKGLYRDVMLENYSNLISLDWESRGETNNLFPKTDSYEIKSLQLKIKRVESSHLEC

SEQ ID NO: 28280 - protein, 81 aa, Panthera pardus
EMDSVAFEDVTVKFTMEEWALLDPSQKKLYRDVMQETFRNLASIVCISEEKWEVYDSEDRDENHGTHLISQMVGRLCKCKE

SEQ ID NO: 28281 - protein, 81 aa, Rhinolophus ferrumequinum
FQGLVSFKDVAVDFTQEEWQHLDPAQRTLYRDVMLENYSHLVSVGHPLSKPDVISKLEQGEDPWIIKRDMSNWIYPGENQA

SEQ ID NO: 28282 - protein, 81 aa, Panthera pardus
LLTFRDVAIEFSQDEWGCLNQSQRELYRDVMLETCGHLLFLAISSHGTQNLLPKPCIETSSQNVSLGTGKHHTFENLHLMI

SEQ ID NO: 28283 - protein, 81 aa, Panthera pardus
SVALEDVAVNFTLEEWALLNPSQKKLYRDVMQETFRNLASVGDKWEDRNSKSLYEHETNRRRVVEGPCQSKEGSQRGDPRR

SEQ ID NO: 28284 - protein, 81 aa, Panthera pardus
LLEAVTFKDVAVVFTEEELGLLDPTQRKLYREVMLENFGNLVSVGDKIQHKMETIPKVEPHEELSCWQIRQHIADDLTWCH

SEQ ID NO: 28285 - protein, 81 aa, Macaca nemestrina
SLVTFEDVAVYFSQEEWELLDAAQRHLYHSVMLENLELVTSLGNTLSQHVLLCSSVGTDLSNYFPNWLHHFTSLSGVYKCS

SEQ ID NO: 28286 - protein, 81 aa, Ursus arctos
LLRLLLRMCSTSQAPLDVPACCGRRSGTSRVLEGYMLLWELVRPEWEGCCIPKPEVILKLEQGEQPWILEEESPSQSYPEV

SEQ ID NO: 28287 - protein, 81 aa, Ursus arctos
KSQGFVSFKDVTVDFTWEEWRQLDSAQRNLYRDVMLENYSNLVSVGCQSLKSDVILLKQGEPWMKEEEISSWAYSDFGIRP

SEQ ID NO: 28288 - protein, 81 aa, Ursus arctos
AQASVSFKDVTVEFTREEWRQMDSAQRTLYRDVMLENYSHLVSVGYCFTKPELIFTLEQGEDPWLLKKEFLRKSSPEDSQP

SEQ ID NO: 28289 - protein, 81 aa, Muntiacus reevesi
QLTFKDVFIDFSPEEWECLDPAQRTLYKDVMVETLMNLLSVEMSHKHMIKKLHAKASSGKGEIFQRVMFGRAESLDIKDFR

SEQ ID NO: 28290 - protein, 81 aa, Muntiacus reevesi
RMKSVTFEDVAVYFTQTEWDSLSIAQRALYRDVMLENYGNVASLGFPLLKPAVISQLEGGGELEGPSPLASGAGTGPQGLW

SEQ ID NO: 28291 - protein, 81 aa, Ursus americanus
HILKSRFSSGFSGFCDSPIEEPHGLLISSCNSRTMTDGLVTFRDVAIDFSQEEWECLDPAQRDLYVDVMLENYSNLVSLGK

SEQ ID NO: 28292 - protein, 81 aa, Ursus americanus
GLLDPAQRKLYGDVMLENFRNLISVGEDRRPVDLRDKNLNDLETLQEIGLKYLPHEELFCSQIWQQVTKELTQCQDSMVSI

SEQ ID NO: 28293 - protein, 81 aa, Sapajus apella
ALRSVMFSDISIDFSPEEWDCLDLEQKDLYRDVMLENYSNLVSLGCFISKPDVISLLEQGKEPWKVVRKRRGQCPDLQTKY

SEQ ID NO: 28294 - protein, 81 aa, Oryctolagus cuniculus
SQEQVSFKDVCVDFTQEEWYLLDPAQRVLYRDVILENYSNLVSVGYCFTKPEVVFKIEQGEEPWILEKGFSSQSHSERKWG

SEQ ID NO: 28295 - protein, 81 aa, Oryctolagus cuniculus
NQCPYGMPVLQAAALPNTPQSGRFISKPDVISLLEQGKEPWKVVRKGRRCYPELETRCETKKLSSESNIYEISLSHFKIME

SEQ ID NO: 28296 - protein, 81 aa, Rhinolophus ferrumequinum
DEALMAFRDVAVAFTWKEWKLLSPAQRILYRDVMLENYSHLVSLGIAFSKPKPITQLEQGDEPWREESECLLDLCVEPRKE

SEQ ID NO: 28297 - protein, 81 aa, Rhinolophus ferrumequinum
YRELVTFRDVAVDFSQEEWDCLNSSQRHLYSNVMLENYRILVSLGLCFSKPSVILLLEQGKEPWMVKRELAKDLCSGWESM

SEQ ID NO: 28298 - protein, 81 aa, Rhinolophus ferrumequinum
DHELVTFRDVIINFSQDEWEYLNSAQRDLYWDVMMENYSNLVSLGCFISKPDVISLLEQGKEPWKVVRKERRRYPDLETRH

SEQ ID NO: 28299 - protein, 81 aa, Rhinolophus ferrumequinum
MLEIYSHLVSVGYCITKPQVIFKLQQGEEPWSLEKEFLNQKYPGYYEVDVHIERNQEKEEKPLWQVIFSDKKTLSKEGQKV

SEQ ID NO: 28300 - protein, 81 aa, Ursus maritimus
LGFTSEEWGLLDLEQKSLYREMMLENYRNLVSVEHQLSKPDVVSQLEEEEALWSVERGIPQDTFSEYPTAQLDPQLDPFPA

SEQ ID NO: 28301 - protein, 81 aa, Ursus maritimus
FQELIAFQDVVVDFSQEEWEQLSPGQKALYWDVMLEDYRNLVSLGKGSFRHGWIQELKCYFLKGLWNMNFIKACKEDSLPE

SEQ ID NO: 28302 - protein, 81 aa, Ursus maritimus
SSQGLLTFGDVAIEFSQEEWRCLSHTQRELYRDVMLENYGHLLFLDFILLKPDLIMFLEQEKQLWDVKRKETVAFHPGRWD

SEQ ID NO: 28303 - protein, 81 aa, Ursus maritimus
SQEPVTFEDVAVYFTQNQWASLDPTQRALYREVMLENYANITSLAFPFPKPDLILQLERGEARWGLDPWIAIEGEALGGVH

SEQ ID NO: 28304 - protein, 81 aa, Ursus maritimus
MLENYSNLVSLGFSISKADVLSLLKQGKAPWKVVQDVTRSQSSDWESKCETKKLSSKRGIYEIESSQWEIIEQLTRHKCEC

SEQ ID NO: 28305 - protein, 81 aa, Ursus maritimus
SVTFEEVAVDFSQEESASLDPAQKILYRDLMLENYRNLRQPHIVIDQKFQLKIKRPLQSRIKSGKNTYCQENDQTFLPRKE

SEQ ID NO: 28306 - protein, 81 aa, Rhinopithecus bieti
PQGRLTFRDVAIEFSLAEWKCLNPAQRALYREVMLENYRNLESVDSSFKTMMEYSSTGQGNTEVFHTEMLERHESHHFGDF

SEQ ID NO: 28307 - protein, 81 aa, Myotis brandtii
MDFEDVAITFSQEEWGLLDEAQRLLYCDVMLEIFALAASLGCWHNLEDKEAPSTQSVSVEGELQVRASETAPAARRTHPCR

SEQ ID NO: 28308 - protein, 81 aa, Myotis brandtii
AVVGQLTFSDVAIEFSQEEWACLDPAQRKLYMDVMLQNYRNLVFLGVSKPVLLTFLKHMKEPWELKGKKTIPIQPAITSQV

SEQ ID NO: 28309 - protein, 81 aa, Myotis brandtii
VTFEDIALYFSREEWSLLDEGQRQLYLNVMLENFELLSSQGCCCGAENVEALTEQNISVRVSQARNPKDFTVEKGLMSAVN

SEQ ID NO: 28310 - protein, 81 aa, Propithecus coquereli
SVTFKDVAVVFTREELGLLDPAQRKLYRDVMVENFKNLVAVGSKNQNKMETFQKFAFKYLSHEELSCWQIWKQVASELSRC

SEQ ID NO: 28311 - protein, 81 aa, Gorilla gorilla
QVTFSDVAIDFSHEEDLYKDVMVQNYENLVSVGLSVTKPYVITLLEDGKEPWMMEKKLFLFSYTVLSIMYILPISVITPAS

SEQ ID NO: 28312 - protein, 81 aa, Ailuropoda melanoleuca
GYQAPKPDMISKLQKGEEPWLGKGKRPKQDGPRELARPKQIGTNRNEVQQGNDQLGNDQESQNKLLKEVTFKKKSLTKKKD

SEQ ID NO: 28313 - protein, 81 aa, Lynx canadensis
PCRLVLFKDVAIDFSQEEWECLDLEQKDLYRDVMLENYNNLVSLGFSISKTDVLSLLKQGKEPWKVVQDVTRSQSSAWESR

SEQ ID NO: 28314 - protein, 81 aa, Lynx canadensis
FQELVTFRDVAIDFSRQEWEYLDSVQRDLYRDVMLENYRNLVSLGHSISKPDVVDLLEQGKEPWMILREETQRQYTDLDLH

SEQ ID NO: 28315 - protein, 81 aa, Phyllostomus discolor
MDSVAFEDVAVSFSLEEWALLDPSQKKLYRDVMQETFWNLTSIGGKWEDHDIEDQYKHQGGKQRSDMVERICEGKEGSQQG

SEQ ID NO: 28316 - protein, 81 aa, Phyllostomus discolor
AQGLLTFKDVSIDFSQEEWECLGPAQRKLYMDVILENYRNLVSLGLVDSKPYLVTFLEQMKECWDMQRKKLISAHPALTSE

SEQ ID NO: 28317 - protein, 81 aa, Phyllostomus discolor
ARVGVTLEDVAIYFSLDEWHLLNEAQRCLYLDVMLENFELISSLGCCCGAEDMEASIEQNVSVRVSQVKNPKVSLSSQKCH

SEQ ID NO: 28318 - protein, 81 aa, Phyllostomus discolor
AQDRVTLEDVTVYFSRTEWRLLDETQRRLYLDVMLENFALISSLGCCCGAEDVEAPTEQNLSTQASQEKNLKIALPSQKSH

SEQ ID NO: 28319 - protein, 81 aa, Desmodus rotundus
SVTFRDVIVDFTQEEWQQLKPAQKDLYRDVMMEVYWNLVSLDVETRPDAKESDPQEDDWEDRPSVVVIAEGPTRNGARSYT

SEQ ID NO: 28320 - protein, 81 aa, Myotis lucifugus
FSDDMNFEDVAIAFSQEEWGLLDEAQRLLYCDVMLEVFALVSSVGCYHKTDDAEDCSEQSVSVQGESQDRASKTAPETQRI

SEQ ID NO: 28321 - protein, 81 aa, Myotis lucifugus
TARSQASVTFKDVAMDLTPEEWGKLDPAQTDVMLENYRNLVSLWLPVSKPENYNLENGKETLMLERKVPRSSYSDSESRPE

SEQ ID NO: 28322 - protein, 81 aa, Myotis lucifugus
ESVTFKDVAVLFTQDEWAQLSPAQRALYRDVMLENYSHLVSLDWMTIPVSKKSTLKADIPEEELDQWMIKERLTSNSHWKY

SEQ ID NO: 28323 - protein, 81 aa, Puma concolor
APEQVTFEDVVVDFTQEEWGQLEPAQRTLYRDVMLETFRLLVSVGGPLMPDPGLHAEQKTHAKAKPYECQACGKAFGHSSA

SEQ ID NO: 28324 - protein, 81 aa, Puma concolor
SYGSLSFEDVTVGFSQEEWQHLDPAQRTLYRDVMLENYSHLVAVGCCVPKPDVIFRLEQGQQPWLIEEESLDQSCPEVCRV

SEQ ID NO: 28325 - protein, 81 aa, Sapajus apella
VQESVTFRDVAVFFSPDEWLHLDCAQRALYREVMLENYSSLVSLGILFSKPKVISHLEQGEDPWMVESGVPQGIHLGWESL

SEQ ID NO: 28326 - protein, 81 aa, Sapajus apella
PQELLTFRDVAIEFSPEEWTYLDPAQQNLYRDVMLENYRNLVSLGVAICNPDLVTCLEQRKEPCNVKIRKTVAHPPAVCSH

SEQ ID NO: 28327 - protein, 81 aa, Sapajus apella
AHDRVVFEDVAIYFSQEEWGHLDEAQRLLYRDVMLENLALLSSLGCWHGAEDEVAPSQQGFSAGVSEVTTSNSCMITQKIH

SEQ ID NO: 28328 - protein, 81 aa, Sapajus apella
MDVAIEFSLEEWQCLDTAQQNLYMDVMLENYRNLAFLGIAASKPDLITCLEQGKEPWNVTRHELVAEPPVVGSLFAQDLGP

SEQ ID NO: 28329 - protein, 81 aa, Sapajus apella
LQGLVTFEDVAMEFTQEEWALLAPAQRMLYRNVMLENCRNLASSLGNQVDKPSLISHLEQEDKLMTEERGIVPGTRPDVET

SEQ ID NO: 28330 - protein, 81 aa, Sapajus apella
VSFGDVAVYFSREEWGCLQPAQRALYRDVMRETYSHLGALDSRNKEEKRPREGVGALEKPLPVATGPLGLKAPQALSAGPP

SEQ ID NO: 28331 - protein, 81 aa, Oryctolagus cuniculus
FGMMIAFEDLAVYFTWEEWQNMNQAQKILYRDVMLETYSSLFSLGHCMTKPDLILKLEQGAEPWMGEECLHHSLPVAMKRD

SEQ ID NO: 28332 - protein, 81 aa, Oryctolagus cuniculus
MTAFEDLAVYFTWEEWQKMNNAQKILYRDVMLETYSSLFSLGHCITKPDLIFKLERGEEPWMVDECLNRSLSGQSAHKRQG

SEQ ID NO: 28333 - protein, 81 aa, Oryctolagus cuniculus
MTAFEDLAVYFTWEEWQKMNNAQKILYRDVMLETYSSLFSLVVMKRDDLIRINQESQDKNLNQDFMKNNKTSALKRIELRR

SEQ ID NO: 28334 - protein, 81 aa, Ursus maritimus
SHGPLSFEDVAIAFTKEEWQQLDPAQRTLYRDVMLENFSHLVSLGHPVSKPDVISKLEQGEEPWIYPERETRLENPQLDIL

SEQ ID NO: 28335 - protein, 81 aa, Ursus maritimus
SQHLVTFEDVAVNFTWEEWTLLDQTQRDLYRDVMLENYQNLIILGYESCGPDLNSPVGGAEELRTGGRGILQELDLQLKTK

SEQ ID NO: 28336 - protein, 81 aa, Ursus maritimus
VTFEDVAVYFSWKEWKFLDEAQRRLYHHVMLENFTLISSLGCCCGAEGEEAPFAQSTSVGASQAGTPTAPVSSRKTHPCEL

SEQ ID NO: 28337 - protein, 81 aa, Ursus maritimus
MPHPKVVKTLPSEISTFFQERPAKYEEVLWCCIPKPEVILKLEQGEQPWILEEESPSQSYPEVCKVDNQLEQNQEAQDRHF

SEQ ID NO: 28338 - protein, 81 aa, Ursus maritimus
AQESLTLEDVAVGFTWEEWQLLAPTQKELYQDVMLENYRNLVSVGYQASQPDVLSELEQGEPPWILEDEDEVQSQTHPQIQ

SEQ ID NO: 28339 - protein, 81 aa, Rhinopithecus bieti
EMGLLTFRDIAIEFSLAEWQCLDHAQRNLYRDVMLENYRNLVSLGIAVSKPDLITCLEQNKEPRNIKRNEMVSKHPVTCSH

SEQ ID NO: 28340 - protein, 81 aa, Rhinopithecus bieti
QQGYVTFEDVAVYFSQEEWRLLDETQRLLYRNVMLENFSLLASLGLASSKTHDITQLESWKEPFMPAWGVVTSAIPRVWLC

SEQ ID NO: 28341 - protein, 81 aa, Rhinopithecus bieti
RPESVTFEDVAVYFSENEWIGLGPAQRALYRDVMLENYGAVASLAFPFPKPALISQLERGEALDGVPVPWGALDGEDPRGI

SEQ ID NO: 28342 - protein, 81 aa, Rhinopithecus bieti
LGLDSARPWEGKPRYLGPVTFEDVAVLFTEAEWKRLNLEQRNLFEEVMLENLRNLVSLGEDILGSLRSGLLHLDVNLDLWL

SEQ ID NO: 28343 - protein, 81 aa, Oryctolagus cuniculus
SEVMIAFEDLAVYFTWEEWQNMNKAQKILYRDVMLEIYSSLFSLGHCITKPDLIFKLEQGAEPWMVEECLNQSLPVAMKSD

SEQ ID NO: 28344 - protein, 81 aa, Pteropus alecto
SVMFRDVAVDFSQEEWECLDPAQRDLYREVMLENYSNLVSMGLYIPKPQVISLLEQGQEPWMVGRELTRGLCSDLESMCET

SEQ ID NO: 28345 - protein, 81 aa, Rhinolophus ferrumequinum
IGEQLVTFKDVAVVFTEEELGLLDSAQRKLYQDVMMENFRNLLSVGHQPFKQGTVHLVRGEKFWMIKVATQIKGNSGGKIQ

SEQ ID NO: 28346 - protein, 81 aa, Rhinolophus ferrumequinum
AQGSVSFEDVTVEFTQEEWPYLGPAQRAVYRDVMLENYSHLVSVEYYKVDVHVTENQEKQEKALWQVIISNNKTLSKEGQK

SEQ ID NO: 28347 - protein, 81 aa, Rhinolophus ferrumequinum
FQESVTFKDVIVDFTQEEWRQLDPVQRDLFRDVTLENYTHLVSIGLQVSKPDVISHLEQGTEPWTVEPGIPVGGVADWETS

SEQ ID NO: 28348 - protein, 81 aa, Ursus maritimus
ECLSHTQRELYRDVILENYGHLLFLGVIVSKPDLVSLLEQRKEPWGEKRNKTVLFDPGSLSFLPEPCKEASFQNVSVGRYK

SEQ ID NO: 28349 - protein, 81 aa, Ursus maritimus
LLGSLSFEDVAVDFTWEEWQLLDSAQKTLYRSVTLENLSSLVSLGFQLIRPDVISRLEQEQPRVVGEDIPGQSFSEYWKVD

SEQ ID NO: 28350 - protein, 81 aa, Rhinopithecus bieti
LYEAVTFKDVAVVFTEEELGLLDPAQKKLYRDVMLENFRNLLSVGKSQTEMETVPEAGTHEEFSCKQIWEQIASDLTRSQD

SEQ ID NO: 28351 - protein, 81 aa, Rhinopithecus bieti
EQGLVTFEDVAVDFTQEEWQYLNSPQRTLYRDVMLETYSNLVFVGQQVTKPNLILSWSRRMPAEGKIPFGTFLVKVCQVGE

SEQ ID NO: 28352 - protein, 81 aa, Ursus arctos
MDFSREEWQQLDPAQRRLYQDVMGEVYSHLLSLGYHIPNPEIISRMEKGEKLWLREAQLPHQRHGEGVFGLKTSQQKMFEK

SEQ ID NO: 28353 - protein, 81 aa, Ursus arctos
AQDSVTFEDVAVYFSWEEWGLLDEAQRHLYHDVMLENFALVTALGYWHGAEDGKSPSKQAASVGVSQVRTHHAGPYPQKAH

SEQ ID NO: 28354 - protein, 81 aa, Ursus arctos
ARVLVTFKDVAVTFTQEEWGQLDLDQRALYQEVMLETCGLLVSLGHPVPKPELTHLLEHGQELWTGKRGLSRSMCSGDNVK

SEQ ID NO: 28355 - protein, 81 aa, Muntiacus reevesi
ELVTFRDVVISFSQEEWEYLDSAQRDLYWDVMMENYCNLVSLDLESKYDTKTLSVEKGILEKNNSQWEVIENSKLVGLQNS

SEQ ID NO: 28356 - protein, 81 aa, Muntiacus reevesi
MGLLTFQDVTVDFTQEEWECLDLGQRELYRDVMLENYGNLACLGLVVSKPDLVTFLEQMKDPWDVRGMETAIHPVINFHIY

SEQ ID NO: 28357 - protein, 81 aa, Muntiacus reevesi
QAGSDLFRDVAIVFSQEEWEQLAPTQRDLYRDVMLETYSNLVSLGLAVSKPDVIAFLEQGREPWTVEGVATGGLCPVLKSR

SEQ ID NO: 28358 - protein, 81 aa, Muntiacus reevesi
AQETLTFDDVAVAFTWEEWQLLAPAQKVLYRDVMLENHSNLVSVGFQASTPEVLSKLDQGEPWTMMDDEVHCRTRSEVWKV

SEQ ID NO: 28359 - protein, 81 aa, Muntiacus reevesi
KQLTFKDVAIEFTQEEWECLDPVQRALYRGVMWETYRNLVSVQCCKEQYCIGTWNVRTMNQGKLEAVKQEMARVVRIHKRT

SEQ ID NO: 28360 - protein, 81 aa, Muntiacus reevesi
ALISFEDVAITFTGEEWRHLDLAQRTLYQEVMLETCSLLVSLGHPVPKAELIHLLEYGPGLWTVKRGLSRNTCTGEKANPK

SEQ ID NO: 28361 - protein, 81 aa, Myotis brandtii
VTFEDVAVYFSGTEWQLLDEAQRCLYLDVMLENFALISSLGCCCGTRDLEASLEQNMSVRVSQAKKTKVPLSSQNSHPCES

SEQ ID NO: 28362 - protein, 81 aa, Oryctolagus cuniculus
MVGELNFKDVAIYFSQKEWERLHCAQKDLYRDVMLENYSNLIFVGFYDAKPSVISLLEQGKEPWMVQRKDTKEWRPDQASK

SEQ ID NO: 28363 - protein, 81 aa, Oryctolagus cuniculus
TETQISFDDVAVDFTLEEWLLLNPTQKNLYRDVMLENCSNLVFLAGYQMMTPDVIFKLKHDEPWIIDEEILSQNFSEVWLD

SEQ ID NO: 28364 - protein, 81 aa, Rhinolophus ferrumequinum
SQEQVSFQDVCVDFTQEEWYLLDPAQKILHRDVMLENYNHLVTIGHCITKPDVIIKIEQGEEPWILEQGFPSQCRLEDWKV

SEQ ID NO: 28365 - protein, 81 aa, Rhinolophus ferrumequinum
AQVPLTFSDVAIDFSQEEWECLNSDQRDLYRDVMLENYTNLVSLDFDFTTETNKLSSEKSNYEVNSYHWETTKRSKTLNLM

SEQ ID NO: 28366 - protein, 81 aa, Ursus maritimus
LGLLDPAQRKLYRDVMLENFRNLLSVGEGNVWVMDTYLDWRCKKLDRQDIVYKHEGDSYGFSWISRCHDAHRLPERETPCN

SEQ ID NO: 28367 - protein, 81 aa, Ursus maritimus
WQGLVVFTDVAIHFSQEEWGLLDEAQRSLYHSVMLENLALLSSLGKALPPPPVSGAGHQVSPFPGGSSVVSTHLSHYFPSG

SEQ ID NO: 28368 - protein, 81 aa, Rhinopithecus bieti
FQESVTFQDVAVDFTAEEWQLLDCTERTLYWDVMLENYRNLISVAGCPINKTKVILKVEQGQEPWMVEGVNPHQSSPESDC

SEQ ID NO: 28369 - protein, 81 aa, Rhinopithecus bieti
AQESLTLEDVAVDFTWEEWQFLSPAQKDLYRDVMLENYSNLVAVGYQASKPDVFFKLEQGEPPWTTEDGIHSGACSEIWKV

SEQ ID NO: 28370 - protein, 81 aa, Rhinopithecus bieti
AATLRLSAQGTVTFEDVAVKFTWEEWNLLSEAQRCLYRDVMLENLALISSLDPVLDGSADNTQTGNLGQSVLPSHPEQKTA

SEQ ID NO: 28371 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPRGTSGLSQVT

SEQ ID NO: 28372 - protein, 81 aa, Macaca nemestrina
QEPVTFEDVAVYFTQNEWASLHPMQRALYREVMLENYANLPVFLSPLHAFPSPNQDLICHIPDPWTLAGGRGEQESLPSSF

SEQ ID NO: 28373 - protein, 81 aa, Macaca nemestrina
TCDEAVTFKDVAVVFTEEELELLDPAQRKLYRDVMLENFRNLLSVGHQLSYQDTFHFQREEKFWIMETATQKEGNSGGKIQ

SEQ ID NO: 28374 - protein, 81 aa, Ursus arctos
SPGFVSFADVAVYFSPEEWGCLRPAQKALYRDVMRETYGLLDALGFSGPKPAFIFWVEGEVEAWSPESQDPEGESPAAVIR

SEQ ID NO: 28375 - protein, 81 aa, Ursus arctos
SGTSRVLEGYMLLWELVRPEWEALPSEISTFFQERPAKYEEVLWCCIPKPEVILKLEQGEQPWILEEESPSQSYPEVCKVD

SEQ ID NO: 28376 - protein, 81 aa, Muntiacus reevesi
AAFQEIATLKDVAMDFTLENWEQLGQGQGDLFWDTALDNYQNLFLLSEPNLTFHPDGGEKLEALVKESPESTDADIAETSP

SEQ ID NO: 28377 - protein, 81 aa, Muntiacus reevesi
QACVTFEDVAVYFSQEEWRLLNETQRFLYCDVMLENFALTTSLGEAFIFLPEDEVIPSEQSLSVGESQVRPSQSGPSTQKI

SEQ ID NO: 28378 - protein, 81 aa, Muntiacus reevesi
MALERLTSEDVAIEFTQEEWEFLDPAQRALYRDVMLETYRNLLSVGEDDLLPELPLGICIFPVCPLGGPDVFHLRVLVTRA

SEQ ID NO: 28379 - protein, 81 aa, Myotis brandtii
LPDMVTFKDVAIEFTQEEWALLDPSQKTLYKDVMLENCRNLASLGYHVDKLSLISQLEQEDKVMTEERGILPGICSGAEGV

SEQ ID NO: 28380 - protein, 81 aa, Oryctolagus cuniculus
AQESVVFSDVSVEFSQEEWEYLSDDQRTLYRNVMLENYSNLVSMGYSISKPNVISCLEQGKEPWLVSRELTRSQWPESSCE

SEQ ID NO: 28381 - protein, 81 aa, Oryctolagus cuniculus
SLQSVSFKDVTVDFSREEWQRLDLAQKSLYRDVTLENYFNLVSVGCRVPRPEVVFNLELGAEPCVLAGEVSSQSCSDGDIE

SEQ ID NO: 28382 - protein, 81 aa, Pteropus alecto
AQMSVTFDDVAVTFTQEEWGQLDLSQRTLYQEVMLENCGHLVSLGCPIPRPELIYQLEHGQELWMVDRDLSQSTCPGDREK

SEQ ID NO: 28383 - protein, 81 aa, Pteropus alecto
VAFEDVAVNFSLEEWALLDSLQKELYRDVMRETFRNLASVGKKWEDHDIEDQYKNRVRKLRLMFGELTMSYEERPVIGQQN

SEQ ID NO: 28384 - protein, 81 aa, Oryctolagus cuniculus
SQGLVTFEDVAVYFSLEEWARLDASQRGLYQEVMQENYGILVSLGYPIPKPDLIFRLEQGEEPWVPDSPRPDEGDIVTGVY

SEQ ID NO: 28385 - protein, 81 aa, Rhinopithecus bieti
FQGSVTFEDVAIAFSQQEWESLDCSQRGLYRDVMLENYRNLISMAGHSLSKPHVIALLEQWKEPEVTVRTDERRWCTDLQL

SEQ ID NO: 28386 - protein, 81 aa, Rhinopithecus bieti
MLFLFNETGIAFSKPDLITYLEQGKEPWNMKRHETVAKPLVMCSYFAQDLWPEQNIRSSFQKVILRRYGKCRDENLPLRKD

SEQ ID NO: 28387 - protein, 81 aa, Panthera pardus
SQVLLTFRDVTIDFSQEEWECLDPAQRALYRDVMLENYRNLVSLGVDKVRPDVGICPNISVRSVIKELSTKEDINKEELFQ

SEQ ID NO: 28388 - protein, 81 aa, Panthera pardus
QAPESVTFEDIAVDFTKEEWALLSASQRKLFRDVMLESINHLIFLENNSCKRSFRLEQEGELQSEGTGFLQEHSPAECQFL

SEQ ID NO: 28389 - protein, 81 aa, Panthera pardus
SEESVTFKDVAVDFTQEEWGQLDSPQRALYRDVMLENYQNLLALGPPVCKPDVISHLERGEEPWWMPREAPGGACPEGEPG

SEQ ID NO: 28390 - protein, 81 aa, Panthera pardus
FQEAVTFKDVAVVFTEEELGLLDPTQRKLYREVMLENFRNLVSVGHSSSKPDVISQLEREEKLCTKEIHTQRGGRNQNEKE

SEQ ID NO: 28391 - protein, 81 aa, Macaca nemestrina
MLFIFNKTGIAAFKPDLIIFLEQGKEPWNVKRYEMVEEPPVICSHFAQHLCPEQGIEDSLQKVILRKYEKCGRENLQLKID

SEQ ID NO: 28392 - protein, 81 aa, Ursus arctos
SVTFEEVAVDFSREESASLDPAQKILYRDLMLENYRNLRQPHIVIDQKFQLKIKRPLQSRIKSGKNTYCQENDANSTQRET

SEQ ID NO: 28393 - protein, 81 aa, Ursus arctos
RKGCVTFEDVAIYFSQEEWVLLDEAQRHLYHDAMLENFALIASLVCWHGMEDEEAAFEQSISGEVLLRVKTPKAGPSTQKT

SEQ ID NO: 28394 - protein, 81 aa, Ursus arctos
PKVPVTFDDVAVYFSEQEWGKLDEWQKELYKHVMRGNYETLVSLDYAISKPEVLSQTEQGKEPCSWRRTGPKVPDVPVDPS

SEQ ID NO: 28395 - protein, 81 aa, Ursus arctos
MNKSQEEWEQLDPSQRILYMDVMLENYSNLLSVEVWKADDQVERDRSNPDEQARPFIIFKNQTPIEERGNLFGKTFNLSTD

SEQ ID NO: 28396 - protein, 81 aa, Muntiacus reevesi
RLTFKDVAIEFTPEEWECLDPAQRALYREVMVETLRNLLSVDTSPKRVMKGSAPKQSSHTGGILQTVLSERHKSHDTKDHA

SEQ ID NO: 28397 - protein, 81 aa, Ursus americanus
MGLLTFRDVAIEFSQEEWGCLNLVQRELYRDVMLENYGNLLFLGPDLVIFLEQKRELWDVKGKETVAIHPGWGPKVREEGR

SEQ ID NO: 28398 - protein, 81 aa, Myotis brandtii
KIEDVADVAVSFILEEWEHLDQSQKSLYRDDRKENYESITSMDCKSKNDNMELIVKQISDEAKSHWMTSGITERSVAQSQE

SEQ ID NO: 28399 - protein, 81 aa, Ailuropoda melanoleuca
SQDPVTFEDVAVEFTQEEWTLLDQTQRRLCRDVMLENYKSLAAIARYQLCRPGLIFKVEQKVCNSLPSTPVEDWKFHNISI

SEQ ID NO: 28400 - protein, 81 aa, Phyllostomus discolor
CQVSVTFEDVAVLFSRDEWRKLCPSQRSLYQDVMLENYSHLVSLGLPFSKPKVISLLQQGEEPWKAEEERRRHASPGQKSS

SEQ ID NO: 28401 - protein, 81 aa, Phyllostomus discolor
AEVGVTFEDVAVYLSRTEWLLLDEAQRRLYFDVMLENYTLISSLGCCCGAEDGEAPIEENVSIRVSRAMNLKSALSSQKNH

SEQ ID NO: 28402 - protein, 81 aa, Phyllostomus discolor
SKDLVTFGDVAIDFSQEEWEWLNLAQRNLYRKVMLENYRNLVLLGVSVSKPEVISLLEQGKEPWMVKEVETGGTYSDWEYA

SEQ ID NO: 28403 - protein, 81 aa, Phyllostomus discolor
SVTFEDVAVHFSWEEWRLLDEAQRLLYLRVMLENFSLISSLGCCCGAEGVEAPTELNICAQAPQERNAKAASSSQKSHPCE

SEQ ID NO: 28404 - protein, 81 aa, Phyllostomus discolor
SQGSVTFRDVAIDFSQEEWEWLQPAQRDLYRRVMLENYGHLVALAGLNMSKPDVVSLLEQGKEPWLGKDVRTDFFSVSGSN

SEQ ID NO: 28405 - protein, 81 aa, Phyllostomus discolor
LQESLTFKDVSVDFSWEEWECLDPAQRKLYSDVMLENYSNLVSLAVSSADKQDFLQRTGREDALFEATLHRFHTGHGPGKY

SEQ ID NO: 28406 - protein, 81 aa, Phyllostomus discolor
SEESVTFKDVAVDFTQEEWGQLDSPQRALYRDVMLENYQNLLALGPPVCKPDVISHLERGEEPWQVPRKVPGGARPEWEPR

SEQ ID NO: 28407 - protein, 81 aa, Phyllostomus discolor
VTFEDVAVYFSRTEWSLLDAAERRLYLHVMLENFGLISSLGCCCGAADVEAPTDQNLSVRVAQAKDPKAALSPKKSHPCDS

SEQ ID NO: 28408 - protein, 81 aa, Myotis lucifugus
KVPVTFVDIAVYFSEDEWKNLDGWQKELYNNLVKENYKTLMSLDAEGPGPKPEAPSQAEPREEPCVWEQRNPEEREILMDP

SEQ ID NO: 28409 - protein, 81 aa, Puma concolor
VVFEDVAVNFTPEEWALLNRGQRKLYRDVMLETCRNLSAVGCRSQGNTSTSRPQWSILLNEPLGEEKTGIFTRKDSCSVFG

SEQ ID NO: 28410 - protein, 81 aa, Puma concolor
VNFSDVAVYFFAGGWGCRRPAQSALYRDVMWETYGRLGALGFLGPKSAFISWVEGEVEAADPEGETPAAVIRDGGGGEGSG

SEQ ID NO: 28411 - protein, 81 aa, Sapajus apella
DSVTFDDVAVDFTQEEWTLLDPTQRSLYSDVMLENYKNLATVGWELQLETQWSTLQQNCLMGQTSIGIQLEGNHNRGKLCD

SEQ ID NO: 28412 - protein, 81 aa, Sapajus apella
YISAFSQEEQEMAKPQEEWQYLNPLQRTLYRDVMLETYSNLVFVGQQVTKPDLILKLEVEECLVEGKIPFWSFPEVCQVNE

SEQ ID NO: 28413 - protein, 81 aa, Sapajus apella
LCVFQAPLTFRDVTVEFSLEEWQCLDTVQRNLYRDVMLENYRNLAFLGIAVSKPDMITCLEQGKEPWNMKRYEMVAKSPGR

SEQ ID NO: 28414 - protein, 81 aa, Sapajus apella
MAKPQEEWQYLNPLQRTLYRDVMLETYSNLVFVGQQVTKPDLILKLEVEECLVEGKIPFWSFPEVCQVNEQIERQHQDDQG

SEQ ID NO: 28415 - protein, 81 aa, Oryctolagus cuniculus
MFQVTFSDVAVDFSPEEWGWLSSAQRDLYREVTVQNYENLVSLGLSVAKPCVVTLLENGKEPWMVEKNLPKDWAPRWESKE

SEQ ID NO: 28416 - protein, 81 aa, Oryctolagus cuniculus
MSKDLVTFGDVAVNFTQEEWEWLNPAQRNLYRKVMLENYRSLASLGVSAKPDVISLLEQGKEPWMVKEGTRGTCPDWEYVF

SEQ ID NO: 28417 - protein, 81 aa, Oryctolagus cuniculus
AHGPVTFRDVAIDFSQEEWEFLDSAQRDLYRDVMWENYSNFISLGPSISNPNLVTLLDDEGKEPGMVVREGTRKYCHDLES

SEQ ID NO: 28418 - protein, 81 aa, Rhinolophus ferrumequinum
MFKDAVTFKDVAVGFTEEELGLLDSAQRKLYQDVMVENFRNLVSVGHQPFRRDISHVEREERLWMMKTSPQIERNLGDNNQ

SEQ ID NO: 28419 - protein, 81 aa, Rhinolophus ferrumequinum
TASSQASVTFKDVAMDFTPEEWGKLDPAQRDVMLENYRNLVSLWLPVSKPENYNLENEREPLKFERKTPQSSYSDLESGPE

SEQ ID NO: 28420 - protein, 81 aa, Rhinolophus ferrumequinum
QGEVTFEDVAVLLSREEWGRLGPAERGLYRDVMLETYGHLVSLGAGPAGPKPGVITQLERGDEPWVLDMQGAEETGRLRVD

SEQ ID NO: 28421 - protein, 81 aa, Rhinopithecus bieti
VAFEDVAVNFTQEEWALLDISQRNLYREVMLETFRNLTSIGKSWKDQNIEYEYQNPRRNFRSLIEEKVNEIKEDSHCGETF

SEQ ID NO: 28422 - protein, 81 aa, Rhinopithecus bieti
VGLQFQGSVTFEDVAIAFSQQEWESLDCSQRGLYRDVMLENYRNLISMGHSLSKPHVIALLEQWKEPEVTVRTDERRWCTG

SEQ ID NO: 28423 - protein, 81 aa, Panthera pardus
QDSVTFEEVAVDFSQEEWALLDPTQKILYRDVMLENYRNLASVGLDIQLKSKDAFPVQNVPREKTCNDIKTVPTKPSKKPL

SEQ ID NO: 28424 - protein, 81 aa, Panthera pardus
TQGCVTFEDVAIDFSQEEWGLLDEAQRRLYHDAMLENLALIASLGSRHGTEDEETAVEQNISVGVSQVRTPKAGPSTQKAH

SEQ ID NO: 28425 - protein, 81 aa, Rhinolophus ferrumequinum
MNFEDVAIDFSQEEWVLLDEAQRLLYCDVMLENFALVASMGCWHKMEDEEAPSEQSVSVEGESQVRASKISSIIQKIHPCE

SEQ ID NO: 28426 - protein, 81 aa, Rhinolophus ferrumequinum
TQDSVVFEDVAVNFTLEEWALLDGAQKNLYRDVMLENFQNLASLGYPLHTPCLIFQWKQEENLEIAKRRPIQGEQQEGFET

SEQ ID NO: 28427 - protein, 81 aa, Rhinolophus ferrumequinum
PQESVTFEDVAVYFTQNQWASLEPVQRALYREVMLENYANVASLVAFPLPKPVLISQLEKGEAPWGPDPWEAEVLRGVCPG

SEQ ID NO: 28428 - protein, 81 aa, Ursus maritimus
FQEPVTFKDVAVVFSEEELGLLDSTQRKLYRDVMLENFGNLVSVGHSSSKPDVISQLEREEKLCMKETHSERGDRHQKEME

SEQ ID NO: 28429 - protein, 81 aa, Ursus maritimus
MIQWEAELEEWQHLDPAQKALYRDVMLENYCHLISVGFHMTKPDMIRKLEQGEELWTTERMFPSQSYLEEDGKAEDVLVKF

SEQ ID NO: 28430 - protein, 81 aa, Ursus maritimus
PVTFEEVSTQFSGEQWQCLDPDQQALSRDMMLDNFGSSASLGKGCAVGLQSLSGLWLALGLRGEAKRTATTSSCPVCHKGA

SEQ ID NO: 28431 - protein, 81 aa, Ursus maritimus
RPGAVSFADVAVYFSPEEWGCLRPAQRALYRDVMRETYGHLGALGCAGPKPALISWLERNTDEWEPAALDPRECPRGVTVQ

SEQ ID NO: 28432 - protein, 81 aa, Ursus maritimus
RLTFRDVAIEFSPEEWECLDPAQRALYRDVMVENYRNLLSLDISTRCMRKELPPKDNINNGELFQTLILERHVSRDFDDFG

SEQ ID NO: 28433 - protein, 81 aa, Rhinopithecus bieti
RDVAIEFSLEEWQCLDTAQRNLYKNVILENYRNLVFLGIAVSKPDLITCLEQEKEPLTMQRHEMVDEPPVMCSHFAQEFWP

SEQ ID NO: 28434 - protein, 81 aa, Rhinopithecus bieti
GTVTFEDMAVKFPREEWNLLSEVQRCLYCDVTLENLALISSLGCWCGVEDEAPSKQSIYIQRETQVRIPMAGVSPKKAHTC

SEQ ID NO: 28435 - protein, 81 aa, Rhinopithecus bieti
MLENYSSLVSLGILFSKPKVISQLEQGEDPWMVESGVPQGTHLGWESLFETIISKEENQEVMKKLIIDGAFDFKLEKTYIN

SEQ ID NO: 28436 - protein, 81 aa, Rhinopithecus bieti
EDVAVDFTLEEWALLDSAQRNLYREVIFEMWERTKTQFKANGSVSQQDMYGEEKSKERTIPNFTRNNSCAYTLEKTCRGRQ

SEQ ID NO: 28437 - protein, 81 aa, Panthera pardus
AHRSVTFRDVAIHFSQQEWEYLDSVQKNLYRDVMMENYDNLVSLEHSISKPDVIRLLEQRKEPWMVVREDTKRWCTDLESK

SEQ ID NO: 28438 - protein, 81 aa, Panthera pardus
KGSMMFRDVSINFSQEEWECLDSGQMNLYKEVMLENFSNLVSVVASLSSHQGTGSDFWDTHSITMSHVFSCDQDFPILSQL

SEQ ID NO: 28439 - protein, 81 aa, Panthera pardus
GFRTASCWDVSVEFTRDEWQLLDSAQKYLYRDVILENYSHLVSVGYHGTKPDLIFKLEQGEEPWIINAKVSRQSCPEDWKE

SEQ ID NO: 28440 - protein, 81 aa, Macaca nemestrina
VAFEDVAVNFTQEEWTLLDISQKNLFREVMLETFRNLTSVGKDDSFPFLSALVNQSLIEEKVNEIKEDSHCGETFTQVPDD

SEQ ID NO: 28441 - protein, 81 aa, Ursus arctos
SSQGLLTFGDVAIEFSQEEWRCLSHTQRELYRDVMLENYGHLLFLGLIVSKPDQVSFLEQEKQLWDVTRKETVAFHPGRWD

SEQ ID NO: 28442 - protein, 81 aa, Ursus arctos
PCKLVLFKDVAVDFSQEEWECLDLEQKDLYRDVMLENYSNLVSLGFSISKADVLSLLKQGKEPWKVVQDVTRSQSSDWESK

SEQ ID NO: 28443 - protein, 81 aa, Ursus arctos
MHKDVMLENYSNLASVGLCVAKPEMIFKLERGEELWILEEESSGRGYPGSLSLLCGNSSVGGNALRHDNDLRRQKIQTLDQ

SEQ ID NO: 28444 - protein, 81 aa, Ursus arctos
RFRTASCWDISMEFTWEEWQLLDSTQKYLYRDVILENYSHLVSVGYHGTKPDLIFKLEQGEEPWIINAKVSRQSYPEGWKE

SEQ ID NO: 28445 - protein, 81 aa, Muntiacus reevesi
MGRLTFQDVAIDFTQEEWECLDFGQRELYRDVMLENYANLASLGLVSKLDLVAFLEQLKAPRNIRRMETTTSYPDSNLKNH

SEQ ID NO: 28446 - protein, 81 aa, Oryctolagus cuniculus
FQVSVTFEDVAVLFTRDEWRKLDPPQRILYRDVMLENYSNLLSLGLPCTKPKVISLLQQGEDPWKIEKDSPGGSSVDWKSG

SEQ ID NO: 28447 - protein, 81 aa, Ursus maritimus
SQESVTFQDVAVDFTEKEWPLLDSSQRKLYKDVMLENYSNLASVGYQVGKPSLISHLEQEEEPRTEERVLHRATSPDWEAP

SEQ ID NO: 28448 - protein, 80 aa, Ursus maritimus
LQGLLTFGDVAIEFSQEEWRCLSHTQRELYRDVMLENYGHLLFLGLTVSKPDLVSFLEQRKEPWDEKRNKTAGFDASRWE

SEQ ID NO: 28449 - protein, 81 aa, Ursus maritimus
MLENYRNLVALGHQLYKPEVISQLEQEEQWVMERGSPLDTHADGESRPEIKKSTPNQNISDETQNHDMIMERLTGDSFWYS

SEQ ID NO: 28450 - protein, 81 aa, Ursus maritimus
VPKFSQEEWECLSHTQRELYRDVILENYGHLLFLGVIVSKPDLVSLLEQRKEPWGEKRNKTVLFDPGSFLPEPCKEASFQN

SEQ ID NO: 28451 - protein, 81 aa, Ursus maritimus
PRNPVSPHPLQHMLCGSVSFRDVTVDFTRDEWLRLTGTQRTLYRDVMLENYSHLVSVGEGLPLKLPPQDLFAIFFFFFLIS

SEQ ID NO: 28452 - protein, 81 aa, Ursus maritimus
LKREGSSLANLRAMPQEEWQHLDPAQKALYRDVMLENYCHLISVGFHMTKPDMIRKLEQGEELWTTERMFPSQSYLEEDGK

SEQ ID NO: 28453 - protein, 81 aa, Macaca nemestrina
RCVLENYRNLVSLGVAISNPDLVTCLEQRKEPYNVKIRKIVARPPAVCSHFTQDRWPVQGIEDSFHNLILRRYEKCRHENL

SEQ ID NO: 28454 - protein, 81 aa, Macaca nemestrina
QDVTIEFSLEEWQCLDTAQQTLYRDVMLENYRNLVFLGIAVSKLDLIACLKQGKELWNMKRHEMVTKPPVMRSHFTQDLWP

SEQ ID NO: 28455 - protein, 81 aa, Muntiacus reevesi
SRSLENDGVCFSEQEWENLEDWQKELYANVMKSNYETLVSLKVLGQPEGDMELGAEMPGDLEEEESRGGHPVEEVVVKQET

SEQ ID NO: 28456 - protein, 81 aa, Ursus americanus
IIEPVTFKDVAVVFSEEELGLLDSTQRKLYRDVMLENFGNLVSVGNQPFKPELIFQLEREEKLLMMEAETQGEGMNIFPFI

SEQ ID NO: 28457 - protein, 81 aa, Ursus americanus
LQGLLTFGDVAIEFSQEEWGCLSHTQRELYRDVMLENYGHLLFLGFILSKPDLIMFLEQEKQLWDVKRETVAFHPENPHEY

SEQ ID NO: 28458 - protein, 81 aa, Ursus americanus
SLLHTHGLLTFKDVAIEFSQEEWRCLSHTQRELYRDVMLENYGHLLFLGEDDSFQISQATLWVRMTPSRFPKPHSGFSSFL

SEQ ID NO: 28459 - protein, 81 aa, Ursus americanus
LTFRDVAIEFSREEWRCLSHTQRELYRDVMLENYGHLLFLGEDDSFQISQSTLRVFFLPVKTVSWKIPLCMNGIQIQAERE

SEQ ID NO: 28460 - protein, 81 aa, Ursus americanus
MLENYGAVASLAFPFPKPALISQLERGEAPWCKAPQGALDGEGPRGISSGCPFLKPAGISHLEQVEEPLNPKLQGEVPSLV

SEQ ID NO: 28461 - protein, 81 aa, Pteropus alecto
AQGCVTFEDVFVCFSREEWELLEEAQRRLYRDVMLENFALVSSLGCCHVAEEEPVPSEQSVSDPMAAAALMDRARGSVTFK

SEQ ID NO: 28462 - protein, 81 aa, Pteropus alecto
AVTFADVAVSFSREEWRLLDEAQRRLYLAVMLENFALVSSQGCCCGAEDVEASIEPSISVGASHGRTPKEPSSSQRTHPCE

SEQ ID NO: 28463 - protein, 81 aa, Pteropus alecto
SQELLTFKDISVDFTQEEWGHLAPAHRNLYREVMLENYGNLISVGYELSKPGVISQLEKGEEPWLTEREISGGPSSDLESK

SEQ ID NO: 28464 - protein, 81 aa, Oryctolagus cuniculus
MITFEDLAVYFTWEEWQHMNKAQKILYRDVMLETYSSLLFLVAMKSDEIIRTNQEIQENIFKQNVITNNKTSTPKRAESIK

SEQ ID NO: 28465 - protein, 81 aa, Rhinolophus ferrumequinum
PLCLLGKQRARIWGYCFTKPELIFRLEQCEDPWLIEKEFLSRNSPEASQLDELSEKSPENQGKHLWQVLFTKNSLITEQEI

SEQ ID NO: 28466 - protein, 81 aa, Rhinolophus ferrumequinum
LQGPVSFEDVTIHFSREEWQHLDPAQRRLYQDVMLEIYSHLFSVEYHIPNPEVIFRMEKEKELWLGEAELSHQRHPEEESG

SEQ ID NO: 28467 - protein, 81 aa, Rhinopithecus bieti
PQGLVTFGDVAVDFSQEEWQWLNPNQRNLYRKVMLENYRNLASLGLCVSKPDVISSLEQGKEPWTVKRKMTRAWCPDLKTV

SEQ ID NO: 28468 - protein, 81 aa, Panthera pardus
SSQTLLTFRDVAIEFSQEEWGCLNHSQRELYRDVMLETYGHLLFLGLVSKPDLVIVLEQKKELWGVKRKETVASHPAVSSQ

SEQ ID NO: 28469 - protein, 81 aa, Panthera pardus
QGSAAYEFLSVDYTERKWKGPALSQRAVYRSLMPENYRRVASLANEARMECPDLPAKQEVSKGLGSSDGTSGGLCGVVSGE

SEQ ID NO: 28470 - protein, 81 aa, Panthera pardus
TQDSVTFEDVAMYFSWEEWGLLDEAQRWLFHNVMLENFALVTSLGCWHGAGDGETPSEQSAFVGASQVRTHQASPDPQKAH

SEQ ID NO: 28471 - protein, 81 aa, Panthera pardus
DRRRRTASQNAPPESGAQVPVSFEDVSMYFIKTEWKLLGLSQRILYKRVLLENYRHLVSLDAGFTAQFWNRQSMPHVPAAS

SEQ ID NO: 28472 - protein, 81 aa, Macaca nemestrina
LFQVTFSDVAIDFSHEEWAWLDSAQRDLYKDVMVQNYENLSYVFSGGFISYPFLLITLGKKKSSALWENKELSTKKDIYDE

SEQ ID NO: 28473 - protein, 81 aa, Macaca nemestrina
MELLTFRDVAIEFSPEEWKCLDPAQQNLYKDVMLENYRNLVSLAMCSPFSQDLSPVQGIEDSFQKLVLKRYEKCGYENLQL

SEQ ID NO: 28474 - protein, 81 aa, Ursus arctos
VKIEDVADVAVSFILEEWGHLDQSQKSLYRDDRKENYGSITSMDYESGHDNVELAVKQISDDAEPRWMTSGSPERNVPQSQ

SEQ ID NO: 28475 - protein, 81 aa, Ursus arctos
MTRLEGFQFPKPEVICLLEQWEEPWILDLPRAGTRKASSSACPGSEARCKMKKPTPKQKISEDSESCKMSVVKQTTAKRPA

SEQ ID NO: 28476 - protein, 81 aa, Muntiacus reevesi
CIKDEGSITFEDVAVYFSWEEWALLNETQKLLYCNVMLENFALMASLAYVSSFLPMLEIVVTDMESLQPQIPETPQKGKST

SEQ ID NO: 28477 - protein, 81 aa, Muntiacus reevesi
FTFRDVAIEFSQEEWECLAPSQRALYRDVMLETYRNLVSLGEDNFSPEVGILSVGFAINKLSPRENTNVGELYGNENHGIK

SEQ ID NO: 28478 - protein, 81 aa, Muntiacus reevesi
RKRGSLTLEDVAVDFTWEEWQLLAPAQKALYQEVMLENYGNLVFVGYQASKPAALSRLERGEPWPVEDEVHSQLCPEMRKD

SEQ ID NO: 28479 - protein, 81 aa, Muntiacus reevesi
LPLTFEDVAVYFSEQEWQNLEAWQKELYKQVMRANYEILLSLDNGLPKPELISWIEQGKELFKKWGESQQSRSIICSSADL

SEQ ID NO: 28480 - protein, 81 aa, Oryctolagus cuniculus
ETMLVSFEELAVNFTQEEWQHLDNAQRTLYRDVMLETYSSLLSLGYCISKPEVILKLEQGAEPWMVIEPLNQSLSGQSLHT

SEQ ID NO: 28481 - protein, 81 aa, Oryctolagus cuniculus
LQVMLTFEDLAVYFTWEEWQNMNKAQKILYRDVMLETYSSLLSLGHCITKPDLIFKLEQEAEPWMVNECLNQSLPVAMKSD

SEQ ID NO: 28482 - protein, 81 aa, Pteropus alecto
IREQDFGASLLQTAPQEQWRNLDSTQKEQYWDFMLETYGKMVSGGISSSKPDLTNSADYGEELTELHLHVSEKIPIPTCIG

SEQ ID NO: 28483 - protein, 81 aa, Oryctolagus cuniculus
SQASVSFKDVSVEFTLEEWQHVSPAQRTLYRDVMLENYSHLVSLGYCIFKPEVIFKLEQGEEAWFSEGDFSSQDLPVLEDY

SEQ ID NO: 28484 - protein, 81 aa, Pteropus alecto
MLENYGHLVSLGLPLFKPKVISLLQQGEEPWKVEEGSRRGSWLGSKSSPKTTKSTQTQDSSFWGLIKKRLKRDEPWKFLSE

SEQ ID NO: 28485 - protein, 81 aa, Rhinolophus ferrumequinum
SQESLTFEDVAVNFTQEEWALLDTSQRKLFRDVMLENISHLVSVGSQLYKSDMISHLEKGEKLSREGIGFLPGQGPGRRDY

SEQ ID NO: 28486 - protein, 81 aa, Ursus maritimus
EWMLLSQQQKEICGSDKLVAPLGPTIATPELFYKFEQGPEPWLGNVQGQRNVLSHQPGKNKMGCMEERDSRSPAREARLDL

SEQ ID NO: 28487 - protein, 81 aa, Ursus maritimus
SPLLESVTFKDIAVDFTQEEWALLDTSQRKLYRDVMLENISHLVSVGESVNINIFIQQVSSTVLVIQGEHRPQEEGPGREG

SEQ ID NO: 28488 - protein, 81 aa, Ursus maritimus
SHGLLTFGDVAIEFSQEEWECLSHTQRELYRDVILENYGHLLFLGVIVSKPDLVSLLEQRKEPWGEKRNKTVLFDPAVSSH

SEQ ID NO: 28489 - protein, 81 aa, Ursus maritimus
MLENFRNLVSVGHSSSKPDVISQLEREEKLCMKETHSERGDRHQKEMETLHEAGIRCLSLGELSCWQIKRHVVSRLTKNQD

SEQ ID NO: 28490 - protein, 81 aa, Ursus maritimus
CSILSGFLDPGHRNIRSSWILLDPSQTDFYGEYVMQENCGIVVSLRFPIPKLDMLSQLEGGEEQWVPDPQDLEERDILRVT

SEQ ID NO: 28491 - protein, 81 aa, Ursus maritimus
MLENYSNLVSVGCQATKPDALSKFEHRDELWITENEIQNRTHPGFGNFDHHLQEPSQNHRFLKNTQQYGERSAFRNTVHLS

SEQ ID NO: 28492 - protein, 81 aa, Rhinopithecus bieti
PQVSLTFEDVAVLFTRDEWRKLAPSQRNLYRDVMLENYRNLVSLGFPFTKPKVISLLQQGEDPWKVEKDSSGDSSLGCKSM

SEQ ID NO: 28493 - protein, 81 aa, Ursus maritimus
SSPVCYQKEEEMTESQEEWQQLDPAQRNLYRNVMLENYNNLITVGCPFTKPDVIFKLEQEEEPWVVEEEVLRRHCPGEIWG

SEQ ID NO: 28494 - protein, 81 aa, Macaca nemestrina
AATLRLSAQGTVTFEDVAVNFTQEEWNLLSEAQRCLYRDVTLENLALISSLDSALDGSVDKTETGNLGQSVLPSHPEQKTA

SEQ ID NO: 28495 - protein, 81 aa, Macaca nemestrina
MEGLVMFQDLFIHFSQEEWECLDAAQKDLYRDVMMENYSSLVSLGLCIPKPDVISLLEQGKEPWMVSRDVLGGWCPDSEFR

SEQ ID NO: 28496 - protein, 81 aa, Macaca nemestrina
MAKPVREEWRHLDPSQRNLYRDVMLETYSHLLSVGYQVPKPEVVMLEQGKEPWALQGERPRQSCPGEKLWDHNQCRKILTY

SEQ ID NO: 28497 - protein, 81 aa, Ursus arctos
TFKEALTFKDVAVVFTEEELGLLDPTQRELYRDVMLENFGNLVSVGHQPFRRDVGHLVREEKFWMVKLATQRKGNSGDKVQ

SEQ ID NO: 28498 - protein, 81 aa, Oryctolagus cuniculus
MLQFGKMLHYFPLTGYCITKPEVIFKLEQGAEPWIVEGPLSPSLPAVQKMDNLIKASQESQDGYISQAATTNNNTSTEERI

SEQ ID NO: 28499 - protein, 81 aa, Oryctolagus cuniculus
MLENFRNLLSVGHQSFKPDVISQLEREERLQVQEIQTQRGSKNGNKTGTCLDAESRCLALGDLPCWRIERRPGSQLPGSQD

SEQ ID NO: 28500 - protein, 81 aa, Rhinolophus ferrumequinum
GQESLTFDDVAVDFTWEEWQLLVPEQKDLYRDVMLENYSHLVSLGYQACKPDMLSKLDRGESPWTMADEVHYWTRSEIWKD

SEQ ID NO: 28501 - protein, 81 aa, Rhinolophus ferrumequinum
DSVQGQVTFEDVAVYFSQEEWRLLEDTQRLLYRDVMLENFALTASLGCWHGMENEEIPFEQWVSIKGVSQVRTPKSGPSTQ

SEQ ID NO: 28502 - protein, 81 aa, Rhinolophus ferrumequinum
CLQGPVTFKDVAVEFTQEKWVRLDSAQRSAYRDVMLENYMNLTTVELQLCKPPVLSLLGQEEMIPRQRIPQGTCPDWETQN

SEQ ID NO: 28503 - protein, 81 aa, Rhinolophus ferrumequinum
AEDLVTFKDVAIDFSQEEWDWLNPAQRSLYRSMMLENYQSLVSLGLCISKPCVISLLEQGKEPWEMKSDMTGSIFSDCESR

SEQ ID NO: 28504 - protein, 81 aa, Panthera pardus
KMNTPQASVSFKDITVEFTQEEWQQMDSAQRTLYRDVMLENYSHLVSVASLFRSIWTYLRDFAGSIPDHHNEMNTTIQQVK

SEQ ID NO: 28505 - protein, 81 aa, Panthera pardus
DRRRRTASQNAPPESGAQVPVSFEDVSMYFIKTEWKLLGLSQRILYKRVLLENYRHLVSLDADAALSSGVTDLLRFHGQDF

SEQ ID NO: 28506 - protein, 81 aa, Ursus arctos
SVTFRDVTVDFTQEEWQQLEPAQKDLYRDVMLENYRNLVSLDLETRPEMKESGPKEDSAEDRPSAGVVVEGPTRSGAHGLA

SEQ ID NO: 28507 - protein, 81 aa, Ursus arctos
QTEPSGPKLVARLSGPTQPTPTPGVAGAAARMNPAQGCVTFEDVFVYFSREEWELLEEAQRLLYRDVMLENFALVSSLGPM

SEQ ID NO: 28508 - protein, 81 aa, Ursus arctos
SVTFEEVAVDFSREESASLDPAQKILYRDLMLENYRNLRQPHIVIDQKFQLKIKRPLQSRIKSGKNTYCQENDQTFLPRKE

SEQ ID NO: 28509 - protein, 81 aa, Ursus arctos
SEESVTFKDVAVDFTQEEWVQLDSPQRALYRDVMLENYQNLLALAGPPVCKPDVISHLERGEEPWQMPREVPGGAYLEGEP

SEQ ID NO: 28510 - protein, 81 aa, Ursus arctos
MLENYGNLVSVGYQLSKPSVISQLEKGQEPWMTEKEGPGDPRSAYNTENNKSCHDLLEDLKNKTESDASAAKNDILQEQLY

SEQ ID NO: 28511 - protein, 81 aa, Pteropus alecto
VGPVVSVRAVAIEFTPEEWERLDLAQRALSRDMMSEDYGTLLSLGEGDFPPEIGEFLRVSVTLKSGVLGKGLLTFRDVAIE

SEQ ID NO: 28512 - protein, 81 aa, Pteropus alecto
WDSVTFEDVAVNFTPEEWALLDPTQKKLYRDVMRETFENLASVEVFIQHSSCNRHIRCHTGHKAYEFRKCGEKPYKCKECS

SEQ ID NO: 28513 - protein, 81 aa, Pteropus alecto
NKGQLTLSDVFIEFSQEEWECLTPAQRALYREVMLESYRKLRFLGISVSDLYIVSILEQGKAPWILESELKIAQKPNRQKC

SEQ ID NO: 28514 - protein, 81 aa, Rhinolophus ferrumequinum
LPDLVRFEDVAVEFTQEEWALLDPSQRTLYRDVMLETCRNLASLGYDVDKPSLISQLEQEDKMLTEERGVLPGTCSDLETV

SEQ ID NO: 28515 - protein, 81 aa, Ursus maritimus
METSLRLRAGITAFAHHHSHIPFLSLQTGLLSSKPKLITQLEQGAEPWMEVQQIPSDTCSVQEYWFETKMSTLKQHASEGS

SEQ ID NO: 28516 - protein, 81 aa, Rhinolophus ferrumequinum
KSQGRVAFKDVSASQLPPGGCQELDSAQKILCWDVMLENDSSLVSMGCHDQTKCVSQLEQEEPWITEVELLVQSLPHSGQR

SEQ ID NO: 28517 - protein, 81 aa, Ursus maritimus
NRNIVTFEDVCIYFSPEEWELLDEAQKRLYCNVILENFLLVTSLGLAISRYHLIPQLLPVREPGVPANVAIAPAGAGMVQG

SEQ ID NO: 28518 - protein, 81 aa, Ursus maritimus
MMLENYRNLVSVGYQASKPDALSKLERGEELWTIEDEIHSRICPELRKVDDPLQCHLQNRSIQKSVEQCCEHNTFADILNQ

SEQ ID NO: 28519 - protein, 81 aa, Ursus maritimus
RLTFRDVAIEFSAEEWECLDPAQRALYRDVMVENYRNLVSLDSSARFMIKELLPKKERKNRELCQPVVLGGHESHDLKDFD

SEQ ID NO: 28520 - protein, 81 aa, Ursus maritimus
MRLCQLWPGTFPREHRRGENGSCASNSQTAGLLVPKPDVIFQLKRGEEPWKLDFQEDEKSEVPGSTFPDQNARLESQDSTQ

SEQ ID NO: 28521 - protein, 81 aa, Ursus maritimus
MFKETVTFKDVAVVFTEEELGLLDPAQRKLYRDVMLENFRNLISVGEHPFRHDICFLEKAKKLWMMLGAHREEKSGGKIQS

SEQ ID NO: 28522 - protein, 81 aa, Rhinopithecus bieti
AQSSVTFEDVAVNFSLEEWSLLNEAQRCLYRDVMLETLTLISSLGCWHGGEDEAAPSKQSTCLHIYKDQGGHSGERPYECG

SEQ ID NO: 28523 - protein, 81 aa, Panthera pardus
TVTFKDVAVVFTEEELVLLDKAQIHPYQDVTLENFRNIVSVGDRIRDNISHLQGKGLSYLSPEGLYRWPIWKQRISELTGS

SEQ ID NO: 28524 - protein, 81 aa, Panthera pardus
TQGCVTFEDVAIDFSQEEWGLLDEAQRRLYHDAMLENLALIASLVCWHGMEDEETPFEQSVSIEVLSQVRIPKAGASIQKT

SEQ ID NO: 28525 - protein, 81 aa, Panthera pardus
MDFSREEWEQLDPAQRCLYWDVMLEICSHLLSLGYPIPRPEMIFRMEKEEEPWIREAQLPHQWRPEGEFGLKTSRQKIFEK

SEQ ID NO: 28526 - protein, 81 aa, Balaenoptera physalus
LPMAFDDVALYFLEQEWEVLEKWQKEMYQQEMKTNYETLDSLGCISSKPDLITWMEQGRMLLIRDQGHLEKTQMTLGLSGR

SEQ ID NO: 28527 - protein, 81 aa, Balaenoptera physalus
PKVPVTFDDISIYFSTPEWEKLEEWQKELYKNIMKGNYESLISMDYAMNQPDVLSQIQPEGGHNTEDQAGPEGSEIPTDPS

SEQ ID NO: 28528 - protein, 81 aa, Muntiacus reevesi
HRGRLMFRDVAIDFTQEEWECLDLGQWDLYRDVMLETYGKLASLGLVVSKPDLVTFLEQMKNPWDVRRTDTTATYPELIQQ

SEQ ID NO: 28529 - protein, 81 aa, Muntiacus reevesi
SVTFEDVAVYFSWEEWALLDDAQRCLYHDVMLENFALTSSLGCWHGVEDKGAPSEKSVSVEGVSQIKTLKADSSPQKDQPF

SEQ ID NO: 28530 - protein, 81 aa, Ursus americanus
MQENYGLLISVGYRVNKPNAVFKLKQGKEPWILEVEFPHRNYPEDLWKIHDLGAKYQESRAENSRNGELRKHQQPQPREKI

SEQ ID NO: 28531 - protein, 81 aa, Oryctolagus cuniculus
AQGLVTFRDVAVEFSQEEWKCLKPAQRDLYRDVTLENFGNLVSLGISISKPDIISLLEQGKEPWTIANDITGPWCPDLASR

SEQ ID NO: 28532 - protein, 81 aa, Rhinolophus ferrumequinum
AQGSLSFEDVTVEFTQEEWPYLGPAQRALYRDVMLENYSHLVSVGHYKVDVYLAGNQEEQEKPLWQVIFNKTLRKEGQKDI

SEQ ID NO: 28533 - protein, 81 aa, Rhinolophus ferrumequinum
GLLDSAQRKLYRDVMLENFRNLLSVGHQPFKQGTVHLVRGEKFWMIKVATQIKGNSEMGTIPESEPHEELSCWQIWQQIAR

SEQ ID NO: 28534 - protein, 81 aa, Rhinolophus ferrumequinum
SVKEAQRKRKEEGMALFQGWLTFKDVFIEFSQEEWECLDPAQRALYRDVMSENYKNLLSLGDGNFPPEIGNYLWMSFCFAL

SEQ ID NO: 28535 - protein, 81 aa, Rhinolophus ferrumequinum
SAAGLVTFKDVTMAFTQKEWEQLDPAQRSLYKDVMLENYSSLASMGYQADKPDVISKLEKEEPWLGKGKRPRQGGPSAIAT

SEQ ID NO: 28536 - protein, 81 aa, Ursus maritimus
ECLSHTQRELYRDVILENYGHLLIHSHTYFPFLYETGVIVSKPDLVSLLEQRKEPWGEKRNKTVLFDPGSLSFLPEPCKEA

SEQ ID NO: 28537 - protein, 81 aa, Ursus maritimus
RPGAVSFADVAVYFSPEEWGCLRPAQRALYRDVMRETYGHLGALGFAGPKPALISWLERKKEVWSPEAEDPEAGARHPGSG

SEQ ID NO: 28538 - protein, 81 aa, Ursus maritimus
SVTFEDVAVYFSWEEWGLLDEAQRHLYHDVMLENFALVTALGKALIPSSGTWAKPLCFYPRDGSISLPLQTWALLPPQFPG

SEQ ID NO: 28539 - protein, 81 aa, Ursus maritimus
VTFEDVAVYFSWKEWRLLDEAQRRLYHHVMLENFTLISSLGCCCGAEGEEAPFAQSTTVGASQAGTPTAAVSSRKTHPCEL

SEQ ID NO: 28540 - protein, 81 aa, Ursus maritimus
PRDPAQGMNFEDVAIDFSQEEWGLLDETQRLLYCDVMLENFALVASLDLHQQQRHGSGEKPWKRDVDRVSCVTSCNFCVSG

SEQ ID NO: 28541 - protein, 81 aa, Ursus maritimus
SQELVTYEDVAVDFTHKEWQHLDPAQKTLHRDVMLETYSHLVSVGCSGIKPGIIFKLEREEDPRIIKSELSTWVHSDREKS

SEQ ID NO: 28542 - protein, 81 aa, Rhinopithecus bieti
PLESVTFKDVAIDFTLEEWRLMDPTQRNLHKDVMLENYRNLVSLGLAVSKPDMISHLENGKGPWVTMRGISRIPYPDIEPK

SEQ ID NO: 28543 - protein, 81 aa, Panthera pardus
SVTLKDIAVDFTQEEWALMDTSQRTLYRDVMLENISHLVSVGMKKSHNKQEIISMQDIYLKDPPNCWTIQKRHAGEDLSVY

SEQ ID NO: 28544 - protein, 81 aa, Macaca nemestrina
LEDVAVDFTWEEWQLLGPAQKDLYRDVMLENYSNLVAVGYQASKPDVFFKLEQGEPPWTTEDGIHSGACSEIWKVDDHVLK

SEQ ID NO: 28545 - protein, 81 aa, Macaca nemestrina
GSVSFKDVTVDFTQEEWQQLDPAQKALYRDVMLENYCHFVSVDEWTRIFYGKTEDVLVKFKEYQDRHSRSLIFINHKKLIK

SEQ ID NO: 28546 - protein, 81 aa, Ursus arctos
MLENYSHLVSLGCCIPKPEVILKLEQGEQPWILEEESPSQSYPEVCKVDNQLEQNQEAQDRHFWQAPFINNKTLTMHRGNV

SEQ ID NO: 28547 - protein, 81 aa, Oryctolagus cuniculus
MITFEDLAVYFTWEEWQHMNKAQKILYRDVMLETYSSLLFLGHCITKPDLILKLEQGAEPWMVNEFLNQNLPVAMKSDEII

SEQ ID NO: 28548 - protein, 81 aa, Pteropus alecto
SMEPLTFKDVAVVFTEEELGLLDAAQRKLYRDVMLENFKNLVSVGQQPCKPGEMSHLEQDRETWVTERGTLRGAHSGDNNE

SEQ ID NO: 28549 - protein, 81 aa, Rhinolophus ferrumequinum
AQGSVSFEDVTVEFTQEEWPYLGPAQRALYRDVMLENYSHLVSVGHYKVDVYLAGNQEEQEKPLWQVIFNKTLRKEGQKDI

SEQ ID NO: 28550 - protein, 81 aa, Rhinolophus ferrumequinum
MLENFRNLLSVGHPSSKPDVISQLEREEKLWMMEIQTQRGGSSENEMDTLHEARVRCLSLGELSCWQIKKHVVSKLTRSQD

SEQ ID NO: 28551 - protein, 81 aa, Rhinolophus ferrumequinum
LFQGRLTFRDVAIDFSQEEWKCLHPAERKLYMDVMLENYRNLCSLGLAVSKPDLVIFLERMKEAWAVKRKKTVSIHPGRWE

SEQ ID NO: 28552 - protein, 81 aa, Ursus maritimus
MFFQAGCSISKPDVITLLEQGKEPWMVVRDERRRSLDLESRYDTKKLFQEKDIYEMNLSQWEIMGRIRSCGLEDSFVRKDY

SEQ ID NO: 28553 - protein, 81 aa, Ursus maritimus
MYFSQEEWELLDPTQEALYNDVMRENYETVISLALFVLPKPKVISYLDHEEEPWVQGPLEFKNSPGDLPAGLKVKTDTENH

SEQ ID NO: 28554 - protein, 81 aa, Ursus maritimus
LGLLDPAQRKLYRDVMLENFRNLLSVGEGNVWVMDTYLDWRDKNEKEMEYIQGRELKCLSYRELSYWKIWEHVAGELTENQ

SEQ ID NO: 28555 - protein, 81 aa, Ursus maritimus
SQSFLTFEDVAMYFSQEEWELLDPTQKALYNDVMWENYETVISLALFVLPKPKVISYLDHEEEPWVQGPLEFKNSPGDLPA

SEQ ID NO: 28556 - protein, 81 aa, Ursus maritimus
QSLQDPVAFEDVAVNFTLEEWALLDPSQKKLYRDVMRETLRNLASIGKDDTLPNIEDQYKNQGRKLRSHMVETLCQSKEGS

SEQ ID NO: 28557 - protein, 81 aa, Ursus maritimus
PKPSVSFKDVAVTFTQEEWGQLNLAQRRLYRNVTLETWSHLVSLGLLLSKPDVISWLEQGQDSWRAEQGPPQDWKNTFEKK

SEQ ID NO: 28558 - protein, 81 aa, Panthera pardus
EQESVTYKDVAVDFTQEEWALMDTSQRTLYRDVTLENISHLVSVGCHFFRSDVISPWEQRGELWREERGPPQGWSPGMKKS

SEQ ID NO: 28559 - protein, 81 aa, Panthera pardus
FETMAHGSVTFRDVAIDFSQEEWEFLDSAQRDLYRDVMWENYSNFISLDVITLLDEGKEPWMVIREGTRRHYPDLESRYRT

SEQ ID NO: 28560 - protein, 81 aa, Macaca nemestrina
FQKPVTFEDVAVNFTQEEWDCLDASQRVLYQDVMSEIFKNLASVARIFLHKPERITKLEQEEEQWRETQVLQASQAGPPFF

SEQ ID NO: 28561 - protein, 81 aa, Macaca nemestrina
DSVTFEDVAVDFTQEEWTLLDQTQRNLYRDVMLENYKNLVAVDWESHINTKWSAPQQNFLQGKTSSVVEMVRFRSLALSPR

SEQ ID NO: 28562 - protein, 81 aa, Macaca nemestrina
DSISLEDVAVNFTLEEWALLDPGQRNIYRDVMRATFKNLACIGEKWKDQDVEDDPKNQGRKPSSPMVETLCENKEDHPCGK

SEQ ID NO: 28563 - protein, 81 aa, Ursus arctos
AQESVMFSDVSIDFSQEEWECLNDDQRDLYRDVMLENYSHLVSMGHSVSKPDVISFLEQGKEPWLVDRELTRDHWPVLESR

SEQ ID NO: 28564 - protein, 81 aa, Ursus arctos
KFQEAVTFKDVAVVFTEEELGLLDPVQRKLYRDVMLENFRNLLSVGYEPFRLETLPLGREEKLWVMETETQGDGPSGLRNQ

SEQ ID NO: 28565 - protein, 81 aa, Oryctolagus cuniculus
STEASVSFEDVAVDFTRQEWHRLDPAQRTMHKDVMLETYSNLASVGLCVAKPEMIFKLEGEELWIIESSGHGYPGSLSRLC

SEQ ID NO: 28566 - protein, 81 aa, Oryctolagus cuniculus
FQGPVTFKDITVEFNKDEWKLLTTAQRTLYKEVMLENYSLLAAVGYRVSKPNTVFKLKQGKKPWILEVEFPHQSHPEDLWK

SEQ ID NO: 28567 - protein, 81 aa, Oryctolagus cuniculus
SVTFRDVAIDFSQEEWKWLQPAQRDLYRCVMLENYGHLVSLVSEPTDEIKEFSPENVIYKGDSSQYLIVERILSQNPVHSS

SEQ ID NO: 28568 - protein, 81 aa, Pteropus alecto
LWLPLTFEDIAIYFSEQEWQNLEAWQKDLYRNVMRANYEILVSLDDGLPKPELISHIEQGKELFWNLGETQKSGNIICSSA

SEQ ID NO: 28569 - protein, 81 aa, Rhinolophus ferrumequinum
GWVPALFDEVAIYFSDEEWEVLTEQQKALYREVMRMNYETVLSLEFPFPKPDMISRLEGEEEPQNSDGWQLPGGTFAENED

SEQ ID NO: 28570 - protein, 81 aa, Rhinolophus ferrumequinum
LQGSVMFRDVSINFSQEEWECLDSGQMNLYKEVMLENFSNLVSVGLSSSKPAVISLLEQGKEPWMVETEMKRGLCSDLESM

SEQ ID NO: 28571 - protein, 81 aa, Rhinolophus ferrumequinum
FQESVTFEDVAIYFAENEWTGLTPAQRALYRDVMLENYAAVASLAFPFPKPALISQLERGEAPWSSAPQGALDGEGPRDIS

SEQ ID NO: 28572 - protein, 81 aa, Rhinolophus ferrumequinum
VQESVTFKDVAVLFTPDEWAQLSPAQRALYREVMLENYSNLVSLGLLGPKPDMVAHLGKKEEWMPQDASGCFCLDWMTTPM

SEQ ID NO: 28573 - protein, 81 aa, Rhinolophus ferrumequinum
LQVSVTFEDVAVLFTRDEWRKLRPFQRNLYQDVMLETYSNLVSLGLPFSKPKVISLLQQGEAPWELEEGSPEGSWPEERYV

SEQ ID NO: 28574 - protein, 81 aa, Rhinolophus ferrumequinum
SRRQCPMVTRMMFQPPVSFKDVVVTFTREEWGQLDPAQRTLYITITLETCDHLLSLGKAGSAHHRGFLPLGLRAVSLHKGC

SEQ ID NO: 28575 - protein, 81 aa, Ursus maritimus
MLENYRHLVSVGCHIIKPEVIIKLEQGEEPWIVEGEFLPQSYPEEVWKTDDLGERVQENEGRYSRQTVSINNKTLIEERGN

SEQ ID NO: 28576 - protein, 81 aa, Ursus maritimus
MDSAQRTLYRDVMLENYSHLVSVGYCFTKPELIFTLEQGEDPWLLKKEFLRKSSPEDSQPNQLSEKSLGNQGKYLWQVLFT

SEQ ID NO: 28577 - protein, 81 aa, Ursus maritimus
MLENYGNLVSVGCQLSKPDVISQLEKGEEPWLIEREISGSPGSDLENKTETRESTLKNGISWEELHHGLMMEQSTRGSTLY

SEQ ID NO: 28578 - protein, 81 aa, Ursus maritimus
AKESLTLEDVAVDFTWEEWQLLGPAQKDLYWDVMLENYSNLVSVGCQATKPDALSKFEHRDELWITENEIQNRTHPGFGNF

SEQ ID NO: 28579 - protein, 81 aa, Ursus maritimus
AHRSMTFSDVAIDFSQQEWEYLDSVQKNLYRDVMMENYDTLVSLAGHSISKPDVITLLEQGKDPWMVVKEDTRRWCTDLES

SEQ ID NO: 28580 - protein, 81 aa, Rhinopithecus bieti
MELLTFRDVAIEFSPEEWKCLDPAQQNLYRDVMLENYRNLVSLAMCSPFSQDLSPVQGIEDSFQKLVLRRYEKCGYKNLQL

SEQ ID NO: 28581 - protein, 81 aa, Rhinopithecus bieti
PQGHLTFMDVAIEFSQEEWKCLDPGQRALYRDVMLENYRNLVSLGICLPDLSIISMLKQRREPLILQSEVKIVKNPDGREC

SEQ ID NO: 28582 - protein, 81 aa, Balaenoptera physalus
MGTPDLGYCIPKPELIFRLEQGEQPWVLEEESPSQSYPEVCKVDNQLEQSQEIQDRHFGQAPFINNKTLTIERGSVTGNIE

SEQ ID NO: 28583 - protein, 81 aa, Muntiacus reevesi
GSVSFEDVAVGFSQEEWQLLGPSQKALCWDVMLENYCNLVSVGYQAPKPDSLFRLEQGRPPWKVKGAALSPTCPGLVFGNR

SEQ ID NO: 28584 - protein, 81 aa, Muntiacus reevesi
GLESVTFKDVAVDFTPEEWGRLGPGQRELYRDVMLENYQNLLSLGFPGAKPDVISRLEQGEEPRMERREAQQGTCPDLETS

SEQ ID NO: 28585 - protein, 81 aa, Muntiacus reevesi
GLLSFEDVALYFTREEWDTLDWAQKALYRDVMLDNYRHIVSLGFPFPKPEVICQLEQWEEPWTLDLPRAGTRKASGSACPD

SEQ ID NO: 28586 - protein, 81 aa, Muntiacus reevesi
PQGSTPFSSLTVDFTQGGWRQLAPAPRDRFEEGMPEKSRNLVLLGLPVSQPGMNFQLEQREDSWMLKRDGLRNACPDWKII

SEQ ID NO: 28587 - protein, 80 aa, Rhinolophus ferrumequinum
KMEQLMTFRDVAIDFSQEEWDYLDPAQRALYRDVMMENYSHLVLLISKPDVISFLEQEKEPWMVSRNMARGWCPETFKKA

SEQ ID NO: 28588 - protein, 81 aa, Rhinolophus ferrumequinum
QTQVSVTFEDVAVTFTQEEWGHLDPAQKILYQEVMLENCGLLVSLGCPIPRPELIYHLEQELWTVKKDLSQSTCPGDKEKL

SEQ ID NO: 28589 - protein, 81 aa, Rhinolophus ferrumequinum
FMVTFKDVAVVFTEEELGLLDSAQRKLYQDVMMENFRNLLSVGHQPFKQESEPHEELSYWQIWQQIARDLIRCQASMIKSS

SEQ ID NO: 28590 - protein, 81 aa, Rhinolophus ferrumequinum
MLENYSHLVSVGYQVSKPDTLSKLEQGEEPWIIEDEIHIPVCPEIGKVDNHLQGHLENEIMLKGMKQNHKHKALGNNVPQS

SEQ ID NO: 28591 - protein, 81 aa, Ursus maritimus
VTFGDVAVHFSREEWQCLDPGQRALYKEVMLENHSSVAGLGEAGSWDPSPASLINTHLARPCQKLGIWGPRVFVGQELTLG

SEQ ID NO: 28592 - protein, 81 aa, Ursus maritimus
WALLDTSQRKLFRDVMLENIRHLVSLGYQHCKSDVIFQLEQGEELWREGPGFLRGPSPGGPSFNNLSSLSPKQKSHTPEDP

SEQ ID NO: 28593 - protein, 81 aa, Ursus maritimus
LQGSVSFEDVAVDFTRQEWHRLDPAQRTMHKDVMLENYSNLASVGLCVAKPEMIFKLERGEELWILEEESSGRGYPGSLSL

SEQ ID NO: 28594 - protein, 81 aa, Ursus maritimus
ISQDLVTFKDVAVDFSQEEWEWLNPAQRNLYKNMMLENYQNLVSLGLCVSKPYVISLLEQGKFWATKTEMTRSLFPDSGSI

SEQ ID NO: 28595 - protein, 81 aa, Rhinopithecus bieti
IYFPQEEWELLEYTQKALYNDVMQENYETVISLALFVLPKPKVISCLEQGEEPWVQVSPEFKDTFVPFFKKSLNFSFYSWL

SEQ ID NO: 28596 - protein, 81 aa, Rhinopithecus bieti
PRLPLTFEDVAIYFSEQEWQDLEAWQKELYKHVMRSNYETLVSLDDGLPKPELISWIEHGGEPFRNWRESQKSRNIICSSS

SEQ ID NO: 28597 - protein, 81 aa, Rhinopithecus bieti
ESRPGAVSFADVAVYFSPEEWGCLRPAQKVLYRDVMRHTFGHLGALGFSGPKPAFISGVEAWSPEAQDPEGESPAAVSRGQ

SEQ ID NO: 28598 - protein, 81 aa, Panthera pardus
MAPLLGTEGLILNLFPFLQAGLNISKPYVVSLLEQGKEPWLEKRGVRRDLFSEPNREVKEFSRKNVIYEDDSPQCFVVGRI

SEQ ID NO: 28599 - protein, 81 aa, Panthera pardus
TQGCVTFEDVAIDFSQEEWGLLDEAQRRLYHDAMLENLALIASLGYESSMSLGVASLELGGKPWVSDWADVTPARTREAQG

SEQ ID NO: 28600 - protein, 81 aa, Panthera pardus
PRVSLTFEDVAVLFTRDEWRKLGPSERNLYQDVMLENYSNLVSLGLLFSKPKVISLLQQGEDPWKVEKESPGGPSLGYKSS

SEQ ID NO: 28601 - protein, 81 aa, Panthera pardus
SVTYKDVAVDFTQEEWALMDTSQRTLYRDVTLENISHLVSVGMKNSHNKQEIIPMQDICMNDPPNCWTVKCHTGEDLSVYS

SEQ ID NO: 28602 - protein, 81 aa, Panthera pardus
GCVTFEDVFVYFSREEWELLEEAQRLLYRDVMLENFALVASLDCWREADNEETPEQNVFVGVSQLRTPESGPFIQKAHPCE

SEQ ID NO: 28603 - protein, 81 aa, Macaca nemestrina
MDPLGLAISKPDVISFLEQGKEPWMVERVVSGGLCPVLESRYDTKELSPKQHVYEVESPQWEIMESLTSYGLECSSFQDDW

SEQ ID NO: 28604 - protein, 81 aa, Macaca nemestrina
PQASVCFEDVAMAFTQEEWEQLDLAQRTLYREVTLETWEHIVSLGLFLSKSDVISQLEQEEDLCRAEQVAPREARSSKEQR

SEQ ID NO: 28605 - protein, 81 aa, Gorilla gorilla
TARSQETVTFKDVAMDFTPEEWGKLDPAQRDVMLENYSNLVSLWLPVSKPENYNLENGKEPLKLERKAPKSSYSGKQSPLL

SEQ ID NO: 28606 - protein, 81 aa, Gorilla gorilla
ASGSVTFEDVAVYFSWEEWDLLDEAQKHLYFDVMLENFALTSSLGLTSSWSHVVAQLGLGEVPSVLHRMFMTPASARWDQR

SEQ ID NO: 28607 - protein, 81 aa, Gorilla gorilla
MDSVVFEDVAVDFTLEEWALLDSAQRDLYRDVMLETFRNLASVVSVHVRTHNGERPYVCKLCGKTFPRTSSLNRHVRIHTA

SEQ ID NO: 28608 - protein, 81 aa, Gorilla gorilla
QVTFSDVAIDFSHEEWGWLNSAQRDLYKDVMVQNYENLVSVGLSVTKPYVITLLEDGKEPWMMEKKLSKAISVITPASSVN

SEQ ID NO: 28609 - protein, 81 aa, Ailuropoda melanoleuca
PKVPVSFEDVSVYFTKTEWKLLDLRQRILYKRVMMENYRHLVSLGFLSSKPHLVSWLEQGEGPWAADICRTPAATGRQTGD

SEQ ID NO: 28610 - protein, 81 aa, Ailuropoda melanoleuca
LQGLVTFEDVAVYFSREEWGLLNLTQRSLYRDVMLENFALIGSLGFAPSRSHVVAQLESEEELWVPSMVNLTMGSRAEARR

SEQ ID NO: 28611 - protein, 81 aa, Gorilla gorilla
SLDLVSFEEVAVHFTWEEWQDLDDAQRTLYGDVMLETYSSLVSLGHCITKPEMIFKLEQGAEPWIVEETPNLRLSGGSRKQ

SEQ ID NO: 28612 - protein, 81 aa, Lynx canadensis
EEWGCLNHSQRELYRDVMLETYGHLLFLGAPQTQISRRNGNICSNEDIPNLKIDDFLTTKNVENKYLNQFENRIGLTFQTT

SEQ ID NO: 28613 - protein, 81 aa, Lynx canadensis
PQKSVTFEDVAVYFTQTEWNGLSPAQRALYRDVMLENYGNVASLGFSLLKPAVISQLEGAGQLGDPSPLVAGTEICSQGVW

SEQ ID NO: 28614 - protein, 81 aa, Phyllostomus discolor
WVQAPVTFKDVAMEFTQEEWMMLDSAQRSMYRDVMLENYMNLTSVAYQLCKPSVTSQLGQEETRTMKRRIPKGTYLNWEIQ

SEQ ID NO: 28615 - protein, 81 aa, Phyllostomus discolor
MTFADIALYFSREEWRLLNEAERRLYLDVMLENFELISSLGCCCGGEDVEELSEQNVSVRVVQAENPKVALSSQKSHPCES

SEQ ID NO: 28616 - protein, 81 aa, Phyllostomus discolor
SLDLVTFTDVAIVFSQDEWEWLNLAQRTLYKKVMLENYKNLVSVGLCLSKPDMISLLEQGKEPWVINGEMTGGLYPDLEYM

SEQ ID NO: 28617 - protein, 81 aa, Oryctolagus cuniculus
SGPERPEVAGQARAPRSVSGAAARWRAPGALLGGSRQDLWMPPTQPHAGFLVFKPELISRLEQGQEPWVLDLQGAEKTEAS

SEQ ID NO: 28618 - protein, 81 aa, Oryctolagus cuniculus
MTAFEDVAVYFTWEEWQKMNNAQKILYRDVMLETYSSLFSLGHCITKPDLIFKLEQGAEPWMVDECLNESLPVGMKRDDLI

SEQ ID NO: 28619 - protein, 81 aa, Rhinolophus ferrumequinum
GLLTFRDVFIEFSQEEWECLDPAQQKLYMDVMLENYRNLVSLGLAIAKPDLVTFLEQKQEAWGVKIKRTAIHPDMSPHDTL

SEQ ID NO: 28620 - protein, 81 aa, Rhinolophus ferrumequinum
MSLTFRDVAIHLSQDEWECLDPAQRALYRDVMMENYSNLVSLGCSIPKPDVITLLEQEKEPWMVMREGTRSWYTDLESKCV

SEQ ID NO: 28621 - protein, 81 aa, Rhinolophus ferrumequinum
MLENFRNLLSVGHLPFKPDMVSQLEVEEKLWMMERETQRNENSSGSHMAVLSGSKNQNKVETLQKVALKYLLHEELPCWQI

SEQ ID NO: 28622 - protein, 81 aa, Rhinolophus ferrumequinum
QPWLTLQDVIIEFSPEEWECLDSAQRLYRDVKSENYRNLRSLDEGDVSPEVRICPCVSSPLCASWEPLPCVTEIEALFTQT

SEQ ID NO: 28623 - protein, 81 aa, Ursus maritimus
FQGSLSFRDVAVGFTRKEWQQLEPAQRTLYRDVMLENYSHLVSVGEEITKPAVISRLEQGQEPWMEEEEILRWSFPGERGS

SEQ ID NO: 28624 - protein, 81 aa, Ursus maritimus
SVTFEEVAVDFSQEESASLDPAQKILYRDLMLENYRNLRQPHIVIDQKFQLKIKRPLQSRIKSGKNTYCQENDANSTQRET

SEQ ID NO: 28625 - protein, 81 aa, Ursus maritimus
STEPVIFRDVAMYFTQKEWQLLKPAQKDLYREVMLENYGNLASLGYRLFKPKLITRLEQGDEPCVKERDVPRAPQQGDAGI

SEQ ID NO: 28626 - protein, 81 aa, Ursus maritimus
MGLLTFGDVAIEFSQEEWRCLSHTQRELYRDVMLENYGHLLFLGLIASKPDLVSCLEQKKEPWDLKRRKTVANISENQRFK

SEQ ID NO: 28627 - protein, 81 aa, Rhinopithecus bieti
SQEPVTFADVAVVFTPEEWVFLDSTQRSLYRDVMLENYRNLASVADQLCKPTALSYLEQRGEQWTTDRGILSDTCAEPQLQ

SEQ ID NO: 28628 - protein, 81 aa, Phascolarctos cinereus
GKESVTFKDVAVEFTQEEWVQLNSSQKKLYKDMMLENYRNLVSLERRGFTGDKPLECNECGKAFWSKNHLAVHQRIHTGDI

SEQ ID NO: 28629 - protein, 81 aa, Phascolarctos cinereus
HQALVTFKDVAVDFTQEEWGRLCPSQKELYRDVMLENYRNLVWLGLAVSKPDVIYQLEQVEGPWVPEGEAPAVSCPESFIS

SEQ ID NO: 28630 - protein, 81 aa, Phascolarctos cinereus
MLENYRNLVSLGLPVSKPEVISQLEQGEVPWLAEEEVPRSTYSDWETRPETKNSVAKQGTSVKESSQERLAGCGLWDSNLG

SEQ ID NO: 28631 - protein, 81 aa, Puma concolor
MSPAQRTLYRDVMLENYSHLISVGYCLTKPKMIFRLEQEEEPWSLEEEFLNQRYPGYFSIDIHIEGNQEKQEKPLWQVIFT

SEQ ID NO: 28632 - protein, 81 aa, Myotis lucifugus
ESQDMNFEDVAIAFSQEEWGLLDEAQRHLYCDVMLEVFALVSFIGHWHKMDDVEAYSEHSVSVGESQVRASKTAIATQRTH

SEQ ID NO: 28633 - protein, 81 aa, Myotis lucifugus
FQETVTFGDVAVHFSREEWMCLDPGQRALYKEVMLENHSSVAGLAGFLLFKPELISRLEQGQEPWVLDLQGTEAREARRTL

SEQ ID NO: 28634 - protein, 81 aa, Myotis lucifugus
MNFEDVAIAFAQEEWEILDEAQRRLYCDVMLEVFSLVSFVGPWRKMDDVEAYSQHSVSVGDSQVRASRTAAATQRTHLCKP

SEQ ID NO: 28635 - protein, 81 aa, Sapajus apella
SRSLENDGVCFTEQEWENLEDWQKELYRNVMESNYETLVSLKVLGQPEGEAELGTEMLGDLEEEGPGGAHPGGVMIKQELQ

SEQ ID NO: 28636 - protein, 81 aa, Oryctolagus cuniculus
TPGSLTFTDVAIDFSEDEWQWLNLAQRSLYRKVMLENYRNLVSVGLCISKPDMISLLEQEKEPWVVTGDMTRGLYPDLEYV

SEQ ID NO: 28637 - protein, 81 aa, Oryctolagus cuniculus
PQVSVTFEDVAVLFTWDEWKKLDPSQRILYRDVMLENYSNLLSLGLPCTKPNVISLLEQGEDPIEEESPGGFSLGCKSRLK

SEQ ID NO: 28638 - protein, 81 aa, Oryctolagus cuniculus
SQELVTFEDVAVYFIRKEWKRLEPAQRNLYRDVMLENYGNVFSLDGETRTEDDQDISQDRGSHGVLLGRFQKDISQGLKFE

SEQ ID NO: 28639 - protein, 81 aa, Pteropus alecto
PKVPVTFDDISIYFSTPEWEKLEEWQKELYKNIMKGNYESLISMDYAMNQPDVLSQIQPEGEHNTEDQTRPQESEIPTDPS

SEQ ID NO: 28640 - protein, 81 aa, Pteropus alecto
SQGLVTFEDVAVYFSLEEWQRLDAAQRDLYKEVMQENYGILVSLGYPIPKPDLIFRLEQGEEPWVPDSPSPEEGDIVTGVY

SEQ ID NO: 28641 - protein, 81 aa, Pteropus alecto
QGLLIFRDVAIEFSQEEWECLDTAQRALYRDVMSENYRNLVFLAGPDHLFGANEGVLRFEEKKDNIHPPRYVGMSEADDTD

SEQ ID NO: 28642 - protein, 81 aa, Oryctolagus cuniculus
MVIVQEFLTLEDMAVAFTQEEWQLLGPAQRDLYWDVMLENYSNLVSVGYQASKPDVISKLERGELWTMEDKMHSPVCLGEW

SEQ ID NO: 28643 - protein, 81 aa, Rhinolophus ferrumequinum
LQASVSFKDVTVEFTQEEWQHLGPAQRALYRDVMLENYSHVVSVEDWQLDHLENTQENQDKYLCQVLFTSSQSLTNEQEKV

SEQ ID NO: 28644 - protein, 81 aa, Rhinolophus ferrumequinum
TPVLYTLPRATENERTSGYCFTKPELIFRLEQCEDPWLIEKEFLSRNSPEASQLDELSEKSPENQGKHLWQVLFTKNSLIT

SEQ ID NO: 28645 - protein, 81 aa, Rhinolophus ferrumequinum
QAQESLTFDDVAVHFTWEEWQLLVPEQKDLYRDVMLENYSHLVSVGYQVSKPDVFCKLERGELWTIDKIHSQNCPEIRKVN

SEQ ID NO: 28646 - protein, 81 aa, Ursus maritimus
VTFEDVAVYFSWKEWRLLDEAQRRLYHRVMLENFTLISSLGCCCGAEGEEAPFAQSTSVGASQAGTPTAPVSSRKTHPCEL

SEQ ID NO: 28647 - protein, 81 aa, Ursus maritimus
QEEWQHLDPAQRSLYRDVMLENYSHLVSLGYSISKPEVILKLEQGEEPWILEEEFPSQSDLELIKSRNYSRKKFNEFNKGR

SEQ ID NO: 28648 - protein, 81 aa, Ursus maritimus
SLTHIKQDLSLQESLTLEDVAVGFTWEEWQLLAPTQKELYQDVMLENYRNLVSVGEDKTTLFHLSVKHFLNARFLLKGFSI

SEQ ID NO: 28649 - protein, 81 aa, Ursus maritimus
DGILDVAVYFSREEWELLDETQRHLYHNVMLENLALVASLGKALPPPSFLFCSLSFLFSRNSSEHSELSTSIEHAEDVLDS

SEQ ID NO: 28650 - protein, 81 aa, Ursus maritimus
MLENYKIIVSLGLPVPRPDVIFQLKRGDEPWIVDLHRSEERECPENVSLDWGTKPEIHGASEEESEGTARGKLGGEVPVCP

SEQ ID NO: 28651 - protein, 81 aa, Ursus maritimus
MAAGFKFKDVAIYFSQKEWECLHSAQKALYRDVMLENYNNLISLGLSDSKPDVISLLEQGKEPWMVKSQETKECCPDWESR

SEQ ID NO: 28652 - protein, 81 aa, Rhinopithecus bieti
NFWILRLPPGSKGEAPKEWGKLEDWQKELYKHVMRGNYETLVSLDYAISKPDILTRIERGEEPCLDGWGQEKQNEVEVGHP

SEQ ID NO: 28653 - protein, 81 aa, Puma concolor
FEGSVSFEDVAVDFTRQEWHRLDPAQRTMHKDVMLENYSNLASVGLCVAKPEMIFKLERGEELWILEEESSGQRFPGSLSL

SEQ ID NO: 28654 - protein, 81 aa, Sapajus apella
MGVLTFRDVAIEFSPEEWECLDSAQQHLYRDVMLQNYRNLVFLGLAVTKPDLITHLEQEKELWNVERQETVAKYPEILPKQ

SEQ ID NO: 28655 - protein, 81 aa, Sapajus apella
FQESVAFEDVAVYFTQNQWGSLDPAQRALYSEVMLENYANVASLAFPFPKPALISHLEKGEAPWGPDPWDAEIPSGINQGG

SEQ ID NO: 28656 - protein, 81 aa, Sapajus apella
MDVAIEFSLEEWQCLDTAQRNLYRDVMLENYRNLVFLGIVVSEPDLITCLEKGKKPLTVKGHEMIATPPVMCSHFAKDLWP

SEQ ID NO: 28657 - protein, 81 aa, Oryctolagus cuniculus
FRAGTLWPPCSLGLSGPLEFTVRGRSRLEGLSFEDLTVYFTHEEWQDLDDAQRTPYREVMHYLVNINFQSTVYGLQWLPPR

SEQ ID NO: 28658 - protein, 81 aa, Oryctolagus cuniculus
MLENYGHLVSLGLSISKPDLVSLLEQGKEPWLGKGDIRRNLFSVSEPTDEIKEFSPENVIYKGDSSQYLIVERILSQNPVH

SEQ ID NO: 28659 - protein, 81 aa, Oryctolagus cuniculus
MKGHKDSQGGPRDELIHTSRQALTHGLCFGFCVTKPEVIFRLEQGEEPWILEEEFSNQSFPGIWKADHLNERSKENHLKHF

SEQ ID NO: 28660 - protein, 81 aa, Pteropus alecto
MNRVSPFKDMIFCFSEEDWSLLDPAQTGFYGEFIIGEDCGVSLPPDVPAAQLDLSQEENEPRVPELQDPQEKGAAQASYAA

SEQ ID NO: 28661 - protein, 81 aa, Oryctolagus cuniculus
SQSFVEFGDVAIGFSQEEWEWLNPAQRTLWKRVVWENHSDLGASEHCVSKPDFVSLLEEGKEPWMGRRDVTGGLFSLESSG

SEQ ID NO: 28662 - protein, 81 aa, Rhinolophus ferrumequinum
PQKSVTFEDVAVYFTPTEWDGLSPAQRALYREVMLENYGNVASLGFSLLKPAVISQLEGGGELGCPSLLTAGTGTGPPGLW

SEQ ID NO: 28663 - protein, 81 aa, Rhinolophus ferrumequinum
FQGAVTFKDVIVEFTQEEWKLLDTAQRTLYREVMQENYGHLVSVGYCVNKSNAVFKLKQGKEPWTLEVEFPRQNHPENLWN

SEQ ID NO: 28664 - protein, 81 aa, Ursus maritimus
MLENYSNLVSVGYQVTKADAFYQLENGTPWITEEEIQSQSHPEDTWEVDCHTDGHKENQGNLETMESHHENNAFRKILSLS

SEQ ID NO: 28665 - protein, 81 aa, Ursus maritimus
GLLTFGDVAIEFSQEEWQCLSHTQRELYRDVMLENYGHLLFLECGKSGNESSRIRIHKTVCSGEKPYKCKECGKAFIQKSH

SEQ ID NO: 28666 - protein, 81 aa, Panthera pardus
ALALVSFEDVAVTFTGEEWRQLDLAQRTLYQEVMLETCGLLVSLGHPVPKPELIYPLEPGQELWTGKRGISKSTYTGEKAK

SEQ ID NO: 28667 - protein, 81 aa, Panthera pardus
RLPALLLALDRRRRTASQNAPPESGAQVPVSFEDVSMYFIKTEWKLLGLSQRILYKRVLLENYRHLVSLGCTVQSLAVSVP

SEQ ID NO: 28668 - protein, 80 aa, Oryctolagus cuniculus
MEIFESFEDLAVYFTWEEWQNMNKAQKILYRDVMLETYSSLLFLGHCITKPDLIFKLEQGAENLMNVITVAKPSAISHNS

SEQ ID NO: 28669 - protein, 81 aa, Oryctolagus cuniculus
RPRALKFVDVAVYFSEEEWGCLRPAQRALYRDVMRENYGHLGALGFPGPKPALISWMERESEAWSPAAQDPDEGQSPGGAL

SEQ ID NO: 28670 - protein, 81 aa, Ursus maritimus
SLSFEDVAVDFTWEEWQLLDSAQKTLYRSVTLENLSSLVSLGKDTSCVDVDARPFPAHLLKSGTCECGVKLAPLKQKPNKH

SEQ ID NO: 28671 - protein, 81 aa, Ursus maritimus
DVAIDFSREEWEWLNSAQRTLHRDVMLENYRNLVSLGPCVSKPDLVSLLEHGKEPWMVEREVTRGLFSGECGGPGGVGSAT

SEQ ID NO: 28672 - protein, 81 aa, Ursus maritimus
MGLLTFGDVAIEFSQEEWRCLSHTQRELYRDVMLENYGHLLFLGLIASKPDLVSCLEQKKEPWDLKRRKTVNLTVPNDNLE

SEQ ID NO: 28673 - protein, 81 aa, Ursus maritimus
EAVVFADVAVDFTPEEWALLDGGQRRLYRDVMLETCRNLGTNVSYECPILLGPRNGGTLHVWESNEGNRCGETVKQIPSLT

SEQ ID NO: 28674 - protein, 81 aa, Ursus maritimus
PQEPVTFADVAVLFTPEEWMFLDSAQRSLYRDVMLENYRNLASVGDQLGKPSTFSHLEPPERSSFPGTHPEPQHQPQDSVS

SEQ ID NO: 28675 - protein, 81 aa, Rhinopithecus bieti
FRDVAIEFSQEEWKCLDPAQRTLYRDVMLENYRNLVSLDISSKCTMKEVLSTVQGNREVFHTGTLQRHESHHFGDFCFQDI

SEQ ID NO: 28676 - protein, 81 aa, Panthera pardus
YMQGLLTFRDVAIEFSQEEWGCLNHSQRELYMGVMLDTYGHLLFLGLVVSKTDLVIVLEQEKELWGVKRKETVALHPGRWK

SEQ ID NO: 28677 - protein, 81 aa, Panthera pardus
SQVSVSFKDVTVEVTQEEWHQMDPAQRTLYRDVMLENYSHLVSLGYCFIKPEVIFRLEQGEDPWLLEDEFLNRSYLGDCQL

SEQ ID NO: 28678 - protein, 81 aa, Panthera pardus
HQEVVTFEDAAIYFTRTEWAGLSSAQRDLYREVMLTNYGNLTSLGYPVCRLALMSLLEEGDLSWGLETQDDPPAESTNDVC

SEQ ID NO: 28679 - protein, 81 aa, Panthera pardus
QDFVSFKDVAVNFTEEEWRELDPVQRVLYRDVMLENYRNLVSLDLETRKLSPKNVFSEEESYQGISMEKNTEVDASLKEAW

SEQ ID NO: 28680 - protein, 81 aa, Macaca nemestrina
MLENYRNLAFLGIAVSKPDLITCLEQGKEPWNMKRHEMVDKPPAICPHFAQDFWPEQGMEDSFQKVLLRKYEKCGHENLQL

SEQ ID NO: 28681 - protein, 81 aa, Macaca nemestrina
MLENYRNLAFLGIAVSKPDLITCLEQGKEPWNMTQHEMVDESPGICPRFAQDLWPEQGMDDSFQKVILRRYEKYGPENLQL

SEQ ID NO: 28682 - protein, 81 aa, Oryctolagus cuniculus
PKVPVTFDDVAVYFSELEWGKLEDWQKELYKHVMRGNYETLVSLDYAIAKPDILTRMERGENPCPEDQWGQEKKENEQGTA

SEQ ID NO: 28683 - protein, 81 aa, Oryctolagus cuniculus
AQGPVSFKDVAVGFTQEEWRQLEPAQRRTYREVMLENYSHLVAVGGDISKPRVIVKLEQGEEPWVPEGELPCRSRAEEAWK

SEQ ID NO: 28684 - protein, 81 aa, Pteropus alecto
MVKIEDMAVSLILEEWGCQNLARRNLSRDNRQENYGNVFSQENIFAASQHAVCGDSLQEEKKEVFRAAIDKKLTQLCSKGN

SEQ ID NO: 28685 - protein, 81 aa, Rhinolophus ferrumequinum
SLETVTFKDVAVDLTQEEWQQMKPAQRNLYRDVMLENYSNLVTVGYQVTKPDVIFKLEQEEEPWVIEEEMFGTHCPESRRG

SEQ ID NO: 28686 - protein, 81 aa, Rhinolophus ferrumequinum
VQGSVSFEDVTVEFTQEEWPYLGPTQRALYRDVMLENYSHLVSVGYCITKPQVIFKLEQGEELWSLEEEFLIQRYPGYYQV

SEQ ID NO: 28687 - protein, 81 aa, Rhinolophus ferrumequinum
FCVTFEDVAVFFSWEEWELLDEAQRHLYHDVMLENLRLITSPGKIFTPTSPLVVHRMVMSPATARWAQREPGPEEWHPGGG

SEQ ID NO: 28688 - protein, 81 aa, Rhinolophus ferrumequinum
FQASVSFKDVTVGFTPEEWQHLDPTQRSLYRDVMLENYSNLVSVGYCVTKPEVIFRLEQGEEPWILEKEFMSQSFPEVWKT

SEQ ID NO: 28689 - protein, 81 aa, Rhinolophus ferrumequinum
MSFMVTFKDVAVVFTEEELGLLDSAQRKLYQDVMMENFRNLLSVGHQPFKQGKIQQEMGTIPESEPHEELSYWQIWQQIAR

SEQ ID NO: 28690 - protein, 81 aa, Rhinolophus ferrumequinum
AQGSVSFEDVTVEFTQEEWPYLGPAQRALYRDVMLENYSHLVSVGYCITKPQVIFKLEQEEEPWSLEEEFLNQRYPGYYQV

SEQ ID NO: 28691 - protein, 81 aa, Ursus maritimus
LTFGDVAIEFSQEEWRCLSHTQRELYRDVMLENYGHLLFLGEDDSFQISQAPLGPDLVSCLEQKKEPWDLKRRKTVVIHSG

SEQ ID NO: 28692 - protein, 81 aa, Ursus maritimus
RGGCGEKQAGATLKLLLAKVPVTFVDIAVYFSEDEWKNLDEWQKELYNNLVKENYKTLMSLGKRSFPPPGRAVSGLCVRSL

SEQ ID NO: 28693 - protein, 81 aa, Ursus maritimus
TVTFKDVAVVFTEEELALLDKAQINLYQDVMLENFRNLVSVGDRIKNNISHLQGKGLSYLSQEVLYCWQIWKQRVSELTVS

SEQ ID NO: 28694 - protein, 81 aa, Rhinopithecus bieti
EKGPLTFRDVAIEFSLEEWQCLDTAQQDLYRRVMLENYRNLVFLGIAVSNPDLITCLEQGKEPWNMKRHAMADEPPVMYSH

SEQ ID NO: 28695 - protein, 81 aa, Rhinopithecus bieti
PQASVCFEDVAMAFTQEEWEQLDLAQRTLYREVTLETWEHIVSLGLFLSKSDVISQLEQEEDLCRAEQVVPRGARSSKEQR

SEQ ID NO: 28696 - protein, 81 aa, Panthera pardus
PKSVCRLEEGIPLPHPHPEMESTLPTTGAQGPMLFEDLAVFFSQEECVCQHSVQRSLSRDTTQEGFEEMALMENSFRREEV

SEQ ID NO: 28697 - protein, 81 aa, Panthera pardus
SQDLVTFKDVAIDFSQEEWEWLNPAQRSLYKNMMLENYRNLVSLDLESMYETHELSLKHFVYDDVLMERITGCGLEHSTFS

SEQ ID NO: 28698 - protein, 81 aa, Macaca nemestrina
LFQVTFSDVAIDFSHEEWGWLDSAQRDLYKDVMVQNYKNLVSVTGLSVTKPYVITLLEDGREPWMVEKKLSKDWESRWENK

SEQ ID NO: 28699 - protein, 81 aa, Macaca nemestrina
VTFRDVAIEFSLAEWKCLNPAQRALYREVMLENYRNLEAVDSSFKTMMEYSSTGQGNTEVLHTGMLERHESHHIGDFCFPE

SEQ ID NO: 28700 - protein, 81 aa, Ursus arctos
ELLSFEDVAMYFTREEWNRLDWAQKDLYRDVMLENYRNMILLGSEARCKMKKPTPKQKISEDSESCKMSVVKQTTAKRPAE

SEQ ID NO: 28701 - protein, 81 aa, Ursus arctos
MASPSPPPEPKEWDYLDPAQRSLYKDVMMENYGNLVSLDVLNRDKDEEPTVKQEMEEIEEEVEPQGVIVTRIKSEIDQDPI

SEQ ID NO: 28702 - protein, 81 aa, Oryctolagus cuniculus
MCCFALTGCCISKPEVIFKLEQGAEPWIVEEPVNHSLPVLQKMDDLIGTSQEIQDMIFWQVVMTNNTSTKENTYLGETFNL

SEQ ID NO: 28703 - protein, 81 aa, Pteropus alecto
PKASRSLENDGVCFSEQEWENLEDWQKELYRNVMKSNYETLVSLRPRLQRRLENMENLLKNRNFWILRLPPGSNGEVPKVP

SEQ ID NO: 28704 - protein, 81 aa, Rhinolophus ferrumequinum
VMFRDVAIDFSQEEWECLDFAQRDLYRDVMLENYSNLVSLDLPSRCANKELSPKKDTFETELSQWEMSDRLENYDLKECSS

SEQ ID NO: 28705 - protein, 81 aa, Rhinolophus ferrumequinum
LLQAPVSFKDVTVEFTQEEWQHLGPAQRALYRDVMLEIYSHLVSVGYCSIKPEVIFQLEQEDPLLVEDKFLNGSYPAGIFE

SEQ ID NO: 28706 - protein, 81 aa, Rhinolophus ferrumequinum
QGRVTFDDVAVYFSLEEWDLLDEAQRHLYHDVMLENLALITSLELEHQKQHIGEKCFRSNMGTVSLVKDCKFCVSGKPFSC

SEQ ID NO: 28707 - protein, 81 aa, Ursus maritimus
MLENYRNLVSVGYQASKLDSLFQSEQGGPPWTVEGAAQSQTCPEEIWEIDHMQWHPENQNESKTLERYQQSYALGNNFDLC

SEQ ID NO: 28708 - protein, 81 aa, Ursus maritimus
LGLLDPAQRKLYRDVMLENFRNLLSVGEGNYIQGRELKCLSYRELSYWKIWEHVAGELTENQDHRVNLQGKSFQFSEDASL

SEQ ID NO: 28709 - protein, 81 aa, Ursus maritimus
QDSVVFEDVIVDFTQEEWTLLNPAQRRLYKDVMLETFRNLVSVDDDTQLKTNGSISQQDIFGEKISNEQKIARFIKNDYWT

SEQ ID NO: 28710 - protein, 81 aa, Ursus maritimus
QGWLTFRDVAIEFSPEEWECLDPAQRALYQDVMVENYRNLVSLGEDSFPPELNSISVSEQGEEPWTVESEGEIGGNADRWE

SEQ ID NO: 28711 - protein, 81 aa, Ursus maritimus
ALGLVTFEDVAVYFSREEWGLLNLTQRSLYRDVMLENFALIGSLGFAPSRSHVVAQLDSEEELWVPSMVDLTMGSRAEARR

SEQ ID NO: 28712 - protein, 81 aa, Rhinopithecus bieti
AQGYVTFEDVTIYFSQEESGLLDEAQRLLYCDVMLENFALIASLGLISFRSHIVSQLEMGKEPWVPDSVDMTSAMARGAYG

SEQ ID NO: 28713 - protein, 81 aa, Rhinopithecus bieti
ADVSLAFRDVSIDLSQEEWECLDPAQRDLYKDVMLENYSNLVSLGYTIAKPDVITLLEQQQEPWIVMREGTRSWYTDLEYK

SEQ ID NO: 28714 - protein, 81 aa, Rhinopithecus bieti
MDTVVFEDVVVGFTLEEWALLNPAQRNLYRDVMLETFKHLASVDNEAQPKTGGSISQQDTSGEKLSLKQKIEKFTRKNTWA

SEQ ID NO: 28715 - protein, 81 aa, Panthera pardus
RPESVTFEDVAVYFSENEWIGLAPAQRVLYRDVMLENYGVVASLGYPFLKPAAISHLEQVEELLNLKLQGEGPSLLCTEGV

SEQ ID NO: 28716 - protein, 81 aa, Macaca nemestrina
TQGPLKFMDVAIEFSQEEWKCLEPAQRTLYRDVMLENYRNLVSLGICLPDLSVISTLEEKKDPWILQSEEKIANNPDGREC

SEQ ID NO: 28717 - protein, 81 aa, Macaca nemestrina
PQGHLTFRDVAIEFSQAEWKCLDPAQRALYKDVIIMGSEFYSFLAFLGSSYALGSNAKDKPVKKQLGVSFHLHLSELELFP

SEQ ID NO: 28718 - protein, 81 aa, Myotis lucifugus
QEQVSFKDVCVDFTQEEWYLLDSAQKILYRDMMLENYSHLVSIGYCITKPEVIIKIEQGEEPWILKQGFPSQCHPEDWKVG

SEQ ID NO: 28719 - protein, 81 aa, Myotis lucifugus
DMNFEDVVIAFSQEEWGLLDEVQRHLYCDVMLQALLNTVSLSCWHKMDNEEAYSDQSVSVQGESRVRASKTAPATQKSHSC

SEQ ID NO: 28720 - protein, 81 aa, Myotis lucifugus
SQDMNFEDMAIAFSQEEWEILEEAQRRLYCDVMLEVFALVASVGCRHKMNDEEAYSDQSVSIEEESHVRDSETASASQKSH

SEQ ID NO: 28721 - protein, 81 aa, Puma concolor
AQAPLSFEDVAVSFSREEWRLLVPAQKDLYRDVMLENYRNLVSVGYQASEPDSLFRLEHGGPLWVVEGAAPRPPCPGEYVA

SEQ ID NO: 28722 - protein, 81 aa, Sapajus apella
MLETYSHLLSVGYQVPEAEVVMLEQGNEPWALQGERPRQSCPGEKLWDHNQCRKILDYKQVSSQPQKMHPGKKPYERAEFQ

SEQ ID NO: 28723 - protein, 81 aa, Sapajus apella
FFAVLSFMTVAIEFSQEKWECLNPAQANLYRGAMLENYRNLLLLGLTVSKLDLVTFLEGRKEPWTVTSEETVAAQPGMCSY

SEQ ID NO: 28724 - protein, 81 aa, Oryctolagus cuniculus
GAQGSVTFRNVAMFLSQAEWLHLDSTQSSSYQEVTLENYNNLLSLRILFSQPKVISQLQQADHWLVKKEVPRGTCLGWESL

SEQ ID NO: 28725 - protein, 81 aa, Oryctolagus cuniculus
QQVMIAFEDLAVYFTWEEWQKMNNAQKTLYRDVMLETYSNLFSLGHCITKPELIFKLERGAEPCMVDECLNQSLSVGMKRD

SEQ ID NO: 28726 - protein, 81 aa, Pteropus alecto
WSQMPVTFEDVALYLSREEWGRLDHTQQSFYHDVLQKRNRLALGAVEVGKEPMPCPASHGDVKSFRTRAERAHGDSLQCGQ

SEQ ID NO: 28727 - protein, 81 aa, Oryctolagus cuniculus
TSPTMIAFEDLAVYFSWEEWKNMNKAQKILYRDVMLETYSSLLSLVAMKNDDIIRTNQEIQENLNQNGTTDNKTATPKRVE

SEQ ID NO: 28728 - protein, 81 aa, Rhinolophus ferrumequinum
ELVTFRDVIINFSQDEWEYLNSAQRDLYWDVMMENYSNLVSLDLEYKYATKSLSVGKNIIENNGSLWEVIESSKFIGLQNY

SEQ ID NO: 28729 - protein, 81 aa, Rhinolophus ferrumequinum
LTFEDIAIYFSAQEWRTLEAWQKELYKHVMRTNYEILVSLGNQQAVSSGEPACHFQADPLQSQCSSEPLLGKREAVSFTPD

SEQ ID NO: 28730 - protein, 81 aa, Rhinolophus ferrumequinum
VDDLVIFRDVAVDFAQEEWECLNSYQKNLCRDAILENYSNLVSVGYSISKPHVVTLIEQGKEPWMVARDEKKRWNFIHHLF

SEQ ID NO: 28731 - protein, 81 aa, Ursus maritimus
MQKNLYRDVMLETFQNLVSVDYETLFKASGLVSQQDRHEEKNPSEQNMAKFTRNHSCAYILEKNWEDHSIEDQHGNHSRHL

SEQ ID NO: 28732 - protein, 81 aa, Ursus maritimus
RRICTNTDSVTFTDVAVNFTREEWALLDSAQRILYRDVMLENCRNLASVGSQAEPESKIWIDRQNNILHVHNSICVGVDID

SEQ ID NO: 28733 - protein, 81 aa, Ursus maritimus
MLENYQNLVAVGYQLPKPKLITWLEQQELRTVEKRVFQEWEMQHQAKGSASHQDSLEGKTARKIKKEGTHRGAEYSDYQQS

SEQ ID NO: 28734 - protein, 81 aa, Rhinopithecus bieti
SCEGSVSFRDVAINFSREEWQHLDLSQRNLYRDVMLETYSHLLSAGYQVPKPEVVMLEQGKEPWALQGDRPRQSCPGEKLW

SEQ ID NO: 28735 - protein, 81 aa, Myotis lucifugus
AQDMNFEDMAIAFSQEEWEILDESQRRLYCNVMLEVFAFVSFVGSKGHSSFIPYVQHTFIMGLHPVNIHFLIISLFSGPWH

SEQ ID NO: 28736 - protein, 81 aa, Puma concolor
MLENFSHVISLGYPVSKPDVISKLEQGEDPWIIKRDIPYYGASDSNLEKMHNGVMPCNNNQCGNIFSSKQSLMQYQNVETK

SEQ ID NO: 28737 - protein, 81 aa, Sapajus apella
MFQNYENLVSLGLSITKPYVITLLEDGKEPWMMEKNLSKGVTPDWESRWENKELSTKKDIYDEDSPQTVIIEKVIKQSYEF

SEQ ID NO: 28738 - protein, 81 aa, Sapajus apella
MLENYRNLVFLGIALSKPALITYLEQGKEPWNMKRHETVAKPPVMCSYFAQDLLPEQDTKKLFPKVILRSYGNCGDKHVPL

SEQ ID NO: 28739 - protein, 81 aa, Sapajus apella
QGCLTFSDVAIEFSLAEWKCLTPAQRALYREVMSENYRNLESVGEENVPLDMRNLCQAGVQWRNLGSLQPPPPRFKKFSYL

SEQ ID NO: 28740 - protein, 81 aa, Sapajus apella
PKVPVTFDDVAVYFSEQEWGKLEDWQKELYKHVMRGNYETLVSLDYAISKPDILTQIERGEEPCPDQWSQKKGSEVEVAHS

SEQ ID NO: 28741 - protein, 81 aa, Oryctolagus cuniculus
MIAFEDLAVYFMWEEWKKMNNAQKILYRDVMLETYSSLFSLGYCTTKPDLIFKLERGAEPWMVDECLNRSLPVVMKRDDLI

SEQ ID NO: 28742 - protein, 81 aa, Oryctolagus cuniculus
ISFDDVAVDFTLEEWLLLNPTQKNLYRDVMLENCSNLVFLEVWLDNDSKIWHQDNQDKLKSMERGHQYDVLEKIFNSSINF

SEQ ID NO: 28743 - protein, 81 aa, Oryctolagus cuniculus
KVPVTFDDVAVYFSEQEWGKLEDWQKELYKHVMRGNYETLVSLGSAPPVPAPDLLMQIKQEGELQLQEQQALGVEAWAAGQ

SEQ ID NO: 28744 - protein, 81 aa, Oryctolagus cuniculus
SCEGSVSFRDVAIDFSSEEWQHLEPAQRSLYWDVMQETFSHLLSVGFQVPEPEVFMLEQGEEPWELQSKNPSQFCPGEKLW

SEQ ID NO: 28745 - protein, 81 aa, Pteropus alecto
SCEGSVSFRDVAVDFSREEWQHLDLAQKNLYRDVMLETYSHLLSVGYQVPEPEVFMLEQGKEPWALQDESPHQSCSGEKLW

SEQ ID NO: 28746 - protein, 81 aa, Pteropus alecto
MDFTLEDWEQLGLDQGDVFWDTALDNYQNLFLLNPPGSDLPSPPDVAEEPEALMRGSPEATGPDIAEAKNCSPLQDFLEEG

SEQ ID NO: 28747 - protein, 81 aa, Oryctolagus cuniculus
LQVLVSFEDLAVDFTWEEWQDLDSAQRTLYRDVMLETYSSLLSLGFCITKPEVIFKLEQGAEPWTVEESLNQSVSGQSVHT

SEQ ID NO: 28748 - protein, 81 aa, Rhinolophus ferrumequinum
SVTFGDVAVLFSQDEWLCLDPAQRALYREVMLENYSSLVSLDFKTWPEIEALPPRQDIFIEETSQGIRKKKCAKFGHWGIK

SEQ ID NO: 28749 - protein, 81 aa, Rhinolophus ferrumequinum
AQDSVTFEDIAVFFSWEEWGLLDEAQRRLYHDVMLENFALISSLGCCCGAGDVEAPTEQNDCVEVSQARTPEGAPTSQKTH

SEQ ID NO: 28750 - protein, 81 aa, Rhinolophus ferrumequinum
VQGQVTFEDVAVYFSQEEWRLLEDTQRLLYRDVMLENFALTASLGYASSMSHGVAPLELDGKPWVPDWVDVIPAMTREAQG

SEQ ID NO: 28751 - protein, 81 aa, Ursus maritimus
WVPSLSQAGKSGDQAAAAALQMVRPQGSAAYQFLSVDYTERKWKGPALSQRAVHQSIMPGNYCSMASLGNDSVPQYYSLHS

SEQ ID NO: 28752 - protein, 81 aa, Ursus maritimus
HDVAVNFSWEEWQDLDDAQRTLYRVVMLETYSSLVSLGHCITKPEVIVKLEQGAEPWTVEEAPTQSLPGQSTSGDLIETRQ

SEQ ID NO: 28753 - protein, 81 aa, Ursus maritimus
MRLLTFRDVAIVFSQEEWEQLTPAQRDLYRDVMLETYSNLVSLGLCVSKPDMISSLEQRKEPWMVKRKLTRGRCPGEHGRP

SEQ ID NO: 28754 - protein, 81 aa, Oryctolagus cuniculus
YQELVTFGDVAVDFSQEEWDCLDSSQRHLYSNVMLENYSVLVSLGLCFSKPSVILLLEQGKEPWMVKRELTKGLCSGWESM

SEQ ID NO: 28755 - protein, 81 aa, Pteropus alecto
ASVTFADLAVYFSQEEWEGLSPIQKDLYEDVMLETYQNLVSVALILHVRIHSGENLYRCNKCEKVCNRHSSLLQHQKVHTK

SEQ ID NO: 28756 - protein, 81 aa, Rhinolophus ferrumequinum
MLTFRDVFIEFSQEEWECLDPAQRKLYMDVMLESYRNLVSLGHSISKPDVITLLEQGKDPCMVVREETRRWCTGKNKSGRR

SEQ ID NO: 28757 - protein, 81 aa, Rhinolophus ferrumequinum
PKVPVTFGDLAIYFSQEEWEWLSPTQKDLYKDVMLDNYQNLLFLGLSYRRPNVITLLEEGRAPWMVEPVRRRRGLDLGSKC

SEQ ID NO: 28758 - protein, 81 aa, Ursus maritimus
MFSDVSVDFSQEEWECLDPGQRDLYRDVMLENYSNLLSMGLYIPKPQVISLLEQGKEPWMVGRELTRGLCSDLESMCETKL

SEQ ID NO: 28759 - protein, 81 aa, Panthera pardus
AQELLTLEDVAVDFSWEEWQLLAPAQKDLYRDVMLENYRNLVSVGCQATKRDALSVLEHRDEAWMKAEDEIQDRTRAGIGR

SEQ ID NO: 28760 - protein, 81 aa, Panthera pardus
MLETYRNLVSLGLQRSKPDVISRLEKGEEPWAPQSLRIEESWIRNHRSGSFESLMEKKELTPKQEISKAMESQRAKSEEHA

SEQ ID NO: 28761 - protein, 81 aa, Panthera pardus
VQEQLTFRDVAIEFSQEEWECLDPAQRALYRDVMLENYRNLVSLGEKNVPPEVGICPNSSATFVIKELLPKKDINNGELYQ

SEQ ID NO: 28762 - protein, 81 aa, Panthera pardus
KSQGSLAFEDVAVNFTRDEWQLLDSAQKNLYRNVMLENVSSLVSLGFQLIKPDVIFKLEREQPWILGEEVPSQSLSEYWKV

SEQ ID NO: 28763 - protein, 81 aa, Panthera pardus
RDSVVFEDVAVDFTLEEWSLLDSVQKNLYRDVMLVSVEKIGKTIALKISMETMQDIKSCDRFYESNEGNQHRDTCSHCPHL

SEQ ID NO: 28764 - protein, 81 aa, Panthera pardus
MLETCGLLVSLGHPVPKPELIYPLEPGQELWTGKRGISKSTYTGEKAKPETTEFTASQLAFTEEAPFEDQMTQGASRDSRL

SEQ ID NO: 28765 - protein, 81 aa, Macaca nemestrina
LQESVTFQDVAVDFTAEEWQLLDCTERTLYWDVMLENYRNLISVGCPINKTKVILKVEQGQEPWMVEGVNLHQISLCHPGW

SEQ ID NO: 28766 - protein, 81 aa, Myotis brandtii
MDFEDVAIAFSQEEWRLLDEAQRLLYCDVMLEVFALVSSVGCWHKTYDDEVFPERSISVQGESQVRASETAPATQRTLLCN

SEQ ID NO: 28767 - protein, 81 aa, Myotis brandtii
PQVKVTFEDVAVLLSQEEWDQLGPAQRGLYRHVMMETYGNVVSLGLPGTKPSVISQLERGEEPWVLDGHGAKESWGLGSDS

SEQ ID NO: 28768 - protein, 81 aa, Propithecus coquereli
PQEPVTFEDVAVYFTQNQWASLDSAQRALYREVMLENYANVASLVAFPFLKPVLISQLEKGEAPWGPDPWDTEILRGISPG

SEQ ID NO: 28769 - protein, 81 aa, Balaenoptera acutorostrata
QLTFKDVAIEFSQEKWECLDPGQRALYRDVMLETYRNLLSLGTSAKCVIKESAPKENSHTGEMLQTVLLERHESCETEDYG

SEQ ID NO: 28770 - protein, 81 aa, Vombatus ursinus
MGLPISKPDVISQLERKEDPWMLEREVSRDAYPDWEAKPEIKQSSPKHDFSEEGSSHGEIIERFTRDGPWDSMFLESWDCK

SEQ ID NO: 28771 - protein, 81 aa, Balaenoptera acutorostrata
AHMSLSFRDVAIDLSQEEWECLDPVQRALYRDVMLENYSNLVSLGCSSPKPDVITLLEQEREPWTVMREGTRSWYTDLESK

SEQ ID NO: 28772 - protein, 81 aa, Saimiri boliviensis
MGLLTFRDVAIEFSLEEWQCLDTAQQNLYRNVMLENYRNLAFLVVCPHFAQDLWPEQGMEDSFQKVILRRYEKCGHENLQF

SEQ ID NO: 28773 - protein, 81 aa, Vombatus ursinus
FQGSVTFRDVAVTFSHEEWGHLDPSQKALYCEVMLENYRNMVCLGLAASQPNVMDQLERGEAPWTPEGDVAWSSSADWVTS

SEQ ID NO: 28774 - protein, 81 aa, Saimiri boliviensis
MLENYGNLVSVGYQLSKPGVISQLEKGEEPWLMEREISGVPSLDLESKTKTKESSLQNDISWEELHCGLMMERSTKRSTLY

SEQ ID NO: 28775 - protein, 81 aa, Saimiri boliviensis
RSQESLTFQDVAVDFSREEWDQLYPAQKDLYRDVMLENYRNLVALGHQLYKPEVIAQLELEEEWVIEKDSPLDTCPDGENR

SEQ ID NO: 28776 - protein, 81 aa, Vombatus ursinus
GQLDPAQQNLYRDVMLDNYQNLIFLEDSINLFCLKHSGKRKEVGWFNLSKIWAYQALGGPNFHSFLVPLNPRRSLAFERDS

SEQ ID NO: 28777 - protein, 81 aa, Lynx pardinus
EEAFASFHDVSVDFTQEEWPLLSHAQRLLYRYVMLENYSNLVFLGIPFPKPTLVIVLEQGEEPWREERECLCSGDSKPDIQ

SEQ ID NO: 28778 - protein, 81 aa, Vombatus ursinus
MLENYGNLVCVGLAGAKPDVIQRLEQGEPPWRPGEGFSRSSRPDWETRLENKELSSALGIFIEESSRGKLKVDSPCVLNLR

SEQ ID NO: 28779 - protein, 81 aa, Vombatus ursinus
FQDSVTFQDVAVTFTPEEWGRLAAPQKELYREVMLENFGHLACLGLALSKPDVICQLERGEAPWMPRGDVPQRPSAAPSGD

SEQ ID NO: 28780 - protein, 81 aa, Balaenoptera acutorostrata
PLESVTFEDVAINFTQEEWALLETSQRNLFKNVMLENITHLVTVGYQISKSDVISQLEQGKELWSEATGCLQGQSPDDESP

SEQ ID NO: 28781 - protein, 81 aa, Saimiri boliviensis
SQGHLTFTDVAIEFSQEEWKCLDPAQRALYKDVMLENYRNLVSLGVGLPDLSVVSMLEQKREPWTLQSEEKIAWNPDGREC

SEQ ID NO: 28782 - protein, 81 aa, Saimiri boliviensis
DSVVFEDVAVDFTLEEWALLDSAQRDLYRDVMLETFQNLASVDDETQFKASCSVSQQDIYGEEISKESKIAEFTRNVSWAS

SEQ ID NO: 28783 - protein, 81 aa, Vombatus ursinus
FQESVTFKDVSVDFTQGEWGQLDPAQKNLYRDVMLENYRTLVSLGLQVFKPEVIYRLERGEAPWILEREISRGPCPDWPET

SEQ ID NO: 28784 - protein, 81 aa, Cervus elaphus
KDQGSLTLEDVAVDFTWEEWQLLAPAQKALYRDVMLENYSNLVSVGYQASKPAALSRLERGEPWPVEDEVHSRLCPEFSNL

SEQ ID NO: 28785 - protein, 81 aa, Colobus angolensis
QGRLTFRDVAIEFSLAEWKCLNPAQRALYREVMLENYRNLESVDISSKCMMKDVLSTGQGNMEVFHTGTLQRHESHHIGDF

SEQ ID NO: 28786 - protein, 81 aa, Vicugna pacos
AQGSLTLKDVAVDFTREEWQLLTPAQKALYREVMLQNYSHLVSVEIEKVAGLVQLHWQNQNMPQRMEQCYGQDAFGNSIHW

SEQ ID NO: 28787 - protein, 81 aa, Odobenus rosmarus
LQALLTFRDVAIEFSQEEWRCLNHTQRQLYRDVMLENYGHLLFLGLVLSKPDLIMFLEQEKQLWDVKRKETVAFHPDLLMN

SEQ ID NO: 28788 - protein, 81 aa, Eschrichtius robustus
SQAPVTFEDMAMYLTREEWRPLDPTQRDLYRDVMQENYGNVVSLACLYRSLTKQHQRTHSGEKPYECEECGKSFSRSSHLA

SEQ ID NO: 28789 - protein, 81 aa, Eschrichtius robustus
VTFQDVAVDFTEKEWPLLDSSQRKLYKDVMLENYSNLASVDWETPSKTKWSILMEDIFGKETSNGVTMESSRLGEKSSEYA

SEQ ID NO: 28790 - protein, 81 aa, Myotis brandtii
VMMDVNFEDVAIAFSEEEWVILDDAQRLLYYDVMLKVFALVSSVGCWHKMEDEEACSDQRVCIQGKSQVRTSKTAPVTHKN

SEQ ID NO: 28791 - protein, 81 aa, Myotis brandtii
MATRPSPLQEFCLICFDEVSVSRERSRPLNQFSPVCTPPTGTEKHLPGHPVSKPEVISKLEQGEDPWIIKRDISNWIYPEL

SEQ ID NO: 28792 - protein, 81 aa, Propithecus coquereli
MAVGLCKTMSQLSISKPNVVSLLEQGKDPWMVETEMSHSQFADWESWCEIKELSPTWFIDEEEISQGMVMERITSHGLICS

SEQ ID NO: 28793 - protein, 81 aa, Saimiri boliviensis
MLENYRNLAFLGIAVSKPDLIACLEKEKEPWKTKRHAVVDEPPVVCPHFAQDLWPEQGMEDSFQKVILRRYEKCGHENLQF

SEQ ID NO: 28794 - protein, 81 aa, Lynx pardinus
TFKEVVTFKDVAVVFTEEELGLLDPTQRKLYREVMLENFGNLVSVGHQPFKRDMVHLVREGKFWMMKLATQGKGSSGDKIQ

SEQ ID NO: 28795 - protein, 81 aa, Saimiri boliviensis
MLENYRNLVFLGLAVTKPDLITHLEQEKELWNVKRQETVAKYPEILPRQNIKDSSKNVIPRKYESCDLDNLCLKKVWQDVN

SEQ ID NO: 28796 - protein, 81 aa, Saimiri boliviensis
TVTFKDVAVDLTQEEWEQMKPAQRNLYRDVMLENYSNLVTVEVWEVDEQIKKQQETLVRKVTSISKKILIKEKVIEYKKVA

SEQ ID NO: 28797 - protein, 81 aa, Cervus elaphus
SRDSARAARLRSSSRTEPGEPGASQRVPTRSASAFTVLQGSMSFRDVAVDFTQEEWQHLDPEQKTTYRDVMLENYSHLISV

SEQ ID NO: 28798 - protein, 81 aa, Colobus angolensis
VAFEDVAVNFTQEEWALLDIFQKNLYREVMLETFKNLTSIGKSWKDQNIEYEYQNPRRNFRSLIEEKVNEIKEDSHCGETF

SEQ ID NO: 28799 - protein, 81 aa, Mustela putorius
LPDLVTFEDVAVEFTQEEWALLDPSQRTLYRDVMRENCRNLASLGYHVDKPSLISQLEQEDKVVTEERGVLPGTCPDLDTV

SEQ ID NO: 28800 - protein, 81 aa, Mustela putorius
SLGPVSFRDVAVNFTQEEWQQLEPEQKTTYRDVMLENYSHLVSVGCHIIKPEVIIKLEQGEEPWIVEGEFLPQSYPGDVWK

SEQ ID NO: 28801 - protein, 81 aa, Mustela putorius
LQVCVISEDVFVSFSREEWMLLDDSQRLLYQDVMLENFVLLASLGITSSRSHLVTPLEQRADPRIADQVDMAPATERKTWK

SEQ ID NO: 28802 - protein, 81 aa, Mustela putorius
MFKSQISFEDVAVDFTSEEWQLLNPTQKSLYRDVMLENYSNLVFLGYQIIRPDAVFKPEPEEPWVTEAAPRRAAAEEVWLD

SEQ ID NO: 28803 - protein, 81 aa, Mustela putorius
TVVFADVAVNFTREEWALLDRGQRQLYRDVMLETCRNLAFLVDTSQNKRSASRPQRNVLQNELPSEGKTILFARNDSCSVF

SEQ ID NO: 28804 - protein, 81 aa, Tupaia chinensis
MKRFISFEDVTMDFTWEEWQDLEDAQEILYKDLMLETYSNLMFLGQCIAKPAVIFKLEQGGDPWTLEELLSLSLPGHVCLP

SEQ ID NO: 28805 - protein, 81 aa, Opitutae bacterium
EGIVVIDEAYVDFAEQNALCLLDEFSNLVITRTMSKSYSLAGLRVGYGLSSPEVVSVLDQARDVYNVDRLAQVAASACLKD

SEQ ID NO: 28806 - protein, 81 aa, Halomonas heilongjiangensis
VTVVVDEAFIDFVDEPGEALTPLLAHFDNLILLRSLTKLYTLPGLRLGYILAGAQTIRRLQAGQPPWSVNHLSAALVAPLL

SEQ ID NO: 28807 - protein, 81 aa, Sporosarcina newyorkensis 2681
DFVGLALVDISKKRHELKWRYVSGNLSTRYRRIVLQSGRGVAGLVFKMGKPIMIENVEAQLDPQDLYNHPIVLFEKLKSFG

SEQ ID NO: 28808 - protein, 81 aa, Geotrypetes seraphini
MKENYETLISLGSVRISPDLLSWIKQDEEPNIQDPQESGEREVRHSDTGLNCLQRIHESERPFTCPECGKSFTQQSHLITH

SEQ ID NO: 28809 - protein, 81 aa, Geotrypetes seraphini
MQVTFEDITVSFSQEEWGYLAEEQKELYREVMKENYQTLISLGTDSPNVTPDSVSHIEQGEEPYIKSEPGSEESETGRSSC

SEQ ID NO: 28810 - protein, 81 aa, Geotrypetes seraphini
AQMQVTFEDIAVSFSQEEWEYLDEEQKELYREVMKEIYQTLLSLGSPTVIPDIISQIERGEETYIRDEPGSEERETGKSSC

SEQ ID NO: 28811 - protein, 81 aa, Pogona vitticeps
LPNEPPVSLEEVALYFTKEEWDRLDLGQRALYKEVMLANYGNVVSLVPRPHLISQLEEGGDPFVQNPSDREGSASGYSEKA

SEQ ID NO: 28812 - protein, 81 aa, Micrurus lemniscatus
SEDEWSRLDPVQKDLHREVMLENSRNVAFLGNNVQENKETFQTFRDEERRKEFSYSMEKTENERNLSNNASKRNSTVPSIE

SEQ ID NO: 28813 - protein, 81 aa, Microcaecilia unicolor
SRTMRVTFEDIAVSFSQEEWEYLDEGQKELYREVMKENYETLISLGYNKISPDILSRIKQETYVQDVQETRETEFTSDTSA

SEQ ID NO: 28814 - protein, 81 aa, Alligator sinensis
RPLKREASLELQEVFEDVAVYFTRKEWELLEDEDKVLYQAQMLKNYQALISLGKNLVLASPWSYVNTRVLQSLPVSTVSSL

SEQ ID NO: 28815 - protein, 81 aa, Alligator sinensis
AKLQVVFEDVALYFTRKEWTLLEDGDKALYREQMLRNYQALVSLGHRGPTPDLICRIQRGEVELSVHDHEDSGESALSEGS

SEQ ID NO: 28816 - protein, 81 aa, Micrurus lemniscatus
ASFEDVAVYFSKEEWSQLNADQKALHGEVMLENSRNLFSLGFNGQENKNCNEECQAIHLKMEKGKFADQMQSNSDETKQSQ

SEQ ID NO: 28817 - protein, 81 aa, Aythya fuligula
MEPWVMLDPRQKALYRDVMQESYETLMSLAAQGLVSEKAAEEGAAQQIPEELEARPSRSPERAKTLGSNRRKTKRPDKAVP

SEQ ID NO: 28818 - protein, 81 aa, Pogona vitticeps
WAAQVTFEDVAVYFSSEEWAELTAWQKDLYWEVMKGNHNLTASLAPACGPASEVLRRMERGEAPPSETPPDEKQEDPPPCP

SEQ ID NO: 28819 - protein, 81 aa, Micrurus lemniscatus
LSDASQELPFRGIPQEDPSWDNSGGSSPFPGGTERVAEPPVQGLVSFEDVAVCFSKEEWTQLDPCQKALHGEVMRDNLRNV

SEQ ID NO: 28820 - protein, 81 aa, Pantherophis guttatus
NSIFFEDVAVFFSVEEWALLDLGQKNLYREVMLDNARNLSSLTGDGWWMEGHGQEAAAAFPKGIKEVVERMFGKKGSKENQ

SEQ ID NO: 28821 - protein, 81 aa, Amazona aestiva
PKVPVSFNDASFNFSEEEWKSLNEWQKELYRHIMKGNYEAVISMDAAISKPDLLSRIEQGEDPNAEDQDDSEGGETPTDPS

SEQ ID NO: 28822 - protein, 81 aa, Anaerococcus lactolyticus S7-1-13
VDLDEVSPYLSTDDDISIDETEEILKVLDEKDREIFRKLFLEGYSYDDLAKVYDISKAGLYNRVARGKKKIKEEIQNEKCL

SEQ ID NO: 28823 - protein, 81 aa, Micrurus paraensis
LVSFEEVAVYFSEDEWSQLDSDQKELYLEVMLENHRNVVSLGNNGQENQDSCELSQVINTKDGMEKFGIRTEFEKHERNQS

SEQ ID NO: 28824 - protein, 81 aa, Micrurus paraensis
PSKSSLEMFFRKISQNDPKKDMTTGKNSRKLTLPEGGTERMVETPVQEGLVSFEDVAVYFSEEEWSQLDPDQKALHWEVML

SEQ ID NO: 28825 - protein, 81 aa, Micrurus paraensis
LFFRRIPWEDPSQGTSGEKQRMKLSGFYDGDQTVVEPPNQEGLVSFEEVAVHFSEEEWSQLHSDQKALHSEVMIENHRNVV

SEQ ID NO: 28826 - protein, 81 aa, Micrurus paraensis
LDQRQKALYRDVMQESYETLMSLANQLLNNSNHDDEDEEDEEEPEGVEELRPGTSQSAPRKVKPLTRRETPKQPKIIPVVK

SEQ ID NO: 28827 - protein, 81 aa, Micrurus paraensis
DFVSFEDVAVSFSEEEWALLDSEQKALYREVMLENKRNVASLGNGWEMEDSGQEVVAPLPKDKQEEKRHGRQSLEQNQLTG

SEQ ID NO: 28828 - protein, 81 aa, Xenopus tropicalis
FSKVAVYFTESEWICLEEGQKELYKEVMLENYLTFNSLGYLHKKPDIISRIERDEDPSLKPHKKLQMKRISSMTNEQLQKK

SEQ ID NO: 28829 - protein, 81 aa, Micrurus paraensis
GFLTQGPVSFGEVAIHFSSEEWLLLDPSQKALYHEVMLETSRMVASLAFDAQKNEIDQEPKLVPLQIIKTEIPGETSTNKR

SEQ ID NO: 28830 - protein, 81 aa, Xenopus tropicalis
ASVAFDDLASSFSKEEWMELEEWQKELYRNVMKETSETLISLGEGRNLISLPTKAIGEKDSDTLEPAASLAMDCTNNLPFC

SEQ ID NO: 28831 - protein, 81 aa, Bambusicola thoracicus
GEVPKLVLDPAQGFSEDEWKNLNEWQKELYRHIMKGNYEAVISMDTAISKPDLLSRIEQGEDPNAEDQDDSEGGETPTDPS

SEQ ID NO: 28832 - protein, 81 aa, Xenopus tropicalis
MEESAKSNDVTVCFSVEELDSLEDGQRDHNKNLKTKIHHSPNLVGYLYVKPEIVPRIRRGEGLCVSSDLYTEKRRNRARLA

SEQ ID NO: 28833 - protein, 80 aa, Xenopus tropicalis
MGCLSFDDIAIYFSEEEWKSLKEGQKALYKDVMIENYQTLRLLGIKPSHSNLTYLPPLKSTDPLKQTEHEAWLGAWPGWD

SEQ ID NO: 28834 - protein, 81 aa, Xenopus tropicalis
EEDSIKPDNVAVCFSVEELESFEERQKESCKNVMREIHQTPTVVGYIYVKPETVSLIRRGEELCVSSNLYSRKQELCTSPP

SEQ ID NO: 28835 - protein, 81 aa, Bambusicola thoracicus
EPVTFEDVAIYLSRAEWDMVAEEQRELYRSVMLDNYELLASLGYPGPKPDILHRLERGEEPWVNTPQSTVTWDGPDRPLGC

SEQ ID NO: 28836 - protein, 81 aa, Micrurus paraensis
LVSFEEVAVYFSEEEWSQLDPDQKSLHSEVMLENHRNLVSLGKNGQGNQDSCELSQVINTKDGMEKFGIRTEFEKHERNQS

SEQ ID NO: 28837 - protein, 81 aa, Xenopus tropicalis
GQMEEASVSFSAEEWGSLEKEQRDLYKDLLMENDETLRSLNSFSVKTESCSRAEREELHIKDPPEDPPPDLHPNTFPCTDA

SEQ ID NO: 28838 - protein, 81 aa, Microcaecilia unicolor
EALVTFKDVAAYFLEVDWDLLGEWQKELYKKVIKEIHDILISRGKYVSLSSTTQAHYGISGVKITGIRYHEHLKFRSWFLI

SEQ ID NO: 28839 - protein, 81 aa, Microcaecilia unicolor
NEAFITFNDVAAYFLEAEWKIFGEWKKELYKKVIKEIHVILLSRGYSIVNPDVIFKIKKEDENYFIQQFNWKGKENPNDFT

SEQ ID NO: 28840 - protein, 81 aa, Microcaecilia unicolor
DQASVTFSDVAAYFWEVEWDILGEWQKNLYKKIIKEIHNFLMSQGYSIVNPDVIFKIKKEDEKYFTQHYDWEEKEDMNDST

SEQ ID NO: 28841 - protein, 81 aa, Microcaecilia unicolor
SKMPVTFEDIAVSFSQEEWGYLDEGQKELYREVMKENYETLISLGYERTNPEILSRIKQKEEPYVQELQESEEDCHSYTDQ

SEQ ID NO: 28842 - protein, 81 aa, Microcaecilia unicolor
QMQVKFEDVAVSFSQEEWEYLDEEQKELYREVMKENYQILISLGTGSLTFTPKIISQIERGEEPYSRDEPGSEEREPGKSS

SEQ ID NO: 28843 - protein, 81 aa, Microcaecilia unicolor
EPVTFEDITVHFSQEQWEYLDEGQKELYREVMKENYQTLISLEKDDSRNSNTETHHWKLSEKPKGEKMLSERDKEETSSCC

SEQ ID NO: 28844 - protein, 81 aa, Microcaecilia unicolor
DQVLVAFKDVAAYFLEVDWDILGEWQKELYKKVVKEIHDILISQGYSVVNPDVVFKIKNEDEKYFTQQSEWEGKENPNDSN

SEQ ID NO: 28845 - protein, 81 aa, Micrurus paraensis
EWSQLDPDQKALHSEVMLENHRNVVSLGNNGQENLDSCELFQVINAKDRMEKFGIGIEFKSHERNQSKNWNQESSSSTDAP

SEQ ID NO: 28846 - protein, 81 aa, Xenopus tropicalis
LQAPAHFKEVAVYFTESEWICLEEGQKELYKEVMLENYLTFNSLGYLHKKPDIISRIERDEDPCLSYNKDKRKSFHFDGAR

SEQ ID NO: 28847 - protein, 81 aa, Microcaecilia unicolor
VPVTFEDITVHFSQEQWEYLDEGQKELYREVMKENYETLISLEKDDSKNNNTEVHHWNLSEKPEEEKKLSESLKEETSSCS

SEQ ID NO: 28848 - protein, 81 aa, Microcaecilia unicolor
DQVLVSFKDVAAYFLKVDWDILGEWQKELYKKVIKEIHDILISRGYSIVNPDVIFKIKKEDEKYFSPHFDWEEKENPDDLI

SEQ ID NO: 28849 - protein, 81 aa, Xenopus tropicalis
RKGPIKFEDVAVYFSEDEWNYLEDGQKNLYKNVMMENYYTVSSVGCANEKPKIIVKIEQGEKTYLGHTPEKTKYVSMLRNA

SEQ ID NO: 28850 - protein, 81 aa, Microcaecilia unicolor
GQASVIFKDVAAYFLEVEWNILGEWQKELYKKIIKEIHGFLWSRGYAIVNPDVIFKIKKEDEKYLIQHFEWEGKENPDDSP

SEQ ID NO: 28851 - protein, 81 aa, Microcaecilia unicolor
AQVPVTFEDITVHFSKEEWEDLEEWQKELYKDVMKENYEILNSLGCLSVIPDIIANIESGEEPGFKERETGKSSCSEINVC

SEQ ID NO: 28852 - protein, 81 aa, Microcaecilia unicolor
QVPVTFEDIAVYFSQEEWEDLQEQQRELYKDVMKENYETLSSLGTGPPAVTPDIISHIERGEEPYIRGETGSEERETGKSI

SEQ ID NO: 28853 - protein, 81 aa, Microcaecilia unicolor
DQALVTFKDVSAYFLEAEWIILGQWQKELYKKVVKEFHDILTSKGYSIVNPDVIFKIKKEDEKYFTQHFEWERKENPDDLM

SEQ ID NO: 28854 - protein, 81 aa, Xenopus tropicalis
MSQVGKVTFQEVALYFSRGEWERLSEEQKELYREVMLDNYQLVLSLCRPEIISRIVLGQEPCIGSRSSSAEGGPANDRLLP

SEQ ID NO: 28855 - protein, 81 aa, Xenopus tropicalis
LQVAPTFDDVAVYFSWSEWESLSPSQRDMYKSVMAENYECVLSLGYPIGKPEIVSKIEAGEDLWSRSDARPERKEKDGETP

SEQ ID NO: 28856 - protein, 81 aa, Acidimicrobiaceae bacterium
RGLVGEIIGRFERKGLRMVEAELRTLDRDVLARHYSEHVGKGFYDDLVAFMGRGPVLVAVVEGPRDTWSVVRQMMGATDPM

SEQ ID NO: 28857 - protein, 81 aa, Candidatus Shapirobacteria bacterium CG10_big_fil_rev_8_21_14_0_10_36_6
AITLDEFNKDVTPKEWKFIEAEQKYYYLVVALKKARNSMGLTQNKLAELSNMPRTTITRIESGSRNATLQTLMTIAGSMGK

SEQ ID NO: 28858 - protein, 81 aa, Gordonia sputi NBRC 100414
VDEAFADLTVDPVTGEREPQSLASMRNDDIVVLRSVTKTFGLAGLRAGYLLASPEIVERLSRGRRPWPLSTPALAALAECV

SEQ ID NO: 28859 - protein, 81 aa, Halomonas titanicae
LDTFRKLWFTASLEQWSQMDDHQRTLLDSGMIANARKAEPWKAVELFRALADRAELTQRLEHFNQEYHLLMTPSVAIPPFE

SEQ ID NO: 28860 - protein, 81 aa, Rhizobiales bacterium
KLPSRTLNNLVGFSAEELAELDNAIAILKRDNMNEQANILHSLATKLKTLQKPEAMSRVEPDYEALLEAEGLAMRPGPKPK

SEQ ID NO: 28861 - protein, 81 aa, Colinus virginianus
LKAPEASEGDAACFTEQEWENLEEWQKELYKNMLRGNSESLSSLADYAIPEPSFAGALKQNEEVCVEEQEATEGAEFTELS

SEQ ID NO: 28862 - protein, 81 aa, Geotrypetes seraphini
SAQKQVTFEDITVSFTQEEWAYLDEEQKKLYREVMKDNYQMLISLDHQIRPEWQRIKSQREDPVEMDQIQTQSENIYENIS

SEQ ID NO: 28863 - protein, 81 aa, Geotrypetes seraphini
AEASVMFSDVTAYFLEAEWDILREWQKEIYKKVIKEIHSFLISQGYSILNPDVIFKIKKEDEKYFTQHYESEEKENMNDSS

SEQ ID NO: 28864 - protein, 81 aa, Geotrypetes seraphini
EVQETFEDIAVFFSQEEWGYLDEEQKELYREVMRENFQTLISLGTGSLTVAPDIICRIERGEEPYIKDEPGSEEREPGRSS

SEQ ID NO: 28865 - protein, 81 aa, Geotrypetes seraphini
AQASVTFHDVAIYFSEKEWQLLEEWQKELYRNVIKMIHGALTSLGHIIINSGVVFRIKKEKAPYLWNPCDSEGQERIKDPT

SEQ ID NO: 28866 - protein, 81 aa, Geotrypetes seraphini
NLLRLEQSTMADQMLLTFHDVAVTFSEEEWQLLEDWQKDLYRKVMKETYDNLISLMPLTFHDIAIYFSEEEWQLLGEHQKA

SEQ ID NO: 28867 - protein, 81 aa, Geotrypetes seraphini
AQMQVAFQDIAISFSQEEWEYLDEGQKELYREVMKENYETLISLGFVRISPDLLSWIKQDGESNIQDPQESGEREVRHSYT

SEQ ID NO: 28868 - protein, 81 aa, Geotrypetes seraphini
MQMRLRFEDISVSFSQEEWGYLAEEQKELYREVMKENYQTLISLGSPLVTPDIISHIERGEEPYVRDEPGSEEREPGRSSC

SEQ ID NO: 28869 - protein, 81 aa, Geotrypetes seraphini
MEVTFKDIAVSFSQEEWRYLDEEQKELYVEVMEENFQTLISLEQQLKQEKESEKNQGEDPLEMGQIQRQSGNVSANISQRT

SEQ ID NO: 28870 - protein, 81 aa, Geotrypetes seraphini
VTFEDITVAFSQEEWEYLDEGQKELHREVMKENYEILRTLEKDDPKNNPWKLSEKPEGVKMLSEGEKEKWGEKEKNQNPKY

SEQ ID NO: 28871 - protein, 81 aa, Geotrypetes seraphini
SAQKQVTFEDITVSFTQEEWDYLNEEQKKLYREVMKENYQMLNSLDHQIRPEWQRIKSQREDPVEMDQIQTQSENIYENNS

SEQ ID NO: 28872 - protein, 81 aa, Geotrypetes seraphini
DHASVTFSDVAAYFLEVEWNILGEWQKELYKNVIKKIHSFLILQGYSIVNPDVVFKIKKEDEKYFTQHCEWEGKENSNDPS

SEQ ID NO: 28873 - protein, 81 aa, Geotrypetes seraphini
AQMQLTFEDITVSFSQEEWEYLDEEQKELYREVMKDNYQTLLSLGSPTFTPKIISCIEQGEEPYIRFEAESEERETGKSSC

SEQ ID NO: 28874 - protein, 81 aa, Geotrypetes seraphini
HPASVTFNDVAAYFWEVEWDVLGEWQKKLYKTVIEEIHDLLMSRGYSIVNPDVIFKIKKEDEKYFTQHSEWEGKGYPNDPT

SEQ ID NO: 28875 - protein, 81 aa, Geotrypetes seraphini
AQMRVTFEDIAVSFSKEEWEYLREGQKELYREVMKENYENLIFLGYEGINADILSRIKQEEEPNIQDPKELGEREVTHSYS

SEQ ID NO: 28876 - protein, 81 aa, Geotrypetes seraphini
DQTSVTFRDVAAYFLEMEWDILGEWQKELYKRVIEEIHDILISRGYLIVNPDVIFKIKKEDEKYFAQHCELEGKDNPNEPS

SEQ ID NO: 28877 - protein, 81 aa, Geotrypetes seraphini
AREMVTFEDIAVSFSEEEWAYLDEEQKKLYREVMEENYQTLVSLAEQELKQERESEKNQGEDRLEMEQIQRQSGNVCANIS

SEQ ID NO: 28878 - protein, 81 aa, Geotrypetes seraphini
QMRLRFEDISISFSQEEWGYLDEEQKELYREVMKENYQTLISLATDSPLVTPDIISHIERGEEPYVRDEPGSEERETERSS

SEQ ID NO: 28879 - protein, 81 aa, Geotrypetes seraphini
MRVTFEDITVSFSQEEWMYLDEGQKELYREVMMENYEILMSLADHEVTDEVRESREEHCLKWKPHPRNVGVSQGTEWKERH

SEQ ID NO: 28880 - protein, 81 aa, Geotrypetes seraphini
VKLEDVTVSFSQEEWEYLDEGQKELHREVMKENYELLRTLEKDDPKNNHWKLSEKPEGVKMLSEGEKEETSSCSVWGEKEK

SEQ ID NO: 28881 - protein, 81 aa, Geotrypetes seraphini
QMQVTFEEVAVSFSQEEWEYLDDEQKELYREVMKENYQILISLATGSPTVTPKIISHIERGEEPYIRGEPGSEERETGNSS

SEQ ID NO: 28882 - protein, 81 aa, Geotrypetes seraphini
DQVSVTFNDVASYFLEVEWDILGEWQKEMYKKVIKEIHDILRSQGYSIANPDVVVKIKQEDEKYFTQHFGWEEKENLNGPM

SEQ ID NO: 28883 - protein, 81 aa, Geotrypetes seraphini
SAHMQASVTFIDVAAYFLEGEWNVLGEWQKELYKKIIKDIQGYSIVYPDVIVKIKKEDEKYFTHHYEGEEKENPTKSLPVV

SEQ ID NO: 28884 - protein, 81 aa, Geotrypetes seraphini
MQVKFEDVAISFSQEEWEYLDEGQKELYKEVMKENYETLISLGLNCLQRIHESERPFTCPECGKSFTQQSHLIKHRRIHTG

SEQ ID NO: 28885 - protein, 81 aa, Geotrypetes seraphini
QMPVTLEDIFISFSQEEWEYLNEEQKELYREVMAENYETLMSLGTDSPPVTPDIISHTERGEEPYIKDEPGSEERETGTSS

SEQ ID NO: 28886 - protein, 81 aa, Geotrypetes seraphini
QMRLRFEDISVSFSQEEWAYLDEEQKELYREVMRDNYQTLISLGVGFSSVTPDIISRIEQGEEPYVRDEPGSEERETGRSS

SEQ ID NO: 28887 - protein, 81 aa, Geotrypetes seraphini
ARAPVSFEEVAVYFSPEEWQTLQGWQKEMYRGVMRENYEIMLSLGYQFSKPEILLMMERGEEPCVEDCQRRIPVTFREKHL

SEQ ID NO: 28888 - protein, 81 aa, Geotrypetes seraphini
AGASAQVTFEDIAVSFSQEEWEYLNEGQKELYREVMKENYEILISLDTKAMQETKREENEEKWLLEHIPRQPGNVSENISQ

SEQ ID NO: 28889 - protein, 81 aa, Anas platyrhynchos
HILKWDLLLLQEPRWVLLDPVQRTLYVDVMLENYETITSLGKESWPLEFWSQELLELWLLAFMLQTVSVLGWHELCGADAN

SEQ ID NO: 28890 - protein, 81 aa, Geotrypetes seraphini
QMPVTFDDVAIYFSQEEWEELNEQQRELYQEVMRENLELLTSLDTGPAQKDPDVTLSIDHMKVPYIEEQQILHWITGTTLS

SEQ ID NO: 28891 - protein, 81 aa, Geotrypetes seraphini
EQMRLRFEDISVSFSQEEWAYLDEEQKELYREVMMDNYQTLISLGSPPATPDIISHIEQGEEPYIKDEPGSEEREPGRSSW

SEQ ID NO: 28892 - protein, 81 aa, Geotrypetes seraphini
LQFSVTFRDVAAYFSEEEWEVLEDWQKELYRNVMKEIHRTLFSLGYAIVNPSVLVRIQKEQDLAPGDQCLTREISVNCKDA

SEQ ID NO: 28893 - protein, 81 aa, Geotrypetes seraphini
QMQVTFEEVAVSFSQEEWEYLNEEQKELYREVMKDNYQTLISLGVGSPNFTPEIISYIERGEEPYIRGETGSEERRPETSS

SEQ ID NO: 28894 - protein, 81 aa, Geotrypetes seraphini
QMQVTFEEVAVSFSQEEWEYLDEEQKELYREVMKENYQTVISLATGSPTVTPKIISHIERGEEPYIRGEPGSEERETGNSS

SEQ ID NO: 28895 - protein, 81 aa, Geotrypetes seraphini
RMQVTFEEVSFSFSQEEWEYLDDEQKELYREVMKENYQTIISLGTGSPTFTPKIISYIERGEEPYIRDEPVSEEKETEKSS

SEQ ID NO: 28896 - protein, 81 aa, Geotrypetes seraphini
MQVKFENVAVSFSQEEWENLDEGKKELYREVMKENYETLVSLGSVRISPDLLSGIKQEGEPNIQDPQEREKLDIQTRQIQE

SEQ ID NO: 28897 - protein, 81 aa, Geotrypetes seraphini
QMQVTFEEVAVSFSQEEWEYLDEEQKELYREVMKENYQTLISLAAGSLTVTPKIISHIERGEEPYIRGEPGSEEREIGKSS

SEQ ID NO: 28898 - protein, 81 aa, Geotrypetes seraphini
PQELVTPCDMAAAIPEVEWNLLEDWQKQLYKDVMKESYKTILSLGYSVAKQNIMTEPTAEEKACNSGVRNPESGNIAGSSS

SEQ ID NO: 28899 - protein, 81 aa, Geotrypetes seraphini
TMRVTFEDITVSFSQEEWEYLDEGQKELYREVMNENYQTLISLETGYERIDHDILSRIKQEEEPYVWDSLETREREVTLLD

SEQ ID NO: 28900 - protein, 81 aa, Geotrypetes seraphini
NQVSVAFKDVAAYFLEVEWSILREWQKEIYEKVIKEVHGILTSQGYSIVNPDVIFKIKKEDEKYFSQGCESEGKEIPNDPT

SEQ ID NO: 28901 - protein, 81 aa, Geotrypetes seraphini
AQMQVKFEDVVVSFTQEEWEYLDEGQKELYKEVMKENYETLISLGAVRISPDLLSWIKQDGEPNIQDPQESGEREVRHSDT

SEQ ID NO: 28902 - protein, 81 aa, Geotrypetes seraphini
QMRVSFEDVTVSFSQEEWEYLEEGQKELYREVMKENYETLISLGTGSPAVTPDIISHIEQGEEPYVRDEPGSEERETGRSS

SEQ ID NO: 28903 - protein, 81 aa, Geotrypetes seraphini
AQMQVKFEDVAVSFSQEEWEYLDEGQKELYREVMKENYETLISLGSVRISPDLFLWIKQDGETHIQDPQESGEREVRHSDK

SEQ ID NO: 28904 - protein, 81 aa, Geotrypetes seraphini
SAQVTFEDIAVSFSQEEWGYLDEEQKNLYREVMKENYQTLISLGTGSPTFTPKMTSHIERGQGPYIKDEPESEERETGQNS

SEQ ID NO: 28905 - protein, 81 aa, Geotrypetes seraphini
AQMQVTFEEIAVSFSQEEWEYLDEEQKELYREVMKENYEILISLGSPTFTPKIISYIERGEEPYIRDEPVSEERETEKSIC

SEQ ID NO: 28906 - protein, 81 aa, Geotrypetes seraphini
EQMQVTFEDIAVSFSQEEWEYLDEGQKELYREVMKENYETLISLGYVRISPDPLSWIKQEGEPNIQDPQEPGEREVRHSYT

SEQ ID NO: 28907 - protein, 81 aa, Geotrypetes seraphini
DQALVTFKDVAAYFWEVEWNILGEQQKELYKKVVKEVHGILLSRGYSIVNPNVLFKIKKEDEKYFTQHFECERKENTLDPM

SEQ ID NO: 28908 - protein, 81 aa, Geotrypetes seraphini
QVPVTFEDITVYFSQEQWRYLDEGQKELYREVMKENYETLISLGTGHESFNSELLLRIKQEEEPHVWDPKASEREATHSHA

SEQ ID NO: 28909 - protein, 81 aa, Anas platyrhynchos
PKVPLTFDDISVYFNEQEWETLDSWQKDLYKAVMRGNYETLISLEETGRKEEALGEQKVPSEAGTDVSCPLVLKAAFLFPA

SEQ ID NO: 28910 - protein, 81 aa, Geotrypetes seraphini
QMPVKFEDIAVSFSQEEWEYLNEEQKELYREVMEENYQTLISLGTGSPPITPDIISHIERGEEPYIREEPGSEERGPVRSS

SEQ ID NO: 28911 - protein, 81 aa, Geotrypetes seraphini
DLASVIFNDVVAYFWDAEWDVLEERQKELYKKVIKEIHGFLMSRGYLIVNPDVLIRVKHEGGKYFTQHHDWEENENINDPL

SEQ ID NO: 28912 - protein, 81 aa, Geotrypetes seraphini
AQGQVTFEDIAVSFSQEEWEYLDEEQKELYREVMKENYQTLISLGYEKINPEMLSGIKSEEKSYVQDPQESGEKEVTHLYP

SEQ ID NO: 28913 - protein, 81 aa, Geotrypetes seraphini
DQASVTFKDVAAYFLEVEWDIVGEWQKELFKKVIEEIHDILIIQGCSIVNPDVIFKIKKKDEKYFAENFGWEGKENSNDPP

SEQ ID NO: 28914 - protein, 81 aa, Geotrypetes seraphini
NQALITFSDVAAYFWEVEWDILGEWQKELYKKVIKEIHSFLISQGYSIVNPDIIFKIKKEDEKYFTQHCEWKEKEKTHNST

SEQ ID NO: 28915 - protein, 81 aa, Geotrypetes seraphini
WEMQVTFEEVAVSFSQEEWEYLDDEQKELYREVMKENYQILISLGSPTVTPKIISHIERGEEPYIRGEPGSEERETGNSSC

SEQ ID NO: 28916 - protein, 81 aa, Geotrypetes seraphini
AQMQVMFEDIAVSFSQEEWKYLDEGQKELYREVMKENYETLISLGYIGIRSDVLSWIKEEGEPKIQDPQDPGETEVRHSDT

SEQ ID NO: 28917 - protein, 81 aa, Geotrypetes seraphini
QVSVTFEDIAIYFSQEEWEDLEKWQKELYKDVMKENYEILISLGTSSVTVTPDIISHIEQGEELNIRNEPGSEERETGKSS

SEQ ID NO: 28918 - protein, 81 aa, Geotrypetes seraphini
KMRVTFEDVAVSFSQEEWEYLDEEQKELYWEVMKENYKTVISLGTEYQKIDPDLSSRITQKEKPSVWDPQESAEREVTPTY

SEQ ID NO: 28919 - protein, 81 aa, Geotrypetes seraphini
KEMQVSFEDIAVSFSQEEWEYLEEEQRELYREVMKENYQTLISLGCPNLTPEIISRIERGEEPYIRGEPGSEERETGKSNC

SEQ ID NO: 28920 - protein, 81 aa, Geotrypetes seraphini
AQMQVKFEDVAVSFSQEEWEYLDEGQKELYREVMKANYETLVSLGSVRISPDLFSWIKQDGEPNIQDPQESGEREVRCSFM

SEQ ID NO: 28921 - protein, 81 aa, Geotrypetes seraphini
AAISVTFSDVAVYFSEKEWGLLDEWQKELYRNVMKEIHGALLSMGYKILNPGNLFRIRKAEESNDRDPDDAKQKDFTICST

SEQ ID NO: 28922 - protein, 81 aa, Geotrypetes seraphini
QMPVKFEDIAVSFSQKEWEYLNEEQKELYREVMKENYLTLISLGTGSPSITPDIISHIERGEELYIKEEPGSEEREPGRSS

SEQ ID NO: 28923 - protein, 81 aa, Geotrypetes seraphini
FVQVTFQDISISFSQEEWGYLDEEQKDLYREVMKENYQTLISLGTGSPNLTPEIISRIERGEEPYIRGEPGSEERETGESS

SEQ ID NO: 28924 - protein, 81 aa, Geotrypetes seraphini
QMWVTFEDVAVSFSQEEWVYLDEGQKELYREVMKENYETVMSLAGEEFSRGKEKEGSIEQQSLKTEVHEMNKRVKLFKCSE

SEQ ID NO: 28925 - protein, 81 aa, Geotrypetes seraphini
QVQETFEDIAVSFSQDEWEYLDEEQKELYREVMRENYQTLLSLGTGSLTVAPDIICRIERGEEPYIKDEPGSEEREPGRSS

SEQ ID NO: 28926 - protein, 81 aa, Geotrypetes seraphini
QMQVKFEDIAISFSQEEWEYLNEEQKELYREVMEENYQTLLSLATDSPTFTPKIISYIKRGEEPYIRGEPDSEERESGKSS

SEQ ID NO: 28927 - protein, 81 aa, Geotrypetes seraphini
AQMQVTFEEIAVSFSQEEWEYLDEEQKELYREVMKENYEILISLGSPTFTPKIISYIERGEEPYIRDEPGSEERETVKSSC

SEQ ID NO: 28928 - protein, 81 aa, Geotrypetes seraphini
QMPVKFEDIAVSFSQEEWEYLNDEQKELYREVMKENYQTLISLGIGSPSVTPDIISHIERREEPGSEEREPGRSSCSDHQK

SEQ ID NO: 28929 - protein, 81 aa, Geotrypetes seraphini
FQMQVKFEDVAVSFSQEEWEYLDEGQKELYREVMKENYETLISLGSVRISPDLLSWIKQDGETHIQDPQESGEREVRRSDT

SEQ ID NO: 28930 - protein, 81 aa, Geotrypetes seraphini
DQKLVTFKDVSAYFWEMEWNILGEQQKELYKKVIKEVHGILLSLGYSIVNPDVIFKIKKEDEKHFTQHFEWEGKENPHDPM

SEQ ID NO: 28931 - protein, 81 aa, Geotrypetes seraphini
QMPVKFEDIAVSFSQEEWEYLNEEQKELYREVMEENYQTLISLGTGSLPVTPDIISHIELGEEPYIREDPGSEEREPGRSS

SEQ ID NO: 28932 - protein, 81 aa, Geotrypetes seraphini
GQMPVKFEDIAVSFSQEEWEYLNEEQKELYREVMKENYETLISLGSPPVTPDIISHIERGEEPYIKEEPGSEERGPVRSSC

SEQ ID NO: 28933 - protein, 81 aa, Geotrypetes seraphini
TRIQVKFEDIAVSFSQEEWEYLDEGQKELYREVMKENYETLISLGSVRISPDLFSWIKQDGKPKIQDPQESGEREVRHSDT

SEQ ID NO: 28934 - protein, 81 aa, Geotrypetes seraphini
QMQVTFEDIAISFSQEEWEYLDEEQKELYREVMKENYQTLISLGTGSLTFTPKIISHIERGEEPYIRREPGSEERETWKNS

SEQ ID NO: 28935 - protein, 81 aa, Anas platyrhynchos
GSSRTGILRDRDERWVLLDPVQRTLYVDVMLENYETITSLGKESWPLEFWSQELLELWLLAFMLQTVSVLGWHELCGADAN

SEQ ID NO: 28936 - protein, 81 aa, Geotrypetes seraphini
AQMQVTFEEIAVSFSQEEWEYLDEEQKKLYREVMKENYEILISLDSPTFTPKIISYIERGEEPYIRDEPGSEERETEKSSC

SEQ ID NO: 28937 - protein, 81 aa, Geotrypetes seraphini
QEPVTFEDITVSFSKEQWEYLDEEQKELYREVMKNNYETLISLGADHKSIDPEVLSRITEEEEPCVGDPKEREDTHANTGI

SEQ ID NO: 28938 - protein, 81 aa, Geotrypetes seraphini
KMLVTFDDVTVYFSEEEWNGLEDEQKQLYKEVMRDNYEALIFLGKDSAAADPAVLSRIEEGEVHCNDHSASEGGEHNLWAS

SEQ ID NO: 28939 - protein, 81 aa, Geotrypetes seraphini
AKMQVTFEDIAVSFSQEEWRYLDEGQKELYREVMMENYETLIFLENNPRSKNQEIHHCEVTENAKRNKMSEGDEEHTSFGS

SEQ ID NO: 28940 - protein, 81 aa, Geotrypetes seraphini
QIPVTFEDIAIYFFQKEWEDLDAWQKELYKDVMKENYQTLMSLEKAFSNVIPDIISHIERGEEPYIRDDSGSEERETGKST

SEQ ID NO: 28941 - protein, 81 aa, Geotrypetes seraphini
VMFEDVFISFSQEEWQYLDEEQKELYKEVMKENYEILMSLEKDDPKYNPSKLTEKPEGVKMLSEKEETSSCSDWGEKGKNQ

SEQ ID NO: 28942 - protein, 81 aa, Anas platyrhynchos
RPGADPRDEPRPCRAPGLSLQMPVMFEDVAIYFSPEEWAELAGWQRQLYREVMLENFEALASLGEERDGDAGPGPSRGQGK

SEQ ID NO: 28943 - protein, 81 aa, Geotrypetes seraphini
MQNQMRVKLEGISVSFSQEEWAYLDERQKELHREVMKENYELLRSLANEMRLKKEKREEQLLKWKPYSSQVDISQRTERRN

SEQ ID NO: 28944 - protein, 81 aa, Geotrypetes seraphini
AQMQVAFEDISISFSQEEWEYLNEEQKELYREVMKENYQTLISLGSMAFTPKIISHIERGEEPYIRGEPGSEEREHEKSSC

SEQ ID NO: 28945 - protein, 81 aa, Geotrypetes seraphini
EQISVTFRDVVASFSEEEWKVLEDWQKELYGNVMKEIHGTLISLGYAIANPSVLFRIKRKDEPNEWDSQNSDGKDGIGVSS

SEQ ID NO: 28946 - protein, 81 aa, Geotrypetes seraphini
ARALVTFHDVAIYFSEEEWQLLEEWQKELYRNVMEEIHEVLISLGHTSTSPGISYRIKEEEEPYFGDQDNSSRNLNKRPSA

SEQ ID NO: 28947 - protein, 81 aa, Geotrypetes seraphini
QKPMITFNAVAAYFSEAVWEALEEWQKELYRSVVQEIHGALLSLGYAIIHPDVLLRIKGQEDPYKDERSKTYKEQMTSDSS

SEQ ID NO: 28948 - protein, 81 aa, Geotrypetes seraphini
APVSVAFSDVAAYFLETEWDILGEWQKELYEKVIQEIHDLLMSRGYSIVNPDVIFKIKKKDEKYFTRHRDLEGNKDVCDPS

SEQ ID NO: 28949 - protein, 81 aa, Geotrypetes seraphini
MEVTFKDIAVSFSQEEWRYLDEEQKELYVEVMEENFQTLISLAEQQLKQEKESEKNQGEDPLEMGQIQRQSGNVSANISQR

SEQ ID NO: 28950 - protein, 81 aa, Geotrypetes seraphini
MQVKFEDVAVSFSQEEWEYLDEGQKELYREVMKENYETLISLGSVRLSPDLLSWIKQEGETHIQDPQESGEREVRHSDTVD

SEQ ID NO: 28951 - protein, 81 aa, Geotrypetes seraphini
FMTSVTFKDVAAFFSEEEWAALEEWQKELYRSVMKEIHTALLSLGYRIVNPDTVFWVKNELVSTAKWNQNLGEIESINVSY

SEQ ID NO: 28952 - protein, 81 aa, Geotrypetes seraphini
PVTLEDIFISFSQEEWEYLNEEQKELYREVMAENYETLMSLEHEITQERKREGEHPIEREEIQRQSENVCENISQGTKRIH

SEQ ID NO: 28953 - protein, 81 aa, Geotrypetes seraphini
QMQVKFEDIAISFSQEEWEYLNEEQKELYREVMKDNYQTLLSLATGSPTFTPKIISHIKHGEEPYIRGEPESEERETGKSS

SEQ ID NO: 28954 - protein, 81 aa, Geotrypetes seraphini
AQMQVTFEDIAISFTQEEWEFLDEEQKELYREVMKENNQILISLADQQIPHEWKREKNQGEDPVEMEQIQTQSENVCENIS

SEQ ID NO: 28955 - protein, 81 aa, Geotrypetes seraphini
KMRVTFKDIAISFSQEEWGYLKEEQKELYREVMMENYQTLISLGTGSPPVTPDIISHIERGEEPYIREEPGSEEREPGRSS

SEQ ID NO: 28956 - protein, 81 aa, Geotrypetes seraphini
QMQVTFEDIAVSFSQEEWEYLDEEQKELYREVMKENYQTLISLATGSPTFTPKIISHIEPEEKPYLRDEPGSEERETEESS

SEQ ID NO: 28957 - protein, 81 aa, Geotrypetes seraphini
ISDQVSVTFGDFLETEWDVLGEWQKELYKRVIKEIHSFLISQGYSIINPDIIFKIKNEDEKYLTRRYQWEGKESKNDLTAS

SEQ ID NO: 28958 - protein, 81 aa, Geotrypetes seraphini
QMRLRFEDISVSFSQEEWAYLDEEQKELYREVMRDNYQTLISLGIGSPPVTPDIISCIEQGEEPYIRDEPGSEERKTGRSS

SEQ ID NO: 28959 - protein, 81 aa, Geotrypetes seraphini
QMQVTFEEVAVSFSQEEWEYLDEEQKELYREVMKENYQTVISLAAGSLTVTPKIISHIERGEEPYIRGEPGSEEREIGKSS

SEQ ID NO: 28960 - protein, 81 aa, Geotrypetes seraphini
AQMQVAFEDIAVSFSQEEWRYLEEEQKELYREVMKENYQTLISLGFPAITPEIISQIERGEEPYVRDEPGSEGRETGKSSY

SEQ ID NO: 28961 - protein, 81 aa, Geotrypetes seraphini
RIPVTFEDIIVHFSQEEWEHLEEWQKELYKDVMKENYETLILLGMYSPTDTPDIISHIERGEEPYIRDETGSEERETGKSS

SEQ ID NO: 28962 - protein, 81 aa, Geotrypetes seraphini
DQTSVTFKDVAAYFLEMEWDVLGEWQKELYKKVIKEIHDILISRGYLIVNPDVIFKIKKEDEKYVAQHCELEGNEDPNEPT

SEQ ID NO: 28963 - protein, 81 aa, Geotrypetes seraphini
TGASITFCDVAAYFLELEWEALEEWQKELYKKVIKEIHTFLTSRGYVIANPDVIVKIKKEDEKYFTQHYECKGTENMNDPT

SEQ ID NO: 28964 - protein, 81 aa, Geotrypetes seraphini
GMRVTFEDIAISFSQEEWGYLDEGQKELYKEVMKENYQILISLGAASATFTPEIISHIERGEEPCVRDEPGSKERETGQSS

SEQ ID NO: 28965 - protein, 81 aa, Geotrypetes seraphini
DQASITFKDVAAYFLEVEWSILGEWQKELYKKVIKEVHDILISRGYSIVNPDVIFKIGKEDDKYFTQQFEWKEEEDLNDPT

SEQ ID NO: 28966 - protein, 81 aa, Geotrypetes seraphini
AKAAVTFDDVAVYFSEEEWEKLEEGQKELYRETMKDNYEALISLGVPVFKHEIISRIESGEEPCVQGSQYLEQREMPESNF

SEQ ID NO: 28967 - protein, 81 aa, Geotrypetes seraphini
VLASVTFSDVSAYFRKMEWDIMEKWQKELYKKVIKEIHSFLISQGYSILNPDVIFKIKKEDEKYFTQRYEWKRKENLNDPS

SEQ ID NO: 28968 - protein, 81 aa, Geotrypetes seraphini
QMRVTFEDIAVSFSQEEWEYLDEEQKDFYREVMKENYQILISLGAGSPILTPKIISHIERGEEPYIKDEPESEEREIGKSS

SEQ ID NO: 28969 - protein, 81 aa, Geotrypetes seraphini
QMQITFEDIAFSFSQEEWEYLDEEQKELYKEVMKENYQTLISLETGSPAAIPDIISHIERGEEPYIRGEPGSEERETGKSS

SEQ ID NO: 28970 - protein, 81 aa, Geotrypetes seraphini
MMENYVTLASLGNIITSCLYFTRHTSVKPVIVSKIEDGEAPCTSQFSDAEKRKAFKCHSREPGSRNISKDNFHKQFATSLR

SEQ ID NO: 28971 - protein, 81 aa, Geotrypetes seraphini
QMRLSFEDISVSFSQEEWAYLDEEQKELYREVMKENYQTLISLGTGSPSVTPDIISHIEREEEPYVRDEPGSEEREPGTSS

SEQ ID NO: 28972 - protein, 81 aa, Geotrypetes seraphini
SAQMQVKFEDIAISFSQEEWEYLNEEQKQLYREVMEENYQILLSLDHQIQHEWKREKNQGEDPVEMEQIQTLSKNVCENNS

SEQ ID NO: 28973 - protein, 81 aa, Geotrypetes seraphini
QMQVTFEEVAVSFSQEEWEYLDEEQKELYKEVMKENYQILISLATGSPTVTPMIISHIEQGEEPYIRGEPGSEERETGNSS

SEQ ID NO: 28974 - protein, 81 aa, Geotrypetes seraphini
SAQMQVKFEDVAVTFSQEEWEYLDEGQKELYREVMKENYETLISLADSEATQETKREENQVNWLLEIEPIPRQSGNVSENI

SEQ ID NO: 28975 - protein, 81 aa, Geotrypetes seraphini
AQKQVTFEDITVSFTQEEWDYLNEEQKKLYREVMKENYQMLNSLADHQIRPEWQRIKSQREDPVEMDQIQTQSENIYENNS

SEQ ID NO: 28976 - protein, 81 aa, Geotrypetes seraphini
QITVTFNDVAAYFSEQEWQALEEWQRELYRGVMKQIHRALFSLGYPFIRPDVLFRIKQEEMEEAYYWDPQEPEGGDETFCT

SEQ ID NO: 28977 - protein, 81 aa, Geotrypetes seraphini
MPVTFEDIFISFSQEEWDYLNEEQKELYREVMKDNYQTLISLDHQITQEQRDPAGDSSYEHQGKRKGKTHQKQLQSMHKRN

SEQ ID NO: 28978 - protein, 81 aa, Geotrypetes seraphini
DQTLVTFKDVAAYFWEVEWNILGEWQKELYKKVIKEVHGILLSRGYSIVNPDVIVKIKKEDEKYFTQNFEWAGKGNPHDPM

SEQ ID NO: 28979 - protein, 81 aa, Geotrypetes seraphini
VPITFEDVTVNFSQEEWEDLEEWQKELYKDVMKENYETIISLEQREEPYVKDELESEERETGKSSCSESDEPGSQNEPTCL

SEQ ID NO: 28980 - protein, 81 aa, Geotrypetes seraphini
QVPAMFEDVAIYFGEEEWELLEEWQKKLYKETMKENYETLVSLGMGLLAEKPDLIVRIEREENPCVKAQWDSRDEKRWRSS

SEQ ID NO: 28981 - protein, 81 aa, Geotrypetes seraphini
QSPVSFEDIAIYFSQEEWAYLEEWQKELYKDVMKENYEMLSSLEIEFKRRHEGTLPKELHLEVTKTESEKERRDTCPCCDW

SEQ ID NO: 28982 - protein, 81 aa, Geotrypetes seraphini
VSAQVTFEDIAVSFSQEEWGYLDEEQKNLYREVMKENYQTLISLGSPTFTPKMTSHIERGQGPYIKDEPESEERETGQNSC

SEQ ID NO: 28983 - protein, 81 aa, Geotrypetes seraphini
AQMQLKFEDVAVSFSQEEWEYLDEGQKELYREVMKENYETLVSLGSVRISPDLFSWIKQDGEPNIQNPQESGEREVRCSFT

SEQ ID NO: 28984 - protein, 81 aa, Geotrypetes seraphini
DRVKFTFSDVAVYFSEEEWQLLEEQQKELYQNVMKENYTTLMSLGYTTVKPDVISKIEQGKQPLVSSPSGSKGRRAIGRPS

SEQ ID NO: 28985 - protein, 81 aa, Geotrypetes seraphini
AQVPVTFEDIAVYFSQKEWEDLEEWQKELYKDVMKENYEILISLGFLTVIPDIICHIEQGEEPFTRDEPGFKARETGKSSG

SEQ ID NO: 28986 - protein, 81 aa, Geotrypetes seraphini
QEMVTFEDITVRFSQEQWDYLDEGQKKLYREVMKENYETLISVEKDNPINSSAEIYHWEGEKMLSERDKENASSCSDGGEK

SEQ ID NO: 28987 - protein, 81 aa, Geotrypetes seraphini
RMQVTFEEVAVSFSQEEWEYLDEEQKELYREVMKDNYQILISLGKDSPTITPKIISHIDRGEEPYIRGEPGSEERETGKSS

SEQ ID NO: 28988 - protein, 81 aa, Geotrypetes seraphini
QMRLSFEDISVSFSQEEWAYLDEEQKELYREVMKENYQTLISLGTGSPTITPDIISHIERGEEPYVRDVAGTEEKESGISS

SEQ ID NO: 28989 - protein, 81 aa, Geotrypetes seraphini
DQKSVTFKDVAAYFWEVEWNILGEWQKELYKKVIKEVHGILLSRGYSIVNPDVIFKIKKEDEKHFTQHFEWEGKENPHDPL

SEQ ID NO: 28990 - protein, 81 aa, Geotrypetes seraphini
MKENYEILISLETDSPTVIPDIISQIERGEEPFIMDEPGSEERETGKSSCSDHQKRHDWKRIENQGEGPVEMEKIQTQSEN

SEQ ID NO: 28991 - protein, 81 aa, Geotrypetes seraphini
AQMQLKFEDVAVSFSQEEWEYLDEGQKELYREVMKENYETLISLGSVRINPDLLSWIKQDGEPNIQDPQESGEREVRRSDT

SEQ ID NO: 28992 - protein, 81 aa, Geotrypetes seraphini
AQMQVAFEDIAISFSQEEWEYLDEGQKELYREVMKENYETLISLGFVRISPNLLSWIKQDGESNIQEPQESGEREVRHSNT

SEQ ID NO: 28993 - protein, 81 aa, Geotrypetes seraphini
SAQMPVKFEDVAVSFSQEEWEYLNEEQKELYREVMKENYQTLISLDHQITQEMKREKKQGEDPVEIEQVQRQSGNVCENIS

SEQ ID NO: 28994 - protein, 81 aa, Geotrypetes seraphini
EDQVTFQDISISFSQEEWGYLDEEQKDLYREVMKENYQTLISLGTGCPELTPEIISRIERGDELYIRGEPGSEERETGKSS

SEQ ID NO: 28995 - protein, 81 aa, Geotrypetes seraphini
AKVPITFEDVTVNFSQEEWEDLEEWQKELYKDVMKENYETIISLGFLTITPEIIPHIEQREEPYVKDELESEERETGKSSC

SEQ ID NO: 28996 - protein, 81 aa, Geotrypetes seraphini
EQMRVTFEDIAVSFSQEEWEYLDEEQRELYREVMKENYQTLISLGFPTITPDIISHIERGEEPYVRDKPGSEERETGRSNC

SEQ ID NO: 28997 - protein, 81 aa, Geotrypetes seraphini
QMRVTFEDIAVSFSQEEWEYLDEEQRELYREVMKENYQTLISLGTGFPTITPDIISHIERGEEPYVRDKPGSEERETGRSN

SEQ ID NO: 28998 - protein, 81 aa, Geotrypetes seraphini
MLRRRRGRGREEAAEAPRGRRGNGRGPGRAGFAMKKPEVVSRIEQGEEPWVMENAGSSISGTNTILTILERLEKRMARIEH

SEQ ID NO: 28999 - protein, 81 aa, Geotrypetes seraphini
SAQMRVTFEDIAVSFSQEEWEYLDEEQKELYREVMKENYETLISLADTEAMHETKREENEEKCLLEIENISKQSGNVSENI

SEQ ID NO: 29000 - protein, 81 aa, Geotrypetes seraphini
EQVPVTFSDVAAYFWEAEWDVLGEWQKELYRQVIKGIHGVLISWGYSIINPDVIFRIKQPEEKYFSQYHDWEETQPPLGHP

SEQ ID NO: 29001 - protein, 81 aa, Geotrypetes seraphini
QVPITFEDIALYFSRAEWEYLQEQQKELYKDVMKENYEILISLEAGSPIVTPDIISHIERGEELYIMNDPISEERETGKSS

SEQ ID NO: 29002 - protein, 81 aa, Geotrypetes seraphini
VTFEDITVAFSQEEWEYLDEGQKELHREVMKENYEILKSLEKDDPKYNPWKLSEKPEGVKMLSEGEKENWGEKEKNQNPKY

SEQ ID NO: 29003 - protein, 81 aa, Geotrypetes seraphini
NVPVTFQDIAVYFSQEEWEDLEEWQKELYKDVMKENYQTLMSLGAGPLTVTPDIISHIERGEELYTRDKLGSEERETGKSS

SEQ ID NO: 29004 - protein, 81 aa, Geotrypetes seraphini
DQVSITFSDIAAYFLEVEWDILGEWQKEMYQKAIEEIHDILRSRGYSIANPDVVFKIKKEDEKHFAQPFASEGNENLNDHM

SEQ ID NO: 29005 - protein, 81 aa, Geotrypetes seraphini
QEALVTFKDVAAYFWEVEWNILGEQQKELYKKVIKEVHGILLSRGYSIVNPDVIFKIKKADENYFTQHFEWEGKGNPHDLM

SEQ ID NO: 29006 - protein, 81 aa, Geotrypetes seraphini
DQTLVTFKDVAAYFWEVEWNILGDQQKELYKKVIKEVHGILLSRGYSIVNPDVIFKIKKEDEKYFTQDFEWEGKENPHDSM

SEQ ID NO: 29007 - protein, 81 aa, Geotrypetes seraphini
ASAQVTFEDVVVSFSQEEWEYLNEEQKELYREVMEENYQTLISLADHQIQHEWKREKNQGEDPVEMEQIQTQSENVCENNS

SEQ ID NO: 29008 - protein, 81 aa, Geotrypetes seraphini
DQVSITFNDVAAYFLETEWNILEEWQKEMYRNVIQEIHGILTSRGYSIVNPDVIFKIKREDEKYPVQHYEWEKKENMTDPP

SEQ ID NO: 29009 - protein, 81 aa, Geotrypetes seraphini
DQTSVTFKDVAAYFLEMEWDILGEWQKELYKKVIKEIQDILISRGCLIVNPDVIFRIKKEDEKYFPQHCELEEKGNPNEST

SEQ ID NO: 29010 - protein, 81 aa, Geotrypetes seraphini
DQTSVTFKDVAAYFLETEWDVLGEWQKELYKKVIKEIQDILISRGYLIINPDVVFKIKKEDEKYFPQHCDLEEKGNPNEPT

SEQ ID NO: 29011 - protein, 81 aa, Geotrypetes seraphini
MQASVTFIDVAAYFLEGEWNVLGEWQKELYKKIIKDIQGMLISWGYSIVYPDVIVKIKKEDEKYFTHHYEGEEKENPTKSL

SEQ ID NO: 29012 - protein, 81 aa, Geotrypetes seraphini
VTFEDITVAFSQEEWEYLDEGQKELHREVMKENYEILRSLEKDDPKNNPWKLSEKPEGVKMLSEGEKENWGEKEKHQNQKY

SEQ ID NO: 29013 - protein, 81 aa, Geotrypetes seraphini
ALTSVVFSDVAACFWELEWDILKEWQKEIYKKVIKDIHSILMSQGHPLVTSVLSVSVKQESDLSFTDSPESEITEQVHVPV

SEQ ID NO: 29014 - protein, 81 aa, Geotrypetes seraphini
DQVPVAFSDVAAYFWEVEWDVLGERQKKLYKEVIKEIHGILTSRGYSILNPDVIFKIKKEDEKYLTQHCEQKEKENLKVPT

SEQ ID NO: 29015 - protein, 81 aa, Geotrypetes seraphini
MPAGASAQEEWQDLEEWQKELYKDVMKENYETLVSLGAGSPILTPDTISHIERGEEPYIRDDPRSAERETGKSSCSDYEIG

SEQ ID NO: 29016 - protein, 81 aa, Geotrypetes seraphini
MPAEAAAQVLVTLEEEWKGLEEGQRKLNSDVMRDCDENYEALISLGCTAPTPEVLSRIEVENEVQSHSDQFVSEARENATD

SEQ ID NO: 29017 - protein, 81 aa, Geotrypetes seraphini
EMRVMFEEITVSFSQEEWEYLDEGQKELYQEVMKENHETLIFLETNLQFVNPDMLSKIRRDSRMSRKRKATRSYAADDEAK

SEQ ID NO: 29018 - protein, 81 aa, Geotrypetes seraphini
AEMLVTFEDVAVYFSEEEWKVLEDGQKELYKDVMKENFESLMILGYPLVKPDVLIKLERGEDPWEKNWGHLRNTVISRTLC

SEQ ID NO: 29019 - protein, 81 aa, Geotrypetes seraphini
DQTSVTFKDVAAYFLEIEWDVLEEWQKELYKKVIKEIHDILISRGYLIINPDVIFKIKKEDEKYFPQHCELEEKGNPNEPT

SEQ ID NO: 29020 - protein, 81 aa, Geotrypetes seraphini
AQMQVTFEDIAVSFSQKEWEYLDEEQKELYREVMKENYQTVLSLGSPTVIPDIISQIERGEELYIRDEPGSDERETGKNSC

SEQ ID NO: 29021 - protein, 81 aa, Geotrypetes seraphini
TGVPVTFEDIAVYFLEDEWEMLAEWQKELYKETMKENYETLTSLGSSPEKPSLISKIEREEDPCIRNQQDSQDRRRPRSCW

SEQ ID NO: 29022 - protein, 81 aa, Geotrypetes seraphini
DQKLVTFKDVTAYFWEVEWNILGEWQKELYKKVIKEVHGILLSRGYSIVNPDVIFKIKKEDEKHFTQDCEWKGKENPHDPM

SEQ ID NO: 29023 - protein, 81 aa, Geotrypetes seraphini
VKLEDITVSFSQEEWKYLDEGQKELHREVMKENYELLRTLEKDDPIYNPWKLTEKPEGVKMLSEGEKEETSSCSDWGEKGK

SEQ ID NO: 29024 - protein, 81 aa, Geotrypetes seraphini
AQMQVTFEEVAVSFSQEEWEYLDEEQKELYREVMKENYQTLISLAGSLTVTPKIISHIERGEEPYIRGEPGSEEREIGKSS

SEQ ID NO: 29025 - protein, 81 aa, Geotrypetes seraphini
QMQVKFEDIAISFSQEEWEYLNEEQKELYREVMEENYQTLLSLATGSPTFAPKIISYIERGEEPYIRGEPESEERESGNSS

SEQ ID NO: 29026 - protein, 81 aa, Geotrypetes seraphini
QMSVKFEDIAVSFSQEEWEYLNEDQKELYREVMKENYQTLISLGTGSPSITPDIISHIERGEELYIKEEPGSEEREPGRSS

SEQ ID NO: 29027 - protein, 81 aa, Geotrypetes seraphini
QMPVKFEDVAVSFSQEEWEYLNEEQKELYREVMEENYQILLSLATGSPTFTPKIISLIKQEEEPYFRGEPESEERETGKSS

SEQ ID NO: 29028 - protein, 81 aa, Geotrypetes seraphini
VQIPVTFEDLVIYFSKEEWEDLEEWQKELYKEVMKENYKSLISLGSPTITPDVISLIERGEEPYVRDDPGSEERDSGKSSC

SEQ ID NO: 29029 - protein, 81 aa, Geotrypetes seraphini
EDCMQTWVTFEDVAVSFSLEEWQYLNEGQKDLYREVMKENLELLTSLSSLVAQLEQNRELFMKGQRGTLLSPSTGNRVAPG

SEQ ID NO: 29030 - protein, 81 aa, Geotrypetes seraphini
DQKLVTFKDVAAYFWEVEWNILGEWQKELYKKVIKEVHGILLSRGYSIVNPDVIFKIKKEDEKYFTQDFEWEGKENQHDSM

SEQ ID NO: 29031 - protein, 81 aa, Geotrypetes seraphini
RMQVTFKDITVSFSQEEWEYLDEGQKELYREVMKENYRTLISLDHQISQERKREKKQREDSVEIEQVQRQSGNVCENISQG

SEQ ID NO: 29032 - protein, 81 aa, Geotrypetes seraphini
AQMQVKFEDVAVSFSQEEWEYLDEGQKVLYREVMKENYETLISLGTVRISPDLLSWIKQDGETHIQDPQESGEREVRHSDT

SEQ ID NO: 29033 - protein, 81 aa, Geotrypetes seraphini
TRVTFEDITVSFSQEEWEYLNEEQKDLYREVMKENYETLSSLDYQITQEQRDPAGDSSYEHQGERKGKTHQKELQSIHKRN

SEQ ID NO: 29034 - protein, 81 aa, Geotrypetes seraphini
DLASVIFHDVAVYFSSEEWEILTDWQKELYKNVMREIHGTLVALGYTIVNRSTLLRVKEKTEAWRRRDRNKPSPTSTTSYP

SEQ ID NO: 29035 - protein, 81 aa, Geotrypetes seraphini
AQMQVKFEDVVVSFTEEEWEYLDEGQKELYKEVMKENYETLISLGSVRISPDLLSWIKQEGEPNIQNPQESGEREVRRSDT

SEQ ID NO: 29036 - protein, 81 aa, Geotrypetes seraphini
FQVSVTFKDVAAHFSEEEWEGLEEWQKEFYRKVMLEVHEALISLGYGILNSDIIFRVKQRDKLYSKDWQDVDGGRSARTSS

SEQ ID NO: 29037 - protein, 81 aa, Geotrypetes seraphini
AQMQVKFEDVAVSFSQEEWEYLDEGQKELYREVMKENYETLISLGSVRISPDLFSWIKQDGETHIQDPQESGEREVRHSDK

SEQ ID NO: 29038 - protein, 81 aa, Geotrypetes seraphini
QNQMRVKLEGISVSFSQEEWAYLDERQKELHREVMKENYELLRSLAANEMRLKKEKREEQLLKWKPYSSQVDISQRTERRN

SEQ ID NO: 29039 - protein, 81 aa, Geotrypetes seraphini
MKDNYEALISLGVPVFKHEIISRIESGEEPCVQGSQYLEQREMPESNFMDDDLIKEIKVEEEHLVECASVPDEQIIPSEKL

SEQ ID NO: 29040 - protein, 81 aa, Geotrypetes seraphini
EVPVTFEDIALYFSQEEWEALEEWQKELYKDVMKENYQILLSLGIGSLNVTPDIISHIERGEEPYIRDELRSEERDTGKSS

SEQ ID NO: 29041 - protein, 81 aa, Geotrypetes seraphini
QMRVTFEDISVSFSQEEWGYLNEEQKELYREVMKENYQTLISLATDSPIIDPDIISRIERGEEPYVRDEPASEERETGRSN

SEQ ID NO: 29042 - protein, 81 aa, Geotrypetes seraphini
VQTLLAFEDVAVYFSEEEWALLDELQKDIYKNTMRENYETLLSLGLTNMKPEIIAKIDAGEAPSVRNGSYLEKQGRKNAAG

SEQ ID NO: 29043 - protein, 81 aa, Geotrypetes seraphini
QMPVKFEDIAVSFSQEEWEYLNEEQKELYREVMKENYQTLISLGTGSPCVTPDIISHIEWGEEPYIREEPGSEEREPVRSS

SEQ ID NO: 29044 - protein, 81 aa, Geotrypetes seraphini
AQMQLKFEDVAVSFSQEEWEYLDEGQKELYREVMKENYETLLSLGSVRISPDLLSWIKQDGETHIQDPQESGEREVRHSDT

SEQ ID NO: 29045 - protein, 81 aa, Geotrypetes seraphini
AQMPVKFEDIAVSFSQEEWEYLNEEQKELYREVMEENYQTLISLGSPPVTPDIISHIERGEEPYIREEPGSEEREPGRSSC

SEQ ID NO: 29046 - protein, 81 aa, Geotrypetes seraphini
RVPVTFEEIAVHFSREQWECLNEGQKELYREVMKENYETVISLGIDHESINPEVLSRIKQEEEPCVWDPKESGEREVTHLY

SEQ ID NO: 29047 - protein, 81 aa, Geotrypetes seraphini
AQMPVKFEDIAISFSQEEWEYLDEEQKQLYREVMKDNYQTLLSLADHQIHHEWKREKNQGEDPVDMEQIQIQSENVSENNS

SEQ ID NO: 29048 - protein, 81 aa, Geotrypetes seraphini
AQVPVTFEDIAIYFSQEEWEYLDEGQKALYREVMKENYETLLLLGCPGLKPVIISSIEQGEEPCVRKLQERAELYPTAGDE

SEQ ID NO: 29049 - protein, 81 aa, Geotrypetes seraphini
DQTSVTFKDVAAYFLEMEWDILGEWQKELYKKVIKEIHDILMSRGYLIVNPDVVFKIKKEDEKYFPQHCDLEEKGNPNEST

SEQ ID NO: 29050 - protein, 81 aa, Geotrypetes seraphini
DQASVIFSDVAAYFWDVEWDILGEWQKELYKKVIKEIHSFLIAQGYSILNPDVIFKIKKEENKYFTQHCEMEGKENINDST

SEQ ID NO: 29051 - protein, 81 aa, Geotrypetes seraphini
QMPVTLEDIFISFSQEEWEYLNEEQKELYREVMAENYETLKSLGTDSPPVTPDIISHTERGEEPYIKDEPGSEERETGTSS

SEQ ID NO: 29052 - protein, 81 aa, Geotrypetes seraphini
AQVSVTFDDAAGRSLEDEWKGLEEGQKMLHMDTMKDTYEVLTCLDSAAANPEVLSRIKEEDEPPCSDHSASEGKEDSNPGI

SEQ ID NO: 29053 - protein, 81 aa, Geotrypetes seraphini
AQGLVSFEDIAIYFSQEEWEDLEEPQKELYKDVMKDNYQTLSSLGRASITPDIITHIEQGEEPYIRTWPKSEEREARKSSH

SEQ ID NO: 29054 - protein, 81 aa, Geotrypetes seraphini
ASGQVAFEDIAVSFSQEEWEYLDEGQKELYREVMKENYETLISLGYVKISPDLLSWIKQEGEPNIQDPQESEERERHSYTG

SEQ ID NO: 29055 - protein, 81 aa, Geotrypetes seraphini
QMPVKFEDIAVSFSQEEWEYLNDEQKELYREVMKENYQTLISLGIGSPSVTPDIISHIERKEEPGSEEREPGRSSCSDHQK

SEQ ID NO: 29056 - protein, 81 aa, Geotrypetes seraphini
TQMRVTFEDITVSFSQEEWEYLDQGQKELYREVMKENYEILISLADHQISQEWKKEKNQGEDPVKMEQMQTQENVGQNISQ

SEQ ID NO: 29057 - protein, 81 aa, Geotrypetes seraphini
AQMQVKFEDVAVSFSQEEWEYLDEGQKELYREVMKENYETLISLGSVRISPDLFSWIKQDGEPNIQDPQESGEREVRCSFT

SEQ ID NO: 29058 - protein, 81 aa, Geotrypetes seraphini
AQMQVKFEDVAISFSQEEWEYLDDGQKELYREVMKENYETLISLGLICLQRIHESERPFTSPECGKSFNHQSSLRRHERIR

SEQ ID NO: 29059 - protein, 81 aa, Geotrypetes seraphini
QQMWVTFEDVAVSFSQEEWEYLDDGQKELYQEVMKENYETVMSLGEEFSQEKEKEENAEHSLKTEVHEMNLKAVNLFKCSL

SEQ ID NO: 29060 - protein, 81 aa, Geotrypetes seraphini
DKALVTFKDVAAYFWEVEWNILGERQKELYKKVIKEVHGILLSRGYSIVNPDVLFKIKKEDEKYFTQHFEWEGKGNPHDPM

SEQ ID NO: 29061 - protein, 81 aa, Geotrypetes seraphini
QIPVTFEDTAIYFSQEEWDDLEEWQKELYKDVMKENYEILISLGAGSPAVTPDIISYIERVKELYIGDELGSEERETRKSS

SEQ ID NO: 29062 - protein, 81 aa, Geotrypetes seraphini
AQMQITFEDIAFSFSQEEWEYLDEEQKELYKEVMKENYQTLISLGSPPVTPDIIFHIERGEEPYIREEPGSEEREPGRSSC

SEQ ID NO: 29063 - protein, 81 aa, Geotrypetes seraphini
QVPVTYEDITVHFSREQWECLNEGQKELYREVMKENYDTLISLGTGHESIGPEVLSKIKQEEEPLVWDPKEAGETEITHSY

SEQ ID NO: 29064 - protein, 81 aa, Geotrypetes seraphini
DQASVIFSDVAAYFWEMEWNILGEWQKNLYKKIIKEIHNFLMSQGYSIVNPDVIFKIKKEDEKHFTQCYEREDMKDSIMKF

SEQ ID NO: 29065 - protein, 81 aa, Geotrypetes seraphini
QKPVTFEDIIVSFTQEEWAYLDEEQKKLYREVMKENYQMLNSLGTGSPTFTLKILSHIKPRQKPNIRSEPGSEERETGKSS

SEQ ID NO: 29066 - protein, 81 aa, Geotrypetes seraphini
SAQKQVTFEDITVSFTQEEWAYLDEEQKKLYREVMKDNYQMLISLDHQIRPEWQRIKSQREDPVEMDQIQTESENIYENIS

SEQ ID NO: 29067 - protein, 81 aa, Geotrypetes seraphini
AQMRVTFEDIAVSFSPEEWEYLDQRQKDLYREVMKENYEILISLGCPNLTPEIISRIERGEEPYIRGEPGSEERETGKSSC

SEQ ID NO: 29068 - protein, 81 aa, Geotrypetes seraphini
QMQVTFEDIAVSFSQEEWEYLDEEQKELYREVMKDNYQTLLSLAIDSLTFTPKIISHIKRGEEPYIRSEPESEERESVKSS

SEQ ID NO: 29069 - protein, 81 aa, Geotrypetes seraphini
RAMPVTLEDVTVSFSSEEWQMLEEWQKELYRNVMSDNYDTISSLGEIDLKPNVMPNFEWDEELIAGDRAEVAGNDGYSVFN

SEQ ID NO: 29070 - protein, 81 aa, Geotrypetes seraphini
SAQMQLKFEDVAVSFSQEEWEYLDEGQKELYREVMKENYETLISLADTEAMQEMKMEENQENWLLEIELIPRQSGNVSENI

SEQ ID NO: 29071 - protein, 81 aa, Geotrypetes seraphini
QMQVTFEEVAISFSQEEWEYLDEEQKELYREVMKENYQTLISLATGSPTVTPKIISHIERGEEPYIRGEPGSEERETGKNS

SEQ ID NO: 29072 - protein, 81 aa, Geotrypetes seraphini
QMPVKFEDVAVSFSQEEWEYLKEEQKELYREVMKENYETLISLGTGSPPVTPDIISHIERGEEPYIREEPGSEERGPVRSS

SEQ ID NO: 29073 - protein, 81 aa, Geotrypetes seraphini
DQTSVTFKDVAAYFLEMEWDILGEWQKELYKKVIKEIHDILISRGYVILNPDVIFKIKKEDEKYFAQHCELEGKGNPNEPI

SEQ ID NO: 29074 - protein, 81 aa, Geotrypetes seraphini
RVTFEDIAVSFSQEEWEYLDEGQKELYREVMKENYQTLMFLDNEAVWEPKREPNREPQVDMEKGPPKSGNGCQNISERNER

SEQ ID NO: 29075 - protein, 81 aa, Geotrypetes seraphini
GQMPVTFEDIFISFSQEEWDYLNEEQKELYREVMKDNYQTLISLDHQIMHEQSDPARDSRFQPQAKRKGKAHQKELQCVHK

SEQ ID NO: 29076 - protein, 81 aa, Geotrypetes seraphini
VKMEDVTVSFSQEEWEYLDEGQKELHREVMKENYELLRSLEKDDPKYNSWKLSEKTERVKMLSETSSCSVWGEKEKHQNQK

SEQ ID NO: 29077 - protein, 81 aa, Geotrypetes seraphini
GMRVTFEDIAVSFSQEEWEYLGEGQKELYREVMKENYETLISLGTDSSALTPEIISRIERGEEPCIRDKPGSEERETGKSS

SEQ ID NO: 29078 - protein, 81 aa, Geotrypetes seraphini
DQTSVTFKDVAGYFLETEWDILREWQKELYKKIIKEIHDILISRGYLIVNPDVIFKIKKEDEKYFAQHCELERKGNPNEPT

SEQ ID NO: 29079 - protein, 81 aa, Geotrypetes seraphini
SAQMRVTFEDIAVSFSQEEWEYLDEKQKELYREVMKENYEILISLADTEAMQWIKREENEEKWLLEIEHIPRQPGNVSENI

SEQ ID NO: 29080 - protein, 81 aa, Geotrypetes seraphini
MRVTFEDIAVSFSQEEWEYLDEEQKELYREVMKENYEILISLADTEAMQEMKREQNEEKWLLEIEPIPRQPGNVSENISQS

SEQ ID NO: 29081 - protein, 81 aa, Geotrypetes seraphini
VTFEDITVSFSQEEWEYLDEGQKELHQEVMKENYEILRSLEKDDPKNNPWKLSEKTEGVKMLSEGEKENWGEKEKNQNQKY

SEQ ID NO: 29082 - protein, 81 aa, Geotrypetes seraphini
AQMQVKFEDIAISFSQEEWEYLDEEQKELYREVMKENYQTLLSLADHQIQHEWKRENNQGEDPVEMEQIQTQSENVCENIS

SEQ ID NO: 29083 - protein, 81 aa, Geotrypetes seraphini
AQLHVKFEDVAVSFSQEEWEYLNEEQKELYREVMEENYQTLLSLGSPTFTPKIISHIKHGEEPYIRGEPESEERESGKSNC

SEQ ID NO: 29084 - protein, 81 aa, Pseudonaja textilis
IGLFTLQEVAVHFTKEEWTLLEPDQKAPHRETMEEISGILASLGKSHLSLETERRNHEASSYVESWDETSDRNMSWKSHPG

SEQ ID NO: 29085 - protein, 81 aa, Pseudonaja textilis
DLISFEDVAVFFSVEEWALLDSEQKALYQEVMLENKRNVASLGDGWEMEDSGQEAAAPLPKDKKEVVGKMYGKPSCELSQL

SEQ ID NO: 29086 - protein, 81 aa, Pseudonaja textilis
DLVSFEDVAVFFSVEEWALLDSEQKALYQEVMLENKRNVASLGDGWEMEDSGQEAAAPLPKDKKEVVGKMYGKPSCELSQL

SEQ ID NO: 29087 - protein, 81 aa, Colinus virginianus
TQSGSISMEEIRRDVHAAAAAAALLDPAQRALYRDVMLETYECVASLGEGFAAFPPLLGSFGSAECASTSRAQNNHHAVLS

SEQ ID NO: 29088 - protein, 81 aa, Geotrypetes seraphini
DQTSVTFKDVAAYFLEMEWDVLGEWQKELYKKVIKEIHDILISRGYVIVNPDVIFRIKKEDEKYFAQHCELEGKVNPNEPT

SEQ ID NO: 29089 - protein, 81 aa, Geotrypetes seraphini
DQASITFKDVAAYFLEVEWDILGEWQKELYKKIIKEIHDILISRGCLIVNPDVIFKIRKEDEKYFTQHFEWEEKENLNDPT

SEQ ID NO: 29090 - protein, 81 aa, Geotrypetes seraphini
QMRLRFEDISVSFSQEEWAYLDEEQKELYREVMMDNYQTLISLGTGSPPATPDIISHIEQGEEPYIKDEPGSEERETGRSS

SEQ ID NO: 29091 - protein, 81 aa, Geotrypetes seraphini
ASAQVTFEDIAVSFCHEEWRYLDEGQKELYKEVMKENYETLISLGFLCEKPSLISKIEQEEDPCVRDQQNSRERRRRLKNF

SEQ ID NO: 29092 - protein, 81 aa, Geotrypetes seraphini
VTFEDITVAFSQEEWEYLDEGQKELHREVMKENYEILKSLGKDDPKNNPWKLSEKPEGVKMLSEGEKENWGEKEKNQNPKY

SEQ ID NO: 29093 - protein, 81 aa, Geotrypetes seraphini
DWVSVTFSEVAAYFWEVEWDGLGERQKELYKMVIFEIHGILMSRGYSIFNPDAIFKLKRQDGKYFTPLCEWKRKENPNDPP

SEQ ID NO: 29094 - protein, 81 aa, Geotrypetes seraphini
QMPVKFEDIAVSFSQEEWEYLNEEQKELYREVMEENYQTLISLGIGSPSVTPDIISHIEGGEEPYIREEPGSEEREPGRSS

SEQ ID NO: 29095 - protein, 81 aa, Geotrypetes seraphini
QLHVKFEDVAVSFSQEEWEYLNEEQKELYREVMEENYQTLLSLATGSPTFTPKIISHIKHGEEPYIRGEPESEERESGKSN

SEQ ID NO: 29096 - protein, 81 aa, Geotrypetes seraphini
YQASVTFNDVAVYFSQEEWRLLDEWQKRLYKDVTKEIQSVLISLGYTIVNPNVLFRIKDSDRPSKEGRRERVHRGREKLKG

SEQ ID NO: 29097 - protein, 81 aa, Geotrypetes seraphini
QVPVTFEDVAVSFSQEEWKYLDEAQKNLYWEVMKENYETLISLADSEVHQEEEREKNQEEYPMLWGLISRQSRKNHEKVYW

SEQ ID NO: 29098 - protein, 81 aa, Geotrypetes seraphini
AQMQVKFEDVAVSFSQEEWEYLDEGQKELYREVMKENYETLLSLGSVRISPDLFSWIKQDGEPNIQDPQESGEREVRHSDT

SEQ ID NO: 29099 - protein, 81 aa, Pelodiscus sinensis
EVEPVSFEEVAVYFSEDEWALLHPAQRALYGDVMQENYESVNWLKFQVSKTDVISWMELEEELRVPDPQSVCPLFYSSFRV

SEQ ID NO: 29100 - protein, 81 aa, Pelodiscus sinensis
VMEPVSFEEVAVYFSEEEWALLGPRQRALYRDVMQENNEAVNWLRFSILKPDLVAQLERGEEPWVSDFQSSKEMEILRVTR

SEQ ID NO: 29101 - protein, 81 aa, Geotrypetes seraphini
QMQVKFEDIAISFSQEEWEYLNEEQKELYREVMEENYQTLLSLATGSLTFTPKIISYIERGEEPYIKDEPESEEKESGKSS

SEQ ID NO: 29102 - protein, 81 aa, Geotrypetes seraphini
GRMQVTFEEIFISFSQEEWDYLNEEQKELYREVMKENYQTLISLADQQIRHEWKRQKNQGEDVVEMEQSQTQSENVCENIS

SEQ ID NO: 29103 - protein, 81 aa, Geotrypetes seraphini
AQMQLKFEDVAVSFSQEEWEYLDEGQKELYREVMKENYETLISLGSVRISPDLLSWIKQEGETHIQDPQESGEREVRHSDT

SEQ ID NO: 29104 - protein, 81 aa, Geotrypetes seraphini
TRASVTFRDVAVCFSEEEWETLEEWQKELYRNAMKKIHGALISLGYAIVNPGVLFKIRKEDETRYGGEHASKGRENNDIAD

SEQ ID NO: 29105 - protein, 81 aa, Geotrypetes seraphini
MRVTFEDIAVSFSQEEWEYLDQGQKDLYREVMKENYEILISLGSSNPIPEIISRIERGEEPYIRGEPGSEERKTGKSSCSD

SEQ ID NO: 29106 - protein, 81 aa, Geotrypetes seraphini
GQMRLSFEDISVSFSQEEWAYLDEEQKELYREVMKENYQTLISLGSPTVTPDIISHIERGEEPYVKDEAGTEERESGTSSC

SEQ ID NO: 29107 - protein, 81 aa, Geotrypetes seraphini
DQASITFKDVAAYFLEVEWNILGEWQKQLYKKFIKEIHDILISRGYSIINPDVIFKIRREDDKYFTQQFEWKEEEDLNDPI

SEQ ID NO: 29108 - protein, 81 aa, Geotrypetes seraphini
QVPVTFEDIAVYFSQEEWEDLEEQQRELYKDVMKENYETLSSLGTGPPAVTPDIISHIERGEEPYIRFESGPEEREIGKSS

SEQ ID NO: 29109 - protein, 81 aa, Geotrypetes seraphini
AQKQVTFEDITVSFTQEEWAYLDEEQKKLYMEVMKDNYQMLISLADHQIQPEWQRIKSQREDPVEMDQIQTQSENIYENIS

SEQ ID NO: 29110 - protein, 81 aa, Geotrypetes seraphini
EDCMQTWVTFEDVAVSFSLEEWQYLNEGQKDLYREVMKENVELLTSLSSLVAQLEQNRELFVKGQRGTLLSPSTGNIVGPG

SEQ ID NO: 29111 - protein, 81 aa, Geotrypetes seraphini
DWVSVTFSEVAAYFWEVEWDGLGERQKELYKMVIFEIHGILMSRGSSSVKPDILIRFKLEGFQTEPRGFEDRGNLPISDFS

SEQ ID NO: 29112 - protein, 81 aa, Geotrypetes seraphini
VMFEDIFIFFSQEEWEYLDEEQKKLYKEVMKENYEILMSLGKDDPKNNPWKLSEKPEGVKMLSEGEKEETSSCSVWEEKEK

SEQ ID NO: 29113 - protein, 81 aa, Geotrypetes seraphini
AAQMQVTFEDITVTFSPEEWEYLNEGQKELYREVMKENYQTLISLGYQIAQERKREKNQGEEPVEIEQIQKQSENICETVS

SEQ ID NO: 29114 - protein, 81 aa, Geotrypetes seraphini
VQMPVTFDDVAIYFSQEEWEELNEQQRELYQEVMRENLELLTSLGYPKATHDITLKIKEWEESCIWEQQDTQGDEILLSFH

SEQ ID NO: 29115 - protein, 81 aa, Geotrypetes seraphini
VTFEDIAVSFSQEEWEYLDEGQKELYREVMKENYQTLMFLADNEAVWEPKREPNREPQVDMEKGPPKSGNGCQNISERNER

SEQ ID NO: 29116 - protein, 81 aa, Geotrypetes seraphini
DQPLVTFKDVAAYFLEVEWNILGEQRQELYKKVIKEVHGILLSRGYSIVNPDVIFRIKKEDENYFTQHFEWEGKGNPHDPM

SEQ ID NO: 29117 - protein, 81 aa, Geotrypetes seraphini
AQVPITFEDIALYFSRAEWEYLQEQQKELYKDVMKENYEILISLAGSPIVTPDIISHIERGEELYIMNDPISEERETGKSS

SEQ ID NO: 29118 - protein, 81 aa, Geotrypetes seraphini
DQALVTFKDVAAYFWDVEWNILGERQKELYKKVIKEVHGILLSRGYSIVNPDVIFKIKKEDEKHFTQDFEWEGKENPHDSM

SEQ ID NO: 29119 - protein, 81 aa, Geotrypetes seraphini
SAQKQVTFEDITVSFTQEEWAYLDEEQKKLYMEVMKDNYQMLISLDHQIQPEWQRIKSQREDPVEMDQIQTQSENIYENIS

SEQ ID NO: 29120 - protein, 81 aa, Geotrypetes seraphini
MEVTFEEIAISFSEEEWQCLNEEQKELYREVMKENYQTLISLGPGAPTVIPAIISRIERGEEPRLEKKKRGKSSCSDNEAS

SEQ ID NO: 29121 - protein, 81 aa, Geotrypetes seraphini
DQTSVTFKNVAAYFLETEWNVLEEWQKELYKKVIKEIQDILISRGYLIVNPDVIFRIKKEDEKYIAQHGELEGKGNPNEPT

SEQ ID NO: 29122 - protein, 81 aa, Geotrypetes seraphini
DLVSVTFRDVAAYFLEMEWDILGEWQKEMYKKVIKEIHGILRSHGYSIVNPNVVFKFKKEDEKYSTQLFEWEGEESPNDPM

SEQ ID NO: 29123 - protein, 81 aa, Geotrypetes seraphini
GLPQVTFDDAAIYFSEEQWKNLEEWQQEMYKELMKEIYETMIALGHQIPKPDILSLIERGEEPCALPSKRKKTEPHPQTTE

SEQ ID NO: 29124 - protein, 81 aa, Pelodiscus sinensis
VVEPVSFEEVAVYFSEEEWALLDAGQRALYWDVMQENYEAVSWLGFPASTAHAISWVEQGEELWIPDVQGCEEGEIISDPH

SEQ ID NO: 29125 - protein, 81 aa, Pelodiscus sinensis
VVELLTFEEVAVYFSKEEWALLDPGQRALYRDVMQENYEAVSWLGFPVSKTDVISWVEREEEFWVPDPRSCEEGVIISNTH

SEQ ID NO: 29126 - protein, 81 aa, Pelodiscus sinensis
AQRLVAFEEVAVYFTKEEWALLDPSQRAVYWDIMQENYENVTSLGLPLSTPEVTPQLEGGEELWVSDLQGSEGREIPRGTY

SEQ ID NO: 29127 - protein, 81 aa, Colinus virginianus
PKVPLTFDDIAVYFNEEEWERLDSWQKDLYKAVMRGNYETLVSLDYAVSKPDILSRIERGEELFVKDCWESPQTFNQVSPE

SEQ ID NO: 29128 - protein, 81 aa, Pelodiscus sinensis
PKVPVMFEDGAVFSQDEWENLEDWQKELYKNVMKGNYEYMISLGTDYAISKPDILSRIERGEEPCARGQQESEGKSCMTNR

SEQ ID NO: 29129 - protein, 81 aa, Colinus virginianus
RLLHKEPVSFEEVAVYFSREEWALLDPAQRALYRDVMLEMYECVASLGEGFAAFPPLLGTFGCAEYESEIRAQNNHHAVPS

SEQ ID NO: 29130 - protein, 81 aa, Pelodiscus sinensis
QQPPVAFEDVALYFTRAEWELLSPPEKQLYREQMLRNYRALVSLGFSGSTPDLICRIELGEAELWIQDAENFKESSWPEGE

SEQ ID NO: 29131 - protein, 81 aa, Pelodiscus sinensis
VEPVSFEEVAVYFSEEEWALLDPGQRALYWDVMQENYEAVSWLAGDGMLSENNEGSLHQEGPEQVAPCEILLGRSEGHVSQ

SEQ ID NO: 29132 - protein, 81 aa, Pelodiscus sinensis
PEPVNFEEVAVYFSEEEWALLDPGQRALYRDVMQENYEAVSWLAGDKMLNENSERSLQEEGPERMAPCGMLVGRSEWHVSQ

SEQ ID NO: 29133 - protein, 81 aa, Pelodiscus sinensis
QESVTFEEVAVYFTRAEWALLDPAQRALYRAVMQENYEMVALLGKQNEESFWENDAEEYEEQVEPQGMLSERLKGTVSENC

SEQ ID NO: 29134 - protein, 81 aa, Pelodiscus sinensis
EPMPFKEVAVYFTWEEWALLDPAQRALYRAVMRENYENVTSLGCGMTSMCCSRPSRLPLGRGREMAALELVQGPVTFEEVA

SEQ ID NO: 29135 - protein, 81 aa, Pelodiscus sinensis
VAKPVSFQEVAVYFSEEEWALLAPGQRALYWDAMQENYEAVSWLGFPVPKAHVLSWVEQREELQTLDIQGCEEGEIISDTH

SEQ ID NO: 29136 - protein, 81 aa, Pelodiscus sinensis
AAAGLVTFEEVAVYFSEEEWALLDPGQRALYWDVMQENYEAVSWLAFELLQPEGFEGKGGFSPLAGDGTLRENNESPERGE

SEQ ID NO: 29137 - protein, 81 aa, Pelodiscus sinensis
KVPVTFDDVSVYFSEQEWGNLDDWQKDLYKNVMKGNYESLISLGTDYAISKPDLLSRIERGEEPWGGEQENAEEREIPMEP

SEQ ID NO: 29138 - protein, 81 aa, Colinus virginianus
LQEPVSFAEVAVYFSREEWALLDPAQRALYRDVMLEMYECVTSLGEGFAAFPPLLDTFGCAECASAIRAQSNRHAVPSWQT

SEQ ID NO: 29139 - protein, 81 aa, Pseudonaja textilis
VSFEEVAVCFSKEEWTQLNPHQKALHGEVMRENLRNVKRHFVEPALWPKANHTRGGIQQVLTRGYYLLLCRALPASQDLFL

SEQ ID NO: 29140 - protein, 81 aa, Pelodiscus sinensis
PVTFEEVAVYFSEEEWALLDPGQRALYWDVMQENYEAVSWLGFPVCKAHVISWMDRGEELLVPDLQACEEGENGSDTHTGE

SEQ ID NO: 29141 - protein, 81 aa, Pelodiscus sinensis
FQVPVTFEELSVYFTVGQGALLSPAQRDLYEDVMQENYETVASLGFSILKPDLIAQLERGEELWVPDLQPFKEMEILRGTH

SEQ ID NO: 29142 - protein, 81 aa, Pelodiscus sinensis
QGLVTFEEVAVHFTEEEWVLLDPAQRALYRDVMQENYENVSSLGMEPSTDDENDRDTFEDQKHEAKLLTNFQEMVSFSLQN

SEQ ID NO: 29143 - protein, 81 aa, Pelodiscus sinensis
GFPISKPDLLSWMERGEEPWVPDLQAPEEREIPRSSSPGEQEESEGENHVRTEKEVESPSPGPEGKLEILEGKTPEKPAGQ

SEQ ID NO: 29144 - protein, 81 aa, Pelodiscus sinensis
EIPKVPVTFDDVSVYFNEQEWGCLEEWQKELYKNVMKGNYEALISLDTGPDSPLVLEECGTWLKVPRQPLVSLPATTQHPL

SEQ ID NO: 29145 - protein, 81 aa, Pseudonaja textilis
WACHLLVAIHFNNEEWLLLDPSQKALYQEVMLETSRMVASLGKGSSGGKFTSEQGVTRYIIYNLDLYPHQRKTAQSVPKIS

SEQ ID NO: 29146 - protein, 81 aa, Pelodiscus sinensis
PKVPVTFNNASFNFSEQEWKSLDEWQKELYRHIMKGNYEAVISLDAAISKPDLLSRIERGEAPGVGNQGDSESRQIPEDPS

SEQ ID NO: 29147 - protein, 81 aa, Colinus virginianus
SQEPVSFEEVAVYFSREEWALLDPAQRALYRDVMLETYECVASLAPLPAPKPMVISLLEEGEEPWIPDVGSPEAVAGDVSP

SEQ ID NO: 29148 - protein, 81 aa, Pelodiscus sinensis
FQVPVTFEEVAVYFTQGQGALLGPAQRALYRDVMRENYEMVTSLGFPVPKPDLVTRLERGEELWVPDCQASEEGGICRGEE

SEQ ID NO: 29149 - protein, 81 aa, Pelodiscus sinensis
PKVPVKFDEVSGCFSGQEWGVLEQRQEELHRNTERSHYETLISLDHAASTPDAQSWIEAREEPRVQGGQGSPKRETPTAPS

SEQ ID NO: 29150 - protein, 81 aa, Pelodiscus sinensis
VSEPVTFEEVALYFSEEEWALLDAGQRALYRDVMKENYEAVRWLDNGRLNENHDKSLQNEGPEQMAPCGMMLGISEGHVSQ

SEQ ID NO: 29151 - protein, 81 aa, Colinus virginianus
WQEPVTFEDIAVYLSRAEWDMVSEEQRELYCSVMLDNYELLASLGYPGPKPDIVHRLERGEEPWVSTPQSPVKWDGPDRSL

SEQ ID NO: 29152 - protein, 81 aa, Geotrypetes seraphini
SGRMQVTFEEIFISFSQEEWDYLNEEQKELYREVMKENYQTLISLDQQIRHEWERKKNPGEEAVEMEQIQTHSENVCKNIS

SEQ ID NO: 29153 - protein, 81 aa, Geotrypetes seraphini
QMPVKFEDIAVSFSQEEWEYLNEEQKELYREVMKENYETLISLGTGSPPVTPDIISHIERGEEPYIKEEPGSEERGPVRSS

SEQ ID NO: 29154 - protein, 81 aa, Geotrypetes seraphini
SAQKQVTFEDITISFTQEEWAYLDEEQKKLYREVMKDNYQMLISLDHQIRPEWQRIKSQREDPVEMDQIQTQSENIYENIS

SEQ ID NO: 29155 - protein, 81 aa, Geotrypetes seraphini
MWVTFEDVAVSFSQEEWEYLDEGQKELYREVMKENYETVMSLAGIEFSQQKEKEENLEQHSLKWRLRPRRVDVILETVKGE

SEQ ID NO: 29156 - protein, 81 aa, Geotrypetes seraphini
DQALVTFKDVAAYFWEVEWNILGEQQKKLYKKVIKEVHGILLSRGYSIVNPDVLFKIKKEDEKYFTQHFEWEGKGKPHGHM

SEQ ID NO: 29157 - protein, 81 aa, Geotrypetes seraphini
GLKKATFDDVAVYFSSEEWSQLDEDQKTIYRDVMQDNYQIMISLGYDIPKPKVLLLVEEGRDPCIDDHIDSARENIDGMVI

SEQ ID NO: 29158 - protein, 81 aa, Geotrypetes seraphini
QVQETFEDIAVSFSQEEWGYLDEEQKELYREVMKENYQTLLSLGTGSLTVAPDIICRIERGEEPYIKDEPGSEEREPGRSS

SEQ ID NO: 29159 - protein, 81 aa, Geotrypetes seraphini
AQMQVEFEDIAVSFSQEEWEYLDEGQKELYREVMKENYETLISLGSPTFTPKIISYIERGEEPYIRGEPESEERESGKGSC

SEQ ID NO: 29160 - protein, 81 aa, Geotrypetes seraphini
RIPVTFEDIIIYFSQEEWEYLEEWQKELYKDVIKENYETLILLGMYSPTDTPDIISRIERGEEPYIRDETGSEERETGKSI

SEQ ID NO: 29161 - protein, 81 aa, Geotrypetes seraphini
DQASVTFSDVAAYFWKAEWDILGEWQKELYKKVIKEIHNFLMLQGYSIVNPDVIFKIKKEEDKCFTQHCELEGDENLKDST

SEQ ID NO: 29162 - protein, 81 aa, Geotrypetes seraphini
DQKSVTFKDVAAYFLEMEWDILGEWQKKLYKKVIKEIHDILISRGYLIVNPDVIFKIKKEDENYFSQHCELEEKGNPNEST

SEQ ID NO: 29163 - protein, 81 aa, Geotrypetes seraphini
MQVKFEDVAVSFSQEEWEYLDEGQKELYREVMKENYETLISLGSVRISPDLLSWIKQDGEPNIQDPQESGEREVRHLDTGL

SEQ ID NO: 29164 - protein, 81 aa, Geotrypetes seraphini
PVTLEDIFISFSQEEWEYLNEEQKELYREVMAENYETLMSLDHEITQERKREGEHSIEREEIQRQSENVCENISQGTKRIH

SEQ ID NO: 29165 - protein, 81 aa, Geotrypetes seraphini
AQMQVKFEDVAVSFSQEEWEYLDEGQKELYREVMKENYETLISLGSVRISPDLLSWIKQDGETRIQDPHESGEREVRRSDT

SEQ ID NO: 29166 - protein, 81 aa, Geotrypetes seraphini
RMWVSFEEIFISFSQEEWDYLNEEQKELYMEVMKENYETLISLDDRITQERTRAKKQGEDPVEIEQVQRQSENVCENISQN

SEQ ID NO: 29167 - protein, 81 aa, Geotrypetes seraphini
AQMQVTFEEIAVSFSQEEWEYLDEEQKELYREVMKENYEILISLGSLAFTPKIISHIERGEEPYIRGEPGSEEREHGKSSC

SEQ ID NO: 29168 - protein, 81 aa, Geotrypetes seraphini
AQKQVTFEDITVSFTQEEWAYLDEEQKKLYREVMKDNYQMLISLADHQIRPEWQRIKSQREDPVEMDQIQTQSENIYENIS

SEQ ID NO: 29169 - protein, 81 aa, Geotrypetes seraphini
RASAQMPVKFEDIAVSFSQEEWEYLNEEQKELYREVMEENYQTLISLDHQITQEKKQGEDPVEIEQVQRQSGNVCENISQG

SEQ ID NO: 29170 - protein, 81 aa, Geotrypetes seraphini
SAQMPVTFEDITVSFTQEEWEYLNEEQKKLYREVMKENYQTLISLDHQIRHEWKRIKKRGEDPVKMEQIQTQSENVCENIS

SEQ ID NO: 29171 - protein, 81 aa, Geotrypetes seraphini
AQMQVKFEDVVVSFTQEEWEYLDEGQKELYKEVMKENYETLISLGSVRISPDLFSWIKQDGEPKIQDPQESGKREVRHSDT

SEQ ID NO: 29172 - protein, 81 aa, Geotrypetes seraphini
QMQVKFEDIAISFSQEEWEYLNEEQKELYREVMEENYQTLLSLATGSLTFTPKIISYIERGEEQYIKDEPESEEKESGKSS

SEQ ID NO: 29173 - protein, 81 aa, Geotrypetes seraphini
DQALVTFSDVAAYFWEVEWDILGEWQKELYKKVIKEIHSFLIAQGYSILNPDVIFKIKKEDEKYLTHYCESEEKENMNDPT

SEQ ID NO: 29174 - protein, 81 aa, Geotrypetes seraphini
QVPVTFEDITIYFSQEEWQDLEEWQKELYKDVMKENYETLVSLGAGSPILTPDTISHIERGEEPYIRDDPRSAERETGKSS

SEQ ID NO: 29175 - protein, 81 aa, Geotrypetes seraphini
EQISVTFRDVVASFSEEEWKVLEDWQKELYGNVMKEIHGTLISLDFLSIKPDILLRIKEEEEEEEEEEDVEAFCWDAQEVE

SEQ ID NO: 29176 - protein, 81 aa, Lonchura striata
EQEPVTFKDVTVFLSRAEWDALTAGQRELYRDVVSDTYELLTSLGYPGPKPDILHRLERGEEPWICSSPGHAKSWLEEPSS

SEQ ID NO: 29177 - protein, 81 aa, Geotrypetes seraphini
DQESVIFSDVAAYFLEAEWDILGEWQKNLYKKVIREIHDILMSRGYSIANPDVIFKIKKEDEKYLIPHFEWERKENLNDPT

SEQ ID NO: 29178 - protein, 81 aa, Geotrypetes seraphini
AQMRVTFQDIAVYFSEEEWEYLDEGQKELYWDVMKENYQTLLSLGDNEVIQEQQRELDQEKPPVKMEQIPKQSGNVFENIS

SEQ ID NO: 29179 - protein, 81 aa, Geotrypetes seraphini
KLKPVKFQDVAVYFSEEEWQLLENQQKELYRSVMKENYENLTSLGFTTTKPNILKRMEQGRPLWVSTRRKVIKHSFREGEP

SEQ ID NO: 29180 - protein, 81 aa, Geotrypetes seraphini
MKENYETLVSLGAGSPILTPDTISHIERGEEPYIRDDPRSAERETGKSSCSDYEIGAKYEETQDGNLAENLDWNKMLFPEE

SEQ ID NO: 29181 - protein, 81 aa, Geotrypetes seraphini
DQTSVTFKDVAAYFLEMEWDILGEWQKELYKKVIKEIHDILMSRGYLIVNPDVVFKIKKEDKYFPQHCDLEEKGNPNESTK

SEQ ID NO: 29182 - protein, 81 aa, Geotrypetes seraphini
VARMQTRVTFDDIAVSFSQEEWEYLDEGQKELYREVMEENLELLTSLGSLVAQPEQMEELYMMDHHDMGLRGTLLSLCTED

SEQ ID NO: 29183 - protein, 81 aa, Geotrypetes seraphini
AQVPVSFEDITICFSQAEWEMLKEWQKELYKDVMKENYQTLISLGFPIVSPDIISHIERGEEPYIRDQQGSKEREPGKRSC

SEQ ID NO: 29184 - protein, 81 aa, Geotrypetes seraphini
DQASITFKDVAAYFLEVEWSILGEWQKELYKKVIKEVHDILISRGYSIVNPDVIFRIKKGDDKYFTQQFEREEKENLTDPT

SEQ ID NO: 29185 - protein, 81 aa, Geotrypetes seraphini
QMQVTFEEIAVSFSQEEWEYLDEEQKELYREVMKENYQILISLGIGSPTFTPKIISQIEREEEPYIRGEPGSEERGNGKSS

SEQ ID NO: 29186 - protein, 81 aa, Geotrypetes seraphini
QMPVKFEDIAVSFSQEEWEYLNEEQKELYREVMEENYQTLISLGTGSPPVTPDIISHIERGEEPYIREEPGSEEREPGRSS

SEQ ID NO: 29187 - protein, 81 aa, Geotrypetes seraphini
QMRLSFEDISVSFSQEEWAYLDEEQKELYREVMKENYQTLISLGTGSPSVTPDIISHIERGEEPYVRDEPGSEEREPGTSS

SEQ ID NO: 29188 - protein, 81 aa, Geotrypetes seraphini
ASAQMRVTFEDIAVSFSQEEWEYLDEKQKELYREVMKENYEILISLDTEAMQWIKREENEEKWLLEIEHIPRQPGNVSENI

SEQ ID NO: 29189 - protein, 81 aa, Geotrypetes seraphini
DQASVSFSDIAVYFSEEEWQLLEEWQKELYRNVMMENYVTLASLGHTSVKPVIVSKIEDGEAPCTSQFSDAEKRKAFKCHS

SEQ ID NO: 29190 - protein, 81 aa, Geotrypetes seraphini
QVQETFEDIAVSFSQEEWGYLDEEQKELYREVMRENYQTLLSLGTGSLTVAPDIICRIERGEEPYIKDEPGSEEREPGRSS

SEQ ID NO: 29191 - protein, 81 aa, Geotrypetes seraphini
AQMPVTLEDIFISFSQEEWEYLNEEQKELYREVMEENYQILLSLADHQIHHEWKREKNKGEDPVEMEQIQTQSENVCENIS

SEQ ID NO: 29192 - protein, 81 aa, Geotrypetes seraphini
MEWDILGEWQKELYKKVIKEIHDILISRGYVILNPDVIFKIKKEDEKYFAQHCELEGKGNPNEPIEMFPIVTSVFSLSVKQ

SEQ ID NO: 29193 - protein, 81 aa, Geotrypetes seraphini
VIFHNVAAYFSEDDWEALEDWRKEMYRNAMREIHRALVSLGYGIVNKEVLFQITQEDKLFFRDPGASKIREDINGCAASSP

SEQ ID NO: 29194 - protein, 81 aa, Geotrypetes seraphini
AFVQVTFQDISISFSQEEWGYLDEEQKDLYREVMKENYQTLISLADQQLSQEWKREKNQGEDPVEMGDIQRQSKPVCENIF

SEQ ID NO: 29195 - protein, 81 aa, Geotrypetes seraphini
EPASVTFSDVAAYFWEAEWDVLGEWQKDLYRKVIKEIHGILMSLGYSIVNPDVIFRIKQREERYLSQHYDWKEKENGDNPS

SEQ ID NO: 29196 - protein, 81 aa, Anas platyrhynchos
PQELPAFEDVAVFLSRAEWELAAEEQRELYRAVMLDNFALLASLGYAGPKPDLLYRLEHGEEPWVCTPQGSETWDGPNSPS

SEQ ID NO: 29197 - protein, 81 aa, Geotrypetes seraphini
AQMPVTFEDITVSFTQEEWEYLNEEQKKLYREVMKENYQTLISLADHQIRHEWKRIKKRGEDPVKMEQIQTQSENVCENIS

SEQ ID NO: 29198 - protein, 81 aa, Geotrypetes seraphini
AQMQVKFEDIAISFSQEEWEYLNEEQKELYREVMEETYQILLSLADHRIQHEWKREKNKGEDPVEMEQIQTLSKNVCENNS

SEQ ID NO: 29199 - protein, 81 aa, Geotrypetes seraphini
AQMQVKFEDIAISFSQEEWEYLNEEQKQLYREVMEENYQILLSLADHQIQHEWKREKNQGEDPVEMEQIQTLSKNVCENNS

SEQ ID NO: 29200 - protein, 81 aa, Geotrypetes seraphini
QMPVKFEDVAVSFSQEEWEYLNEEQKELYREVMKENYQTLISLGTGSPPITPDIISHIEWGEEPYIREEPGSEEREPGRSS

SEQ ID NO: 29201 - protein, 81 aa, Geotrypetes seraphini
EDCMQTWVTFEDVAVSFSQEEWQYLSEGQKELYREVMKENLELLTSLSSLVAQLEQNRELFMKGQRGTLLSPSTGNRVAPG

SEQ ID NO: 29202 - protein, 81 aa, Geotrypetes seraphini
AQASVIFNKVAIYFSEEEWQLLEEWQKELYKNVMKEIHGTLISLGHTVLNRGILFRIKNEDVQPHGREERQLLGLARALVT

SEQ ID NO: 29203 - protein, 81 aa, Geotrypetes seraphini
QQMQVTFEDIAVSFSQEEWEYLDEGQKELYREVMMENYELLMSLGDQIILETEREKESEECGKSFKHKRRSAQGLKKYRKK

SEQ ID NO: 29204 - protein, 81 aa, Geotrypetes seraphini
EPVTFEDVTVHFSREQWESLNEGQKELYREVMKENYETLISLENNDTRNNDTEIHRWKLSEETEEEKLFERNKEVTSSCSD

SEQ ID NO: 29205 - protein, 81 aa, Anas platyrhynchos
AAVAFEDVAIYFSPEEWVELAAWQRELYQEVMMDNYDLVACLGKEEPCQGLGWPKTCVGSALGVSPTQALLIPHPSSSPKW

SEQ ID NO: 29206 - protein, 81 aa, Geotrypetes seraphini
QMQVTFEEVAISFSQEEWEYLDEEQKELYREVMKENYQTLISLATGSPTVTPKIIAHIERGEEPYIRGEPGSEERETGNSS

SEQ ID NO: 29207 - protein, 81 aa, Geotrypetes seraphini
KVRVTFENVALSFSQEGWGYLDGGPKDLYKEAMKENYENLRCLDTDHERINPNLLSSIKQEGNLNGQDPQKSGDGEVTHSY

SEQ ID NO: 29208 - protein, 81 aa, Geotrypetes seraphini
QMQVKFEDVAISFSQEEWEYLNEEQKQLYREVMEENYQTLLSLATGSLTFTPKIISHIKHEEEPYIRGEPESEERESGKSS

SEQ ID NO: 29209 - protein, 81 aa, Geotrypetes seraphini
VTFEDITVAFSQEEWEYLDEGQKELHREVMKENYEILKSLGKDDPKNNPWKLSEKPEGVKMLSEAEKMNWGEKEKNQNPKY

SEQ ID NO: 29210 - protein, 81 aa, Geotrypetes seraphini
AQMQVKFEDIAIYFSQEEWEYLDEEQKELYREVMEENYQTLLSLADHQIQHEWKREKNQGEDLVEMEQIQTLSKNVCENNS

SEQ ID NO: 29211 - protein, 81 aa, Hirundo rustica
KAPAVALENDATGFSTQEWENLEEWQRELYGKVLTGKREALVPLDDVISEPALLSRLQGGEAPCNEEEVAPREIPAEPEAL

SEQ ID NO: 29212 - protein, 81 aa, Colinus virginianus
PKVPVTFDDVSVYFNDKEWEKLEEWQKELYKNVMKGNYESLISLDYAISKPGVLSQIEQGEEPRVRNEQDLEESEMMTDAT

SEQ ID NO: 29213 - protein, 81 aa, Geotrypetes seraphini
QIPVIFEDIVIYFSQEEWKDLEEWQKELYKDVMKENYQTLISLGTGFPTPPPDIISHIERGEEPYIRDELESEKRETGKRG

SEQ ID NO: 29214 - protein, 81 aa, Geotrypetes seraphini
AQMQVAFEDIAISFSQEEWEYLDEGQKELYREVMKENYETLISLGFVRISPDLLSWIKQDGESNIQDPQESGEREVRHSYT

SEQ ID NO: 29215 - protein, 81 aa, Geotrypetes seraphini
AQVPVSFEDITIYFSQEEWQRLDEGQKELYKNVMKENYEALSSLGFPIATPDIITLIEHGKEPYIKNEPGLEERYQGESNC

SEQ ID NO: 29216 - protein, 81 aa, Geotrypetes seraphini
PITFEDIAIYFSQEEWEDLEEWQKKLYKEVMKENYQMLNSLEIESKRRHEVALPEELTRHLKATKTELEKERRDTCPCCDW

SEQ ID NO: 29217 - protein, 81 aa, Geotrypetes seraphini
RMQVTFEEIFISFSQEEWDYLNEEQKELYREVMKENYQTLISLETGSPTVIPDIISHIERGEELYIRNEPGSEERETGKSS

SEQ ID NO: 29218 - protein, 81 aa, Geotrypetes seraphini
QMRIKFEDIALFFSQEEWEYLDEEQKELYREVMKENYQTLISLETGSPTVIPDIISHIERGEQPYIRGEPGSEEREIGKNS

SEQ ID NO: 29219 - protein, 81 aa, Geotrypetes seraphini
QQMQVTFEDVAVSFSQEEWEYLDEGQKELYREVMKENYETVVSLGSPASTPKIISCIECGEEAYIRGEPGSEGRETGKSSC

SEQ ID NO: 29220 - protein, 81 aa, Geotrypetes seraphini
QMPIKFEDIAVSFSQEEWEYLNEEQKELYREVMKENYQTLISLGTGSPPVTPDIISHIERGEEPYIREEPGSEEREPGRSS

SEQ ID NO: 29221 - protein, 81 aa, Geotrypetes seraphini
MQVTFEDIAVSFSQEEWRYLDEGQKELYREVMMENYETLIFLGTDSSAIAPEIISRIERGEELYIKDEPGFEERETGEGSC

SEQ ID NO: 29222 - protein, 81 aa, Geotrypetes seraphini
AQMQVKFEDIAISFSQEEWEYLDEEQKQLYREVMEENYQTLLSLATGSPTTPKIISHIKQGEEPYIRGEPELEERETGKSS

SEQ ID NO: 29223 - protein, 81 aa, Geotrypetes seraphini
AQMQVTFEEIAVSFSQEEWEYLDEEQKELYREVMKENYEILISLAGSPTFIPNIISYIERGEEPYIRDEPGSEERETVKSS

SEQ ID NO: 29224 - protein, 81 aa, Geotrypetes seraphini
VKLEDVTVSFSQEEWEYLDEGQKELHREVMKENYELLRSLEKDDPKNNPWKLSEKPEGVKMLSEGEKENWGEKEKHQNQKY

SEQ ID NO: 29225 - protein, 81 aa, Geotrypetes seraphini
TQVHITFEDIAVSFSREEWGYLDEGQKELYREVMKENYETLISLGNERVRPDILSRIKREEEPYVQDSQESGEREVATSFT

SEQ ID NO: 29226 - protein, 81 aa, Geotrypetes seraphini
MPVTFEDITVSFSQEQWDYLDEGQKELYREVMKENYEILISLGIDHESMNPEVLARINQEERLNVWDPEKSGESEVAHLYT

SEQ ID NO: 29227 - protein, 81 aa, Geotrypetes seraphini
QPVSITFSDVAAYFWEAEWDVLGEWQKEMYKKVIKGIHGVLRSWGYSIVHPDVVFKIKKEDEKYFAQHCEWEEKEDSGSLS

SEQ ID NO: 29228 - protein, 81 aa, Hirundo rustica
AQEPVTFEDVMVFLSRAEWDVLPTGRRQLYRDVVSDTYELLTSLGYPGPKPDILHRMERGEEPWICSSSEHDGSWLEEPSS

SEQ ID NO: 29229 - protein, 81 aa, Geotrypetes seraphini
DQTLVTFKDVAAYFLEVEWNILGEWQKELYKKVIKEVHGILLSRGYSIVNPDVIFRIKKEDENYFTQHFEWEGKGNPHDPL

SEQ ID NO: 29230 - protein, 81 aa, Geotrypetes seraphini
EQMRVKLEDVTISFSQEEWEYLDEGQKELHREVMKENYELLRSLEKDDPKYNSWKLSEKTERVKMLSEREKEETSSCSVWG

SEQ ID NO: 29231 - protein, 81 aa, Geotrypetes seraphini
DQALVTFKDVAAYFWEVEWNILGEWQKELYKKVIKEVHGILLSRGYSIVNPDVIFKIKKEDEKYFTQDFKWEGKENPLDSM

SEQ ID NO: 29232 - protein, 81 aa, Geotrypetes seraphini
VTFEDITVSFSQEEWEYLDEGQKELHREVMKENYELLSYLGKDEPKNNLWNLSEKSEGVKMLSEGEKENWGEKEKNQNKKY

SEQ ID NO: 29233 - protein, 81 aa, Geotrypetes seraphini
QMQVAFEDVAIAFTQEEWRYLDAEQKELYWEVTKENYETLMSLGLEVTQGRKSEENREEGAIEMDQMSRQSGFDCDIVLLG

SEQ ID NO: 29234 - protein, 81 aa, Geotrypetes seraphini
DQASVTFKDVAGYFSEAEWDVVGEWQKELYKKVVEELRDNLISRGYSIVNPDVIVRIKKEDEKYFTQHFEWDGKENPHDPM

SEQ ID NO: 29235 - protein, 81 aa, Geotrypetes seraphini
AQMPVKFEDVAVSFSQEEWEYLKEEQKELYREVMKENYETLISLGSPPVTPDIISHIERGEEPYIREEPGSEERGPVRSSC

SEQ ID NO: 29236 - protein, 81 aa, Geotrypetes seraphini
MQVKFEDVAVSFSQEEWEYLDEGQKELYREVMKENYETLLSLGLKCLQKIHESDRPFTYPACGKSFNHQSNLRKHKRNHTG

SEQ ID NO: 29237 - protein, 81 aa, Geotrypetes seraphini
ASAQMRVTFEDIAVSFSQEEWEYLDEKQKELYREVMKENYEILISLDTEAMQEMKREENEEKCLLEIEHIPRQPGNVSENI

SEQ ID NO: 29238 - protein, 81 aa, Geotrypetes seraphini
SDQALVTFKDVAAYFWEVEWNILGELQELYKKAIKEVHGILLSRGYSIVNPDVIFKIKKADEKYFTQHFEWEGKENPHDPM

SEQ ID NO: 29239 - protein, 81 aa, Geotrypetes seraphini
HQASVTFSDVAVYFSEEEWQLLEEWQKELYRNVMMEIHGALISLGYPTVSPDILLRIKHEAEPCHREQHLPDGRERISTSN

SEQ ID NO: 29240 - protein, 81 aa, Geotrypetes seraphini
RLPVTLEDITVYFSQEQWEYLNEGQKELYREVMKENYETLISLGTNHESIDPEVLSRIKQEEKLRIWDLQESGDREDARSY

SEQ ID NO: 29241 - protein, 81 aa, Geotrypetes seraphini
AQVPVTFEDVAVYFCKDEWELLAGWQKDLYTETMKENYETLTSLGSSSEKPSLISKIERQEDLCVIDQQDPREKLKSPWRG

SEQ ID NO: 29242 - protein, 81 aa, Pelodiscus sinensis
LQMRVTFEEVAVYFTQGQGALLGPAQRALYRDVMQENYEAVTSLGFPVPKPELIARLERGEEPWEPDLQARDETGDGTGSE

SEQ ID NO: 29243 - protein, 81 aa, Pelodiscus sinensis
VVEPVNFEEVAVYFSEEEWALLDPGQRALYRDVMQENYEAVSWLGIPVSKAHVLSWMERGEELQILDLQGCEEGEIISDTH

SEQ ID NO: 29244 - protein, 81 aa, Pelodiscus sinensis
PTGLVTFEEVAVYFTREEWALLDSAQRALYRAVMQENYESVALLGFPVPKPDVISWLERGEDPWVSDLQSSEEREILRNAC

SEQ ID NO: 29245 - protein, 81 aa, Geotrypetes seraphini
ASAQVTFEDIAVSFSQEEWEYLDEEQKQLYREVMKENYQTLLSLADQQIQHEWKREKNQGEDPVEMEQIQTQSENVCENIS

SEQ ID NO: 29246 - protein, 81 aa, Geotrypetes seraphini
DQAPVTFREVAAYFWEEEWCILGEWEKKMYKGVIKEVHGFLISRGYSIFNPDVVFKIKKDDGKYFPQHCEQEGKENLNDPK

SEQ ID NO: 29247 - protein, 81 aa, Geotrypetes seraphini
SAREMVTFEDIAVSFSEEEWAYLDEEQKKLYREVMEENYQTLVSLEQELKQERESEKNQGEDRLEMEQIQRQSGNVCANIS

SEQ ID NO: 29248 - protein, 81 aa, Geotrypetes seraphini
GQVPLTFDDVAVYFSFDEWRKLEDWQKELYKTTMQENYDSLESLGFAMKKPEVVSRIEQGEEPWVMENAGSSISGTNTILT

SEQ ID NO: 29249 - protein, 81 aa, Colinus virginianus
EPVSFEEVAVYFSREEWALLDPAQRALYRDVMLETYECVASLAPLPGPKPMVISLLEEGEEPWIPDVGSPEAVAGDVSPGE

SEQ ID NO: 29250 - protein, 81 aa, Pelodiscus sinensis
PKVPVTFDDVSVYFNEQEWGHLNEWQKELYKNVMKSNYETLISLDYAISKPDILSRIERGEELSVGDQGDGDEREISINHS

SEQ ID NO: 29251 - protein, 81 aa, Pelodiscus sinensis
ETVTFEEVAVYFSEEEWALLDPDQRALYWDVMQENYEAVSWLVGDGTLSENNEKSLLQEQMPPRGLLLERSEGQVSQRPEQ

SEQ ID NO: 29252 - protein, 81 aa, Pelodiscus sinensis
EPVSFEEVAVYFSEEEWALLDPGQRALYRDVMQENYEAVNRLSKGWVSFHKRERLASSLKNNGHKQDNHRHQKPVYSRCFH

SEQ ID NO: 29253 - protein, 81 aa, Pelodiscus sinensis
VQVSVTFEEVAVYFTSAEWALLDPAQRALYRAVMQENYKNMSSLGILVSKPDVISQLERGEEPWVPDLQSLVEREILRGIP

SEQ ID NO: 29254 - protein, 81 aa, Pelodiscus sinensis
AQGLVPFEEVAVYFTRTEWALLDPAQRALYRAVMQENYENVTSLGFAVSKPDVISQLERGEEPWVPELQGSEHREILGGTG

SEQ ID NO: 29255 - protein, 81 aa, Pelodiscus sinensis
FQVPVTFEEVAVYFTTGQGALLSPAQRALYKDVMQENYETVASLGFPISKPDLLTQLEQGEKLWVPDLQPSKEMRILRDIH

SEQ ID NO: 29256 - protein, 81 aa, Pelodiscus sinensis
VSFEEVAVYFSEEEWALLDPCQRALYRDVMQENYESVSWLGFPVSKAHVISWVEQGEELWIPDLQDCERDFRILFPTGDGR

SEQ ID NO: 29257 - protein, 81 aa, Pelodiscus sinensis
VSFEEVAVYFSEAEWALLDPGQRALYRDVMQENYEAVNWLGKDSCPHGILSQIYRENAPCLLESVLQHWVLRTESHCYRLS

SEQ ID NO: 29258 - protein, 81 aa, Pelodiscus sinensis
EPVTFAEVAVYFSVEEWVLLDPGQRALYWDVMQENYEAVSWLGFQVSKVHISWEELQIPDLQGSKEGEIIHDTHSGDGMTS

SEQ ID NO: 29259 - protein, 81 aa, Pelodiscus sinensis
LQMRVTFEEVAVYFTQGQGALLGPAQRALYRDVMQENYEAVTSLGFPVPKPELIARLERGEEPWEPDLQARDEREILRGTR

SEQ ID NO: 29260 - protein, 81 aa, Pelodiscus sinensis
LGAFRQGCRTPMFVSSSAPGLQSQGQEVAVAEPVSFEEVAVYFSEEEWALLDLGQRALYRDVMQENYEAVNWLSKDSCPLG

SEQ ID NO: 29261 - protein, 81 aa, Pelodiscus sinensis
GAVTFEEVAVYFTEEEWALLDPAQRHLYRAVMRENYETVTSLGKQPRSLGYSKPEEVADQPEIVRTKEVPLSGAPENTDLH

SEQ ID NO: 29262 - protein, 81 aa, Pelodiscus sinensis
VEEPVSFEEVAVYFSEEEWALLDPGQRALYWDVMQENYEAVSWLGFPISKADVISWVEQGEELWIPGLQGFEEGEIIRHIH

SEQ ID NO: 29263 - protein, 81 aa, Pelodiscus sinensis
KVPVAFENDSVYFAEHEWQNLEEWQKELYKNVMKGNYESLISLAERGQGEGEPREEGACAKALEEWGPEPGTHPSGAAGVS

SEQ ID NO: 29264 - protein, 81 aa, Pelodiscus sinensis
EPLTFEEVAVYFSEEEWAFLDPGQRALYRDVMQENYEAGRWLGFPVSTPHMISWVEQGDALWIPALQGCENGKIMTDTHTG

SEQ ID NO: 29265 - protein, 81 aa, Pelodiscus sinensis
LAEPVSFEEVAVCFSEEEWALLDLGQRTLYGDVMQENYEAVSWLGFPLRKPDLIAQLERGEEPWVPDLQPSKDLEIQRDTH

SEQ ID NO: 29266 - protein, 81 aa, Pelodiscus sinensis
VAELVSFEEVAVYFFEEEWALLDPGQRALYRDVMQENYEAVSWLGFPVSEAHEISWVEQEEELQVPDPQSCEEGEIINNTH

SEQ ID NO: 29267 - protein, 81 aa, Pelodiscus sinensis
VEPVSFEEVAVYFSEEEWALLDPGQRALYWDVMQENYEAVSWLVRGRGVSKAHVISWVERGEELWIPDRQGCEEGESISDI

SEQ ID NO: 29268 - protein, 81 aa, Pelodiscus sinensis
FQMPVTFEEVAVYFTAGQGVLLSPMQRDLYEDVMQENYETVASLGFSISKPDLIIQLERGEEPWVPDLQPSKEMGFLRESR

SEQ ID NO: 29269 - protein, 81 aa, Pelodiscus sinensis
AQMQVTFEEVAVYFTQGQGALLGPAQRALYRDVMQENYEAVTSLGFPVPKPELITRLERGEEPWVPDLQASEEREILRGTR

SEQ ID NO: 29270 - protein, 81 aa, Pelodiscus sinensis
SKVPMTFDDVSIQIAREKWENLEEWQKELYKNVMKGNYESLISLDHAISKPDILSRIEQGEELCVGDPQDLEVRAIHIESS

SEQ ID NO: 29271 - protein, 81 aa, Pelodiscus sinensis
AEPVTFEEVAVYFSEEEWALLAPGQRALYRDVMQENYEAVSWLAGDGMLNENSERSLQEEGPKEMAPCGVLVERCEGHVSQ

SEQ ID NO: 29272 - protein, 81 aa, Pelodiscus sinensis
AEPVSFEEVAVYFSEEEWALLDPGQRALYRDVMQENYEAVNRLSSSVEENIREQGETCERQHSLERQHENHPGEGQGNFSH

SEQ ID NO: 29273 - protein, 81 aa, Pseudonaja textilis
DDLMFLCFVAIHFNNEEWLLLDPSQKALYQEVMLETSRMVASLGVTRYIIYNLDLCVTLIDKSMHRDIKVDVVDYSNLFFF

SEQ ID NO: 29274 - protein, 81 aa, Micrurus corallinus
QDSTQESRKPSLDFLESPLCAGAEGFAEPLLQDIVSFEEVAVHFSAEEWSQLDADQKALHGEVMLENSRNLAFLGFNEKEN

SEQ ID NO: 29275 - protein, 81 aa, Micrurus corallinus
EDQSQDSTQESRKLSLDFLESLHCAETEPLLQDIVSFEEVAVYFSEEEWSQLDADQKALHGEVMLENSRNLAFLGFNEKEN

SEQ ID NO: 29276 - protein, 81 aa, Micrurus corallinus
QGSVSFEDVAVYFTEEEWALLDSSQRALHREVMLENSRNLAAVGYGQEHENYQELNFTLLQSEERMLGIQRVLQKSTNSCL

SEQ ID NO: 29277 - protein, 81 aa, Micrurus corallinus
FDHVEEVALDFTEEEWRLLDSGQKALCWEVMQEVFRNMAALDDGPANENDKSAKLNLQQLEKNEVEVMFGTQGDITRQERS

SEQ ID NO: 29278 - protein, 81 aa, Pseudonaja textilis
QNSISFEDVAVFFSMGEWALLDLEQKTLYREVMLENARNLASLSKRLCFSGMKFWWKVFSSESQTVFPSYADHLMCSFYTF

SEQ ID NO: 29279 - protein, 81 aa, Micrurus corallinus
VLVFFEDVTVFFSEEEWALLDFDQKSLYREVMLENAKNVESMGDRGEPEYYKEPGVNSLEKTETTKGIFQNQKKPNVTEEH

SEQ ID NO: 29280 - protein, 81 aa, Pseudonaja textilis
PKVPLNFSDASVHFNEQEWRKLEEWQRELYRTVMRSNYDMLVSLDHAISKPDILSQMDQGEEVRMEESEVLENREIPKDPS

SEQ ID NO: 29281 - protein, 81 aa, Pseudonaja textilis
SPDLVSFEDVAVFFSMEEWALVDSEQKALYREVTLENKRSKKEPSSSFTCFLSLHKKIHKAEDPHICLDCGRTFRQKNHLN

SEQ ID NO: 29282 - protein, 81 aa, Pseudonaja textilis
QNFVSFEDVAVFFSVEEWALLDSEEKALYREVMLENKRNVASLGKGFCYNTVLENSSGLPCPDINALLDADDCHEKEVCSK

SEQ ID NO: 29283 - protein, 81 aa, Pseudonaja textilis
TCDLVSFEDVAVFFSMEEWALVDSEQKALYREVTLENKRSKASLGGNPYKYTECAETFGTSCFLSLHKKIHKAEDPHICLD

SEQ ID NO: 29284 - protein, 81 aa, Anas platyrhynchos
PTAGAGEDDAACLPEQEWGGLDSRQQELYRMAVKGSYEAVVSLGPGDASSKPSLLLPAEDGEDLGTRTHGLLEKGAVSGHV

SEQ ID NO: 29285 - protein, 81 aa, Pseudonaja textilis
RAGPVSFEEVAIHFNNEEWLLLDPNQKTLHREVMLETSRIVDSLGKGSFRGKLSQTGETLNALMVQYKRKGRCTEPPLKYF

SEQ ID NO: 29286 - protein, 81 aa, Pseudonaja textilis
PKVPVTFDDLSVHFNEHEWGNLDELQKDLYKTVMKSNYEMLVSMDYAIAKPEILTRIEQGEALCDTNIDTMPGINTPTPPG

SEQ ID NO: 29287 - protein, 81 aa, Pseudonaja textilis
FLPQVTFEDVAIYFSREEWDELSEWQRELYQAVMMENYEAVLSLGKNDFIAQCTWGLREGEKRASGKSEKARNRPVSNLWR

SEQ ID NO: 29288 - protein, 81 aa, Micrurus corallinus
CQVSVTFEEVAVYFTKEEWALLDPSQRALHEEVMLENSRNVTALGKPRLWMETTETSPPCGGAATSQGLASFEEVVVYFTE

SEQ ID NO: 29289 - protein, 81 aa, Pseudonaja textilis
QLGGWQCVAVYFSEEEWSQLDPDQKVLHLEVMFENHRNVVSLGKSFLKIRKKYPGKSVNLFKGKIQLNEHYYTPNKREDAI

SEQ ID NO: 29290 - protein, 81 aa, Pseudonaja textilis
PKVPITFEDNAVYFSEQEWGNLEKWQKELYKNVMKSNYESLVSLGKKKKELLLLMGLPLQGAPKTYCHHRRQSIQMGCSCS

SEQ ID NO: 29291 - protein, 81 aa, Pseudonaja textilis
LVSFEEVAVYFSEEEWSQLDPDQKVLHLEVMFENHRNVVSLGEERPLCFQRLLPWISCSPQFLKEHRPKINRKFSPNSSLD

SEQ ID NO: 29292 - protein, 81 aa, Pseudonaja textilis
MEEWALVDSEQKALYREVTLENKRSKASLVWKNIDTVQIQQWYLIAFALNVVLTFLFFIDSGQEAAAPLPKDKKEVAEKMY

SEQ ID NO: 29293 - protein, 81 aa, Anas platyrhynchos
MEPYVLLDPRQRALYRDVMQESYETLMALEFPVSKPDLLSRLAHEDEPTALDLHVPKDAPSGEPPPPPPQKCADCGKRLNH

SEQ ID NO: 29294 - protein, 81 aa, Micrurus corallinus
RRIPQEDPNQDTSEVKHRMMCGLYGSVETVDETAENQDTLSFEEVAVHFSEEEWSQLDADQKTLHWEVMLENYRNMASLVR

SEQ ID NO: 29295 - protein, 81 aa, Pseudonaja textilis
ESLVSFEEVAVYFSEEEWSQLDPHQKVLHREVMLENHTNVVSLGKKPFRVIPHKDSLEKPANQKVEMHERNQSSNWNQESL

SEQ ID NO: 29296 - protein, 81 aa, Pseudonaja textilis
LQNSVTFEDVAVYFTEDQGALLDRKQRTLYEDVMVENYGIVASLGFLALKPALISQIEHGEEPWLPEISKLDDTEISNANA

SEQ ID NO: 29297 - protein, 81 aa, Pseudonaja textilis
LVSFEDVAVFFSMEEWALVDSEQKALYREVTLENKRSKASLDESRQHPRRSLPPPLRERINEGGNPYKYTECAETFGTSCF

SEQ ID NO: 29298 - protein, 81 aa, Pseudonaja textilis
VPVTFDDMSVYFNEKEWEKLEEWQKELYKNLMKGNHQSLVSLGKGEAPLEEEEEEEEEEEEEEEDPVSLENRGLFSSRAEP

SEQ ID NO: 29299 - protein, 81 aa, Pseudonaja textilis
MEEWALVDSEQKALYREVTLENKRSKFGRILILFKYSNVAEKMYGKPSLKQKQLTGELENCSGLPCPDINVLLDTDDSHEK

SEQ ID NO: 29300 - protein, 81 aa, Micrurus corallinus
ESTPDSRKLSLEILESPPLCGGAEELAEPLLQGVVSFEDVAVYFSKEEWSQLDADQKALHGEVMLENSRNLAFLGFNEKEN

SEQ ID NO: 29301 - protein, 81 aa, Pseudonaja textilis
VGGYLGWDISVTFSEEEWALLNPDQRALHRDVMAENSGICLECGKRFIHNTSLTYHRQHHTGVKPYKCSECGKRFSHRTSL

SEQ ID NO: 29302 - protein, 81 aa, Pseudonaja textilis
RKSLGARETFLSFQGLVTLDKVALGFTEEKCELLDLEQKALHEEVMEEIKGIVVSLGKPPHPRFGSRFSRPACQSHPVYFF

SEQ ID NO: 29303 - protein, 81 aa, Pseudonaja textilis
AKGEAPKVRAGVGFSEQEWRGLDESQKDLYRHIMMHNYQAVVSVGKSGLASGLGPTGENGPPPRRGAGGRLGHAHPATSPA

SEQ ID NO: 29304 - protein, 81 aa, Thamnophis sirtalis
MPVTFVDIAVYFSAEEWKNLADWQKDLYNNLLKENYESLLALGANINVAKPEGHPRAERVAPEPSVPEPSAKERDVIPEPC

SEQ ID NO: 29305 - protein, 81 aa, Thamnophis sirtalis
KNSICFEDIAVFFSMEEWALLDLEQKKLHREVMLDNSRNLASLTGDGWKMEGQEAAIPFPKEIKEVLERMFGKKDSEENQL

SEQ ID NO: 29306 - protein, 81 aa, Thamnophis sirtalis
PKVPLNFSDASVHFNEQEWRNLEEWQRELYRTVMRSNYDMLVSLDHAISKPDILSQMDQGEEVCMEESEVLENREIPKDPS

SEQ ID NO: 29307 - protein, 81 aa, Micrurus corallinus
SQEMFFRRISQDDPNQDRTRGKNRRKFTVPDGGTETMIETPIQEGLISFEDVAVYFSEEEWTELDPDQKALHQEVMLEHYR

SEQ ID NO: 29308 - protein, 81 aa, Micrurus corallinus
NSISFEDVAVFFSVEEWALLDLEQKTLYQEVMLENARNVASLTDEWETGGSSQEEEASMSTARNEVAERMFGKQGLHEDQL

SEQ ID NO: 29309 - protein, 81 aa, Pseudonaja textilis
ENLVSFEEVAVYFSEEEWSQLDPDQKALHSEVMLENHRNVVSLGKCFLVSNQEVIMKKYTGKSVKLIKAKVQVNEHYLTQN

SEQ ID NO: 29310 - protein, 81 aa, Micrurus corallinus
KNPSNPPQELFFRRIPWEDPSLDTSGEEQRMKLSSFYDGDQTAVEPPNQEGLVSFEEVAVYFSEEEWSQLHPDQKALHSEV

SEQ ID NO: 29311 - protein, 81 aa, Pseudonaja textilis
MQRLVSFKDVAVYFTESQGALLDPTQRALYREVMVENYENVASLGFPVPKPNLISRLERGEPPWLLDSQGLDANSSGALRK

SEQ ID NO: 29312 - protein, 81 aa, Pseudonaja textilis
VMLEEVSVTFSEEEWALLNPDQRALHRDVMAENSGIASSLGKFPLKKKKGWCCDSGIGICSVDRCETSLTYHQRSHTGVKP

SEQ ID NO: 29313 - protein, 81 aa, Pseudonaja textilis
VKSEPACLPVCVFSVTFSEEEWALLNPDQRALHRDVMAENKDLAVKFEPALLSDSEGSQDEELPVREKIEDGIEWSQCLLC

SEQ ID NO: 29314 - protein, 81 aa, Anas platyrhynchos
EDEVPSASICVLGTEKPLGLELLSSTGCFYMEPLCLQEPVTFVEVAVYFSREEWELLHPAQRVLYRDVMLETYESITSLGE

SEQ ID NO: 29315 - protein, 81 aa, Micrurus corallinus
TSGEKQRMKLSGFYDGDQTAVEPPNQEGLVSFEEVAVYFSEDEWSQLDPDQKVLHLEVMLENHRNVVSLGNNGQENLDSCE

SEQ ID NO: 29316 - protein, 81 aa, Micrurus corallinus
EGLVSFEEVAVYFSNEEWSQLDPDQKMLHLEVMLENHRNVASLDNGRENKDTGEPFQVFSAGDETQKSEIQMEIERHERNQ

SEQ ID NO: 29317 - protein, 81 aa, Micrurus corallinus
QAPPFSFEEVAVYFTEVEWTLLDAEQRDLYWDVMQENYETVASLAVAIPKPELICRLERGEDPWIPAQAASEEKKIPLNLY

SEQ ID NO: 29318 - protein, 81 aa, Pelodiscus sinensis
EPVTFKEVAVYFSEEEWALLDTSQRDLYWDVMQENYEAVSWLEFSFSSAQGMTPLWILSLSQQRPMRRSQCSPQRQQGNHL

SEQ ID NO: 29319 - protein, 81 aa, Pelodiscus sinensis
MVEPVSFEEVAVYFSEEEWALLDPGQRALYWAVMQENYEAVSWLGFPVSTAHVISWVERGEELRVPVLQGCEEGKIISNTH

SEQ ID NO: 29320 - protein, 81 aa, Pelodiscus sinensis
VVEPVSFEEVAVYFSEEEWALLDPGQRALYWDVMQENYEAVSWLGFPVSKAHVISWVERGEELWIPDRQGCEEGESISDIH

SEQ ID NO: 29321 - protein, 81 aa, Colinus virginianus
PSVPVTFRDVFVQFSRDEWALLDDEQKELHQSVMQSNYEMLMSLYCDLAKPEVSLQMERGEPCLPAEPDLQGTAVSLNPAA

SEQ ID NO: 29322 - protein, 81 aa, Pseudonaja textilis
LYCLTYVAVRFSDEEWMLLDAGQQDLYREVMAENSGMVASLSKDPWLIFSLLLPPIHPTSPKKGVAGSEEVAKRLGNGRVL

SEQ ID NO: 29323 - protein, 81 aa, Pelodiscus sinensis
PVSFEEVAVYFSEEEWALLDPCQRALYMDVMQENYEAGLSSPWESGWSEGKSCRSQISKAVRKGRSSVTPTQVRNQSPEQG

SEQ ID NO: 29324 - protein, 81 aa, Pelodiscus sinensis
GIILFQEVAVHSTKEEWELRDSSKRAIYRDIMKENNFPNLSSVGRGSGQLEATDHLLAPFPSPMSPAPTSVSLSIPAGCYY

SEQ ID NO: 29325 - protein, 81 aa, Pelodiscus sinensis
TKMRVTFEEVAVYFTPGQGALLGPAQRALYRDVMQENYEAVTSLGFPVPKPELIARLEQGDEPWVLDMQAGGEREMLRHTC

SEQ ID NO: 29326 - protein, 81 aa, Pelodiscus sinensis
MYFTRAEWALLDPAQRALYRAVMQENYENVISLGFPVSKPDVISQLEGGEEPWVPELQGSVKREIQRSPCTGEETVNLLRI

SEQ ID NO: 29327 - protein, 81 aa, Pelodiscus sinensis
PKMPVTFVDVAVYFSAEEWKNLEDWQKELYNNLMKENYESLSSLESLMSTPDILSRIKQEEGPFVGEHQFSEERGIPVDPC

SEQ ID NO: 29328 - protein, 81 aa, Pelodiscus sinensis
FQGPVTFDEVAVYFTKEEWALLDPAQRALYRDVMQENYETVTSLGLPVSRPDVISQMEQGEEPWASALQGSEDRLILRGIC

SEQ ID NO: 29329 - protein, 81 aa, Pelodiscus sinensis
FLMPVTFEEVAVYFTPGQGALLDPAQRALYRDVMQENYETVASLGFSIPKPDLIAQLEQGEEPWVPDLQPSKEMVILRGIC

SEQ ID NO: 29330 - protein, 81 aa, Pelodiscus sinensis
VVEPVSFEEVAVYFSEEEWALLDPGQRALYWAVMQENYEAVSWLGFSIPKPDLITQLDRGEEPWVPDLQPSKKLEILRGTR

SEQ ID NO: 29331 - protein, 81 aa, Pelodiscus sinensis
AQVPVTFEEVAVYFTQGQGALLGPAQRALYRDVMRENYEMVTSLGFPVPKPDLVARLERGEEPWVSDCLASEEGGTRRGRG

SEQ ID NO: 29332 - protein, 81 aa, Pelodiscus sinensis
PKMRVTFEEVAVYFTPGQGALLGPAQRALYRDVMQENYEAVTSLGFPIPKPELITQLEHGEEPWVPDLQADKEMESLKGTR

SEQ ID NO: 29333 - protein, 81 aa, Pelodiscus sinensis
LLFQGPVPVEEVAVHFTREEGALLDPAQRAPYRAVMPENVTSLECPVPKPDVISQLERGEDPGVLKLQGSEDGEIPRGACA

SEQ ID NO: 29334 - protein, 81 aa, Pelodiscus sinensis
VAEPVSFEEVAVYFSEEEWALLDPCQRALYRDVMQENYEAVSWLAITHPGLGHLRGTTKGRPGWNPHKEDSAGGRVEPRQQ

SEQ ID NO: 29335 - protein, 81 aa, Pelodiscus sinensis
MRENYETVAGLGLPVPKPDLIARLEAGEDPWVPDLQVSEEKMILRGSGTGDDETGNPPLEGPEKGELQGTLMRRTEELFSQ

SEQ ID NO: 29336 - protein, 81 aa, Pelodiscus sinensis
MQENDEAVSWLGFFIPKPDLIAWLEQGEELWVQYLQHSKEMEIQRCIYTAGASTVRENNEENQQQEGSELVESQGTFVEEA

SEQ ID NO: 29337 - protein, 81 aa, Pelodiscus sinensis
AQVPVTFEEVAVYFTAGQGALLGPNQRALYRDVMQENYETVASLGFSIPKPDLITQLERGEEPWVPDLQPSKEMEFLRGTC

SEQ ID NO: 29338 - protein, 81 aa, Pelodiscus sinensis
FQGPVTFKEVAVYFTRAEWALLDPAQRALYRAVMQENYENVTSLGFQVSKPDVISQMERGEEPWVLELQGSEAGAGMGSEN

SEQ ID NO: 29339 - protein, 81 aa, Pelodiscus sinensis
MRVTFEEVAVYFTQGQGALLGPAQRALYRDVMQEIYEMVTSLGFPVPKPELVARLERGEEPWVSDLQAIGESESLRGTRTG

SEQ ID NO: 29340 - protein, 81 aa, Pelodiscus sinensis
VAEPVSFEEVAVYFSEEEWALLDPGQRALYRDVMQENYEAVSWLGFSILKPDLILWLERGEVPWALILKETELLRQTGAVE

SEQ ID NO: 29341 - protein, 81 aa, Pelodiscus sinensis
VAEQVTFEEVAVYFSEEEWALLDPGQRALYWAVMQENYEAVSWLGFSIPKPDLIPWLEQGEESWAPDLQAAKETEILRAGA

SEQ ID NO: 29342 - protein, 81 aa, Pelodiscus sinensis
LSPCTLTWAGFTPCAGFPAPKPELIARLERGEEPWVPDLQADAGGETPRGARPAGSGAEGENKKENQQQEGPGGVEPPETF

SEQ ID NO: 29343 - protein, 81 aa, Pelodiscus sinensis
PVSFEEVAVHFSEEEWALLDLGQRALYRDVMQENYEAVNWLVLSQLVCRLLSTGTEEALAFGQGDGMLSENNEKSLQQPNG

SEQ ID NO: 29344 - protein, 81 aa, Pelodiscus sinensis
VAGPVTFEEVAVYFSEEEWALLDPGQRALYRDVMQENYEAVSWLGFPVSKPGETSWLERAGKLQEWESRSHANTARPRGNQ

SEQ ID NO: 29345 - protein, 81 aa, Pelodiscus sinensis
AQRPVTFEEVAVYFTRAEWALLDPAQRALYRAVMQENYENVTSLDFPVFTPDGISHIEEVKEPRVPNLHDSEEREILRGAC

SEQ ID NO: 29346 - protein, 81 aa, Pelodiscus sinensis
AQMPVTFEEVAVYFTAGQGALLGPAQRALYRDVMQENYETVVSLGFSIPKPDLIARLEREEEPWVPDLQPSKEMEIQRGTR

SEQ ID NO: 29347 - protein, 81 aa, Pelodiscus sinensis
AQELVSFEEVAVYFSEEEWALLDPAQRALYWDVMQENYETVTSLDFPVPKPDVIYQLARREEPRITALQGAEEKGTLRDSH

SEQ ID NO: 29348 - protein, 81 aa, Pelodiscus sinensis
MRENYETVTGLGLPIPKPDLIARLEAGEEPWVPDPQTTEERNIPRGSETGNETKNENVEGVLQQQGLQPMELQENFLRRAG

SEQ ID NO: 29349 - protein, 81 aa, Pelodiscus sinensis
FQMRVTFEEVAVYFTVGQGALLDPAQRALYRDVMQENYETVASLGLPVPKPALIARLEAGEELWVPDLQTSEERKIPRGSS

SEQ ID NO: 29350 - protein, 81 aa, Micrurus corallinus
ENVENLLKNRNFWILRLPLGPKGEIPKVPVTFDEEQAVNFSTPEWAKLEDCQKGLYPNITRGSYEPLVSLGKSRVCLVGNW

SEQ ID NO: 29351 - protein, 81 aa, Micrurus corallinus
VYFSEEEWLQLDADQKALYGEVMLETSRNLASLGKMSAKRKSYSIEFKKEVVEDSLGKNLTVFCKEKKLGLRMVRKWRAEY

SEQ ID NO: 29352 - protein, 81 aa, Micrurus corallinus
MEEWALLDCEQKAPHQEVMVEDAKKMASFGDGLKIVDAAQEMATPFLTAEKEVAERMREKERPEEKELKEELRKYSNSQYV

SEQ ID NO: 29353 - protein, 81 aa, Pelodiscus sinensis
SEMRVTFEEVAVYFTKGQGALLDARQKALYRDVMLENYEAVTSLGFPVPKPELIARLERGEEPWVPDLQAGEEREILRGTR

SEQ ID NO: 29354 - protein, 81 aa, Pelodiscus sinensis
AQMLVTFEEVAVYFTQVQGALLDPGQRALYRAVMQENYETVTSLGLHIPKPALITQLEAGEEPWVPDLQASEERKIPRGTS

SEQ ID NO: 29355 - protein, 81 aa, Micrurus corallinus
LVSFEEVAVYFSEEEWSQLDSDQKALHSEVMLENHRNVVSLGNKGQENQDSYELFQVINAKDGMEKFGFRMEFESHEKNQA

SEQ ID NO: 29356 - protein, 81 aa, Micrurus corallinus
PNQVQEGLVSFGEVAVHFSEEEWSQLDPDQKELHWEVMMENYRNVASLGNNGQENQDSCELFQVINAGDETEKSAERHERN

SEQ ID NO: 29357 - protein, 81 aa, Pseudonaja textilis
PTQVGRKRLAAYMEERFQGPVSFGEVAIHFNSEEWLLLDPSQKALYQEVILEISRMVASLSKGSSIRTLQKLGKCPEYGKS

SEQ ID NO: 29358 - protein, 81 aa, Pseudonaja textilis
PWPRSLLSSLQAPPFSFEEVAVYFTEVEWTLLDAEQKDLYWDVMQENYETVASLGKNSLPQSRSGLQKFFSNGHFWLEAPQ

SEQ ID NO: 29359 - protein, 81 aa, Pelodiscus sinensis
VMEPVSFEEVAVYFSEEEWALLDPGQRALYWDVMQENYEDVSWLGFPVSKAHVISWVEQREELWVPGLQGCEEGTEEWIVE

SEQ ID NO: 29360 - protein, 81 aa, Pelodiscus sinensis
MLRNYRALVSLGYSGSTPDLIHLIERGQAELWIQDAEDSRERSGPESPSSAGPEIPERTRALSERRESTEGKLHPTSLMGS

SEQ ID NO: 29361 - protein, 81 aa, Micrurus corallinus
SFEEVAVYFSEEEWSQLDPDQKALHSEVMLENHRNVVSLGNNGQENQDSCELFQVISAKDGTEKFGIRMKFKSHERNQSKN

SEQ ID NO: 29362 - protein, 81 aa, Pseudonaja textilis
PNFVSFEDVAVFFSVEEWALLDSEEKALYREVMLENKRNVSLMGLSLHVFPPCRLRPCEVPQGSVLGPVLFNIFTNDLDEG

SEQ ID NO: 29363 - protein, 81 aa, Pelodiscus sinensis
VAFAEVTVWFSREEWGLLDPGQRQLYRDVMRENYQMLLSLGFPVPDPAMICGMEQGEELRVLDLQGSEEREIPRGACTAGS

SEQ ID NO: 29364 - protein, 81 aa, Pelodiscus sinensis
AQESVTFEEVAVYFTRAEWALLDPAQRALYRAVMQENYEMVALLGFPVSKPDMIFRLERGEEPWVPDLEGSEKQVPPRAAC

SEQ ID NO: 29365 - protein, 81 aa, Pelodiscus sinensis
VPEPVNFEEVAVYFSEEEWALLDPGQRAFYWDVMQENYEAVSWLGFPISDAHVISWVALEKELWIPGFQGSEEGEIIRNTH

SEQ ID NO: 29366 - protein, 81 aa, Pelodiscus sinensis
PVSFEEVAVYFSEEEWALLDPGQRALYWDVMQENYEAVSWLGFPVSKAHGISWVERGEELGTQKIPNQERPYTCSKCGKSF

SEQ ID NO: 29367 - protein, 81 aa, Pelodiscus sinensis
AQMPVTFEEVAVYFTAGQGVLLDPAQRALYRDVMQENYETVASLGFPVPKPELITRLERGEEPWVLNLQVARKRESPRGTQ

SEQ ID NO: 29368 - protein, 81 aa, Pseudonaja textilis
FPPGSKGETPKVEFGTGEWGNLEKWQKELYKNVMKSNYESLVSLDYAIAKPDLLSRIEQGERPCTEEEEAATTDRVIPLEP

SEQ ID NO: 29369 - protein, 81 aa, Pelodiscus sinensis
VAEPVTFEEVAVYFSEEEWALLDPGQRALYRDVMRENYETVASLGFPVSKPSVTSWLERGGKLQEWEILRVPSTAGDGMVN

SEQ ID NO: 29370 - protein, 81 aa, Pelodiscus sinensis
VAEPVTFEEVAVYFSEEEWALLDPGQRALYWDVMQENYEAVSWLGFPVSKAHGISWVERRAELRIPDRQGSEEGESVSDTR

SEQ ID NO: 29371 - protein, 81 aa, Pelodiscus sinensis
LSMRVTFEEVAVYFTPGQGALLGPAQRALYRDVMQENYETVASLGFPVPKPELIARLERGDEPWVPDLQVCEERGIPRGSP

SEQ ID NO: 29372 - protein, 81 aa, Pelodiscus sinensis
AQVPVTFEEVAVYFTAGQGVLLSPAQRALYEDVMQKNYETVASLGFSISKPDLIARLERGEEPWVPDLQPSKEMGILRDTR

SEQ ID NO: 29373 - protein, 81 aa, Pelodiscus sinensis
MTIRIYDQPPLQPVPKLQTQSVLMNSAAIRLPIPKPDLIARLEAGEDPWVPELQVSEERKIPGGTGKGNPSPEGPEEVEWQ

SEQ ID NO: 29374 - protein, 81 aa, Pelodiscus sinensis
VAELVSFEEVAVYFSEEEWALLDPGQRALYWDVMQENYEAVSWLGIFPVLNEGPRRDLAEGVRNVPTRYRPSREQQNTHLP

SEQ ID NO: 29375 - protein, 81 aa, Pelodiscus sinensis
MRVTFEEVAVYFTQGQGALLDPAQRALYRDVMQENYETVASLGFSIPKPNLIAQLEQGEEPWVPDLQPSKETEILRGTCTS

SEQ ID NO: 29376 - protein, 81 aa, Pelodiscus sinensis
QPPVAFEDVALYFTRAEWELLSPPEKQLYREQMLRNYRALVSLGYSGSKPDLIHQIELGAAELWVGDAEDSRKSSRLESPI

SEQ ID NO: 29377 - protein, 81 aa, Pelodiscus sinensis
DSMRVTFEEVAVYFTPGQGALLGPAQRALYRDVMQENYEAVTSLGFPVPKPELIARLERGEEPWVPDLQAREEREIPRGTC

SEQ ID NO: 29378 - protein, 81 aa, Pelodiscus sinensis
VAEPVTFKEVAVYFSVEEWALLDPGQRALYRDVMQENYEAVSWLGFPVSTANVISWVERGEDLWVLDLQGCKEGEIIRDTH

SEQ ID NO: 29379 - protein, 81 aa, Pelodiscus sinensis
KAVQRFWKSVEFMCREQEWENLEEWQKELYKNVMKGNYETLVSLDYAVSKPDVLARIERGLEERLPKEEGLVEREVSSAGR

SEQ ID NO: 29380 - protein, 81 aa, Pelodiscus sinensis
RVTFEEVAVYFTQGQGALLGPAQRALYRDVMQENYEAVTSLESAGMGTENEEKPPRESSEEAGLQGTVLCRSKGSLSQNRK

SEQ ID NO: 29381 - protein, 81 aa, Pelodiscus sinensis
VVEPVSFEEVAVYFSEEEWALLDPGQRALYRDVMQENYEAVSWLGFPVSKAHVLSWVEELQILDLQGCEEGEIKSDTDTAG

SEQ ID NO: 29382 - protein, 81 aa, Pelodiscus sinensis
VEEPVSFEEVAVYFSEEEWALLDPDQRAFYEDVMQENYEAVNWLRFPASQTDVISWVEREGELQVPYPQSCEEGESISNTQ

SEQ ID NO: 29383 - protein, 81 aa, Pelodiscus sinensis
VTFEEVAVYFSAEEWALLGPAQRALYREVMRENYEAVTSLAWAGLPISKPDLISCMERGEEPWVAHLQSQRRRELPRGRNS

SEQ ID NO: 29384 - protein, 81 aa, Pseudonaja textilis
MDSSFFREVTIHFNSEEWLLLDPSQKVLHEEVMLGTSRMVASLGKGSSMRNLGVVRREGEESHTFIQSSDLTSHKRIHTGE

SEQ ID NO: 29385 - protein, 81 aa, Pelodiscus sinensis
VAELVTFEEVAVYFSEEEWTLLDPGQRALHRDVMQENYEAVCFLAGFPVSKTSVISWVEQREDLQVCEEGVIISDTHTGDE

SEQ ID NO: 29386 - protein, 81 aa, Pelodiscus sinensis
VAEPVSFEEVAVYFTEEEWALLDPGQRTLFKDVMQENYEAVSWLGKDSCPLGSILKLQSEGAGWSHRSRGLKTNTKTVQQK

SEQ ID NO: 29387 - protein, 81 aa, Geotrypetes seraphini
QMQLRFEDISVSFSQEEWAYLDEEQKELYREVMMDNYQTLISLGTGSLPVTPHIISRIEQGEEPYIKDEPESEEREPGRSS

SEQ ID NO: 29388 - protein, 81 aa, Geotrypetes seraphini
SGQVTFQDISISFSQEEWEYLDEEQKNLYREVMKENYQTLISLGSSSPILTPKIISHIERGEEPYIKDEPESEEREIGKSS

SEQ ID NO: 29389 - protein, 81 aa, Geotrypetes seraphini
QMQVAFEDIAVSFSQEEWEYLDEGQKELYREVMKENYETLISLETGYVRINPDLLSWIKQEGEPNIQDPQESGEREVRHLY

SEQ ID NO: 29390 - protein, 81 aa, Geotrypetes seraphini
MEWDVLGEWQKELYKKVIKEIHDILISRGYLIVNPDVIFKIKKEDEKYVAQHCELEGNEDPNEPTKMFPIVTSVFSLSVKQ

SEQ ID NO: 29391 - protein, 81 aa, Geotrypetes seraphini
NEALITFKDVAAYFLETEWDILGDRKKEIYKQIIKDIHDLFISRGYSIVNPDVIFKIEKEDKSFNQHFEWEGKENPNDSSK

SEQ ID NO: 29392 - protein, 81 aa, Geotrypetes seraphini
SQALVEFRDVAISFTKEEWLQLEDWQRQLYKNVIQEIHQALISLGYTILKSDIVIRIRDEDEHYTNDQDQPQKYGCDNDPT

SEQ ID NO: 29393 - protein, 81 aa, Geotrypetes seraphini
RQEPVTFDDIAVYFSEEEWDILEGWQKEIYKDVMRENYGMLASLGFPVPSPEVFLSLVDRQKTPCTESLGHWGERDTLSRS

SEQ ID NO: 29394 - protein, 81 aa, Geotrypetes seraphini
QMRVTFEDIAVSFSQEEWDYLDQGQKELYREVMKENYEILISLGTGCPNLTPEIISCIERGEEPYIRGEPGSEERETGKSS

SEQ ID NO: 29395 - protein, 81 aa, Geotrypetes seraphini
QMQVTFEEIAVSFSQEEWEYLDEEQKELYREVMKENYEILISLETDSPTVIPDIISQIERGEEPFIRDEPGSEERETGKSS

SEQ ID NO: 29396 - protein, 81 aa, Geotrypetes seraphini
VTFEDITVVFSQEEWEYLDEGQKELHREVMKENYEILKSLGKDDPKNNPWKLSEKPEGVKMLSEGEKENWGEKEKNQNKKY

SEQ ID NO: 29397 - protein, 81 aa, Geotrypetes seraphini
DQESVIFSDVAAYFLEAEWDILGEWQKNLYKKVIREIHDILMSRGYSIANPDVIFKIKKEDEKYFTPHFEWEKKENLNDPT

SEQ ID NO: 29398 - protein, 81 aa, Geotrypetes seraphini
AQMQVKFEDIAISFSQEEWEYLNEEQKELYREVMEENYQTLLSLDHQIQHEWKREKNEEEEDPVEMEQIQTLSENVCENIS

SEQ ID NO: 29399 - protein, 81 aa, Geotrypetes seraphini
DQTSVTFKDVAAYFLEMEWNLLAEWQKDLYKKVIEEIHDILISRGYLIVNPDVVFKIKKEDEKYFPQHCDLEEKGNPNEST

SEQ ID NO: 29400 - protein, 81 aa, Geotrypetes seraphini
MRVTFEDIAVSFSLEEWEYLDQGQKELYREVMKENYEILISLGTGCPNLTPEIISRIERGEEPYIRGEPGSEERETGKSSC

SEQ ID NO: 29401 - protein, 81 aa, Geotrypetes seraphini
VTFEEIFISFSQEEWDYLNEEQKELYREVMKENYQTLISLDQQIRHEWKRQKNQGEDVVEMEQSQTQSENVCENISQSPER

SEQ ID NO: 29402 - protein, 81 aa, Geotrypetes seraphini
SQGSVTFRDVAAYFLEVEWGILGEWQKELYKRVIKEIHSFLISQGYSIANPDVIFKIKEEEEKYFTQRCEWEGKENVNDAT

SEQ ID NO: 29403 - protein, 81 aa, Geotrypetes seraphini
GQMSVTFEDIAVYFSREEWEDLEEWQKEFYKEVMKENYEILNSLGYGTLRPEILCRMDRGEEPWVSDRQERERSIHLYSGD

SEQ ID NO: 29404 - protein, 81 aa, Geotrypetes seraphini
QMQVKFEDIAVSFSQEEWEYLDEEQKELYREVMKENYQTVLSLETGSPTVIPDIISQIKRGEEPYIRDEPGSEERETGKSS

SEQ ID NO: 29405 - protein, 81 aa, Geotrypetes seraphini
ASAQMRVTFEDIAVSFSQEEWEYLDEEQKELYREVMKENYETLISLDTEAMHETKREENEEKCLLEIENISKQSGNVSENI

SEQ ID NO: 29406 - protein, 81 aa, Geotrypetes seraphini
SGRMQVTFEDIAVSFSQEEWDYLNEEQKELHREVMKDNYQTLISLDPQISQEWTREGNQGEDTVEMEQIQTQSENVCENIS

SEQ ID NO: 29407 - protein, 81 aa, Geotrypetes seraphini
RMQVTFEEVAVSFSQEEWEYLDEEQKELYREVMKDNYQTLISLGTGFPTITPKIISYIERGEEPYIRGEPGSEERETGNSS

SEQ ID NO: 29408 - protein, 81 aa, Geotrypetes seraphini
DQKLVTFKDVAAYFWEVEWNILGEWQKELYKKVIKEVHGNLLSQGYSIVNPDVIFKIKKEDEKHFTHDSMKGLPVVTSVFS

SEQ ID NO: 29409 - protein, 81 aa, Geotrypetes seraphini
QMWVTFEDVAVSFSQEEWVYLDEGQKELYREVMKENYETVMSLGEEFSRGKEKEGSIEQQSLKTEVHEMNKRVKLFKCSEC

SEQ ID NO: 29410 - protein, 81 aa, Geotrypetes seraphini
QMPVKFEDIAVSFSQEEWEYLDEEQKELYREVMKENYQTLISLGTGSPSITPDIISHIERGEEPYIREEPGSEEREPGRSS

SEQ ID NO: 29411 - protein, 81 aa, Geotrypetes seraphini
MRVTFEDITVSFSQEEWMYLDEGQKELYREVMMENYEILMSLDHEVTDEVRESREEHCLKWKPHPRNVGVSQGTEWKERHP

SEQ ID NO: 29412 - protein, 81 aa, Geotrypetes seraphini
AQMQVTFEEIAVSFSQEEWEYLDEEQKELYREVMKENYEILISLGSLAFIPKIISHIERGEEPYIRGEPGSEEREHGKSNC

SEQ ID NO: 29413 - protein, 81 aa, Geotrypetes seraphini
QMQVKFEDVAVSFSQEEWEYLNEEQKELYREVMEENYQTLLSLATGSPTFTPKIISHIKHGEEPYIRGEPESEERETGKSS

SEQ ID NO: 29414 - protein, 81 aa, Geotrypetes seraphini
EMRVMFEEITVSFSQEEWEYLDEGQKELYQEVMKENHETLIFLETNLQFVNPDMLSKIRRDSRMSRKRKATRSYADDEAKQ

SEQ ID NO: 29415 - protein, 81 aa, Geotrypetes seraphini
AQVPVTFEDIAVYFSQEEWEDLEEQQRELYKDVMKENYETLSSLGPPAVTPDIISHIERGEEPYIRFESGPEEREIGKSSC

SEQ ID NO: 29416 - protein, 81 aa, Geotrypetes seraphini
DQTSVIFKDVAGYFLEMEWDVLGEWQKELYKKVIKEVHDILISRGYSIVNPDVIFKIKKEDEKYFAQPCEMEGKENVNEPT

SEQ ID NO: 29417 - protein, 81 aa, Geotrypetes seraphini
MEWNILGEQQKELYKKVIKEVHGILLSLGYSIVNPDVIFKIKKEDEKHFTQHFEWEGKENPHDPMKSLPVVTSVFSLRVKQ

SEQ ID NO: 29418 - protein, 81 aa, Geotrypetes seraphini
DQTSVTFKDVAAYFLEMEWDVLGEWQKELYKKVIKEIHDILISRGYLIVNPDVVVKIKKEDEKYFPQHCDLEEKGNPNEST

SEQ ID NO: 29419 - protein, 81 aa, Geotrypetes seraphini
EQVPVTFADVMVCFSEEEWKELEDWQKELYDSVMKENYECLLSLGYPVVKPEFISKTEAGAKPCLGDPCDFIVAEDAKTGT

SEQ ID NO: 29420 - protein, 81 aa, Geotrypetes seraphini
VSVTFEDVTVSFSREQWEYLNEGQKELYREVMKENYETLISLGLGIEHERINPEVLSRIKQEEEPHVWDPTELGVREVTPS

SEQ ID NO: 29421 - protein, 81 aa, Geotrypetes seraphini
QMQVAFEDIAVSFSQEEWEYLEEEQRELYREVMKENYQTLISLGIGSQTVTPEIMSHNERGEKVYTRNELGSEERETRKSS

SEQ ID NO: 29422 - protein, 81 aa, Geotrypetes seraphini
ASAQMQLKFEDVAVSFSQEEWEYLDEGQKELYREVMKENYETLISLDTEAMQEMKMEENQENWLLEIELIPRQSGNVSENI

SEQ ID NO: 29423 - protein, 81 aa, Geotrypetes seraphini
QMRLSFEDISVSFSQEEWAYLDEEQKELYREVMKENYQTLISLGTGSPTVTPDIISHIERGEEPYVKDEAGTEERESGTSS

SEQ ID NO: 29424 - protein, 81 aa, Geotrypetes seraphini
EQITVTFNDVAAYFSEQEWQALEEWQRELYRGVMKQIHRALFSLGYSIANPDVLFRIKQDDEPYFRDPFDSEGSNNIGGKD

SEQ ID NO: 29425 - protein, 81 aa, Geotrypetes seraphini
DQTSVTFKDVAAYFLEMEWDVLGEWQKELYKKVIKEIHDILISRGYLIVNPDVIFKIKKEDEKYFAQHCELEGNGDPNEPT

SEQ ID NO: 29426 - protein, 81 aa, Geotrypetes seraphini
SAQMQVTFKDIAVSFSQEEWEYLAEEQKELYIEVMEENFQSLIFLEQQLKQERESEKNQGEDPLEMGQIQRRSQNVCANIS

SEQ ID NO: 29427 - protein, 81 aa, Geotrypetes seraphini
MYRGVMRENYEIMLSLGYQFSKPEILLMMERGEEPCVEDCQRRIPVTFREKHLGQIPEDVIVLDSSDEEEPTKNTKPSPTV

SEQ ID NO: 29428 - protein, 81 aa, Geotrypetes seraphini
QGLVSFEDIAIYFSQEEWEDLEEPQKELYKDVMKDNYQTLSSLENMCHRRYEEMHVIKTVSKRERWNTCLCCDWGKNFQTE

SEQ ID NO: 29429 - protein, 81 aa, Geotrypetes seraphini
VTFEDITVAFSQEEWEYLDEGQKELHREVMKENYEILRSLEKDDPKNNPWKLSEKPEGVKMLSEAEKMNWGEKEKNQKYSP

SEQ ID NO: 29430 - protein, 81 aa, Geotrypetes seraphini
DQTLVTFKDVAAYFWEVEWNILGELQKELYKKAIKEVHGILLSRGYSIVNPDVIVKIKKEDEKYFTQNFEWEGKGNPHDSM

SEQ ID NO: 29431 - protein, 81 aa, Geotrypetes seraphini
AQMQVAFEDIAISFSQEEWEYLDEGQKELYREVMKENYETLISLGFVRISPDLLSWIKQDGEPNIQDPQESGEREVRHSYT

SEQ ID NO: 29432 - protein, 81 aa, Geotrypetes seraphini
AQMRVTFEDIAVSFSPEEWEYLDQGQKELYREVMKENYEILISLGCPNLTPEIISRIERGEEPYIRGEPGSEERETGKSSC

SEQ ID NO: 29433 - protein, 81 aa, Geotrypetes seraphini
QMPVKFEDIAVSFSQEEWKYLNDEQKELYREVMKENYQTMISLGIGSPSVTPDIIFHIEGGEEPYIREEPGSEEREPGRSS

SEQ ID NO: 29434 - protein, 81 aa, Geotrypetes seraphini
ASGQVTFEDIAVTFSQEEWEYLDEGQKELYREVMKENYETLISLVDIGAMQEMKREENQEKCLLEIERISRQSGNVSDNIS

SEQ ID NO: 29435 - protein, 81 aa, Geotrypetes seraphini
DKAVVTFSDVAAYFLEVEWGIMGERQKQLYMKVIKEIHSFLISQGYSILNPDVLFKIKKEDEIYLAQQCEGEGKECMNDST

SEQ ID NO: 29436 - protein, 81 aa, Geotrypetes seraphini
AKVPITFEDVTVNFSQEEWEDLEEWQKELYKDVMKENYETIISLESDEPGSQNEPTCLEENMESSNVLPEGGGEDVSSCSG

SEQ ID NO: 29437 - protein, 81 aa, Geotrypetes seraphini
SAQVTFEDITVSFSQEEWRYLDEGQKELYREVMKENYQILISLGTSSTTFTPELISRIEEGKELYIRDELGSKDRESSCSD

SEQ ID NO: 29438 - protein, 81 aa, Geotrypetes seraphini
QVPVTFDDVAAYFSEEEWKDLEECQKELYKDMMKENYVPFISLDDGPMIEKEKHHLKYNEKLEPNEPLPVTVLENTSQCSD

SEQ ID NO: 29439 - protein, 81 aa, Geotrypetes seraphini
EDCMQTWVTFEDVAVSFSLEEWQYLNEGQKDLYREVMKENLELLTSLSSLVAQLEQNQELFVKRQRKTPLSPSTGNIVGPG

SEQ ID NO: 29440 - protein, 81 aa, Geotrypetes seraphini
FVQVTFQDISISFSQEEWGYLDEEQKDLYREVMKENYQTLISLDQQLSQEWKREKNQGEDPVEMGDIQRQSKPVCENIFQR

SEQ ID NO: 29441 - protein, 81 aa, Geotrypetes seraphini
ASAQMRVTFEDIAVSFSQEEWEYLDEEQKELYREVMKENYEILISLDTEAMQEMKREQNEEKWLLEIEPIPRQPGNVSENI

SEQ ID NO: 29442 - protein, 81 aa, Geotrypetes seraphini
RTMRVTFEDITVAFSQEEWEYLDEGQKELHREVMKENYQTLISLSSEWINLDVLSNIKQEEETRVWDAQETKKRAVTRSDT

SEQ ID NO: 29443 - protein, 81 aa, Geotrypetes seraphini
GRMQVTFEDIAVSFSQEEWDYLNEEQKELHREVMKDNYQTLISLADPQISQEWTREGNQGEDTVEMEQIQTQSENVCENIS

SEQ ID NO: 29444 - protein, 81 aa, Geotrypetes seraphini
ASVIFHDVAVYFSSEEWEILTDWQKELYKNVMREIHGTLVALATSYPSVKPDIYLRIEREDTACPWTQQDSGCPVFDPKLS

SEQ ID NO: 29445 - protein, 81 aa, Geotrypetes seraphini
SAQVAFEDISISFSQEEWEYLNEEQKELYREVMKENYQTLISLVTGSMAFTPKIISHIERGEEPYIRGEPGSEEREHEKSS

SEQ ID NO: 29446 - protein, 81 aa, Geotrypetes seraphini
MKENYEILISLADSPTFTPKIISYIERGEEPYIRDEPGSEERETEKSSCSADHQNRHDWKRIENQGEGPVEMEEIQTQSEN

SEQ ID NO: 29447 - protein, 81 aa, Geotrypetes seraphini
RMQVTFEEVAVSFSQEEWEYLDEEQKELYREVMKDNYQTLISLGTGSPTFTPKIISYIERGEEPYIRGEPGSEERETGNSS

SEQ ID NO: 29448 - protein, 81 aa, Geotrypetes seraphini
TQIPVTFEDTAIYFSQEEWDDLEEWQKELYKDVMKENYEILISLGSPAVTPDIISYIERVKELYIGDELGSEERETRKSSC

SEQ ID NO: 29449 - protein, 81 aa, Geotrypetes seraphini
DQTLVTFKDVAAYFWEVEWNILGEQQKELYQKVIKEVHGILMSRGYSIVNPDVIFKIKKEDEKYFTQHFEWEEKGNLHDPM

SEQ ID NO: 29450 - protein, 81 aa, Geotrypetes seraphini
QVQETFEDIAVSFSQEEWEYLDEEQKELYREVMKENYQTLLSLGTGSLTVAPDIICRIERGEEPYIKDEPGSEEREPGRSS

SEQ ID NO: 29451 - protein, 81 aa, Geotrypetes seraphini
SAQLRVTFEDIAVFFSQEEWEYLDEEQKELYREVMKENYETLISLADTETMQEIKREENEEKCLLEIENIPKQSGNVSENI

SEQ ID NO: 29452 - protein, 81 aa, Geotrypetes seraphini
QMPLTFDDVTVHFSEEQWGCLDEGQKELYREVMKENYETLISLGTGLESIDPKVLSRIKQENELHVWYRKESGEREATPSY

SEQ ID NO: 29453 - protein, 81 aa, Geotrypetes seraphini
VTFEDITVSFSQEEWEYLDEGQKELHREVMKENYEILRSLGKDDPKNNPWKLSEKPEGVKMLSEGVKKNWGEKEKNQNQKY

SEQ ID NO: 29454 - protein, 81 aa, Geotrypetes seraphini
DQASVAFKDVAAYFLEVEWNLLAEWQKDLYKVVIQEIHDILISRGYSIVNPDVIFKIKKEDEKYFTQHLEQEGKETLNDPT

SEQ ID NO: 29455 - protein, 81 aa, Geotrypetes seraphini
AQMQVTFKDIAVSFSQEEWEYLAEEQKELYIEVMEENFQSLIFLAEQQLKQERESEKNQGEDPLEMGQIQRRSQNVCANIS

SEQ ID NO: 29456 - protein, 81 aa, Geotrypetes seraphini
ASGQVTFEDIAVSFSQEEWEYLDEGQKELYREVMKENYETLISLGYIRISPDLLSWIKQDGEPNIQDPQESGEREVRHSYS

SEQ ID NO: 29457 - protein, 81 aa, Geotrypetes seraphini
QMQVAFEDIAISFSQEEWEYLDEGQKELYREVMKENYETLISLETGFVRISPDLLSWIKQDGEPNIQDPQESGEREVRHSY

SEQ ID NO: 29458 - protein, 81 aa, Geotrypetes seraphini
AQMQVTFEEIAVSFSQEEWEYLDEEQKKLYREVMRENYQILISLAGSPTFTPKIISYIERGEEPYIRDEPVSEERETEKSI

SEQ ID NO: 29459 - protein, 81 aa, Geotrypetes seraphini
MRVTFEDIAVSFSLEEWEYLDQGQKELYREVMKENYEILISLGCPNLTPEIISRIERGEEPYIRGEPGSEERETGKSSCSA

SEQ ID NO: 29460 - protein, 81 aa, Geotrypetes seraphini
MFEDVAIYFGEEEWELLEEWQKKLYKETMKENYETLVSLGMGLLAEKPDLIVRIEREENPCVKAQWDSRDEKRWRSSCTGY

SEQ ID NO: 29461 - protein, 81 aa, Anas platyrhynchos
PHILKWDLLLLQEPERWVLLDPVQRTLYVDVMLENYETITSLGKESWPLEFWSQELLELWLLAFMFFVAFKSEADSLPDVP

SEQ ID NO: 29462 - protein, 81 aa, Geotrypetes seraphini
NMMQVTFEDVAVSFSQEEWEYLDEGQKELYREVMKENYETLISLGSVRISPDLLSWIKQDGEPNIQDPQEREKLDIQIRQI

SEQ ID NO: 29463 - protein, 81 aa, Geotrypetes seraphini
MYKELMKEIYETMIALGHQIPKPDILSLIERGEEPCALPSKRKKTEPHPQTTEICVHDSDLTEAEKDKLFLESFYHILQPQ

SEQ ID NO: 29464 - protein, 81 aa, Geotrypetes seraphini
QMRLRFEDISVSFSQEEWAYLDEEQKELYREVMMDNYQTLISLGTGSPPATPDIISHIEQGEEPYIKDEPGSEEREPGRSS

SEQ ID NO: 29465 - protein, 81 aa, Geotrypetes seraphini
QMLVKFEDIAVSFSQEEWEYLNEGQKALYREVMKENYQILTSLGTGTLTVTPEIISHVERGEELNIKDEPRAEEREMGESS

SEQ ID NO: 29466 - protein, 81 aa, Geotrypetes seraphini
VTFDDITVYFSQEEWEYLDEEQQELYREVMKENYETLIFLADNEALWEQKREKKRESQVYMEEVPRQSGNVCQNISEGNER

SEQ ID NO: 29467 - protein, 81 aa, Geotrypetes seraphini
MPVTFEDIFISFSQEEWDYLNEEQKELYREVMKDNYQTLISLDHQITQEQRDPAGDSSYEHQFKRKGKTHQKELQSMHKRN

SEQ ID NO: 29468 - protein, 81 aa, Geotrypetes seraphini
SAQMPVKFEDIAVSFSQEEWEYLNEEQKELYREVMEENYQTLISLDHQITQEGKREKKQGEDPVEIEQVQRQSGNVCENIS

SEQ ID NO: 29469 - protein, 81 aa, Geotrypetes seraphini
QMRVTLKDIFISFSQEEWEYLNEEQKELYWEVMAENYETLISLETSSPTFIPDIISYMAQREEPYIRNEPGSEERETGTSS

SEQ ID NO: 29470 - protein, 81 aa, Geotrypetes seraphini
TGASITFCDVAAYFLELEWEALEEWQKELYKKVIKEIHTFLTSRGFPDVTSAFSLNIKQEEDMPFMDNVKTEMIEEIHPPV

SEQ ID NO: 29471 - protein, 81 aa, Geotrypetes seraphini
QKPVTFEDITISFTQEEWAYLDEDQKKLYREVMKENYQMLISLGTGSPTFTLKILSHIKPRQKPNIRSEPGSEERETGKSS

SEQ ID NO: 29472 - protein, 81 aa, Geotrypetes seraphini
QMQVKFEDVAVSFSQEEWEYLDEEQKQLYREVMEENYQTLLSLATGSLTFTPKIISHIKHGEEPYIRGEPESEERESGKSS

SEQ ID NO: 29473 - protein, 81 aa, Geotrypetes seraphini
MNRIGDWASTNKLKFNAKWDILREWQKEIYKKVIKEIHSFLISQGYSILNPDVIFKIKKEDEKYFTQHYESEEKENMNDSS

SEQ ID NO: 29474 - protein, 81 aa, Geotrypetes seraphini
SRATVTFNDVAAYFSEAEWEVLEEGRKELYRGVMKEIHWVLMSLGYTIVNDDVLLKIKPGEEPYHKYHFGSEDAGGTMDLS

SEQ ID NO: 29475 - protein, 81 aa, Geotrypetes seraphini
AQMQVTFEEIAVSFSQEEWEYLDEEQKELYREVMKENYEILISLGSLAFTPKIISHIERGEEPYIRGEPGSQEREHGKSSC

SEQ ID NO: 29476 - protein, 81 aa, Geotrypetes seraphini
AAAQVTFEDVAVSFSQEEWEYLDEEQKELYREVMEENYQTLISLADLQISQEWKSVKNQGEGPVEKEEIQTQSENVCENIS

SEQ ID NO: 29477 - protein, 81 aa, Lonchura striata
PKVPVAFNDASFNFSEEEWKSLNEWQKELYRHIMKGNYEAVISMDAAISKPDLLTRIEQGEDPNAEDQEDSEGGETPTDPS

SEQ ID NO: 29478 - protein, 81 aa, Geotrypetes seraphini
VTFEDITVSFSQEEWEYLDQGQKELYREVMKENYEILISLDHQISQEWKKEKNQGEDPVKMEQMQTQENVGQNISQGTERI

SEQ ID NO: 29479 - protein, 81 aa, Geotrypetes seraphini
MWVTFEDVAVSFSQEEWEYLDEGQKELYREVMKENYETVMSLGIEFSQQKEKEENLEQHSLKWRLRPRRVDVILETVKGET

SEQ ID NO: 29480 - protein, 81 aa, Geotrypetes seraphini
QVPVSFEDITICFSQAEWEMLKEWQKELYKDVMKENYQTLISLGTGFPIVSPDIISHIERGEEPYIRDQQGSKEREPGKRS

SEQ ID NO: 29481 - protein, 81 aa, Geotrypetes seraphini
SAQMQVTFEDIAISFTQEEWEFLDEEQKELYREVMKENNQILISLDQQIPHEWKREKNQGEDPVEMEQIQTQSENVCENIS

SEQ ID NO: 29482 - protein, 81 aa, Geotrypetes seraphini
AQMQVTFEEIAVSFSQEEWEYLDEEQKELYREVMKENYEILISLAGSPTFTPKIISYIERGEEPYIRDEPVSEERETEKSI

SEQ ID NO: 29483 - protein, 81 aa, Geotrypetes seraphini
SAREMVTFEDIAVSFSEEEWAYLDEEQKKLYREVMEENYQTLVSLEQELKQERESEKNQGKYRLEMEQIQRQSGNVCANIS

SEQ ID NO: 29484 - protein, 81 aa, Geotrypetes seraphini
DQTLVTFKDVAAYFWEVEWNILGEWQKELYKKAIKEVHGILLSRGYSIVNPDVIVKIKKEDEKYFTQNFEWEGKGNPHDSM

SEQ ID NO: 29485 - protein, 81 aa, Geotrypetes seraphini
MRVTFEDITISFSQEEWEYLDEGQKELYREVMKENYEALISLGYETFKGEEEPNVQDTQETGEKEVSHLYTESEGLLEQKR

SEQ ID NO: 29486 - protein, 81 aa, Geotrypetes seraphini
AQMQVKFEDIAISFSQEEWEYLNEEQKELYREVMEENYQTLLSLADHQIQHEWKREKNEEEEDPVEMEQIQTLSENVCENI

SEQ ID NO: 29487 - protein, 81 aa, Geotrypetes seraphini
GRMQVTFEEIFISFSQEEWDYLNEEQKELYREVMKENYQTLISLADQQIRHEWERKKNPGEEAVEMEQIQTHSENVCKNIS

SEQ ID NO: 29488 - protein, 81 aa, Geotrypetes seraphini
QIPVTFEDLVIYFSKEEWEDLEEWQKELYKEVMKENYKSLISLGTGSPTITPDVISLIERGEEPYVRDDPGSEERDSGKSS

SEQ ID NO: 29489 - protein, 81 aa, Geotrypetes seraphini
QKQVTFEDITISFTQEEWAYLDEEQKKLYREVMKDNYQMLISLDHQIRPEWQRIKSQREDSVEMDQIQTESENIYENISLR

SEQ ID NO: 29490 - protein, 81 aa, Geotrypetes seraphini
ASAQMQVTFEDIAVSFSQEEWEYLDEEQKELYREVMKENYEILISLDTKAMQETKREENEEKWLLEHIPRQPGNVSENISQ

SEQ ID NO: 29491 - protein, 81 aa, Geotrypetes seraphini
QQVPVTFEDVAVSFSQEEWKYLDEAQKNLYWEVMKENYETLISLDSEVHQEEEREKNQEEYPMLWGLISRQSRKNHEKVYW

SEQ ID NO: 29492 - protein, 81 aa, Geotrypetes seraphini
MAAGASAQEEWEYLNEEQKELYREVMKENYQTLISLVTGSMAFTPKIISHIERGEEPYIRGEPGSEEREHEKSSCIDHQNQ

SEQ ID NO: 29493 - protein, 81 aa, Nipponia nippon
MAALEPAQVPEALQEVTIATMAASEQAWPLAARLPAGFPVYNPDLLARLEQGEEVWIPDIQSSEEEEEEQLARPLLRLWTR

SEQ ID NO: 29494 - protein, 81 aa, Hirundo rustica
HGVPLLFEDVAVQFSRQEWASLDEGQKEMYRSVMEGNYEMLMSLYCALSKPELLLQLEREELSTPPESEPEAAEVSPELAV

SEQ ID NO: 29495 - protein, 81 aa, Nipponia nippon
EKPSFSQLPVPLPTMEPWVMLDPRQKALYRDVMQESYETLMSLAQGLVSEKAAEEGAAEESCEELEACSSRSPEREKTLGS

SEQ ID NO: 29496 - protein, 81 aa, Geotrypetes seraphini
QMQITFEDIAFSFSQEEWEYLDEEQKELYKEVMKENYQTLISLGTGSPPVTPDIIFHIERGEEPYIREEPGSEEREPGRSS

SEQ ID NO: 29497 - protein, 81 aa, Geotrypetes seraphini
AQVPITFEDIALYFSRAEWEYLQEQQKELYKDVMKENYEILISLGSPIVTPDIISHIERGEELYIMNDPISEERETGKSSH

SEQ ID NO: 29498 - protein, 81 aa, Geotrypetes seraphini
AQMLVTFDNAANYFSEEEWKGADEGQKTTYKEMKEDTSETPVLLDSTTTDSEVLSRIKVEDEPLCNDYSAFEGKENNPSPS

SEQ ID NO: 29499 - protein, 81 aa, Geotrypetes seraphini
QMQVTFEDVAVSFSEEEWAYLDEEQKKLYREVMEENYHTLISLEQELKQERENEKNQGEDGLEMGQIQRQSGNDCANTSQR

SEQ ID NO: 29500 - protein, 81 aa, Geotrypetes seraphini
TRVTFEDIAVSFSQEEWEYLNEEQKDLYREVMKENYETLSSLDHQIIQEQRDPAGDLRYEYHGKRKGKTHQRELQSMHKRN

SEQ ID NO: 29501 - protein, 81 aa, Geotrypetes seraphini
AQMQVAFEDISISFSQEEWEYLNEEQKELYREVMKENYQTLISLGSLTFTPKIISHIERGEEPYIRGEPGSEEREHEKSSC

SEQ ID NO: 29502 - protein, 81 aa, Nipponia nippon
LPKAPVAFESAAAYFSAQEWENLEEWQRELYKNVLRGKSESLISLDYAISKPELLSRLQRGETPCDEDKATSREIPAEPSA

SEQ ID NO: 29503 - protein, 81 aa, Cariama cristata
PKAPVTFESNAAYFSAQEWENLEEWQRELYKNVLRGKNESLISLDYAISKPNLLSQLQRGEAPCGGDEAASRDVPAEPTDY

SEQ ID NO: 29504 - protein, 81 aa, Cuculus canorus
PKVPVTFVDIAVYFSAEEWKNLEEWQKELYNNLVKENYESLISLESLISTSDILSRIKQEVAFVGEQQFTEERAMPADPCA

SEQ ID NO: 29505 - protein, 81 aa, Nipponia nippon
MEPYVLLDPRQRALYRDVMQESYETLMALEFPVSKPDLLSRLDHGDEPTALDLHVPRDTPATEDGAGVEQEPPREEAAEKE

SEQ ID NO: 29506 - protein, 81 aa, Hirundo rustica
PKVPLTFDDISVYFNELEWERLERWQKDLYRAVMRGNYETLVSLDYAVSKPDILSRMERDEELGDKEGQEPPWMQSGDAQE

SEQ ID NO: 29507 - protein, 81 aa, Lonchura striata
LQVPLLFEDVAVRFSRQEWASLSEGQKEMYRSVMEGNYEMLVSLYCALSKPELLLQLEREELNTPPESEAEAAEVSPELAV

SEQ ID NO: 29508 - protein, 81 aa, Lonchura striata
PEVTFEEVAVSFSPEEWAQLAPWQRALHREVMADNYGLVASLEPNSRFTHMKEESHGRVPCAGGHSGDTDTTDTRASSGSD

SEQ ID NO: 29509 - protein, 81 aa, Geotrypetes seraphini
VTFDDITVYFSQEEWEYLDEEQQELYREVMKENYETLIFLDNEALWEQKREKKRESQVYMEEVPRQSGNVCQNISEGNERR

SEQ ID NO: 29510 - protein, 81 aa, Geotrypetes seraphini
DQGPVVFKDVAAHFVEAEWNALGEWKKEFYKKVVREIHSFLWSRGYSVLNPDVLFKIKKEDEKYIIQHYEWEEKENPLYPT

SEQ ID NO: 29511 - protein, 81 aa, Geotrypetes seraphini
MLAEWQKDLYKETMKENYEMLTVLGSLSEKPSLISKIEQEKDLYVRNRQDSPGRLKSSWKGYRPSCENGKHQESCAEKQET

SEQ ID NO: 29512 - protein, 81 aa, Hirundo rustica
PKVPVAFNDASFNFSEEEWKSLNEWQKELYRHIMKGNYEAVISMDAAISKPELLTRIEQGEDPNAEDQEDSEGGETPTDPS

SEQ ID NO: 29513 - protein, 81 aa, Nipponia nippon
MEPWVMLDPRQKALYRDVMQESYETLMSLAAQGLVSEKAAEEGAAEESCEELEACSSRSPEREKTLGSNRRKMKRPDKAVP

SEQ ID NO: 29514 - protein, 81 aa, Callipepla squamata
MLETYECVASLAPLPAPRPMVISLLEEGEEPWVPDLGSPEAVAGDVSPAPLPGPKPIVISLLEEGEEPWIPDVGSPEALAG

SEQ ID NO: 29515 - protein, 81 aa, Alligator mississippiensis
WQKWQGKLEKQAESMELREAFEEVAVYFTREEWELLEDAQKGLYRDQMLRNWRALVSLGKSTSSPQCDHASLMFNTNICFI

SEQ ID NO: 29516 - protein, 81 aa, Alligator mississippiensis
QLQLVFEDVALYFTQKEWELLDDGDKVLYRDQMLRNYQTVVSLGSKRQTSPEDLYQCRECGEPCGDQQELGARGASHKQET

SEQ ID NO: 29517 - protein, 81 aa, Callipepla squamata
FQEPVSFEEVAVYFSREEWALLDPAQRALYRDVMLEKYECVASPAPLPAPKPMVISLLEEGEEPWIPDLGSPEAVAGDVSP

SEQ ID NO: 29518 - protein, 81 aa, Callipepla squamata
MLETYECVASLDPVPGPKPMVISLLEEGEEPWIPDVGSHEAMAGDVSPGSLSSPCEPQGDDACSMEERCFLHLREQGPGVV

SEQ ID NO: 29519 - protein, 81 aa, Alligator mississippiensis
REVFEAVAVYFTREEWELLEDEDKVLYRDPMLRNYQALLSLGWDSGGIPEAVATTASKAAAAAGADPTLGQEMMQTMQPPS

SEQ ID NO: 29520 - protein, 81 aa, Gopherus agassizii
MSGPVTFEEVAVYFTREEWALLDPVQRALYRDVMQENYEMVVLLGFPISKPDVISQLERGEEPWVADLQGSEKEVLPRAAC

SEQ ID NO: 29521 - protein, 81 aa, Gopherus agassizii
VPVVFDDIAVYFSREEWDMFAEWQKDLYREVMTENYEMLLSLGKELFSFFSNGRSRSSSEEQHPDEGAETLQPYRVLFRGS

SEQ ID NO: 29522 - protein, 81 aa, Gopherus agassizii
MEPWVMLDPRQRALYRDVMQESYQTLMSLADGLVSDNEEEDAEEEEEEEGSEELEPRTSQNPEWEKSPANSDEQKKRGAAG

SEQ ID NO: 29523 - protein, 81 aa, Gopherus agassizii
KLDGWGSVACLLGFPVSKPDVISQLEQGEEPWVPDLQGSEEREIMRALRTGEKTLNQLRICKCLKETSGMPSKALGRSLSS

SEQ ID NO: 29524 - protein, 81 aa, Micrurus lemniscatus
SFEDVAVYFSKEEWSQLDADQKALHGEVMLENSMNLASLGLNGQENKKGGKEKFADQMQPKSDKTKQLQSRIKKGFPRVSW

SEQ ID NO: 29525 - protein, 81 aa, Gopherus agassizii
SSMDHCTSASPATAIPLSLCKLCHAELSCLSFQMSVTFEDVAMYFSPAEWALLGEEQKQLYRYVMWENYQTLVSLGEELCL

SEQ ID NO: 29526 - protein, 81 aa, Taeniopygia guttata
HGVPVLFEDVAVRFSRQEWANLSEGQKEMYRSVMEGNYEMLVSLYCALSKPELLLQLEREELSTPPESEAEAAEVSPELAV

SEQ ID NO: 29527 - protein, 81 aa, Gopherus agassizii
AMPVTFEEVAVYFTKGQGALLDPAQRALYRDVMLETYETVTLLALGSACLTLLSWIRKEWGHIVPWLSTRGSCGAARRFQG

SEQ ID NO: 29528 - protein, 81 aa, Gopherus agassizii
LPSGPFDSALFLRQGALLDPAQTALYRDVMLENYETVTSLGKGFPSPRLLESVGPAMLMLVTFFPASLFTSLPGTSSSHGK

SEQ ID NO: 29529 - protein, 81 aa, Gopherus agassizii
MPVTFEEVALYFTQRQGALLDPTQRALYRDVMQENYEMVTSLGKGFPFIQLLEAVGPTYLNVPCFTSGKTKSSVTLPGPAA

SEQ ID NO: 29530 - protein, 81 aa, Gopherus agassizii
FQGRVTFEEVAVYFTREEGALLDPAQRALYWDVMQENYEMVVLCRPKVVPSSLLWGRVWGKSAPDRFDLSRTYFGLFIPFS

SEQ ID NO: 29531 - protein, 81 aa, Gopherus agassizii
LSQECKWFSETAGTGEWALLNPAQRALYREVTQENYATVASLGFPVSKPDVISQLERGEEPWVPDLQGSEERELQKGAQIG

SEQ ID NO: 29532 - protein, 81 aa, Gopherus agassizii
MPVTFEEVAVYFTQGQGALLDPAQRALYRDVMQENYETGPQRPCSCPLGFHVPPEEHGDGNGGREEDPRAQQTNPKEETPC

SEQ ID NO: 29533 - protein, 81 aa, Gopherus agassizii
SGRDHEGVAVYFTREEWALLDPTQRALYRDVMQQNYETVTSLGKDSLKVHVTPQCNLNSALFQQHPNMPVTHTPALCPPLL

SEQ ID NO: 29534 - protein, 81 aa, Gopherus agassizii
EMGFEEVAVYFTAGQGALLDPAQRALYRDVMQENYENVSSLGKDSCPLKCPMNSPDLPCFLSPGQGVQKNTCAEIHTGEKP

SEQ ID NO: 29535 - protein, 81 aa, Gopherus agassizii
GIGLVTFEEVAVYFTESEWALLDPAQRALYRDVMEENYENVTSLAFPVSKPDVISWLEQGEEPWVPDLQNAEEKETLRHTC

SEQ ID NO: 29536 - protein, 81 aa, Gopherus agassizii
GVGPVIFEEVAVYFTSEEWALLDPTQRALYWDVMQENYENVTSLGFPVSKPHIISQLEQGEEPWPAEKMGKFISCRGTQKS

SEQ ID NO: 29537 - protein, 81 aa, Gopherus agassizii
FQMPVTFEEVAVYFTQGQRALLDPAQRALYRDIMQENYKTVTSLVRGLQKTEAFSCLEDEEEYPSSNGSRQRLLGYDLGKK

SEQ ID NO: 29538 - protein, 81 aa, Gopherus agassizii
FQRPMTFEEVAVYFTREEWALLDPTQRTIYRDVMQENYETVTSLGFPVSKPDVISQLEQGEEPWVPDLQGSKERLILRAPC

SEQ ID NO: 29539 - protein, 81 aa, Podarcis muralis
RQICFEDVTIRFTDEEWAFLDPDQRALHQDVMEETRGIVASLGKAPCGIIISYSHNGHANLRQPLAWVLFEEKHQEHCVEC

SEQ ID NO: 29540 - protein, 81 aa, Gopherus agassizii
QMPVTFEEVAVYFTKGQGALLDPAQRALYRDVMLETYETVTLLALGSALELQGIFLRRAKGNFSQGLEQRTAWGDRHRSEM

SEQ ID NO: 29541 - protein, 81 aa, Gopherus agassizii
ISRPDVISLLERGEELWVPDLQGFEKEVLLRVPCTGEVLISILSGAGNDLYLDSLCLPSGDGMVSENEEEKPLQEDAEQVE

SEQ ID NO: 29542 - protein, 81 aa, Gopherus agassizii
LLGLGKPGVAVYFTREEWALLDPAQRALYRDVMQENYENVTSLGKDSRPVGSWKAKCRVKVHPTPTIPPLLCPVSTSPQYA

SEQ ID NO: 29543 - protein, 81 aa, Micrurus lemniscatus
KFSGFYDGDQVAVESPNQESLVSFKEVAVYFSEQEWSQLDSDQKELYSEVMLENHRNVVSLGNNGQDNQDSCELSQGINAN

SEQ ID NO: 29544 - protein, 81 aa, Micrurus lemniscatus
YWDVMQENYETVASLEYLTSTPDLICQQEPWWLQRLEERENRESQSLGKGQVEPSRILSEGDSEGHKSLTGPAAPYNGTRS

SEQ ID NO: 29545 - protein, 81 aa, Gopherus agassizii
GAPVTFEDVAVYFSPEEWKELVEWQKELYWDVMKENYELITSLGKETCLSTGNHAAHEKPGPQTVTWDSPCMECVRSVSLT

SEQ ID NO: 29546 - protein, 81 aa, Micrurus lemniscatus
WSQLDPDQKALHSEVMLENHRNMVSLGNNGQENQDSCELFQVINAKDGTEKFGIRTALESHEKNQSKNWNLESSSSTDAPM

SEQ ID NO: 29547 - protein, 81 aa, Gopherus agassizii
MELPLFEVAVYFTREEGTLLDPTQRALYRDVMQQNYENVTSLAGFLVFQHDVISQLEQGEEPWVPDLQGSEEREILRSSCT

SEQ ID NO: 29548 - protein, 81 aa, Gopherus agassizii
FQGPVTFEEVAVYFTSEEWALLDPTQRALYWDVMQENYENVTSLGFPVSKPHIISQLEQGAEPWVPDLQGSEEILSKHQRI

SEQ ID NO: 29549 - protein, 81 aa, Phasianus colchicus
MEEPVTFEDIAIYLSRAEWDMVAEEQRELYRSVMLDNYELLASLGYPGPKPDILHRLERGEEPWVNTPQSPVKWDGPDRPF

SEQ ID NO: 29550 - protein, 81 aa, Gopherus agassizii
FPMPVTFEEVAVYFTQGQGALLDPAQRALYRDVMQENYKMVTSLAGFPIPKPDLIAQLERGEEPWVPDLQADEERESPRGT

SEQ ID NO: 29551 - protein, 81 aa, Gopherus agassizii
TPRLAETFTGRLRPSIELVTFEEVAVHFTQGEWALLDPIQRALYRDVMQENYENVTSLATQTNYQNPKNPTNHCYCFALCE

SEQ ID NO: 29552 - protein, 81 aa, Gopherus agassizii
PPALVTFREVAVYFSKEEWALMDPGQKALYRDVMQDNYETLISLGFVTPKPDLISQLERGEVSWVLDLQGSEKSDMLTGTC

SEQ ID NO: 29553 - protein, 81 aa, Gopherus agassizii
SNVAFEDVALYFTREEWELLSQPEQQLYRDQMLRNYWTLVSPPPPMNIIILTVHLNNSLIPATTQPQSKLRRVIDVAVSEY

SEQ ID NO: 29554 - protein, 81 aa, Gopherus agassizii
DKGQVTFEEVAVYFSREEGTLLDPTQRALYRDVMQENYENVTSLGKACERQHRPERQQGIQPREKVGKSINCQGTHQNLNE

SEQ ID NO: 29555 - protein, 81 aa, Gopherus agassizii
TLVPVQFEDVAVTLSEAEWLLLDEEKQQLYRDIMYENYQSISSLGELHYYPDFLPTVEALGRAVQKIINLFHRILFFKETE

SEQ ID NO: 29556 - protein, 81 aa, Gopherus agassizii
GPVTFEEVAVYFTREEWALLDPVQRALYRDVMQENYETVVLLGKESCPLDAEQREPHGMLSGRSKGNVSGSCALPEKPKAC

SEQ ID NO: 29557 - protein, 81 aa, Podarcis muralis
YWICFEDVTIRFTDEEWAFLDPDQRALHQDVMEETRGIVASLGKAPCGIIISAWKFKTYLYGTNLIYFHRAQHSKLTSHQI

SEQ ID NO: 29558 - protein, 81 aa, Gopherus agassizii
VSQLVPRDAMYFNEQEWGSLEEWQKELYKNVMKGNYETLISLGKDLFSLLSDDEGIVIKTEVQQVEDVPGTLLERAKEEAV

SEQ ID NO: 29559 - protein, 81 aa, Taeniopygia guttata
NFWILRLPPGRKGEVPKEWEKLEEWQKELYKNVMKGNYESLISLDYAISKPGVLSQIEQGEESRGRNEQDLEESEIITDAT

SEQ ID NO: 29560 - protein, 81 aa, Phasianus colchicus
HCALSPPNSPKAAVAFEDVALYFSAEEWALLARWQRELYQEVMMDNYDLVACLGKEQCCAAPPVPPAPGVPLLPLHPSLLP

SEQ ID NO: 29561 - protein, 81 aa, Gopherus agassizii
VGFEEVAVYFSWEEWGLLDKGQRQLYRDVMQENYQTLISLGEVPLPLGDQELMKQGVLDSFGSGLFPGPVDFWRIGPCPKP

SEQ ID NO: 29562 - protein, 81 aa, Gopherus agassizii
PVTFEEVAVYFTREEGALLDPAQRALYRDVMQENYENVASYCRTELNTLCWTKSSPKKASSLDMRLPEMKNLPLPLNSRPY

SEQ ID NO: 29563 - protein, 81 aa, Gopherus agassizii
LLMLVTFEEVAVYFTEGQGALLDPSQRALYRDVMQENYETVTSLGLPIPKPDLVARLEAGEEPWLPDFQASEERKLPSTGE

SEQ ID NO: 29564 - protein, 81 aa, Gopherus agassizii
DPVTFEEVAVYFTREEWALLDPVQRALYRDVMQENYETVTSLGKESWINNKKVKYTLGTHQVEATKEEKDLGGNVKTPYTC

SEQ ID NO: 29565 - protein, 81 aa, Gopherus agassizii
RVTFEEVAVYFTREEWALLDPAQRALYWDVMQENYETVVLLGKEFDLSYTYFGLFVPFSIRLSEMSFLSGSDLCLDSLCLL

SEQ ID NO: 29566 - protein, 81 aa, Gopherus agassizii
GALVGFEEVAVYFSWEEWGLLDEGQRQLYRDVMQENYQTLISLGEAPLPLGDQERVGGSEVPVVVLAHQISYLCGVRPRFY

SEQ ID NO: 29567 - protein, 81 aa, Gopherus agassizii
LMFQMLVTFEEVAVYFTQEQGALLDPTQRALYRDVMQENYETVTSLGKGFLAPWLLEAVGSAYLTLVRFFPGELVWRVRVS

SEQ ID NO: 29568 - protein, 81 aa, Gopherus agassizii
QGPVIFEEVAVYFTSEEWALLDPTQRALYWDVMQENYENVTSLVKVYASPTMPLLLCPVSASPQYAIQFLFLFDLSQALVL

SEQ ID NO: 29569 - protein, 81 aa, Gopherus agassizii
GCGPVTFEEVAVYFSREEWALLDPVQRALYRDVMQENYETVTSLVGSPVSEPDVISQLERGEEPWVPDRQSSEKEVPPRAT

SEQ ID NO: 29570 - protein, 81 aa, Gopherus agassizii
VPVTFDDVSVYFNEKEWEKLDEWQKELYKNVMKGNYESLISLGKDQNKALTFFTMVAEVMESAPGGWNDGIVIKTEEEDDP

SEQ ID NO: 29571 - protein, 81 aa, Micrurus lemniscatus
ITSEGNGATLWFTEKTPLLCGGTETAVVIPTQNCMSFEDIAVFFSEEEWALLNPDQKLLYREIMLENARNVTCLGERREKE

SEQ ID NO: 29572 - protein, 81 aa, Gopherus agassizii
PTYITSVAVYFTREEWALLDPVQRALYRDVMQENYETVVLLGKEFWGKSAPDRFDLSHTYVGFFIPFSIPLSEIFFLSGAG

SEQ ID NO: 29573 - protein, 81 aa, Xenopus laevis
EEDSIKPDNVAVCFSVEELESFEERQKEPCKNVMREIHQTPTVVGYIYVKPETVSLIRRGEELCVSSNLYARKPDLRSSPA

SEQ ID NO: 29574 - protein, 81 aa, Phasianus colchicus
CQEPVSFAQVAVYFSREEWALLDPAQRALYRDVMLETYQCVASLAPLPAPKPVLISQLEGEEDPCISDVRSPEAVPGDLSP

SEQ ID NO: 29575 - protein, 81 aa, Gopherus agassizii
APGPVTFEDVAVYFTREEWALLDPTQRALYRAIMQENYENVTSLGFPVSKPDVISQLEQGEEPWMRGPFWPFFSLPCFEVD

SEQ ID NO: 29576 - protein, 81 aa, Gopherus agassizii
PGPVTFEEVAVYFTREERALLDLSQRDLYRDVMQENYETVKLLVSFLDMCFFGAVSHFKIAFNVSLLDTLITVAFMPFPHF

SEQ ID NO: 29577 - protein, 80 aa, Gopherus agassizii
LPSPPVSFADVSVSFTQEEWEILAEWQKELYWDVMRENYEILISLDKGLKSSLEGTETLMLQGCSLPLIEEGTLRKNFPL

SEQ ID NO: 29578 - protein, 81 aa, Gopherus agassizii
PPVPVTFEEVAVYFTEEEWALLDLCQRNLYIDVMQENYENVTSLGFPIPKLEVISQLEQGKELWVTELQDGSLNDLNETVI

SEQ ID NO: 29579 - protein, 81 aa, Gopherus agassizii
MESLEVAVYFTREEWALLDPAQRALYRAIMQENYENVTSLGKDSFKVHATSTRPPLHCPLSASPQYANLSPLPPSSLPKAL

SEQ ID NO: 29580 - protein, 81 aa, Phasianus colchicus
MEPYVLLDPRQRALYRDVMQESYETLMSLEFPISKHNPLSHRDEPTALHLHVPKDTLLGDNGAVQEPPQEDPKATKPTEEG

SEQ ID NO: 29581 - protein, 81 aa, Alligator sinensis
AQALVTFEEVAVYFSKGQWALLDPSQRALYRDVMQENYEMVASLAGFPVPQPDVISQLERGEEPWVMDLQEREILGYIHTD

SEQ ID NO: 29582 - protein, 81 aa, Alligator sinensis
MLRNYQALVSLGYQGFAPDLICCIQRGEMELWVCDDEDPGERSWSETSSLAGAGTMTRAEQRPPEQEPANLELIPARNQLS

SEQ ID NO: 29583 - protein, 81 aa, Alligator sinensis
MLRNWRALVSLGYRGPTPDLICRIAQGQEELWVCDDEDHGDISKSEDLLSGSTWLLSRVEKQSLEDGSANLEPPWAFPGGL

SEQ ID NO: 29584 - protein, 81 aa, Alligator sinensis
MYFAEIQWALLDPGQRPVYRDVVPDGYGTLVSLADGGMTNANPQQGCLETAQPHGTLPGLRSEVNIYQALGHAITRPEGQQ

SEQ ID NO: 29585 - protein, 81 aa, Alligator sinensis
LELQEVFEDVAVYFTRKEWELLEDKDKVLYRDQMLRNFQALVSLGYQGPTPDLICSIQQGQVELWVCDDEDCRLEDLLPGG

SEQ ID NO: 29586 - protein, 81 aa, Alligator sinensis
LGLQEVFEDVAVYFTRKEWELLEDEDKVLYRDQMLRNFQALISLGHRGPTPDLICRIQRGLVELWVCDDEDGGEISRSEEL

SEQ ID NO: 29587 - protein, 81 aa, Alligator sinensis
FGLREAFEDVALYFTQKGWELLEDGDKVLYRDQMLRNYQALVSLGCRGPTPDLICRIQRGQGELWVGDDKEPGESAWFEGL

SEQ ID NO: 29588 - protein, 81 aa, Alligator sinensis
LELREVFEDVAVYFTRKEWELLEGEDKVLYRDQMLRNFQALVSLGYRGLAPDLICHIQRGQVELWVCDDEDGGEISRSEDL

SEQ ID NO: 29589 - protein, 81 aa, Alligator sinensis
PVTFEDVAVYFSPEEWKELVEWQKELYWDVMKENYELVTSLDDGLTNESLEEKSREEEVESLPIQPFLAKLKEKVPQSPAK

SEQ ID NO: 29590 - protein, 81 aa, Alligator sinensis
MLTPEPETPAGFPITKPDMISRMEQKEEPWVLRVQGYEEKEILNGMRTAGGGILSENEKNPHQDDPKSMEPYDTVSDASRG

SEQ ID NO: 29591 - protein, 81 aa, Alligator sinensis
LELQEVFQDVAVYFTRKEWELLEDEDKVLYRDQMLRNFQALVSLGHRGPTPDLICRIQRGLVELWVCDDEDGGEISRSEEL

SEQ ID NO: 29592 - protein, 81 aa, Paroedura picta
LVAFEDVAVFFSEEEWALLDRGQKTLHRKVAVENSRNLAFLERSRNRRGKQQRRRIEVKLQGMNDSVTSECCNSHRSPVQG

SEQ ID NO: 29593 - protein, 81 aa, Paroedura picta
MLSPVTFEDVAVYFTEGQGALLDPNQRALYREVMMENYENMASLGFLFIKPALISQLEQGEELWAPESQGLDAAEISDTSD

SEQ ID NO: 29594 - protein, 81 aa, Paroedura picta
QGLVSFEEVAVYFTQEEWALLSPAQKVLYKEVMQENFGIVASLGGLQRMQTGEKKYQCLECGKIFTRSSSLRYHRRIHTGE

SEQ ID NO: 29595 - protein, 81 aa, Paroedura picta
SWLQVVFEDVALYFSPEEWLELAEWQRELYQAVMMENYLAILSLGHSSAKPEVICKIERGEDVCLGEGWTPPVWRKPPSLW

SEQ ID NO: 29596 - protein, 81 aa, Paroedura picta
KLSRWASEKTCFAMEPWVYLDPRQRALYRDVMQESYETLMSLAADKLLNSSNNDEEEEEEEDEEEDEGPEELRPGTSQSTP

SEQ ID NO: 29597 - protein, 81 aa, Paroedura picta
PVYFEEVAVDFTEAEWALLDPDQRALYWEVTLENYENVAFLEEARNVGDRIMEPDRGPLCPGGLESFSRGESISFPCDSAE

SEQ ID NO: 29598 - protein, 81 aa, Magnetospirillum magneticum
RLPNGTLDRLVAFTAEELAALESATRLFERDNREDEAAELATLGAKLRALLKPDVARRVEPDLEALLEAEGLAMRPGPRPR

SEQ ID NO: 29599 - protein, 81 aa, unidentified
  REGION 1..81: note = Gordonia sp. 852002-10350_SCH5691597
VDEAFADLTVDPVTGEREPQSLASMRNDDIVVIRSVTKTFGLAGLRAGYLLASPEIVERLSRGRRPWPLSTPALAALAECV

SEQ ID NO: 29600 - protein, 81 aa, Microcaecilia unicolor
SAQVTFEEIAVSFSQEEWGYLNEEQKELYREVMKENYQILLSLGTGSPTIIPDIISHVEQGEELYIRDERGSEERETGKSI

SEQ ID NO: 29601 - protein, 81 aa, Pipra filicauda
MEPWAPLDPRQKELYRDVMHESYETLLSLAAQGLLSEKAAVEDAGAAEPAEGPGAVSEREKPLGSHRRKAKRPDRAVPPGT

SEQ ID NO: 29602 - protein, 81 aa, Micrurus spixii
LQGVVSFEDVGVYFSKEEWSQLDADQKALHREVMLENSRNLSSLGFKGQENKNCKQECQAIHPKEGKMNFTDQLQPKSNET

SEQ ID NO: 29603 - protein, 81 aa, Amazona aestiva
PKVPVTFDDVSVYFNDKEWEKLEEWQKELYKNVMKGNYESLISLDYAISKPGVLSQIEQGEESRVRNEPDLEESEIITDAT

SEQ ID NO: 29604 - protein, 81 aa, Micrurus lemniscatus
MITFEDVSIHFTEEEWTLLNHKEKNLYWNVMHQNYDNIAYLASDQIKGKSQKEDPLQEDFEPAVEWLEKSKEIILQHPEPK

SEQ ID NO: 29605 - protein, 81 aa, Micrurus lemniscatus
LEGRRNPSNPFQELFSRRIPQEGPNQDTLEVKHRMMCGLYGSVETADETAENQKDILSFEEVAVHFSEEEWSQLDADQKTL

SEQ ID NO: 29606 - protein, 81 aa, Micrurus lemniscatus
MSFEDIAVFFSEEEWALLNPDQKLLYREIMLENARNVICLGERREKEDSKKEIVEDLPIVKNEIGETMFQCQRGVQSPEEN

SEQ ID NO: 29607 - protein, 81 aa, Micrurus lemniscatus
GFLTQGPVSFGEVAIHFSSEEWLLLHPSQKALYQEVMLETSRMVTSLAFYAQKKENDQEPNLVPLQIIKTETPGETSTNKW

SEQ ID NO: 29608 - protein, 81 aa, Micrurus spixii
IKNSVTFEDVAVYFTEDQGVLLDRKQRTLYEDVMMENYGIVASLGFLAFKPALISQIECGEEPWLPEIPKLDDIEISNANA

SEQ ID NO: 29609 - protein, 81 aa, Micrurus spixii
QDLVSFEDVAVFFSMEEWALLDSEEKALYWEVMLENKRNMASLDPLMAFSSSPGTSVLCSGRSTAAELPTQHHPSHQQQQQ

SEQ ID NO: 29610 - protein, 81 aa, Micrurus spixii
QEGLVSFEDVAVYFFEEEWTELDPDQKALHREVMLENYRNVASLGNDEQDHKEPRESFQGFRHGDVMEKRAIQTKFQRQKR

SEQ ID NO: 29611 - protein, 81 aa, Micrurus spixii
AGFLTQGPVSFGEVAIHFSSEEWLLLDPSQKALYQEVMLETSRMVTSLAFYVQKENDQEPNLVPLQIIKTETPGETSTNKW

SEQ ID NO: 29612 - protein, 81 aa, Pantherophis guttatus
MYFAEIQWALLDPCQRPVYRDIVQDNFGTLLSLDGGTMNSNSQPGGPEGMQKQVQGRPEGSAYGGQLSAGQLSEEAGKGWV

SEQ ID NO: 29613 - protein, 81 aa, Ophiophagus hannah
CLPPTQGFISFDEVAVDFTLEEWALLDWSQRALWREVMLEISLNIAALSYGQSDENDQQPWLVPLQTADYEVEEVMFGHQG

SEQ ID NO: 29614 - protein, 81 aa, Ophiophagus hannah
VAEGLGGEPKYVALNKMKLPRETAPPFSFEEVAVYFTEVEWTLLDAEQRDLYWDVMQENYETVASLVLATGSLPAFWVGVA

SEQ ID NO: 29615 - protein, 81 aa, Microcaecilia unicolor
QVPVTFEDIALYFSQAEWEFLQDQQRELYRDVMKENYEIFISLGVDSPTVTPDIIAHIERGEEPYIRDDPRAEEKVTEKSS

SEQ ID NO: 29616 - protein, 81 aa, Microcaecilia unicolor
QIPVTFEDIAIYFSQEEWEDLEETQKELYEDVMMVNYQTLISLETDSVTVTPDIISHIERGEAPYIRHELGSEERKTGKSS

SEQ ID NO: 29617 - protein, 81 aa, Pantherophis guttatus
MEPWVYLDQRQKALYRDVMQESYETLMSLAANQLLNNSNHDDEDEDEDDEEEHEGMEELRPGTSQSAPRRVKPLTRRETPK

SEQ ID NO: 29618 - protein, 81 aa, Pogona vitticeps
LLKQLMSFQEVAVSFTQQEWDLLDPGQRGLYKEVMLEIYRMVTSLAVPKPELTFLLEGGGDPFVQDSEEQKRWAGGCLGLD

SEQ ID NO: 29619 - protein, 81 aa, Micrurus lemniscatus
VSFEEVAVYFSEEEWSQLDADQKALHGEVMLENSRNLFSLGFNGQENKNCNEECQAIHLKMEKGKFADQMQSNSDETKQSQ

SEQ ID NO: 29620 - protein, 81 aa, Micrurus lemniscatus
PKVPVTFSDLSVHFNEHEWGNLDELQKDLYKTVMKSNYEMLVSMDYAIAKPEILTRIEQGDALCDTNVDTMPGNNTPAHLG

SEQ ID NO: 29621 - protein, 81 aa, Micrurus spixii
HFSEEEWSQLDADQKTLHWEVMLENYRNMASLGYNGQENEDSGKPFLINTSGDRIETPTMQMELESHERSQSNTWDEESSS

SEQ ID NO: 29622 - protein, 81 aa, Micrurus spixii
RYFLYFLLNIQDLETREFVLYFQVPVTFNDLSVHFNEHEWGNLDELQKDLYKTVMKSNYEMLVSMDYAIAKPEILTRIEQG

SEQ ID NO: 29623 - protein, 81 aa, Patagioenas fasciata
MSVTFEDVALYFSPEEWAKLSGCQRQLYREVMLENYEMVASLGWASDKPEIICKMEREETPCVPEPPRDWQRHQSPVAAAV

SEQ ID NO: 29624 - protein, 81 aa, Micrurus spixii
MEEWALLDCEQKAPHQEVMVEDAKNMASFGDGLKIVDAAQEMATPFLIAEKEVAERMREKERPEEKELKEELGKYSSSQYV

SEQ ID NO: 29625 - protein, 81 aa, Aquila chrysaetos
PKVPLTFDDISVYFNEQEWERLDRWQKDLYRAVMRGNYEMLISLDYAVSKPDILSRIERDEELCVKDGQKPPLMPIGGSQE

SEQ ID NO: 29626 - protein, 81 aa, Patagioenas fasciata
MSVTFKDVALYFSPEEWAKLSGCQRQLYREVMLENYEMVASLGWASDKPEIICKMEREETPCVPEPPGEQQRHQSPVPDPG

SEQ ID NO: 29627 - protein, 81 aa, Micrurus spixii
TLAKGFLLNCVEQKIQRKQIPVSFEDVIIFFSVEEWALLDFDQKSLYREVMLENAKNVESMGKRYVLLWVQINGEVYSDER

SEQ ID NO: 29628 - protein, 81 aa, Aquila chrysaetos
PKVPLTFDDISVYFNEQEWERLDRWQKDLYRAVMRGNYEMLISLDYAVSKPDILSRIERDEELCVKDGQEPPQTSVRDGQE

SEQ ID NO: 29629 - protein, 81 aa, Aquila chrysaetos
TQEPVTFEDVAVYLSHAEWDAIAAGQRELYRTVMLDNYKLLTSLGYPGPKPDVLYRIEHGEEPWVCTPQSPVRWDGHDSPS

SEQ ID NO: 29630 - protein, 81 aa, Aquila chrysaetos
KGEVPKVTVFCSEEWKSLNEWQKELYRHIMKESLSCKGKGNFLILFLHADAAISKPDLLSRIEQGEDPNAEDQDDSEGGET

SEQ ID NO: 29631 - protein, 81 aa, Strigops habroptila
AVPVTFDDVSVYFNDKEWEKLEEWQKELYKNVMKGNYESLISLGKYGFSRAPGCLQAWAPSESSLEIPLDPLETQIPENPE

SEQ ID NO: 29632 - protein, 81 aa, Strigops habroptila
NFWILRLPPGRKGEVPKEWEKLEEWQKELYKNVMKGNYESLISLDYAISKPGVLSQIEQGEESRVRNEPDLEESEIITDAT

SEQ ID NO: 29633 - protein, 81 aa, Micrurus lemniscatus
GFLTQGPVSFGEVAIHFSSEEWLLLDPSQKALYQEVMLETSRMVTSLAFYAQKKENDQEPNLVPLQIIKTETPGETSTNKR

SEQ ID NO: 29634 - protein, 81 aa, Micrurus lemniscatus
DVVCFEEVAVYFSEEEWSQLDADQEELYREVMVENSRNLLSLGFNGPEKKNCKEECQAIHSKGGNRKFVDQMQLKSDETKQ

SEQ ID NO: 29635 - protein, 81 aa, Micrurus lemniscatus
GVSFEEVAVYFSKEEWSQLDPAQKALHGEVMLENSRNLASLGYNGQKNKNSKEECQAIHLKEGKGKRYQCMQCGKTFPLSS

SEQ ID NO: 29636 - protein, 81 aa, Micrurus spixii
VTFEDVAVYFSAEEWSQLDPDQKALHKEVMLENYRNVASLVALQRLKREQIISGRISEKPRLESVVSESALDHIKQSQTQP

SEQ ID NO: 29637 - protein, 81 aa, Meleagris gallopavo
QEPVSFAEVAVCFSREEWALLDPAQRVLYRDVMLETYQCVASLAGDGLTNIKEDKQKSVVAERQLSGTSVEEIRRAVQGGL

SEQ ID NO: 29638 - protein, 81 aa, Micrurus spixii
EEWSQLDPHQKALHWEVMLENYMNMASLDNNGQENKESIESFQKFKLGNRTEKPANQMEQQSQERNLSNNWNKESLSSVDA

SEQ ID NO: 29639 - protein, 81 aa, Aquila chrysaetos
NFWILRLPPGRKGEVPKEWEKLEEWQKELYKNVMKGNYESLISLDYAISKPGVLSQIEQGEESRVRNEQDLEESEIITDAT

SEQ ID NO: 29640 - protein, 81 aa, Strigops habroptila
MEPWVLLDPRQKALYRDVMQESYETLMSLAQGLVSGKAAEEGAGAGSRGEPAARSSRSPDSEQTPGSNRRKAKRPDKAAPP

SEQ ID NO: 29641 - protein, 81 aa, Patagioenas fasciata
PKVQVMFDSGTADVSAPEREDLEGWQRELHTNVLRGENEPLISLDYAISKPDLLSRLQSGETPCDSDKVTSREIPAEPSAA

SEQ ID NO: 29642 - protein, 81 aa, Chloebia gouldiae
PQVPVAFNDASFNFSEEEWKSLNEWQKELYRHIMKGNYEAVISMGNDGPGFALSLLAQSFPGNWWMEGAVCPAGSGRGWCA

SEQ ID NO: 29643 - protein, 81 aa, Strigops habroptila
MKEDPARPVALGYTVTKPDILAEVERGEEAAAASGHYREHQSPGPRMAPAGPSQGDWLGKEVKSEEGVSPPPGSPPSHRTG

SEQ ID NO: 29644 - protein, 81 aa, Meleagris gallopavo
HPSQEPVSFADVAVYFSREEWALLDPAQRVLYRDVMLETYECIASLAPKPAVISMLEGEEDPWIPEVHGLKDMAGDLGPAD

SEQ ID NO: 29645 - protein, 81 aa, Micrurus spixii
SLVSFKEVAVYFSEEEWSELDPDQKALHWEVMMENYWNVASLEDEWEMLGSRHEAAAPLPKNKMKTAETFLGKQNSEGKQL

SEQ ID NO: 29646 - protein, 81 aa, Meleagris gallopavo
CSKEPLCLQEPVSFADVAVYFSREEWALLDPAQRALYWDVMLETYECIASLGGEDPWIPDVHGLKDMAGDTCPGDGIADLK

SEQ ID NO: 29647 - protein, 81 aa, Patagioenas fasciata
PKVPVTFVDIAVYFSAEEWKNLEEWQKELYNNLVKENYESLISLDGAVSRNEAQPRGERGDGPCIPEQRDLEQRELPPDAC

SEQ ID NO: 29648 - protein, 81 aa, Micrurus spixii
DLVSFEDVAVFFSVEEWALLDSEQKALYREVMLENKRNVASLGDGWEMEDSGQEAAAPLPKDKKEEKIYRKQSSEKIQLTG

SEQ ID NO: 29649 - protein, 81 aa, Micrurus spixii
MSFEDIAVLFSEEEWALLNPDQKLLYREITLENARNVTCLVERWEKEDSKKEMVEDLSIVKNEIGETMFRCQRGVQSPEEN

SEQ ID NO: 29650 - protein, 81 aa, Micrurus spixii
RSFPLDKMESPLFAESSPSIGEAERTARFLTQGHVSFGEVAIHFNSEEWLLLDPSQKALYQEVLLETSRIVASLAFDPQKK

SEQ ID NO: 29651 - protein, 81 aa, Micrurus spixii
PPKAPVSFKDVAVYFAEEEWSLLDQDQRILYREVMLETYGIVASLEFPKPDIKSWMEEGEDLVVQQDEEGERSAGICSGLV

SEQ ID NO: 29652 - protein, 81 aa, Meleagris gallopavo
VSFADVAVYFSREEWALLDPAQRALYWDVMLETYECIASLGDQASKPVVISLLEGGEDPWIPDVHGLKDMAGDTCPGEVVE

SEQ ID NO: 29653 - protein, 81 aa, Strigops habroptila
MGLLVTFEDIVVHFSGAEWASLDDGQKELYRTVMEDNYEMLVSLALPGAGPSQSQDSVQVPLLWEPSAEPWQELHPGCARE

SEQ ID NO: 29654 - protein, 81 aa, Amazona aestiva
VTFEDVAVRFSAEEWELLEEWQRELHWEVTEGTSQLLASLGPPSSPALAALVQLVKEIPEFLFGGPKADVDPGATTSGDTE

SEQ ID NO: 29655 - protein, 81 aa, Terrapene carolina
PVTFKEVAVYFTREEWALLDPAQRALYRDVMQENYENVTSLGKDSFKVHHILRYNLNSALFQQHPNMPVTHTPAIPSESSV

SEQ ID NO: 29656 - protein, 81 aa, Amazona aestiva
PKVPVTFVDIAVYFSAEEWKNLEEWQKELYNNLVKENYESLISLDGALSRSEAQPRSERPEGPCVPEQRDLEQRELPTYGA

SEQ ID NO: 29657 - protein, 81 aa, Micrurus spixii
PSWKTPSEDRATRMVSFETSILCAGGIETFGLPRKNSISFEDVAVFFSVWEWALLDLEQKNLYQEVMLDNARNLASLSDEW

SEQ ID NO: 29658 - protein, 81 aa, Alligator sinensis
MEPYVLLDPRQRALYRDVMQESYETLMALEFPISKPDLLSRLDHGDEPTALDLHVPKGARAAEGATSENEEENPARESPKE

SEQ ID NO: 29659 - protein, 81 aa, Pogona vitticeps
PVTFEDVVIYFTEAEWALLTWTQRALYKEVMQENYQNVMSLGTSPISQAPTATAKDTQESQRQRAKFWSKEEIGLFVDLWI

SEQ ID NO: 29660 - protein, 81 aa, Micrurus lemniscatus
VHGEVAVYFSEEERSQLDAEQKELYREVMVENSRNLFFLGFNGQEDKNCKEKHQAIHSKRGKRKFVDQKQLKSDEAKQSQS

SEQ ID NO: 29661 - protein, 81 aa, Amazona aestiva
PKVPLTFDDISVYFNEQEWEQLDCWQKDLYRAVMRGNYETLISLDYAVSKPDILCRIERGEELCIRDSQESPQTCIRGDQE

SEQ ID NO: 29662 - protein, 81 aa, Microcaecilia unicolor
AAISVTFSDVAVYFSEKEWGLLDEWQKELYRNVMKEIHGALLSMGYKILNPGNLFRIKKAEEPYDRDPDDATQRDFTIHTT

SEQ ID NO: 29663 - protein, 81 aa, Ophiophagus hannah
STPVTFEDVVVYFTAAEWVHLTNWQRDFYQAVMMETYELVASVAGDGVPMAEDEEGGVERPVWQYIPRGKRRRKTPQPRAD

SEQ ID NO: 29664 - protein, 81 aa, Micrurus lemniscatus
VGKKNPSNPPQELFCRQIPWEDPSQDTSGDKQRMKLYGFYDGDQTAVEPPNQEGLVSFEEVAVYFSEEEWSQLHPDQKALH

SEQ ID NO: 29665 - protein, 81 aa, Micrurus lemniscatus
EVRDPEGRKNPSNPPQELLFRRIPWEDPSLDTSGEEQRMKLFGFYDGDQTAVEPPNQEGLVSFEEVAVYFSEEEWSRLDPD

SEQ ID NO: 29666 - protein, 81 aa, Micrurus lemniscatus
LVPLSFEDVAVYFTEEESPLLNASQMALQMEVMVENYQNLSSLGREVWRNEEEDESQRVSLKRARSIQEGLQSEGIEERPK

SEQ ID NO: 29667 - protein, 81 aa, Micrurus lemniscatus
PKVPMTFEDNGVYFSEQEWGNLEEWQKELYKNVMKSNYESLVSLDYAIAKPDLLSRIEQGERPCAEEEEATMTDRVIPSEP

SEQ ID NO: 29668 - protein, 81 aa, Alligator sinensis
MLRNCRALVSLGYRGPTPDLICCIKQGQEELWVSDNGDRGDTSRLKELLPGSAWMLSRAEDQNLVVGPANLELPWTSPGRL

SEQ ID NO: 29669 - protein, 81 aa, Pogona vitticeps
QVPEAFVEVTVSSTGGLRSLVSRHPQKALHKNTMQEDYTIKASLGGFPIHTSELLTRLDRGEVAWVPDLQSSDESTDEGPV

SEQ ID NO: 29670 - protein, 81 aa, Ophiophagus hannah
MEPWVYLDQRQKALYRDVMQESYETLMSLAANQLLNNSNHEDEDEEDEEEPEGVEELRPGTSQSAPRKVKPLTRRETPKQP

SEQ ID NO: 29671 - protein, 81 aa, Micrurus lemniscatus
IPLEDPSQDTSGEIQRMKLSVFYDGAQTVDEPPNQENLMSFEEVAVHFSKEEWSQLDSDQKALHSEVMLENHRNMVSLGNN

SEQ ID NO: 29672 - protein, 81 aa, Microcaecilia unicolor
VSFEDIAIYFSQEEWEDLEEWQKDLYVDVMKENYQTLISLEIDDPRSNNMEGDHWELSESVEGNKTLSERDRGAATSCSDW

SEQ ID NO: 29673 - protein, 81 aa, Alligator sinensis
QMLVTFKEAAVHFTEEQWNLLDPDQRSLYTDVIQEIYEMVVSLGSLSPSTENGPPLDALSVPAGYWMASENEEESPQQKGP

SEQ ID NO: 29674 - protein, 81 aa, Amazona aestiva
RPGQGAVAFEDVAVHFSPEEWRRLERWQRQLYWEVMLENRDLVASLVFESKLVCKMEAEEESYVRDPCGGGDGEAPDASGT

SEQ ID NO: 29675 - protein, 81 aa, Micrurus lemniscatus
MEEWALLDCEQKAPHQEVMVEDAKNMASFGDGLKIVDAAQEMATPFLTAEKEVAERMREKERPEEKELKEELGKYSSSQYV

SEQ ID NO: 29676 - protein, 81 aa, Micrurus lemniscatus
MAVDFTEEEWAMLDSGQKALCREVMLELFRNMAALCDGLVSEKEKQLRLLTLQREVSAKSHSFPFTLSKILNRKYKLHTFA

SEQ ID NO: 29677 - protein, 81 aa, Micrurus lemniscatus
MSFEDIAVFFSEEEWALLNPDQKLLYREIMLENARNVICLGERREKEDSKKEIVEDLPIVKNEIGETMFRCQRGVQSPEEN

SEQ ID NO: 29678 - protein, 81 aa, Microcaecilia unicolor
MMEIHGALISLGYGILNPDVLFRFKKEEEPYYRSQQKSKGKERVVDLNTGYPTVSPDILLRIKHEAEPCHRDQHMPDGRER

SEQ ID NO: 29679 - protein, 81 aa, Pogona vitticeps
VAFEDVAVYFTEEEWALLDRNQKALYWEVMEENLVTVFSLEGGEQESEKGGEASKAALLERVTWEEKEEQQTTSETKEKNE

SEQ ID NO: 29680 - protein, 81 aa, Micrurus lemniscatus
KEDPSHDISGGKSQMKSSALYDGDETIVELPTQESPVSYEEVAVYFSEEEWSQLDVHQKVLHWEVMLENQRNVASLCNNGK

SEQ ID NO: 29681 - protein, 81 aa, Micrurus lemniscatus
VQDFVTFEDVAVYFSADEWSQLDPDQKALHKEVMLENYRNVASLVALQRMKKEQIPSVRISEKPRSESVVSESALDHIKQS

SEQ ID NO: 29682 - protein, 81 aa, Geotrypetes seraphini
ALTSVVFSDVAACFWELEWDILKEWQKEIYKKVIKDIHSILMSQGCLIVNPHVIFKIKKEDDKYFTQQYKLEGKENMSDPT

SEQ ID NO: 29683 - protein, 81 aa, Geotrypetes seraphini
VRFEDISVSFSQEEWAYLDEEQKELYREVMRDNYQTLISLDHWLTQEMKREKKQGEHPIEREESQRQSENVYENISQGTER

SEQ ID NO: 29684 - protein, 81 aa, Geotrypetes seraphini
RMQVTFKDITVSFSQEEWEYLDEGQKELYREVMKENYRTLISLGTGLPRVTPDIISHIERGEEPYIREEPGSEEREPGRSS

SEQ ID NO: 29685 - protein, 81 aa, Micrurus lemniscatus
SFEDVAVYFSKEEWCQLDADQKALHGEVMLENSRNLFSLGFNEQEVNNCNKECQAIHLKGEKEKFAGHMKSNSDETKQSQS

SEQ ID NO: 29686 - protein, 81 aa, Geotrypetes seraphini
VNGSVFQIPVVLCFTEEQRMDLEEQQTELSKDMMENYQTLISLGSGSVAVTPDIISHTEEGEELYIKDELGSEERESGRSS

SEQ ID NO: 29687 - protein, 81 aa, Geotrypetes seraphini
AQMQVKFEDIAISFSQEEWEYLNEEQKQLYREVMEENYQILLSLADHQIQHEWKREKNQGEDPVEMEQIQTLLKNVCENNS

SEQ ID NO: 29688 - protein, 81 aa, Terrapene carolina
LQVPVQFEDVAVTLSGAEWLLLDEEKKQLYRDVMNENYQSISSLGELHYDPNVLPTVEALDRAWKIYTFQCNPNIFGSKTA

SEQ ID NO: 29689 - protein, 81 aa, Microcaecilia unicolor
RVPPVTFHDVAAYFSEDDWEALEDWRKEVYTNAMREIHGALVSLGYGIVNTNVLFRIKQEEEPFFKDPGASKIREGTNSRA

SEQ ID NO: 29690 - protein, 81 aa, Amazona aestiva
MKEDPERPVALGYTVTKPDILAEVERGEEAAAAAAAGHCREHQSPGPRMAPAGPSQGEWDKGAGAQVVGQILLNRRAWSHG

SEQ ID NO: 29691 - protein, 81 aa, Pantherophis guttatus
VTIEDVTVYFSEEEWSQLDPDQKALHKEVMLENSRNVASLVALNRMKRRQNFSARINKKPRLESVVSELALDGIKQSQAQP

SEQ ID NO: 29692 - protein, 81 aa, Aquila chrysaetos
MMENYQLIASLGSSGPKPEVIQKLERGEEPHLGDPPAAPMGGTPQAPGTADSRRRRLSGCAAAAATCKRKELSLADRVKLL

SEQ ID NO: 29693 - protein, 81 aa, Strigops habroptila
PKVPVTFVDIAVYFSAEEWKNLEEWQKELYNNLVKENYESLISLDGVLSRSEAQPRSERPEGPCVPEQRDLEQRELPTDTC

SEQ ID NO: 29694 - protein, 81 aa, Meleagris gallopavo
EEPVSFAEVAVYFSREEWALLDPAQRALYRDVMLETYQCVASMESLLPAPKPIVISLLEGGEDLWIPDMQSPEDVAGDLRP

SEQ ID NO: 29695 - protein, 81 aa, Meleagris gallopavo
LQEPVSFAEVAVYFSREEWALLDPAQRALYRDVMLETYQCVASLAPLPVPKPMLISQLEGGEDPWIPDACSPEAVPGDLSP

SEQ ID NO: 29696 - protein, 81 aa, Meleagris gallopavo
MEPYVLLDPRQRALYRDVMQESYETLISHLERHRRLHRGENPYQCGLCGKGFAWSSHYDRHRLTHTGEKPFSCAQCGKCFG

SEQ ID NO: 29697 - protein, 81 aa, Meleagris gallopavo
EPVSFAEVAVYFSREEWALLDPAQRALYRDVMLETYQCVASLVTETPVPAPKPVLISLLEGRKEPWIPDMRSPEAMPGDLS

SEQ ID NO: 29698 - protein, 81 aa, Aquila chrysaetos
VTKGSLRAGVRGHEWENLEEWQRELYKNVLRGKNESLISLGRYHFPADEVITFKIEQLDSEERPQSSASPATLSSESKELL

SEQ ID NO: 29699 - protein, 81 aa, Strigops habroptila
LSHLEDVWLQFSEQEWRALRGWQRALHQAIMRSNYHILLNVSVSVHDENTKRDPAVDCFESTARDSEVPGRPGEQFSKDPS

SEQ ID NO: 29700 - protein, 81 aa, Strigops habroptila
KMPAACEDEAASLPEQEWGSMDSQQKEISRMAMKGNYNEAGVFLGPADASSKPPLLPLAEDREDPGARTQGLPEEASVLGH

SEQ ID NO: 29701 - protein, 81 aa, Strigops habroptila
LQMLVTFEDVSVHFSSEEWAVLAGWQRELYCSVMRDNYRLLTSLGYPGPKPDILYRMERGEEPWVCSPQSPARWEGPSCPS

SEQ ID NO: 29702 - protein, 81 aa, Aythya fuligula
MEPYVLLDPRQRALYRDVMQESYETLMALEFPVSKPDLLSRLAHEGEPTALDLQVPKDAPSGEDGARAEQEPPGEETVEKE

SEQ ID NO: 29703 - protein, 81 aa, Aythya fuligula
QVPTAGEDDAACLPEQEWGGLDSRQQELYRMAVKGSYEAVVSLGPGDASSKPSLLLPAEDGEDLGTRTHGLLEKGAVSGHV

SEQ ID NO: 29704 - protein, 81 aa, Aquila chrysaetos
MEPYVLLDPRQRALYRDVMQESYETLMALEFPVSKPDLLSRLDHGNEPTALDLHMPRDTLATEDGAGEEQEPPQEEAVEKE

SEQ ID NO: 29705 - protein, 81 aa, Aquila chrysaetos
MEPWVMLDPRQKALYRDVMQESYETLMSLAAQGLVSEKAAEEGAAEESCKELEEHSSRSPEREKTLGSNRRKTKRPDKAMP

SEQ ID NO: 29706 - protein, 81 aa, Aquila chrysaetos
PKVTVSWGAGVRICTQKEWEKLEEWQKELYKNVMKGNYESLISLGKYGGSLPVPRRGEAEEKGWPRAEHVVSGAELEAGSP

SEQ ID NO: 29707 - protein, 81 aa, Aquila chrysaetos
NKNFWILQLPPGDEVPKEWENLEEWQRELYKNVLRGKNESLISLDYVISKPDFLSQLQRGEAPCNGDKEVLEGSTMLAEPG

SEQ ID NO: 29708 - protein, 81 aa, Meleagris gallopavo
LQEPVSFAEVAVYFSREEWALLDPAQRALYRDVMLETYQCVASLASLPVPRRLLISLLEGGEDPWIPDVRCPETVRTDLSP

SEQ ID NO: 29709 - protein, 81 aa, Meleagris gallopavo
SQEPVSFAEVAVYFSREEWALLDPAQRALYRDVMLETYQCVASLAPLPAPKPMLISLLEGGEEPWIPDVRSPEAVPGDLSP

SEQ ID NO: 29710 - protein, 81 aa, Aythya fuligula
FQAAVAFEDVAIYFSPEEWVELAAWQRELYQEVMMDNYDLVACLGSVDTSSKLVPKMEPEEEPCGGASPGEGDRETPDTAG

SEQ ID NO: 29711 - protein, 81 aa, Aythya fuligula
PKVPVTFVDIAVYFSAEEWKNLEEWQKELYNNLVKENYESLISLDAALARSDPQPRLERGEVPCVPEQRDLEPRELPADAC

SEQ ID NO: 29712 - protein, 81 aa, Strigops habroptila
KAPTVVFQSETTCFSAQEWSNLEEQQRELHINELRGKNDPQICLNYTISKHDLLSQLQRGEASCNGDEAASKEVPAELSAA

SEQ ID NO: 29713 - protein, 81 aa, Strigops habroptila
MQRGAVAFEDVAVHFSPEEWGQLARWQRQLYWEVMLDNRDLVASLVSESKFVCKMEAEEESYVGDPCSRGNSGAPDTSGTS

SEQ ID NO: 29714 - protein, 81 aa, Meleagris gallopavo
SQEPVSFADVAVYFSREEWALLDPAQRVLYRDVMLETYECIASLACPAPKPAVISMLEGEEDPWIPEDMAGDLGPGEPVRE

SEQ ID NO: 29715 - protein, 81 aa, Meleagris gallopavo
LKAPEASESDTACFAEQEWENLEEWQKELYKNVLRGNNESLNSLDYAISKPDLLSRLQRGEVPCSEVTSGQKEIPTEPSAA

SEQ ID NO: 29716 - protein, 81 aa, Aquila chrysaetos
RGAVTFEDVAVYFSPEEWVELVAWQRELYQEVMMDNYDLIATLGPESKLTHRMEPREESRGGVPYGGGDGRAPDASGTSAW

SEQ ID NO: 29717 - protein, 81 aa, Aquila chrysaetos
GKMPVTFEDVAVYFSPEEWAELAGWQRRLYREVMLENYQAVASLGWPAVKPEIICKMEREEMPCMPAPPRARWRHRTPVPA

SEQ ID NO: 29718 - protein, 81 aa, Strigops habroptila
MQENYDSLLLLEFPIPKPTVISRLELEEELGVPDPNDSKEWEILRVAPADDGTWSGNDEDPPAPPHPDIPLSHGIKAAASH

SEQ ID NO: 29719 - protein, 81 aa, Meleagris gallopavo
LQEPVSFAEVAVYFSREEWLLDPAQRALYRDVMLETYQCVASMGPLPAPKPVVISLLEGGDDPWIPDVRRWREGGWAVKAL

SEQ ID NO: 29720 - protein, 81 aa, Meleagris gallopavo
MEEPVTFEDIAIYLSRAEWDMVAEEQRELYRSVMLDNYELLASLGYPGPKPDILHRLEHGEEPWVNAPQSPVKWDGPDRLF

SEQ ID NO: 29721 - protein, 81 aa, Meleagris gallopavo
QVPVTFDDIAVYFNEQEWERLDSWQKDLYKAVMRGNYETLISLDYAVSKPDILSRIERGEEDGQELTQTHSPSSEEPLQAH

SEQ ID NO: 29722 - protein, 81 aa, Pogona vitticeps
SVTFEKVAVCFTQEEWALLDPDQRALQREVMEENSRMVTSLDNLKKTAICAKSSKCFVQKMDLVRHWQTHTNVKRITGGKP

SEQ ID NO: 29723 - protein, 81 aa, Meleagris gallopavo
QVPVTFVDIAVYFSAEEWKNLEEWQKELYNNLVKENYESLISLGADAALSRSDTQPRLERGDVPCVPEQQDLEQREMPADA

SEQ ID NO: 29724 - protein, 81 aa, Meleagris gallopavo
LQEPVSFAEVAVCFSREEWALLDPAQRVLYRDVMLETYQCVASLASLLTPKPVLISLLEGGEEPWIPDDFLCHPAGDGLTN

SEQ ID NO: 29725 - protein, 81 aa, Chloebia gouldiae
LQVPVLFEDVAVRFSRQEWASLSKGQKEMYRSVMEGNYEMLVSLYCALSKPELLLQLEREELSTPPESETEEAENCTSDDA

SEQ ID NO: 29726 - protein, 81 aa, Aythya fuligula
QVPTAGEDDAACLPEQEWGGLDSRQQELYRMAVKGSYEAVVSLAGEKIVIKTEEQQPQEEGPESLALPQAPSMRLEEEVPL

SEQ ID NO: 29727 - protein, 81 aa, Aythya fuligula
AEEPVTFVEVAVYFSREEWELLHPAQRVLYRDVMLETYESITSLGLLPSPKPVVISQLEEGEDPWIPDLHGVEDVTGDLSP

SEQ ID NO: 29728 - protein, 81 aa, Pogona vitticeps
EETQKLVTFEDVAVCFTKEEWVLLASDQRSLYKEVMMENYETVFSLVPKSERISHMEQEEELCVQNPLDVEQVEIMDLGSS

SEQ ID NO: 29729 - protein, 81 aa, Pogona vitticeps
PWQFVSFEEVAVYFTKEEWDRLDPGQKTLYTEVMLEIRGMVASLGDGQANENCQRLSLVSWEDEESEDGQDLFGNPEKLNI

SEQ ID NO: 29730 - protein, 81 aa, Pogona vitticeps
GPVTFEEVAVNFTQEEWALLDSDERSLHRDVTVENRQMVASLNCKEYGKSFIHNSVLLTHQKVHRQKLYKCQECGECFPHN

SEQ ID NO: 29731 - protein, 81 aa, Pogona vitticeps
VTFDEVAVNFTEAEWALLDQNQRACHRDVMEETHENVLSLAHEGRHSENQEELCWEDLETFLFKESHLPGRRSEANTYSRN

SEQ ID NO: 29732 - protein, 81 aa, Pogona vitticeps
QGLATFEEVAVSFTQEEWTLLDPDQKALHREVMEEIRGILASLAGNAWKMGKKENPHLVERDSRTTSKAKQNKRNKSIFPG

SEQ ID NO: 29733 - protein, 81 aa, Pogona vitticeps
EWPQNPLTFSDVALYFTEGQWALLDHDQRALYWEVMQENYDHVACLGLPGMAMKLEKEKEPPDVLQWEENTFPEFTVGSPP

SEQ ID NO: 29734 - protein, 81 aa, Pogona vitticeps
AQGPVTFEEVAVYFTDEEWARLDPGQRSLYAEVMFDNYKTVTWLESALSAKPHLISWLEEREKDSFLQSAAEKERLSAKAD

SEQ ID NO: 29735 - protein, 81 aa, Aythya fuligula
PKVPEGFDSSAAGFSEPEWENLEEWQRELYRNVLRGSGESLISLDYAISKPNLLSRLQREVRCDEVDLGEREIPVEPSAAE

SEQ ID NO: 29736 - protein, 81 aa, Pogona vitticeps
VTFEEVAVFFTQEEWALLDPDQKALHQEVMEENWQTASSLEIIHREISVCPHCGKRFRYKLELVEHPRTHTEEERYIREKP

SEQ ID NO: 29737 - protein, 81 aa, Pogona vitticeps
DQSPVTFEEVAVSFTQEEWRLLDLDQKALHQEVMEKNWQMISSLRSVKMPTTGIASSLPEDAALPDQGSVTFEEVAVSFTQ

SEQ ID NO: 29738 - protein, 81 aa, Pogona vitticeps
MGSITFEDVTVYFTQEEWALLDPGQKALHQEVMEENWQTVSSLDIWREKNVCPKCGKSSRHKFKLPEHQRIHTEDKWCIQE

SEQ ID NO: 29739 - protein, 81 aa, Pogona vitticeps
MFEDVAVYFTRGEWKALSEWQKDLYRAVMVENYEAVASSAGDGIRIEEEAEGEGPGPIRPPKARRGRKKRGRPPGTETPAT

SEQ ID NO: 29740 - protein, 81 aa, Pogona vitticeps
QSLKDVLMHFEDIAIHFTEEEWALLDEGKRALHQEVMEENIATLIPLAANGIPLPLSSSGYQMAGAGEQLLLKGVGPGLRH

SEQ ID NO: 29741 - protein, 81 aa, Pogona vitticeps
MFEDVAVYFTRGEWKALSEWQKDLYRAVMVENYEAVASSGDGIRIEEEAEGEGPGPIRPPKARRGRKKRGRPPGTETPATW

SEQ ID NO: 29742 - protein, 81 aa, Pogona vitticeps
QGSVAFEEVAVYFTWEEWALLDPDQKALHQEVMEENWKTASALGAGWRPATNVSSPLPWDGAEPDQGPVTFEEVAVSFTQE

SEQ ID NO: 29743 - protein, 81 aa, Pogona vitticeps
AESLVIFEEVAVRFTEEEWALLDRGQRVLYREVMLGNYEMAISLRTLLLPKPGLISWLEEEEMRDQFTQEAVRWAGVASWE

SEQ ID NO: 29744 - protein, 81 aa, Pogona vitticeps
PVAFEEVAVSFTQEEWALLDLDQRALYQEVMEENWRTVSFLGVERMPSTTIHSFLPSDGAEPDQDPVAFEEVAIYFSQEEW

SEQ ID NO: 29745 - protein, 81 aa, Pogona vitticeps
GVTSVTFEDVTLFFTKGQWNLLDQHQRALYKEVMQENYDNMASLACTMECPFPPRSKKRESMATVEEAQEPVTFEEVAVYF

SEQ ID NO: 29746 - protein, 81 aa, Pogona vitticeps
MEPWVYLDPRQRALYRDVMQESYETLMSLAADKLLNSNNNEEEEDDDDEEEEDEGPEELRPGTSQSIPRRMKPVPRRVAPK

SEQ ID NO: 29747 - protein, 81 aa, Micrurus surinamensis
PWEDPSQDTSGGGQRMKLSGFYDGDQTAVESPNQESLVSFEEVAVYFSEEEWSQLDPDQKVLHSEVMLENHRNVVCLGNNG

SEQ ID NO: 29748 - protein, 81 aa, Micrurus surinamensis
FSAGDEKVEHPTQVLVSFEEVAVHFSKEEWSRLDPDQKSLYREIMLENSRNLAFLRNHVQENKEASQTFGDEERRVQFENP

SEQ ID NO: 29749 - protein, 81 aa, Micrurus surinamensis
LVSFKEVAVYFSEQEWSQLDSDQKALHSEVMVENHRNVVSLGNNMQENQDSCELFQVINAKDGTEKFVIRMEFKSHERNLS

SEQ ID NO: 29750 - protein, 81 aa, Dipodomys ordii
MQVSLEDVAVNFTQEEWECLDTGQRTLYVDVMTEILKNLESVGFKEGKEKEGEEEEEEEEEEEEEHQEPGQDLSNEGTNDK

SEQ ID NO: 29751 - protein, 81 aa, Peromyscus maniculatus
PKVPVSFEDVSVYFTNTEWKLLNLKQRNLYKQVMLENYSHLVSVGFAFSKPNLVSQLERGEKPWITDGGKETAAGSCAGNG

SEQ ID NO: 29752 - protein, 81 aa, Rattus norvegicus
KPGTVSFSDVAVYFSSEEWRCLQPAERALYREVMRETYGLLGSFGIRGAKPALICWVEEETELWGPRAQDPEVAMCKTEVH

SEQ ID NO: 29753 - protein, 81 aa, Rattus norvegicus
YKEPVIFKDVAVYFSQKEWQLLEPAQKDLYKDVMLENYGNLISVEYYIFKPKLITRLEQGIDLFAKENDTPGDPQQGEAGV

SEQ ID NO: 29754 - protein, 81 aa, Mus caroli
VSFEDLVVHFTQDEWDLLAPSQKTLYGDVMLETFRNFTDTGCEWEDQKIGDHSEEPEINLRKIITHSEYTQYECEEYEEKP

SEQ ID NO: 29755 - protein, 81 aa, Mus musculus
PKGLLRFKDVAVDFSQEEWECLDCAQRALYMDVMLENYNNLFFVENLCIFPKYENGLDQDTQHIVHKHVTIQKKSYKYYEH

SEQ ID NO: 29756 - protein, 81 aa, Cavia porcellus
QVPISFKDLAVRFSEEEWRLLEEGQREFYRDVMRENYETLVSVGTAELLPLSAFLLPVEPGGAPRAENRTEQRQEPTAGAS

SEQ ID NO: 29757 - protein, 81 aa, Cavia porcellus
SRALENDGVCFSEQEWENLADWQKELYRNVMQSNYEALVSLKVLGQPEGEAELGAEMLGDLEEEESLVGAHPADGAVLRPE

SEQ ID NO: 29758 - protein, 81 aa, Octodon degus
IQELVTFEDVAVYFTKEEWALLDLTQRDLYRDVMLETFQNLASLGYQIPMPQLISQWEKGEDLLRVKGGLIQGTCMGEQKE

SEQ ID NO: 29759 - protein, 81 aa, Octodon degus
IQGLLTFKDVAIEFSQEEWTDLDPAQRTLYREVMLENYRNLVSLGIHRFDLGVVSMLEQGTEPWSVDGRVKVARNLDEWES

SEQ ID NO: 29760 - protein, 81 aa, Peromyscus maniculatus
LQGLLTFRDVSVEFHQEEWECLDSAQRALYIDVMLENYNNLVFVENYCKCDPVHQHVKTEKESYRCNEVDKVLHDPSTCTL

SEQ ID NO: 29761 - protein, 81 aa, Rattus norvegicus
LWEPLTFRDVAVSFSQDEWLHLDPAQRTLYREVMLENYSNLASLGILSPKPKVISQLEQADFQMVESGMFQGVYLGWKSLF

SEQ ID NO: 29762 - protein, 81 aa, Rattus norvegicus
MLENYRNLVSVGYQLSKPTVISQLEKGEGPWTAESQGPKDSILDVKTKLETKESTSEDDISVKFYHGAMRGRLSEDHIVCS

SEQ ID NO: 29763 - protein, 81 aa, Rattus norvegicus
MASPSPPLESKEEWGYLDAAPRSLYKDVVMDSYGKLVSLDVLNRNEDEEPTVKEEIEKDIEPQGIIVTRIKSELDQDPMGS

SEQ ID NO: 29764 - protein, 81 aa, Mus caroli
FETLNDVAMDFTVEDWKDLESELDQRDLFWDVTLNDYQDMFSFTDTPQPSLTSQPDVREELEATSTEVPETKNSPLQNGFL

SEQ ID NO: 29765 - protein, 81 aa, Mus caroli
SLGPLSFKDVAVAFSQEEWQQLDPEERTTYRDVMLETYSNLVSLGYDIIKPDVIIKLEQGEEPWIVEGAFSPQSYPDEIRH

SEQ ID NO: 29766 - protein, 81 aa, Mus musculus
MNAVTYEDVHVNFTQEEWALLDPSQKKLYKDVMVETYRNLNAIGFNWEAHNIEEYCQSSRRHRRCERSQSAEKPSEYTQCG

SEQ ID NO: 29767 - protein, 81 aa, Mus musculus
SVEMLSFRDVAIDFSAGELECLEPAQWDLYRDVMLENFSHLVFLGFSFSKPLLVRFLEKNQELRNVKRKAATVPRGKKPYK

SEQ ID NO: 29768 - protein, 81 aa, Cavia porcellus
MASPNSPLEPKEEWDYLDPAQRSLYKDVMMENYGNLVSLDVLNRDKDEEPTVKQEIEEIEDEVEPQSVIVTRIKSEIDQDP

SEQ ID NO: 29769 - protein, 81 aa, Marmota monax
VTFEDVVVNFTEEEWALLDPSQRNLYRDVMLEVFRNLAFVENKWHEKNIQDEIKNSEIILRHITSHSEHKSYKHEECEEKP

SEQ ID NO: 29770 - protein, 81 aa, Peromyscus maniculatus
VQEPVTFKDVAVAFTQEEWGQLDIVQRTLYRDVMLETYGHLLSVGNQIAKPEVISLLEQGEEPWSVEQAYPQSTCPEWMRN

SEQ ID NO: 29771 - protein, 81 aa, Rattus norvegicus
MLENYSNLLFLGHCKTKPELIFNLEQRLGSWIVEASHQSIPDFQKVNTLNETSPETKARHVCQVPLNSDTSEELAGIGNTC

SEQ ID NO: 29772 - protein, 81 aa, Rattus norvegicus
VSFEDLVVHFTQDEWDLLEASQKSLYGDVMLETFRNLTAVGYEWEDEAIEDHCEEPEVNLRDIVSHSEYTHEYEHKEYEEK

SEQ ID NO: 29773 - protein, 81 aa, Mesocricetus auratus
YQDLVSFKDVTVDFTQEEWTSLNPAQRCLYRDVMLENYKNLATVGYQLIKPSLVSWLEQEEFSTGQKIVFPEWKMQLETKC

SEQ ID NO: 29774 - protein, 81 aa, Mesocricetus auratus
SQRSVSFKDLAVDFTREEWQCLGPAQRLLYRDVMLETYRNLISLGFRVSKPEVILKLEQGKEPWTVEELPSQNHAGKCEDR

SEQ ID NO: 29775 - protein, 81 aa, Peromyscus maniculatus
PLGSELFRDVAITFSQEEWERLEPAQKDLYREVMLENYGHLVSLGLTISKPDVIAILEQGREPWLEERGTAGGLPSALESG

SEQ ID NO: 29776 - protein, 81 aa, Octodon degus
CEVLVSFEDVIVDFSREEWQQLDSNQRCLYHDVMLENYSHLLSVGFEVPKPEVIFKLEHGEEPWMWEKKTPHYGCSGGTFW

SEQ ID NO: 29777 - protein, 81 aa, Mus caroli
PHKSVKFEDVSLTFTKEEWAQLDLQQKCLYREIMMENYSNMISVEHHFSKPYVISQLEEAEDCWPMQREIPQDTLPECSWP

SEQ ID NO: 29778 - protein, 81 aa, Mus caroli
SKGPLSFKDVAVAFSQEEWQQLDPEERTTYRDVMLETYSNLVSLGYDVTKPNMIIKLEQGEEPWTVEGDRHAQRHLEISKV

SEQ ID NO: 29779 - protein, 81 aa, Blattella germanica
MESDNYGDLSTFFSVTEWDSLTAYEKKRYFNILDNYRKMVTLGLNPKKPSFMHTKTEGEEDSIFNRNNNHFISPKHLKRKD

SEQ ID NO: 29780 - protein, 81 aa, Candidatus Lokiarchaeota archaeon
RKAPPTPPKGKETTTPAITTKKVMKALSEDEWQTIKHLIFKLRIKDMMDARYLQIKLKELVRKDKILMEIKKGKKHWKLKE

SEQ ID NO: 29781 - protein, 81 aa, unidentified
  REGION 1..81: note = Halomonas sp. R57-5
LDTFRKLWFTASLEQWSQMDDHQRTLLDSGMIANARKAEPWKAVELFRALADRAELTQRLEHFNQEYHLLMTPSVAIQPFE

SEQ ID NO: 29782 - protein, 81 aa, unidentified
  REGION 1..81: note = Aciduliprofundum sp.
IGVAARETALYFPIVPWQNEDEVKKHQWREEGLDPIDSLIEMLRPDSLLNIIKNYLFFRIEHGSATKVIARYMQYRAAEKI

SEQ ID NO: 29783 - protein, 81 aa, Mus musculus
MAKDLRFEDVVIYFSLEEWECLRHSHRNLYRAVMLDNYSNLLSLSLADTKPRVVSLLEQGKEPWMVMRNETKIWHPDWVSR

SEQ ID NO: 29784 - protein, 81 aa, Pan troglodytes
VKIEEVADVAVSFILEEWGHLDQSQKSLYRDDRKENYGSITSMGYESRDNMELIVKQISDDSESRWVAPEHTERSVPQDPD

SEQ ID NO: 29785 - protein, 81 aa, Rattus norvegicus
RDQEVGTALLPSLQEEQWRHLDSTQKEQYWDLMLETYGKMVSGVAGISNSKPDLTNMAEYGEELVGLHLHSAEKMARAPCK

SEQ ID NO: 29786 - protein, 81 aa, Homo sapiens; identical to SEQ ID NO: 2897

SEQ ID NO: 29787 - protein, 81 aa, Homo sapiens; identical to SEQ ID NO: 2898

SEQ ID NO: 29788 - protein, 81 aa, Mus musculus
VVTKDLVTFNDVAVDITQEDWELMPPVQKELYKTVTLQNYWNMVSLGLTVYRPTVIPVLEEPWMVIKEIVEGPNPEWEPKA

SEQ ID NO: 29789 - protein, 81 aa, Pongo abelii
GMVTFEDMAVSLTWEEWERLDPARRDFCRESAQKDSGSTVPPSLESRVENKELIPMQQILEEVEPQGQLQEAFQGKHPLFS

SEQ ID NO: 29790 - protein, 81 aa, Homo sapiens; identical to SEQ ID NO: 2899

SEQ ID NO: 29791 - protein, 81 aa, Homo sapiens; identical to SEQ ID NO: 2900

SEQ ID NO: 29792 - protein, 81 aa, Pongo abelii
QEPVTFKDVVVEFSKEEWGQLDSAVKNLYRNVMLENFRNLNSLRKAHLLSKPFESLKLESRKKRWIMEKEIPRKTIFDMKS

SEQ ID NO: 29793 - protein, 81 aa, Bos taurus
SQELLTFKDISVDFTQEEWGQLAPAHRNLYREVMLENYGNLVSVAGCQLSKPSVISQLEKGEEPWMTEKEGPGDPNSDLKS

SEQ ID NO: 29794 - protein, 81 aa, Homo sapiens; identical to SEQ ID NO: 2901

SEQ ID NO: 29795 - protein, 81 aa, Homo sapiens; identical to SEQ ID NO: 2902

SEQ ID NO: 29796 - protein, 81 aa, Homo sapiens; identical to SEQ ID NO: 2903

SEQ ID NO: 29797 - protein, 81 aa, Mus musculus
RDQELGTAVLPPLQEEQWRHLDSTQKEQYWDLMLETYGKMVSGVAGISNSKPDLTNLAEYGEELVGLHLHGAEKMARLPCK

SEQ ID NO: 29798 - protein, 81 aa, Mus musculus
LVKTEDVADVAVSFILEEWAHLDQSQKSLGRDSRKEDCESTTPVDYEPKEGNLEFTVQQVSDAADPHWVAAERTEKNGVQR

SEQ ID NO: 29799 - protein, 81 aa, Mus musculus
NRVSPFKDMILCFSEEDWSLLDPAQTGFYGEFIIGEDYAVSMPPNEPPVQPGHSHEEENGLRVTEWTTDLQDKEIPQASCL

SEQ ID NO: 29800 - protein, 81 aa, Homo sapiens; identical to SEQ ID NO: 2904

SEQ ID NO: 29801 - protein, 81 aa, Homo sapiens; identical to SEQ ID NO: 2905

SEQ ID NO: 29802 - protein, 81 aa, Pan paniscus
GMVTFEDMAVSLTWEEWERLDPARSDFCRESAQKDSGSTVPPSLESRVENKELIPVQQILEEAEPQGRLQEAFQGKRPLFS

SEQ ID NO: 29803 - protein, 81 aa, Aspergillus steynii IBT 23096
WSITLGKIRCLHALQDWQALSGISEEKWSHASLEHQRAIAPLAVTAAWRLKNWDLIQTLLHGIKPGTADRSFFGAVLAVHH

SEQ ID NO: 29804 - protein, 81 aa, Homo sapiens; identical to SEQ ID NO: 2906

SEQ ID NO: 29805 - protein, 81 aa, Homo sapiens; identical to SEQ ID NO: 2907

SEQ ID NO: 29806 - protein, 81 aa, Homo sapiens; identical to SEQ ID NO: 2908

SEQ ID NO: 29807 - protein, 81 aa, Homo sapiens; identical to SEQ ID NO: 2909

SEQ ID NO: 29808 - protein, 81 aa, Homo sapiens; identical to SEQ ID NO: 2910

SEQ ID NO: 29809 - protein, 81 aa, Homo sapiens; identical to SEQ ID NO: 2911

SEQ ID NO: 29810 - protein, 81 aa, Homo sapiens; identical to SEQ ID NO: 2912

SEQ ID NO: 29811 - protein, 81 aa, Myotis brandtii
SQGLVTFKDVAVCFSQEQWDDLDPTQKEFYGEYVLEEDCGIVVSLSFPIPRLDEISHIIEEEPLVPDILEPQEPQEPDILT

SEQ ID NO: 29812 - protein, 81 aa, Balaenoptera acutorostrata
QEAAEFEFLSVDYTQKKWKGPALSQKAALYRNIMPENCCSLASLGENRMESSELPPKQEISEESESSDRTSGILYGVIPGG

SEQ ID NO: 29813 - protein, 81 aa, Cervus elaphus
EDPVTFLDVAVDFSTEEWGLLDPMQRTEYHDVMLETFGHLVSVGWETTLDSKQLTPQPGPPEEGPACPLKEEEGSSADDAR

SEQ ID NO: 29814 - protein, 81 aa, Colobus angolensis
TLTQVGNSGDQAGATILRMVRPQDTVAYEDLCVDYTQKKWKGPALSQRALQWNMMLENDHSMASLGWSTMVRSWLTSISSS

SEQ ID NO: 29815 - protein, 81 aa, Fusarium mangiferae
ELKLIDFLDDAIRFVDTDTEVINLAPLQLYHSVLVFAPTNSIVRKTFVAEIPSCLRRVTGGRTDWDPRLRSLENSAPTLWH

SEQ ID NO: 29816 - protein, 81 aa, Octodon degus
TCEPIAFKDVVMSFSRREWRKLEPSQKELFKDVLLENLKHLEFLGFQVSKLDLISQLKWVELPRLVERKLLKDSRAECEPK

SEQ ID NO: 29817 - protein, 81 aa, Fukomys damarensis
SQEPVKDVHVIRSLSHKKTVHQIPVHRDLYREIRKENVGNTVSLGNTVSPSNKIARLEQRKEPWTVGLHSSNKRNVLQSTY

SEQ ID NO: 29818 - protein, 81 aa, Paroedura picta
QHLFSFEEVAVYFTGEEFALLDPGQIALYREVMLENSGSVAFLARNIRETAVETNKSLASGERLESFSSASPGRNSFPDEL

SEQ ID NO: 29819 - protein, 81 aa, Paroedura picta
GRVTLEEVFVHFTEEEWALLDPDQRRLHQEVMEENGQNVASLESEAQMTSVEEPHHHHLLEKKQQKRIKGTKWTRSCLQNA

SEQ ID NO: 29820 - protein, 81 aa, Podarcis muralis
SLCFEDVAIHFTDEEWALLDPDQRALHQEVMEENRGIMASLGGDELEMKNKGDHNKIRRVEKPQKHLECAESFNQNSNLTS

SEQ ID NO: 29821 - protein, 81 aa, Paroedura picta
PFSFEEVSVSFSEAEWALLDPGQRALHREVMLENCENVAFLEARCITEFMAERGNGLAFQEKLQSSARGSQAEESQGNGEE

SEQ ID NO: 29822 - protein, 81 aa, Micrurus lemniscatus
FLAILPKEIQSWVWQQHPENCGKAVDLVENFLTGLSLLERHGKKALVTFEEVSMYFSEEEWRLLDESQRKIFTKVMMENYE

SEQ ID NO: 29823 - protein, 81 aa, Micrurus lemniscatus
GQIMDMVILEQFLHVLPLGMQAWVRARKPSTSQEAAQLAEAYLEQQCPVAFQDVAVYFTPEEWDLLDNEQRFLYYTVMQEN

SEQ ID NO: 29824 - protein, 81 aa, Podarcis muralis
GPVCFEDVAVCFTDEEWAFLDPDQRALHKDVMEENCGIVASLDKAPCGIIISAWKFTELNSAPYNPWEPNTPTINNCDESE

SEQ ID NO: 29825 - protein, 81 aa, Alligator sinensis
LELQKMFEDVAVYFTRKEWELLEDEDKGLYRDQMLRNYQALVSLGYRGPTPDLIYRIRRGQVELWVYDDEDHEDISRLEYM

SEQ ID NO: 29826 - protein, 81 aa, Podarcis muralis
QGPAPFEKMSVHFMEEKRTLPEPGQASLHRGSAEENTGDLVFLGNGQEGCQEGEGQRRAAEETQKWGAKAFVFEGGEADEI

SEQ ID NO: 29827 - protein, 81 aa, Podarcis muralis
FQGSVSFEDVAVWFTEEEWDLLDPDQRALHNQTMFPPPYSLFFGQETDERKETGIPRVNRGSRSSKRGRKPSVKTRPRENS

SEQ ID NO: 29828 - protein, 81 aa, Alligator sinensis
MELRDAFEDVAVYFTRKEWALLDDGDKGLYRDQMLRNYQAVVSLGYRGPTPDLICRIQRGEVELWVGDDEDCGESSRLEDL

SEQ ID NO: 29829 - protein, 81 aa, Podarcis muralis
GSVSFDEVSVRFTNEEWALLDPGQRALYEEVMEEIREMMTSVGDVWGIQTERETSEVPHERAEEHNAQRKLRVQVGTYRNE

SEQ ID NO: 29830 - protein, 81 aa, Alligator sinensis
LELREVFEDVAVYFTWEEWELLEEEDKVLYWDQMLKNYQALVSLGYRGPTPALICSIQQGQVELWGCDDETRGKISRSEEL

SEQ ID NO: 29831 - protein, 81 aa, Podarcis muralis
SVSFEDVAVCFTAEEWALLDPAQRALHKEVMEETWRTMISLGGDELEMKNKGDHDEIHTEEKPYKNLECAKSFSQSSQSTS

SEQ ID NO: 29832 - protein, 81 aa, Podarcis muralis
VCFEDVTVCFTDEEWALLDPDQRALHKDVMEENHGIVASLGKAPCEIVRFTRSSSLSSHHRIHTGEKPYQCVECGKSFRQS

SEQ ID NO: 29833 - protein, 81 aa, Alligator sinensis
SELREVFEDVAVYFTRKEWELLDDEDKVLYQDQMLKNYQALISLGYRGPTPDLISSIERGQVELGECDEEDSGEISRSEDV

SEQ ID NO: 29834 - protein, 81 aa, Paroedura picta
PPFSFEEVAVSFTEAEWALLDPGQRALHREVMLENYGSVASLETKSIRAKLAETDNGLASEERLESFSSGSQEHVSFPDQL

SEQ ID NO: 29835 - protein, 81 aa, Paroedura picta
AQGPVSFEEVAVHFSPGEWSLLRPAQRALYKEVMLENFGHVASLGCLLAKPGLVSWLEEEVQPFALGAEHEEGLPDGGSAV

SEQ ID NO: 29836 - protein, 81 aa, Alligator sinensis
DKGLVTFKDVAVYFTKEQWALLDPGQKALYRDVMQENYETVTSLGLLIPKYNMISQLEEGTKPWSPDPQGEIPRDADTHKA

SEQ ID NO: 29837 - protein, 81 aa, Paroedura picta
VQGPFSLEEVSVSFTEAEWALLDPGQRALHREVMREISQDLAFLAKEARSTGQTVGETEEGPASQGRLPPSSKEPPDQISS

SEQ ID NO: 29838 - protein, 81 aa, Paroedura picta
QHPFSFEEVAVSFAEAEWELLDPGQKALYREVMLENCGNLASLDARREAAVETDKGLAPAEGLENFSRASQEHISFPSELA

SEQ ID NO: 29839 - protein, 81 aa, Alligator sinensis
PETVVSFEDVAVRFSPDEWHLLDDGQRRLYRDVLRENYSHVRSLGFPVPDLAVIFRMERGEEPWPPGLPAGTKSDDQEEER

SEQ ID NO: 29840 - protein, 81 aa, Alligator sinensis
MELQEVFEDVAVYFTWEEWELLEDEDKVLYWDQMLKNYRALVSLGYRGPTPDLICHIQQKQVELWVCDVENYGEISSLEDL

SEQ ID NO: 29841 - protein, 81 aa, Paroedura picta
LEKLATFEDVAVCFTEEEWSVLDSGQRALYREVMVENYRNVGLLEHLLIPKPELICWLEEEELREGCTDTGERSAGEKHEN

SEQ ID NO: 29842 - protein, 81 aa, Podarcis muralis
GSVSFDEVSVRFSNEEWALLDPGQRALYEEVMEEIREMMTSVGDVWGIQTERETSEVPHERAEEHNAQRKLRVQVGTYRNE

SEQ ID NO: 29843 - protein, 81 aa, Alligator sinensis
MEVREVFEDVAVYFTWEEWELLEEEDKGLFQDQMLRNHQALVCLGFRGPTPDLICHIQPGQVELWVCDDEDRGEMLRSEDL

SEQ ID NO: 29844 - protein, 81 aa, Podarcis muralis
PVCFEDVAVRLTDGEWAMLDPDQRALHKDVMEENWGIVASLDCDELESKNKGDHNTICRVEKAHKNLQCGKSCSQSSHSTS

SEQ ID NO: 29845 - protein, 81 aa, Alligator sinensis
MELREVFEDVAVYFTWEEWELLEEEDKELYRDQMLKNYQALIFLGYQGPTPDLLCRIQSGQVQLWVCDDEDSGEILRSEDL

SEQ ID NO: 29846 - protein, 81 aa, Alligator sinensis
LELQEVFEDMAVYFTRKEWELLEDEDKVLYRDEMLKNYQALVSLGYRGPTPALICSIQQGQVELWVCDDEDSGEISRSQDL

SEQ ID NO: 29847 - protein, 81 aa, Alligator sinensis
LELWEVFEDVAVYFTRKEWELLDDDDKVLYQDQMLKNYQALVSLGYRGPTPDLICSIQKGQVELWVCDGEDRGEISGFMGK

SEQ ID NO: 29848 - protein, 81 aa, Paroedura picta
EKRDQLIPYQRGGFCDAEWALLDRGQRALYRDVMLENYGMVASLEGDQGTEEDNEMHRLLPEEVKAADLGGNFSHRVEKRD

SEQ ID NO: 29849 - protein, 81 aa, Paroedura picta
DQGPLTFDQVAVHFTDGEWALLDADQRALHREIMEGNCQNVASLEGPLIRNLDFNSWQEEGDARFVQVPKEESLRSCMGSV

SEQ ID NO: 29850 - protein, 81 aa, Alligator sinensis
ELQEVFEDMAVYFTRKEWELLEDEDKVLYRDEMLKNYQALVSLGGVWMLSRAEEQPTAEGSADLEPAQASPGSLGEMDSLR

SEQ ID NO: 29851 - protein, 81 aa, Paroedura picta
PVSFAEVAVDFAEAEWALLDPAQRALYLEVMQENYGSVAFLEEASNVRDTAWEPDRGLVSVGGLESFSRGSSETVSFLNDP

SEQ ID NO: 29852 - protein, 81 aa, Paroedura picta
VQGPFSFEEVAVSFTEAEWALLDPSQRALYREVMLEIDGSVATLGDDLRKEKDQDLHNLSSDEVKSEDLKAAEVLSDVLQK

SEQ ID NO: 29853 - protein, 81 aa, Paroedura picta
VQCPFSLEEVSVSFTEAEWALLDPGQRALHREVMLENYGNVAFLAKNDRRNEEGDKLHQQMPDTSKNEDLQENVRNRGRPK

SEQ ID NO: 29854 - protein, 81 aa, Paroedura picta
AQGLVTFEEVAVCFFEEEWALLDRDQRALYQEVMMENYDNVAALGLWIPKPELISWLEGGEDAFIRDSKEVEGFAGDTTVN

SEQ ID NO: 29855 - protein, 81 aa, Paroedura picta
KAALVTFEEVAMYFSEEEWRLLGETQRQIYREVMLDNYGNVQSLGFPIQKPYLISRMESGKDQDPCFCDPPKSDRKEARKD

SEQ ID NO: 29856 - protein, 81 aa, Paroedura picta
PVTFEEVAIYFTKDEMALLDLAQKALYAEVMLENYIAVVSLGDVLGSKTEGELPQLLLGGAKDAEKMGSQHRAKETQRSRS

SEQ ID NO: 29857 - protein, 81 aa, Podarcis muralis
QGLVCFEDVAVHFTDKELALLDPDQRALHEEVMEENCGLLDSLGGDEMEINNKGNQERVHTVEEPYKYSDGEDNFSQSSQT

SEQ ID NO: 29858 - protein, 81 aa, Podarcis muralis
EKALVTFEEVGVYFFEEEWRFLDETQRQIYREVMLENYENVRSLGFPTRKPDLISKMESSKNPVPCFQDLQESKKGVPPRD

SEQ ID NO: 29859 - protein, 81 aa, Paroedura picta
SLMFFEEVAVFFTREEWALLDSGQRKVFWEVMEENYEAVTSLGAYLGEMVGEKEPGRVILKKDEAKFRDQVIPKRQKRTKR

SEQ ID NO: 29860 - protein, 81 aa, Alligator sinensis
SKILEAFEDVAVFFTREEWELLEAGDKGLYQDQMLRNYQALVSLGLQGPAPDLICRMQLGEMELWVCDDEEAGESSLSEDF

SEQ ID NO: 29861 - protein, 81 aa, Alligator sinensis
MELQEVFEDVAMYFTREEWELLEEEDKGLYQDQMLRNYQALLSLGYQGPTPDLIGRIQRGQVELWVCDDEDRGEISKSEDL

SEQ ID NO: 29862 - protein, 81 aa, Paroedura picta
NKGLVTLEDVSVHFTPEEWALLDPGQRALHTEVMMENCRNLASLVELLILESDLASWLEEGQDPFSQGVEGGERMSGREVK

SEQ ID NO: 29863 - protein, 81 aa, Paroedura picta
PAASVEPEQASVEEEWALLDPDQRRLHREVMEENRQGVSSLEADFSHNKSKAEPQQHPLEEKPERRNPGTKQGRENEWPVS

SEQ ID NO: 29864 - protein, 81 aa, Lithobates catesbeianus
IRCQDVTVYFSMKEWEYLEGHKDLYKDVMMENQRTFSHGHIIKKPYHLSKVILNHTLEVINLLTGEVKMILGLYNHITYLC

SEQ ID NO: 29865 - protein, 81 aa, Lithobates catesbeianus
INLLTGEVPIRCQDVAVYFSMEEWEYLEGNKDLYKDIIMENQPPLTSPGKRRFYCKGESSTEGPLRLTSNAESIPIFSLCL

SEQ ID NO: 29866 - protein, 81 aa, Terrapene carolina
EELVTWKEETVCSSGAERAELDPGQSEICREVKEENKEDILILLEGFTIPDLAAIPRMEPEEEPRVPNLQGSEEREIPKGA

SEQ ID NO: 29867 - protein, 81 aa, Terrapene carolina
PYACCECGKTAAAARPYACCECGKTFTRGSHLIRHQRTHTGTRPYEIWFPLSKPEVMSQLEPGEEPWVSDLQGSEAREILI

SEQ ID NO: 29868 - protein, 81 aa, Paroedura picta
VQSPFAFEEVAVSFTEAEWALLDLGQRALYREVMLENYGSVASLEGDQSNEEDEQLEIKNEVQRGSIRSQGRPRREGGSHA

SEQ ID NO: 29869 - protein, 81 aa, Paroedura picta
HFLAVLPGEMQSWVRECEPETCAQAVAAAEDFVMFLEQQGLVTFEEVAVRFTEEEWALLDQDQRALHSEIMQGNFANVAYL

SEQ ID NO: 29870 - protein, 81 aa, Paroedura picta
CPVSFEEVAVYFTEAEWALLDQGQRALYREVMLDNYRSVASLSRNGRGTTVETEEGLESSSRGFQQNVSFPSELSAAGDAE

SEQ ID NO: 29871 - protein, 81 aa, Alligator sinensis
MELREVFEAVAVYFTRKEWELLGDEDKVLYRDQMLRNFHALVSLGYRGPTPDLICHIRRGEVELWVCEEEKLGENPWSGSL

SEQ ID NO: 29872 - protein, 81 aa, Paroedura picta
QSLPSFEEVVVDFTEAEWALLDLGQKALYREVMLENYGSVAFLEDNRGNEEDEELHHLSPGELKKEDLRENIRNQDGPKRQ

SEQ ID NO: 29873 - protein, 81 aa, Paroedura picta
VSLEEVDVDFTREEWELLDPGQRALAMEVTLENFGNVASLEADGARNKSKGESQQHLLEEQLDGRNPGMKQERGNKFPASP

SEQ ID NO: 29874 - protein, 81 aa, Paroedura picta
LCRGMETSGPPLGQAEWALLDPGQRALYREVMQENYGNVASLARNVKETMVETDKGLALEEWLESFSRRCRERISLPDEQP

SEQ ID NO: 29875 - protein, 81 aa, Paroedura picta
SEVEGDIHVQDVLPCGTGEMPFGCHLFGAVEMTDSLPVQVPFSFKEVSVSLTEAEWALLDPSQRALYREVMLENSETVISL

SEQ ID NO: 29876 - protein, 81 aa, Paroedura picta
EKNQEQQISKYHFIVRRLCHQTRETPSFCDRIATMKPEQGRVTLEEVSVRFSEEEWALLDPDQRNLHQEVMEENGQNVASL

SEQ ID NO: 29877 - protein, 81 aa, Paroedura picta
VEGPVSFEEVAVYFTEEEWALLDLGQRALYREVMMENFGSVAFVEGPWTCKPDLISWLEEVGEILVQDSAKVKASTADLPC

SEQ ID NO: 29878 - protein, 81 aa, Paroedura picta
KAKQEAPAGFGTASLTLLGPSPLCPGVGGAIIRPARTEEGPVSFEEVDVDFTQEEWELLDPGQRALAMEVTLENLGNVASL

SEQ ID NO: 29879 - protein, 81 aa, Paroedura picta
PEEWQRAQAQEALSHGSGGTLSSPGLFRGVEMTPAPPVQFMFSFEDVAVYLTEAEWALLDPGQRALYGEVMLENYGNVASL

SEQ ID NO: 29880 - protein, 81 aa, Paroedura picta
SKGSVSFEEVAVYFTEEEWALLDPGQRALYTEVMLEIYGNLASQGLWTCKPDLISWLEELDAVFVQDSEDKESSTGTSLDV

SEQ ID NO: 29881 - protein, 81 aa, Alligator sinensis
NELLEAFEDVAVYFTQKEWELLEAGDKELYRDQMLRNYQALVSLGYQGPAPDLICRIQRGEMELWVGDKKAAGESSLSEDL

SEQ ID NO: 29882 - protein, 81 aa, Paroedura picta
DQSPVTFEEVHVYFTEEEWSLLDPDQRALYIEVMLENCGNVASLDGGLQWKDTLCCLPFGEGKGATMKPAQGGVSFEEVAV

SEQ ID NO: 29883 - protein, 81 aa, Paroedura picta
GRVTLEEVSVYFTQEEWALLDPDQRNLHQEVMAENGQNVASLENDVPQNTYKEEAQRFIFEEKEQRRNTETEWEVGNESSS

SEQ ID NO: 29884 - protein, 81 aa, Paroedura picta
SDEGLVSFEEVAVRFTEEEWALLSQGQRALYKEVMLENYENVTFLSFLRPDSLSCLEEDEGPFGLDSEEEEWSAATEMAAT

SEQ ID NO: 29885 - protein, 81 aa, Microcaecilia unicolor
RKVSVTFSDVAACVSEEEWEILDDWERDLYRNVMREIHMVLISLGYTIVNPNVLLRIKPGEALNFRDPVDFEGTVGMRSPG

SEQ ID NO: 29886 - protein, 81 aa, Pantherophis guttatus
PGSSKEAVQLAMAYHKQEPAKPIQDMITFEDVSIHFTAEEWTLLDHKEKNLYWNVMHQNYDNVACLGKNSEEILERSSSED

SEQ ID NO: 29887 - protein, 81 aa, Pantherophis guttatus
LVSFEEVAVSFSEEEWSQLDPDQKALHSEVMLENHRNVVSLGNNGQENQDSCELFQVINAKDGTEKFGIRMEFESHERNQS

SEQ ID NO: 29888 - protein, 81 aa, Pantherophis guttatus
LVTFEEVAVHFSEEEWSQLGPDQKELHWEVMVENHRNVASLGNNVQENQDSFEMFQVINAGDGTEKSAIQKEIERHERNQL

SEQ ID NO: 29889 - protein, 81 aa, Pantherophis guttatus
VSFEEVAVYFSKEEWSQLDSDQKALHGEVMLENSRNLASLGYNGQENKNCNKECQPIYLKEGKGKQYQCMERGKAFTHSSN

SEQ ID NO: 29890 - protein, 81 aa, Pantherophis guttatus
QQCPVAFQDVAVYFTPEEWDLLDNEQRILYYTVMQENSENVTSLELLISKPDPYLQLDWGEISQMADLQTMKGKDTIDQGI

SEQ ID NO: 29891 - protein, 81 aa, Pantherophis guttatus
VSDSDPFEEVAMDFTEEEWALLDSGQKALCREVMLEVSMNLAALAGDGDSDELGNEDEKQPPLLTLQKAPSAKSHAFSFTS

SEQ ID NO: 29892 - protein, 81 aa, Xenopus laevis
RKTPTAFNRIAVYFSDEEWEMLEEWQRDLYKNTMKENSEALTSLGYSNISPNILLKIKDEDVMRFTSDCSPEDVEQADNPN

SEQ ID NO: 29893 - protein, 81 aa, Pantherophis guttatus
NHMSFEDIAVFFSEEEWALLNPDQKLLYREIMLENARNVTCIGERWENEDSKKEMIEHLPTVNNEITERMFRCQWGVQSPE

SEQ ID NO: 29894 - protein, 81 aa, Pantherophis guttatus
ATIEELAVYFTEEEWVLLDPDQKALYKQIMEENFEIVTSLRHDQYKVKENPTGTKPYMCLECGKSFGYKINLTSHQRIHTG

SEQ ID NO: 29895 - protein, 81 aa, Pantherophis guttatus
LVSFEEVTVYFSKEEWSQLDPDQRALHWEVMLENHRNLVSLGKGLLRSTHKIWEDSFKLDEMNYFFFLFVISLLKISCRNK

SEQ ID NO: 29896 - protein, 81 aa, Pantherophis guttatus
GLVSFEEVAVYFSKEEWSQLAPDQKLLHSEVMLENHRNVASLGNNGQENKDTEEPFQVFNAGDETEKSEIQMEIESHERNQ

SEQ ID NO: 29897 - protein, 81 aa, Pantherophis guttatus
GLVFFEQVAVCFSEEEWSQLDAQQKVLHWEVMLENHRNVASLSNNGEENEESEDLFQTMSRKYSTKNYAIQMVVESHERNH

SEQ ID NO: 29898 - protein, 81 aa, Pantherophis guttatus
GLVFFEEVAVYFSKEEWCQLDAQQKVLHWDVMLENHRNVASLSNNGEENEDSEDLFQTMSHKYSTKNPAIQMVVKSHERNQ

SEQ ID NO: 29899 - protein, 81 aa, Notechis scutatus
LATIEELAVYFTEEEWILLDPDQKALYKQIMEENFEIVTSLRRDRYKTKEHLTGTKPYMCLECGKSFGYKNHLTCHRRIHT

SEQ ID NO: 29900 - protein, 81 aa, Pantherophis guttatus
SVSFKEVAVYFSKEEWSRLDAHQKALHKEVMLENSRNVASLGGNEQGNKKCKEILQTLMLEEGKELFANQTEPKTRGESHS

SEQ ID NO: 29901 - protein, 81 aa, Pantherophis guttatus
PQDVVSFEEVAVYFSEEEWSQLDADQKALHGEVMLETIRNLSSLGKMSAKRKSYSVEFKKGIVEDSLGKNLVAFCKEKKLD

SEQ ID NO: 29902 - protein, 81 aa, Pantherophis guttatus
VSFEEVAVYFSEEEWSQLDPDQKALHSEVMLENHRNVVSLDTETGSHLWSLQGKLFSWGKKKKGGITWRAQLWSTRNGPVK

SEQ ID NO: 29903 - protein, 81 aa, Pantherophis guttatus
DFVSLEEVTVHFSKEEWSQLDPDQKALHGEVMLENSRNLVYLGYNGQESKNCKEECQAIHSKGRKGKFADQMQPKSDETKQ

SEQ ID NO: 29904 - protein, 81 aa, Pantherophis guttatus
MVPVSFEDVAVYFTDEECPLLNASQVALQLEVMVENYQNMTSLGREAWWNEDEDESQRVSLKRARSTQEGLQSEGTEERVK

SEQ ID NO: 29905 - protein, 81 aa, Pantherophis guttatus
LVSFEEVAVYFSEEEWSQLDPHQKALHSEVLLENYRNVASLGNNGQENKESMEPFQKFRLGNRTEKPANQMEQQKQERNPS

SEQ ID NO: 29906 - protein, 81 aa, Pantherophis guttatus
LVSFEEVAVCFSKEEWTQLDPRQKALHGEVMRENLRNVASVDTVGQENTCYRQILEALRRKEGRDQTELKSHERNQSKYGS

SEQ ID NO: 29907 - protein, 81 aa, Pantherophis guttatus
LVSFKEVAVYFSKEEWSQLDPDQKALYSEVMLENYRNVVSLGNNGQENQDSCELFKVINAKDGTEKFGIQMELETHNRKQS

SEQ ID NO: 29908 - protein, 81 aa, Pantherophis guttatus
LVSFKEVAVSFSEEEWSQLDSDQKALHLEVMLENHRNVVSLGNSEQENQDSCELFQVLNRNDGTEKFGIQMELESHEKKQS

SEQ ID NO: 29909 - protein, 81 aa, Pantherophis guttatus
LVSFKEVAVYFSEEEWSQLDPDQKALHSEVMLENHRNVVSLGNNGQENQDSCELFQVINAKDGTEKFGIRMELETHDRNQS

SEQ ID NO: 29910 - protein, 81 aa, Pantherophis guttatus
VSFQDVVVCFSKEEWALLDSTQKSLHGEVMEENSRHVASLEADENSENWQPSDTATSQPTRAKVGNEIFENRRRSGTFGEK

SEQ ID NO: 29911 - protein, 81 aa, Pantherophis guttatus
QQWPVAFEEVAVYFTPEEWDLLDEEQRILYYTVMQENSENVTSLELLVSKPDPRLQTVWEEGLQMADLQIFKEKDSIVKGI

SEQ ID NO: 29912 - protein, 81 aa, Pantherophis guttatus
QKCPMAFQDVAIYFTQDEWDLLNEEQRILYYTVMRENSENITSLELLISKPDQSLQSDWDEEAQRAFKGKDSIEEVVNWED

SEQ ID NO: 29913 - protein, 81 aa, Xenopus laevis
AQDPVTFDDISVYFSRDEWALLDAGQKQLYREVMAENYRALVSVGYVMEEPGLVSHIEHEQQGSPIRSRSSLHAGRHCGFI

SEQ ID NO: 29914 - protein, 81 aa, Alligator mississippiensis
REAFGDVAMYFTREEWELLEEEDKGLYRDQMLRNHQTLVSLVFCFVVCSPNRSQPAVLHGQTLKTEPVAVLQEVLQEHSSE

SEQ ID NO: 29915 - protein, 81 aa, Alligator mississippiensis
DKGLVTFKDVALYFTKEQWALLDPGQKALYRDVMQENYETVTSLGLLIPKYNMISQLEEGTKPWSPDPQGEIPRDADTQKA

SEQ ID NO: 29916 - protein, 81 aa, Notechis scutatus
IRDPEGKKNPSNPPRELFFRKIPWEDPRQDPSGEKQRMKISGFYEGDQTAVEPPNQEGLVSFEEVAVYFSEEEWSQLDPDQ

SEQ ID NO: 29917 - protein, 81 aa, Notechis scutatus
LVSFEEVAVYFSEEEWSQLDPDQKALHLEVMLENHRSVVSLGNNGQGNQDSCELFQVISAKDGTEKFGIQMELESHETNQS

SEQ ID NO: 29918 - protein, 81 aa, Pantherophis guttatus
SKELMDLKDAGVSLNVVEPTPIQSGQQTMFWQVMQEEDGDAESLEGLLVPKPDLASNPEEGEEEPSYIQFPVDSERIPNHE

SEQ ID NO: 29919 - protein, 81 aa, Pantherophis guttatus
VSFEEVAVYFSKEEWSQLDSDQKALHGEVMLENSRNLASLGYNGQENKNCNMECQPIYSKEGKGKQYQCMECGKTFTHSSN

SEQ ID NO: 29920 - protein, 81 aa, Pantherophis guttatus
DSDPFEEVAMDFTEEEWALLDSGQKALCREVMLEVSMNLAALGDGDSDELGNEDEKQPPLLTLQKAPSAKSHAFSFTSPNI

SEQ ID NO: 29921 - protein, 81 aa, Xenopus laevis
RKTPTTFNRIAVYFSDEEWEMLEEWQRDLYKNMIKENSEALTSLGYSNINPNILKIKDEDVKHFTADCSPDDVEQADSPKA

SEQ ID NO: 29922 - protein, 81 aa, Pantherophis guttatus
ISFKELFVFFTKEEWDLLDPKQKALHGEVMLETSWNVASLYNERKNEIYQEPEDKPLQVFKVKVGEETFQNQWQRISEDGI

SEQ ID NO: 29923 - protein, 81 aa, Pantherophis guttatus
DPFEEVAVDFTEEEWALLDSSQKALCREVMLEVTRNMAALGDGDGLENEKQLKLQRAVSSKSQSDFCTRHNLTHHQRSHSS

SEQ ID NO: 29924 - protein, 81 aa, Notechis scutatus
DPVSFEEVAIHFTSEEWSLLDLGQKALHQEVMLETCRIMASLDDEPKNENDQEPNVLPSQIILESAKKSGRKRCEKNQSCN

SEQ ID NO: 29925 - protein, 81 aa, Pantherophis guttatus
SPNQESLVSFKEVAVSFSEEEWSLLDPDQKALHSEVMLENHRNVASLGEKPYKCMECGKTFAQRGHLTSHKMIHTREKPYK

SEQ ID NO: 29926 - protein, 81 aa, Pantherophis guttatus
EKQRMKLSGFSDGDQTAVEPPNQESLVSFEEVAVSFSEEEWSQLDPDQKALHSEVMLENHRNVASLGKSSLVSNQRVQEDR

SEQ ID NO: 29927 - protein, 81 aa, Pantherophis guttatus
LVSFEEVAVYFPEEEWSQLDPHQRALHWEVMVENYKNVVSLGENENDNKDSGEPIKVFRQGDVMEKPAIQSEFQRQERNLS

SEQ ID NO: 29928 - protein, 81 aa, Pantherophis guttatus
LVSFKEVAVSFSEEEWSLLDPDQKALHSEVMLENHRNVASLGNNGQENQDFCELFQVIDAKDGTEKFGIRMELETHERNQS

SEQ ID NO: 29929 - protein, 81 aa, Notechis scutatus
GVSFEDVAVYFSKEEWSQLDADQKELYRAVMLENSRNLASLGYNGQKNKNCKEKCQAIHLKEGKEKRYQCMECGKMYTQSS

SEQ ID NO: 29930 - protein, 81 aa, Notechis scutatus
LVSFEDVTVFFSEEEWALLDFDQKSLYREVMLENAKHVESMVDKQEPENYKESDVNSLKQTETGEGILQNQEEPNMIENQL

SEQ ID NO: 29931 - protein, 81 aa, Notechis scutatus
GVVSFEDVAVYFSKEEWSQLDADQKALHGEVMLENSRNLFSLGFNGQEIKNCNEECQAIHRKKEKGKFADQTQSNSDETKQ

SEQ ID NO: 29932 - protein, 81 aa, Notechis scutatus
GSGPFEEVTVDFTLEEWELLDSGQKTLCREVMWEILKNMAALGGDGLENENSKQAKLKTEKGEVEEVIFGHEEDTRRQERN

SEQ ID NO: 29933 - protein, 81 aa, Alligator mississippiensis
ESMEHQEVFEHMALYFMRKEWELLEDADKVLYRNQMLKNYQALVNLGSLGEMDSLRSEKEPWHKSHGRPQKQKNIAVNEHQ

SEQ ID NO: 29934 - protein, 81 aa, Notechis scutatus
RKLSLVFLERPSLCDRAERVAEPLPQGGVSFEEVAVHFSEEEWSQLDPAQKALHGEVMLENSRNLASLGKNLCAQKCREGM

SEQ ID NO: 29935 - protein, 81 aa, Notechis scutatus
GVSFEEVAVYFSKEEWSQLDADQKALHREVMLENSRNLASLGYNEQKNKNCKEEGQAIHLKEGKEKRYQCMECGKTYIHSS

SEQ ID NO: 29936 - protein, 81 aa, Notechis scutatus
VVLGETSLSGETETNVGLPGQGTISFKELFVFFTEEEWDLLDPKQKALHGEVMLETSWNVASLCKKSPIQIWCFVIGSHLF

SEQ ID NO: 29937 - protein, 81 aa, Alligator mississippiensis
MELREAFEDVAVYFTRKEWERLEDGDKGLYRDQMLRNYQALISLGFLSTPCNSVIWGQATAPHGCCGSMKSPVIHGSYYPP

SEQ ID NO: 29938 - protein, 81 aa, Notechis scutatus
LDHVMLEEVSVTFSEEEWALLDPDQRALHRDVMAENSGIASSLGSDWLESESGEIYEILFGKIGSEEEDKQRPDTEAGKVK

SEQ ID NO: 29939 - protein, 81 aa, Notechis scutatus
DIVTFEEVAVYFSKEEWSQLDADQQELYREVMLENSRNLLSLGFNGQENKKCKEERQAIHSKGAERKFVDQMQPKSDETKQ

SEQ ID NO: 29940 - protein, 81 aa, Notechis scutatus
PLSTSTAINFSGEEWTLLDFDQKTIYTEVMLENAKIVASIRDEQKFEDDKKPVAEKLQAVKNKIKETFFENPQGPKRPKEN

SEQ ID NO: 29941 - protein, 81 aa, Alligator mississippiensis
GEAPVTFEDVAVYLTTEEWKELVDWQRELYQDVMKENYELATSVEAVLEKPEIVARLERGEEPYVADLLDSRKGRRAGSPS

SEQ ID NO: 29942 - protein, 81 aa, Notechis scutatus
QEDQSQDATQESRKLTVDFLESPLCAGAEPVLQDIFSFEEVAVYFSEEEWSQLDADQKALHAEVMLENSRNLFSLCKKPFL

SEQ ID NO: 29943 - protein, 81 aa, Notechis scutatus
IVPFEEVAVYFSDEEWSQLDPHQKGLHREVMLENYRNAASLGNNGQENTESIEPFQKFRLGNRTEKPANQMEQQRQERNLS

SEQ ID NO: 29944 - protein, 81 aa, Notechis scutatus
SISFKEVAIYFTKEEWALLDPDQKALHEEIMLETCRNVAFLSNERKNKQETEIEPLRVIKVEVGEETFQNQCPSKNPEEIQ

SEQ ID NO: 29945 - protein, 81 aa, Notechis scutatus
SVPFEEVAVEFTEEEWALLNSGQKALCREVMLDVSANIASLTGDCDWNGLENKKDKQQRLLKRQRGVSAESHSFSFTIPNI

SEQ ID NO: 29946 - protein, 81 aa, Alligator mississippiensis
PETVVSFEDVAVRFSPDEWHLLDDGQRRLYRDVLRENYSHVRSLGFPVPDLAVIFRMERGEEPWPPGLPAGEWPWGQGQAP

SEQ ID NO: 29947 - protein, 81 aa, Alligator mississippiensis
TRDPGQLHRGQGKPPKQELREAFEDVAVYFTQKEWELLGDEDKELYRNQMLRNYQALVSLGAIDSLLQSLSTTWVSRTIVY

SEQ ID NO: 29948 - protein, 81 aa, Notechis scutatus
LVSFKDVAVYFSEEEWSRLDPDQKALHSEVMLENHRNVVSLGNNGQENQDSYELFQVINAKDGTEKFGIQIEFESHERNQS

SEQ ID NO: 29949 - protein, 81 aa, Notechis scutatus
VSFEEVAVHFSKEEWSQLDTDQKALHGEVMLENSRNLASLGYNGQKNTNCKEECQAIHSKEGKGKQYQCIECGKIFTHSSS

SEQ ID NO: 29950 - protein, 81 aa, Alligator mississippiensis
GRPPNQGETVELPKVFEEVAVYFTRKEWELLEDEDKVLYRDQMLKNYQALVSLDHTPITVIRRNGLGAGPSENQFSFPEDL

SEQ ID NO: 29951 - protein, 81 aa, Notechis scutatus
FRRIPWEDQSEDISKEKQRMKFSVFYDGAQTAVDPPNQGSLVSFEEVAVYFSEEEWSQLDSDQKALHSEVMLENYRNVVSL

SEQ ID NO: 29952 - protein, 81 aa, Alligator mississippiensis
RISPGRLEESGSRTPEPGQVQKGQDRPPKLGETLELWEVFENVALHFTRTEWELLEDEDKVLYRDQMLRNYQALVSLVLSS

SEQ ID NO: 29953 - protein, 81 aa, Notechis scutatus
LVSFEEVAVYFSEEEWSQLDPDQKALHSEVMLENHRNVVSLGNNGQENQDSCELFQVISAKDGTEKFGIRMEFENHKRNQS

SEQ ID NO: 29954 - protein, 81 aa, Notechis scutatus
DLQSLEDLAVHFSKEEWSQLDPNQKALHGEVMLEISRNVAFLSVNGQENENDKELCQTISQKAGKEKIQVQQNHVGESFIF

SEQ ID NO: 29955 - protein, 81 aa, Notechis scutatus
EGLVSFEEVAVYFSKEEWSQLDPDQKVLHLEVMLENHRNVASLDNSKENKDTEEPFQVFNAGDETQKSEIQMEIESHERNQ

SEQ ID NO: 29956 - protein, 81 aa, Notechis scutatus
GLVSFKEVAVYFSEEEWSELDPDQKALHWEVMMENYRNVASLEDEWEMLSSGHEAAAPLPKDKVKTAETFFGKQNSEEKRL

SEQ ID NO: 29957 - protein, 81 aa, Notechis scutatus
VQDFVTFEDVAVYFSAEEWSQLDPDQKALHKEVMLENYRNVASLEKLLYRCRECGESFSSNSSLISHQITHTGVKPYKCME

SEQ ID NO: 29958 - protein, 81 aa, Alligator mississippiensis
KLREAFEDVAVYFTQEEWELLEEEDKGLYRDQMLRNYQALISLGKALVLALPWSHSGYEKRIRPHGTTIVAAAAFLDAFQK

SEQ ID NO: 29959 - protein, 81 aa, Alligator mississippiensis
RLGERSSLTPEPGQVQKGQSRPPKQEESLELQEVFEDMAVYFTRKEWELLEDEDKVLYRDEMLKNYQALVSLGKALVLASP

SEQ ID NO: 29960 - protein, 81 aa, Alligator mississippiensis
VQKGQGMPPNQEESSELREMFEDVAVYFTRKEWELLDDEDKVLYRDQMVKNHQALISLGKALGLASPRRYANSFVVTSLFQ

SEQ ID NO: 29961 - protein, 81 aa, Notechis scutatus
GVSFEDVAVYFSKEEWSQLDPVQKALHGEVMLENSRNLASLGYNGQKNKNYKEECQAIHFLCKGKRYQCMECGKSFSYYIS

SEQ ID NO: 29962 - protein, 81 aa, Notechis scutatus
LVSFEEVAVCFSKEEWTQLNPHQKALHGEVMRENLRNVASLDTVGQENMCCRQILEALRRKEGRDQTELKSYERNQSKDGS

SEQ ID NO: 29963 - protein, 81 aa, Notechis scutatus
LVSFEEVAVYFSEEEWSQLDPDQKALHSEVMLENHRNVVSLGNNGQEDQDSCKPFQVMTAKDGMEKFVIRAEFESHERNQS

SEQ ID NO: 29964 - protein, 81 aa, Alligator mississippiensis
RMGEMGSLMPEPGQLEKGQSMPPKQGESLELWDAFEDVALHFTRKEWELLEDEDKVLYRDQMLRNYQALISLGKALVLGYP

SEQ ID NO: 29965 - protein, 81 aa, Notechis scutatus
NFQEDQSQDATQESRKLSLDFLESPLCAGAEGLAEPLLQDIVSYEEVAVYFSEEEWSQLDADQKELYREVMLENSRNLFSL

SEQ ID NO: 29966 - protein, 81 aa, Notechis scutatus
LVSFEEVAVYFSEDEWSQLDPDQKALHLEVMLENHRNVVSLGDNGQENQDSSELFQVINAKGGTDKFGIRMEFESHEINQS

SEQ ID NO: 29967 - protein, 81 aa, Alligator mississippiensis
SKILEAFEDVAVFFTREEWELLEAGDKGLYQNQMLRNYQALVSLGLQGPAPDLICRMQLGEMELWVCDDEEAGESSLSEDF

SEQ ID NO: 29968 - protein, 81 aa, Alligator mississippiensis
EGQGRPAKQGESMQLWEVFEDVAVYFTREEWELLEEEDKGLYRDQMLMNHQALLSLGLPEIKDKHCRWVSPKHWGMWSMSA

SEQ ID NO: 29969 - protein, 81 aa, Notechis scutatus
LVSFEEVAVYFSKEEWSQLDPDQKALHSEVMLENYRNVVSLGYNGQENQNSCELFQVISAKDGREKFGIRMEFESHERNQS

SEQ ID NO: 29970 - protein, 81 aa, Notechis scutatus
SGEKQRMKISGFYEGNQTAVEPPNQEGLVSFEEVAVYFSEEEWSQLDPDQKALHSEVMLENHRNVVSLGKIFLVPNQEERL

SEQ ID NO: 29971 - protein, 81 aa, Notechis scutatus
LVSFEEVAVYFSEEEWSQLDPDQKALHLEVMLENHRSVVSLGNNGQGNQDSCELFQVISAKDGTEKFGIQVELESHETNQS

SEQ ID NO: 29972 - protein, 81 aa, Notechis scutatus
NEPPVPFKDIDVKFSNEEWALLTEEQRALYDDVTQENFQNLSTLGIPLEKPEIITRTQQGGDLYFQNNTINSPKVQFIGSQ

SEQ ID NO: 29973 - protein, 81 aa, Micrurus lemniscatus
QDLVSFEDVAVFFSMEEWALLDSEQKALYRKVMLESKRNVAFLRPLMAFSSSPGTSVLCNGGSTAAELPTQDLVSFEDVAV

SEQ ID NO: 29974 - protein, 81 aa, Gopherus agassizii
VTFEEVAVYFSEEEWALLDPGQRALYRDVMQENYETVISLGKDFCPLSPEQVALCGMLCGRSEGHVSQSPEQRETCKRQHK

SEQ ID NO: 29975 - protein, 81 aa, Podarcis muralis
PVCFEDVAVRFTDEEWELLDPDQRAMHKDVMEGNRGIVASLDCGELESKNKEEHNTICRVEKARKKLECGKSCSQSSHSTS

SEQ ID NO: 29976 - protein, 81 aa, Gopherus agassizii
QMPVTFEEVAVYFTQGQGALLDPAQRALYRDVMQENYETVTSLGKGFPSPRLLEQTTPKEDKHHEWFGYGNEFILRPQFVS

SEQ ID NO: 29977 - protein, 81 aa, Podarcis muralis
GPLETTALNFSTAEWTLSDIWQKHLSRGSKLEGDRDAGLLGGGRSEDQKSLLLRRSEQMTTLKQAKENVVQCPNQGDALKN

SEQ ID NO: 29978 - protein, 81 aa, Microcaecilia unicolor
NKALVTFKDVTGYFLDVDWDILGERQKELYKKVIKEIHDILMSRGYSIVNPDVIFKIKKEDEKYFTQQFEWEGKENSNDST

SEQ ID NO: 29979 - protein, 81 aa, Microcaecilia unicolor
IKASNKFKDVSAYFLEANWDILGEWQKELYKKVIKEIHDTLISRGYSILNPDVIFKIKKEDEKYFTQQCEWEGKENPNDST

SEQ ID NO: 29980 - protein, 81 aa, Microcaecilia unicolor
NEALVIFKDVAAYFLEVDWDILGERQKELYKKVIKEIHDILMSRGYSIVNPDVIFKIKKEDEKYFSHQSEWEGKENLNDST

SEQ ID NO: 29981 - protein, 81 aa, Microcaecilia unicolor
HLALVTFADIAAYFWEVEWDVLGERRKELYKKVIKEIHSILISRGYSIANPDAVFKIKKEDKKYFTQSCEWEAKESLNDPL

SEQ ID NO: 29982 - protein, 81 aa, Micrurus paraensis
LEQFLSVLPVDMQTWLNAQEPGSSKEAIQLALAYHKQEPAKPIQDMITFEDVSIHFTEEEWTLLDHKEKNLYWNVMHQNYD

SEQ ID NO: 29983 - protein, 81 aa, Microcaecilia unicolor
SHEALVTFKDVAAYFLDWDLLGEWQKELYKKVIKEIHNILMSRGYSIVNPDVIFKIEKEDEKYFTQQSEWERKKTPNDSTN

SEQ ID NO: 29984 - protein, 81 aa, Lithobates catesbeianus
ITVPPPSFLTLERNSKKILEVTKKMTKLLTGEVPIRCQDVTVYFSMEEWEFLERHKDLYKDVMMENQPPLTWPGKMNLNCK

SEQ ID NO: 29985 - protein, 81 aa, Microcaecilia unicolor
ARALVTFHDVAIYFSDEEWQLLEEWQKELYKNVMTEIHEALIILGHTSTSPGISCRIKEEEEPYFGDHDNSSRNLSKRPTA

SEQ ID NO: 29986 - protein, 81 aa, Microcaecilia unicolor
NEALVIFKDVAAYFLEVDWDILGERQKDLYKKVIKEIHDILMSRGYSIVNPDVVFKIENEDEKYFTQQSEWKGKENPNDSN

SEQ ID NO: 29987 - protein, 81 aa, Microcaecilia unicolor
NEVLVTFKDVSAYFLEMDWDLLGERQKELYKKVIKEIHDILISRGYSIVNPDVIFKIKKEDEKYFNHQFEWEGQENPNDST

SEQ ID NO: 29988 - protein, 81 aa, Terrapene carolina
PKVPVTFDDISVYFNEQEWKSLSEWQKELYKNTMKGNYETLISLDYAVSKPDILSRIERGEEPYIGDPRDSEERKISVEPC

SEQ ID NO: 29989 - protein, 81 aa, Microcaecilia unicolor
NEALVTFRDVAAYFLDVEWDILGERQKELYKEVIKEIHDILLSQGYSIVNPDVIFKIKKEDEKYFTQQFEWEGKENLNDSN

SEQ ID NO: 29990 - protein, 81 aa, Microcaecilia unicolor
HEALVTFKDVAAYFLEVDWDLLGERQKELYKKVIKEIHDILTSRGYSIINPDIIFKIEKEDEKYFTQQSEWEGKKTPNDST

SEQ ID NO: 29991 - protein, 81 aa, Microcaecilia unicolor
NEALVTFKDVAAYFLEVDWDLLGDWQKELYKKVIKEIHAILLSRGYSIVNPDALFKIKMEDEKYFTQQFKWEGKENPNDFN

SEQ ID NO: 29992 - protein, 81 aa, Microcaecilia unicolor
PEASDEATIKASNEALVTFKIVAAYFMEVEWNILEEWQKELYKKVIREIHDILISRSKCAYVIDDRGTYYGISGVKFTGTR

SEQ ID NO: 29993 - protein, 81 aa, Lithobates catesbeianus
VPIRCQDVTVYFSMEEWEYLEGHKDLYKDIMMENQSPLTSMDGSSNGNPPERWPHPLYSRDSTQEDHTIPQLYIGYSHLKQ

SEQ ID NO: 29994 - protein, 81 aa, Terrapene carolina
APVVFEEVAVYFTPAEWAPLDQRQRDLYRDVMQENFRNIHLLGEASSPLDISCCLVSGVQVTQRSHLIQHQRVHTGEKPYP

SEQ ID NO: 29995 - protein, 81 aa, Microcaecilia unicolor
HEALVTFKDVSAYFVEVDWDLLGEWQKELYKKVIKEIHDILMSRGYSIVNPDVIFKIKREDEKYFTQQFEWEGKENLNDST

SEQ ID NO: 29996 - protein, 81 aa, Microcaecilia unicolor
RQEPVTFDDIAVYFSEEEWSILEDWQKEVYKNVMRENYDMLVSLGFPVPSSEVFLSLVERQKAPCTESPRHWGERDMLSRS

SEQ ID NO: 29997 - protein, 81 aa, Microcaecilia unicolor
NEALVTFKDVAAYFLDVDWDLLGERQKELYKKLIKEIHNILISRGYSIVNPDVIFKIKKEDEKYFTQQFEWEGKENPNDST

SEQ ID NO: 29998 - protein, 81 aa, Lithobates catesbeianus
YFSPIRCQDVTVYFSMEEWEYIEGHKDLYKDVMMENQPPLTSPDGSSNGNPPERCPRPLYSRDSTQEDQEIPQVDHQVLQD

SEQ ID NO: 29999 - protein, 81 aa, Lithobates catesbeianus
PLLALQENNEKKILEVTKKMMELLTGEVPIRCQDVTVYFSMEEWEYLEGHKDLYKDIMMENQSPLTSMGKRRLYCKESRNT

SEQ ID NO: 30000 - protein, 81 aa, Microcaecilia unicolor
NEALVTVKDVAAYFSEVNWDILGEWQKEMYMTVVKEIHDILISRGYSILNPVVIFKIKMEQKYFTQQFEWEGKENPNDSTN

SEQ ID NO: 30001 - protein, 81 aa, Microcaecilia unicolor
IEALVEFRDVALCFTKEEWMQLEEWQKQLYRNVIQEIHQTLISLGYTILKSDILIRIRDEDEHYISDQDEPQKHECHNGPT

SEQ ID NO: 30002 - protein, 81 aa, Microcaecilia unicolor
IKASNQFKDVAAYFLEADWDLLGEWQKQLYKKVIKEIHVILISRGYSIVNPDVIFKIKKEDEKYFTQQCEWEGKENPNGST

SEQ ID NO: 30003 - protein, 81 aa, Microcaecilia unicolor
NEALVTFKDVAAYFLEVDWDLLGGRQKELYKKVIKEIHDILISRGYSILNPDQEEDLPFMENPESQMSEQTLPSVTDDGFG

SEQ ID NO: 30004 - protein, 81 aa, Xenopus tropicalis
PTTFNRIAVYFSDEEWEMLEEWQRDLYKNMIKENSEALTSLDYSVSPNILLNIKDEDVKHYTSNSSPDDVEQAQSPKTEDH

SEQ ID NO: 30005 - protein, 81 aa, Microcaecilia unicolor
NEVLVAFKDVAAYFLEVDWDILGEWQKELYKKVVKEIHDILISQGYSIVNPDVIFKIKNEDEKYFTPHFEWEEKGNPDLMK

SEQ ID NO: 30006 - protein, 81 aa, Microcaecilia unicolor
GNLTTTGTSEELQEACDEASIKASDEVLVTFKDVAAYFSEVDWDILGEWHKELYKKVIKEIHDILMSRGYSIVSPDVEIGH

SEQ ID NO: 30007 - protein, 81 aa, Notechis scutatus
LVSFEEVAVYFSEEEWSQLDPDQKSLHWEVMLENHRNLVSLGNNGQENQDSSELSQVINAKDGTEKFGIRMEFESHERNQS

SEQ ID NO: 30008 - protein, 81 aa, Notechis scutatus
LPPTQGFISFEEVAVDFTLEEWALLDWSQKALWREVMLEIFLNIAALAGYGQSDENDQHAWLAPLQTAEYEMEEVMFGHQG

SEQ ID NO: 30009 - protein, 81 aa, Pantherophis guttatus
SLVTFKEVAVNFSEEEWSQLDPDQKLLHWEVMLENHRNVASLDDNRQESQDSCELFQVINAGEGMEKSAIQMEAESHERKQ

SEQ ID NO: 30010 - protein, 81 aa, Pantherophis guttatus
LLPFKEVAVYFSEEEWSQLNPHQRALHWEVMLENYKNVASLGANENDNKVSGEPIKLFRQRDVMENPIIQMEFQRQERNPS

SEQ ID NO: 30011 - protein, 81 aa, Pantherophis guttatus
QEGLVSFKEVAVYFSEEEWSQLDADQKALYREVMLENHRNVTSLGNNGEEDEDSRELFEMISHSYSMKNRIILMEVESHER

SEQ ID NO: 30012 - protein, 81 aa, Pantherophis guttatus
HLVSFEEVAVYFSEEEWSQLDAAQKALHWEVMLENHRNVASLGNNGQENKDSCELFQVISAGDRTFPIQMKKERHERNQSN

SEQ ID NO: 30013 - protein, 81 aa, Pantherophis guttatus
PQDDVSFEEVAVYFSEEEWSQLDADQKALHGEVMLETIRNLSSLGKMSAKRKSYSVEFKKGIVEDSLGKNLTAFCKEKKLD

SEQ ID NO: 30014 - protein, 81 aa, Pantherophis guttatus
PQDVVSFEEVAVYFSEEEWSQLDPAQKALHGEVMLENSRNLASLGYNRQENKNYKAEGQAMHPKEEKGKFADQSSETSQSQ

SEQ ID NO: 30015 - protein, 81 aa, Pantherophis guttatus
LVSFKEVAVSFSEEEWSLLDPDQKALHSEVMLENHRNVASLGNNGQENQDSCELFQVINAKDGREKFGIRMELESHERNQS

SEQ ID NO: 30016 - protein, 81 aa, Gopherus agassizii
PVQFKDVAVTLTEAEWLLLDEEQRQLYGTVMQENYRSISSLGYVSTNPPSLVSSANLLRVQSTPSSRSLMKILNKTGSPTS

SEQ ID NO: 30017 - protein, 81 aa, Micrurus lemniscatus
SSSQEMFFRRISRDDPYQDTNRGKNRRKFTIPDGGTETMIETPIQEGLVSFEDVAVYFSEEEWTELDPDQKALHREVILEN

SEQ ID NO: 30018 - protein, 81 aa, Pantherophis guttatus
LVSFKEVAVYFSEEEWSQLDPDQKALHSEVMLENHRNVVSLGNNGQENQDSCELFKVINAKDGTEKFGIQMELETHNRKQS

SEQ ID NO: 30019 - protein, 81 aa, Micrurus lemniscatus
RNVASLDPLMAFSSSPGTSVLCNGGSTAAELPTQDLVSFEDVAVFFSMEEWALLDSEQKALYREVMLENKRNVASLGDGWE

SEQ ID NO: 30020 - protein, 81 aa, Micrurus lemniscatus
DLVSFEDVAVFFSMEEWALLDSEQKALYRKVMLESKRNVAFLRKGFYYDTVVQYIVVAFTIYSLPFVKNQIQSCTCFAGKE

SEQ ID NO: 30021 - protein, 81 aa, Pantherophis guttatus
VSFEEVAVHFSEEEWSQLDADQKALHGEVMLENSRNLFSLGFNGQENKNCKEECQAILLKKEKGKFAIQMQPKSNETKQSQ

SEQ ID NO: 30022 - protein, 81 aa, Podarcis muralis
SSVSFEDVAVCFTAEEWALLDPAQRALHKEVMEETWRTMISLGKVPCWVIISVLEFSRYFSGTNLPYLDGSQRCHLDFSQS

SEQ ID NO: 30023 - protein, 81 aa, Podarcis muralis
VFILLICCSYRERIFLQKRVLIPLRQRGLRWTPERGLCFEDVAVCFMAEEWALLDPAQRALHKEVMEENCGILASLSKVPS

SEQ ID NO: 30024 - protein, 81 aa, Alligator sinensis
LELQQVFEDVAVCFTRKEWKLLEDDDKVLYRDQMLRNYQALVSLGYRGPTPDLICRIQRGEVELWVCEDEDQEKILKLEDL

SEQ ID NO: 30025 - protein, 81 aa, Paroedura picta
AQSPFSLEEVSIIFTEAEWALLDPGQRALYKEVMLENSGHVAFLARSIRETMVKMENSFGKDREQLEHSSRGSQEHICFPN

SEQ ID NO: 30026 - protein, 81 aa, Paroedura picta
RQAEQTWGPPVKTEAAFSEAEGASLEQGQQDRVQRPVSFEEVAVYFTEAEWALLDSEQRALCKEVILEIYGNVDFLGKDLS

SEQ ID NO: 30027 - protein, 81 aa, Paroedura picta
EQGRVTLEEVSVHFSEEEWALLDADQRNLHQEVMAENRQEVASLETLLLLRPDSMSTMDEAGNLFLQDPEERKRSAEVDSE

SEQ ID NO: 30028 - protein, 81 aa, Podarcis muralis
QGPVCFEDVAVCFTDEEWALLDPDQRALHKDVMEENRGIVASLDCDELEIESKGDNEKFPREEKPVKNLECGESCSQSSHS

SEQ ID NO: 30029 - protein, 81 aa, Paroedura picta
SLPSFEEVAVDFTEAEWALLDSGQRALHWEVMLENYGSVAFLASNVREVTVEPGRGLASFSRGPPERISFPNNPVERKAEE

SEQ ID NO: 30030 - protein, 81 aa, Alligator sinensis
AEEGPVILELQRTCAGSLWELLDDEDKVLYQDQMVKNYQALVSLGYRGPTPDLICSIQRGQVELWVCGDEEIGEISRSEYV

SEQ ID NO: 30031 - protein, 81 aa, Paroedura picta
PPVSFEEVTVSFTGEEWALLDPGQRKVFWEVMEDNSETVASLEDSISQKALRAPERRTLPFLGDQSEVFPHSGDGSLWAVQ

SEQ ID NO: 30032 - protein, 81 aa, Paroedura picta
SGLPVSFKEVAVFFTQEEWALLDPAQRALYWEGFGTLDHPLMHGTEQGKCDPSTAVRNQEGVQVAPCQGPSEKMNGRHSPL

SEQ ID NO: 30033 - protein, 81 aa, Paroedura picta
CPFSLEEVSVSFTEAEWALLDPGERALHWEVMLEFFGDVVFLVENDERNEEVDEINHRMSEGDQNVKDFKENIQNQGGKAA

SEQ ID NO: 30034 - protein, 81 aa, Paroedura picta
QCAPVTFEDVAVHFTEGEWALLRPKQRALYKEVMQENYNIVVSLGYPVAKPDLICRLEGGEVLWLPDPLGTTLRDMPPDYS

SEQ ID NO: 30035 - protein, 81 aa, Paroedura picta
PPVQTPFSFEEVAVSFTEAEWALLDPGQRALYREVMLETYETVASLGTLLPPPTLLSAKEPRNVKETAAETDKSLPPKERL

SEQ ID NO: 30036 - protein, 81 aa, Paroedura picta
PVAFQEVAVYFTQEEWDLLDEDQRYLYYSVMQENSENMASLGKDPFHEILCATSDPVLHPGCVEESHIVKLQKTNKKEITA

SEQ ID NO: 30037 - protein, 81 aa, Paroedura picta
AQGGVSFEEVAVHLSPAEWALLHPAQRALYKEVMLENFGIVASLGPWISKPDFISRLEEGEEPFLLGPEEAEGLAAGGRWQ

SEQ ID NO: 30038 - protein, 81 aa, Chelonia mydas
QLEQGEEPLRNHIHISLQVGPSSRRQRREMAVMEPAQMPVTFEEVAVYFTPGQGALLDPAQRALYRDVMQENYETVTSLAQ

SEQ ID NO: 30039 - protein, 81 aa, Anolis carolinensis
VIFEDVAVHFSVEEWALLDPDQRALHWEVMEENYRMVSSLGGDAQGSENGEVQNKMWLKIARSKKEEERSVRIEAGEYKRK

SEQ ID NO: 30040 - protein, 81 aa, Anolis carolinensis
DQVMFEDVAVHFSEAEWALLNTDQRSLHREVMEENYRMVSSLGDDGQGSENGGAPNKMWLKTGRRKKEAERSPRIEAEGYN

SEQ ID NO: 30041 - protein, 81 aa, Anolis carolinensis
ITLSVTFEDVSVDFSEEEWALLDPSQKALHQQIVEENLGIVSSLGKAPVITSNLNYVWKQMGSQWSRGSHGEKMISMLEAW

SEQ ID NO: 30042 - protein, 81 aa, Anolis carolinensis
NAEQCNEVSFEELAVYFTAEEWALLDPSQRRLHEEIMTENWGTVSFLGEPPPFLGLDRFNSRKSPWLKSGIQKNSRRGPHF

SEQ ID NO: 30043 - protein, 81 aa, Anolis carolinensis
DQVIFEDVSVDFSEEEWALLDPSQKALHQQIMEENLGIVSSLAMPIEETPFKYLQDGMDFNSKETLTFSQETHTRDKPFKC

SEQ ID NO: 30044 - protein, 81 aa, Anolis carolinensis
IIMGPQTKARGPDAALQGHLPGPRPQFYNIIFLYKQQQGSITFEDLAVNFSLEEWMLLNPGQKVLHMQIMEEIRGIVDSLG

SEQ ID NO: 30045 - protein, 81 aa, Anolis carolinensis
AEEETEKQQQVPPERGESEPTHTGFPLPFDAFSTHSVTPHQVTFQEVAVSFSEEEWALLNPDQRALHQQVMKENFETLSSL

SEQ ID NO: 30046 - protein, 81 aa, Anolis carolinensis
QGPIAFEDVAVHFSLEEWALLNPDQKALHMQIIKQINGIVDSLDKQEKNRKDGLKTEILKWLQKVSPSLNGVETNKERAHR

SEQ ID NO: 30047 - protein, 81 aa, Anolis carolinensis
KQQATFEEVAVYFTEEEWDLLDPEQRDLHREVMEESMEVLSFLDGENKENSTEVSLVKNKTDKTWSGHIWVRKTRFKPEKK

SEQ ID NO: 30048 - protein, 81 aa, Anolis carolinensis
QMTFEDVSLHFSKEEWELLDSDQQTLHWEVMEENYKMLASFGGPGQVSEYAPCKTWLKTEDCKDEEAENLRMEAEVYRGNQ

SEQ ID NO: 30049 - protein, 81 aa, Anolis carolinensis
RSYPCIEVTRYLDDVAVDFSLEEWVLLNPDQKALHKQIMEEMNGIVDSLDWLERGAGEWLIKHQLSSLSESHTRIGEHGKR

SEQ ID NO: 30050 - protein, 81 aa, Anolis carolinensis
KKPPVPFKDVSVKFSDAEWTLLSDKQRTLYQDVMLENFQNVSSLGFPREKYKLIVPIKKGGELDFQDDAERGYFLEREVTG

SEQ ID NO: 30051 - protein, 81 aa, Anolis carolinensis
ADRCLVMFEEVAVNFSPEEWALLDSDQRALHREVMEENHEIVTSLASVPEPNTNQKEEEEEDLKVPDSQVVGLTKILETGD

SEQ ID NO: 30052 - protein, 81 aa, Anolis carolinensis
VSHCCFSPFPVKKRSGLLGDQAGGVILHNYLMSDTVDFEDVAVHFSEEEWALLDLNQRALHTEVMEKNYGMVASLGKGLLA

SEQ ID NO: 30053 - protein, 81 aa, Anolis carolinensis
PVTFEEVAVSFLPEEWGFLNADQRALYNEVMEETCSIMSALGNWKGKNAFANHRNPHTQIFPKHEEACIEEKCPEEMSCIC

SEQ ID NO: 30054 - protein, 81 aa, Anolis carolinensis
GAETSSQAVALAEGFLLSREQERKQDKLQVTFQDVSVDFTEEEQALLDPGQRALHQQVMEEDLEIVSSLGKAPLFILKPAL

SEQ ID NO: 30055 - protein, 81 aa, Anolis carolinensis
NQGPIAFEDVTVHFSSEEWVILNLGQKILHMQIMEEIHGIVASLADNWKESNEYTKRRKRLGHNGSLPRHQQTHSEDEDSA

SEQ ID NO: 30056 - protein, 81 aa, Anolis carolinensis
SSTTFRNSFLRRDSVGPDQDIFNECVIQSHKSQLQVTFEDVSVDFSEDEWALLDLNQKALHQQIMEENLGIVTTLGKAPLC

SEQ ID NO: 30057 - protein, 81 aa, Anolis carolinensis
QNQVTFEDVAVTFSDAEWALLDPDQQVLYKEVMDQNVKMVVSFGGDGQGSKNGQVPCEGWLQTDRCVEENITTEAEESRRS

SEQ ID NO: 30058 - protein, 81 aa, Anolis carolinensis
IAFEDVAVDFSLEEWVLLNPDQKALHKQIMEEMNGIVDSLVSQIEASLSLSLSLSECLCERQGEGGSRLAGERGQRMDHEE

SEQ ID NO: 30059 - protein, 81 aa, Anolis carolinensis
DQVIFEDVAVHFSVEEWASLDPDQRALHWEVMEENYRMVASLGGDGQGSKNRGVPNKMWLKTGRSKKVEERSPRMEAEGYN

SEQ ID NO: 30060 - protein, 81 aa, Anolis carolinensis
QEEERKREKPQVQDSFPDETNQGEESVSHIWLVHIGEGSDQVIFEDVSVDFSEEEWALLDPSQKALHQQIMEENLGIVSSL

SEQ ID NO: 30061 - protein, 81 aa, Anolis carolinensis
PDQAIFQEVAVSFSKEEWALLDPDQRDLHQKVMEENLEAVASLGAGDWENVKEELVRSLMEGDRSAEREDRVISFWTVRQT

SEQ ID NO: 30062 - protein, 81 aa, Anolis carolinensis
EEERKREKPQVQDSFPDETNQGEESVSHIWLVHIGEGSDQVIFEDVSVDFSEEEWALLDPSQKALHQQIMEENLGIVSSLG

SEQ ID NO: 30063 - protein, 81 aa, Anolis carolinensis
YQVTFEDVAVYFTEEEWALLNPGQKALHWEVMQENLGVLFSLASDGEMDQYKGESCQTLLQRDHCKQLNETERETDTKGMW

SEQ ID NO: 30064 - protein, 81 aa, Thamnophis sirtalis
RESRRLSLEMLESPPLCAGAEELAEPLRRAVVSFEEVAVYFSEEEWSQLDADQKALHGQVMLENSRNLASLGKNPHLCSET

SEQ ID NO: 30065 - protein, 81 aa, Thamnophis sirtalis
LMTFEDVAVSFSEEEWSQLDPDEKILHSEVMLENHRNVVSLGNNGQEKQDSCELFQVISAKDGTEKFGIQMEIESHDRNQS

SEQ ID NO: 30066 - protein, 81 aa, Thamnophis sirtalis
KKRMKFSGFSDGDQATAESPNQESLVSFEEVAVYFSEEEWFQLDPDQKALHSEVMLENHRDVVSLGKSFLVPNQRVQEDRL

SEQ ID NO: 30067 - protein, 81 aa, Thamnophis sirtalis
PVSFEDVTVFFSEEEWVLLDFDQKSLYREVMLENATNVEFVVDRQKPENCNESGVNSLKRTETGEEILQNQEEPNMTKNQL

SEQ ID NO: 30068 - protein, 81 aa, Pogona vitticeps
AAFEEVTVSFSQEEWALLDPDQRALHQKVMEENWQMVSSLNHLNGKNVCSKYEKSFTHNLETAGHQRNNTEEDNYIQEKPY

SEQ ID NO: 30069 - protein, 81 aa, Pogona vitticeps
ECPVTFEEVAVCFTQEEWALMDPDQRALYREVMEENWRIVASPSMPDIICTDHEQNRISEPQQNHKSSNRLGNVKREGGNS

SEQ ID NO: 30070 - protein, 81 aa, Pogona vitticeps
VPVTFEDVAVCFTEEEWVLLDPGQRTLQWEVMLENYMNLNYPADDALDDEEKEESCRVSLKKARDVERTEQSEATETEAAR

SEQ ID NO: 30071 - protein, 81 aa, Chelonia mydas
PSIMMPVTFAEVAVYFTQGQGALLDPTQRALYTDVMQENYETVTSLVGFCPGQHVVSGGLLFQGPVTFEEVAVYFTLGQGA

SEQ ID NO: 30072 - protein, 81 aa, Chelonia mydas
PQVPVTFNDVSVYFNEQEWESLDEWQKELYKNVMKGNYETLISLDYAISKPDILARIEQGEEPCVRDQQDSEKAEIPVEPC

SEQ ID NO: 30073 - protein, 81 aa, Pogona vitticeps
LVIFQDVAVGFAEEEWALMDLNQKALHKDVMEDISWMLGSLGNTVASEANPRSSPLLGRVGTFSRSCFPISRHTKNILNGP

SEQ ID NO: 30074 - protein, 81 aa, Pogona vitticeps
QVPVTFEEVTVHFTEEEWLLLDPAQRVLHEEVMEENHTNVASLGDWGKRRNESKELRIKTENKEDWRQGSIMSKGSAFWEI

SEQ ID NO: 30075 - protein, 81 aa, Pogona vitticeps
DQGPVTFEEVAVHFTQEEWALLDRDQRSLHREVMEENRTIVASLGNLRKRNVWGKCEKYFMHTTGLDGHLQTHTKGESCTR

SEQ ID NO: 30076 - protein, 81 aa, Pogona vitticeps
LMTFEDIAVHFTEEEWTLLDEDQRALHREVMEENIASLISLATLTREKRSEEEGGIISLRPLIDIKWKQPLESSGSISGRS

SEQ ID NO: 30077 - protein, 81 aa, Pogona vitticeps
PVTFDEVAVNFTEAEWALLDHNQRACHRDVMEETRENVVSLAHEGRHSENQEELYWLDLETDVCKESYLQGRRCEANKHNR

SEQ ID NO: 30078 - protein, 81 aa, Pogona vitticeps
DPVTLEDVAVSFTEEEWALLDPGQRALHWEVMKENLAHVVSLAPGVGGSRSEEEWLQICLEKFTEREKTQGIKTESEEKRN

SEQ ID NO: 30079 - protein, 81 aa, Pogona vitticeps
DWAAFADLAVYFTEEEWALLDPGQRTLHTQVMEENYELLTSLRKDSSSTIKSGENTSGGLENAEVVNETSAFNVHEIIPAR

SEQ ID NO: 30080 - protein, 81 aa, Pogona vitticeps
DPVTFQDVAVYFSEEEWTLLDPGQKALHREVVEENLAHLVSLAPDTRRNRNEKEQLQICLKRITKKEGKRQKRKKTEVEQK

SEQ ID NO: 30081 - protein, 81 aa, Pogona vitticeps
DVLATFEDIAVHFMEEEWALLNERQRALHRKVMEENVASLISLAMSRRVKMSEEEEGAVFLGAIMAKKQKEPLKCSKTVPR

SEQ ID NO: 30082 - protein, 81 aa, Pogona vitticeps
PVALEDVAVSFTDDEWALLDRGQRALHWEVMVENFANVVSLASGMREDRSKEDQDEVFLENSTKEEGKPQRRKAEIEEKRN

SEQ ID NO: 30083 - protein, 81 aa, Pogona vitticeps
SALRDVRTMLETDPRSSLRCEGTETAPVRMEQGPVTLEDVGVSFTGEEWALLDPGQRALHWEVMEENLALLVSLGKLSFPS

SEQ ID NO: 30084 - protein, 81 aa, Pogona vitticeps
GPVTFEEVAVSFTQEEWALLDPDQRALHQEVMEENWQMISSLDNWRDKKMCPKSENTFMHKSEFTEHKRIHADVESCIREK

SEQ ID NO: 30085 - protein, 81 aa, Pogona vitticeps
REGNQEETDRSATLQGVGTRLATHAESSLLLDDGEKGEESPVTFEEVTVDFTQEEWALLDPDQRALHKEVMEENWGMVVSL

SEQ ID NO: 30086 - protein, 81 aa, Pogona vitticeps
KVQKLLLAFEEVAVYFSREEWDLLDLGQRALYRGVMLENYGNVASVAPKPALISMLEEGDDPFVQDSLDTEMSAGGCPGDR

SEQ ID NO: 30087 - protein, 81 aa, Pogona vitticeps
RAHMGICEEVVVHFTAEEWALLDPDQKALYWEVLLENYRNVASLGLPVPTSDVLSCLEKSDGPFVEGSKEGETPDVTAPVG

SEQ ID NO: 30088 - protein, 81 aa, Pogona vitticeps
SVMMAFEDIAVHFAEEEWALLDKDQKALHREVMAENVVSLISLATGTREKRSEEEGGIDMDEKQKEVLKGSTALSDRRSLG

SEQ ID NO: 30089 - protein, 81 aa, Pogona vitticeps
VADAFEELAVSFTEEELALLDPVQRALYREVMEENLAHAVFLAGEVGERRSKEEQHQICLGKCTEAKKTQGIKTETVEKKD

SEQ ID NO: 30090 - protein, 81 aa, Pogona vitticeps
NEPPIPLEDVCVKFSEEEWALLTEEQRALYRDIVLENFQNASALGIPQEKPTLIKQIQEERIPCFQDYVLRGDSQDNPFTG

SEQ ID NO: 30091 - protein, 81 aa, Pogona vitticeps
KKALVTFDEVAVYFSEEQLNLLDKTQSGIYREVMLENFENVQSLGFPVHKPDLIFEMEKSKNQEIFSQDPENSKEGTPMGT

SEQ ID NO: 30092 - protein, 81 aa, Pogona vitticeps
GPVAFEDIAMHFSEEEWALLDPGQRALHWEVMVENFAHVVSLAPGVGERKGEEEPLQVLEKGEEKEKKPQKMKTETEMKKN

SEQ ID NO: 30093 - protein, 81 aa, Pogona vitticeps
GEEAVFIDLGNQQGTHPCSSLFDGRMATASVQLEQGPVAFEDLAVLFSEEEWALLDPGQKALHWEVMEENWAHLMSLDPCV

SEQ ID NO: 30094 - protein, 81 aa, Pogona vitticeps
GNLMATQAGSGPSPLYGQVERDAIKPLRQLVSFEEVAVCFTKGEWALLEPAEKVLYKEVMLANYGVVASLGKDTFPLIDIN

SEQ ID NO: 30095 - protein, 81 aa, Pogona vitticeps
PVTFDDVAVNFTEAEWALLDQNQRACHRDVMEETRENVVALARDVRDSKNEEELHGVCLDRVIGKESEHQGRRNEAKTHGR

SEQ ID NO: 30096 - protein, 81 aa, Pogona vitticeps
DIADDLQNPVSLEDVAVYFTGEEWSLLDPDQKALYTEVMLENYKNVASSAWKSDLVSQSEEKEDLWFSRVQDVDGAEATES

SEQ ID NO: 30097 - protein, 81 aa, Pogona vitticeps
VAFEDIAVHFSEEEWALLDPSQRTLHQEVMEENFAILLSVAPGVRERRPEEGGLQKCLGNVTEKEEKPQRRETGIEQKGNE

SEQ ID NO: 30098 - protein, 81 aa, Pogona vitticeps
VPVTFEEVTVHFTEEEWLLLDPAQRVLHEEVMEENHTNVASLAGDWGKRRNESKELRIKTENKEDWRQGSIMSKGSAFWEI

SEQ ID NO: 30099 - protein, 81 aa, Pogona vitticeps
LCPVTFGEVAVCFTQEEWALMDPDQRALHREVMEENWRIVASPSMPDIICTDHEQNRISEPQQDHKSSDRLGNVKREPGYS

SEQ ID NO: 30100 - protein, 81 aa, Pogona vitticeps
AVVTFEEVAVDFTLEEWALLDPEQRALHREVMEENRLFVASLADQEIYAREETYTCTMCGKHFAERLALTLHEQIHTEDLC

SEQ ID NO: 30101 - protein, 81 aa, Pogona vitticeps
DAVVPFEEVTVRFSKEERALMDPGQKALHREVMEENYGMVASLGDGRESSKGSEQQMRETEAKHKWNKSVSSREMDPLEIP

SEQ ID NO: 30102 - protein, 81 aa, Pogona vitticeps
GRERSALQLSKLVSFQEVAIYFTQEEWELLNPGQRALYNEVMLENYGTVSSLGRNHFPLVSFQEVAIYFTQEEWELLNPGQ

SEQ ID NO: 30103 - protein, 81 aa, Pogona vitticeps
VTFEEVAVNFTQEEWVLLDPDQRFLHREVMEENRSIVASFDGGENISAAAEPLDFPATITPLHGNEKGDLCLTADEVSCAT

SEQ ID NO: 30104 - protein, 81 aa, Pogona vitticeps
NEESSSSVGSVKIPATSIPSSLPGDAVELDQGPVTFEEVAVSFTQEEWALLDPDQKALHQEVMEENWQMLSSVGKTPFFSS

SEQ ID NO: 30105 - protein, 81 aa, Pogona vitticeps
HLPQLMAFKEVAVHFTQREWNFLDLGQRALYHEVMVEIWEMVCSLAIPKPDLIFSLEEGDDPFVQDSEEQKKWQGACLGDD

SEQ ID NO: 30106 - protein, 81 aa, Micrurus surinamensis
ETMIETPIQEGLVSFEDVAVYFSEEEWTELDPDQKALHRKVMLENYRNVASLGDDEQDHKEPRESFQGFRHGDVMEKRAIQ

SEQ ID NO: 30107 - protein, 81 aa, Pogona vitticeps
PQDWVTFEDVAVHFTEQEYALLDPAQKALHWEVMEEVSAHVAFVGDKENEEQRTKTECEQQQSTSLPHHPGIQTAEKKFKC

SEQ ID NO: 30108 - protein, 81 aa, Geotrypetes seraphini
NEASVIFKDVAAYFLEMEWNILEEWQKELYKKAMKEVLDILMSRGYSVVYPDIIFKIRKEDEKYFTQHFEWEGKENPNDST

SEQ ID NO: 30109 - protein, 81 aa, Alligator sinensis
LELRDVFEDVAVYFTRKEWELLEDDDKVLYQDEMLKNYQALISLGHRGPTPDLICRIQCGQVELWVCDDEDSGEISRSEDL

SEQ ID NO: 30110 - protein, 81 aa, Geotrypetes seraphini
QLALVSFSDLAAYFRQEEWDFLGERQKELYRKVIKYLHGILVSRGSSIVNPDVTLKIKKADEKYFTQCCEWEGKENLNDPL

SEQ ID NO: 30111 - protein, 81 aa, Notechis scutatus
QQCPVAFQDVAVYFTPEEWDLLDNEQRILYYTVMQENSENMTSLELLISKPDPCLQLDWEEISQMTDLQTLKGKDTIDQGV

SEQ ID NO: 30112 - protein, 81 aa, Pantherophis guttatus
VSFEEVAVHFTSEEWSLLDSRQKALHQEVTLEASRIVNSLVDVQKNENYQEPSVVPSQIIRTEIQEEISASKWGRRRYDKK

SEQ ID NO: 30113 - protein, 81 aa, Thamnophis sirtalis
KKALVTFEEVSMYFSEEEWRLLDESQRKIFTKVMMENYENVRELGFPTNNPDLVFKMGRNKNNELYMDKIQNLEEGASPEV

SEQ ID NO: 30114 - protein, 81 aa, Pantherophis guttatus
SWNTSGEKQRMKFSSFYDGDQTAVEPPNQEGFVSFEEVAVSFSEEEWSQLDPDQKALHSEVMLENHRNVVSLGKRFLVPNQ

SEQ ID NO: 30115 - protein, 81 aa, Micrurus spixii
QAWVRARNPSTSQEAAQLAETYLEQQWPVAFEEVAVYFTPEEWDLLNEEQRILYYTVMQENSENVISLGKVPIPVKPYKPF

SEQ ID NO: 30116 - protein, 81 aa, Micrurus spixii
SSQEMFFRRISQDDPYQDTNRGKNRRKFTIPDGGTETMIETPIQEGLVSFEDVAVYFSEEEWTELDPDQKALHREVMLENY

SEQ ID NO: 30117 - protein, 81 aa, Micrurus spixii
QQWPVAFEEVAVYFTPEEWDLLNEEQRILYYTVMQENSENVISLELLVSKPDLRVQTEWEEELQMADFLLFKKKDSIVEGV

SEQ ID NO: 30118 - protein, 81 aa, Micrurus lemniscatus
DVGNHIPKGLVSFEEVAVYFSEEEWSQMDAHQKALHKEVMLENSQNVASLGAREQENEGCKEPFQKINQKKEERLKKREKP

SEQ ID NO: 30119 - protein, 81 aa, Micrurus spixii
DLVSFEDVAVSFSEEEWALLDSEQKALYREVMLENKRNVASLGDGWEMEDSGQEAAAPLPKDKKEEKIYRKQSSEKIQLTG

SEQ ID NO: 30120 - protein, 81 aa, Micrurus spixii
DLVSFEDVAVSFSEEEWALLDSEQKALYREVMLENKRNVASLGDGWEMEDSGQEAAAPLPKDKKEIAEKMYGKQSLEENQL

SEQ ID NO: 30121 - protein, 81 aa, Anolis carolinensis
VRRNSLGLNHQTSVETENIEPRNILLIHQGPIAFEDVAVQFSLEEWVLLNPDQKVLHMQIMEEIPEAPCRSLHPVHLLSKP

SEQ ID NO: 30122 - protein, 81 aa, Anolis carolinensis
QGPIAFEDVAVHFSLEEWILLNPDQKVLHMQTMEEIHGIVDSLDLSQQEIFEETEDFVSQECEEYFLQRLHLVKHERFHTG

SEQ ID NO: 30123 - protein, 81 aa, Anolis carolinensis
PHQVTFQEVAVSFSEEEWALLDPDQRALHQQVMKENLETVSSLKTHREGESSQYGDCGEKKDLGLSGQQAMYAKRKPFKCL

SEQ ID NO: 30124 - protein, 81 aa, Anolis carolinensis
QDQVTIEDVSIHFSEEEWTLLDRHQRALHWEVMGENYKMLASFGDDGQGSQSPPKCSQLEESSGCRIPLFHHETSHREDKP

SEQ ID NO: 30125 - protein, 81 aa, Anolis carolinensis
PIAFEDVAVDFSLEEWVLLNPDQKALHKQIMEEMNGIVDSLGKAPSLMGISISKCSIIPRSKPSEQMQLRPRSKKNCTDRL

SEQ ID NO: 30126 - protein, 81 aa, Anolis carolinensis
DQMMFEDVAVHFTVEEWALLDLNQQALHWEVMEENYRIVASLGGDGQGSENGGAPNKMWLKTGRSKKVEERSLRMEAEGYN

SEQ ID NO: 30127 - protein, 81 aa, Anolis carolinensis
EEIAFEDVAVNFSPEEWVTLNPDQKVLHVQIMEEIRGIVDSLADNWKKSNVCTKNRKHFEHNGGLPIHQQTNREDGNSARE

SEQ ID NO: 30128 - protein, 81 aa, Anolis carolinensis
RRVIFEEVAVYFTEEEWALLDSGQRALHWEVMEENLGILSSLGDKSFSRKETLLRHQATHTGEKPFKCLECGKSFSRKINL

SEQ ID NO: 30129 - protein, 81 aa, Anolis carolinensis
EQVTFEEVAVFFTEEEWALLNPGQWALHREVMQENLGLVSSLGGEEQLGEIEGKPFKALSRGSKCQQMEKNGRNPDSQQKG

SEQ ID NO: 30130 - protein, 81 aa, Anolis carolinensis
DQVTLDELAVGFTPEEWALLDPEQRALHKEVMEENYGMVASLGDTAPLGGRNEDEPCLTWLENANWKEDEELSIDTEGELE

SEQ ID NO: 30131 - protein, 81 aa, Anolis carolinensis
GKNEEKTKDVAVDFSLEEWVLLNPDQKALHKQIMEEMNGIVGSLEIYDIRVIIKITNSDSKMEEWSSPKVTDVNAPTPPDA

SEQ ID NO: 30132 - protein, 81 aa, Anolis carolinensis
AQLAEAYFRECQPDHAIQSSFHLDYQENVSVSFTTEEWALLNHGEKSLYWNVMHQNYDNVTGLVSLSLTHTHTHTHKDCTP

SEQ ID NO: 30133 - protein, 81 aa, Anolis carolinensis
EGPIAFEDVAVDFSLEEWVLLNPDQKALHKQIMEEMNGIVDSLGKAPSLMGISVSKVNDWGSGPFVHRERHRAAVKLCPSP

SEQ ID NO: 30134 - protein, 81 aa, Anolis carolinensis
ETGPVTFEAIAVYFTKEEWALLDPGQRTLYWEVMEENLTNLMSLIPSVSGSKNEKELQRRFLEGLVGKEGRRQTRQNEITQ

SEQ ID NO: 30135 - protein, 81 aa, Anolis carolinensis
GPDQVTFEDVSVDFSEEEWALLDPSQKVLHQQIMEENLGMVSSLEETQFEYLEDGMNFNRKEALTFSQETHTRDKPFKCLE

SEQ ID NO: 30136 - protein, 81 aa, Anolis carolinensis
QDLVSFEEVAVRFTEEEWALLSPDQKTLHRQVMEENSKNLISVGDWRNNEKTNQERKKTEAKEKRRKESIASEGVEFDNCT

SEQ ID NO: 30137 - protein, 81 aa, Anolis carolinensis
CLDVEVSMSFLPEEWALLNPDQRALFKEVMEETLKTISVLKHQTCKKKNSMQALRGFLRFLRAEGQNIWGPTSQGSYVQVT

SEQ ID NO: 30138 - protein, 81 aa, Anolis carolinensis
LHCVQDVAVDFSLEEWVLLNPDQKALHKQIMEEMNGIVASLGKAPSLMGFLFQKLKWEDFHNWSQVKVSRRGIEQPSNSAP

SEQ ID NO: 30139 - protein, 81 aa, Anolis carolinensis
QGLVSFEEVAVRFSEEEWALLDADQRALHRDVIEETRGIVASLGAMRKNKSKDEQERPQSTSEQTGMQKCGFPESVGSHKI

SEQ ID NO: 30140 - protein, 81 aa, Anolis carolinensis
LHGEVTFEEIAVDFSEEEWALLDPGQRALHTEVICSNLTRNRVGFTQVNSKQLLAPLNTFLPMVPASCLGSDLLFLAFQGG

SEQ ID NO: 30141 - protein, 81 aa, Thamnophis sirtalis
ASVSFEEVAVYFVAEEWEILDSNQKALHREVMLENSQHVTALACEQESENYKEENAARLQTAQNEAEEETFGNKGETNSSE

SEQ ID NO: 30142 - protein, 81 aa, Thamnophis sirtalis
AVSFKEVAVYFSKDEWSRLDAHQKALHEEVMLENSRNVASLGRKGQGNKNCKETLQTWMLEEGKELFANQMEPKTSVDSCF

SEQ ID NO: 30143 - protein, 81 aa, Anolis carolinensis
CGHHQGPIAFEDVAVHFSLEEWVLLNPDQKILHMQTMEEIHEIVDSLVESHLSKLNGPAEPWVMILQIKHKNIMLYNKFDR

SEQ ID NO: 30144 - protein, 81 aa, Anolis carolinensis
PVMFEDVAVHFSEEEWALLDVDQRSLHWEIMEPPHCQTATYFTAKQQNMKEGTPGAVSPLNSHLGSSSALQDEVEGQLVST

SEQ ID NO: 30145 - protein, 81 aa, Anolis carolinensis
TIAYEDVAIHFSPEEWVTLNPDQKVLHLQIMEEIQGIVESLVREAYDSNQTLCPYLSNKTERHKVTPPHSRQIPDTNTADE

SEQ ID NO: 30146 - protein, 81 aa, Thamnophis sirtalis
QILVSLEEVAVCFSEEEWSRLDPVQKDLHREVMLENSRNVAFLGNNLQENKEAVQMFRDEERRKAFSYPMKTTENERNLSN

SEQ ID NO: 30147 - protein, 81 aa, Thamnophis sirtalis
IRDVASFEEVVVCFSEEEWSQLDADQKALHKEVMLENSRNLFSLGYKGQEECQVIHSKKGKRKRYQCMECGKMFTHSSSLH

SEQ ID NO: 30148 - protein, 81 aa, Anolis carolinensis
IAHLFVKQEKRSPWNRIRERRLLCVHPRGLVTFEDVSVHFTEEEWVLLDPDQRALHWEVMGENHKMLASFGYRTKNARKEQ

SEQ ID NO: 30149 - protein, 81 aa, Anolis carolinensis
RYLDDVAVDFSLEEWVLLNPDQKALHKQVMEEMNGIVDSLGKAPSLMGISVSKIPDNLSCRHLAPEHGNFWRNLPAQPVYV

SEQ ID NO: 30150 - protein, 81 aa, Anolis carolinensis
FLQEVTFQEVAVSFSEEEWALLDPDQRALHQQVMKENLETVSSLSSQQDKITLNVPFSYRTSLFGRGRNFQQATYAKRKPF

SEQ ID NO: 30151 - protein, 81 aa, Thamnophis sirtalis
GFVPFEEVAVYFSEEEWSQLDSDQKALHWEVMLENYRNMASLGNNGQENKESVELFQKFRHGNRTEKPANQMEQQRQERNP

SEQ ID NO: 30152 - protein, 81 aa, Anolis carolinensis
KRQDEQPCRDSGSFLGIRWKIVVENVFFSLQNPVTFEDVAVYFSTEEWDLLDPDQKALHAQIMTETHGIMASLGKVPSLMK

SEQ ID NO: 30153 - protein, 81 aa, Anolis carolinensis
HHQQQQQQCLTLPSLAQVVPSQGGAFQDRCIEPFQVTFQEVTVSFSEEEWAMLNPDQRALHQQVMKENVEMVSFLIWFLIR

SEQ ID NO: 30154 - protein, 81 aa, Anolis carolinensis
GAAALQGKEEPFGVFCFLFIFLDYPNGPIAFEEVAVHFSPEEWVLLTPDQKGLHVEIMEEIHGIVDSLAHSFLKTRREGNN

SEQ ID NO: 30155 - protein, 81 aa, Thamnophis sirtalis
ISFKELFVFFTKEEWDLLDPTQKALHGEVMLETSWNVASLCNEQKNEIYQEPEDTPLQIFKVKVGEETFQNHWQPKSEDGI

SEQ ID NO: 30156 - protein, 81 aa, Thamnophis sirtalis
LVSFEEVAVYFSEEEWSQLDPDQKALHSEVMLENHRNVVSLLGNNGQENQDSCELFQVKKAKDGTEKLGFEMEFESHERIQ

SEQ ID NO: 30157 - protein, 81 aa, Anolis carolinensis
VIFEEVAVSFSEEEWALLDPDQRALHKEVIEETCRIMVALASRRSFRGDTLSLAKAVFKEQPSSSSQAGTLFLFVLWQRPS

SEQ ID NO: 30158 - protein, 81 aa, Anolis carolinensis
KGPIAFEDVAVDFSLEEWVLLNPDQKALHKQIMEEMNGIVDSLVDNGEKSHVCTKYRKHLGHNGCLHRHQQAHREDGGSAR

SEQ ID NO: 30159 - protein, 81 aa, Thamnophis sirtalis
QEAAQLAEAYLEQQCPMAFQDVAVYFTQEEWDLLNEEQRILYYTVMQENSENITSLGKGSCKIKESFLKLSTLFCLYNSPY

SEQ ID NO: 30160 - protein, 81 aa, Anolis carolinensis
DQVTFEDVSVDFSEEEWALMDPSQKALHQEIMEENLGIVSSLAMSIEETSFKYLEDGMNFNRKEALTFSQETHTRDKPFKC

SEQ ID NO: 30161 - protein, 81 aa, Thamnophis sirtalis
EGMTPVIQSWWPPYGNGIETAHEEPPQDLVTFEDVAVYFTDEEWALLDPDQRALHVEVMEENCGNLAFLAGDSWKAKTEEE

SEQ ID NO: 30162 - protein, 81 aa, Thamnophis sirtalis
NEPPVPLKDIDVKFSSEEWALLTEEQRALYDDVTLENFQNVSTLGIPLEKPEIITRIQQGGELYFQNNTINSPKDRFTGNQ

SEQ ID NO: 30163 - protein, 81 aa, Micrurus corallinus
ILLALKESKIAPCLLLVTPYSSSVAFHQVSFEEVAMHFSEQEWALLNVSERALYKDVMQENYKHILSLGQLQSLLIFLSSS

SEQ ID NO: 30164 - protein, 81 aa, Thamnophis sirtalis
VVSFEEVAVYFSKEEWSQLDPAQKALHGEVMLENSRNLFSLEQYLRCYITYQQTNWAELLPFAEVAYNNAIHSSTSHTPFK

SEQ ID NO: 30165 - protein, 81 aa, Thamnophis sirtalis
VSFEEVAMHFSEQEWALLNVNERALYKDVMQENYKHILSLGEISQPGSPINTTSFGRLVDHLQATESPNSDLRYLREECQE

SEQ ID NO: 30166 - protein, 81 aa, Thamnophis sirtalis
PGQVPASFGEVAIHFNSEEWLLLDPSQKALHEEVMLETSRMVASLAFDEPDTENYQEPGVVPSQIIKIEIQRDTSADMCEK

SEQ ID NO: 30167 - protein, 81 aa, Micrurus corallinus
KDQSNKSRPESRKLSLEILESPFCGRAEGLAKLQLQGVVSFEDVAVYFSKEEWSQLDADQKALHGEVMLENSRNLASLVSH

SEQ ID NO: 30168 - protein, 81 aa, Thamnophis sirtalis
PESRKPSLEFFESPPLCGGAEELAEPLFQAVVSFEEVSVYFSEEEWSQLDADQKALHGEVMLENSRNLFSVGKNPYQCSKT

SEQ ID NO: 30169 - protein, 81 aa, Thamnophis sirtalis
ILLALKESKIAPCLLLVTPYSSSVTFRQVSFEEVAMHFSEQEWALLNVNERALYKDVMQENYKHILSLGQLQSLLISLSNP

SEQ ID NO: 30170 - protein, 81 aa, Thamnophis sirtalis
QQCPVSFEEVAVYFTPEEWDLLDDEQRILYYTVMQENSENVTSLELLISKPDPCLQLDWGEVSQMADLQTLKGKNTIDQRI

SEQ ID NO: 30171 - protein, 81 aa, Thamnophis sirtalis
VSFDEVAIYFTSEEWLLLDPSEKATYREIMLETCEIVASLVDDQENDNYQELSVVPEVIKIEIKEETSTDKFGRRQYEKKQ

SEQ ID NO: 30172 - protein, 81 aa, Thamnophis sirtalis
DSDPFEEVAVDFTEEEWALLDSGQKALCREVMLEVSMNLATLAGDGDDLRNENEKQPPLFTLQNALSAKSHSFSFALPNIP

SEQ ID NO: 30173 - protein, 81 aa, Micrurus corallinus
KPRLWMETTETSPPCGGAATSQGLASFEEVVVYFTEDEWELLDPSQRALYGDVMLENSRNMAALAYVKDHENNKKPSMVVF

SEQ ID NO: 30174 - protein, 81 aa, Micrurus corallinus
PRLWMETTETSPPCGGAATSQGLASFEEVVVYFTEDEWELLDPSQRALYGDVMLENSRNVTALGKPRLWMETTETSPLCGG

SEQ ID NO: 30175 - protein, 81 aa, Thamnophis sirtalis
LVSFEEVAVYFSKEEWSQLDPDQKALHSEVMLENHRNVVSLGNNGQENQDSCELFQVINAKDGMEKFGIRMELKSFKRNQL

SEQ ID NO: 30176 - protein, 81 aa, Thamnophis sirtalis
LVSFEEVAVYFSEEEWSQLDPDQKALHSEVMLENHRNVVSLGNNGQEDQDSCELFQVINGKDGMETFGIRMELKTHDRNQS

SEQ ID NO: 30177 - protein, 81 aa, Pelodiscus sinensis
PKVPLTFDDISVYFNEQEWKSLSDWQKVLYKDTMKGNYETLISLDYAVSKPDLLSRIERGEEPYIVDPRDSEERTVSIEPH

SEQ ID NO: 30178 - protein, 81 aa, Pelodiscus sinensis
AVELVTFEEVAVYFSEEEWALLDPGQRALYWDVMRENYEAVSWLGFPVFKTHVISWVKQREELWIPDLHGYVEGEIINDTH

SEQ ID NO: 30179 - protein, 81 aa, Pseudonaja textilis
QQCPVAFQDVAVYFTPEEWDLLDNEQRILYYMVMQENSENVTSLELLISKPDPCLQLDWEEISQMTDLQTLKEKDTIDQGV

SEQ ID NO: 30180 - protein, 81 aa, Pantherophis guttatus
LVTFEEVAVHFSEEEWSQLGPDQKELHWEVMVENHRNVASLGNNGQENQDSFELFQVINTGDGTEKSAIQKEVERHERNQL

SEQ ID NO: 30181 - protein, 81 aa, Pantherophis guttatus
VSFEEVAVYFSEEEWSQLDPDQKALHSEVMLENHRNVVSLGNNGQENQESCELFQVTNAKDETEKFGFRMEFESHERSQSN

SEQ ID NO: 30182 - protein, 81 aa, Pantherophis guttatus
APVSLKEVAVGFTEEEWALLDSSQRALHQEVMLENSRTLASLAGEGKENLAWQDLGTTPLGKSMHPIKEEKLHNQRKPERF

SEQ ID NO: 30183 - protein, 81 aa, Pantherophis guttatus
PLSFEEVAVHFSEEEWSQLDAHQKTLHWEVMLENYRNMASLGNNGKENEDCGEPFLMNTSGDRTEKSAIQMELETQERSQS

SEQ ID NO: 30184 - protein, 81 aa, Notechis scutatus
DAVSFKEVAVYFSKEEWSWLDAHQKALHEEVMLENSRNVASLGDKRQNKNCKESLQTLMLEEGKEPFANQTEPKTCSESHS

SEQ ID NO: 30185 - protein, 81 aa, Notechis scutatus
KKALVTFEEVSMYFSEEEWRLLDESQRKIFTKVMMENYENVRALGFPTNDPDLIFKMRRNESHELYTDKIENGVSPEGVSP

SEQ ID NO: 30186 - protein, 81 aa, Pantherophis guttatus
KKALVTFEEVSLYFSEEEWRLLDESQRKIFTKVMMENYENVRALGFPTSNPDFIFKMGRNENHELCMDKIQNLSEGASPEV

SEQ ID NO: 30187 - protein, 81 aa, Alligator mississippiensis
GKFPEAFEDVALYFTQKEWELLGDGDKVLYQDQMLRNYQALVSLGCQGPMPDLINRIQRGELELWVCDDEDLGENAWFEGL

SEQ ID NO: 30188 - protein, 81 aa, Pantherophis guttatus
QVLVSFQEVAVHFSEEEWSQLDPDQKSLYREIMLENSRNLAFLRNHVQENKETFQRFGDEGRRAEFANPTETKEHERNLSG

SEQ ID NO: 30189 - protein, 81 aa, Dipodomys ordii
PPNRVSPFKDMILCFSEEDWSLLDPAQTGYYGEFIIGEDYEVSVSPNEAPAQPDLSQGEESEPRVPEFQDLQGKEGPQVPH

SEQ ID NO: 30190 - protein, 81 aa, Cricetulus griseus
PPNRVSPFKDMILCFSEEDWSLLDPAQTGFYGEFIIGEDYGVSMPPNDPAAQPDFSPEEENRPRVTEMADLQGKEALQVSC

SEQ ID NO: 30191 - protein, 81 aa, Cricetulus griseus
EEGLVTFEDVCVDFTWDEWQDLDDAQRKLYRDVMLETYSSLLSLNMQHVNDPNEISQDNRQIHGCNLVIAKSSTSAEERAK

SEQ ID NO: 30192 - protein, 81 aa, Mesocricetus auratus
KPLALGDIPFYFSQEEWGSLDSAQRDLFWDIKRENSRNAVLGLGSKSQSKSAPPDEAVPALSGQTDCEVTMSWNPKEAETE

SEQ ID NO: 30193 - protein, 81 aa, Cavia porcellus
SQNLLNFKDISVDFTQEEWGQLAPAHRNLYREVMLENFRNLVSVAGYQFSKPSVISQLEKGEEPWMTEKEDLGNPSADLKS

SEQ ID NO: 30194 - protein, 81 aa, Cricetulus griseus
GCVTFEDVAVYFCREEWELLDESQRLLYLDVMLENFALIASLDCWHEAETGETACTQSVSPTEEPQVRAPKEGLPTKKTHP

SEQ ID NO: 30195 - protein, 81 aa, Cricetulus griseus
VKIEDVADVAVSFILEEWGHLDQSQKSLSRDGREENCESITPVDYESREGNSELMVQQVSDGADSHWVAAESREKNGAQSQ

SEQ ID NO: 30196 - protein, 81 aa, Cricetulus griseus
SQLPENFEDVAMYISQEWGHQDPSKRALSREMVQDSYENVGTLESCIPGQEVISTQVEQGGKPWDPSVQSCKGGRSPRDPV

SEQ ID NO: 30197 - protein, 81 aa, Ictidomys tridecemlineatus
ETATNEDLSVDCTQKKWKGPAVRQRALYRNTVLENYSIMNSLAGENRMESSEFTPKQTISKGSESSDRSPGGLFGVTSMGP

SEQ ID NO: 30198 - protein, 81 aa, Ictidomys tridecemlineatus
SQGLVTFKDVAICFSQDQWSDLDPTQKEFYGEYVLEEDCGIVVSLSFPIPRLDAISQVREEEPQVPDIHEPQEPEEPEILS

SEQ ID NO: 30199 - protein, 81 aa, Peromyscus maniculatus
YQEALTFQDVKVTFSQEEWGCLDSAQRNLYRDVMLENYGNVVSVVGSSPKPALISWLEARKPSTVNICKVQPKRDSGTAPE

SEQ ID NO: 30200 - protein, 81 aa, Cavia porcellus
HQESASTSLQPPRSQEQWALLDPSQKELYWDAMLRKYGSVVSLGLPDQERKPDQEPSPHPAYQDPVVPRKPYMCAQCGCSF

SEQ ID NO: 30201 - protein, 81 aa, Cricetulus griseus
NGNTGESEGKEQVLCYHQTHDKSSQEDISEPIQKLLPGVLDILTFKDVAIGFSREEWECLDSAQRALYRDVMLENYSNLVS

SEQ ID NO: 30202 - protein, 81 aa, Castor canadensis
PNRVSPFKDMILCFSEEDWSLLDPAQTGFYGEFIIGEDCGVSMPPNDPPAQPDLSQREENEPRPAELQDLQGKEGPQVSYL

SEQ ID NO: 30203 - protein, 81 aa, Peromyscus maniculatus
PRESVTFEDVSVDFTRGEWKMLELSQRELYKEVLLETLKNLEFLGLPVSKFELISKLKWVKLPRVLEKEISEGPRPEAEPR

SEQ ID NO: 30204 - protein, 81 aa, Octodon degus
HRESASTSLESVRTQEQWALLDPSQKELYWDAMLQKYGSAMSLGLPDRESNPDRELSPRRPHQDPPEPRKPYMCAQCGCGF

SEQ ID NO: 30205 - protein, 81 aa, Cricetulus griseus
TQEPVKDVHTVRSFSYKKGVHQIPTHRDLYHGIRKESAENMVSLGSTVSTSNKTAQLEQRKEPWTVGLHSSNKRNSVLRSN

SEQ ID NO: 30206 - protein, 81 aa, Mesocricetus auratus
YQEALTFQDVEVIFSQEEWRLLGAAQRNLYRDVMLENYRNVVSVVGSSPKPALISWLEARKPLAVNICTAQPKTDSGTAPE

SEQ ID NO: 30207 - protein, 81 aa, Mus caroli
PRESVTFEDVSVDFSRGEWKLLEPSQRELYKEVLLENLGTLEFLGSPVSKLDLISHLKWVKLPRVLEKEISKDPRPGELVK

SEQ ID NO: 30208 - protein, 81 aa, Rattus norvegicus
PREAVTFEDVSVDFTRGEWKLLEPSQRELYKEVLLENLGSLEVLGSPVSKFDLISHLKWVKLPRVLEKELSKDPRPGESVK

SEQ ID NO: 30209 - protein, 81 aa, Mus caroli
MAKDLRFEDVVIYFSLEEWERLGHSHRNLYRAVMLDNYSNLLSLSLADTKPRVVSLLEQGKEPWMVMRNETKIWHPDWESR

SEQ ID NO: 30210 - protein, 81 aa, Cricetulus griseus
PVTFQDVAVDFSQDEWQLLGRMQKTEYRDVMLETLGNLVSVGWKPTSGKQELTQESSSSVLEPICVPKSKHFSRNDTKFTV

SEQ ID NO: 30211 - protein, 81 aa, Cricetulus griseus
SQGLVTFKDVALCFSQDQWSDLDPTQKEFYGEYVLEEDCGIVVSLSFPIPRLDDTSQISEQEPQVPDVQQSQEPTEPEILS

SEQ ID NO: 30212 - protein, 81 aa, Cricetulus griseus
LVTKESMTFTDVAVDITQEDWELMRPVQKELYKTVTLQNYWNMVSLGLTVYRPTVIPILEEPWMVIKEIVEGPNPEWETKT

SEQ ID NO: 30213 - protein, 81 aa, Mesocricetus auratus
PREPVTFEDVSVNFTRGEWKLLEPSQRELFKEVLLENLHNLEFLGFPVSKVDLISQLKWVKLPRALEKEISKGPRAEGESG

SEQ ID NO: 30214 - protein, 81 aa, Cavia porcellus
SQGLVTFKDVAVCFSQDQWSDLDPTQKEFYGEYVLEEDCGIVVSLSFPIPRLDDISQVIEEEPLVPDTHEPEEPEILSFTY

SEQ ID NO: 30215 - protein, 81 aa, Mesocricetus auratus
QQLPENFEDVTMYISQEWGHQDPSKRALSRDMVQESYENMGSLESCIPGQEVLSTQAEQGGKPWDPSVQSCKGGRSPGDPV

SEQ ID NO: 30216 - protein, 81 aa, Ictidomys tridecemlineatus
PNRVSPFKDMILCFSEEDWSLLDPAQTGFYGEFIIGEDYGVSMPANDAAAQPDLLQGEENGPRVPELQDLQGKEEPQISYL

SEQ ID NO: 30217 - protein, 81 aa, Cavia porcellus
EFQPLQEHEVPVLQEPDLPAERSSGDSEMVALLTALSQGLVTFKDVAVCFSQDQWSDLDPTQKEFYGEYVLEEDCGIVVSL

SEQ ID NO: 30218 - protein, 81 aa, Cavia porcellus
LVTEESMTFKDVAVDITQEDWELMRPVQKELYKTVTLQNYWNMVSLGLTVYRPTVIPTLEEPWMVIKEILEGPSPECKTEA

SEQ ID NO: 30219 - protein, 81 aa, Cricetulus griseus
TEESTGYQDVTVTFSKEEWGYLDSAQRKLYRDVMLENYGNVVSVVGSFPKPALISWLEARKPRAVNICKVQPKRDSDTAPE

SEQ ID NO: 30220 - protein, 81 aa, Octodon degus
FEDVADVAVSFILEEWGHLDQSQKSLYRDGRKEKYGNITSLDYESKNNNVELRVKQISNEASSPSSQWVAAGSTQRNVSLS

SEQ ID NO: 30221 - protein, 81 aa, Cavia porcellus
YIPEAITFKDVEVTFSQDEWGCLDSAQRNLYRDVMLENYGNSVSLAGSFSKPALISWLETRGPWQMSVQTARPKRLLRSAP

SEQ ID NO: 30222 - protein, 81 aa, Cricetulus griseus
PREPVTFEDVSVNFTRGEWKMLEPSQRELYKEVLLENLRNLEFLGLPVSKVDLISQLKWVKLPRALEKEISKGPRPEDESR

SEQ ID NO: 30223 - protein, 81 aa, Dipodomys ordii
EHQEPASTSCHPPRTQEEWGLLGPSQKELYWDVMLEKYGAVMSLGLQPPGQVMAAESEAGTRGMEPQHLGAGDTGPGLGQA

SEQ ID NO: 30224 - protein, 81 aa, Octodon degus
HKTRASPFKDMILCFSEEDWSLLDPAQTGFYGEFIIGEDCGVSVPPDNPEAQPDLSPREDSEPRVPELPELPGKEVLQDPS

SEQ ID NO: 30225 - protein, 81 aa, Cricetulus griseus
KPVALGDIPFYFSREEWGSLDPAQRDLFWDIKRENSRNAALGLGSKSQSERAPPDEAMTALSGQTDCEVTVSWNPEEAETE

SEQ ID NO: 30226 - protein, 81 aa, Peromyscus maniculatus
LEKIEDMAVSLIREEWLLDPSQKDLNRDNRPEKYRNMFSLGNIDRNPATWTDSCQLQWGCYPGSCSWKNPRPSGQIREAAG

SEQ ID NO: 30227 - protein, 81 aa, Octodon degus
LVTEESMTFKDVAVDITQEDWELMRPVQKELYKTVTLQNYWNMVSLGLTVYRPTVIPTLEEPWMVIKEILEGPSEECKTEA

SEQ ID NO: 30228 - protein, 81 aa, Cavia porcellus
HDSPAPEASILSQEENPRNQLMALMLLTAQPQELVMFEEVSVCFTSEEWACLGPIQRALYWDVMLENYGNVTSLGKDSFFL

SEQ ID NO: 30229 - protein, 81 aa, Cricetulus griseus
GELPATFEDVAIYFTQEEWSLLDRQQKELYRDVMQMNYELLVSLEPPAAKPDLIIRLKQRAAPWIKDPNGLKSGKSRSLGK

SEQ ID NO: 30230 - protein, 81 aa, Mesocricetus auratus
KVDAVTFEDVTVDFTQEEWTSLDPVQRNLYRDVMLENYQNLATVGGQLFKPSLISWLEQKVELTVTEQEILQEWEMHLKTK

SEQ ID NO: 30231 - protein, 81 aa, Ictidomys tridecemlineatus
LVTLKDVAVSLPWEEWEQLDPAQRDFCRENVQKDNGSTVLPSLETKAENKGLIPKEEILEEAEPQVWLQEVSQGKASLFSK

SEQ ID NO: 30232 - protein, 81 aa, Ictidomys tridecemlineatus
LVKIEDVADVAVSFILEEWEHLDQSQKSLYREGRKENYGSITSMDYESRDNDMELIVKQISDEADTHWMASGSPERNAPQS

SEQ ID NO: 30233 - protein, 81 aa, Rattus norvegicus
LVTKESVTFNDVAVDITQEDWELMRPVEKELYKTVTLQNYWNMVSLGLTVYRPTVIPILEEPWMVIKEIVEGPSPEWETKA

SEQ ID NO: 30234 - protein, 81 aa, Mesocricetus auratus
SQGLVTFKDVAVCFSQDQWSDLDPTQKEFYGEYVLEEDCGIVVSLSFPIPRLDDTSQISEGEPQVPDVHESQEPAEPEILS

SEQ ID NO: 30235 - protein, 81 aa, Mus caroli
RDQELGTAVLPALQEEQWRHLDSTQKEQYWDLMLETYGKMVSGVAGISNSKPDLTNLAEYGEELVGLHLHGAEKMARLPCK

SEQ ID NO: 30236 - protein, 81 aa, Ictidomys tridecemlineatus
GELPAVFEDVAVYFTREEWGLLDKWQKELYRDVMRMNYELLASLGPAAAKPDLISKLERRAAPWIRDPFGLKWRSGRSPGK

SEQ ID NO: 30237 - protein, 81 aa, Marmota monax
LVTLKDVAVSLPWEEWEQLDTAQRDFCRENVQKDNGSTVLHSLETKAENKELIPKEEILEEAEPQVWLQEVSQGKASLFSK

SEQ ID NO: 30238 - protein, 81 aa, Marmota monax
LVKIEDVADVAVSFILEEWEHLDQSQKSLYREGRKENYGSITSMDYESRDNDMELIVKQISDEADTHWMAPGSPERNAPQS

SEQ ID NO: 30239 - protein, 81 aa, Cricetulus griseus
VKIEDMAVSLILEEWGCQNLARRNLNRDSRQENLGNVFSQGSENRNGKESTSKTDVKEDSTSHGETAGRVQKEFGEKREQQ

SEQ ID NO: 30240 - protein, 81 aa, Cricetulus griseus
SRDQDMGTAFLPAVHQEQWRHLDSTQKEQYWDFMLETYGKMVSGAGISNSKPDLTNIADYGEELAGLQLHISEKIPRLTCK

SEQ ID NO: 30241 - protein, 81 aa, Rattus norvegicus
NALPVLQVPSVPLKDSQEPTASLLSAGPQKLVKIEDVADVAVSFILEEWGHLDQSQKSLSRDGRKEDCERTTPVVSVCIPK

SEQ ID NO: 30242 - protein, 81 aa, Castor canadensis
GDQEALTFKDVEITFSQDEWGCLNSAQRNLYRDVMLENYRTLASLVGPFSKPALISWLEAREPWGLNVCTVQPKRDPGIVP

SEQ ID NO: 30243 - protein, 81 aa, Marmota monax
GELPAVFEDVAVYFTREEWGLLDKWQKELYRDVMRMNYELLASLGPAAAKPDLISKLERRAAPWIRDPIGLKWGSGRSPGK

SEQ ID NO: 30244 - protein, 81 aa, Cavia porcellus
MEDVADVAVSFILEEWGHVDQSQKSVYRDGRKENYGSIASLDCESKDNNVDLIVKQISNEASSPHSHWVAAGSTQKDIPQS

SEQ ID NO: 30245 - protein, 81 aa, Cavia porcellus
TCESIAFKDVVMSFSRREWKKLEPSQKELYKDVLLENLKNLEFLGFPVSKLDLISRLKWVELPRLVEKELSKHSRPGKLES

SEQ ID NO: 30246 - protein, 81 aa, Heterocephalus glaber
GHPFLAMTVASPQERWVLLDRSQKELYWDAMLQKYGSAVSLGEDRFALGPQAPLPVRVYACLMAPSAGLPDREPNPDPELS

SEQ ID NO: 30247 - protein, 81 aa, Cricetulus griseus
QVDAVTFEDVTVDFTQEEWTSLDPIQRSLYRDVMLENYQNLATVGGQLFKPSLISWLEQKVELTVTEQEILQDVSQKMSTL

SEQ ID NO: 30248 - protein, 81 aa, Marmota monax
SQGLVTFKDVAICFSQDQWSDLDPTQKEFYGEYVLEEDCGIVVSLSFPIPRLDDISQVREEEPQVPDIHEPQEPEEPEILS

SEQ ID NO: 30249 - protein, 81 aa, Peromyscus maniculatus
VKIEDMAVSLILEEWGCQNLARRNLNRDSRQENLGNVFSQGSENRNGHESTSKADVKEDSTVRGETAGRFQKEFGEKREQQ

SEQ ID NO: 30250 - protein, 81 aa, Peromyscus maniculatus
LVTKESVTFTDVAVDITQEDWELMRPVQKELYKTVTLQNYWNMVSLGLTVYRPTVIPILEEPWMVIKEIVEGPSPESETKA

SEQ ID NO: 30251 - protein, 81 aa, Ictidomys tridecemlineatus
DMTLLSVEEAWPACCPEVIAQQEKEQEDVAICPEAVPNEEPVTFQDVAVGFSREEWGLLGPTQRTEYHDVMLETFGNLVSV

SEQ ID NO: 30252 - protein, 81 aa, Ictidomys tridecemlineatus
IRDQDFGAALLPAAPQEHWRHLDSSQKEQYWDLMLETYGKMVSGGISNTKPDLTNSTVYGQELTGLQLHVSEKIPRLTCVG

SEQ ID NO: 30253 - protein, 81 aa, Peromyscus maniculatus
MAKSLKFKDVVIYFSRDEWACLYPSHRNLYRDVMLENYSNLISLGLADTKPSVISLLERGKEPWMVRRNETKEWHSDWASI

SEQ ID NO: 30254 - protein, 81 aa, Ictidomys tridecemlineatus
PQLPESIEDVAMYISQEEWGHQDPNKRVLSRDTVQESYENVDSLESHIPSQEALNTQVEQGGKPWDPSVQSCKEGVSPRSA

SEQ ID NO: 30255 - protein, 81 aa, Ictidomys tridecemlineatus
SQRMLKMENVALTFSPGWTQLNSSQMNLYRDERQENCGNLVSLGGKIQATIQDLPPAKEHLEKPGQKLYHLGEDIAQISAG

SEQ ID NO: 30256 - protein, 81 aa, Mesocricetus auratus
QNRVSPFKDMILCFSEEDWSLLDPAQTGFYGEFIIGEDYGVSMPPNDPAAQPDLSPEENGPRVTEMADLQSKDAPQVSCLD

SEQ ID NO: 30257 - protein, 81 aa, Peromyscus maniculatus
GEPPATFEDVAVYFSREEWGLLGKRQKELYRDVMRMNYELLASLEPPAAKPDLITRLKRRAAPWIKDPNRLKPGRSRSLGK

SEQ ID NO: 30258 - protein, 81 aa, Marmota monax
PNQLSEDPVPQDTSLLQEESMGDAEQMTTLQLPPNRVSPFKDMILCFSEEDWSLLDPAQTGFYGEFIIGEDYGVSMPASKA

SEQ ID NO: 30259 - protein, 81 aa, Marmota monax
LVTKESVTFKDVAVDITQEDWELMRPVQKELYKTVTLQNYWNMVSLGLTVYRPTVIPILEEPWMVIKEILEGPSPEWETEA

SEQ ID NO: 30260 - protein, 81 aa, Neotoma lepida
LVKIEDAADVAVSFILEEWGHLDQSQKSLSRDGRKDNCESITPVDYESREDNLELVVQQASDGADSHWVAAESTERNGAQS

SEQ ID NO: 30261 - protein, 81 aa, Cricetulus griseus
PVQQNRGDLEGERRQKLRIQGLLTFRDVTVDFSQEEWECLDSAQRALYKDVMLENYSNLVFVGENSLFVEFLTHLLFVLTP

SEQ ID NO: 30262 - protein, 81 aa, Ictidomys tridecemlineatus
LVMFEEVSVCFTSEEWACLGPIQRALYWDVMLENYGNVTSLEWETMTDNEEVTSKPSISQRADAQKGISKRLQGSVSQVPG

SEQ ID NO: 30263 - protein, 81 aa, Cricetulus griseus
QSPTPSQKGSSGDQEVTARLLTAGFQTLEKIEDMAVSLIREEWLLDPSQKDLNRDNRPEKYRNMFSLGNIFWNPATWTNSC

SEQ ID NO: 30264 - protein, 81 aa, Marmota monax
QEPLTFKDVVVEFTKEEWGQLDPAVKNLYRDVMLENYRNLHSLHKVHPLSKPVEIPKLESKKERWIMEGEVPRRTICDMET

SEQ ID NO: 30265 - protein, 81 aa, Peromyscus maniculatus
VRDQDMGTAFLPAVHQEQWRNLDTTQKEQYWDFMLETYGKMVSGGISNSKPELTNIAEYGEELAGLHLHVGEKTPRLACKE

SEQ ID NO: 30266 - protein, 81 aa, Heterocephalus glaber
VKIEDMAVSLILEEWGCQNLARRNLNRDSRQENYGNMFSQGRENRSENKESTSKGEDTQDSGSHGETAGRCQKDLGEKREQ

SEQ ID NO: 30267 - protein, 81 aa, Heterocephalus glaber
EPQEAATFKDVEVTFSQDEWGCLDSTQRNLYRDVMLENYGNAASLAISCSKPALISWLEAREPWGLDVQTAQTKQLPGSGP

SEQ ID NO: 30268 - protein, 81 aa, Cricetulus griseus
LGCLPTQSLLTFVDVAINFSKEEWECLNTSQRDLFRGVMLENYSNLVSVVTCLEQNQEPWKVNIEEAEGLEPVPHISSNDF

SEQ ID NO: 30269 - protein, 81 aa, Marmota monax
QAMVKIEDMAVSLILEEWGCQNLARRNLNRDSRQENYGNVFSQGCETRNENEESTSKAEVTEDSASHGEKAGRFQKEFGEK

SEQ ID NO: 30270 - protein, 81 aa, Marmota monax
IRDQDFGAALLPAAPQEHWRHLDSSQKEQYWDLMLETYGKMVSGGISNTKPDLTNSTVYGEELTGLQLHVSEKIPRLTCVG

SEQ ID NO: 30271 - protein, 81 aa, Marmota monax
SQSLLTFEEVAMYFSQEEWELLDPTQKALYNDVMQENYETVISLALFVLPKPKVISCLEQGEEPWVQGSSEFKDYPRESPT

SEQ ID NO: 30272 - protein, 81 aa, Cricetulus griseus
SYTLSLKEDVSVDLSQEEWECLDCAQRALYMDVMLENYSNLLFVENHHIVGKCEKVLPQETKHFIQDHANIQVKTYKCSEL

SEQ ID NO: 30273 - protein, 81 aa, Mesocricetus auratus
VTFQDVDVDFSQDEWRLLGPMQRTEYHDVMLETLGNLVSVGWEPTSGKEELTLESPSSVVEPIHDPKPKGFSREDTQSTVS

SEQ ID NO: 30274 - protein, 81 aa, Heterocephalus glaber
IREQDFGAALLSAAPQEQWRHLDSTQKEQYWDLMLETYGKMVSGAGISNSKPNLTNSAECGEDPAGLHLHVGEKIPRLSCV

SEQ ID NO: 30275 - protein, 81 aa, Peromyscus maniculatus
QEALTFQDVKVTFSQEEWGCLDSAQRNLYRDVMLENYGNVVSVAGKPQIKSSKFILKQDPSEYTETFAVPSVCPETSVSEG

SEQ ID NO: 30276 - protein, 81 aa, Mesocricetus auratus
SRDQDMGTAFLPAVHQEQWRNLDSTQKEQYWDFMLETYGKMVSGGISNSKPDLTNIAEYGEELAGLQLHISEKIPRLTCKE

SEQ ID NO: 30277 - protein, 81 aa, Neotoma lepida
AMVKIEDMAVSLILEEWGCQNLSRRNLNRGSRQENLGNVLKTGMGMSQPQRLKSKKIPPYMGRQQEDSRKNWERNVNSRAE

SEQ ID NO: 30278 - protein, 81 aa, Dipodomys ordii
SSEPIMFEEVAVDFSRSEWKKLEPSQRELYKEVLLESLGNLESLGFPVSKFNLLSQLKWIKLPKLLEKELSKDSRPGNNFD

SEQ ID NO: 30279 - protein, 81 aa, Ictidomys tridecemlineatus
QLESVTFEDVAVDFTQEEWTSLDPTQRNLYKDVMLENFQNLSTVGRQLLKPSLISWLEEEVQLTLVERGILQEWEMHLQTK

SEQ ID NO: 30280 - protein, 81 aa, Heterocephalus glaber
SQGLVTFKDVAVCFSQDQWSDLDPTQKEFYGEYVLEEDCGIVVSLSFPIPRLDDISQVPDIHEPQEPEEPEILSFTYTGDR

SEQ ID NO: 30281 - protein, 81 aa, Neotoma lepida
PVALGDIPFYFSREEWGSLDPAQRELFWDIKRENSRNAALGLGSKSQSDRVPAEEAVTALLGQTDCEVTMSWNPEEAETEV

SEQ ID NO: 30282 - protein, 81 aa, Cricetulus griseus
QGLLTFRDVAVDFSQEEWECLDSVQRALYIDVMLENYSNLVSVENYCMCAIVHQHVESEEKYSKCNELGKMLHESTRCTVY

SEQ ID NO: 30283 - protein, 81 aa, Heterocephalus glaber
QELVMFEEVSVCFTSEEWACLGPIQRALYWDVMLENYGNVTSLEWETMMENEEVTPKLSISQRADSQRETSKRLQEGVLQV

SEQ ID NO: 30284 - protein, 81 aa, Heterocephalus glaber
SQLPESLEDVAMYISQEEWGHQDPSKRTLSRDTIQESYENVDSLEPHIPSQELLTTQVEQGGKPWDPSVQSCKEAMSPRSP

SEQ ID NO: 30285 - protein, 81 aa, Mus musculus
SQGLVTFKDVALCFSQDQWSDLDPTQKEFYGEYVLEEDCGIVVSLSFPIPRLDDTSQIREEEPQVPGVHESQEPAEPEILS

SEQ ID NO: 30286 - protein, 81 aa, Cavia porcellus
ETQPGLVAIADMAIDFTPQLEPAQKSFCGNVLWESHAGLGPLGHCVSKPDFVAFLELGKEHWVVQRELVAGLFPAQQCARE

SEQ ID NO: 30287 - protein, 81 aa, Rattus norvegicus
EHQETLTFQDVEVTFSQEEWGCLNSAQRNLYRDVILENYGNVVSVVGSSPKPALISWLEARKPWGMNICTVQLKREPDAAP

SEQ ID NO: 30288 - protein, 81 aa, Cricetulus griseus
VSQEMVTFRDVAVVFSEEELVLLDAAQRKLYRNVMLETFKNVVSLGARNPDGMESLQEVGWRYLPHQELFCSRIRHQVSRA

SEQ ID NO: 30289 - protein, 81 aa, Ictidomys tridecemlineatus
SCETITFKDVTVNFSRGEWKKLEPSQKELYKEVLLENLRNLEFLGSSVSQLDVISQLKWIELPRVLAKEISKDSRPGELVK

SEQ ID NO: 30290 - protein, 81 aa, Fukomys damarensis
PQGLVTLEAVSVTWEEWERLDAAQRDFHRESSQKNYRNMVPPSLETRAENKELIPKQKILEAKPQPWLQEVSQGKGPLFSE

SEQ ID NO: 30291 - protein, 81 aa, Heterocephalus glaber
MVKGMNFKDVAIYFSQKEWECLHSVQKALYRDVMLENYQNLISLRLSDTTPSVISLLEQGKEPWMVSRKEIKGCYPDWESR

SEQ ID NO: 30292 - protein, 81 aa, Heterocephalus glaber
QLDSVTFEDVAVDFTKEEWTSLDPTQRNLYKDVMLENYQNLSTVGRQLLKPSLISWLEEEVELTIVERGFFQEWEMHLKTK

SEQ ID NO: 30293 - protein, 81 aa, Mus caroli
VRDQELGTAVLPALQEEQWRHLDSTQKEQYWDLMLETYGKMVSGAGISNSKPDLTNLAEYGEELVGLHLHGAEKMARLPCK

SEQ ID NO: 30294 - protein, 81 aa, Ictidomys tridecemlineatus
QAMVKIEDMAVSLILEEWGCQNLARRNLNRDSRQENYGNVFSQGCETRNENKESTSKAEVTEDSASHGEKAGRFQKEFGEK

SEQ ID NO: 30295 - protein, 81 aa, Neotoma lepida
SQLPENFEDMAMYISQEWGHQDPSKRALSRDMVQDSYENVGTLESCIPGQEVLSTQAEQGGKPWDPSVPSCKEGGGPRDPV

SEQ ID NO: 30296 - protein, 81 aa, Octodon degus
SEKLLNFKDISVDFTQEEWKQLAPAHRNLYREVMLENFRNLVSVGYPLSKPSVISQLEKGEEPWMTAKEDLGNHNADLKSK

SEQ ID NO: 30297 - protein, 81 aa, Dipodomys ordii
IVDGLKFNDVVIYFSQLEWECLSSAQKDLYQDVMLENYNNLVSLGLCDTKPYVISLLEQGKESWMVMRKTTVWHPDCESRW

SEQ ID NO: 30298 - protein, 81 aa, Octodon degus
GPVALGDIPFYFSREEWGSLDPAQRDLFWDIKRENSRNSTLETTGTERAALSPPFAGLELHSKSKRVLLEEGVKVLPGQAG

SEQ ID NO: 30299 - protein, 81 aa, Octodon degus
LLTFEDVAVHFSEEEWQLLDPNQKTLYNEVMWDICEAASFVGLKFKNDTGNAEPSSVSALEIQAAERQGSKTRKNVARKRK

SEQ ID NO: 30300 - protein, 81 aa, Mus caroli
TQEPIRDVHTERSFSYKKSVQQVPTHKDLYYDIRKESAGSMASLGDSVSAPNKIAQLEQKKEPWSVGLHSSNKRNSVLQSN

SEQ ID NO: 30301 - protein, 81 aa, Dipodomys ordii
RSSMCLDDVAVSLTWEEWEQLDAAERNICRESTQDYGSPPVLPSLETRAENERLIPKQENLEDQPQDWLQEIGPGKALPFP

SEQ ID NO: 30302 - protein, 81 aa, Peromyscus maniculatus
VRDQDMGTAFLPAVHQEQWRNLDTTQKEQYWDFMLETYGKMVSGAGISNSKPELTNIAEYGEELAGLHLHVGEKTPRLACK

SEQ ID NO: 30303 - protein, 81 aa, Mesocricetus auratus
DAVTFEDVTVDFTQEEWTSLDPVQRNLYRDVMLENYQNLATVEWEMHLKTKGPANGTQLGRKYNGGMRGDSIQVGTVISEE

SEQ ID NO: 30304 - protein, 81 aa, Neotoma lepida
SQGLVTFKDVALCFSQDQWSDLDPTQKEFYGEYVLEEDCGIVVSLSFPIPRLDDTSQIREEEPRVPNVQESQEPAEPEILS

SEQ ID NO: 30305 - protein, 81 aa, Dipodomys ordii
SQELLTFKDISVDFTQEEWGQLVPTYRNLYREVMLENYRNLVSVAGYQLSKPSIISQLEKGEEPWMRVNEGPGDPILDLKN

SEQ ID NO: 30306 - protein, 81 aa, Octodon degus
QLDSVTFEDVAVDFTKEEWTSLDPTQRNLYKDVMLENYQNLSTVGHQLLKPSLISWLEEEVELTIVEQGFLKEWEMHLKTK

SEQ ID NO: 30307 - protein, 81 aa, Fukomys damarensis
SQGLVTFKDVAVCFSQDQWSDLDSTQKEFYGEYVLEEDCGIVVSLSFPIPRLDDISQVREEEPQVPDIHEPQEPEEPEILS

SEQ ID NO: 30308 - protein, 81 aa, Octodon degus
SEKLLNFKDISVDFTQEEWKQLAPAHRNLYREVMLENFRNLVSVAGYPLSKPSVISQLEKGEEPWMTAKEDLGNHNADLKS

SEQ ID NO: 30309 - protein, 81 aa, Cricetulus griseus
YQEALTFQDVTVTFSKEEWGYLDSAQRKLYRDVMLENYGNVVSVVGSFPKPALISWLEARKPRAVNICKVQPKRDSDTAPE

SEQ ID NO: 30310 - protein, 81 aa, Rattus norvegicus
SQGLVTFKDVALCFSQDQWSDLDPTQKEFYGEYVLEEDCGIVVSLSFPIPRLDDPSQIREEEPQVPGVHESQEPAEPEILS

SEQ ID NO: 30311 - protein, 81 aa, Octodon degus
SQSLLTFEEVAMYFSQEEWELLDTTQKALYNDVMQENYKNVISIALFGLPKPKVISCLEQGEEPWVQGSLDFKDTPRESLT

SEQ ID NO: 30312 - protein, 81 aa, Octodon degus
ETCEPIAFKDVVMSFSRREWRKLEPSQKELFKDVLLENLKHLEFLECEPKGELEEVSAQNRDVFMEELTLEKIIEECFKDD

SEQ ID NO: 30313 - protein, 81 aa, Cavia porcellus
EGLVTLEAVSVTWEEWKHLDAAQRYFGRESALKDYRSMVLPNLETKAENKELIPEEQIFEEVKPQPWLQTVSEGKASLFSE

SEQ ID NO: 30314 - protein, 81 aa, Cricetulus griseus
KPVALGDIPFYFSREEWGSLDPAQRDLFWDIKRENSRNAALEEGKDQAPVYWEPEPGSKFWAWRKPHLVLMAFLVSGTLQA

SEQ ID NO: 30315 - protein, 81 aa, Dipodomys ordii
LPTFEDVAVYFTEDEWQLLEPSQKNLYNDVMQENYENVIFLGLKLKKNTGNDQPKSVTASEIQAPKKTRAKVAQKTAGKEK

SEQ ID NO: 30316 - protein, 81 aa, Dipodomys ordii
PITLRDVVVEFSEEEWGLLDPAVKKLYRDEMLENYRNLNSLHSGTVSEHQDSVPQQIVSAEESSPEAGLTKSTHSSLPERN

SEQ ID NO: 30317 - protein, 81 aa, Dipodomys ordii
SQELLTFKDISVDFTQEEWGQLVPTYRNLYREVMLENYRNLVSVGYQLSKPSIISQLEKGEEPWMRVNEGPGDPILDLKNK

SEQ ID NO: 30318 - protein, 81 aa, Octodon degus
QQLPESLEDMAMYISHEEWGHQDPSKRTLSRDTVQESYETVDSLGPHIPSQEALSTQVEQGEKPWDPNIQSCKEDRSPRSP

SEQ ID NO: 30319 - protein, 81 aa, Peromyscus maniculatus
SVTFTDVAVDITQEDWELMRPVQKELYKTVTLQNYWNMVSLESETKAEAHIPLKDLPTFKQDGTQTVKQDGTQTVKLEEAD

SEQ ID NO: 30320 - protein, 81 aa, Mesocricetus auratus
LVTKESMTFTDVAVDITQEDWELMHPFQKELYKTVTLQNYWNMVSLGLTIYRPSVIPILEEPWMVIKEIVEGPSPVSEWET

SEQ ID NO: 30321 - protein, 81 aa, Ictidomys tridecemlineatus
GQHVAPLSPLLPTQSPKGHLRHQDTASTSFHPPRIQEWGLLDPSQKELYWDAMLEKYGTVVSLGEDHRPFPPGLGCRLLAW

SEQ ID NO: 30322 - protein, 81 aa, Heterocephalus glaber
QKHHPQNIRQAVVLVECLQRESGGTKNENLLTFEDVAVYFSEEEWQLLDPNQKALYNDVMQDTYETASFLGKDFSFSLCTS

SEQ ID NO: 30323 - protein, 81 aa, Cavia porcellus
VKIEDMAVSLILEEWGCQNLARRNLSRDSRQENYGNVFSQGRENKSENEESTSKAKDTEDSASHGKTAGRFQKDLGEKREQ

SEQ ID NO: 30324 - protein, 81 aa, Cricetulus griseus
SQGVLTFRDVTVDFPQEEWECLDSAQRALYIDVMLENYSNLVSVENYCKCDPVHHHVKTEKESCQCNELGKVLHDPATCAL

SEQ ID NO: 30325 - protein, 81 aa, Mesocricetus auratus
WDVNTGEIEDKDQGNIDIRRHGHRHLSGGMGMPGFCTEILYKDIMLEACRNLVSGGLTVSKPELINSLEQSKEPLNRRNRS

SEQ ID NO: 30326 - protein, 81 aa, Ictidomys tridecemlineatus
SQEPMKDVQMTRGFSYKKSVHQIPAHRHLYRDIRKESVGTMVSLGSTVSTSNKISRLEQRKEPWTIGLHSSNKRNILRSNC

SEQ ID NO: 30327 - protein, 81 aa, Mus caroli
VTFQDLAVDFSQEEWQLLGPMQRTKYHDVMLETLGNLVSVGWEPTLGNRELIPDSPIPVVKPIHDPNSKDLSRNRTQFTVF

SEQ ID NO: 30328 - protein, 81 aa, Mus caroli
EHLPLPECEVPVSQDVDFPTEQGSGHPEMVALLTALSQGLVTFKDVALCFSQDQWSDLDPTQKEFYGEYVLEEDCGIVVSL

SEQ ID NO: 30329 - protein, 81 aa, Dipodomys ordii
VKIEDVADVAVSFILEEWGHLDPAQKSLYRDSRKDNYGRITCMDYESKDAVELVVKQISEEAESHWMAAAGPAGSGSPGGE

SEQ ID NO: 30330 - protein, 81 aa, Heterocephalus glaber
NILGDNTIEFCRQGPAEEGLLEVPVVLEKLPAMFEDVAVYFTREEWGLLDKQQKELYRNVMQMNYELLASLGKAPICATIT

SEQ ID NO: 30331 - protein, 81 aa, Dipodomys ordii
LVTKESMTFKDVAVDITQEDWELMRPVQKELYKTVTLQNYWNMVSLGLTVYRPTVIPILEEPWMVIKEILEGPSQGGLLYS

SEQ ID NO: 30332 - protein, 81 aa, Octodon degus
ALEAAPLSQEENPRNQLMALMLLTAQPQELVMFEEVSVCFTAEEWACLGPIQRALYWDVMLENYGSVTSLENPHWRETLQM

SEQ ID NO: 30333 - protein, 81 aa, Mesocricetus auratus
VKIEDMAVSLILEEWGCQNLARRNLNRDSRQENLGNVFSQGSENRNGKESTSKAEVKEDSTSHGETAGRVQKEFGQKREQQ

SEQ ID NO: 30334 - protein, 81 aa, Heterocephalus glaber
PQGLVTLEAVSVTWEEWEHLDAAQRDFHRESSHKDYQSMVLPSLETRAENKELIPKQKILEVKPQPWLQEVSQGKGPRFSE

SEQ ID NO: 30335 - protein, 81 aa, Rattus norvegicus
TQEPVRDIHTVRSFPYKRSVQQVPAHRDLYHEIRKESACSVVSLGDTVSAPNKIAQLEQKKEPWTVGLHSSNKRTSVLQSK

SEQ ID NO: 30336 - protein, 81 aa, Octodon degus
EPQEATTFKDVEVTFSQDEWGCLDAAQRNLYRDVMLENYGNSASLAGSFSKPALISWLETRGPWGLNVQMAQPERLLGSTQ

SEQ ID NO: 30337 - protein, 81 aa, Fukomys damarensis
LLTFEDVAVYFSEEEWQLLDPNQKALYNDVMQDTYETASFLGLKLKNDTRNDQPKSVSASEIQAPERKVSTKTRMKVAQKT

SEQ ID NO: 30338 - protein, 81 aa, Octodon degus
ECQPLQENEVPVLQDRDPPAERSSGDPDMVALLTALSQGLVTFKDVAVCFSQDQWSDLDPTQKEFYGEYVLKEDCGIVVSL

SEQ ID NO: 30339 - protein, 81 aa, Fukomys damarensis
FQLPESLEDVAMYISQEEWGHQDPSKRTLSRDTVQESYENVDSLEPHIPSQEVLTTQAEQEGKPWDPNVQSCKEAMSPRSP

SEQ ID NO: 30340 - protein, 81 aa, Dipodomys ordii
FLKLMSFDDVVVDFSWEEWQHLGIAQRTLYRDVMLETYSNMVSLGHHIPKPNLIVKLEQGVEPWRREDSDKNLTDVQAMED

SEQ ID NO: 30341 - protein, 81 aa, Octodon degus
VALGDIPFYFSREEWGSLDPAQRDLFWDIKRENSRNSTLGLELHSKSKRVLLEEGVKVLPGQAGGEGTGSWSPGHSEAWER

SEQ ID NO: 30342 - protein, 81 aa, Dipodomys ordii
QELLTFKDISVDFTQEEWGQLVPTYRNLYREVMLENYRNLVSVDLKNKTETSESTAKNDISQEQLYHDMVGRLIRDDIIYS

SEQ ID NO: 30343 - protein, 81 aa, Mus caroli
TQLPESLEDMAMYISQEWDHQDPSKRALSRDTVQDSYENVGTLESCIPSQEVSSTHVEQGEKLWDSSVQTCKEGMNPRNPV

SEQ ID NO: 30344 - protein, 81 aa, Octodon degus
LVMFEEVSVCFTAEEWACLGPIQRALYWDVMLENYGSVTSLEWETMMENEEVTPEQNISQRSDSQRGTSKRLQDGVPQDLD

SEQ ID NO: 30345 - protein, 81 aa, Heterocephalus glaber
SQEPVKDVHVLRGFSHKKTVHQIPVHRDLYREIRKENVGNTVSLGNTVSPSNKIARLEQRKEPWTVGLHSSNKRNVLRSAY

SEQ ID NO: 30346 - protein, 81 aa, Mus musculus
PRESVTFEDVSVDFSRGEWKLLEPSQRELYKEVLLENLGTLEFLGSPVSKLDLISHLKWVKLPRVLEKEILKDPRPGELVK

SEQ ID NO: 30347 - protein, 81 aa, Mus musculus
MAKDLRFEDVVIYFSLEEWECLRHSHRNLYRAVMLDNYSNLLSLSLADTKPRVVSLLEQGKEPWMVRRNETKIWHPDWVSR

SEQ ID NO: 30348 - protein, 81 aa, Dipodomys ordii
SQSLLAFDDVAMYFSQEEWELLNPTQKSLYNDVMQENYNTVISLALFVLPKPKVIFCLEQGEEPWVQGSSDFKESRRGFCT

SEQ ID NO: 30349 - protein, 81 aa, Dipodomys ordii
GDQEALTFKDVEVIFSQDEWGCLNSAQRNLYQDVMLENYGTLASLVGSFSKPALISWLETREPWGLNIYTVQPEGETDTAC

SEQ ID NO: 30350 - protein, 81 aa, Fukomys damarensis
IREQDLGAALLSAAPQEQWRHLDSTQKEQYWDLMLETYGKMVSGGISNSKPNLTNSAEYGEELVGLHLHVSEKIPRLSCVG

SEQ ID NO: 30351 - protein, 81 aa, Mustela putorius
QAMVKIEDMAVSLILEEWGCQNLARRNLNRDNRQENYGNVFSQGCENRSENEESTSKAEVAEDSAPRGETTGRFQKDFGEK

SEQ ID NO: 30352 - protein, 81 aa, Mustela putorius
RKESMTIKDVVVSFSRGEWRRLEPFQKELYKEVLLENFRSLEFVGFPVSKLDLISQFKWVELPWLLEKEISKGSRPERPCV

SEQ ID NO: 30353 - protein, 81 aa, Carlito syrichta
SQERLTFKDISIDFTQEEWGQLAPAHQNLYREVMLENYRNLVSVAGYQLSKPCVISQLEKGEEPWMTKKEGPDPSSDLKSK

SEQ ID NO: 30354 - protein, 81 aa, Gulo gulo
VRDQDFGASFLQAAPPEQWRHLDSSQKEQYWDLMLETYGKMVSGGISNSKSDLTNSTEYGEELAGLHLHVGEKIPRPTCVG

SEQ ID NO: 30355 - protein, 81 aa, Erinaceus europaeus
LVTKESVNFKDVAVDISPEDWELMRPVQKELYKTVTLQNYWNMVSLGLTVYRPTVIPMLEEPWMVVKEILEGPSTDWKTEI

SEQ ID NO: 30356 - protein, 81 aa, Ornithorhynchus anatinus
SQRSKKYENASMSLSQERQNHLVPPRRNLHRHLKQENYGNISSLGFGVSKPDISGLKPGEEELGDLDLQGSKDKDILRGSC

SEQ ID NO: 30357 - protein, 81 aa, Vicugna pacos
EELPVVFEDVAVYFTREEWGVLDKRQKELYRDVMRMNYELLASLGPAAAKPDLISKLERRAAPWIKDSNGPKWGKGRVPGK

SEQ ID NO: 30358 - protein, 81 aa, Odobenus rosmarus
RQVPVTLEDMAAYLSQEEWECMDPAQQDRSWDVLPEHGGLGLQLEDGQDTREDVSMGRERDRELVRGMARPEQPLERGGPR

SEQ ID NO: 30359 - protein, 81 aa, Odobenus rosmarus
SQGLLTFKDISVDFTQEEWGQLAPAHRNLYREVMLENYGNLVSVGYQLSKPSVISQLEKGQEPWMTEKEGPGDPSSDLNKT

SEQ ID NO: 30360 - protein, 81 aa, Vicugna pacos
HRQESLTFDDVAVDFTWEEWQLLVPAQKALYRDVMLENYSHLVSVGYQASTPGVLSELDQERPWMMEDEVHCQASSEIWKV

SEQ ID NO: 30361 - protein, 81 aa, Delphinapterus leucas
MVPVTLEDVAVYLSQEEWGCLDLAQQDHSCNMLQEDEAGLPAPGPCLTAQDGPGQGLRDPACAASGLREVSGSAGSELGRQ

SEQ ID NO: 30362 - protein, 81 aa, Carlito syrichta
ETQPVLVTIKNMAVNFSQQLDPGQKSFCKNRILENCNDLGSVGHHVSKPDLVCLLEQGKDSWMVKRELTGGLFSGKQSVHE

SEQ ID NO: 30363 - protein, 81 aa, Erinaceus europaeus
SQGSTRDVHMTRGFSYKKSMHQIPAHRDLYRETRKESVGNMVSLGSSVPTSDKLAQLGQRKEPWAVGLHSTHKRNLLRSNY

SEQ ID NO: 30364 - protein, 81 aa, Erinaceus europaeus
SQGSVTLKDVVVSFSRGEWRKLEPFQKELYKEVLLENFMNLDFLGFPVSKSDLLSQLRWVELPWLLGKDVSRPESDPKGEL

SEQ ID NO: 30365 - protein, 81 aa, Vicugna pacos
KIEDVADVAVSFILEEWGHLDQSQKSLYRDDRKENYGSVTSMDYESRNDSMEVLVKQISEEAESPWMTSGSTERNVPPSQG

SEQ ID NO: 30366 - protein, 81 aa, Odobenus rosmarus
VTVENMAVSLTWEEWDRLDPAQRDFCPESALKDCRNTVSLVSLSLETRTENKEFIPKQEVLEEVEPQGQLQEGSHRKAPPF

SEQ ID NO: 30367 - protein, 81 aa, Carlito syrichta
GREQVTFEDVVVDFTQEEWGQLKPAQRTLYCDVMLETFELLVSVGHWFLKPGITSLQEQGAKPWLVDSGVPQGLCPDLETR

SEQ ID NO: 30368 - protein, 81 aa, Ornithorhynchus anatinus
SQVVRTFEDLAVRFSQERWEQPDPAQRELYRDIGRENYGNEGALGDRFPKEALERGVQEFPEIQPRQAPGEAAPRPAGDRA

SEQ ID NO: 30369 - protein, 81 aa, Colobus angolensis
ESCESITLKDVAVNFSRGEWKKLEPFQKELYKEVLLENFRNLEFLDFPVSKLELISQLKWVELPWLLKEVSEGSRPDESAL

SEQ ID NO: 30370 - protein, 81 aa, Colobus angolensis
IRDQDLGASLLPAAPQEQWRHLDSTQKEQYWDLMLETYGKMVSGAGISHSKPDLTNSIEYGEELAGLYLHVNEKIPRPTYI

SEQ ID NO: 30371 - protein, 81 aa, Odobenus rosmarus
LLTFEEVAMYFSQEEWELLDPTQKALYNDVMRENYETVISLGLKVKTDNENHQPVCLSDLEIQAPEDIVSKKTRVKVPQKT

SEQ ID NO: 30372 - protein, 81 aa, Delphinapterus leucas
PQLPESLEDVAMYISQEEWGHQHPSKRALSQDTVQESYENVDSLESQVPSQEALSTQVEQEGKPWDPSVQTCKEGLSPRSP

SEQ ID NO: 30373 - protein, 81 aa, Odobenus rosmarus
SQGPVKDVHMARGFSYKKSVHQIPAHRDLYRDIRKESVGNMVSLGSAVSVSNKIARLEQRKEPWTLGLHSSNKRNIILRSN

SEQ ID NO: 30374 - protein, 81 aa, Ornithorhynchus anatinus
QGSMTFEDVAVSLNQEEWKILDPAQRSLYQEVMLENFGNLVSLAKQSGNSTRRKLRKFPNQEREFRNEMRRRIPSKKSSYE

SEQ ID NO: 30375 - protein, 81 aa, Carlito syrichta
EEVADVAVSFILEEWGHLDQSQKSLYRDDRKENYGSITSMDYASRDNNVELIVKQISDEAESQWTESGNTERSVPQSQEFA

SEQ ID NO: 30376 - protein, 81 aa, Gulo gulo
PQLPESLEDVAMYISQEEWGHQDPSKRALSRDTVQESYENVDSLESQVPSQEALSTHVEQGGKPWDPSVQTCKEGPSPSSP

SEQ ID NO: 30377 - protein, 81 aa, Delphinapterus leucas
QGLVTVQDVAVSLTWEEWERLGPAQRDLYRESAPKDYGNAVSPSLETRTENKELILKQEILEEVEPQGQLQESQEKGPLSS

SEQ ID NO: 30378 - protein, 81 aa, Erinaceus europaeus
LSPLEPQQDPPVPETSALSQEENPRNALMALKLLTAQPQELVMFEEVSVCFTPEEWACLAPAQRALYWDVILENYGNVTSL

SEQ ID NO: 30379 - protein, 81 aa, Cervus elaphus
SLLTFEEVAMYFSQEEWELLDPTQKALYNDVMQENYETVISLAVPAHQLLAFPEQTNTSEWTVAPELILPESQSLLTFEEV

SEQ ID NO: 30380 - protein, 81 aa, Carlito syrichta
QEPVAFKDVVLEFSKEELGQLDPAVKNVYGDVMLESFQNLNSPWKVHLLSKLVEIPAAESKKKDAIMEGDISRRTIFVKNQ

SEQ ID NO: 30381 - protein, 81 aa, Carlito syrichta
IRSQDFGASLLPVAPQEQWRHLDSTQKEQYWDLMLETYGKMVSGGISNSKPDSTNLTEYGEELTGLHFNVIEKIPRPTCVG

SEQ ID NO: 30382 - protein, 81 aa, Ornithorhynchus anatinus
TAGSQLPVTFEDVAVYLSRDEWGHQDSAKENQENYESAVALGSQIPSQEAASNLEQREKAWDSELQNSREKNSSSSCSGED

SEQ ID NO: 30383 - protein, 81 aa, Ornithorhynchus anatinus
TQGLATFKDVALCFSQEQWGHLDPSQKDFYGEYVLQEDCGIVVSLSFPIPRLEEIPPMGGEEEGLQAPGPHDSEESEILTF

SEQ ID NO: 30384 - protein, 81 aa, Mustela putorius
GHREPASTSFHAPRIQEEWGLLDPSQKELYWDAMLEKYGTVVSLAGIPAPQPEAQVELEPGALRTGTEGRRSLHPGDESES

SEQ ID NO: 30385 - protein, 81 aa, Erinaceus europaeus
LLTFEEVAIYFSQEEWELLDPTQKALYHDVIQENYETVISLGLKLKNDIENHQPICLSNLEIQSPGDLVSKKVRVKIPQKT

SEQ ID NO: 30386 - protein, 81 aa, Erinaceus europaeus
ACRKEAEGAGRLHQEEWMLLNRSQKELHWDVMLEKYGSVVSLGLPAPQTDTAAESHHGVLLTGPQGAGSVHPGVQGQGPGA

SEQ ID NO: 30387 - protein, 81 aa, Ornithorhynchus anatinus
APQESTENQEMTTSLFMARSQDEWRRLDPGSKTCYRDVTLGFTVPKPGMISWLEGGEEPWISGSQSSSEEEIPGEVHKGFE

SEQ ID NO: 30388 - protein, 81 aa, Gulo gulo
GHREPASTSFHPPRIQEEWGLLDPSQKELYWDAMLEKYGTVVSLAGIPAPQPEARAELEPGVLRTGTEGRRSLHPGGESES

SEQ ID NO: 30389 - protein, 81 aa, Delphinapterus leucas
ENPRNQLMALMLLTAQPQELVMFEEVSVCFTSEEWACLGPIQRALYWDVMLENYGNVTSLVDITHPGPGKKLKKKLLRLKD

SEQ ID NO: 30390 - protein, 81 aa, Delphinapterus leucas
LQEPVTFADVAVLFTPEEWLFLDSAQRSLYRDVMLENYRNLASVEPQLQPQDSIPNQDIFAEIPSIGTKRYQRIPAGGNPC

SEQ ID NO: 30391 - protein, 81 aa, Gulo gulo
VMFEEVSVCFTSEEWECLGPIQRALYWDVMLENYGNVTSLEWETMTENEEVTPKPSISQRADSQKGTSKRLQGGIPQTLDF

SEQ ID NO: 30392 - protein, 81 aa, Mustela putorius
KIEDVADVAVSFILEEWGHLDQSQKSLYRDDRKEKFGSITSMDYESGHDNVELAVKQISDDAEPHWMTSGSPARNVPQSQG

SEQ ID NO: 30393 - protein, 81 aa, Vicugna pacos
SQGLVTFKDVAVCISQDQWSDLDPTQKEFYGEYVLEEDCGIVVSLSFPIPRLDEISPAGEEESLIPDIAEPPEPQEPGILS

SEQ ID NO: 30394 - protein, 81 aa, Carlito syrichta
QVWVREHGPESGEEAVAVVRDLQRALEGNSPQRMMTSEDVAVSLSQEEREHLEPAPRDFSRESVQKDYKSTVLPSDIVYEP

SEQ ID NO: 30395 - protein, 81 aa, Odobenus rosmarus
SQSLLTFEEVAMYFSQEEWELLDPTQKALYNDVMRENYETVISLALFVLPKPKVISYLEQGEEPWVQGPLELKNSPGELPS

SEQ ID NO: 30396 - protein, 81 aa, Delphinapterus leucas
TEGLVTFKDVAVDFSPEELTYLTAAQRKLYRELMLENYRNLVSLGYQFPKPDIISRLEAEESRAVEEDSSTMICQDWEKKP

SEQ ID NO: 30397 - protein, 81 aa, Odobenus rosmarus
SRESVTFKDVVVSFSRGEWRRLEPFQKELYKEVLLENFRNLEFLGFPVSKLDLISQFKWVELPWLLEKEISKGSRPEGEPR

SEQ ID NO: 30398 - protein, 81 aa, Delphinapterus leucas
SQSLLTFEEVAMYFSQEEWELLDPTQKALYNDVMQENYKTVISLELSLGCSKTEGREIHSHSSTAVPAHQILAFPEQTNAK

SEQ ID NO: 30399 - protein, 81 aa, Delphinapterus leucas
KIEDVADVAVSFILEEWGHLDQSQKSLYRDDRKENYGSITSMDYESRNDNVELIVKQISDEAESPWMTSGSPERNVPPSQE

SEQ ID NO: 30400 - protein, 81 aa, Ornithorhynchus anatinus
AQGPATQADMTRYLSHEKWGRLVPAHRDRHRGVVQENYGTVVPLGFQVPAADVTPRLERGEEPWAVALQGSKEREFPRGSH

SEQ ID NO: 30401 - protein, 81 aa, Delphinapterus leucas
TGHVIFEDVAVSFSQEEWGLLNNAQRLLYCDVMLENLSLIASLGFWHGVEAEEAVSEQCVSVEQVTEDRNPKLEPSILKPL

SEQ ID NO: 30402 - protein, 81 aa, Chelonia mydas
NQEPATFEEVAVYLTTEEWKELKDWQRELYQDVMKENYELVTSVGGTMAKPEIVSRLERGEEPYNPRETRVPGPHGMGKRQ

SEQ ID NO: 30403 - protein, 81 aa, Chelonia mydas
AQMPVTFEEVAVYFTQGQGALLDPAQRALYRDVMQENYETVTALGFPIPKPELITQLERGEEPWVPDLQASEEREISRGAR

SEQ ID NO: 30404 - protein, 81 aa, Chelonia mydas
EHLKVPGTFDDVAAPDEKNLEEWQKELYKKVIKDNYESLISLGKVSIHDMQSREELRVKAQQGLEEREMSMNPSIVDDGIV

SEQ ID NO: 30405 - protein, 81 aa, Chelonia mydas
REGSVTFEEVAVYFTKEEWSLLDPAQRALYRDVMQENYENVTSLAGFPVSKPDVISQLEQRDEPWVSDLHGSEEREIPRGA

SEQ ID NO: 30406 - protein, 81 aa, Chelonia mydas
QTRAELIKFLTVIIYWSLAQHAAVNSGQGIWGEDPPVLCAVPWGFPVSKPDVISQLERGEEPWVLDLQGFEEGEIPRGACA

SEQ ID NO: 30407 - protein, 81 aa, Capra hircus
QAMVKIEDMAVSLILEEWGCQNLARRNLNRDARQENYGNVISQGCENRSENEESTSKAESAEDSASHGETAGKFQKDVGEK

SEQ ID NO: 30408 - protein, 81 aa, Chlorocebus sabaeus
GHQEAASTSFHPPRIQEEWGLLDRSQKELYWDTMLEKYGTVVSLGLPPHQPEAQAQSELGMLLMGTGVCRSLRSGTPPVPT

SEQ ID NO: 30409 - protein, 81 aa, Suricata suricatta
QQVPVTLEDVAAYLSQEEWECPDLARRGGGCDVLPKSRGLGLQPEDGEGARQDMPMRREEGQEPAGGVTRPERPLERGGPR

SEQ ID NO: 30410 - protein, 81 aa, Chlorocebus sabaeus
QEPVTFADVAVVFTPEEWVFLDSTQRSLYRDVMLENYRNLASVGAADQLCKPNALSYLEQRGEQWTTDRGILSDTCAEPQL

SEQ ID NO: 30411 - protein, 81 aa, Mandrillus leucophaeus
DTQPGLVTIKNLAVDFPQQLHPAQKNFSKNGIWENHSDLGSAGHCVAKPDLVSLLQQEKEPWMVKQQLTGSLLSGACRREI

SEQ ID NO: 30412 - protein, 81 aa, Sus scrofa
QPQEALTFKDVEVTFSQDEWGWLDASQRNLYRDVMLENYGNIASLMGPFTKPALISWLETREPWVLNVQGAQPEGNPGADV

SEQ ID NO: 30413 - protein, 81 aa, Mandrillus leucophaeus
DPIQKSCLDVAVNFSRGEWKKLEPFQKELYKEVLLENFRNLEFLDFPVSKLELISQLKWVELPWLLEEVSKGSRPDESALD

SEQ ID NO: 30414 - protein, 81 aa, Bos mutus
SQELLTFKDISVDFTQEEWGQLAPAHRNLYREVMLENYGNLVSVGCQLSKPSVISQLEKGEEPWMTEKEGPGDPNSDLKSK

SEQ ID NO: 30415 - protein, 81 aa, Bos indicus
KIEDVADVAVSFILEEWGHLDQSQKSLYRNDRKENYGSMTSMDYESRNDNVELTVKQISDEAESSWMTSGGPERIIPPSQE

SEQ ID NO: 30416 - protein, 81 aa, Mandrillus leucophaeus
QGLLKMEDVALTLSPGWTQLDSSQVNIYRDEKQENHSSLVSLGGEIQTESRGLPPVKKLSKKEHGKICHLREDIAQNPTCA

SEQ ID NO: 30417 - protein, 81 aa, Bos mutus
QAMVKIEDMAVSLILEEWGCQNLARRNLNRDTRQENYGNVISQGCENRNENEESTSKAESAEDSASRGETAGKFQKDVGEK

SEQ ID NO: 30418 - protein, 81 aa, Bos mutus
WEATSRVSGRWAGFQSQGHREDFGESQVVRDQGIDQGIAVTGTAIARLSISKPNMISLLEQGKEPWMVEREMSDGQHADFF

SEQ ID NO: 30419 - protein, 81 aa, Chlorocebus sabaeus
PPNRVSPFKDMILCFSEEDWSLLDPAQTGFYGEFIIGEDCGVSIPPNELAAQPDLSQREENEPRVPELQDLQGKEVPQVSY

SEQ ID NO: 30420 - protein, 81 aa, Bos mutus
QPQGTMTFKDVEVTFSQDEWGLLDASQRNLYRDVMLENYGNMASVVGPFTKPALISWLEAREPWGLNVQGVQFKGNPGAAP

SEQ ID NO: 30421 - protein, 81 aa, Neophocaena asiaeorientalis
SQEMLTFRDVFVDFTLEEWQQLDATQKNLCRDVMLENYSHLVSVGFLVAQPGRISRLGQGGEEARMAAGESTTRRCPGEPM

SEQ ID NO: 30422 - protein, 81 aa, Bos indicus
QGLVTVRDVAVSLTWEEWERLYPAQKHFFRESAPKDHGNAVSPSSETRIVNKELIPKQEILEVELQGQLQGFQEKAPLSSE

SEQ ID NO: 30423 - protein, 81 aa, Capra hircus
GNQDFGASLLHTASQEQWRHLDSTQKEQYWDLMLETYGKMVSGGAGISSARPGLTDPAGYGIELAGPHLHASEKIPRPTCI

SEQ ID NO: 30424 - protein, 81 aa, Sus scrofa
SLTFEDVALSFSEEEWQMLDPAQKILYNNVMQENYENVISLGLKLKNDTGNDQPISLSTLEIQASGCKALREARVKVAPKT

SEQ ID NO: 30425 - protein, 81 aa, Sus scrofa
PQEPVTFMDVAVLFTPEEWLFLDSAQRSLYRDVMLENYRNLVFVGDQLCKASRFSHVEQREELCITERRIFLGAHLGEHQA

SEQ ID NO: 30426 - protein, 81 aa, Suricata suricatta
QEPISFKDVIVEFSEEEWGQLDPAVKNVYRDVMLENYRNLNSLHQERLFPKPVELSELESKDRRWIIEQEIPSTSVFDRER

SEQ ID NO: 30427 - protein, 81 aa, Chrysochloris asiatica
QAMVKIEDMAVSLILEEWGCQNLARRNLSRDTRQEMYGNMLSQGCGNRNENEESSSKTKIGEDSASHGETTGRFQKVFGEK

SEQ ID NO: 30428 - protein, 81 aa, Mandrillus leucophaeus
QAMVKIEDMAVSLILEEWGCQNLARRNLSRDHRQENYGSTFPQGGENRNENEESTSKAETTEDSASRGETAGRFQKEFGEK

SEQ ID NO: 30429 - protein, 81 aa, Nomascus leucogenys
SCESITLKDVAVNFSRGEWKKLEPFQKELYKEVLLENLRNLEFLDFPVSKLELISQLKWVELPWLLEEVSKGSRTDESALD

SEQ ID NO: 30430 - protein, 81 aa, Muntiacus muntjak
TEELVTFEDVAVDFSPEELPYLSASQRNLYREVMLENYRNLVSLGYQFPKPDIISQLEEEESHAREEDGSTVTCQDWEEQP

SEQ ID NO: 30431 - protein, 81 aa, Capra hircus
QEPVKFEDVVVEFSKEEWGQLDPAVKNLYRHVMLENYRNLNSLHKEHLLSKPVETSKLESKKESWIMEQEIQRTAVFDRER

SEQ ID NO: 30432 - protein, 81 aa, Chlorocebus sabaeus
IRDQDLGASVLPAAPQEQWRHLDSTQKEQYWDLMLETYGKMVSGAGISHSKPDLTNSIEYGEELAGLYLHVNEKIPRPTCI

SEQ ID NO: 30433 - protein, 81 aa, Mandrillus leucophaeus
QEPVTFKDVVVEFSKEEWGQLDSAVKNLYRNVMLENFRNLNSLRKAYLLSKPVESLKLESKKKRWIMEKEIPRKTVFDMQS

SEQ ID NO: 30434 - protein, 81 aa, Neophocaena asiaeorientalis
SQESMTLKDVAVTFSRGEWRALEPSQKEIYKEVLLENYRNLEFLGFPVSKLDLISQLKWAGLPRLLQKQASRGSRPECELS

SEQ ID NO: 30435 - protein, 81 aa, Suricata suricatta
LLTFEDVAVYFTEEEWALLDPNQKILYNDVMQENYENVICLGLKLKNDTGNDQPTSVSTLEIQASGCKVLRKARIKVAQKT

SEQ ID NO: 30436 - protein, 81 aa, Nomascus leucogenys
IRDQDLGASLLPAAPQEQWRHLDSTQKEQYWDLMLETYGKMVSGAGISHSKSDLTNSIEYGEELAGLYLHVNEKIPRPTCI

SEQ ID NO: 30437 - protein, 81 aa, Equus caballus
PQLPESLEDVAMYISQEWGHQDPSKRALSRDTVQDSYENVDSLESQVPSQEALSTQVEQAGKPWYPSVQTCKEGLSPRSPA

SEQ ID NO: 30438 - protein, 81 aa, Neophocaena asiaeorientalis
QAMVKIEDMAVSLILEEWGCQNLARRNLNRDTREENYGNVISQGCENRNENEESTSKAEIAEDSASHGETTGKFQKDFGEK

SEQ ID NO: 30439 - protein, 81 aa, Nomascus leucogenys
QEPVTFKDVVVEFSKEEWGQLDSAVKNLYRSVMLENFRNLNSLRKAHLLSKPFESLKLESKKKRWIMEKEIPRKIIFDMKS

SEQ ID NO: 30440 - protein, 81 aa, Nomascus leucogenys
QMDLVTFDSVAVEFTQEEWTLLDPTQRNLYSDVMLENYKNLSSVGYQLFKPSLISWLEEEEELSTLPRVLQEWKMCLKTNG

SEQ ID NO: 30441 - protein, 81 aa, Trichechus manatus
SLESMAFKDVAVNFSRGEWKRLKPFQKKLFMEVLLENFRNLEFLGFPVSKLELISQLKWVVMPWLLDKEVSKGSRPECDPI

SEQ ID NO: 30442 - protein, 81 aa, Trichechus manatus
SVVIEDVAVVFSQEEWALLDLAQRKLYIDVMMENFRNLASVVSQNPNDVEKLSSDHVMVQFMKSKTWFSMLGEISELHGSK

SEQ ID NO: 30443 - protein, 81 aa, Sus scrofa
RQEPTSAPFHPSRIQEEWGLLDPSQKELYWDVMLEKYGTVVSLGEEGPFSSRSCVCRASQGAPPSPARAPTPSLHVRTPHT

SEQ ID NO: 30444 - protein, 81 aa, Trichechus manatus
SQELVTFKDVVVDFSPEELSYLSAAQRNLYREVTLENYRNLVSLGSQFTKPDLISQLEAEESCGMEEDSNAVAFQDWETSP

SEQ ID NO: 30445 - protein, 81 aa, Equus caballus
LLTFEDVAVSFSEEEWKLLDPAQKILYNDVMQENYETVISLGLKLKNDTGNDQPISVSTLEIQASGCKALRKSRMKVAQKT

SEQ ID NO: 30446 - protein, 81 aa, Capra hircus
QGLVTVQDVAVSLTWEEWERLGPAQRHFFRESAPKDHGNAISPSSETRIENKELVPKQEILEVESQGQLQGFQERAPVSSE

SEQ ID NO: 30447 - protein, 81 aa, Suricata suricatta
AASTSFRPPRIQEEWGLLDRSQKELYWDVMLEKYGTVVSLAGLPAPPPESRVESEPGVLRSGTEGQRSLHPGDESESHRDG

SEQ ID NO: 30448 - protein, 81 aa, Loxodonta africana
EEVPVVFEDVAVYFTREEWGLLDKRQKELYRGVMWMNYELLASLGPAAAKPDLISKLERRAAPWINNPKGSKWGKGRPPGK

SEQ ID NO: 30449 - protein, 81 aa, Chrysochloris asiatica
VGDQDCGGALLAAPSQEQWRHLDSTQKEHYWDLMLETYGKMVSGGISSPKADAAHSAEYGDELAGLHLRILSLSFTRELTL

SEQ ID NO: 30450 - protein, 81 aa, Suricata suricatta
AHREAASTSFRPPRIQEEWGLLDRSQKELYWDVMLEKYGTVVSLAGLPAPPPESRVESEPGVLRSGTEGQRSLHPGECLST

SEQ ID NO: 30451 - protein, 81 aa, Suricata suricatta
SRESITFKDVAVSFSRGEWRRLEPFQKELFKEVLLENFRNLEFLGFAVSTLDLISQFKWVELPWLLEKEVSKGSRPECEPR

SEQ ID NO: 30452 - protein, 81 aa, Canis lupus
EEPVTFLDVAVDFSKEEWGLLDPMQRTEYHDVMLETFGHLVSVGWETTLESKELTPKSDVPEKEPAHDLKLEEFSRDDTRS

SEQ ID NO: 30453 - protein, 81 aa, Chlorocebus sabaeus
VKIEEVADVAVSFILEEWGHLDQSQKSLYRDDRKENYGSITSMGYESRDNMELIVKQISDEAESHWVAPEHTERSVPQDPD

SEQ ID NO: 30454 - protein, 81 aa, Bos indicus
AEELVTFEDVAVHFSPEELPYLSASQRNLYRDVMLENYRNLVSLGYQFPKPDIISQLEEEESHAREEDGSTVTCQDWEEQS

SEQ ID NO: 30455 - protein, 81 aa, Mandrillus leucophaeus
ATFEDMAVSLTWEEWERLDPARRDFCRESAQKDSGSTVPPSLESRAENKELIPMQEILEAEPQGGLQAALQGKRPLLSKCG

SEQ ID NO: 30456 - protein, 81 aa, Neophocaena asiaeorientalis
SAWSQVPVTLEDVAVYLSQEEWGCLDLAQQDHSCDMLQEDEAGLPAPGPCLTAQDGPGQGLWDPAFAASGLREVSGSAGSE

SEQ ID NO: 30457 - protein, 81 aa, Nomascus leucogenys
VKIEEVADVAVSFILEEWGHLDQSQKSLYRDDRKENYGSITSMGYESRDNMELIAKQISDDSESHWVVPEHTERSVPQDPD

SEQ ID NO: 30458 - protein, 81 aa, Nomascus leucogenys
EENPRNQLMALMLLTAQPQELVMFEEVSVCFTSEEWACLGPIQRALYWDVMLENYGNVTSLDDYRNIKYTRQSKIIGTRVA

SEQ ID NO: 30459 - protein, 81 aa, Muntiacus muntjak
SQGPVKDDHMARGFSYKKSVRQIPAHKDLYWDIRKESVGNMASLGSTVPTANKIAQLEPRKEPWTIGLQSSNRRTVLRSNY

SEQ ID NO: 30460 - protein, 81 aa, Suricata suricatta
GDQAFGASVLQAAPQEQWKHPDPAQEEQHWDVMLETYRKMVSGGDRPENDKENLNLENCRGLEPSDVPCHAPGEVPPQASL

SEQ ID NO: 30461 - protein, 81 aa, Chlorocebus sabaeus
SQEPVKDVHVARGFSYKKSVHQIPAHRDLYRDFRKENVGNMVSLGSTASTSNKITPLEQRKEPWTLGLHSSNKRSILRSNY

SEQ ID NO: 30462 - protein, 81 aa, Sus scrofa
PTSAPFHPSRIQEEWGLLDPSQKELYWDVMLEKYGTVVSLGLPRPLPEALAESEPEGLSPGPEGQRSLRPAGESASSGAEG

SEQ ID NO: 30463 - protein, 81 aa, Muntiacus muntjak
QRLVAVQDVAVSPTWEEWERLGPAQKHFFRESAPKDHGNSVSPSSETRIENKELIPKQEILEVELQGQLQGFQEKAPLSSE

SEQ ID NO: 30464 - protein, 81 aa, Canis lupus
QPQEAVTFKDVEVTFSQDEWGWLDPAERNLYRDVMLENYRNMVSLVGPFAKPILISWLEAREPWGLDVQGAQPKGNPGVAL

SEQ ID NO: 30465 - protein, 81 aa, Chlorocebus sabaeus
SQELLTFKDISVDFTQEEWGHLAPAHRNLYREVMLENYGNLVSVAGYQLSKPGVISQLEKGEEPWLMEREISGVPSSDLES

SEQ ID NO: 30466 - protein, 81 aa, Sus scrofa
LVMFEEVSVCFTSEEWACLGPIQRALYWDVMLENYGTVTSLEWETMAENEEVTSKSSISQRADSQKGTSKRLQGGVPQVLD

SEQ ID NO: 30467 - protein, 81 aa, Sus scrofa
ESMTLKDVAVTFSRGEWRKLEPFQKDIYKELLQKISKSSRREYELSGEWKESGGNQDVLVEESTLDKIIERYLMNRDCNLT

SEQ ID NO: 30468 - protein, 81 aa, Canis lupus
SLESVTFKDVAVNFSRGEWRRLEPFQKELYKEVLLENLKNLEFLGFPVSKLDLISQFKWVELPWLLEKEVSKGSRSECEPT

SEQ ID NO: 30469 - protein, 81 aa, Muntiacus muntjak
EALPVVFEDVAVYFTREEWGALDKRQKEMYRDVMRMNYELLASLGPAAAKPDLISKLERRAAPWIKDPHRLKWGKGRPPGK

SEQ ID NO: 30470 - protein, 81 aa, Sus scrofa
SQESMTLKDVAVTFSRGEWRKLEPFQKDIYKEVLLENFRSLEFLGFPVSKLDLISQLKWAGLPRLLQKISKSSRRESFFSL

SEQ ID NO: 30471 - protein, 81 aa, Nomascus leucogenys
PQLPESLEDVAMYISQEEWGHQDPSKRVLSRDTVQESYENVDSLESHIPSQEVPGTQVGQGGKLWDPSVQSCKEGLSPRGP

SEQ ID NO: 30472 - protein, 81 aa, Bos mutus
SQESMTLKDVAVTFSRGEWRKLEPSQKEIYKEVLLENYRNLELLGFPVSKLDLVSQLKWAGLPRLLQKEVSKGCRPDVLME

SEQ ID NO: 30473 - protein, 81 aa, Bos indicus
SAWSQVPVTLEDVAVYLSQEEWGCLDLAQQDHSCDVLLEDAGLPTPGPCLTALQGQGEDPRDSAQAASGPREVSGGASSER

SEQ ID NO: 30474 - protein, 81 aa, Neovison vison
PLPQVPALSQREVCPGDPLTSQAQEAVTFKDVEVTFSQDEWGWLDPAQRNLYKNMMLENYQNLVSLGLCISKPYVISLLEQ

SEQ ID NO: 30475 - protein, 81 aa, Loxodonta africana
SQGPVKDTHVARGFSYKKRVHQIPAHRDLFREIRKESVGNVASLGSSVSTSSKIARLEQRKEPWTRGLHSSNKRNILRSNY

SEQ ID NO: 30476 - protein, 81 aa, Nomascus leucogenys
TESCESITLKDVAVNFSRGEWKKLEPFQKELYKEVLLENLRNLEFLDFPVSKLELISQLKWVELPWLLEEVSKGSRTGSVI

SEQ ID NO: 30477 - protein, 81 aa, Muntiacus muntjak
QPQGTVTFKDVEVTFSQDEWGLLDASQRNLYRDVMLENYGNMASVVGPFTKPALISWLEAREPWGLNVQGVQFKGNPGAAP

SEQ ID NO: 30478 - protein, 81 aa, Canis lupus
ERQPGLVTITNMAVDFSQQLDPAQKSFCKNVIWENRSDLGSVGPCVSKPDLVSLLEHGKEPWMVERELTRSLFSGQQSIHE

SEQ ID NO: 30479 - protein, 81 aa, Loxodonta africana
SQGLVTFKDVAVCFSQDQWSDLDPAQKEFHGEYVLEEDCGIVVSLSFPIPRLDEISQVREEESWVPDIQEPQEPQETEILS

SEQ ID NO: 30480 - protein, 81 aa, Muntiacus muntjak
QLTFEDVALSFSKEEWQIMDPNQKTLYIDVMREIYETVTSLGLKLKNDTGNDQPVSLSTSEIQPSGCKVLRKARMKVAQTT

SEQ ID NO: 30481 - protein, 81 aa, Neophocaena asiaeorientalis
TLLTAGFQTLEKIEDMAVSLIREEWLLDSSQKDLSRDNRPENYRNMFSLGGETRNENRELASKQHSSIFLHIPPSLTPLSH

SEQ ID NO: 30482 - protein, 81 aa, Canis lupus
QAMVKIEDMAVSLILEEWGCQNLARKNLNRDNRQENYGNVFSQGCENRNENEESTSKAEIAEDSAPRGEMTGRFQKDFGEK

SEQ ID NO: 30483 - protein, 81 aa, Canis lupus
PVTFGDIPFYFSREEWGSLDPAQRELFWDIKRENSRNVTLALVPEPSGTEEAAPSRLAGLGLKSQGQQAGLEETVASAGQA

SEQ ID NO: 30484 - protein, 81 aa, Neophocaena asiaeorientalis
SQGPLKDVHMARGFSYKKSVRQIPAHRDLYRDIRKESIGNMVSLGNTVSTANKMAQLEQRKEPWTIGRQSPNKRNVLQSNY

SEQ ID NO: 30485 - protein, 81 aa, Neophocaena asiaeorientalis
FVTKESMTFTDVAVDITREDWELMRPVQKELYKTVTLQNYWNMVSLGLTVYRPTVIPILEEPWMVIKEILEGPSPEWETEA

SEQ ID NO: 30486 - protein, 81 aa, Bos indicus
EPTSAPFQPPRLQEWGLLEPSQKELYWDAMLEKYGTVVSLGLPHPLPESRAESQPEVLSTGSEGRRRLRPGDESEGRPGGP

SEQ ID NO: 30487 - protein, 81 aa, Canis lupus
PQLPESLEDVAMYISQEEWGHQDPSKRALSRDTVQESYENVDSLESQVPRQEALSTQVERGGKPWDPSLQTCKEGLSPRSP

SEQ ID NO: 30488 - protein, 81 aa, Canis lupus
SQGSLSFRDVTVGFTQEEWQHLNLAQRTLYRDVMLENYSHLVSVGYSIDKPEVILKLEQGEEPWILEEAFPSQSDPELINS

SEQ ID NO: 30489 - protein, 81 aa, Bos mutus
SQGPVKDVHMARGFSYKKSVHQIPAHKDLYRDIRKESVGNMVSLGSTVSAANKIARLEPRKEPWTIGLQSSNKRTVLQSNY

SEQ ID NO: 30490 - protein, 81 aa, Bos mutus
AEELVTFEDVAVHFSPEELPYLSASQRNLYREVMLENYRNLVSLGYQFPKPDIISQLEEEESRAREEDGSPVTCQDWEEQS

SEQ ID NO: 30491 - protein, 81 aa, Muntiacus muntjak
LVTKESITFKDVAVDITQEDWELMRPVQKELYKTVTLQNYWNMVSLGLTVYRPTVIPMLEEPWMVLKEILEGPSPEWETKA

SEQ ID NO: 30492 - protein, 81 aa, Neophocaena asiaeorientalis
SQSLLTFEEVAMYFSQEEWELLDPTQKALYNDVMQENYETVISLELSLGCSKTEGREISSHSSTAVPAHQILAFPEQTNAK

SEQ ID NO: 30493 - protein, 81 aa, Muntiacus muntjak
SQELLTFKDISVDFTQEEWGQLAPAHRNLYREVMLENYGNLVSVAGCQLSKPSVISQLEKGEEPWMTEKEGPGDPSSDLKS

SEQ ID NO: 30494 - protein, 81 aa, Ailuropoda melanoleuca
SRVPVTLEDMAAYLSQEEWECLDPAQRDCSWDVLPENRGLVPPLEDGEDPGEDMSMRREQDREPGRGMTRPEKPLEGGGPQ

SEQ ID NO: 30495 - protein, 81 aa, Canis lupus
LLTFEDVAVFFSEEEWKLLNPTQKILYSDVMQENYETVISLGLKLKNDTGNDQPISLSTLELQASGCKVLRKARVKVAQKT

SEQ ID NO: 30496 - protein, 81 aa, Bos mutus
QEPVKLEDVVVEFSKEEWGQLDPAVKNLYRHVMLENYRNLNSLHKEHLLSKPVETSKLESKKESWIMEQEIPRTAVFVPKQ

SEQ ID NO: 30497 - protein, 81 aa, Muntiacus muntjak
SQGLVTFKDVAVCFSQDQWSGLDPTQKEFYGEYVLEEDCGIVVSLSFPIPRLDEISHVREEEPLVPDAPEPQEPEEPEILS

SEQ ID NO: 30498 - protein, 81 aa, Bos mutus
SQGLVAFKDVAVCFSQDQWSDLDPTQKEFYGEYVLEDDCGIVVSLSFPIPRLDEISHVREEEPLVPDVPEPQEPEEPEILS

SEQ ID NO: 30499 - protein, 81 aa, Nomascus leucogenys
SQEPVTFADVAVVFTPEEWVFLDSTQRSLYRDVMLENYRNLASVADQPCKPSALSYLEERGEQWTTDRGILSDTCAEPQCQ

SEQ ID NO: 30500 - protein, 81 aa, Neophocaena asiaeorientalis
SQEMLTFRDVFVDFTLEEWQQLDATQKNLCRDVMLENYSHLVSDSSWPNQVGSPGWDKEERRPGWQLEKAQHGGVQVSPCR

SEQ ID NO: 30501 - protein, 81 aa, Canis lupus
SVTFKDVAVNFSRGEWRRLEPFQKELYKEVLLENLKNLEFLECEPTGELKESFRNQDVLLDESTLDKIIERCLMSGNYGSM

SEQ ID NO: 30502 - protein, 81 aa, Muntiacus muntjak
VKIEDMAVSLILEEWGCQNLARRNLNRDARQENYGNVISQGCENRNETKESTSKAESAEDSASRGETAGKFQKDVGEKREQ

SEQ ID NO: 30503 - protein, 81 aa, Muntiacus muntjak
KIEDVADVAVSFILEEWGHLDQSQKSLYRDDRKENYGSMTSMDYESRNDNVELTVKQISDEAESSWMTSGGPERTVPSSQE

SEQ ID NO: 30504 - protein, 81 aa, Nomascus leucogenys
DAVAYEDLSVDYTQKKWKGLPLSQRALQWNMMPENDRSMASLAGENMMKGSELTPKQEIFKGSESSNRTSGGLFGVVPGAA

SEQ ID NO: 30505 - protein, 81 aa, Nomascus leucogenys
QLQETMTFKDVEVTFSQDEWGWLDSAQRNLYRDVMLENYRNMASLVGPFTKPALISWLEAREPWGLNVQAAQPKGNPGAAH

SEQ ID NO: 30506 - protein, 81 aa, Ailuropoda melanoleuca
GALFGRQPGLVTIRNMAVDFSQQLDPAQKSFCKNVIWENRCDLGSVGPCVSKPDLVSLLEQGKEPWMVERELTRGLFSGEC

SEQ ID NO: 30507 - protein, 81 aa, Lynx canadensis
LVTKESMTFKDVAVDITQEDWEIMRPVQKELYKTVTLQNYWNMVSLGLTVYRPTVIPMLEEPWMVIKEILEGPSPEWKTEA

SEQ ID NO: 30508 - protein, 81 aa, Bos mutus
PQLPESLEDVAMYISQEEWGRQHPSKRALSRDTVQESYENVDSLESQVPSQEALSTQVEHGGKPWHPSVQTCKEGLSSRTP

SEQ ID NO: 30509 - protein, 81 aa, Bos mutus
VTFGDIPFYFSREEWGSLDPAQRDLFWDIKRENSRNVALGLGHRSHSEKSRLEEVVTALPDQAAGNETASWRPEEAWEAEK

SEQ ID NO: 30510 - protein, 81 aa, Canis lupus
FSLQDAQHDSPAPEASALSQEENPRNQLMALMLLTAQPQELVMFEEVSVCFTSEEWECLGPIQRALYWDVMLENYGNVTSL

SEQ ID NO: 30511 - protein, 81 aa, Ailuropoda melanoleuca
SWESLTFKDVIVSFSRGEWRRLEPFQKELYKEVLLENFRNLEFLGFPVSKLDLISQFKWVELPWLLEKEIAKGSRPDVLLE

SEQ ID NO: 30512 - protein, 81 aa, Gorilla gorilla
GHQEPASTSFHPPRIQEEWGLLDRSQKELYWDVMLEKYGTVVSLGLPPHQPEAQAQSELGMLLTGTGVCRSLGSGNESEGP

SEQ ID NO: 30513 - protein, 81 aa, Muntiacus muntjak
PVGNQDFGASLHTASQEQWRHLDSTQKEQYWDLMLETYGKMVSGGISNARPDLTDPAGYGAELAGPHLQASEKIPRPTCIG

SEQ ID NO: 30514 - protein, 81 aa, Ailuropoda melanoleuca
LVTKESMTFKDVAVDITQEDWEIMRPVQKELYKTVTLQNYWNMVSLGLTVYRPTVIPILEEPWMVIKEILEGPSPEWKAEA

SEQ ID NO: 30515 - protein, 81 aa, Canis lupus
QEPVTFKDVIVEFSEEEWGQLDPAVKNLYRDVMLENYKNLNSLHQEPLLSKPAEISNLESKERRWIMEQEIPSTSVFDRGV

SEQ ID NO: 30516 - protein, 81 aa, Muntiacus muntjak
LLTFEEVAMYFSQEEWELLDPTQKALYNDVMQENYETVISLGLKLKNDTENIQSLCLSDLEIQAPVAIASRKAKLKVPQKT

SEQ ID NO: 30517 - protein, 81 aa, Ailuropoda melanoleuca
QEPVTFKDVIVEFSEEEWGLLDPAVKTLYRDVMLENYRNLNSLHQEQLLSKPVEISKLESKERRWTVEQETPSTSVLVPKQ

SEQ ID NO: 30518 - protein, 81 aa, Ailuropoda melanoleuca
LLTFEDVAVSFSEEEWELLDPPQKTLYNDVMQENYETVISLGLKLKNDTGNDQPISISALEMQASGSKVLRKARMKVAQKT

SEQ ID NO: 30519 - protein, 81 aa, Lynx canadensis
PPNRVSPFKDMIFCFSQEDWSLLDPAQTGFYGEFIIGEDCGVSLPPSDPGTQLHLSQGEENEPRVPELQDLQGKDVPQVSY

SEQ ID NO: 30520 - protein, 81 aa, Bos indicus
SQESMTLKDVAVTFSRGEWRKLEPSQKEIYKEVLLENYKNLELLGFPVSKLDLVSQLKWAGLPRLLQKEVSKDVLMEESTL

SEQ ID NO: 30521 - protein, 81 aa, Gorilla gorilla
AEGLKFKDVVIYFSQKEWECLHSAQKDLYRDVMLENYGNLVLLDNSGLSDTKPNVISLLEQKKEPWMVKRKETKEWCPDWE

SEQ ID NO: 30522 - protein, 81 aa, Nomascus leucogenys
ETQPGLVTIKNLAVDFPQQLHPAQKNFCKNGIWENYSDLGSAGHCVAKPDLVSLLEQEKEPWMVKRELTGSLFSGQRSVRE

SEQ ID NO: 30523 - protein, 81 aa, Gorilla gorilla
PQLPESLEDVAMYISQEEWGRQDPSKRALSRDTVQESYENVDSLESHIPSQEVPGTQVGQGGKLWDPSVQSCKEGLSPRGP

SEQ ID NO: 30524 - protein, 81 aa, Gorilla gorilla
SITLKDIAVNFSRGEWKKLEPFQKELYKEVLLENLRNLEFLALFENHRNYIPYNPKYNSFLSCKQEIFYFLYLLDESALDK

SEQ ID NO: 30525 - protein, 81 aa, Bos indicus
SAEPLTFKDIIVDFTQEEWGHLAPAHQNLYREVMLENYGNLVSVAGYQLSKPGVVSQLEKGEEPWLMKREVSGGPSPGKSK

SEQ ID NO: 30526 - protein, 81 aa, Bos indicus
SQSLLTFEEVAMYFSQEEWELLDPTQKALYNDVMQENYETVISLALFVLPKPKVISCLEQGEEPWVQRPLEFKDSSEELPT

SEQ ID NO: 30527 - protein, 81 aa, Bos indicus
SQGPVKDVHTARGFSYKKSVHPIPAHKDLYWDIRKESVGNMVSLGSTVSAANKIARLEPRKEPWTIGLQSSNKRTVLQSNY

SEQ ID NO: 30528 - protein, 81 aa, Muntiacus muntjak
EPTSAPFQPPRLQEWGLLEPSQKELYWDAMLEKYGSVVSLGLPHPLPESREKSQPEALSTGSRSEGRRKLRPGDESEGRPG

SEQ ID NO: 30529 - protein, 81 aa, Macaca fascicularis
SRESITLKDVAVNFSRGEWKKLEPFQKELYKEVLLENFRNLEFLDFPVSKLELISQLKWVELPWLLEEVSKGSRPDESALD

SEQ ID NO: 30530 - protein, 81 aa, Macaca fascicularis
DTVAYEDLSVGYTQKKWKCPALSQRALQWNMMPENDRSMASLAGENMMKGSELTPKQEIFKGSESSNKTSGGLFGMVPGGA

SEQ ID NO: 30531 - protein, 81 aa, Phascolarctos cinereus
TRDKDEAASLSTSGSQEQWQCLNHTQKELYWDAMLEDYGKVVSLAIPISKPNPTNLVVGKEEPDGSHSHADEAIPRSICIG

SEQ ID NO: 30532 - protein, 81 aa, Puma concolor
EPVSFKDVIVEFSKEEWGQLDPAVKNLYRDVMLENYRNLNSLHQDREVISENQDSVTKERISGESSSHGEIMRRLTKSGPP

SEQ ID NO: 30533 - protein, 81 aa, Sapajus apella
QELVMFEEVSVCFTSEEWACLGPIQRALYWDVMLENYGNVTSLEWETMTENEEVTSKLSSSQRADSQKGTSKRLQGSVPQV

SEQ ID NO: 30534 - protein, 81 aa, Sapajus apella
QQLPESLEDVAMYISQEEWGHQDPSKRALSRDTVQESYENVDSLESHIPSQEVPSTQVGQGGKLWDPSVQSCKEGLNPRGP

SEQ ID NO: 30535 - protein, 81 aa, Myotis lucifugus
KIEDVADVAVSFILEEWEHLDQSQKSLYRDDRKENYESITSMDCKSKNDNMELIVKQISDEAKSHWMTSERSVAQSQEFGE

SEQ ID NO: 30536 - protein, 81 aa, Puma concolor
SRESITFKDVAVNFSRGEWRKLEPYQKELFKEVLLENFRNLEFLGFAVSKLDLISQLKWVELPWLLEKEVSKGSRPECEPR

SEQ ID NO: 30537 - protein, 81 aa, Ailuropoda melanoleuca
VHSLESALGWKMKVNIYAYIIYIWEPVSSLDVAVDFTWEEWQLLAPTQKNLYRDMMLENYRNLVSVAGYQASRPDVLSRLE

SEQ ID NO: 30538 - protein, 81 aa, Desmodus rotundus
FQRQPGLVAIVDVATDFSQQLDPARESFHKNVTWETRDLEAAGCCVSRPDVVSVLGQGKEPWLVKRELTDGLLSGHQSVHE

SEQ ID NO: 30539 - protein, 81 aa, Macaca fascicularis
GHQAAASTSFHPPRIQEEWGLLDRSQKELYWDTMLEKYGTVVSLGLPPHQPEAQAQSELGMLLMGTGVCRSLRSGNESEGP

SEQ ID NO: 30540 - protein, 81 aa, Phascolarctos cinereus
LVKIEDMAVSLIQEEWGLLDPAQKDLCSDGRPDSYGHMYSLGGETRSENRDLTQKQVISAEMEPNGERTAKRNGNVPERDH

SEQ ID NO: 30541 - protein, 81 aa, Sapajus apella
PPNRVSPFKDMILCFSEEDWSLLDPAQTGFYGEFIIGEDCGVSMPPNELAAQPDLSQGEEHEPRVPELQDLQGKEVPQVSY

SEQ ID NO: 30542 - protein, 81 aa, Oryctolagus cuniculus
FETRPGFGSVTDMALDSSQLDPAQRSLWKSAVWENHSDLGSPEHCASKPDFVSLLEEGKEPWMGRRDVRGGLFSRQQSVKE

SEQ ID NO: 30543 - protein, 81 aa, Canis lupus
SQGPVKDVHMARGFSYKKSVHQIPAHRDLYRDIRKESVGNMVSLGSTASASSKIARLEQRKEPWTLGLHSSNKRNIILRSN

SEQ ID NO: 30544 - protein, 81 aa, Phyllostomus discolor
TLVESLKGDPQRLWQWEPWWHLDSTQKEQYWDLLLETYGKMVSGGISNSKPDLTNSTEYGEELAGFHLYVSEKLPKPTCIG

SEQ ID NO: 30545 - protein, 81 aa, Phyllostomus discolor
PQLPESLEDVAMYISQEEWGHQDPSKRAVSRDTVQESYENVDSLESQVSNQEALSTQVEQGRKPWDPSVQTCKEGLNPRSP

SEQ ID NO: 30546 - protein, 81 aa, Desmodus rotundus
SQTLLTFEEVAVYFSREEWELLDPSQKALYNDVMHENYETVISLALFVLPKPKVISCLEQGKEPWVQGSTEFMDSPGELPI

SEQ ID NO: 30547 - protein, 81 aa, Macaca fascicularis
QGLLKMEDVALTLSPGWTQLDSSQVNIYRDEKQENHSSLVSLGGEKQTESRDLPPVKKLSKKEHGKICHLREDIAQNPTCA

SEQ ID NO: 30548 - protein, 81 aa, Phyllostomus discolor
PQELVLFEEVSVCFTAEEWACLGPIQRALYWDVMLENYGSVTSLEWETMTEGDEVTSQPSASQRVDSQKGAPKRLQGGIPQ

SEQ ID NO: 30549 - protein, 81 aa, Phyllostomus discolor
FQGPVKDVLTSKGISYKKSVHQIPVHRDVYRDTREESVGNMVSLGSAVSNSNKIAQVEQRKEPWTIGLHSSNKRNILQSSY

SEQ ID NO: 30550 - protein, 81 aa, Myotis lucifugus
LPGLVKVKDVPVTWEEWEHLDPVQRDIYRESTLKDYGNTVLPSLETRTENKELIPKQESLEVEPQMQLQERSQGNAPLLSK

SEQ ID NO: 30551 - protein, 81 aa, Sapajus apella
SQELLTFKDVSVDFTQEEWGQLAPAHRNLYREVMLENYGNLVSVAGYQLSKPGVISQLEKGEEPWLMEREISGVPSLDLES

SEQ ID NO: 30552 - protein, 81 aa, Macaca fascicularis
DTQPGLVTIKNLAVDFPQQLHPAQKNFSKNGIWENHSDLGSAGHCVAKPDLVSLLQQEKEPWMVKQELTGSLLSGQRSVRE

SEQ ID NO: 30553 - protein, 81 aa, Macaca fascicularis
QTDLVTFDSVAVEFTQEEWTLLDPTQRNLYRDVMLENYKNLSSVGYQLFKPSLISWLEEEEELSTLPRVLQEWKMCLKTKG

SEQ ID NO: 30554 - protein, 81 aa, Phascolarctos cinereus
LNGLGRKELVTFEDISVDFAKKEWKTSAPAQRAFFRDLMLENYRDVVSLGISRREEEPWGLNRQGPLDLEGGRSTCTEGDN

SEQ ID NO: 30555 - protein, 81 aa, Myotis lucifugus
APGEPDAASFHPPRMQEEWVLLDPSQKELYWDAMLEKYGSVVSQGLPPPLPDPRAELEPGLEPGSPSAGAEGPGSLRTGER

SEQ ID NO: 30556 - protein, 81 aa, Puma concolor
LLTFEDVAVSFSEEEWKLLDPAQKILYNDVMQENYETVISLGLKLKNDTGNDQPISVSALEIQASGRKVLRKARMKVAQKT

SEQ ID NO: 30557 - protein, 81 aa, Oryctolagus cuniculus
SQGRVTFKDVAVCFSQDQWSDLDPTQKEFYGEYVLEEDCGIVVSLSFPIPRLEEIPQEREEEPQVLDVPEPPQEPDEPEIL

SEQ ID NO: 30558 - protein, 81 aa, Oryctolagus cuniculus
VKIEDMAVSLILEEWGCQNLARRNLNRDNRQENYGNTFSQGCENRNENEESTSKAEVREDSASRGETAGRFQKEFGEKREQ

SEQ ID NO: 30559 - protein, 81 aa, Puma concolor
LVKIEDVADVAVSFILEEWGHLDQSQKSLYRDDRKENYGSIPSMDYESRNDNVELMVKQISDDAEAHWVTSASTERNVPQS

SEQ ID NO: 30560 - protein, 81 aa, Sapajus apella
QGMMTFEDVAMSLTWEEWERLDPAQKDFYRESVQKDSGSTVPPSLESRTENKELIPMQEILEEAEPQEQLQEAFQGKPPLF

SEQ ID NO: 30561 - protein, 81 aa, Sapajus apella
SQEPVKDVHVARGFSYKKSVHQISAHRGLYRDFRKENVGNVVSLGSTVSTSNRITRLEQRKEPWTLGLHSSNKKSTLRSNY

SEQ ID NO: 30562 - protein, 81 aa, Sapajus apella
SQELLTFKDVSVDFTQEEWGQLAPAHRNLYREVMLENYGNLVSVGYQLSKPGVISQLEKGEEPWLMEREISGVPSLDLESK

SEQ ID NO: 30563 - protein, 81 aa, Puma concolor
SQGPVKDVRVARGFSYKKSVHQIPVHRDLYRDIRKESAGNMVSLGSAVSVSNKIARLEQRKEPWTPGVHSSNKRSILRSNY

SEQ ID NO: 30564 - protein, 81 aa, Pteropus alecto
PVTFGDIPFYFSQEEWGSLDPAQRDLFWDIKRENSRNVALGLGLKSQSQRSQLEEAVTALPGQTGVDVTVAWNPEEAKAWE

SEQ ID NO: 30565 - protein, 81 aa, Macaca fascicularis
QGMATFEDMAVSLTWEEWERLDPARRDFCRESAQKDSGSTVPPSLESRAENKELIPMQEILEAEPQGRLQEAFQGKRPLLS

SEQ ID NO: 30566 - protein, 81 aa, Macaca fascicularis
YMNRVSPFKDMILCFSEEDWSLLDPAQTGFYGEFIIGEDCGVSIPPNELAAQPDLSQREENEPRVPEPQDLQGKEVPQVSY

SEQ ID NO: 30567 - protein, 81 aa, Phascolarctos cinereus
QALVKIEDMAVSLILEEWGCQNLARRNLCRDNRPENYGNVFSQGCGSRTTNEESTSKEEISEATGSHGEISGRFQKEFGAT

SEQ ID NO: 30568 - protein, 81 aa, Macaca fascicularis
SRESITLKDVAVNFSRGEWKKLEPFQKELYKEVLLENFRNLEFLDFPVSKLELISQLKWVELPWLLEEVSKGSRPGIHGAE

SEQ ID NO: 30569 - protein, 81 aa, Sapajus apella
QTDLVTFDSVAVEFTQEEWTLLDPTERNLYRDVMLENYKNLSSVGYQLFKPSLISWMEEEEELSTLPRVLQEWKMCLKMNG

SEQ ID NO: 30570 - protein, 81 aa, Pteropus alecto
SAAYEFLSVDYSERKWKGPALSQRARRRNVMPETHRSVASWGDTRMENSELPPKQEISKGSESSDGTSGDLCEVVPAGPEA

SEQ ID NO: 30571 - protein, 81 aa, Pteropus alecto
SQEQLTFKDISVNFTQEEWGQLTPAHQNLYREVMLENYGNLVSVGYQISKPRVISQLEKGEDPWMTEKEGPGHPSSDLKSK

SEQ ID NO: 30572 - protein, 81 aa, Phyllostomus discolor
SQSLLTFEEVAVYFSQEEWELLDPNQKALYSDVMQENYETVIFLAMFVHLKPKVIFLEQGKESWVQGSTEFLNSPGELPVG

SEQ ID NO: 30573 - protein, 81 aa, Phyllostomus discolor
GHGEPDSASFHPPRIQEEWGLLNPSQKELYWDAMLEKYGSVVSLAGLPPPRLEAPAELEPGALSAGTEDPGSLCQRGESEG

SEQ ID NO: 30574 - protein, 81 aa, Sapajus apella
SQEPVTFADVAVVFTPEEWVFLDSTQRSLYRDVMLENYRNLASVGDQLRKPNASSDLEQRGEQWNTERGVISDTCPEPQLQ

SEQ ID NO: 30575 - protein, 81 aa, Macaca fascicularis
AQLQTMTFKDVEVTFSQDEWGWLDSAQRNLYRDVMLENYRNMAFLVGPFTKPALISWLEAREPWGLNLQAAQPKGNAGVAP

SEQ ID NO: 30576 - protein, 81 aa, Phascolarctos cinereus
PQELLTFEDVALSLTLEEWVQLDLHQKDLYRNVMLENYENVVSLGLSFSKPAVISQLEREKELWLLDIQGAENREVWKSSS

SEQ ID NO: 30577 - protein, 81 aa, Phascolarctos cinereus
FLESVTFKDVAPDFTWEEWEQLEPVQQDLCRDVLLENYRNLVFLGLSTSKTNVTSQIEHMKVPWVKESEAPRGISLYWNTG

SEQ ID NO: 30578 - protein, 81 aa, Desmodus rotundus
ESQSLLTFEEVAVYFSREEWELLDLSQKAVYSDVMQENYETVISLAVPAHQTLAFPEQTNTKDWTVTSELFLPESQTLLTF

SEQ ID NO: 30579 - protein, 81 aa, Oryctolagus cuniculus
IRDQDFGASLLPTAPQEQWRHLDSTQKEQYWDLMLETYGKMVSGAGTSSSKPDLTNSAEYGEELAGLHLHVSEKIPRPACV

SEQ ID NO: 30580 - protein, 81 aa, Rhinolophus ferrumequinum
SQEKLTFRDVSVDFTQEEWGQLAPAHQNLYREVMLENYGNLVSVGYQLSKPRVISQLEKGEDPWITEKEGPGYPSSDLKSK

SEQ ID NO: 30581 - protein, 81 aa, Phascolarctos cinereus
FQESVTFKDVDPDFTWEEWAQLAPVHQDLYKEVLLENYRNLVFLGLSIPKPDVISQLEREEMPWVLESKAPRTICPYFDTD

SEQ ID NO: 30582 - protein, 81 aa, Puma concolor
QAMVKIEDMAVSLILEEWGCQNLARRNLNRDNRQENYGNVFSQGCENRNENEESASKAENAEDSASRGETTGRFQKDFAEK

SEQ ID NO: 30583 - protein, 81 aa, Pteropus alecto
HGKVDSKPCHPPRIQEEWGLLDPSQKELHWDAMLEKYGAGVSLAGLPRPPSDPHGVLELRAPNEGTKSQGNLPPGGESKSR

SEQ ID NO: 30584 - protein, 81 aa, Lynx canadensis
GPVTFGDIPFYFSREEWGSLDPAQRDLFWDIKRENSRNVALGLGPESQSEQSRLEEAATALQGQAGGDVTVSWSPEEAETW

SEQ ID NO: 30585 - protein, 81 aa, Phascolarctos cinereus
PQESFTFKDMAMEFTGEEWVQLNPSQKKLYRDVMLENYRKLVSLGFAISRPDVGKKRNILNARGRYSRRHKEIFQTQLTVH

SEQ ID NO: 30586 - protein, 81 aa, Oryctolagus cuniculus
ALVEGLQRDPGQLLGWEWGLLDPLQKELYWDVMLEKYGTVVSLGLPPPQPGPQHLESEVRGSHRPASESQSLREDPPGCPE

SEQ ID NO: 30587 - protein, 81 aa, Lynx canadensis
SQGPVKDVRVARGFSYKKSVHQIPVHRDLYRDIRKESAGNMVSLGSAVSVSNKIARLEQRKEPWTLGIHSSNKRSILRSNY

SEQ ID NO: 30588 - protein, 81 aa, Lynx canadensis
SQGLVTFKDVAVCFSQDQWSDMDPTQKEFYGEYVLEEDCGIVVSLSFPIPRLDEISHVREEEPLVPDIPEPQEPQEPEILS

SEQ ID NO: 30589 - protein, 81 aa, Phyllostomus discolor
SGESMTLEDISVNFSRGEWRKLEPFQRQLYRDVLLENFRNLEFVGFPVSKLDLVSQLKWVDLPRLLEKEVSKGSRPECEPR

SEQ ID NO: 30590 - protein, 81 aa, Sapajus apella
RLKPEESQSVGVSQDEAFWKTYQGLQEQLSRNTHKETEPVYERALFVLPKPKVISCLEQGEEPWVQVSPEFKDSARGSSTG

SEQ ID NO: 30591 - protein, 81 aa, Phascolarctos cinereus
FQETVTFQDVAPDFTWEEWAQLDPGQQDLCRDVLMENYSNLAFVGLSNSKSDVISQLEHGEMPWLPRSEAPRGVCPDKDIE

SEQ ID NO: 30592 - protein, 81 aa, Phascolarctos cinereus
QTLVKTEEEVKFLVSEEWQCFDPAQKNTCGNVALKNFRNLDSLTGEIIIKDGMLLPKQEISKEIDSQEEVSHALRRDCSPQ

SEQ ID NO: 30593 - protein, 81 aa, Oryctolagus cuniculus
SLGSELFRDVAIVFSQEEWQWLAPVQRDLYRDVMLETYSSLVSLGLCISKPDVISFLEQGREPWIEERVTVGDLCPVLESQ

SEQ ID NO: 30594 - protein, 81 aa, Myotis lucifugus
FQERLTFKDITVNFTQEEWGQLTPAHRNLYREVMLENYGNLVSVAGYEFSKPRVISQLEKGEEPWITEKEGPGHPSADLKS

SEQ ID NO: 30595 - protein, 81 aa, Myotis lucifugus
HSAHCASPVSALPQVRNIGDQAAETVLQMVRPQGSAVYKLLSVDYTEQKWEDPSLSQRAPYQNIMLETNCSMASLGNDSVP

SEQ ID NO: 30596 - protein, 81 aa, Sapajus apella
ETQPGLVTMKHLAIDFPQQLHPAQKNFCKNGLWENYSDVGSAGHCMAKPDLVSLLEQEKEPWMVKRELTGSLFSGQQSVCE

SEQ ID NO: 30597 - protein, 81 aa, Phyllostomus discolor
QPQEALIFKDVEVTFSQDEWGWVAPAQRNLYRDVMLENYGNLASLVGPLAKPALISWLETREPWGLNVQGAQPKGDPGAAP

SEQ ID NO: 30598 - protein, 81 aa, Macaca fascicularis
VKIEDMAVSLILEEWGCQNLARRNLSRDHRQENYGSTFPQGGENRNENEESTSKAETTEDLASRGETAGRFQKEFGEKRDQ

SEQ ID NO: 30599 - protein, 81 aa, Phascolarctos cinereus
FQETITFQDVAPDFTWEEWAQLDPGQQDLYRDVLMENYRNLVFIGLSISKPDVISQLEHGEVPWLLKNEAPRSICPYWDIG

SEQ ID NO: 30600 - protein, 81 aa, Phascolarctos cinereus
FQESVTFKDVVPDFTWEELVQLDPVEQNLYRDVLLENYRNLVFLGLSASKPDVISQLEHGKVPWMLESEAPRDSDSSPEAR

SEQ ID NO: 30601 - protein, 81 aa, Phascolarctos cinereus
SAWSQMPVTFEDMTMYLSQEEWRCLDPVQRERYRDVLQEKYGLPVPKPNLIAQLDRREGLWTSSLQAFKERNIPRDNHKEC

SEQ ID NO: 30602 - protein, 81 aa, Myotis lucifugus
PQLPESLEDVAMYISQEEWGHQDPSKRALSRDTVQESYENVDSLESQVPNQEALSIQVEQGRKPWEPSAQICKEGLSPRNP

SEQ ID NO: 30603 - protein, 81 aa, Phascolarctos cinereus
GFQEPVTCEDVTMSFSPEEWRCLNSAQRVLYRGIVQENYRNVDSVGLAKPLLISRVEHGKDTCIPDLQGCKETEVLSSSCT

SEQ ID NO: 30604 - protein, 81 aa, Myotis lucifugus
AAQELVTFQDVFVDFSQEELNSLSAAQRRLHREVTLENYRSLVSLGYRFPKPDIIAQLEEEESRAMEEDGDTKTGPDWETG

SEQ ID NO: 30605 - protein, 81 aa, Macaca fascicularis
IRDQDLGASLLPAAPQEQWRHLDSTQKEQYWDLMLETYGKMVSGAGISHSKPDLTNSIEYGEELAGLYLHVNEKVPRPTCI

SEQ ID NO: 30606 - protein, 81 aa, Phascolarctos cinereus
SQESVTFKDVAVDFTQEEWGQLDSDQRDLYQAVMLENYRNLVFLGLPVSKPELISHMDQGEEPGILERETCGESIHITQHP

SEQ ID NO: 30607 - protein, 81 aa, Myotis lucifugus
IGDQDFGTSLLHTAPQEHWKHLDSIQKEQYWDLMLETYGKMVSGDCISNSKPDLTNSTECGEELAGLHLHVSEKIPRPTCR

SEQ ID NO: 30608 - protein, 81 aa, Phyllostomus discolor
SQSLLTFEEVAVYFSREEWELLDPSQKALYSDVMKENYETVVSLAVPAHQTLVFPEQTNTKDWTVASELFLPESQPYLCSP

SEQ ID NO: 30609 - protein, 81 aa, Phyllostomus discolor
AEELVTFQDVFVDFNLEELTSLNAAERKLHREVTLENYQNLVSVGYQFSKPDIISQLEEEESCVMQEESATETGQDWERGP

SEQ ID NO: 30610 - protein, 81 aa, Phyllostomus discolor
SQSLLTFEEVAVYFSREEWELLDPSQKALYSDVMKENYETVVSLALFVLPKPKVISCLEQGKEPWVQGSTEFMESPGELPI

SEQ ID NO: 30611 - protein, 81 aa, Phascolarctos cinereus
SQDSVTFKDVAVMFSRKEWWHLQPAQMELYRDVMLENYKNMVSVGLLTSKPELIAQLERGEAPWMRSRNVPRGPGAGSETR

SEQ ID NO: 30612 - protein, 81 aa, Phascolarctos cinereus
NHVTQLKDVILCFSEEEWSLLDPAQTGFYGEFIIEEDYGVSLPMNYPGPQPVPERINELPKVMQLPDSRVEEDEPCVPEFQ

SEQ ID NO: 30613 - protein, 81 aa, Desmodus rotundus
QAMVKIEDMAVSLILEEWGCQNLARRNLNRDNRQETYGNVFSQGCESRNENEQSTSKAEIAEDSASRGETRGRTQKDFGEK

SEQ ID NO: 30614 - protein, 81 aa, Phascolarctos cinereus
SQELVTFGDVAVYFSQEAQGQLDPTPPDLLQDQTQENYENGVSQRFPVPRPNMISQLKQEEKLQNPDLQGSKEKENSKDSQ

SEQ ID NO: 30615 - protein, 81 aa, Phyllostomus discolor
LRDQPFGASLLQTTPQEPWWHLDSTQKEQYWDLLLETYGKMVSGGISNSKPDLTNSTEYGEELAGFHLYVSEKLPKPTCIG

SEQ ID NO: 30616 - protein, 81 aa, Puma concolor
SQELLTFKDISVDFTQEEWGQLAPAHRSLYREVMLENYGNLVSVGYQLSKPGVISQLEKGEEPWLIEREVSGGPRSDLESK

SEQ ID NO: 30617 - protein, 81 aa, Gorilla gorilla
DTVAYEDLSVDYTQKKWKGLTLSQRALQWNMMPENHYSMASLAGENVMKGSELTPKQEIFKGSESSNRTSGGLFGVVPGAA

SEQ ID NO: 30618 - protein, 81 aa, Gorilla gorilla
QEPVTFKDVVVEFSKEEWGQLDSAVKNLYRNVMLENFRNLNSLRKAHLLSKPFESLKLESKKKRWIMEKEIPRNTIFDMKS

SEQ ID NO: 30619 - protein, 81 aa, Phascolarctos cinereus
AQDALTFQDVAVDFTWEEWGQLDPAQQNLYRDVMLENYQNLISLGFPVSKPEVISQLEQGEVPWALKRAVAEGSCPDWEAR

SEQ ID NO: 30620 - protein, 81 aa, Ailuropoda melanoleuca
EPVTFKDVIVEFSEEEWGLLDPAVKTLYRDVMLENYRNLNSLHQGTEQLLSKPVEISKLESKERRWTVEQETPSTSVLDRE

SEQ ID NO: 30621 - protein, 81 aa, Gorilla gorilla
SQEPVKDVHVARGFSYRKNVHQIPAQRDLYRDFRKENVGNVVSLGSAVSTSNKITRLEQRKEPWTLGLHSSNKRSILRSNY

SEQ ID NO: 30622 - protein, 81 aa, Lynx canadensis
EGESITFKDVAVNFSRGEWRKLEPFQKELFKEVLLENFRNLEFLGFAVSKLDLISQLKWVELPWLLEKEVSKDALLDESTL

SEQ ID NO: 30623 - protein, 81 aa, Macaca fascicularis
IRDQDLGASLLPAAPQEQWRHLDSTQKEQYWDLMLETYGKMVSGGISHSKPDLTNSIEYGEELAGLYLHVNEKVPRPTCIG

SEQ ID NO: 30624 - protein, 81 aa, Phascolarctos cinereus
GRKDLVTFEDVSVDLPKKEWKSSAAAQRFFRDLMLENYRDVVSLAGFPFSKPTGISRREEEPWGLNRQEPLDLEGGRSTCT

SEQ ID NO: 30625 - protein, 81 aa, Phascolarctos cinereus
GKESVTFKDVAVEFTKEEWVQLNPSQKKLYRDVMLENYRNLVSLGFAASRPNDSDQLERKEVSSLPEADIPRSSCPESREF

SEQ ID NO: 30626 - protein, 81 aa, Canis lupus
SQDLVTFKDVVVDFSPEELTYLSAAQRNLYREVMLENYRNLVSLGYQFSKPDIISQLEEEESHVREEDINTDKCQDWEKRP

SEQ ID NO: 30627 - protein, 81 aa, Gorilla gorilla
SCESITLKDIAVNFSRGEWKKLEPFQKELYKEVLLENLRNLEFLDFPVSKLELISQLKWVELPWLLEEVSKGSRLDIHGAV

SEQ ID NO: 30628 - protein, 81 aa, Ailuropoda melanoleuca
PQEPVTFADVAVLFTPEEWMFLDSAQRSLYRDVMLENYRNLASVGDQLGKPSTFSHLEPGEERWPPERRSFPGTHPEPQHQ

SEQ ID NO: 30629 - protein, 81 aa, Puma concolor
GPVTFGDVPFYFSREEWGSLDPAQRDLFWDIKRENSRNVALGLGPESQSKQSRLEEAAAALQGQAGGGGGRGGDVTVSWSP

SEQ ID NO: 30630 - protein, 81 aa, Canis lupus
GHREPTSTSFHPPRIQEEWGLLDPSQKELYWDAMLEKYGTVVSLAGIPAPQPEAQAELEPGALRTGTESLHLGDENESHCE

SEQ ID NO: 30631 - protein, 81 aa, Gorilla gorilla
VKIEEVADVAVSFILEEWGHLDQSQKSLYRDDRKENYGSITSMGYESRDNMELIVKQISDDSESHWVAPEHTERSIPQDPD

SEQ ID NO: 30632 - protein, 81 aa, Phyllostomus discolor
QEPVTLKDVVVEFSTEEWGQLDLAVRNLYRDVMLENYRNCNSLRKELQFSKPIEVPKLEIKTKRWMMEQEIPRTMVFGKKQ

SEQ ID NO: 30633 - protein, 81 aa, Canis lupus
IRDQDFGASFLQAASPEQWRHLDSTQKEQYWDLMLETYGKMVSGGISSSKSDLTNSAEYGEELAGLHLHVSEKIPRPTLIG

SEQ ID NO: 30634 - protein, 81 aa, Neophocaena asiaeorientalis
ASVTFEDVAVYFSWEEWSLLDKAQRHLYHDVMLEIFTLISSLGCLCGIENDKAPSGQSVSQERMPQIRTLKPDPSTQKAHL

SEQ ID NO: 30635 - protein, 81 aa, Canis lupus
HREPTSTSFHPPRIQEEWGLLDPSQKELYWDAMLEKYGTVVSLGAPRHPPGPPPLALTCKSPSPAPMSGLLPDCPSPQQEY

SEQ ID NO: 30636 - protein, 81 aa, Ailuropoda melanoleuca
DQEFGASFLQASPPEHWRHLDSTQKEQYWDLMLETYGKMVSGALCVPGISNSKCDLTNSTEYGEELAGLHLHVGEKISRPT

SEQ ID NO: 30637 - protein, 81 aa, Ailuropoda melanoleuca
QPQEAVTFKDVEVTFSQDEWGWLDPAQRNLYRDVMLENYRNVVSLVGPFTKPVLISWLEAREPWGLNAQGAQPKGNLGVAP

SEQ ID NO: 30638 - protein, 81 aa, Phyllostomus discolor
SLLTFEDVIVSFSEEEWELLDPTQKILYHDVMQENYETVISLGLKLRHDTGNEPLISASTLEIEASGCKVLRKARMKVAQK

SEQ ID NO: 30639 - protein, 81 aa, Canis lupus
LVTKESMTFRDVAVDITQEDWEIMRPVQKELYKTVTLQNYWNMVSLGLTVYRPTVIPILEEPWMVIKEILEGPSPEWKTEP

SEQ ID NO: 30640 - protein, 81 aa, Canis lupus
FQSLLTFEEVAVYFSQEEWELLDPTQKALYNDVMRENYETVISLALFVLPKPKVISCLEQGEEPWVQGPLEFKDNPGELPT

SEQ ID NO: 30641 - protein, 81 aa, Nomascus leucogenys
SQEPVKDIHVARGFSYKKNVHQIPAHRDLYRDFRKENIGNVVSLGSTVSTSNKITRLEQRKEPWTLGLHSSNKRSILRSNY

SEQ ID NO: 30642 - protein, 81 aa, Muntiacus muntjak
AQESMTLKDVAVTFSRGEWRKLEPSQKEIYKEVLLENYRNLEFLGFPVSKLDLVSQLKWAGPPRLLQKEVSKGCRPDVLME

SEQ ID NO: 30643 - protein, 81 aa, Muntiacus muntjak
LLTFEEVAIYFSQEEWELLDPTQKALYNDVMHENYETVVSLARRFNPETVPRQDTLLLYNPKECRGKKVCPFFLLENSRPL

SEQ ID NO: 30644 - protein, 81 aa, Ailuropoda melanoleuca
HALPATHVPAPPHEGGPRDQAMASALFTADSQAMVKIEDMAVSLILEEWGCQNLARRNLNRDNRQENYGNVFSQGSFCCLK

SEQ ID NO: 30645 - protein, 81 aa, Gorilla gorilla
ETQPGLVTIKNLAVDFPQQLHPAQKNFCKNRIWENNSDLGSAGHCVAKPDLVSLLEQEKEPWMVKRELTGSLFSGQRSVRE

SEQ ID NO: 30646 - protein, 81 aa, Ailuropoda melanoleuca
LESVTFEEVAVDFSQEEWALLDAAQKILYRDVMLENYRNLASLDWDIQLKSKDGIPMQNVPGEKTCNGIKLAPTQPGKKPL

SEQ ID NO: 30647 - protein, 81 aa, Desmodus rotundus
QPQEALTFKDVEVTFSQDEWGWLAPAQRNLYRDVMLENYSNLASLVGPLIKPALISWLETREPWGLNVQGAQPKDDPGAAP

SEQ ID NO: 30648 - protein, 81 aa, Macaca fascicularis
QTDLVTFDSVAVEFTQEEWTLLDPTQRNLYCDVMLENYKNLSSVGYQLFKPSLISWLEEEEELSTLPRVLQEWKMCLKTKG

SEQ ID NO: 30649 - protein, 81 aa, Ailuropoda melanoleuca
AASISFHAPRIQEEWGLLDPSQKELYWDAMLEKYGTVVSLAGIPAPPPEAQAESEPEALRSGTEGRRSLHPGDESESHCEG

SEQ ID NO: 30650 - protein, 81 aa, Gorilla gorilla
QTDLVTFDSVAVEFTQEEWTLLDPTQRNLYSDVMLENYKNLSSVVYQLFKPSLISWLEEEEELSTLPRVLQEWKMCLKTNG

SEQ ID NO: 30651 - protein, 81 aa, Phyllostomus discolor
SQEQLTFKDISVNFSQEEWGQLTPAHRSLYREVMLENYGNLVSVAGYELCKPRVISKLEKGEEPWISEKEGPGHHSSDLKS

SEQ ID NO: 30652 - protein, 81 aa, Phyllostomus discolor
FERQLGLVTIVNMASDFSQQLDPSPESFHKNMTWETRDLEAAGCCVSRPDVVSVLDQGKEPWLVKREFTGLLSGHQSVHET

SEQ ID NO: 30653 - protein, 81 aa, Phascolarctos cinereus
RLQDSVMFEDVAIHFSEAEWSHLSPAQRALYRNVMLENYGNLASLASPFPKPGVISKLEQASWDLQEALDQEDLKNTYADG

SEQ ID NO: 30654 - protein, 81 aa, Gorilla gorilla
IRDQDLGASLLPAAPQEQWRHLDSTQKEQYWDLMLETYGKMVSGAGISHPKSDLTNSIEFGEELAGLYLHVSEKIPRPTCV

SEQ ID NO: 30655 - protein, 81 aa, Ailuropoda melanoleuca
SVTFRDVAVLFSRDEWRHLDSTQRTLYREVMLENYGTLVSLGLKTQPEMEALPPRQGISIEETFQGMMKKRSIKCSHWDNN

SEQ ID NO: 30656 - protein, 81 aa, Phyllostomus discolor
GHGEPDSASFHPPRIQEEWGLLNPSQKELYWDAMLEKYGSVVSLGLPPPRLEAPAELEPGALSAGTEDPGSLCQRGESEGP

SEQ ID NO: 30657 - protein, 81 aa, Gorilla gorilla
GMVTFEDMAVSLTWEEWERLDPARRDFCRESAQKDSGSTVPPSLESRVENKELIPMQQILEEVEPQGRLQEAFQGKRPLFC

SEQ ID NO: 30658 - protein, 81 aa, Lynx canadensis
QEPISFKDVIVEFSKEEWGQLDPAVKNLYRDVMLENYRNLNSLHQEHVFSKPVELSELESKDRRWIIEQEIPSTSFFDRER

SEQ ID NO: 30659 - protein, 81 aa, Macaca fascicularis
SQEPVKDVHVARGFSYKKSVHQIPAHRDLYQDFRKENVGNMVSLGSTASTSNKITRLEQRREPWTLGLHSSNKRSILRSNY

SEQ ID NO: 30660 - protein, 81 aa, Gorilla gorilla
SCESITLKDIAVNFSRGEWKKLEPFQKELYKEVLLENLRNLEFLDFPVSKLELISQLKWVELPWLLEEVSKGSRLASQEGD

SEQ ID NO: 30661 - protein, 81 aa, Phyllostomus discolor
SQEQLTFKDISVNFSQEEWGQLTPAHRSLYREVMLENYGNLVSVGYELCKPRVISKLEKGEEPWISEKEGPGHHSSDLKSK

SEQ ID NO: 30662 - protein, 81 aa, Macaca fascicularis
SQELLTFKDVSVDFTQEEWGQLAPAHRNLYREVMLENYGNLVSVGYQLSKPGVISQLEKGEEPWLMEREISGVPSSDLESK

SEQ ID NO: 30663 - protein, 81 aa, Phyllostomus discolor
ESQSLLTFEEVAVYFSREEWELLDPSQKALYSDVMKENYETVVSLAVPAHQTLVFPEQTNTKDWTVASELFLPESQTLLTL

SEQ ID NO: 30664 - protein, 81 aa, Acinonyx jubatus
PAATSFHPPRIQEEWGLLDRSQKELYWDAMLEKYGTVVSLAGLPAPLPEARVESEPGVLRSGTEGQRSLHPGLHREQGWRP

SEQ ID NO: 30665 - protein, 81 aa, Acinonyx jubatus
SQGPVKDVRVARGFSYKKSVHQIPVHRDLYRDIRKESAGNMVSLGSAVSVSNNIARLEQRKEPWTLGVHSSNKRSILRSNY

SEQ ID NO: 30666 - protein, 81 aa, Odocoileus virginianus
GDQDFGASLLHTASQEQWRHLDSTQKEQYWDLMLETYGKMVSGGAGISNARPDLTDPAGYGAELAGPHLQASEKIPRPTCI

SEQ ID NO: 30667 - protein, 81 aa, Cebus imitator
TVVFEDLSVDYTQKKQKCPALSQRAMHWNVMPENDHSMASLGGTETGDVCGDTFKELEGQTSDEEGSRLENDFLEITDEDK

SEQ ID NO: 30668 - protein, 81 aa, Ovis aries
SQSLLTFEEVAMYFSQEEWELLDPTQKALYNDVMQENYETVISLAVFVLPKPKVISYLEQGKDPYIQGSPVFKDNPEELLS

SEQ ID NO: 30669 - protein, 81 aa, Ovis aries
LVTFEDVAVDFSPEELPYLSASQRNLYREVMLENYRNQPPSYKSPSSTGYQFPKPDIISQLEEEESHAREEDGSTVTCQDW

SEQ ID NO: 30670 - protein, 81 aa, Rhinopithecus roxellana
PQLPESLEDVAMYISQEEWGHQDPSKRALSRDTVQESYENVDSLESHIPSQDVPGTQVGQGGKLWDPSVQSCKEGLSPRGP

SEQ ID NO: 30671 - protein, 81 aa, Callithrix jacchus
VKIEEVADVAVSFILEEWGHLDQSQKSLYRDDRKENYGSITSMDYESRDNMELMVKQVSDDTESQWMAPEHTERSVPQDPD

SEQ ID NO: 30672 - protein, 81 aa, Odocoileus virginianus
NFALTASMVCLHETETKEIPSEQNVSLEALSQVRTPKVVTFKDVAMTFTQEEWRQLDLDQRTLFREVMLETCGLLVSLGTC

SEQ ID NO: 30673 - protein, 81 aa, Bos taurus
AEELVTFEDVAVHFSPEELPYLSASQRNLYREVMLENYRNLVSLGYQFPKPDIISQLEEEESHAREEDGSTVTCQDWEEQS

SEQ ID NO: 30674 - protein, 81 aa, Rhinopithecus roxellana
SQEPVKDVHVARGFSYKKSVHQIPAHRDLYRDFRKENVGNVVSLGSTASTSNKITRLEQRKEPWTLGLHSSNKRSMLRSSY

SEQ ID NO: 30675 - protein, 81 aa, Odocoileus virginianus
EPTPAPFQPPRLQEWGLLEPSQKELYWDAMLEKYGSVVSLGLPHPLPESRAKSQPEALSTGSGSEGRRNLRPGDESEGRPG

SEQ ID NO: 30676 - protein, 81 aa, Odocoileus virginianus
QEPVKFKDVVVEFSKEEWGQLDPDVKTLYRRVMLENYRNLNSLHKEHLLSKPVETSKLESKKESWIMEQEIPRTAVADRER

SEQ ID NO: 30677 - protein, 81 aa, Odocoileus virginianus
LLTFEEVAMYFSQEEWELLDPTQKALYNDVMQENYETVISLAVPAHQLLAFSEQTNTSEWTVAPELILPESQSLLTFEEVA

SEQ ID NO: 30678 - protein, 81 aa, Bos taurus
QELLTFKDISVDFTQEEWGQLAPAHRNLYREVMLENYGNLVSVGKDRLHIHPESYLKSKTETSASNAKYNILQEQLYHGMM

SEQ ID NO: 30679 - protein, 81 aa, Acinonyx jubatus
PAATSFHPPRIQEEWGLLDRSQKELYWDAMLEKYGTVVSLGLPAPLPEARVESEPGVLRSGTEGQRSLHPGDESESHCEGP

SEQ ID NO: 30680 - protein, 81 aa, Cebus imitator
GHQEPASTSFHPPRIQEEWGLLDRSQKELYWDAMLEKYGTVVSLGLPPHQPEAQAQSELGVLLTGAGVCRNLGSGDENEGL

SEQ ID NO: 30681 - protein, 81 aa, Callithrix jacchus
SQTLVTFKDVFVDFTREEWKLLDTAQQIVYRNVMLENYKNLVSLGYQLTKPDVILRLEKGEEPWVVERGIHQETHPDSETA

SEQ ID NO: 30682 - protein, 81 aa, Bos taurus
PLTFEDVALYFSEEEWKIMTPDEKTLYLDVMQELYEDVASVGLKLKNDTGNDPPVSLPTLEIQPSGCEVLRKATMKDAETT

SEQ ID NO: 30683 - protein, 81 aa, Cebus imitator
PPNRVSPFKDMILCFSEEDWSLLDPAQTGFYGEFIIGEDCGVSMPPNELAAQPDLSQGEENEPRVPELQDLQGKEVPQVSY

SEQ ID NO: 30684 - protein, 81 aa, Ursus maritimus
SQSFLTFEEVAMYFSQEEWELLDPTQEALYNDVMWENYETVISLALFVLPKPKVISYLDHEEEPWVQGPLEFKNSPGDLPA

SEQ ID NO: 30685 - protein, 81 aa, Rhinopithecus roxellana
GRQEAASTSFHPPRIQEEWGLLDRSQKELYWDTMLEKYGTVVSLGLPPHQPEAQAQSELGMMLMGTGVCRSLRSGNESEGP

SEQ ID NO: 30686 - protein, 81 aa, Odocoileus virginianus
QGLVPAQDVAVPLTWEEWERLGPAQKPFFRESAPEGHENAVSPSSETRIENKELIPKQEILEVEPPGQLQGFQERAPLSSE

SEQ ID NO: 30687 - protein, 81 aa, Cebus imitator
QEPVTFKDVVVEFSKEEWGQLDSAVKNLYRDVMLENFRNLNSLRKAHLLSKPVGSLELKNKKKRWITEKEISRKTISDMQS

SEQ ID NO: 30688 - protein, 81 aa, Bos taurus
SQGPVKDVHMARGFSYKKSVHQIPAHKDLYRDIRKESVGNMVSLGSTVSAANKIARLEPRKEPWTISLQSSNKRTVLQSNY

SEQ ID NO: 30689 - protein, 81 aa, Ovis aries
HHLERLTSEDVAIKFTQEEWEFLDPAQRALYRDVMLETYRNLLSVGEDDFLPELPLGICIFPVCPLGGPDVFHLRVLVTGA

SEQ ID NO: 30690 - protein, 81 aa, Odocoileus virginianus
KIEDVADVAVSFILEEWGHLDQSQKSLYRDDRKENYGSMTSMDYESRSDNVELTVKQISDEAESSWMTSGGPERTVPSSQE

SEQ ID NO: 30691 - protein, 81 aa, Odocoileus virginianus
PQEPVTFADVAVLFTPEEWLFLDSAQKSLYRDVMLENYRNLASVGDQLCKTRMSSHMEQREELCVTERGVFPGAQLGPHLQ

SEQ ID NO: 30692 - protein, 81 aa, Callithrix jacchus
VKIEEVADVAVSFILEEWGHLDQSQQSLYRDDRKENYGSITSMDYESRDNMELMVKQVSDDTESQWMAPEHTERSVPQGPD

SEQ ID NO: 30693 - protein, 81 aa, Acinonyx jubatus
SQGLVTFKDVAVCFSQDQWSDMDPTQKEFYGEYVLEEDCGIVVSLSFPIPRLDEISHVREDEPLVPDIPEPQEPQEPEILS

SEQ ID NO: 30694 - protein, 81 aa, Cebus imitator
SCESITLNDVAVNFSRGEWKKLEPFQKELYKEVLLENFRNLEFLDFPVSKLELISQLKWVELPWLLEKEVSKGSHPDESAL

SEQ ID NO: 30695 - protein, 81 aa, Monodon monoceros
QGLVTFKDVAVCFSQDQWSDLDPTQKEFYGEYVLEEDCGIVVSLSAFPIPRLDEISHMGEEEPLIPEIPEAQEPQEPEILS

SEQ ID NO: 30696 - protein, 81 aa, Macaca mulatta
SQSLLTFEEVAMYFSQEEWELLDPTQKALYNDVMQENYETVISLALFVLPKPKVISCLEQGEEPWVQVSPEFQDSAGKSPT

SEQ ID NO: 30697 - protein, 81 aa, Ovis aries
GNQDFGASLLHTASQEQWRHLDSTQKEQYWDLMLETYGKMVSGGAGISSARPDLTDPAGYGTELAGPHLHASEKIPRPTCI

SEQ ID NO: 30698 - protein, 81 aa, Ovis aries
SYRSKTMAQGSLTFSDVAIGFSQQEWECLDPVQKTLYRDVMMENYGNLVSLGHSISKPNVITLLEQGKEPWIVVREETRSW

SEQ ID NO: 30699 - protein, 81 aa, Ovis aries
KLPVVFEDVAVYFTREEWGTLDKRQKELYRDVMRMNYELLASLATGPAAAKPDLISKLERRAAPWIRDPHRPKWGKGHPPS

SEQ ID NO: 30700 - protein, 81 aa, Ovis aries
EKLPVVFEDVAVYFTREEWGTLDKRQKELYRDVMRMNYELLASLGPAAAKPDLISKLERRAAPWIRDPHRPKWGKGHPPSA

SEQ ID NO: 30701 - protein, 81 aa, Ovis aries
SQRPLTFEDVALYFSEEEWLIMDPNQRTLYLDVMQELYENVTSLGLLGNVSNYGLKIQSSNESFKAIQFKMTLKKYKCDTK

SEQ ID NO: 30702 - protein, 81 aa, Vulpes vulpes
VMFEEVSVCFTSEEWECLGPIQRALYWDVMLENYGNVTSLEWETMTENEEVTPKPTISQRADSQKGTFKRLQGSVPQTLDF

SEQ ID NO: 30703 - protein, 81 aa, Otolemur garnettii
QELVTFKDVVVDFSLEELSYLSAAQRNLYREVMLENYRNLVSIGSLFILLKVSVSLSKESRRNFTFLLDWEKTSKTKELTP

SEQ ID NO: 30704 - protein, 81 aa, Vulpes vulpes
SLLTFEEVAMYFSQEEWELLDPTQKALYNDVMRENYETVISLAVPVHKILAFPEQIITKESTVAPELVLPESQSLLTFEEV

SEQ ID NO: 30705 - protein, 81 aa, Otolemur garnettii
LPKMGSVGDWEVLAESQDALGLGRHAEREFKDLLEDNYGDSVCLGVPVPKPSITSQKEQGPEFWCVSLKNSGKRNTTDYSL

SEQ ID NO: 30706 - protein, 81 aa, Ovis aries
QAMVKIEDMAVSLILEEWGCQNLARRNLNRDARQENYGNVISQGCEHRNENEESTSKAESAEDSASHGETAGKFQKDVGEK

SEQ ID NO: 30707 - protein, 81 aa, Rhinopithecus roxellana
SQELLTFKDVSVDFTQEEWGQLAPAHRNLYREVMLENYGNLVSVGYQLSKPGVIFQLEKGEEPWLMEREISGVPSSDLESK

SEQ ID NO: 30708 - protein, 81 aa, Rhinopithecus roxellana
QEPVTFKDVVVEFSKEEWGQLDSAVKNLYRNVMLENFRNLNSLRKAYLFSKPVESLKLESKKKRWIMEKEIPWKTVFDMQS

SEQ ID NO: 30709 - protein, 81 aa, Ovis aries
KIEDVADVAVSFILEEWGHLDQSQKSLYRDDRKENYGSMTSMDYESRNDNVELTVKQISDEAESSWMTSGGPERIVPLSQE

SEQ ID NO: 30710 - protein, 81 aa, Acinonyx jubatus
LLTFEEVAMYFSQEEWEFLDPTQEALYNDVMRENYETVISLGIKHKSDTENHQPIRVSDLEIQAPGDIVSKKARAKVPQKT

SEQ ID NO: 30711 - protein, 81 aa, Bos taurus
PLTFEDVALYFSEEEWKIMTPDEKTLYLDVMQDVYEDVASVGLKLKNDTGNDPPVSLPTLEIQPSGCEVLRKATMKDAETT

SEQ ID NO: 30712 - protein, 81 aa, Ovis aries
QAQSTFKDVFLDFTPEKWECLDPAQRTLYKDMIVETLRNLLSVDVSQIQTIKKLQAKGNSGKEEIFQRVMFGRAKSHEIED

SEQ ID NO: 30713 - protein, 81 aa, Ovis aries
RAKFPQVPVTLEDVAVYLSQEEWGCLDVAQQDHSCDVLLEDAGAVHGSHLEDGEDASLSTAWAQALQDLGPGPGQARPQRP

SEQ ID NO: 30714 - protein, 81 aa, Otolemur garnettii
PQLPESIEDVAVYISQEEWGHQDPSKRALSRDTVQESYENVDSLESHIPRQEIPTTQVEQERKPWDANVQSCKEGLSLRSP

SEQ ID NO: 30715 - protein, 81 aa, Rhinopithecus roxellana
DTQPGLVAIKNLAVDFPQHLHSAQKNFCKNGIWENHSDLGSAGHCVAKPDLVSLLQQEKEPWMVKRELTGSLLSGQLSVRE

SEQ ID NO: 30716 - protein, 81 aa, Tursiops truncatus
QEPVTFKDVVVEFSEEEWGQLDPAVKNLYRDVMLENYRNLNSLHKEHLLSKPVETSRLESKEKSWIMEQEILRTTVFDREI

SEQ ID NO: 30717 - protein, 81 aa, Odocoileus virginianus
SQELLTFKDISVDFTQEEWGQLAPAHRNLYREVMLENYGNLVSVGCQLSKPSVISQLEKGEEPWMTEKEGAGDPSSDLKSK

SEQ ID NO: 30718 - protein, 81 aa, Cebus imitator
SQEPVKDVHVPRGFSYKKSVHQIPAHRGLYRDFRKENVGNVVSLGSTVSTSNRITRLEQRKEPWTLGLHSSNKKSTLRSNY

SEQ ID NO: 30719 - protein, 81 aa, Bison bison
SAWSQVPVALEDVAVYLSQEEWGCLDLAQQDHSCDVLLEDAGLPTPGPCLTALQGQGEDPRDPAQAASGPREVSGGASSER

SEQ ID NO: 30720 - protein, 81 aa, Callithrix jacchus
SQELLTFKDVSVDFTQEEWGQLAPAHRNLYREVMLENYGNLVSVGYQLSKPGLISQLEKGEEPWLMEREISGVPSSDLESK

SEQ ID NO: 30721 - protein, 81 aa, Callithrix jacchus
GPVASADIPFYFSQEEWGTLDPAQRDLFWDIKRENSRNTTLGLGLKGQSERSRPEEVVPALPGQAALGPVVGARRGRPPTR

SEQ ID NO: 30722 - protein, 81 aa, Bison bison
SAEPLTFKDIIVDFTQEEWGHLAPAHQNLYREVMLENYGNLVSVAGYQLSKPGVVSQLEKGEEPWLMKREISGGPSPGKSK

SEQ ID NO: 30723 - protein, 81 aa, Cebus imitator
AELPVVFEDVAVYFTREEWGMLDKRQKELYRDVMRMNYELMASLGPAAAKPDLISKLERRAAPWIKDPNGPKWGKGRPPGN

SEQ ID NO: 30724 - protein, 81 aa, Callithrix jacchus
LLKVEDVALSLAPEWTQLDSSQVNLYRDEKQENHGSLASLGGEIQTQSRDLPPAEELPEKEHGKISCHLSEDIVQIPTCAE

SEQ ID NO: 30725 - protein, 81 aa, Callithrix jacchus
TQGSLTFKDVAIEFSQEEWKCLDPVQKALYRDVMLENYRNLGFLGLCLPDLDIISMLEQGKEPWTVVSQVKITRNPNCGEC

SEQ ID NO: 30726 - protein, 81 aa, Saimiri boliviensis
DSVVFEDLSVDYTQKKQKCPALSQRAMHWNMMLENDHSMASLAGENKLESSELTPKQKIFKGSESSNRTSGELFGVVPGGT

SEQ ID NO: 30727 - protein, 81 aa, Acinonyx jubatus
PHWLVTFRDVAIDFSQEEWECLSSTQRDLYRDVMLENYSNLISLAGCAIPKPDVFSLLEQGKDPWMVTRAMTRRWSSDLES

SEQ ID NO: 30728 - protein, 81 aa, Odocoileus virginianus
EDPVTFLDVAVDFSTEEWGLLDPTQRTEYHDVMLETFGHLVSVGWETTLDSKQLPPQPGLSEEGPACPLKEEEWSSADDAR

SEQ ID NO: 30729 - protein, 81 aa, Cebus imitator
LPLQGLVTMKHLAIDFPQQLHPAQKNFCKNGLWENYSDVGSAGHCMAKPDLVSLLEQEKEPWMVKRELTGNLFSGECKRAC

SEQ ID NO: 30730 - protein, 81 aa, Rhinolophus ferrumequinum
LVTKESMTFKDVAVDITQEDWELMRPVQKELYKTVTLQNYWNMVSLGLTVYRPTVIPLLEEPWMVIKEILEGPSPEWETEA

SEQ ID NO: 30731 - protein, 81 aa, Phyllostomus discolor
SIQDLVKAKDVCLTWGEWKQLDPIQRDFYRENVLKDYGNTVLPSLETRTQNKELIPKQEILEVEPQMQLQEGSPWKAPLYS

SEQ ID NO: 30732 - protein, 81 aa, Bison bison
SQSLLTFEEVAMYFSQEEWELLDPTQKALYNDVMQENYESVIFLALFVLPKPKVISCLEQGEEPWVQRPLEFKDSSKELPT

SEQ ID NO: 30733 - protein, 81 aa, Odocoileus virginianus
SAWSQVPVTLGGVAMYLSQEEWGCLDLAQQDHSCDVLLEDAGLPTPGPCLTALQGQGEGPWDPAQAASGPREVSGGASSGR

SEQ ID NO: 30734 - protein, 81 aa, Cebus imitator
HHFANGDFAQPASPVPTLPQVGNSGDQAGATVLRMVRPQDTVVFEDLSVDYTQKKQKCPALSQRAMHWNVMPENDHSMASL

SEQ ID NO: 30735 - protein, 81 aa, Lipotes vexillifer
LSQGLVTFKDVAVCFSQDQWSDLDPTQKEFYGEYVLEEDCGIVVSLSFPIPRLDEISHMGEEPLIPEIPEAQEPQEPEILS

SEQ ID NO: 30736 - protein, 81 aa, Cebus imitator
QGMMTFEDVAMSITWEEWERLDPARKDFYRESVQKDSGSTVPPSLESRTENKELIPMQEILEEAEPQEQLQEAFQGKPPLF

SEQ ID NO: 30737 - protein, 81 aa, Callithrix jacchus
ESCESITLNDVAVNFSRGEWKKLEPFQKELYKEVLLENFRNLEFLDFPVSKLELISQLKWVELSWLLEKEVSKGCQPGSII

SEQ ID NO: 30738 - protein, 81 aa, Saimiri boliviensis
QLQENMTFKDVEVTFSQDEWGLLDSAQRNLYRDVMLENYRNMVFLVGPFTKPALISWLEAREPWGLNLQVAQPKGNPGAAP

SEQ ID NO: 30739 - protein, 81 aa, Cebus imitator
VKIEEVADVAVSFILEEWGHLDQSQKSLYRDDRKENYGSITSMDYESRDNMELMVKQVSDDTESHWVAPEHTERSVPQGPD

SEQ ID NO: 30740 - protein, 81 aa, Callithrix jacchus
SQEPVKDVHVTRGFSYKKSVHQIPAHRGLYRDFRKENVGNVVSLGSTVSASNRITRLEQRKEPWTLGLHSSNKRSTLRSNY

SEQ ID NO: 30741 - protein, 81 aa, Vulpes vulpes
SQELLTFKDIFVDFTQEEWGQLAPAHRNLYREVMLENYGNLVSVGYQLSKPGVISQLEKGEEPWLIEREISGSPSSDLENK

SEQ ID NO: 30742 - protein, 81 aa, Ovis aries
SQRPLTFEDVALYFSEEEWLIMDPNQRTLYLDVMQELYENVTSLGLLGNVSNYGLKIQSSNESFKAIQFKALSAVLSSESC

SEQ ID NO: 30743 - protein, 81 aa, Cebus imitator
GPVASGDIPFYFSQEEWGTLDPAQRDLFWDIKRENSRNTTLGLGLKGQSERSRLEEVVPALPGQADLGPVVGARRGRPPTR

SEQ ID NO: 30744 - protein, 81 aa, Callithrix jacchus
IRDQDLGTTLLPAAPQEQWRHLDSTQKEQYWDLMLETYGKMVSGGISHSKPDLTNSIEYGEELAGLYLHVNDKIPRPSCIG

SEQ ID NO: 30745 - protein, 81 aa, Otolemur garnettii
EGMVTFEDMAVALTWEEWEHLDSARKDFCKESTQREYGSTIQPSLESTFENKQLILKQEISEETEPQEWLQEVCQGKPSLF

SEQ ID NO: 30746 - protein, 81 aa, Pongo abelii
GMVTFEDMAVSLTWEEWERLDPARRDFCRESVQKDSGSTVPPSLESRVENKELIPMQQILEEVEPQGQLQEAFQGKHPLFS

SEQ ID NO: 30747 - protein, 81 aa, Callithrix jacchus
EELPVVFEDVAVYFTREEWGMLDKRQKELYRDVMRMNYELLASLGPAAAKPDLISKLERRAAPWIKHPNGPKWGKGRPPGN

SEQ ID NO: 30748 - protein, 81 aa, Ovis aries
SQGPVKDVHTARGFSYKKSVHQIPAHKDLYRDIRKESVGNMVSLGSTVSAANKIARLEPRKEPWTIGLQSSNKRTVLRSNY

SEQ ID NO: 30749 - protein, 81 aa, Ovis aries
SQSLLTFEEVAMYFSQEEWELLDPTQKALYNDVMQENYETVISLALFVLPKPKVISCLEQGEEPWVQRPLEFKDSSQELPT

SEQ ID NO: 30750 - protein, 81 aa, Ovis aries
SQVPVTLEDVAVYLSQEEWGCLDVAQQDHSCDVLLEDAGLPMPGPYLTALQGQGEGLRDPARAASGPREVSGGASSEHGSH

SEQ ID NO: 30751 - protein, 81 aa, Vulpes vulpes
PVTFGDIPFYFSREEWGSLDPAQRELFWDIKRENSRNVTLGLGLKSQGQQAGLEETAASAGQAGSSSSGSGRGDVTVSWSP

SEQ ID NO: 30752 - protein, 81 aa, Otolemur garnettii
QPQEAMTFKDVEVTFSQDEWGWLNSAQRNLYRNVMLENYKNMAFLVGPFTKPALISWLEAREPWGLNVQSAHPKENPGAAA

SEQ ID NO: 30753 - protein, 81 aa, Callithrix jacchus
PQLPESLEDVAVYISQEEWGHQDPSKRALSRDTVQESYENVDSLESHIPSQEVPSTQVGQGGKLWDPSVQSCKESLSPRGP

SEQ ID NO: 30754 - protein, 81 aa, Otolemur garnettii
FETQLGLTTITDMAIIFSQQLDPTQKHFWNVMWENHDDPGSVGYCVSKPALVSLLEQGKEPWVVKGQLAGGLFSGQQSVCE

SEQ ID NO: 30755 - protein, 81 aa, Callithrix jacchus
TSVIQVKDMAMSLTWEEWERLDPARKDFYRESVQKDSGSTVLPSLESRTENKELIPMQEILEAEPQEQLQEAFQGKPPLFS

SEQ ID NO: 30756 - protein, 81 aa, Callithrix jacchus
GHQEPGSTSFHPPRIQEEWGLLDRSQKELYWDAMLEKYGTVVSLGLPTHQPEAQAQSELGMLLTGAGVCRNLGSGDENEGL

SEQ ID NO: 30757 - protein, 81 aa, Vulpes vulpes
GHREPTSTSFHPPRIQEEWGLLDPSQKELYWDAMLEKYGTVVSLAGIPAPQPEAQAELEPGALRTGTESLRSLHLGDENES

SEQ ID NO: 30758 - protein, 81 aa, Macaca mulatta
FLKKVTFEDVAIDFTQEEWAMMDTSKRKLYRDVMLENVSHLVSLGYQISKSYITLQLEEGKELWREGREFLQGQNLDKESA

SEQ ID NO: 30759 - protein, 81 aa, Cebus imitator
SQEPVTFADVAVVFTPEEWVFLDSTQRSLYRDVMLENYRNLASVGDQLCKPNASSDLEQSGEQWNTERGVISDTCPEPQLQ

SEQ ID NO: 30760 - protein, 81 aa, Ovis aries
SLLTFEEVAMYFSQEEWELLDPTQKALYNDVMQENYETVISLAVPAHQLLAFPEQTDTSEWTMAPELILPESQSLLTFEEV

SEQ ID NO: 30761 - protein, 81 aa, Ovis aries
SQESMTLKDVAVTFSRGEWRKLEPSQKEIYKEVLLENYRNLEFLGFPVSKLDLVSQLKWAGLPRLLQKEVSKGCRPEVIYN

SEQ ID NO: 30762 - protein, 81 aa, Vulpes vulpes
QPQEAVTFKDVEVTFSQDEWAWLDPAERNLYRDVMLENYRNMVSLVGPFAKPILISWLEAREPWGLNVQGPQPNGNPGVAL

SEQ ID NO: 30763 - protein, 81 aa, Vulpes vulpes
SPAPEASALSQEENPRNQLMALMLLTAQPQELVMFEEVSVCFTSEEWECLGPIQRALYWDVMLENYGNVTSLANMKTSLIW

SEQ ID NO: 30764 - protein, 81 aa, Callorhinus ursinus
SQGLLTFKDISVDFTQEEWGHLAPAHRNLYREVMLENYGNLVSVGYQLCKPGVISQLEKGEEPWLIEREISGSPSSDLENK

SEQ ID NO: 30765 - protein, 81 aa, Enhydra lutris
VTFGDIPFYFSREEWGSLDPAQREFFWDIKRENSQNVALALVPEPSGTEEAAPSRLAGLGLRSHREQPGLEESVTAPRGQA

SEQ ID NO: 30766 - protein, 81 aa, Enhydra lutris
VKIEDMAVSLILEEWGCQNLARRNLNRDNRQENYGNVFSQGCENRSENEESTSKAEIAEDSVPRGETTGRFQKDFGEKREQ

SEQ ID NO: 30767 - protein, 81 aa, Enhydra lutris
SQELLTFKDISVDFTQEEWGQLPLAHRNLYREVMLENYGNLVSVGYQLSKPSVISQLEKGQEPWMTEKEVPEDPSSGETQT

SEQ ID NO: 30768 - protein, 81 aa, Enhydra lutris
SQGLLTFKDISVDFTQEEWGQLAPAHRNLYREVMLENYGNLVSVAGYQLSKPGVISQLEKGEEPWLIEREISGSPSSDLEN

SEQ ID NO: 30769 - protein, 81 aa, Pongo abelii
SQEPVKDVHVARGFSYKKSVHQIPAHRDLYRDFRKENVGNVVSLGSAVSTSNKITRLEQRKEPWTVGLHSSNKRSILRSNY

SEQ ID NO: 30770 - protein, 81 aa, Ovis aries
EWLLISQEQPEAKKSWGPLSFMDVFVDFTWEEWQLLDSAQKHLYRSVMLENYRNLVSLGYQYTKPSIIFQLEQEELWMMHS

SEQ ID NO: 30771 - protein, 81 aa, Ovis aries
QGLVTVQDVAVSLTWEEWERLGPAQKHFFRESAPKDHGNAISPSSETRIENKELVPKQEILEERAPLSSECGDAQQDRREK

SEQ ID NO: 30772 - protein, 81 aa, Otolemur garnettii
ACESMALKDVIVSFSRGEWKKLDPSQKELYQEVLLENFENLEFLGCPVSKLDLLSQLKWSELPWLLEKEISKDSRPGKSTS

SEQ ID NO: 30773 - protein, 81 aa, Otolemur garnettii
VKIEDMAVSLILEEWGCQNLARRNPSRDNRQENFGNVFSQGCESRNENEESTSKAENAEDVSHGETAGRFQKEFGEKRDQQ

SEQ ID NO: 30774 - protein, 81 aa, Enhydra lutris
QAQEAVTFKDVEVTFSQDEWGWLDPAQRNLYRDVMLENYRNVVSLVGPFTKPVLISWLEAREPWGLNVQGAQPKGNPGVAP

SEQ ID NO: 30775 - protein, 81 aa, Enhydra lutris
PQLPESLEDVAMYISQEEWGHQDPSKRALSRDTVQESYENVDSLESQVPSQEALSTQVEQGGKPWDPSVQTCKEGPSPSSP

SEQ ID NO: 30776 - protein, 81 aa, Vulpes vulpes
MAEGFRFKDVAIYFSQKEWECLHSAQKSLYRDVMLENYNNLISLGLFDSKPDVIFLLEQEKEPWMVKSKEPKEWCPDWESR

SEQ ID NO: 30777 - protein, 81 aa, Bos taurus
QEPVKLEDVVVEFSKEEWGQLYPAVKNLYRHVMLENYRNLNSLHKEHLLSKPVETSKLESKKESWIMEQEIPRTAVFDRER

SEQ ID NO: 30778 - protein, 81 aa, Ovis aries
IQAWVRGQQPGSPEEAVVLVEDLQRDPGQLLGWVSVVVVASLREWGLLEPSQKELNWDAMLEKYGTVVSLGEAPSPSLGPW

SEQ ID NO: 30779 - protein, 81 aa, Pongo abelii
SCESITLKDVSVNFSRGEWKKLEPFQKELYKEVLLENLRNLEFLDFPVSKLELISQLKWVELPWLLEEVSKCSRLDESALD

SEQ ID NO: 30780 - protein, 81 aa, Pongo abelii
SQEPVTFADVAVVFTPEEWVFLDSTQRSLYRDVMLENYRNLASVADQLCKPNALSYLEERGEQWTTDRGILSDTCAEPQCQ

SEQ ID NO: 30781 - protein, 81 aa, Acinonyx jubatus
LLTFEDVAVSFSEEEWKLLDPAQKVLYNDVMQENYETVISLGLKLKNDTGNDQPISVSALEIQASGRKVLRKARMKVAQKT

SEQ ID NO: 30782 - protein, 81 aa, Pongo abelii
IRDQDLGASLLPAAPQEQWRHLDSTQKEQYWDLMLETYGKMVSGAGISHPKSDLTNSIEFGDEPAGLYLHVNEKIPRPTCI

SEQ ID NO: 30783 - protein, 81 aa, Sapajus apella
EEPVTFQDVAVDFSREEWGLLGPTQRTEYRDVMLETFGHLVSVGWETTLENKQLALNSGIPGEEPAASLKVQESSRDYALS

SEQ ID NO: 30784 - protein, 81 aa, Rhinolophus ferrumequinum
LVMFEEVSVCFTSEEWACLGPMQRALYWDVMLENYGNVTSLEWETMTENVEVTSKSSISQRADSQKGTSKRLQGGIPQDLD

SEQ ID NO: 30785 - protein, 81 aa, Acinonyx jubatus
SQELLTFKDISVDFTQEEWGQLAPAHRSLYREVMLENYGNLVSVGYQLSKPGVISQLEKGQEPWLIEREVSGGPRSDLESK

SEQ ID NO: 30786 - protein, 81 aa, Acinonyx jubatus
SQESITFKDVAVNFSRGEWRKLEPFQKELFKEVLLENFRNLEFLGFAVSKLDLISQLKWVELPWLLEKEVSKGSRPECEPR

SEQ ID NO: 30787 - protein, 81 aa, Callorhinus ursinus
QESITFKDVIVEFSEEEWGQLDPAVKTLYRDVMLENYRNLNSVHQEHLLYKPVEISKLESKERRWAVEQEIPSTSVLDREV

SEQ ID NO: 30788 - protein, 81 aa, Rhinolophus ferrumequinum
LRDQDFGPSLLQTAPQEQWRHLDSTQKEQYWDLMLETYGKMVSGAGISNSKPDLTNSAEYGEELAGLHLHVSERIPRPTCI

SEQ ID NO: 30789 - protein, 81 aa, Bison bison
SQSLLTFEEVAMYFSQEEWELLDPTQKALYNDVMQENYETVISLALFVLPKPKVISCLEQGEEPWVQRPLEFKDSSKELPT

SEQ ID NO: 30790 - protein, 81 aa, Callorhinus ursinus
QSLLTFEDVAVSFSEEEWKLLDPTQKILYNDVMQENYETVISLAWEDSSSSPPDSVGSRDSAGEEGTETAITQSRLQMDLG

SEQ ID NO: 30791 - protein, 81 aa, Acinonyx jubatus
EPISFKDVIVEFSKEEWGQLDPAVKNLYRDVMLENYRNLNSLHQDREVISENQDSVTKERISEESSSHGEIMRRLTKSGPH

SEQ ID NO: 30792 - protein, 81 aa, Odocoileus virginianus
PVTFGDIPFYFSREEWGSLDPAQRDLFWDIKRENSRNIALGLGRRSHSERSQLEEVVTALPDQAAGDETTSWRPEEAEAWE

SEQ ID NO: 30793 - protein, 81 aa, Cebus imitator
QAMVKIEDMAVSLILEEWGCQNLARRNLSRDNRQENYGSAFPQGGENRNENEESTSKAETAEDSASRGETVGRFQKEFGEK

SEQ ID NO: 30794 - protein, 81 aa, Callorhinus ursinus
PGHREPASMSFHPPRIQEEWGLLDPSQKELYWDAMLEKYGTVVSLGIPAPPPEARAESGPGAMCTGTEGRRNLHPGEERES

SEQ ID NO: 30795 - protein, 81 aa, Acinonyx jubatus
SQVPAVSQAGKSGDQAAAAVLRMVRPQGSAAYEFLSVDYTERKWKGPALSQRAVYRSLMPENYRRVASLDSKGKIELFSFL

SEQ ID NO: 30796 - protein, 81 aa, Odocoileus virginianus
SQGPVKDVHMARGFSCKRSVHQIPAHKDLYRDIRKESVGNMVSLGSTVPTANKIARLEPRKEPWTIGLQSSNKRTVLRSNY

SEQ ID NO: 30797 - protein, 81 aa, Rhinopithecus roxellana
TLTQVGNSGDQAGATVLRMVRPQDTVAYEDLCVDYTQKKWKGPALSQRALQWNMMPGNDRIMASLGWSTMARSWLTSISSS

SEQ ID NO: 30798 - protein, 81 aa, Rhinopithecus roxellana
ATFEDMAVSLTWEEWERLDPARRDFRRESAQKDSGSTVLPSLESRAENKELIPMQEILEAEPQGRLQEVFQGKRPLLSKCG

SEQ ID NO: 30799 - protein, 81 aa, Acinonyx jubatus
EEPVTFLDVAVDFSKDEWGLLDPMQRTEYHDVMLETFGHLVSVGWETTLESKELTPKSDIPEEEPAPDLKMEEFSRDDTWS

SEQ ID NO: 30800 - protein, 81 aa, Bison bison
PQEPVTFADVAVLFTPEEWLFLDSAQKSLYRDVMLENYRNLASVGDQLCKTRMSSHLEQREELCVTERGIFPGAHLGPHFQ

SEQ ID NO: 30801 - protein, 81 aa, Cebus imitator
GLPTGQSQELLTFKDISIDFTQQEWGQLTPAHQNLYREVMLENYSNLVSVLEKGEEPWMTEKGSLGDPSSDLKSNTETTES

SEQ ID NO: 30802 - protein, 81 aa, Macaca mulatta
ESMTFKDVAVDITQEDWELMRPVQKELYKTVTLQNYWNMVSLEWETKVQACTPVENMSKLTKEETQTIKLEDSYDYNDRLQ

SEQ ID NO: 30803 - protein, 81 aa, Ailuropoda melanoleuca
QAMVKIEDMAVSLILEEWGCQNLARRNLNRDNRQENYGNVFSQGCENRNENEESTSKAEIAEDSASRGETTGRFQKDFGEK

SEQ ID NO: 30804 - protein, 81 aa, Ursus maritimus
ELVTVDNAAVSLTWEEWDRLDPDQRDFCRESALKGCRDTVSLVSPSLETRTENKEFIPKQEVLEEVEPQGQLQEGSHRKGP

SEQ ID NO: 30805 - protein, 81 aa, Ursus maritimus
PQLPESLEDVAMYISQEEWGHQDPSKRALSRDTVQESYENVDSLESQVPSQEALSTQVEQGGKPWDPSVQTCKEGLRPRSP

SEQ ID NO: 30806 - protein, 81 aa, Phyllostomus discolor
LVTKESMTFRDVAVDITQEDWELMRPVQKELYKTVTLQNYWNMVSLGLTVYRPTVIPILEEPWMVIKEILEGPSPGQETEA

SEQ ID NO: 30807 - protein, 81 aa, Zalophus californianus
SLLTFEEVAMYFSQEEWELLDPTQKALYNDVMRENYETVISLAVPAHQILAFPEQIITKDWTVAPELVLPESQSLLTFEEV

SEQ ID NO: 30808 - protein, 81 aa, Vicugna pacos
EEPVTFLDVAVDFSREEWGLLDTTQRTEYHDVMLETFGHLVSVGWATTLESKELTPKPNVPEEEPALHLKVEEFSREDARP

SEQ ID NO: 30809 - protein, 81 aa, Phascolarctos cinereus
PQETVMFEDVAVYFRKEEWADLNPAQRVLYRDVMLENYRNIASLAYLFPKPLVISKLEQVSGNLQEAQDIGQWFVCAGGEV

SEQ ID NO: 30810 - protein, 81 aa, Callorhinus ursinus
SQELVTFKDVVVDFSPEELTYLSAAQRNLYREVMLENYRNLVSLGYQFSKPDIISQLEEEESRVREEDSNTEICQDGEKRP

SEQ ID NO: 30811 - protein, 81 aa, Callorhinus ursinus
SQSLLTFEEVAMYFSQEEWELLDPTQEALYNDVMRENYETVISLALFVLPKPKVISYLEQGEDPWVQGPLELKNSPGELPS

SEQ ID NO: 30812 - protein, 81 aa, Pteropus vampyrus
QPQEAITFKDVEVTFSQDEWGWLNPAQRNLYRDVMLENYGNLASLVGPFTKPALISWLEAREPWGLNVQGPQPKGNPGAPP

SEQ ID NO: 30813 - protein, 81 aa, Ursus arctos
IRDQDFGASFLQATPPEQWRHLDSTQKEQYWDLMLETYGKMVSGGISNSKSDLTNSTEYGEELAGLHLHVGEKISRPTCIG

SEQ ID NO: 30814 - protein, 81 aa, Pan troglodytes
QLQETMTFKDVEVTFSQDEWGWLDSAQRNLYRDVMLENYRNMASLVGPFTKPALISWLEAREPWGLNIQAAQPKGNPVAAP

SEQ ID NO: 30815 - protein, 81 aa, Ailuropoda melanoleuca
PQLPESLEDVAMYISQEEWGHQDPSKRAHSRDTVQESYENVDSLESQVPSQEALSTQVEQGGNPWDPSVQTCKEGLRPRSP

SEQ ID NO: 30816 - protein, 81 aa, Vulpes vulpes
SQELLTFKDVSVDFTQEEWGQLSLAHRNLYREVMLENYGNLVSVAGYQLSKPSVISQLEKGQEPWMTEKKGPGDPSPDLKN

SEQ ID NO: 30817 - protein, 81 aa, Callorhinus ursinus
QEPVTFLDVAVDFSKEEWGLLDLTQRTEYHDVMLETFGHLVSVGWETTLESKELTTKSDIPEKEPAHDLKMEEFSRDDTWS

SEQ ID NO: 30818 - protein, 81 aa, Bos indicus
QEPVKLEDVVVEFSKEEWGQLDPAVKNLYRHVMLENYRNLNSLHKEHLLSKPVETSKLESKKESWITEQDIPRTAVFDRER

SEQ ID NO: 30819 - protein, 81 aa, unidentified
  REGION 1..81: note = Bos indicus x Bos taurus
APEASALSQEENPRNQLMALMLLTAQPQELVMFEEVSVCFTSEEWACLSPVQRALYWDVMLENYGNVTSLVYRKYRKQRNK

SEQ ID NO: 30820 - protein, 81 aa, Callithrix jacchus
QAMVKIEDMAVSLILEEWGCQNLARRNLSRDNRQENYGSAFSQGGENRNENEESTSKAETAEDSASHGETAGRFQKEFGEK

SEQ ID NO: 30821 - protein, 81 aa, Callorhinus ursinus
PQLPESLEDVAMYISQEEWGHQDPSKRALSRDTVQESYENVDSLESQVPSQETLSTHLEQGGKPWDPSVQTCKEGLSLRSP

SEQ ID NO: 30822 - protein, 81 aa, Sus scrofa
KIEDVADVAVSFILEEWGHLDPSQKSLCRDDRKENYGSIPSMDYESRNDNVELRVKQVSDEAEAPWMTSGSPGSTAAPSQG

SEQ ID NO: 30823 - protein, 81 aa, Bos indicus
EDPVTFLDVAVDFSTEEWGLLDPTQRTEYHDVMLETFGHLVSVGWETTLDSKQLTPQPGPPEEGPACPLKEEEGSSAADAR

SEQ ID NO: 30824 - protein, 81 aa, Physeter macrocephalus
KIEDVADVAVSFILEEWGHLDQAQKSLYRDDRKENYGSITSMDYESRNDNVELIVKQISDEAESPWMTSGSPERNVPPSQE

SEQ ID NO: 30825 - protein, 81 aa, Balaenoptera acutorostrata
EQGLVTFKDVAVCFSQDQWSDLDPTQKEFYGEYVLEEDCGIVVSLSFPIPRLDEISHMGEEEPLIPEIPEAQEPREPEILS

SEQ ID NO: 30826 - protein, 81 aa, Erinaceus europaeus
QAMVKIEDMAVSLILEEWGCQNLARRNLGRDGRQENYGNVLSQGCENRNENEESTSKAEAAEDSASRGETRSRFQKEFGEK

SEQ ID NO: 30827 - protein, 81 aa, Callorhinus ursinus
PGHREPASMSFHPPRIQEEWGLLDPSQKELYWDAMLEKYGTVVSLAGIPAPPPEARAESGPGAMCTGTEGRRNLHPGEERE

SEQ ID NO: 30828 - protein, 81 aa, Rhinolophus ferrumequinum
FGRQPGLVTIANVAIDLSQQLDPAQKSFCKNVMWENHDLGSVGCCVSEPGLVSLLEQGKEPWLVKRELTGVLFSGQQSVRE

SEQ ID NO: 30829 - protein, 81 aa, Phyllostomus discolor
LSQGLVTFKDVAVCFSEDQWNDLDPTQKEFYGEYVLEEDCGIVVSLSFPIPRLDEISHVREEPLVPDTLEPQEPEILSFTY

SEQ ID NO: 30830 - protein, 81 aa, Camelus dromedarius
FNSLLLSLLVPLTFMDVAIRFSQEEQEFLDPAQRALYRDVMLETYRNLLSVGERTALQKLGSVLGCVCIFPVHPFRSPRFA

SEQ ID NO: 30831 - protein, 81 aa, Pan troglodytes
GMVTFEDMAVSLTWEEWERLDPARRDFCRESAQKDSGSTVPPSLESRVENKELIPVQQILEEAEPQGRLQEAFQGKRPLFS

SEQ ID NO: 30832 - protein, 81 aa, Ursus maritimus
SLLTFEDVAMYFSQEEWELLDPTQEALYNDVMWENYETVISLAVPAHQILAFPEQIITKDWTVAPELVLPESQSLLTFEEV

SEQ ID NO: 30833 - protein, 81 aa, Acinonyx jubatus
ELVKIENVAVSLNCEEWEPLDPAPREFCWESAQEDHRTSVSLVSPSLETRTENKDFIPKQEILEEVEPQGQLQEGSHRKAP

SEQ ID NO: 30834 - protein, 81 aa, Odocoileus virginianus
CERVVPAHRILAFPEQTDTKDWTVAPELVLPESQSLLTFEEVAMYFSQEEWELLDPTQKALYNDVMQENYETVISLEFVDI

SEQ ID NO: 30835 - protein, 81 aa, Cebus imitator
IRDQDLGTSLLPAAPQEQWRHLDSTQKEQYWDLMLETYGKMVSGGISHSKPDLTNSIEYGEELAGLYLHVNEKIPRPSCIG

SEQ ID NO: 30836 - protein, 81 aa, Camelus dromedarius
LLETLSFKDVAVDFTWEEWQLLAPAQKALYRDVMLENYSHLLSVGYQVRRPDALAELERGEDLWAREEETGSGPCPGEGGP

SEQ ID NO: 30837 - protein, 81 aa, Ailuropoda melanoleuca
SQGPVKDVHMARGFSYKKSVHQIPAHRDLYRDFRKESVGNMVSLGSTVSVSNKIARLEQRKEPWTLGLHSSNKRNIILRSN

SEQ ID NO: 30838 - protein, 81 aa, Callorhinus ursinus
ERQPGLVTITNMAVDFSRQLDLAQKSFCKNVIWENHGDLGSVGPCVSKPDLVSLLEQGKEPWMVERELTRGLFSGQQSINE

SEQ ID NO: 30839 - protein, 81 aa, Ursus maritimus
QAMVKIEDMAVSLILEEWGCQNLARRNLNRDNRQENYGNVFSQGCENRNENEESTSKAEIAEDSASRGETAGRFQKDFGEK

SEQ ID NO: 30840 - protein, 81 aa, Rhinolophus ferrumequinum
QPQEALTFKDVEVTFSQDEWGWLTPAQRNLYRDVMLENYGNLASLVGPFTKPVLISWLETREPWGLNVQEAQPQENPGAAP

SEQ ID NO: 30841 - protein, 81 aa, Vulpes vulpes
PVTFGDIPFYFSREEWGSLDPAQRELFWDIKRENSRNVTLALVPEPSGTEEAAPSRLAGLGLKSQGQQAGLEETAASAGQA

SEQ ID NO: 30842 - protein, 81 aa, Acinonyx jubatus
ERPPGLVTITNMAVDFSQQLDPAQKSFCKNVMWENHSDLGSVGPCVSKADLVSLLQQEKEPWMVDRELPKGLGSGQQSIHE

SEQ ID NO: 30843 - protein, 81 aa, Acinonyx jubatus
ISLAVPAHQILAFPEQTITKDWTVAPELVLPESQSLLTFEEVAMYFSQEEWEFLDPTQEALYNDVMRENYETVISLGVSMD

SEQ ID NO: 30844 - protein, 81 aa, Rhinopithecus roxellana
PQELVMFEEVSVCFTSEEWACLGPIQRALYWDVMLENYGNVTSLEWETMTENEEVTSKPSSSQRAESHKGTSKRLQGSVPQ

SEQ ID NO: 30845 - protein, 81 aa, Odocoileus virginianus
TEELVTFEDVAVDFSPEELPYLSASQRNLYREVMLENYRNLVSLGYQFPKPDIISQLEEEESHAREEDGSTMTCQDWEEHS

SEQ ID NO: 30846 - protein, 81 aa, Ursus maritimus
SRVPVTLEDMAAYLSQEEWECLDPAQRDCSWDVLPENRGLVPPLEDGEDPGEDVSMRREQDREPGKSMTRPEKPLEGGGPR

SEQ ID NO: 30847 - protein, 81 aa, Colobus angolensis
SQEPVTFADVAVVFTPEEWVFLDSTQRSLYRDVMLENYRNLASVADQLCKPNALSYLEQRGEQWTTDRGILSDTCAEPQLQ

SEQ ID NO: 30848 - protein, 81 aa, Camelus dromedarius
QEPVTFKDVVVEFSEEEWGQLDPAVKNLYRDVMLDNYRNLNSLHKEHLLSKPAEIAKLESKEKSWIMEQEIPRATVLVHGI

SEQ ID NO: 30849 - protein, 81 aa, Tursiops truncatus
EEPVTFLDVAVDFSREEWGLLDLTQRTEYHDVMLETFGHLVSVGWETTLESKQLTPNPNTPEEEPACHLKVEEFSRDDTQP

SEQ ID NO: 30850 - protein, 81 aa, Physeter macrocephalus
PPNRVSSFKDMIFCFSEEDWSLLDPAQTGFYGEFIIGEDCGVTLPPNDPSAQLDLSQGEENEPRVPELQDLQGKDVSPVSY

SEQ ID NO: 30851 - protein, 81 aa, Pan troglodytes
IRDQDLGASLLPAAPQEQWRHLDSTQKEQYWDLMLETYGKMVSGAGISHPKSDLTNSIEFGEELAGLYLHVNEKIPRPTCI

SEQ ID NO: 30852 - protein, 81 aa, Callithrix jacchus
IRDQDLGTTLLPAAPQEQWRHLDSTQKEQYWDLMLETYGKMVSGAGISHSKPDLTNSIEYGEELAGLYLHVNDKIPRPSCI

SEQ ID NO: 30853 - protein, 81 aa, Rhinolophus ferrumequinum
SQGLVTFKDVAVCFSQDQWSDLDPAQKEFYGEYVLEEDCGIVVSLSFPIPRLDEVSHIREEEPLVPDIRELQEPQEPEILS

SEQ ID NO: 30854 - protein, 81 aa, Vicugna pacos
QEPVTFKDVVVEFSEEEWGQLDPAVKNLYRDVMLDNYRNLNSLRKEHLLSKPVEIAKLESKEKSWIMEQEIPRATVFDSKI

SEQ ID NO: 30855 - protein, 81 aa, Rhinolophus ferrumequinum
GHRAPDSESFHPPRIQEEWGLLDPSQKELYWDVMLEKYGTVVSLGLPPPRPDALAESEPLAPKAGTDSKGSLCLGGDSESH

SEQ ID NO: 30856 - protein, 81 aa, Rhinopithecus roxellana
QDTVAYEDLCVDYTQKKWKGPALSQRALQWNMMPGNDRIMASLAGENMMKGSELTPKQEIFKGSESSNRMGLFGVVPRGAE

SEQ ID NO: 30857 - protein, 81 aa, Ursus arctos
SEQKSTPNWKMASELILPEFQSLLTFEDVAVSFSEEEWKLLDPSQKILYNDVMQENYETVISLAILVSRRIVVLICISLIN

SEQ ID NO: 30858 - protein, 81 aa, Rhinolophus ferrumequinum
PLNRVSPFKDMIFCFSEEDWSLLDPAQTGFYGEFIIGEDCGVSLPPNDPAAQLDLSQGEENEPRVPELQDIQGKEATQPVC

SEQ ID NO: 30859 - protein, 81 aa, Acinonyx jubatus
PQELVTFQDVAVDFSLEELTYLSAAQRNLYREVMLENYRNLVSLGYQFSKPDIISQLEEEESHVMEEDSDTEMHHDPRDPS

SEQ ID NO: 30860 - protein, 81 aa, Balaenoptera acutorostrata
GPVTFGDIPFYFSREEWGSLDPAQRDLFWDIKRENSQNVALGLGLTSHSERSRLEEVVTALPGQAAGDVTVSWRLEEAEAR

SEQ ID NO: 30861 - protein, 81 aa, Acinonyx jubatus
LQVPVTLEDVAAYLSQDEWECLDPAQRGCVWDVLPDSGGLGLQLEDGEGARQDVLTRREQDRELVGGMTRPEQSLERGGPR

SEQ ID NO: 30862 - protein, 81 aa, Callithrix jacchus
PPNRVSPFKDMILCFSEEDWSLLDPAQTGFYGEFIIGEDCGVSMPPNDLAAQPDLSQGEENEPRVPELQDLQGKEVPQVSY

SEQ ID NO: 30863 - protein, 81 aa, Pteropus vampyrus
SQSLLTFEEVAVYFSQEEWELLDPSQKALYNDVMQKNYETVISLATAEPAHQTLTFPEQINTKDWIMAPELFLPESQTLLT

SEQ ID NO: 30864 - protein, 81 aa, Ovis aries
SQVPVTLEDVAVYLSQEEWGCLDVAQQDHSCDVLLEDAGAVGRRCLTPCCVPEWASLWEGAASFGLIEGLPMPGPYLTALQ

SEQ ID NO: 30865 - protein, 81 aa, Camelus dromedarius
EEPVTFLDVAVDFSREEWGLLDTTQRTEYHDVMLETFGHLVSVGWATTLESKELTPKPNVPEEEPALHLKVEEFSGEDTRP

SEQ ID NO: 30866 - protein, 81 aa, Pongo abelii
PEEPVKDVHVARGFSYKKSVHQIPAHRDLYRDFRKENVGNVVSLGSAVSTSNKITRLEQRKEPWTLGLHSSNKRSILRSNY

SEQ ID NO: 30867 - protein, 81 aa, Pongo abelii
KETEPVYERAVPTQQILAFPGQTNTKDWTVTPERVLPESQSLLTFEEVAMYFSQEEWELLDPTQKALYNDVMQETMRLSSL

SEQ ID NO: 30868 - protein, 81 aa, Pongo abelii
EELPVVFEDVAVYFTREEWGMLDKWQKELYRDVMRMNYELLASLGPAAAKPDLISKLERRAAPWIRDTNGPKWGKSRPPGN

SEQ ID NO: 30869 - protein, 81 aa, Camelus dromedarius
GSLTLKDVAVDFTREEWQLLTPAQKALYREVTLQNYSHLVSVAFENHRFVPSRERPKEEDLARRTAIPEKMAAPGQDPRTG

SEQ ID NO: 30870 - protein, 81 aa, Myotis davidii
QPQEALTFKDVEVTFSQDEWAWLNPAQRNLYRDVMLENYGSLASLVGPLAKPALISWLEAREPWGLNVQRAQPKAKPGAAP

SEQ ID NO: 30871 - protein, 81 aa, Leptonychotes weddellii
PVTFGDIPFYFSREEWGSLDPAQRELFWDIKRENSRNVALGVGLQSQSERSGLEEAVTALPGQAGGGGGGGRAPARRRPLR

SEQ ID NO: 30872 - protein, 81 aa, Neomonachus schauinslandi
IRDQDFGASFLQAAPPEQWRHLDSTQKEQYWDLMLETYGKMVSGGISSSKSDLTNSAEYGEELVGLHLPVGEKIPRPTCMG

SEQ ID NO: 30873 - protein, 81 aa, Neomonachus schauinslandi
QSLSLTFEEVAMYFSPEEWELLDPTQEALYNDVMRENCETVISLALFVLPKPKVISYLEQGEEPWIQGPLEFKNSPGGLPT

SEQ ID NO: 30874 - protein, 81 aa, Cebus imitator
SQELLTFKDVSVDFTQEEWGQLAPAHRNLYREVMLENYGNLVSVGYQLSKPGVISQLEKGEEPWLMEREVSGVPSLDLESK

SEQ ID NO: 30875 - protein, 81 aa, Monodon monoceros
SQGPLKDVHMARGFSYKKSVRQIPAHRDLYRDIRKESIGNMVSLGNTVSTANKVAQLEQRKEPWTIGLQSPNKRNVLQSNC

SEQ ID NO: 30876 - protein, 81 aa, Enhydra lutris
SQGPVKDVHMARGFSYKKSIHQIPAHRDLYRDIRKESVGNMVSLGSTVSVSNKIAQMEQRKEPWTLGLHSSNKRNIMLRSN

SEQ ID NO: 30877 - protein, 81 aa, Enhydra lutris
EEPVTFLDVAVDFSKEEWGLLDPTQRTEYHDVMLETFGHLVSLGWETTLESKELTPKSDTPEKEPAHDLKLEEFSRDDTWS

SEQ ID NO: 30878 - protein, 81 aa, Cercocebus atys
VKIEEVADVAVSFILEEWGHLDQSQKSLYRDDRKENYGSITSMGYDFFDNMELIVKQISDDAESHWVAPEHTERSVPQDPD

SEQ ID NO: 30879 - protein, 81 aa, Neomonachus schauinslandi
SQGLLTFKDISVDFTQEEWGQLAPAHRNLYREVMLENYGNLVSVGYQLSKPSVISQLEKGQEPWMTEKEGPGDSSSDLKNK

SEQ ID NO: 30880 - protein, 81 aa, Camelus dromedarius
SQESVTLKDVAVTFSRGEWRRLEPFQKEIYKEVLLENFRNLEFLGFPVSKLDLVSQLKWAGLPRLLQKEVSKRSKPECELS

SEQ ID NO: 30881 - protein, 81 aa, Felis catus
PVTFGDVPFYFSREEWGSLDPAQRDLFWDIKRENSRNVALALVPEPSGTEEAAPSRLAGLGPESQSEQSRLEEAATALQGR

SEQ ID NO: 30882 - protein, 81 aa, Aotus trivirgatus
IRDQDLGTSLLPAAPQEQWRHLDSTQKEQYWDLMLETYGKMVSGAGISHSKPDLTNSIEYGEELAGLYLHVNEKIPKPSCI

SEQ ID NO: 30883 - protein, 81 aa, Camelus dromedarius
KGHLVTFEDVAVNFTQEEWTLLDQTQRDLYRDVMLENYQNLMALGSESCKPHLNSPLEGAEELRKRARRILQSEFMAESDL

SEQ ID NO: 30884 - protein, 81 aa, Cercocebus atys
HHPPNGDFAQCASPVPTLPQVGNSGLRMVRPQDTVAYEDLCVDYTQKKWKCPALSQRALQWNMIPENDRSMASLGWSTMAR

SEQ ID NO: 30885 - protein, 81 aa, Neomonachus schauinslandi
QAMVKIEDMAVSLILEEWGCQNLARRNLNRDNRQENYGNVFSQGCENRNENEESASKAEIAEDSASRGETTGRFQKDFGEK

SEQ ID NO: 30886 - protein, 81 aa, Camelus dromedarius
RKSVTFEDVAVYFTEKEWASLVPAQRALYRDVMLENHGAVVFLGSITHFYTSSDLPSGAREGAMFHPATESPKQKERESRL

SEQ ID NO: 30887 - protein, 81 aa, Myotis davidii
ESVTFEDIAVDFTQEEWALLGTPQKKLYRDVVLENISDLVSVGYRICNSGVTFQLDQGQLRSEGTGFLQGQIADMRDPLKK

SEQ ID NO: 30888 - protein, 81 aa, Cercocebus atys
PPNRVSPFKDMILCFSEEDWSLLDPAQTGFYGEFIIGEDCGVSVPPNELAAQPDLSQREENEPRVPEPQDLQGKEVPQVSY

SEQ ID NO: 30889 - protein, 81 aa, Leptonychotes weddellii
PQLPESLEDVAMYISQEEWGHQDPSKRALSRDTVQESYENVDSLGSQVPSQETLSTHVEQGGKPWDPSVQTCKEGLSLRSP

SEQ ID NO: 30890 - protein, 81 aa, Monodelphis domestica
PGTFKDGEVSLSQEEQESLDAAPKDLCGDVMQENYGNDLSHDFEIQSENEENSNQEIFEAVEENMLSGRPEGEGIQHSDWG

SEQ ID NO: 30891 - protein, 81 aa, Leptonychotes weddellii
QEPITFKDVIVEFSEEEWGQLDPAVKTLYRDVMLENYRNLNSLHQEHLLYKPVEISKLESKERRWTVEQEIPSTSVLGKNQ

SEQ ID NO: 30892 - protein, 81 aa, Monodelphis domestica
GQKDLVTFEGVSADFTEKEWKGSAPAQRAFFRDLMLENYRDVVSLGFPFSKPTGISWREEEPWNLNHQGPLDLEDRKSTCT

SEQ ID NO: 30893 - protein, 81 aa, Physeter macrocephalus
QEPVTFKDVVVEFSKEEWGQLDPAVKNLYRDVMLENYRNLNSLHKEHLLSKPVETSRLESKEKSWIMEQEILRTAVFDREI

SEQ ID NO: 30894 - protein, 81 aa, Aotus trivirgatus
QGMMTFEDMAMSLTWEEWERLDPARKDFYRESMQKDSGSTVPPSLESRTENKELIPMQEILEEAEPQEQLHEAFQGKPPLF

SEQ ID NO: 30895 - protein, 81 aa, Camelus dromedarius
QGLVTFGDVAVDFSQEEWEWLDCAQRTLYRSVMLENYRSLVSLARDDLVTGTEERAMDGEEKVHARPVPRQCGKAFSQSTH

SEQ ID NO: 30896 - protein, 81 aa, Felis catus
SQGPVKDVRVARGFSYKKSVHQIPVHRDLYRDIRKESAGNMVSLGSTMSVSNKIARLEQRKEPWTLGVHSSNKRSILRSNY

SEQ ID NO: 30897 - protein, 81 aa, Myotis davidii
LIVDMNFEDVAVAFSQEEWGLLDEAQRLLYCKMMLEVFALVSSVGCGHKMDDVEACSEQSVSVQVEAQVRVSETEPATQRT

SEQ ID NO: 30898 - protein, 81 aa, Leptonychotes weddellii
SLLTFEDVAVSFSEEEWKLLDPTQKILYNDVMQENYETVISLDREAGNAVGGAGTRGTRARTAERPPGVAPTASDGTRPGR

SEQ ID NO: 30899 - protein, 81 aa, Physeter macrocephalus
QGLVTVQDVAVSLTWEEWERLGPAQRDLYRESAPKDYGNAVSPSLETRIENKGLILKQEILEEVEPQGQLQGSQEKGPLSS

SEQ ID NO: 30900 - protein, 81 aa, Monodelphis domestica
QESMTFEDVAVYFSKAEWTLLSPAQQVLYRNVMLENYENLASLGDESQKENKKLAPARESAEADPEASSPGGLQTCAPQQP

SEQ ID NO: 30901 - protein, 81 aa, Neomonachus schauinslandi
QEPVTFLDVAVDFSKEEWGLLDPTQRTEYHDVMLETFGHLVSVGWETTLESKELTPKSEIPEKEPAHDLKMEEFSRDDTWS

SEQ ID NO: 30902 - protein, 81 aa, Camelus dromedarius
LLTFEDVALSFTEEEWQLLDPTQKILYNDVMQENYETVISLGLKLKNDTGNDQPISLSTLEIQGSGCKVLRKARVKVAQKT

SEQ ID NO: 30903 - protein, 81 aa, Camelus dromedarius
TQEPVTFADVAVLFTPEEWLFLDSAQRSLYRDVMLENYRNLASVGDQLCTPSMFSHLEPREELCITERGLFPGAHAEPQLQ

SEQ ID NO: 30904 - protein, 81 aa, Leptonychotes weddellii
PNRVSPFKDMIFCFSQEDWSLLDPAQTGFYGEFIIGEDCGVSLPPNFPSLQPFQIEERRKRDELQVPEFQTFQQLTLTQNT

SEQ ID NO: 30905 - protein, 81 aa, Neomonachus schauinslandi
EAHGPVTFGDIPFYFSREEWGSLDPAQRELFWDIKRENSRNVALGVGLQSQSERSGLEEAVTALPGQAGGGGGGGRGDVTV

SEQ ID NO: 30906 - protein, 81 aa, Pongo abelii
ETQPGLVTIKNLAVDFPQKLHPAQKNFCKNGIWENHSDLGSAGHCVAKPDLVSLLEQKKESWMVKRELTGSLFSGECRRAW

SEQ ID NO: 30907 - protein, 81 aa, Myotis davidii
GPLTFRDVAIDFSQEEWECLDPDQRKLYLDVMLENYSNLVSVAVAKQAQRPSTSGLGQNACIVTMATTQCPGPAAAIFVME

SEQ ID NO: 30908 - protein, 81 aa, Pan troglodytes
ETQPGLVTIKNLAVDFPQQLHPAQKNFCKNGIWENNSDLGSAGHCVAKPDLVSLLEQEKEPWMVKRELTGSLFSGQRSVRE

SEQ ID NO: 30909 - protein, 81 aa, Pan troglodytes
IRDQDLGASLLPAAPQEQWRHLDSTQKEQYWDLMLETYGKMVSGGISHPKSDLTNSIEFGEELAGLYLHVNEKIPRPTCIG

SEQ ID NO: 30910 - protein, 81 aa, Leptonychotes weddellii
SQELVTFKDVVVDFSPEELTYLSAAQRNLYREVMLENYRNLVSLGYQFPKPDIISQLEEEESRVREEDSNTEICQGESSPD

SEQ ID NO: 30911 - protein, 81 aa, Camelus dromedarius
SASQSPTPSQKGSPGDQEMTAALLTAGFQTLEKIEDMAVSLIREEWLLDPSQKDLSRDNRPENYRNMFSLGVLETGESFAV

SEQ ID NO: 30912 - protein, 81 aa, Vulpes vulpes
SQDLVTFKDVVVDFSPEELTYLSAAQRNLYREVMLENYRNLVFLGYQFSKPDIISQLEKEESHVREEDINTDKCQDWEKRP

SEQ ID NO: 30913 - protein, 81 aa, Otolemur garnettii
LVMFEEVSVCFTSEEWACLGPIQRALYWDVMLENYGNVTSLEWESMIENEEVTSKPSISQRADSQKGTSKRLQGGVPQVPD

SEQ ID NO: 30914 - protein, 81 aa, Otolemur garnettii
SQGLVTVKDVAVCFSQDQWSDLDPTQKEFYGEYVLEEDCGIVVSLSFPIPRPDEISQVREEESWVPDIQEPQETQEPEILN

SEQ ID NO: 30915 - protein, 81 aa, Myotis davidii
SRGLVKVKDVPVTREEWEHLDPVQRDFYREGMLKDYGNTFLPSLETRTENKELIPKQEILEVEPQMQLQERSQGNASLLSK

SEQ ID NO: 30916 - protein, 81 aa, Leptonychotes weddellii
PGHREPASTSFHPPRIQEEWGLLDPSQKELYWDAMLEKYGTVVSLAGIPAPPPEAGAESGPGAMRTGIEGRRSLHPGDESE

SEQ ID NO: 30917 - protein, 81 aa, Aotus trivirgatus
ESCESITLNDVAVNFSRGEWKKLEPFQKELYKEVLLENFRNLEFLDFPVSKLELISQLKWVELPWLLEKEVSKGSQPGSII

SEQ ID NO: 30918 - protein, 81 aa, Camelus dromedarius
AMPQGLVTFGDVAVDFSQEEWEWLDCAQRTLYRSVMLENYRSLVSLARDDLVTGTEERAMDGEEKVHARPVPRTWCVSAWS

SEQ ID NO: 30919 - protein, 81 aa, Camelus dromedarius
AGEALMPGSVTFEDVAVYFSCEEWCLLDEVQIRLYLDVMLENFALEQLCCSHLWTMGAPFLYNYLRRCCGYYGDAECIPTP

SEQ ID NO: 30920 - protein, 81 aa, Aotus trivirgatus
PQELVMFEEVSVCFTSEEWACLGPIQRALYWDVMLENYGNVTSLEWETMTENEEVTSKPSSSQRADSQKGTSKRLQGSVPQ

SEQ ID NO: 30921 - protein, 81 aa, Papio anubis
THHLPNGDFAQCASPVPTLPQVGNSGLRMVRPQDTVAYEDLCVDYTQKKWKCPALSQRALQWNMMPENDRSMASLGWSTMA

SEQ ID NO: 30922 - protein, 81 aa, Neomonachus schauinslandi
PQLPESLEDVAMYISQEEWGHQDPSKRALSRDTVQESYENVDSLESQVPSQETLSTHVEQGGKPWDPSVQTCKEGLSLRSP

SEQ ID NO: 30923 - protein, 81 aa, Aotus trivirgatus
PQLPESLEDVAMYISQEEWGHQDPSKRALSRDTVQESYENVDSLESHIPSQEIPSTQVGQGGKLWDPSVQSCKEGLSPRGP

SEQ ID NO: 30924 - protein, 81 aa, Physeter macrocephalus
TEELVTFKDVAVDFSPEELTYLSAAQRKLYWEVMLENYMNLVSLGYQFPKPDIISGLKVKESRAVEEDSSKMICHDWEKKP

SEQ ID NO: 30925 - protein, 81 aa, Aotus trivirgatus
PPNRVSPFKDMILCFSEEDWSLLDPAQTGFYGEFIIGEDCGVSMPPNDLAAQPDLSQGEENEPHVPELQDLQGKEVPQVSC

SEQ ID NO: 30926 - protein, 81 aa, Aotus trivirgatus
ETQPGLVTMKNLAIDFPQQLHPALKNFCKNGLWENYSDLGSAGRCMAKPDLVSLLEQEKEPWMVKRELTGSLFSGQQSVCE

SEQ ID NO: 30927 - protein, 81 aa, Myotis davidii
EPVTFLDVALDFNRDEWELLDPTQRTEYHDVMLETFRHLVSVGWETTLEGEQLPPKSALPEAEPAPNLKVEELSGAEAQPS

SEQ ID NO: 30928 - protein, 81 aa, Cercocebus atys
SQEPVKDVHVARGFSYKKSVHQIPAHRDLYRDFRKENVGNMVSLGSTASTSNKITRLEQRREPWTLGLRSSNKRSILRSNY

SEQ ID NO: 30929 - protein, 81 aa, Leptonychotes weddellii
FQSLLTFEDVAVSFSEEEWKLLDPTQKILYNDVMQENYETVISLEIQASGCKVLRKARMKVAQKTTGKENHGGTRRVRRRH

SEQ ID NO: 30930 - protein, 81 aa, Leptonychotes weddellii
ERQPGLVTITNMAVDFSQQLDPAQKSFCKNVIWESHGDLGSVGPCVSKPDLVSLLEQGKEPWMVERELARGLFSGQQSINE

SEQ ID NO: 30931 - protein, 81 aa, Aotus trivirgatus
QLQETMTFKDVEVTFSQDEWGLLDSAQRNLYRDVMLENYRNMAFLVGPFTKPALISWLEAREPWGLNMQVAQPKGNPGAAP

SEQ ID NO: 30932 - protein, 81 aa, Monodelphis domestica
SQGLATFKDVTLSFSQEQWGDLDPTQKEFYGEYVLQEDCGIVVSLTFPIPRLEEISQVEEEEESWVPDLEYPQDPEETEIL

SEQ ID NO: 30933 - protein, 81 aa, Papio anubis
QGMATFEDMAVSLTWEDWERLDPARRDFCRESAQKDSGSTVPPSLESRAENKELIPMQEILEAEPQGRLQEAFQGKRPLLS

SEQ ID NO: 30934 - protein, 81 aa, Lipotes vexillifer
LLTFEDVALFFTEEEWQLLDPAQKILYNNVMQENYETVTFLGLKLKNDTGNDQPISLSTLEIQASGCKVLRKARMKVAQKT

SEQ ID NO: 30935 - protein, 81 aa, Leptonychotes weddellii
MAEGFTFKDVAIYFSQKEWECLHSAQKDLYRDVMLENYNNLISLDWESRRVTKNLFPKEHSYEIKSLHLEIKRLTSSDLEC

SEQ ID NO: 30936 - protein, 81 aa, Physeter macrocephalus
SQGPVKDVHMARGFSYKKSVRQIPAHRDLYRDIRKESIGNMVSLGNTVSTANKTAQLEQRKEPWTIGLQSPNKRNVLRNDY

SEQ ID NO: 30937 - protein, 81 aa, Physeter macrocephalus
SQESMTLKDVAVTFSRGEWRTLEPSQKEIYKEVLLENYRNLEFLGFPVSKLDLISQLKWAGLPWLLQKQASRGSRPECELS

SEQ ID NO: 30938 - protein, 81 aa, Monodelphis domestica
FQESVTFKDVDPDFTLEEWAQLAPVQQDLYKEVLLENYRNLVFLGLSVPKPDVISQLERGEMPWMLESEAPRTICPYFDTL

SEQ ID NO: 30939 - protein, 81 aa, Sarcophilus harrisii
TRDKNETASLHLSSSQVQWQCLNQTQKELYWDAMLEDYGKVVSLGIPISKPNPINLVDGREELDGSHSCSSEEMAKSICIG

SEQ ID NO: 30940 - protein, 81 aa, Sarcophilus harrisii
GQKDLVTFEDVSVDFTQKEWKSSTPAQRAFFRDLMLENYRDVVSLGFPFSKPMGISQREEKPWGLNHQAPLALEDGKSTCT

SEQ ID NO: 30941 - protein, 81 aa, Monodelphis domestica
SQEPVICLGMSRNLSHKKWGHLNPAHKNFCRGIMKENYRNMVSLGIPISTSKKVSPLAQRKKPWVLGLQGSNKKYILRGSH

SEQ ID NO: 30942 - protein, 81 aa, Physeter macrocephalus
SQELLTFKDISVDFTQEEWGQLAPAHRNLYREVMLENYGNLVSVGYQLSKPGVISQLEKGEEPWLMEREISGGPSPDLEDE

SEQ ID NO: 30943 - protein, 81 aa, Camelus dromedarius
VTARDVAASLTWEEWQHLGPALRDAYREGTLQGCGNTASPGSETGTENRELIPKQETLDEVEPQGQLPGSQEHLSCEWGEA

SEQ ID NO: 30944 - protein, 81 aa, Camelus dromedarius
RVTFEDVAVYFTQNEWGILAPAQRALYRELLRFLLFQTQKTVPGARGHQPCSKPLGLRADLPWGSESWTLAGPSLPCSSDC

SEQ ID NO: 30945 - protein, 81 aa, Physeter macrocephalus
FVTKESVTFTDVAVDITREDWELMRPVQKELYKTVTLQNYWNMVSLGLTVYRPTVIPILEEPWMVIKEILEGPSPEWETEA

SEQ ID NO: 30946 - protein, 81 aa, Monodelphis domestica
VKIEDMAVSLILEEWGCQNLARRNLCRDNRQENYGTMFSQGCGSRTTNEESTSKEDVAEATGSHGEIPGRFQREFGETCEQ

SEQ ID NO: 30947 - protein, 81 aa, Camelus dromedarius
SQSLLTFEEVAIYFSQEEWELLDPTQKALYGDVMQETYETVISLALFVVPKPKVISCLEHGEEPWIQRPPEFKDSPGELLT

SEQ ID NO: 30948 - protein, 81 aa, Myotis davidii
FQERLTFKDITVNFTQEEWGQLTPAHRNLYREVMLENYGNLVSVGYEFSKPRVISQLEKGEEPWITEKEGPGHPSADLKSK

SEQ ID NO: 30949 - protein, 81 aa, Camelus dromedarius
SQMSVTFEDVAVLFTRDEWRKLGPSQRSLYQDVMLENYSNLLSLAGLPFSKPKVISLLQQGEDPWKVERDSPGGASLEEGS

SEQ ID NO: 30950 - protein, 81 aa, Neomonachus schauinslandi
PASTSFHPPRIQEEWGLLDPSQKELYWDAMLEKYGTVVSLAGIPAPPPEAWADSGPGAMRTGTEGRRSLHPGDESESHCEG

SEQ ID NO: 30951 - protein, 81 aa, Monodelphis domestica
AQDSVTFKDVAVMFSRKEWWHLQPTQMELYRDVMLENYRNMVSVGLLTSKPELIAQLERGEAPWMRSRTVSRGPGAGSETR

SEQ ID NO: 30952 - protein, 81 aa, Camelus dromedarius
NLLTFEEVAMYFSQEEWELLDPTQKALYNDVMQENYETVISLAVPAHQILASPEQTDTKDWTVAPELFLPESQSLLTFEEV

SEQ ID NO: 30953 - protein, 81 aa, Neomonachus schauinslandi
SQGLLTFKDISVDFTQEEWGQLAPAHRNLYREVMLENYGNLVSLGYQLSKPGVISQLEKGEEPWLIEREISGSPSSDLENK

SEQ ID NO: 30954 - protein, 81 aa, Monodelphis domestica
SQESVTFKDVAVDFTEEEWERLDSDQRDLYLTVMLENYRNLVFLGLPVSKPELIFQMDQEEESRILEREVSKAWDIGTESK

SEQ ID NO: 30955 - protein, 81 aa, Papio anubis
SQEPVKDVHVARGFSYKKSVHQIPAHRDLYRDFRKENVGNMVSLGSTASTSNKITRLEQRREPWTLGLHSSNKRSILRSNY

SEQ ID NO: 30956 - protein, 81 aa, Neomonachus schauinslandi
SQGLLTFKDISVDFTQEEWGQLAPAHRNLYREVMLENYGNLVSLAGYQLSKPGVISQLEKGEEPWLIEREISGSPSSDLEN

SEQ ID NO: 30957 - protein, 81 aa, Monodelphis domestica
FQESVTFKDVVPDFTWEELVQLDPVEQDLYRDVLLENYRNLVFLGLLASKPDVIIQLECGEVPWILENEVPKDSDINPEAN

SEQ ID NO: 30958 - protein, 81 aa, Camelus dromedarius
QERVTFEDVAVYFTQNEWGILAPAQRALYREVMLENYANVASLAFKVLAFPNPEDSAWSQGTSAMLQTTWPQEPVAFEDVA

SEQ ID NO: 30959 - protein, 81 aa, Cercocebus atys
GHQEAASTSFHPPRIQEEWGLLDRSQKELYWDTMLEKYGTVVSLGLPPHQPEAQAQSELGMLLMGTGVCRSLHSGNESEGP

SEQ ID NO: 30960 - protein, 81 aa, Cercocebus atys
DTVAYEDLCVDYTQKKWKCPALSQRALQWNMIPENDRSMASLAGENMMKGSELTPKQEIFKGSESSNKTSGGLFGMVPGGA

SEQ ID NO: 30961 - protein, 81 aa, Monodelphis domestica
QNHVTQLKDVILCFSEEEWSLLDPAQTGFYGEFIIEEDYGVSLPMNYPGPQPIPERINELPKVMQLPDSRVEEDEPCVLEF

SEQ ID NO: 30962 - protein, 81 aa, Cercocebus atys
SQELLTFKDISVDFTQEEWGQLAPAHRNLYREVMLENYGNLVSVGYQLSKPGVISQLEKGEEPWLMEREISGVPSSDLESK

SEQ ID NO: 30963 - protein, 81 aa, Cercocebus atys
VKIEDMAVSLILEEWGCQNLARRNLSRDHRQENYGSTFPQGGENRNENEESTSKAETTENSASRGETAGRFQKEFGEKRDQ

SEQ ID NO: 30964 - protein, 81 aa, Neomonachus schauinslandi
SQELVTFKDVVVDFSPEELTYLSAAQRNLYREVMLENYRNLVSLGYQFPKPDIISQLEEEESRVREEDSNTEICQDGEKRP

SEQ ID NO: 30965 - protein, 81 aa, Neomonachus schauinslandi
SQGLLTFKDISVDFTQEEWGQLAPAHRNLYREVMLENYGNLVSVAGYQLSKPSVISQLEKGQEPWMTEKEGPGDSSSDLKN

SEQ ID NO: 30966 - protein, 81 aa, Camelus dromedarius
GLVTFKDVAVCISQDQWSDLDPAQKEFYGEYVLEEDCGIVVSLCKEFQVFLESFPIPRLDEISPAGEEEPLIPDISEPPEP

SEQ ID NO: 30967 - protein, 81 aa, Physeter macrocephalus
QVPVTLEDVAVYLSQEEWGCLDLAQQDHSCDMLLEDEGLPAPGPCLTAQEGPGQGLRDPACAASGLREVSGSAGSELGRQF

SEQ ID NO: 30968 - protein, 81 aa, Monodelphis domestica
GFQEPVTCEDVTVPLSQEEWRCLNSAQRVLYKGIAQEKFRNVDSVGLPKSLLISGMNHGKDICIPDLQGSKETEILSSSHT

SEQ ID NO: 30969 - protein, 81 aa, Cercocebus atys
PQLPESLEDVAMYISQEEWGHQDPSKRALSRDTVQESYENVDSLESHIPSQEVPGTQVGQGGKLWDPSVQSCKEDLSPRGP

SEQ ID NO: 30970 - protein, 81 aa, Cercocebus atys
QTDLVTFDSVAVEFTQEEWTLLNPTQRNLYSDVMLENYKNLSSVGYQLFKPSLISWLEEEEELSTLPRVLQEWKMCLKTKG

SEQ ID NO: 30971 - protein, 81 aa, Felis catus
QQVPVTLEDVAAYLSQKEWECLDPAQRGCVWDVLPDSGGLGLQLEDGEGARQNVPTRREQDRELVGGMTRPEQSLEGGGPR

SEQ ID NO: 30972 - protein, 81 aa, Pan troglodytes
EEPVTFQDVAVDFSREEWGLLGPTQRTEYRDVMLETFGHLVSVGWETTLENKELAPNSDIPEEEPAPSLKVQESSRDCALS

SEQ ID NO: 30973 - protein, 81 aa, Camelus dromedarius
QLPESLEDVAMYISQEEWGHQDPSKRALSGDTVQESYENVDSLGEEKFENLEDSAQSSSPESVHPQALQPGQARGEMVSLG

SEQ ID NO: 30974 - protein, 81 aa, Camelus dromedarius
EEEAQERRKRREKRSGMALSQGQLTFKDVAVVFTQEEWECLDPAQRALYRDVMLETCRNLISVEFVLGNLMIGFPIIKEAS

SEQ ID NO: 30975 - protein, 81 aa, Camelus dromedarius
PAKVTGSVTFGDVAVFFSRDEWLHLNPTQRALYREVMLDNFSALASLGIPFSTPKVICRLQLGEDPCMVEREIPEDPRLGE

SEQ ID NO: 30976 - protein, 81 aa, Myotis davidii
ASIVTFEDVAVNFTLEEWALMDTSQKKLYRDVMWETFRNLASVGKNWKNHDIEDLYRNQRRKRTSGACGPEAPGAPLKLQA

SEQ ID NO: 30977 - protein, 81 aa, Vulpes vulpes
SQELLTFKDVSVDFTQEEWGQLSLAHRNLYREVMLENYGNLVSVGYQLSKPSVISQLEKGQEPWMTEKKGPGDPSPDLKNK

SEQ ID NO: 30978 - protein, 81 aa, Pongo abelii
IRDQDLGASLLPAAPQEQWRHLDSTQKEQYWDLMLETYGKMVSGGISHPKSDLTNSIEFGDEPAGLYLHVNEKIPRPTCIG

SEQ ID NO: 30979 - protein, 81 aa, Vulpes vulpes
SQSLLTFEEVAMYFSQEEWELLDPTQKALYNDVMRENYETVISLALFVLPKPKVISYLEQGEEPWVQGPLEFKASLGELPT

SEQ ID NO: 30980 - protein, 81 aa, Enhydra lutris
SQELVTFQDVVVDFSPEELTYLSAAQRNLYREVMLENYRNLVSLGYRFSKPDIISQLEEEESRVREEDSNTELCQDGEERP

SEQ ID NO: 30981 - protein, 81 aa, Enhydra lutris
ERQPGLVAIANVAVDFSPQLDPAQKSVCKNVRWESHGDLGSVGPCVPKPDLVSLLEQGREPWMVRTELTRGLCSGQQSICE

SEQ ID NO: 30982 - protein, 81 aa, unidentified
  REGION 1..81: note = Bos indicus x Bos taurus
TKDWTVAPELVLPESQEEWELLNPTQKALYNDVMHENYETVISLALFVLPKPKVIYLEQGEEPYIQGSPMFKDNPGELLSE

SEQ ID NO: 30983 - protein, 81 aa, Ovis aries
LLTFEEVAIYFSQEEWELLNPTQKALYNDVMHENYETVISLEIKLKNDMENHQLMCLSDLEIQAPGDIVSKKASVNVHQKT

SEQ ID NO: 30984 - protein, 81 aa, Pan troglodytes
SITLKDVAVTFSRGEWKKLEPFQKELYKEVLLENLRNLEFLALFENHGNYIPYNPKYNSFLSCKQEIFYFLYLLDESALDK

SEQ ID NO: 30985 - protein, 81 aa, Enhydra lutris
LLTFEDVAVSFSEEEWRLLDPTQKSLYNDVMQENYETVVSLGLKLKNDTGNDQPISLSALEIQASGCRVLRKARMKVAQKT

SEQ ID NO: 30986 - protein, 81 aa, Pongo abelii
TESCESITLKDVSVNFSRGEWKKLEPFQKELYKEVLLENLRNLEFLDFPVSKLELISQLKWVELPWLLEEVSKCSRLGSVI

SEQ ID NO: 30987 - protein, 81 aa, Enhydra lutris
PQGSAAYQFLSVDYTERKWKGPALSQRAVYRSIMPENCCSVASMGETRMQHSELPAKQEVSKEPLLPDGTSGGLCGVVSEE

SEQ ID NO: 30988 - protein, 81 aa, Enhydra lutris
SQVPVTLEDMAAYLSQEEWESPDPAQRDCSWDTLPEHRGLGLQLDGEDAREDVSMRRERDREPAGGMTRPEQPLERAGPRR

SEQ ID NO: 30989 - protein, 81 aa, Enhydra lutris
TKDWTVAPELVLPESQEEWELLDPTQKALYNDVMRENYETVISLALFVLPKPKVISYLEHGEEPWVQGSLEFKNSPGELPS

SEQ ID NO: 30990 - protein, 81 aa, Pan troglodytes
GHQEPASTSFHPPRIQEEWGLLDRSQKELYWDAMLEKYGTVVSLGLPPHQPEAQAQSELGMLLTGTGVCRSLRSGECPTPS

SEQ ID NO: 30991 - protein, 81 aa, Otolemur garnettii
IRDQDFTASLLPSAPQEQWRHLDSTQKEQYWDLMLETYGKMVSGAGVSNSRADLTNSTEFGEELAGLHLHVSEKLPRPTCI

SEQ ID NO: 30992 - protein, 81 aa, unidentified
  REGION 1..81: note = Bos indicus x Bos taurus
VEEDFRFKDVVIYFSWKEWECLHSAQKDLYQDVMLENYNNLISLGFTNFKPDVISLLEQRKEPWMVKGKETEEWCPDWKSR

SEQ ID NO: 30993 - protein, 81 aa, Ovis aries
VTVQDVAVSLTWEEWERLGPAQKHFFRESTPKDHGNAISPSSETRIENKELVPKQEILEEVESQGQLRGFQERAPLSSECG

SEQ ID NO: 30994 - protein, 81 aa, Otolemur garnettii
VKIEDVADVAVSFILEEWGHLDQSQKSLCRDDRKENYGSITSMDYESRDNNMELIVKQISDDAESHWMASGSTERNVPQSQ

SEQ ID NO: 30995 - protein, 81 aa, Camelus dromedarius
PQELLTFKDICVDFTQEEWKQLAPSHRNLYREVMLENYGHLVSVGCQLSKPGVISQLEKGEEPWLTEREVSGGPSPDLESK

SEQ ID NO: 30996 - protein, 81 aa, Pongo abelii
SQELLTFKDVSVDFTQEEWGQLAPAHRNLYREVMLENYGNLVSVAGYQLSKPGVISQLEKGEEPWLMERDISGVPSSDLES

SEQ ID NO: 30997 - protein, 81 aa, Camelus dromedarius
QAMVKIEDMAVSLILEEWGCQNLARRNPSRDNRQENYGNVISQGKTDAGLLSDEIVLPFCFGCENRNENEESTSKAEIADD

SEQ ID NO: 30998 - protein, 81 aa, Otolemur garnettii
IQTDLVTFDSVAVEFTQEEWTLLDTTQRNLYRDVMLENYKNLSSVGYQLFKPSLISQLEEEFRTVQRSIFQEWKMCLKTNG

SEQ ID NO: 30999 - protein, 81 aa, Enhydra lutris
SQELLTFKDISVDFTQEEWGQLPLAHRNLYREVMLENYGNLVSVAGYQLSKPSVISQLEKGQEPWMTEKEVPEDPSSDLRT

SEQ ID NO: 31000 - protein, 81 aa, Pan troglodytes
ALSQEENPRNQLMALMLLTAQPQELVMFEEVSVCFTSEEWACLGPIQRALYWDVMLENYGNVTSLDTKYTRQSKIIGTRVA

SEQ ID NO: 31001 - protein, 81 aa, Camelus dromedarius
MTFTDVAVDITPEDWELMRPVQKELYKTVTLQNYWNMVSLEVRASSWMRSQVIKFEQLFSSRTKLILFLLNRTYGVQTNCD

SEQ ID NO: 31002 - protein, 81 aa, Myotis davidii
FQLPESLEDVAMYISQEKWGHQDPSKRALSRDTVQESYENVDSLESQVPNQEALSIQVEQGRKPWEPSVQICKEGLSPRNP

SEQ ID NO: 31003 - protein, 81 aa, Cercocebus atys
QGMATFEDMAVSLTWEEWERLDPARRDFCRESAQKDSGSTVPPSLESRAENKELIPMQEILEAEPQGGLQAAFQGKCPLLS

SEQ ID NO: 31004 - protein, 81 aa, Otolemur garnettii
SQKPLKDVHMTRGYSYKKSVHQIPAHRGLYQGIRKESVGNMVSLGSTVSISNKATRLDQRKEPWTLGLHSSNKRSILRSNY

SEQ ID NO: 31005 - protein, 81 aa, Pongo abelii
EEPVTFQDVAVDFSREEWGLLGPTQRTEYRDVMLETFGHLVSVGWETTLENKELAPNSDIPEEEPAPSLKVQESSGDYALS

SEQ ID NO: 31006 - protein, 81 aa, Pan troglodytes
TESCESITLKDVAVTFSRGEWKKLEPFQKELYKEVLLENLRNLEFLDFPVSKLELISQLKWVELPWLLEEVSKGSRLGSVI

SEQ ID NO: 31007 - protein, 81 aa, Camelus dromedarius
KIEDVADVAVSFILEEWGHLDQSQKSLYRDDRKENYGSVTSMDYESRNDSMEVLVKQISKEAESPWMTSGSTERNVPPSQG

SEQ ID NO: 31008 - protein, 81 aa, Pongo abelii
MVTFEDMAVSLTWEEWERLDPARRDFCRESVQKDSGSTVPPSPVKMKGRGCLLSSTRGSHHHGQATTVSLMQVTLFMDRKS

SEQ ID NO: 31009 - protein, 81 aa, Camelus dromedarius
RLMLHEEEAQERRKRREKRSGMALSQGQLTFKDVAVVFTQEEWECLDPAQRALYRDVMLETCRNLISVGEDFFPLEAGLCP

SEQ ID NO: 31010 - protein, 81 aa, Enhydra lutris
GHREPASTSFHPPRIQEEWGLLDPSQKELYWDAMLEKYGTVVSLGIPAPQPEARVELEPGALRTGTEGRRSLHPGDESESH

SEQ ID NO: 31011 - protein, 81 aa, Physeter macrocephalus
LERHLGLVTITNMAIDVSQQPDPTRKSFCKNVVWEDHNLGAVGRCVSEPDLVSLLDLGKEPWVVKGELARGPSPGQQSIHE

SEQ ID NO: 31012 - protein, 81 aa, Papio anubis
QEPVTFKDVVVEFSKEEWGQLDSAVKNLYRNVMLENFRNLNSLRKAYLFSKPVESLKLESKKKRWIMEKEIPRKTVFDMQS

SEQ ID NO: 31013 - protein, 81 aa, Sarcophilus harrisii
VKIEDVADVAVSFILEEWGHLDQTEKDLSRNDRQENYETITAVDYEPRNENMELIVKQEISEEAESLWMTPGSIQKNDSQD

SEQ ID NO: 31014 - protein, 81 aa, Leptonychotes weddellii
PGHREPASTSFHPPRIQEEWGLLDPSQKELYWDAMLEKYGTVVSLGIPAPPPEAGAESGPGAMRTGIEGRRSLHPGDESES

SEQ ID NO: 31015 - protein, 81 aa, Physeter macrocephalus
PTSVPFQPPRIPEEWGLLDPSQKEVYWDAMLQKYGTVVSLAGLPCPLPEARTEPEPEALSTGSEGARSLLPGGESESSREG

SEQ ID NO: 31016 - protein, 81 aa, Monodelphis domestica
SAWSQMPVTFEDMAMYLSQEEWGRLNPEQREHYQNVLQENYGLPALKPNLIAQMERKEGLWNSNVPAFKERDVPRDNPTEC

SEQ ID NO: 31017 - protein, 81 aa, Physeter macrocephalus
LLTFEDVALFFTEEEWQLLDPAQKILYYNVMQENYETVTSLGLKLKNDTGNDQPISLSTLEIQASGCKVLRKARMKVAQKT

SEQ ID NO: 31018 - protein, 81 aa, Monodelphis domestica
SQLPVTFEDVAVYLSQEEWGHQEPSKKALSREVMQENYENVVSLESQIPSQDPASQIEQEEKPWDPNLQSAKEPGISKIPY

SEQ ID NO: 31019 - protein, 81 aa, Monodelphis domestica
TSDNNEAASLLTPGSQEQWQYLNHIQKEIYWDAMLEDYGKVVSLGIPVSKPDLTNLVDRREKLDGSHSLANEEIPRNICIG

SEQ ID NO: 31020 - protein, 81 aa, Physeter macrocephalus
SQSLLTFEEVAIYFSQEEWELLDPTQKALYNDVMQENYETVISLALFVLPKTKVNCCLEQGEEPWVQGSPVFKDSPGELFS

SEQ ID NO: 31021 - protein, 81 aa, Aotus trivirgatus
QEPVTFKDVVVEFSKEEWGQLDSAVKNLYRDVMLENFRNVNSLRKAHLLSKPVESLELTNKKKRWITEKEISRKTISDMQS

SEQ ID NO: 31022 - protein, 81 aa, Monodelphis domestica
SITFKDMAVDFTQEEWCLLDPSQKELYREVMLENVQNLLFVEAETNFEVKEMSPELSLFVEGSGPQKGMNPLYFLLREIWD

SEQ ID NO: 31023 - protein, 81 aa, Physeter macrocephalus
SQELLTFKDISVDFTQEEWGQLAPAHRNLYREVMLENYGNLVSVVGCQLSKPSVISQLEKGEAPWMTEKEGPGDPSSDLKS

SEQ ID NO: 31024 - protein, 81 aa, Monodelphis domestica
FQETITFQDVTPDFTWEEWAQLDTVQQDLCRDVLMENYRNLVFIGLSVSKPDVISQMEHGEVPWLLRSEVPRGICPYWDFG

SEQ ID NO: 31025 - protein, 81 aa, Papio anubis
SQEPVTFADVAVVFTPEEWVFLDSTQRSLYRDVMLENYRNLASVADQLCKPNALSYLEQRGEQWTTDRGILLDTCAEPQLQ

SEQ ID NO: 31026 - protein, 81 aa, Aotus trivirgatus
QTDLVTFDSVAVEFTQEEWTLLDPTERNLYRDMMLENYKNLSSVGYQLFKPSLISWMEEEEELSTLPRVLQEWKMCLKTNG

SEQ ID NO: 31027 - protein, 81 aa, Monodelphis domestica
QETITFQDVTPDFTQEEWAQLNPAQQDLCMDVLMENYRNLVFIGLELSVSKPDVISQMEHGKGPWLLKSEALRGISPYKDI

SEQ ID NO: 31028 - protein, 81 aa, Monodelphis domestica
KSQDLVTFGDVAIYFSQEAQGQLDSAPQDFCQDQTQENENGVSQRFPIPRTSMISQIEQGEKLQNLDLQGCKEKENSRDSR

SEQ ID NO: 31029 - protein, 81 aa, Papio anubis
QGLLKMEDVALTLSPGWTQLDSSQVNIYRDEKQENHSSLVSLGAEIQTESRDLPPVKKLSKKEHGKICHLREDIAQNPTCA

SEQ ID NO: 31030 - protein, 81 aa, Enhydra lutris
VKIEDVADVAVSFILEEWGHLDQSQKSLYRDDRKEKFGSITSMDYESGHDNVELAVKQISDDVEPHWMTSGSPERNVPQSQ

SEQ ID NO: 31031 - protein, 81 aa, Monodelphis domestica
LPKMKSFGDYKLVSGSQEAPGHRSPVQDLCKDSEGKDYGNEFLKEFAVPNSDIILPLKQGREPWAPNLQSSEEKKNNPRGY

SEQ ID NO: 31032 - protein, 81 aa, Aotus trivirgatus
EELPVVFEDVAVYFTREEWGMLDKRQKELYRDVMRMNYELLASLGPAAAKPDLISKLERRAAPWIRDPNGPKWGKGRPSGN

SEQ ID NO: 31033 - protein, 81 aa, Enhydra lutris
QEPVTFKDVIVEFNEEEWGQLDPAIKTLHRDVMLENYRNLNSLYQEHLFSKPVEISKLESKERRWTVEHKIPSTSVLDREI

SEQ ID NO: 31034 - protein, 81 aa, Vulpes vulpes
GHREPTSTSFHPPRIQEEWGLLDPSQKELYWDAMLEKYGTVVSLGIPAPQPEAQAELEPGALRTGTESLRSLHLGDENESH

SEQ ID NO: 31035 - protein, 81 aa, Enhydra lutris
SRESMMIKDVVVSFSRGEWRRLEPFQKELYKEVLLENFRSLEFLGFPVSKLDLISQFKWVELPWLLEREISKGSRPECEPR

SEQ ID NO: 31036 - protein, 81 aa, unidentified
  REGION 1..81: note = Bos indicus x Bos taurus
LLTFEEVAMYFSQEEWELLDPTQKALYNDVMQENYESVIFLGLKLKNDTENIQSLCLSDLEIQVPVAIASRKARLKVPQKT

SEQ ID NO: 31037 - protein, 81 aa, Rhinolophus ferrumequinum
SGEPMTFKDVAVSFSRGEWRKLEPFQKELYKEVLMENFRNLEFLGFPVSKLDLISQLKWVELPWLLEKEVSEGSRPECDPR

SEQ ID NO: 31038 - protein, 81 aa, Callithrix jacchus
QGMMTFEDMAMSLTWEEWERLDPARKDFYRESMQKDSGSTVLPSLESRTENKELIPMQEILEAEPQEQLQEAFQGKPPLFS

SEQ ID NO: 31039 - protein, 81 aa, Neophocaena asiaeorientalis
KIEDVADVAVSFILEEWGHLDHSQKSLYRDDRKENYGSITSMDYESRNDNVELMVKQISDEAESPWMTSGSPERNVPPSQE

SEQ ID NO: 31040 - protein, 81 aa, Acinonyx jubatus
PAATSFHPPRIQEEWGLLDRSQKELYWDAMLEKYGTVVSLGLPAPLPEARVESEPGVLRSGTEGQRSLHPGECFSMRSEPP

SEQ ID NO: 31041 - protein, 81 aa, Zalophus californianus
SRESVAFKDVVVTFSRGEWRRLEPFQKELYKEVLLENFRNLEFLGFPVSKLDLISQFKWVELPWLLEKEISKGSRPEGEPR

SEQ ID NO: 31042 - protein, 81 aa, Phyllostomus discolor
LEKIEDMAVSLIREEWLLDPSQKDLSRDDKPENYRNVFTLGSETRNENRELASKQVISTGVQLHGERAAKCNGDADGSPEL

SEQ ID NO: 31043 - protein, 81 aa, Ursus maritimus
EEPVTFLDVAVDFSKEEWGLLDTMQRTEYHDVMLETFGHLVSVGWETTLESKELTSKSDIPEKELAHDLKIEEISRDDTCS

SEQ ID NO: 31044 - protein, 81 aa, Sus scrofa
SLLTFEEVAIYFSQEEWELLDPTQKALYNDVMHENYETVISVAVPAHQILAFPEQTNSRDWTVAPELVLPEAQSLLTFEEV

SEQ ID NO: 31045 - protein, 81 aa, Panthera pardus
PQELVTFQDVAVDFSLEELTYLSAAQRNLYREVMLENYRNLVSLGYQFSKPDIISQLEEEESHVREEDSDTEMHHDPRGPS

SEQ ID NO: 31046 - protein, 81 aa, Rhinolophus ferrumequinum
QGLVKVKDVAVSLTWEDWEHLDAVQRDFYRESTPKDYGNTVPPRLETRTENKELIPKQEFLDVEPQRQLQEGSQGKAPPFS

SEQ ID NO: 31047 - protein, 81 aa, Bison bison
WTVAPELVLPESQEEWELLDPTQKALYNDVMQENYETVISLAVPAHQLLAFPKQTNTSEWTVAPELILPESQSLLTFEEVA

SEQ ID NO: 31048 - protein, 81 aa, Zalophus californianus
IRDQDFGASFLQAAPLEQWRHLDSTQKEQYWDLMLETYGKMVSGGISSSKSDLTNSTEYGEELVGLHLPVGEKIPRPTCIG

SEQ ID NO: 31049 - protein, 81 aa, Acinonyx jubatus
ESQELLTFKDISVDFTQEEWGQLAPAHRSLYREVMLENYGNLVSVDLESKAETKESAVKNDTSWEELHHGLMKEQSTRGST

SEQ ID NO: 31050 - protein, 81 aa, Panthera pardus
VGDQDFTASVLQAAPQETWRHLESVQKEQYWDLMLETYGKMVSGGISSSKPDPTGSTEYGEEPAGRHPHLSEKIPRPTCLG

SEQ ID NO: 31051 - protein, 81 aa, Panthera pardus
SQELLTFKDISVDFTQEEWGQLPLAHRNLYREVMLENYGNLLSVAGYQLSKPSVISQLEKGQEPWMTEKEGPGDPRSDLKN

SEQ ID NO: 31052 - protein, 81 aa, Sus scrofa
PQLPESLEDVAMYISQEEWGHQDPSKRALSRDTVQESYENVDPLESQVPSQEALSTQVEQGRKPWDPNVQICKEGLSPRSP

SEQ ID NO: 31053 - protein, 81 aa, Acinonyx jubatus
VGDQDFTASVLQTAPQEPWRHLESVQKEQYWDLMLETYGKMVSGGISSSKPDPTGSTEYGEEPAGRHPHLSEKIPRPTCLG

SEQ ID NO: 31054 - protein, 81 aa, Panthera pardus
KSRGSISFEDVTVNFTQEEWGQLDPDQRTLYRDVMLENDGFFISLGHSITKPEEIFKLEQGASWILEEEFASQCYLREQSR

SEQ ID NO: 31055 - protein, 81 aa, Sus scrofa
GGPVTFGDIPFYFSREEWGSLDPSQRDLFWDIKRENSRNVAPGLGFKSPSERPQLEEVVTAIPGQAVGDVAASWRPEAAEA

SEQ ID NO: 31056 - protein, 81 aa, Tursiops truncatus
LERHLGLVTITNMAVDVSQQPDPTRKSFCKNVVWEDHNLGAVGHCVSEPDLVSLLDLGKEPWVVKGELARGPSPDPEGFWS

SEQ ID NO: 31057 - protein, 81 aa, Carlito syrichta
VMFEEVSVCFTSEEWACLGPIQRALYWDVMLENYGNVTSLEWETMTENEEVTSKPNISQRADSHKGTSKRLQGGIPKALDF

SEQ ID NO: 31058 - protein, 81 aa, Acinonyx jubatus
LVTKESMTFKDVAVDITQEDWEIMRPIQKELYKTVTLQNYWNMVSLGLTVYRPTVIPMLEEPWMVIKEILEGPSPEWKTEA

SEQ ID NO: 31059 - protein, 81 aa, Carlito syrichta
SQGLVTFKDVAVCFSQDQWSDLDPTQKEFYGEYVLEEDCGIVVSLSFPIPRPDEISQVREEEPWVPDIQEPQETQDPEILS

SEQ ID NO: 31060 - protein, 81 aa, Vicugna pacos
PQLPESLEDVAMYISQEEWGHQDPSKRALSGDTVQESYENVDSLESQVPSQEALSAQVEQGGKPWDPNVQARKEGLSPRSP

SEQ ID NO: 31061 - protein, 81 aa, Callithrix jacchus
QGMMTFEDMAMSLTWEEWERLDPARKDFYRESVQKDSGSTVLPSLESRTENKELIPMQEILEAEPQEQLQEAFQGKPPLFS

SEQ ID NO: 31062 - protein, 81 aa, Enhydra lutris
GHREPASTSFHPPRIQEEWGLLDPSQKELYWDAMLEKYGTVVSLAGIPAPQPEARVELEPGALRTGTEGRRSLHPGDESES

SEQ ID NO: 31063 - protein, 81 aa, Sus scrofa
TRDEDLGASLLQAAPQAQWSHLDSTQKEQYWDLMLETYGKMVSGGISNPKPDLTSPAGYGAELAGLHLHGSEKIPRPTCTG

SEQ ID NO: 31064 - protein, 81 aa, Sus scrofa
SQEQLTFRDVSVDFTQEEWGQLAPAHRHLYREVMLENYGNLVSVGYQLSKPGVISQLEKGEEPWLMEREVSGGPSPDLKGE

SEQ ID NO: 31065 - protein, 81 aa, Phascolarctos cinereus
MTFEDMTMSFALEKWGQLDPVQKSLCSDKRHDNYGNVVALDGVTTMENGESAQNQDIKADTESKGELPDRLNGHIPQGLEL

SEQ ID NO: 31066 - protein, 81 aa, Pteropus vampyrus
QEPVTFKDVVVEFSEEEWGHLDPAVKSLYRDVMLENYRNLNSLRKEHLFSKPDEVPKLECKKKRWITEQEIPRTIVFDRQT

SEQ ID NO: 31067 - protein, 81 aa, Physeter macrocephalus
PQELVMFEEVSVCFTSEEWACLGPIQRALYWDVMLENYGNVTSLEWETMTENEEVTSKSSLSQRADFQKGTSKRLQGSVPQ

SEQ ID NO: 31068 - protein, 81 aa, Ursus arctos
SLLTFEDVAMYFSQEEWELLDPTQKALYNDVMRENYETVISLAVPAHQILAFPEQIITKDWTVAPELVLPESQSLLTFEEV

SEQ ID NO: 31069 - protein, 81 aa, Neophocaena asiaeorientalis
QEPVTLKDVVVEFSEEEWGQLDPAVKNLYRDVMLENYRNLNSLHKEHLLSKPVETSRLESKEKSWIMEQEILRTAVFDREI

SEQ ID NO: 31070 - protein, 81 aa, Leptonychotes weddellii
SQGLLTFKDISVDFTQEEWGQLAPAHRNLYREVMLENYGNLVSVAGYQLSKPSVISQLEKGQEPWMTEKEGPGDPSSDLKN

SEQ ID NO: 31071 - protein, 81 aa, Odocoileus virginianus
SGQSVSVEGMSQILMIFKYLAMTFTWEEWGQLDLAKRTLYWEVMLETCGLLVSLGYPIPKPEVIHLLENEQNLCLVKRGFS

SEQ ID NO: 31072 - protein, 81 aa, Odocoileus virginianus
QLTFEDVALSFSKEEWQIMDPNQKTLYIDVMQEIYETVTSLGLKLKNDTGNDQPVSLSTSEIQPSGCKVLRKARMKVAQTT

SEQ ID NO: 31073 - protein, 81 aa, Vicugna pacos
PQELLTFKDICVDFTQEEWGQLAPAHRNLYREVMLENYGHLVSVGYQLSKPGVISQLEKGEEPWLTEREVSGGPSPDLESK

SEQ ID NO: 31074 - protein, 81 aa, Pongo abelii
DTVVYEDLSVDYTQKKWKGLTLSQRALQWNMMPENDHSMASLAGENMMKGSELTPKQKIFKGSESSNRTSGGLFGVVPGAA

SEQ ID NO: 31075 - protein, 81 aa, Delphinapterus leucas
QEPVTFKDVVVEFSEEEWGRLDPAVKNLYRDVMLENYRNLNSLHKEHLLSKPVGTSRLESKEKSWIMEQEILRTVFDREII

SEQ ID NO: 31076 - protein, 81 aa, Balaenoptera acutorostrata
SQESMTLKDVAVTFSRGEWRTLEPSQKEIYKEVLLENYRNLEFLGFPVSKLDLISQLKWAGLPRLLQKQASRGSRPECELS

SEQ ID NO: 31077 - protein, 81 aa, Odocoileus virginianus
PQLPESLEDVAMYISQEEWGRQHPSKRALSRDTVQESYENVDSLESQVPSQEALSTQVEHGGRPWHPSVQTCKEGLSSRTP

SEQ ID NO: 31078 - protein, 81 aa, Callithrix jacchus
QLQETMTFKDVEVTFSQDEWGLLDSAQRNLYRDVMLENYRNMAFLVGPFTKPALISWLEAREPWGLNVQVAQPKRNPGAAP

SEQ ID NO: 31079 - protein, 81 aa, Acinonyx jubatus
PVTFGDVPFYFSREEWGSLDPAQRDLFWDIKRENSRNVALALVPEPSGTEEAAPSRLAGLGPESQSKQSRLEEAAAALQGQ

SEQ ID NO: 31080 - protein, 81 aa, Leptonychotes weddellii
QEPVTFLDVAVDFSKEEWGLLDPTQRTEYHDVMLETFGHLVSVGWETTLESKELTPKSDIPEKEPAHDLKMEEFSRDDTWS

SEQ ID NO: 31081 - protein, 81 aa, Leptonychotes weddellii
SQSLLTFEEVAMYFSQEEWELLDPTQKALYNDVMRENYETVISLALFVLPKPKVISYLEQGEEPWIQGPLEFKNSPGGLPT

SEQ ID NO: 31082 - protein, 81 aa, Zalophus californianus
ERAVPAQQILAFSEQKSPPNWKMASELILPEFQSLLTFEDVAVSFSEEEWKLLDPTQKILYNDVMQENYETVISLAVGGSP

SEQ ID NO: 31083 - protein, 81 aa, Ursus arctos
FQSLLTFEDVAVSFSEEEWKLLDPSQKILYNDVMQENYETVISLGFLRCAPSEAICSVNESCRKGALKSVPAHPSRASRGR

SEQ ID NO: 31084 - protein, 81 aa, Panthera pardus
QQVPVTLEDVAAYLSQEEWECLDPAQRGCVWDVLPDSGGLGLQLEDGEGARQDVPTRREQDRELVGGMTRPEQSLERGGPR

SEQ ID NO: 31085 - protein, 81 aa, Pongo abelii
SQELLTFKDVSVDFTQEEWGQLAPAHRNLYREVMLENYGNLVSVGYQLSKPGVISQLEKGEEPWLMERDISGVPSSDLESK

SEQ ID NO: 31086 - protein, 81 aa, Chrysochloris asiatica
QEPVTFQDVVVEFSEEEWGKLDPDVKNLYKDVILENYRNLNALQKGHLLSKPVEVSKLESKKNPQITGGEIPRRTVLGKET

SEQ ID NO: 31087 - protein, 81 aa, Bos mutus
PLTFADVALYFSEEEWKIMTPDEKTLYLDVMQELYEDVASVGLKLTNDTGNDPPVSLPTLEIQPSGCEVLRKATMKDAETT

SEQ ID NO: 31088 - protein, 81 aa, Neophocaena asiaeorientalis
TEGLVTFKDVAVDFSPEELTYLTAAQRKLYRELMLENYRNLVSLGYQFPKPDIISRLEAEESCAVEEDSSTMICQDWEKKP

SEQ ID NO: 31089 - protein, 81 aa, Nomascus leucogenys
QAMVKIEDMAVSLILEEWGCQNLARRNLSRDNRQENYGSAFPQGGENRNENEESTSKAETTEDSASCGETAGRFQKEFGEK

SEQ ID NO: 31090 - protein, 81 aa, Equus caballus
FERQPGLVPITSVAVDFSQQLEPAQKSFCKNVMWKNHDLGPVGCCVSKPDLVSVLEREKEPWLVKRELTRGLFSGQQSIRE

SEQ ID NO: 31091 - protein, 81 aa, Chrysochloris asiatica
QPQEAMTFKDVEVTFFQDEWEWLDHSKRNLYRDVMLENYGNMVSLVGPFHKPALISWLEGREPWGLNDQGVQQREKPGAAP

SEQ ID NO: 31092 - protein, 81 aa, Mandrillus leucophaeus
QCASPVPTLPQVGNSGLRMVRPQDTVAYEDLCVDYTQKKWKCPALSQRALQWNMMPENDRSMASLGWSTMARSWLTSISGS

SEQ ID NO: 31093 - protein, 81 aa, Nomascus leucogenys
GMVTFEDMAVSLTWEEWERLDPARRDFCRESTQKDSGSTVGPSLESRVENKELIPMQQILEEVEPQGRLQEAFQGKRPLFS

SEQ ID NO: 31094 - protein, 81 aa, Chrysochloris asiatica
SQGLVTFQDVAVCFSHDQWSNLDPTQKEFYGEYVFEEDCGIVVSLSFPIPRLDEISQVREEESWVPDIQEPQERQETEILS

SEQ ID NO: 31095 - protein, 81 aa, Mandrillus leucophaeus
GHQEAASTSFHPPRIQEEWGLLDRSQKELYWDTMLEKYGTVVSLGLPPHQPEAQAQSELGMLLLGTGVCRSLRSGNESEGP

SEQ ID NO: 31096 - protein, 81 aa, Sus scrofa
AQSLLTFEEVAMYFSQEEWELLDPTQKALYNDVMHENYETVISVALFVFPKPNVIACLEQGEEPWVQRSLEFKDSSEELPA

SEQ ID NO: 31097 - protein, 81 aa, Loxodonta africana
QESAAYEDLSVDYTQKKWKGPALSQRALYRNMMLENYRSMASLASENRMESSELTPKPELSKGPGSSERTSGGLHGMALGA

SEQ ID NO: 31098 - protein, 81 aa, Suricata suricatta
VQELHPESGEEAVTLVEGMQRELGRLRLQLPESLEDVAMYISQEEWGRQDPSKRALSRDTVQDSYENVDSLGKDFFFRDED

SEQ ID NO: 31099 - protein, 81 aa, Sus scrofa
ESQEQLTFRDVSVDFTQEEWGQLAPAHRHLYREVMLENYGNLVSVDLKGETETKESALKNELSWKELHHCLMMEKSTRGST

SEQ ID NO: 31100 - protein, 81 aa, Sus scrofa
APEASALSQEENPRNQLMALMLLTAQPQELVMFEEVSVCFTSEEWACLGPIQRALYWDVMLENYGTVTSLVYRNCRRQRNK

SEQ ID NO: 31101 - protein, 81 aa, Loxodonta africana
LVKIEDVIDMAFSFILEEWGHLDQSQKNLYRGDRKENCGSITSIDYESRNDNMELIVEQISDEAESHWMTSGSTERNVPQS

SEQ ID NO: 31102 - protein, 81 aa, Loxodonta africana
QAMVKIEDMAVSLILEEWGCQNLARRNLNRDNRQETYGNVFSQGCGNRNENEESTSKTKIAEDSASHGETTGRLQKAFGEK

SEQ ID NO: 31103 - protein, 81 aa, Chrysochloris asiatica
SSESVSFKDVAVNFSRGEWKKLQPFQKKLFMEVLLENCRNLEFLGFPVSKLDLISPLKWVVMPWLLQKEVSKSSRLESSLD

SEQ ID NO: 31104 - protein, 81 aa, Suricata suricatta
FGDQAFGASVLQAAPQEQWKHPDPAQEEQHWDVMLETYRKMVSGGISSSKSDPTDPAECGEELAGRRRPLRETSPRPPCSG

SEQ ID NO: 31105 - protein, 81 aa, Bos mutus
KIEDVADVAVSFILEEWGHLDQSQKSLYRNDRKENYGSMTSMDYESRNDNMELTVKQISDEAESSWMTSGGPERIIPPSQE

SEQ ID NO: 31106 - protein, 81 aa, Neophocaena asiaeorientalis
VTVQDVAVSLTWEEWERLGPAQRDLYRESAPKDYGNAVSPSLETRTENKELILKQEILEEVEPQGQLQESQEKGPLSSECG

SEQ ID NO: 31107 - protein, 81 aa, Equus caballus
FQELLTFKDISVDFTQEEWGQLAPGHRTLYREVMLENYGNLVSVGYQLSKPGVISQLEKGEEPWLIEREISDGPTSDLESK

SEQ ID NO: 31108 - protein, 81 aa, Mandrillus leucophaeus
DTVAYEDLCVDYTQKKWKCPALSQRALQWNMMPENDRSMASLAGENMMKGSELTPKQEIFKGSESSNKTSGGLFGMVPGGA

SEQ ID NO: 31109 - protein, 81 aa, Neophocaena asiaeorientalis
EQQELTSVPFQPPRIQEEWGLLDRSQKEVYWDAMLQKYGTVVSLGLPCPLPEARTEPEPEPEALSTGSEGARSLPPGGESE

SEQ ID NO: 31110 - protein, 81 aa, Loxodonta africana
WGSAALFVKQPGLVIVGDVAVDFSQQKSFCKNVTWENYGDLGSVGHSVSKPDLVSLLAQGMEPWMVKRELTGGLFSGECGR

SEQ ID NO: 31111 - protein, 81 aa, Suricata suricatta
PQLPESLEDVAMYISQEEWGRQDPSKRALSRDTVQDSYENVDSLEPQVPSQEALSAQVEQGGKPWDPSAQTCKEGLSPRGP

SEQ ID NO: 31112 - protein, 81 aa, Sus scrofa
RSQELVTFKDVAVDFSPEELTYLSSAQRNLYREVMLENYRNLVSLGYQFPKPDIISWLEEEEAWAEEEDSRTTLRQDWEKK

SEQ ID NO: 31113 - protein, 81 aa, Chrysochloris asiatica
GPFVLKFKDVAIYFSEKEWECLKPTQKDLYRDVMLKNYNNLVSLGLSDSKPDVIFLLEQGKEPWRVKREETEEWCPDWESR

SEQ ID NO: 31114 - protein, 81 aa, Mandrillus leucophaeus
SQEPVKDVHVARGFSYKKSVHQIPAHRDLYRDFRKENVGNMVSLGSTASTSNKITRLEQRREPWTLGLHSSNKKSILRSNY

SEQ ID NO: 31115 - protein, 81 aa, Sus scrofa
PQELVMFEEVSVCFTSEEWACLGPIQRALYWDVMLENYGTVTSLAMEWTWTREVWRIGEWETMAENEEVTSKSSISQRADS

SEQ ID NO: 31116 - protein, 81 aa, Suricata suricatta
EDAVTFLDVAVDFSKEEWGLLDPTQRTEYHDVMLETFGHLVSVGWETTLESKELTPKSDIPEEELAPDLKMEESSRDDTCS

SEQ ID NO: 31117 - protein, 81 aa, Sus scrofa
PTSAPFHPSRIQEEWGLLDPSQKELYWDAMLEKYGTVVSLGLPRPLPEAFAESEPEGLSPGPEGQRSLRPAGESASSGAEG

SEQ ID NO: 31118 - protein, 81 aa, Neophocaena asiaeorientalis
QSLLTFEDVALFFTEEEWQLLDPAQKILYNNVMQENYETVISLGPLGTVSDCGLKIQLPRESCKAIQCQMTLKKDKWDDKT

SEQ ID NO: 31119 - protein, 81 aa, Chrysochloris asiatica
VMFEEVSVCFTSEEWACLGPIQRALYWDVMLENYGNVTSLEWETMTENEEVTSKPGISQRSDSQKGASKRLRSIPKVLDFE

SEQ ID NO: 31120 - protein, 81 aa, Chrysochloris asiatica
NWNAEAPFKRQPGLLTVRNVAVDFAQQRRFCKHWMQENHGDLGSIGLCISKPEVISLLEQGKEPWQVNGQRTAESPAWEEH

SEQ ID NO: 31121 - protein, 81 aa, Sus scrofa
QLTFRDVSVDFTQEEWGQLAPAHRHLYREVMLENYGNLVSVGLTSKTETSVSTAENDIVQEQLYHSMMMERLMRDDVIYST

SEQ ID NO: 31122 - protein, 81 aa, Sus scrofa
QEPAEYEFLSVDYTQKKWKGPALSQRALYRNIVPENCHSLASLAGENGMECSDLPPEQESSKESEASDRTSGVLYEVIPGG

SEQ ID NO: 31123 - protein, 81 aa, Mandrillus leucophaeus
QTDLVTFDSVAVEFTQEEWTLLDPTQRNLYSDVMLENYKNLSSVGYQLFKPSLISWLEEEEELSTLPRVLQEWQMCLKTKG

SEQ ID NO: 31124 - protein, 81 aa, Neophocaena asiaeorientalis
QSLLTFEDVALFFTEEEWQLLDPAQKILYNNVMQENYETVISLGPLGTVSDCGLKIQLPRESCKAIQCQATSVGCALFLKL

SEQ ID NO: 31125 - protein, 81 aa, Equus caballus
SQSLLTFEEVAMYFSQEEWELLDPTQKALYNDVMQENYETLISLALFVLPKPKVISCLEQGEDPWVQGSPEFNDRPRELPT

SEQ ID NO: 31126 - protein, 81 aa, Suricata suricatta
VMFEEVSVCFTSEEWACLGPIQRALYWDVMLENYGNVTSLEWETMTEHEEVTPKPSTSPRADAQKGPSKRLQGSVPQTLDF

SEQ ID NO: 31127 - protein, 81 aa, Chrysochloris asiatica
LVTKESVTFVDVAVDITQEDWGLMRPVQKELYKTVTLQNYWNMVSLGLTVYRPSVIPILEEPWLVIKEIVEGPSPEWQTKV

SEQ ID NO: 31128 - protein, 81 aa, Sus scrofa
EPTSAPFHPSRIQEEWGLLDPSQKELYWDAMLEKYGTVVSLAGLPRPLPEAFAESEPEGLSPGPEGQRSLRPGKGPPAPGG

SEQ ID NO: 31129 - protein, 81 aa, Capra hircus
SQGLLTFEEVAIYFSQEEWELLNPTQKALYNDVMHENYETVISLALFVLPKPKVISYLEQGEDPYIQGSPVFKDNPEELLS

SEQ ID NO: 31130 - protein, 81 aa, Mandrillus leucophaeus
EENPRNQLMALMLLTAQPQELVMFEEVSVCFTSEEWACLGPIQRALYWDVMLENYGNVTSLVYYRNIKYARQSKIIGTRVA

SEQ ID NO: 31131 - protein, 81 aa, Capra hircus
TEELVTFEDVAVDFSPEELPYLSASQRNLYREVMLENYRNLVSLGYQFPKPDLISQLEEEESHAREEDGSTVTRQDWEEQS

SEQ ID NO: 31132 - protein, 81 aa, Suricata suricatta
VKIEDVADVAVSFILEEWGHLDQSQKSLYRDDRKENYGSIPSMDYESRNDNVELIVKQISDDAESHWMMSGSAERNIPQSQ

SEQ ID NO: 31133 - protein, 81 aa, Suricata suricatta
QLELVTFQDVAVDFSPEELTYLSAAQRNLYREVMLENYRNLVSLGKTAFSMELGFRKNSGTFTFLLDGEERPKTKDLTPEQ

SEQ ID NO: 31134 - protein, 81 aa, Chrysochloris asiatica
VTCENVAVSLTWEEWGHLGPAQRDISRESAQKECGSTVLLSLETRAKNKLMFPKQEILEAEPQVQELEGSQGKVSMFSKYG

SEQ ID NO: 31135 - protein, 81 aa, Chlorocebus sabaeus
DTQPGLVTIKNLAVDFPQQLHPAQKNFCKNGIWENHSDLGSAGHCVAKPDLVSLLQQEKEPWMVKQELTGSLLSGQRSVRE

SEQ ID NO: 31136 - protein, 81 aa, Lipotes vexillifer
PQLPESLEDVAMYISQEEWGHQHPSKRALSQDTVQESYENVDSLESQVPTQEALSTQVEQEGKPWDPSVQTCKEGLSPRSP

SEQ ID NO: 31137 - protein, 81 aa, Equus caballus
SWESVTFKDVAVNFSRGEWRKLEPFQKELYKEVLLENFRNLEFVGLPVSKLDLVSQLTWAELPRLLEKEISKGSRSDCKRR

SEQ ID NO: 31138 - protein, 81 aa, Chrysochloris asiatica
VGDQDCGGSLLAAPSQEQWRHLDSTQKEHYWDLMLETYGKMVSGGLSSPKADAAHSAEYGDELAGLHLRILSLSFTRELTL

SEQ ID NO: 31139 - protein, 81 aa, Suricata suricatta
QPQEAVTFKDVEVIFSQDEWGWLDPAQRNLYRDVMLENYGNMVSLVGPFTKPVLISWLEAREPWGLNGQGAWPKAKSGVAP

SEQ ID NO: 31140 - protein, 81 aa, Loxodonta africana
RDQDLGASLLQASSQEQWRHLDSTQKEYYWDLMLEAYGKMVSEGPDISSPKPDRANSAEHGQERGRLHLHAREKISMQACT

SEQ ID NO: 31141 - protein, 81 aa, Pteropus vampyrus
QGLVNVKDVAVSLTWEEWEHLDPVQRVFYRESKPKDYGNIAPPSLETRTENKELIPKQEILEVEPQRQLQEASQGKAPLFS

SEQ ID NO: 31142 - protein, 81 aa, Zalophus californianus
SQELVTFKDVVVDFSPEELTYLSAAQRNLYREVMLENYRNLVSLGYQFSKPDIISQLEEEESRVREEDSNTEICQGNGITV

SEQ ID NO: 31143 - protein, 81 aa, Zalophus californianus
LILPEFQSLLTFEDVAVSFSEEEWKLLDPTQKILYNDVMQENYETVISLAIWSISESWRKDALKSIPAYPSRASRGRQMHT

SEQ ID NO: 31144 - protein, 81 aa, Trichechus manatus
QGLVTFKDVASSLTWEEWVHLDPAQRIFSRESTQKDYGNTILLSLESRTEDKELILKQEILEEAEPQGQLQEGSQGKAPLF

SEQ ID NO: 31145 - protein, 81 aa, Pteropus vampyrus
AEELVTFQDVVVDFSPEELASLSAAQRNLYREVMLENYRNLVSLGYQFSKPDVISQLEEEESRAIEEDSDKKMCQDWEKRT

SEQ ID NO: 31146 - protein, 81 aa, Trichechus manatus
ALFEKQPGLVTVRDVAVDFSQQKSFCKTVMWENHGGLGSVGCSVSKPDLVSLLEQGTEPWMVKRELTGGLFSGQQSVCETQ

SEQ ID NO: 31147 - protein, 81 aa, Loxodonta africana
QGLVTFKDVAMSVTWEEWVHLDPAQRTFSRDSTQKDYGNTVLLSLESRTENKELIPKQEILEEAEPQGQLEEGSQGKAPLF

SEQ ID NO: 31148 - protein, 81 aa, Chlorocebus sabaeus
EPVTFKDVVVEFSKEEWGQLDSAVKNLYRNVMLENFRNLNSLRKGTAYLLSKPVESLKLESKKKRWIMEKDIPWKTVFDMQ

SEQ ID NO: 31149 - protein, 81 aa, Sus scrofa
QQVLLTLEDMAVYLTQEEWRCLDLARQGHGCGVLPEDEGNVRRDPGFVHQTLCCVSDLGESQGGWRSPRAGCGAVVASRPR

SEQ ID NO: 31150 - protein, 81 aa, Capra hircus
PVTFGDIPFYFSREEWGSLDPAQRDLFWDIKRENSRNVALGLGHRSHSERTQLEEVVTALPDQAAGDKTASRSPEEAEAWE

SEQ ID NO: 31151 - protein, 81 aa, Chrysochloris asiatica
YQELLTFNDISVDFTQEEWGQLAPAHRNLYREVMLENYGNLVSVGYQFSKPGVISQLEKGEEPWLTEREISEGPSSDLESK

SEQ ID NO: 31152 - protein, 81 aa, Chlorocebus sabaeus
QDTVAFEDLSVGYTQKKWKCPALSQRALQWNMMPENDRSMASLGENMMKGSELTPKQEIFKGSESSNKISGGLFGMVPGGA

SEQ ID NO: 31153 - protein, 81 aa, Tursiops truncatus
PTSVPFQPPRIQEEWGLLDRSQKEVYWDAMLQKYGTVVSLAGLPCPLPEARTEPEPEALSTGSEGARSLLPGGESESSREG

SEQ ID NO: 31154 - protein, 81 aa, Tursiops truncatus
LPESVTFEDVAINFTQEEWALLDTSQKTLFRNVMLENITHLVSVGYQISKSDVISQLEQGKELRKRNVSKQCGNSLSQGSF

SEQ ID NO: 31155 - protein, 81 aa, Loxodonta africana
SAEASVSLRSLIFLWLMENWKRALQRHQKIRKKFLLTIMNNIEFLGLPVSKLELISQLKWVVMPWLLEKEGSKGSRPGKLV

SEQ ID NO: 31156 - protein, 81 aa, Tursiops truncatus
LQEPVTFADVAVLFTPEEWLFLDSAQRSLYRDVMLENYRNLTSVGDQLCKASTFSHLEQREELCVTERGIFPGTHLEPQLQ

SEQ ID NO: 31157 - protein, 81 aa, Trichechus manatus
ENWEEAAAVVQAFQRALDGTAPQGLVTFKDVASSLTWEEWVHLDPAQRIFSRESTQKDYGNTILLKPQTRLPLWECGLPQL

SEQ ID NO: 31158 - protein, 81 aa, Zalophus californianus
LTFEDVAVSFSEEEWKLLDPTQKILYNDVMQENYETVISLGFLCCALSKAIWSISESWRKDALKSIPAYPSRASRGRQMHT

SEQ ID NO: 31159 - protein, 81 aa, Capra hircus
KIEDVADVAVSFILEEWGHLDQSQKSVYRDDRKENYGSMTSMDYESRNDNVELTVKQISDEAESSWMTSGGPERIVPLSQE

SEQ ID NO: 31160 - protein, 81 aa, Trichechus manatus
PSNRVSPFKDMIFCFSEEDWSLLDPAQTGFYGEFIIGEDCGVSLPPSDPVSQPALSQGEESEPRVPELQDLQGKNVPQVSY

SEQ ID NO: 31161 - protein, 81 aa, Zalophus californianus
TLVESLKGDPQRLWQWEQWRHLDSTQKEQYWDLMLETYGKMVSGGISSSKSDLTNSTEYGEELVGLHLPVGEKIPRPTCIG

SEQ ID NO: 31162 - protein, 81 aa, Equus caballus
SLLTFEEVAMYFSQEEWELLDPTQKALYNDVMQENYETLISLAVPAHQILASPEQTNTKDWTMAPELVLPESQSLLTFEEV

SEQ ID NO: 31163 - protein, 81 aa, Lipotes vexillifer
QEPVTFKDVVVEFSEEEWGQLDPAVKNLYRDVMLENYKNLNSLHKEHLLSKPAETSRLESKEKSWIMEQEILRTNVFDREI

SEQ ID NO: 31164 - protein, 81 aa, Callorhinus ursinus
SRVPVTLEDMAAYLSQEEWECVDPAQRDCSWDMLPEHGGLGLQLEDGQDTREDVSMGRERDQELVRGLARPEQPLERGGPR

SEQ ID NO: 31165 - protein, 81 aa, Tursiops truncatus
QVPVTLEDVAVYLSQEEWGCLDLAQQDHSCGRLQEDEAGLPAPGPCLTAQDGPGQGLRDPACAASGLREVSGSAGSELGRQ

SEQ ID NO: 31166 - protein, 81 aa, Tursiops truncatus
PTSVPFQPPRIQEEWGLLDRSQKEVYWDAMLQKYGTVVSLGLPCPLPEARTEPEPEALSTGSEGARSLLPGGESESSREGR

SEQ ID NO: 31167 - protein, 81 aa, Equus caballus
LMRDQDFGASLLHTAPQEQWRHLDSSQKEQYWDLMLETYGKMVSGGMSNSKPDPTSTECGEELAGVYLHISEKIPRPTCTG

SEQ ID NO: 31168 - protein, 81 aa, Zalophus californianus
SQSLLTFEEVAMYFSQEEWELLDPTQEALYNDVMRENYETVISLALFVLPKPKVISYLEQGEDPWVQGPLEFKNSPGGLPT

SEQ ID NO: 31169 - protein, 81 aa, Tursiops truncatus
SQEMLTFRDVFVDFTLEEWQQLDATQKNLCKDVMLENYSHLVSDSSWPNQVGPSGWDKEKRRPGWQLEKAQHGGVQGARVR

SEQ ID NO: 31170 - protein, 81 aa, Equus caballus
SQSLLTFEEVAMYFSQEEWELLDPTQKALYNDVMQENYETLISLALFVLPKPKVISCLEQGEEPWVQGSPEFKDCPRELPT

SEQ ID NO: 31171 - protein, 81 aa, Trichechus manatus
PQLPESLEDVALYISQEEWGHQEPRKRALSRDTVQESYENVDSLASPIPSQEALSTQVEPEGKPWDPRVQTCKEGPSPRSP

SEQ ID NO: 31172 - protein, 81 aa, Trichechus manatus
LMTKESMTFKDVAVDITQEDWELMRPVQKELYKTVTLQNYWNMVSLGLTVYRPSVIPILEEPWLVIKEILEGPSSEWQTKA

SEQ ID NO: 31173 - protein, 81 aa, Loxodonta africana
PQLPESLEDVAMYLSQEDCRHLEPGKRALSRDTVQENYKNVDSLESPIPNHGALSTQVEPGGKPWDPRVQSCKERRRPQSP

SEQ ID NO: 31174 - protein, 81 aa, Loxodonta africana
LVTKESMTFKDVAVDITQEDWELMRPVQKELYKTVTLQNYWNMVSLGLTVYRPSVIPILEEPWLVIKEILEGPSPEWQTKA

SEQ ID NO: 31175 - protein, 81 aa, Sousa chinensis
PVTFKDVVVEFSEEEWGQLDPAVKNLYRDVMLENYRNLNSLHKEIISENQDLVPKQRISGEESSHAVIMKRLTENGHPPLD

SEQ ID NO: 31176 - protein, 81 aa, Trichechus manatus
EPQEAVTFKDVEVIFFQDEWGWLDSAKKNLYRDVMLENYGNVASLVGPFPKPALISWLEGRGPWGLNVQGAQQRENPGAAS

SEQ ID NO: 31177 - protein, 81 aa, Equus caballus
VTVEDVAVSLSWEEWERLDPAQRDFHRESAPKDYGDTVSPSLETRPENKELIPKQEILEEVEPQGKPRGSQEKAPLLSECG

SEQ ID NO: 31178 - protein, 81 aa, Trichechus manatus
SQGLVTFKDVAVCFSHDQWSDLDPTQKEFHGEYVLEEDCGIVVSLSFPIPRLDEISQVREEESWVPDIQEPQEPQETEILS

SEQ ID NO: 31179 - protein, 81 aa, Trichechus manatus
QEPVTFKDVVVEFSEEEWGQLDPAVKSLYRDVMLENYRNLNSLRKGHLLSKPVEISKLDSKKKPQIMEGEIPRRTIFAMKK

SEQ ID NO: 31180 - protein, 81 aa, Trichechus manatus
YQELLTFKDVSVEFTQEEWRQLAPAHQNLYREVMLENYGNLVSVGYQLSKPGVISQLEKGEEPWMSEREISGGPVSDLENE

SEQ ID NO: 31181 - protein, 81 aa, Equus caballus
EPQEAMTFKDVEVTFSQDEWGWLDFAQRNLYRDVMLENYGNVASLVGPFTKPALISWLEAREPWGLNIQGAKGNPGATPAG

SEQ ID NO: 31182 - protein, 81 aa, Pan paniscus
MAEGLKFKDVAIYFSQKEWECLHSAQKDLYRDVMLENYGNLVLLGLSDTKPNVISLLEQKKEPWMVKRKETKEWCPDWEFG

SEQ ID NO: 31183 - protein, 81 aa, Tursiops truncatus
TEGLVTFKDVAVDFSPEELTYLTAAQRKLYREVMLENFRNLVSLGYQFPKPDIISRLETEESRTVEEDSSTMICQDWEKKP

SEQ ID NO: 31184 - protein, 81 aa, Neomonachus schauinslandi
SQESVTFKDVVVSFSRGEWRRLEPFQKELYKEVLLENFRNLEFLGFPVSKLDLLSQFKWVELPWLLEKEISKGSRPDVLLE

SEQ ID NO: 31185 - protein, 81 aa, Monodelphis domestica
RLQESMTFEDVAVYFSKAEWTLLSPAQQVLYRNVMLENYENLASLACPFPKPIVISNLEQASWDLQEALVQDLRNTYAGDE

SEQ ID NO: 31186 - protein, 81 aa, Monodelphis domestica
TEEVVMFQDVAVDFTREEWRLLSPPQKELYKEVMLENARNLLSVGLPAPPQEVISYLEQREVQCMLKPEGLQSCCPEGEIS

SEQ ID NO: 31187 - protein, 81 aa, Aotus trivirgatus
SCESITLNDVAVNFSRGEWKKLEPFQKELYKEVLLENFRNLEFLDESALDKIIERCLRDDDDDLMEEFHKYCGISEEEHGN

SEQ ID NO: 31188 - protein, 81 aa, Callorhinus ursinus
ERLIRDQDFGASFLQAAPLWRHLDSTQKEQYWDLMLETYGKMVSGGISSSKSDLTNSTEYGEELVGLHLPVGEKIPRPTCI

SEQ ID NO: 31189 - protein, 81 aa, Monodelphis domestica
PVTFEDMAMYLSQEEWGRLNPEQREHYQNVLQENYECEIKIEDEEDSREDSTMEMELYRTQAGKSKGCGHQPAHQGQACVT

SEQ ID NO: 31190 - protein, 81 aa, Monodelphis domestica
SQELVTFKDVAVDFTQEEWKKLDSTQRNLYWAVMLENYMNMVYLGFPVSKLEVISHMDQGEESWILEKEISKATCPDWEID

SEQ ID NO: 31191 - protein, 81 aa, Lipotes vexillifer
SQSLLTFEEVAMYFSQEEWELLDPTQKALYNDVMQENYETVISLALFVLPKPKVISCLEQGEEPWVQSSLEFKDNSGELPT

SEQ ID NO: 31192 - protein, 81 aa, Monodelphis domestica
RAQEAPTFQDVAVDFTWEEWRQLDPAQRDLYRDVMLENYQNLVSLGLPVSKPDIISQLEQEAPWSLKRDVANGSCLDWGTR

SEQ ID NO: 31193 - protein, 81 aa, Monodelphis domestica
CQESVTFRDVAPDFTWEEWTQLNPIQQALYREVLLETYRNLVFLGFSTSKPDVISQLEDEEITRILDSETPKGTCSYWDTV

SEQ ID NO: 31194 - protein, 81 aa, Equus caballus
QEPVTFKDVVVEFSEEEWGQLDPAVKNLYRDVMLENYRHLNSLRKDHLLSKPVEMSKLESKKKRWIMEREIPRATIFDRQR

SEQ ID NO: 31195 - protein, 81 aa, Loxodonta africana
PLNRVSPFKDMIFCFSEEDWSLLDPAQTGFYGEFIIGEDCGVSLPPSEPGIQPDLSQGEQNEPRITELQDLQGKNMPQVSY

SEQ ID NO: 31196 - protein, 81 aa, Tursiops truncatus
SQELLTFKDISVDFTQEEWGQLAPAHRNLYREVMLENYGNLVSVGCQLSKPSVISQLEKGEAPWMTEKEGPGNPSSDLKSK

SEQ ID NO: 31197 - protein, 81 aa, Capra hircus
SLGSVTFEDVAVNFSWEEWGLLDESHKRLYHDVMLENYALISSLGFWSGEEKVETSFAQSVSEAVSQARTSKEASSSQKTH

SEQ ID NO: 31198 - protein, 81 aa, Pteropus vampyrus
PVTFGDIPFYFSQEEWGSLDLAQRDLFWDIKRENSRNVALGLGLKSQSQRSQLEEAVTALPGQTGVDVTVAWNPEEAKAWE

SEQ ID NO: 31199 - protein, 81 aa, Capra hircus
GGPVTFGDIPFYFSREEWGSLDPAQRDLFWDIKRENSRNPGLWGDPSERTQLEEVVTALPDQAAGDKTASRSPEEAEAWEG

SEQ ID NO: 31200 - protein, 81 aa, Chrysochloris asiatica
GSQELVTFQDVAVDFTPEELSYLTAAQRNLYREVMLENYQNLVSVGHQFDKPDLISQLEKEEWCGMDEDTDVVTQDWEMNP

SEQ ID NO: 31201 - protein, 81 aa, Chrysochloris asiatica
LVEIEEVIDMAVSFSLVEWGRLDPSAKNLYTDGRKENYGSILSIGSESRNGKMELRVEQISDDARSHWMAHGSTERNVPQR

SEQ ID NO: 31202 - protein, 81 aa, Suricata suricatta
PQNLLTFEEVAMYFSQEEWELLDPTQKALYNDVMRENYETLISLALFVLPKPKVISYLEQGEEPWVQGSTEFKDSPGELPT

SEQ ID NO: 31203 - protein, 81 aa, Equus caballus
SQGLVTFKDVAVCFSQDQWSDLDPTQKEFYGEYVLEEDCGIVVSLSFPIPRLDEISHVREEEPLVPDIPEPQESQEPEILS

SEQ ID NO: 31204 - protein, 81 aa, Chlorocebus sabaeus
QGMATFEDMAVSLTWEEWERLDPARRDFCRESAQKDSGGTVPPSLESRAENKELIPMQEILEAEPQGRLQEAFQGKRPLLS

SEQ ID NO: 31205 - protein, 81 aa, Pteropus vampyrus
SQSLLTFEEVAVYFSQEEWELLDPSQKALYNDVMQKNYETVISLAIFVLPKPKVISCLEQGEEPWVQGSPNLKNNDKELPT

SEQ ID NO: 31206 - protein, 81 aa, Pteropus vampyrus
FQEPVTFKDVVVEFSEEEWGHLDPAVKSLYRDVMLENYRNLNSLQHLFSKPDEVPKLECKKKRWITEQEIPRTIVFDRQTI

SEQ ID NO: 31207 - protein, 81 aa, Equus caballus
PQELVMFEEVSVCFTSEEWACLGPIQRALYWDVMLENYGNVTSLEWETMTENEEVTSKSSISQRADSQKGTSKRLQGGVPQ

SEQ ID NO: 31208 - protein, 81 aa, Suricata suricatta
LVTKESMTFKDVAVDITQEDWEMMRPVQKELYKTVTLQNYWNMVSLGLTVYRPTVIPMLEEPWMVIKEILEGPSPEWKTEA

SEQ ID NO: 31209 - protein, 81 aa, Suricata suricatta
VKIEDMAVSLILEEWGCQNLARRNLNRDNRQENYGNVFFQGCEKRNESEESASKAETTEDSASRGETTGRFQKDFAEKREQ

SEQ ID NO: 31210 - protein, 81 aa, Lipotes vexillifer
QAMVKIEDMAVSLILEEWGCQNLARRNLNRDTRQENYGHVISQGCENRNENEESTSKAEIAEDSASHGETTGKFQKDFGEK

SEQ ID NO: 31211 - protein, 81 aa, Equus caballus
MTSGFQSFGSFLVPEELSCLTAAQRNLYREVMLENYRNLVSLGKSAFSMELRTFTFLLDWEKKLETKDVTPEQSLPVQKSS

SEQ ID NO: 31212 - protein, 81 aa, Neovison vison
APWEQHSCGAQLPALKEGRTRETADTCFASEAYGPVTFGDIPFYFSREEWGSLDPAQRELFWDIKRENSRNVALALVPEPS

SEQ ID NO: 31213 - protein, 81 aa, Capra hircus
QPQGTVTFKDVEVTFSQDEWGLLDASQRNLYRDVMLENYGNMASVVGPFTKPALISWLEAREPWGLNVQGVQLKGNPGAAP

SEQ ID NO: 31214 - protein, 81 aa, Capra hircus
SQELLTFKDVSVDFTQEEWGQLAPAHRNLYREVMLENYGNLVSVAGCQLSKPSVISQLEKGEEPWMTEKEGPGDPSSDLES

SEQ ID NO: 31215 - protein, 81 aa, Suricata suricatta
SQDLLTFKDISVDFTQEEWGQLAPAHRSLYREVMLENYGNLLSVGYQLSKPGVISQLEKGEEPWLIEREVSGGPCADLENK

SEQ ID NO: 31216 - protein, 81 aa, Trichechus manatus
SRELLTFKDIAVDFTQEEWRQLDPAHRNLYREVMLENYGNLVSVGYQLSKPSVISQLEKGEEPWLTEKEAPGDTSSDLESK

SEQ ID NO: 31217 - protein, 81 aa, Zalophus californianus
RQVPVTLEDMAAYLSQEEWECVDPAQRDCSWDMLPEHGGLGLQLEDGQDTREDVSMGRERDQELVRGMARPEQPLERGGPR

SEQ ID NO: 31218 - protein, 81 aa, Lipotes vexillifer
SQGPVKDDHMARGFSYKKSVRQIPAHRDLYRHIRKESIGNMVSLGNTVSTANKMAQLEQRKEPWTIGLQSSNKRNVLRSNY

SEQ ID NO: 31219 - protein, 81 aa, Trichechus manatus
SAAYDDLSVDYTQKKWKGPALSQRALYRNMMLENYHSVASLAGENRMNSSELTPNQVISKGPGSSDGTSGGLHGMVPGTPE

SEQ ID NO: 31220 - protein, 81 aa, Callorhinus ursinus
QELVTVENMAVSLTWEEWDRLDPAQRDFCPESALKDRRNMVSLVSLSLETRTENKEFIPKQEVLEEVEPQGQLQEESHWKA

SEQ ID NO: 31221 - protein, 81 aa, Zalophus californianus
SQELVTFKDVVVDFSPEELTYLSAAQRNLYREVMLENYRNLVSLGYQFSKPDIISQLEEEESRVREEDSNTEICQVDFACH

SEQ ID NO: 31222 - protein, 81 aa, Equus caballus
GSAAYEFLCVDYTQKKWRGPAVSQRALYQKVMPENHCSAASLAGENRMESSELPAKHEISKGSDSSNRISGGLYVVVPGGP

SEQ ID NO: 31223 - protein, 81 aa, Pteropus vampyrus
AEVPVAFEDVAVYFTQEEWGSLDKRQKELYRDVMWMNYELLASLGPAAAKPDLISKLERRAAPWIKDTRGPKWGKGKRKTV

SEQ ID NO: 31224 - protein, 81 aa, Lipotes vexillifer
QGLVTVQDVAVSLTWEEWERLGPAQRDLYRESAPKDYGNAVSPSLETRIENKELILKQEILEEVEPQGQLQGPQEKGPLSS

SEQ ID NO: 31225 - protein, 81 aa, Tursiops truncatus
SQSLLTFEEVAMYFSQEEWELLDPTQKALYNDVMQENYETVISLALFVLPKPKVISCLEQGEEPWVQRSLEFKDNSGELPT

SEQ ID NO: 31226 - protein, 81 aa, Equus caballus
VTFGDIPFYFSREEWGSLDPAQRDLFWDIKRENTRNIALGLGLKSHSEHSRPEEALPGQAGGDVTVSWSPAEAEVWESEAR

SEQ ID NO: 31227 - protein, 81 aa, Trichechus manatus
VRDQDFGASLLQASSQEQWRHLDSTQKEYYWDLMLEAYGKMVSGDISSPKSDLANSAEHGQELARLHLDAGENIPMPTCTG

SEQ ID NO: 31228 - protein, 81 aa, Trichechus manatus
SQGPVKDIHTARGFSYKENVHKIPAHRDLYQEIRKESVGNMVSLGGSVSTTSKIAQLEQRKEPRTIGLHSSNKRNTLRSNY

SEQ ID NO: 31229 - protein, 81 aa, Trichechus manatus
TVIFEDVAVVFSQGEWALLDLAQKKLYRDVMMETFRSLAAIVSQNLYDGESLSSEHVMVQFMKNNTWSSMLGEIFESHGTK

SEQ ID NO: 31230 - protein, 81 aa, Trichechus manatus
QEPVTFKDVVVEFSEEEWGQLDPAVKSLYRDVMLENYRNLNSLRKGHLLSKPVEISKLDSKKKPQIMEGEIPRRTVFDRET

SEQ ID NO: 31231 - protein, 81 aa, Pteropus vampyrus
QAMVKIEDMAVSLILEEWGCQNLARRNLSRDNRQENYGNVFSQGCENRNENEESTSKAEIAEDSTSHAETRGRIQKDFGEK

SEQ ID NO: 31232 - protein, 81 aa, Zalophus californianus
LILPESQSLLTFEEVAMYFSQEEWELLDPTQKALYNDVMRENYETVISLAVPAHQILAFPEQIITKDWTVAPELVLPESQG

SEQ ID NO: 31233 - protein, 81 aa, Equus caballus
WELASASFHPPRIQEEWGLLDPSQKELYWDAMLEKYGTVVSLGLPPPRREAPAESEPRALSAGTEGPGSLRTGDESESPRE

SEQ ID NO: 31234 - protein, 81 aa, Zalophus californianus
LTFGDIPFYFSREEWGSLDPAQRELFWDIKRENSRNVALGAGLQSQSQRSGLGEAVTVLPGQAGGGGGGGGRGDVTVSWSP

SEQ ID NO: 31235 - protein, 81 aa, Pan paniscus
DFAQCTSPVPTLPQVGNSGDQAGATVLRMVRPQDTVAYEDLSVDYTQKKWKGLTLSQRALQWNMMPENHHSMASLGNDSVS

SEQ ID NO: 31236 - protein, 81 aa, Pteropus vampyrus
KLKPAEPQPVGMSQDEEFWNTYQGVQEQLSRNTHKETEPVFERAIFVLPKPKVISCLEQGEEPWVQGSPNLKNNDKELPTG

SEQ ID NO: 31237 - protein, 81 aa, Zalophus californianus
QPVYERAVPAQQILAFSEQKSPPNWKMASELILPEFQSLLTFEDVAVSFSEEEWKLLDPTQKILYNDVMQENYETVISLDR

SEQ ID NO: 31238 - protein, 81 aa, Lipotes vexillifer
LERHLGLVTITNMAVDVSQQPDPTRKSFCKNVVWEDHNLGAVGRCVSEPDLVSLLDLGKEPWVVKGELARGPSPGQKSIHE

SEQ ID NO: 31239 - protein, 81 aa, Callorhinus ursinus
MAEGFTFKDVAIYFSQKEWECLHSAQKDLYRDVMLENYNNLISLGLSYSKPDVISLLEQGKEPWMVKSQETKEWCPDWESR

SEQ ID NO: 31240 - protein, 81 aa, Lipotes vexillifer
LPPNRVSSFKDMIFCFSEEDWSLLDPAQTGFYGEFIIGEDCGVSLPPDDPAAQLDLSQGEENEPLVPELQDLQGKDVSQVS

SEQ ID NO: 31241 - protein, 81 aa, Tursiops truncatus
SQESMTLKDVAVTFSRGEWRALEPSQKEIYKEVLLENYRNLEFLGFPVSKLDLVSQLKWAGLPRLLQKQASRGSRPECELS

SEQ ID NO: 31242 - protein, 81 aa, Callorhinus ursinus
PQALLTFRDVAIEFSQEEWGCLTHTQRQLYRDVMLENYGHLLFLGLVLSKPDLMMFLEQEKQLWDVKRKETVAFHPALNRS

SEQ ID NO: 31243 - protein, 81 aa, Sarcophilus harrisii
GSQEPICSGMSRNLSYKKWEHPNPAHKNFCRGIIKENYRNMVSLGIPISTAKKVSQLTRGKKPWVLALQGSSKRHVLRGIH

SEQ ID NO: 31244 - protein, 81 aa, Pteropus vampyrus
SQRPVKDVHVARGFSYRKSMRQVPAHRGLFRDGREESAEDVVSLGSAVSASNEIARLEHRRAPWTVDPHPAHSRSGLRSSH

SEQ ID NO: 31245 - protein, 81 aa, Monodelphis domestica
FQESVTFKDVVPDFTWEELVQLDPVEQDLYRDVLLENYRNLVFLGLLASKPDVIIQLECGEVPWILENEVPKGLIGLRESS

SEQ ID NO: 31246 - protein, 81 aa, Monodelphis domestica
VTPTFQDVAVDFTWEEWKQLDPAQQDLYRSVTLENYQNLVSLGKEKNSITFNCTTVYQSLNCDKGWKGFHPFHPLSQYTMF

SEQ ID NO: 31247 - protein, 81 aa, Aotus trivirgatus
GSQEAVKDVHVARGFSYKKSVHQIPVHRGLYRDFRKENVGNMVSLVTVSTSNRITRLEQRKEPWTLGLHSLIEKSLQGVQE

SEQ ID NO: 31248 - protein, 81 aa, Aotus trivirgatus
VKIEEVADVAVSFILEEWGHLDQSQKSLYRDDRKENYGSITSMDYESRDNMDLMVKQVSDDTESHWVALEHTERSVPQGPD

SEQ ID NO: 31249 - protein, 81 aa, Pan paniscus
EELPVVFEDVAVYFTREEWGMLDKRQKELYRDVMRMNYELLASLGPAAAKPDLISKLERRAAPWIKDPNGAKSGGKGRPPG

SEQ ID NO: 31250 - protein, 81 aa, Pan paniscus
ALSQEENPRNQLMALMLLTAQPQELVMFEEVSVCFTSEEWACLGPIQRALYWDVMLENYGNVTSLDIKYTRQSKIIGTRVA

SEQ ID NO: 31251 - protein, 81 aa, Tursiops truncatus
SQELLTFKDISVDFTQEEWGQLAPAHRNLYREVMLENYGNLVSVVGCQLSKPSVISQLEKGEAPWMTEKEGPGNPSSDLKS

SEQ ID NO: 31252 - protein, 81 aa, Gorilla gorilla
KPRLLEENALPVLQVPSLPLKDSQELTASLLSTGSQKLVKIEEVADVAVSFILEEWGHLDQSQKSLYRDDRKENYGSITSM

SEQ ID NO: 31253 - protein, 81 aa, Pan paniscus
PQLPESLEDVAMYISQEEWGHQDPSKRALSRDTVQESYENVDSLESHIPSQEVPGTQVGQGGKLWDPSVQSCKESLSPRGP

SEQ ID NO: 31254 - protein, 81 aa, Ailuropoda melanoleuca
LIGDQEFGASFLQASPPEHWRHLDSTQKEQYWDLMLETYGKMVSGGISNSKCDLTNSTEYGEELAGLHLHVGEKISRPTCI

SEQ ID NO: 31255 - protein, 81 aa, Homo sapiens; identical to SEQ ID NO: 2913

SEQ ID NO: 31256 - protein, 81 aa, Homo sapiens; identical to SEQ ID NO: 2914

SEQ ID NO: 31257 - protein, 81 aa, Pteropus alecto
DSVAFEDVAVTFTLEEWSLLDSSQKKLYRDVMRETFRNLTSIGKKWEDYDVEDQCKNQGRKRRSHMDSVAYEDVAVNFSVE

SEQ ID NO: 31258 - protein, 81 aa, Ursus arctos
EELPVVFEDVAVYFTREEWGMLVKRQKELYRDVMRMNYELLAALGPAAAKPDLISKLERRAAPWIKDPNGPKWGKGRPPGK

SEQ ID NO: 31259 - protein, 81 aa, Saimiri boliviensis
SCESITLKDVAVNFSRGEWKKLEPFQKELYKEVLLENFRNLEFLDFPVSKLELISQLKWVELSWLLEKEVSKGSQPDESAL

SEQ ID NO: 31260 - protein, 81 aa, Panthera pardus
SQELLTFKDISVDFTQEEWGQLPLAHRNLYREVMLENYGNLLSVGYQLSKPSVISQLEKGQEPWMTEKEGPGDPRSDLKNK

SEQ ID NO: 31261 - protein, 81 aa, Vombatus ursinus
SQESLICSGISRNLSHKKWGHLNPAHKNFCRGIMKENYRNMVSLGIPISTAKKMSQLARGKKPWVLAFQGSNKRHVLRGIH

SEQ ID NO: 31262 - protein, 81 aa, Mustela putorius
SQGPVKDVHMARGFSYKKSVHQIPAHRDLYRDIRKESVGNMVSLGGTVSVSNKIAQLEQRKEPWTLGLHSSNKRSIILRSN

SEQ ID NO: 31263 - protein, 81 aa, Ursus arctos
SLLTFEDVAMYFSQEEWELLDPTQKALYNDVMRENYETVISLAVPAHQILAFPEQIITKDWTVAPELVLPESQRYLCFPNL

SEQ ID NO: 31264 - protein, 81 aa, Myotis brandtii
SLVGVTFEDIALYFSKKEWSLLDEGQRQLYLNVMLENFELVSSLGCCCGAEDVAAPPEQKVSVRVSQARNPKVALSSQKSH

SEQ ID NO: 31265 - protein, 81 aa, Lynx pardinus
TSNSQEPISFKDVIVEFSKEEWGQLDPAVKNLYRDVMLENYRNLNSLHQVELSELESKDRRWIIEQEIPSTSFFDREVISE

SEQ ID NO: 31266 - protein, 81 aa, Propithecus coquereli
VKIEDMAVSLILEEWGCQNLARRNPSRDNRQENYGNVFSQGCENRNENEESTSKAEISEDVASRGETAGRFQKELAEKREQ

SEQ ID NO: 31267 - protein, 81 aa, Oryctolagus cuniculus
SELFRDVAIVFSQEEWQWLAPVQRDLYRDVMLETYSSLVSLVLESQYDTRVSSPEQPVCEIEVPQWGIRERLTSNDLEHSS

SEQ ID NO: 31268 - protein, 81 aa, Propithecus coquereli
QKMMTFEDVAVALTWEEWEHLDPARKDFCRESTQKEYGSTVPPSLEITPENKQLILKQEILEEAEPQGWLQEVFQGNLPLF

SEQ ID NO: 31269 - protein, 81 aa, Balaenoptera acutorostrata
SQSLLTFEEVAMYFSQEEWELLDPTQKALYNDVMQENYETVISLELSLGCSKTEGREISSHSSTAVPAHQFLAFPEQTSAK

SEQ ID NO: 31270 - protein, 81 aa, Camelus ferus
CEMSVSFEDVTVAFTQEEWRHVSPAQRTLYRDVMLENYRHLVSVGYWFTKPDIIFKLERREDPLLLENEFLTKSHAVTSDG

SEQ ID NO: 31271 - protein, 81 aa, Myotis brandtii
IHTGDKTYKCGHVEPVTFKDVAVVFTEEELGLLDPSQRKLYRDVTLENFRNLVSEAVTFQDVAVVFTEEELGLLDPSQRKL

SEQ ID NO: 31272 - protein, 81 aa, Myotis brandtii
RRVSVTFEDVAVTFSQEEWGQLDVAQRTLYQEVMLENCRLLASLGCPVPRPQLICQPESGRELWMVKTDLSRGVFSGEKGK

SEQ ID NO: 31273 - protein, 81 aa, Saimiri boliviensis
ETQPGLVTMENLAIDFPQQLHPAQKNFCKNGLWENYSDVGSAGHCMAKPDLVSLLEQEKEPWMVKRELTGNLFSGQQSVCE

SEQ ID NO: 31274 - protein, 81 aa, Tupaia chinensis
FQKLVTFEDVAVYFTQTEWDDLSPAQRALYRDVMLENYGNVASLGFPLLKPAVIAHLEGGGSVKEENSSIVDGTVEGETGT

SEQ ID NO: 31275 - protein, 81 aa, Muntiacus reevesi
SQELLTFKDISVDFTQEEWGQLAPAHRNLYREVMLENYGNLVSVAGCQLSKPSVISQLEKGEEPWITEKEGPGDLSSDLKS

SEQ ID NO: 31276 - protein, 81 aa, Propithecus coquereli
IRDQDFGASLLPAAPQEQWRHLDSTQKEQYWDLMLETYGKMVSGAGISTSRPDLTNSAEYGEELAGLHLHVNEKLPRPTCI

SEQ ID NO: 31277 - protein, 81 aa, Balaenoptera acutorostrata
LKRHLGLVTITNMAVDVSQQPGPTRKSFRKNVVWEDHSMGAVGRCVSEPDLVSLLDLGKEPWVVKGELARGPSPGQQSIHE

SEQ ID NO: 31278 - protein, 81 aa, Cervus elaphus
KKEPISQDSVVSQEENPEEDKTVSVLPNTEAQESMTLKDVAVTFSRGEWRKLEPSQKEIYKEVLLENYRNLEFLGKDIFSS

SEQ ID NO: 31279 - protein, 81 aa, Cervus elaphus
ALFSADSQVRAVGLSLGFGGTECGDLVLFQAMVKIEDMAVSLILEEWGCQNLARRNLNRDARQENYGNVISQGLNPWETSL

SEQ ID NO: 31280 - protein, 81 aa, Colobus angolensis
DTQPGLVTIKNLAVDFPQQLHPAQKNFCKNRIWENHSDLGSAGHYVAKPDLVSLLQQEKEPWMVKQELTGSLLSGEFTVRE

SEQ ID NO: 31281 - protein, 81 aa, Cervus elaphus
PHSRGAQLPALKQGSTRETTDTCFASGGPVTFGDIPFYFSREEWGSLDPAQRDLFWDIKRENSRNVALGKHWAQQGPGGIP

SEQ ID NO: 31282 - protein, 81 aa, Camelus ferus
MLQQLLITLPTDTSTWVKLHHPEKAKEGPPLWEDVTKMFEGEGYQLSKPSVISQLEKGEEPWMTEKEGPGDLSSDLKSKTE

SEQ ID NO: 31283 - protein, 81 aa, Saimiri boliviensis
SQEPVKDVHVARGFSYKKSVHQIPAHRGLYRDFRKENIGNVVSLGSTVSTSNRITRLEQRKEPWTLGLHSSSKRSTLRSNY

SEQ ID NO: 31284 - protein, 81 aa, Vombatus ursinus
LQDSVMFEDVAIHFSEAEWSHLSSAQRALYRNVMLENYGNLASLASPFSKPAVISKLEQASSDLQEALDQEDLKNTCADGE

SEQ ID NO: 31285 - protein, 81 aa, Cervus elaphus
ADLITDKSQEPVKFKDVVVEFSKEEWGQLDPAVKTLYRHHLLSKPVETSKLESKKESWIMEQEIPRTAVVDRERISENQEL

SEQ ID NO: 31286 - protein, 81 aa, Lynx pardinus
SQSLLTFEEVAMYFSQEEWELLDPTQEALYSDVMRENYETVISLALFVLPKPKVISYLEQGEEPWVQGSTELKDSPGELPT

SEQ ID NO: 31287 - protein, 81 aa, Tupaia chinensis
PEGLVPFEDVAVSLTWEEWERLDTAQKDFRESTHKDGGSTVMPSSETRAETQELIAKQEILEEAEPQGQLPEASQGKTSVF

SEQ ID NO: 31288 - protein, 81 aa, Delphinapterus leucas
SQGPLKDVHMARGFSYKKSVRQIPAHRDLYRDIRKESIGNMVSLGNTVSTANKMAQLEQRKEPWTIGLQSPNKRNVLQSNC

SEQ ID NO: 31289 - protein, 81 aa, Colobus angolensis
APEASALSQEENPRNQLMALMLLTAQPQELVMFEEVSVCFTSEEWACLGPIQRALYWDVMLENYGNVTSLGYRKYRSQRNK

SEQ ID NO: 31290 - protein, 81 aa, Myotis brandtii
VTFKDVALNFTKEEWTLLAPEQRALYRDVMLENIRNLASVGEVIRQETKVSASRQDILAKNTVREANRVRFTSNSPTPGGH

SEQ ID NO: 31291 - protein, 81 aa, Vombatus ursinus
GHHPETAASFLPSGCQEEWGLLDPSQKELYWDVMLEKYGSVVSLGIPAPKPDAKALMERGEELWGPGPCSAAEDKAQPKGV

SEQ ID NO: 31292 - protein, 81 aa, Cervus elaphus
GFVVFEDVAIYFSQEEWGLLDEAQRLLYCQVMLQNIALLSSVGQERFKGTWPWYLGMRKCVLNISSIKSGRTCACTLKYSL

SEQ ID NO: 31293 - protein, 81 aa, Odobenus rosmarus
QESITFKDVIVEFSEEEWGQLDPSVKTLYRDVMLENYRNLNSVHQEHLLYKPVEISKLESKERRWAVEQEIPSTSVLDREV

SEQ ID NO: 31294 - protein, 81 aa, Vicugna pacos
SEQSVSVEGVSQVSMTFKYLAMTFTWEEWGQLDMAQKTLYREVMLETCGLLVSLGYPVPKPELIHLLENKQDLCMGKRGLS

SEQ ID NO: 31295 - protein, 81 aa, Mustela putorius
QGSAAYQFLSVDYTERKWKGPALSQRAVFQSIMPENYCSVVSMAGETRMQHSECPAKQEVSKEPGSPGETSGGLCGIVSEE

SEQ ID NO: 31296 - protein, 81 aa, Carlito syrichta
PQLPESLEDVAVYISQEEWGQQDPSKRALSRDTVQESYENVDSLGSHIHSQKVPSTQVVQGGKPWDPSVQSGKEGLSPRSP

SEQ ID NO: 31297 - protein, 81 aa, Camelus ferus
TGPQLPESLEDVAMYISQEEWGHQDPSKRALSGDTVQESYENVDSLADQMMCVLRLGNSKRVYGSRNFAFRRHRAPDGARR

SEQ ID NO: 31298 - protein, 81 aa, Myotis brandtii
HQGPLTFRDVAIDFSQEEWECLDPAQRKLYLDVMSENYSNLISVAILSEDNQAILQKPKIRDLFPKIILGPLTFRDVAIDF

SEQ ID NO: 31299 - protein, 81 aa, Tupaia chinensis
PQESLMFSDVSIDFSQEEWECLNDDQRDLYRDVMLENYSNLVSMGYSISKPIVISYLEQGKEPWLVDRQLTGGQWPVLKSR

SEQ ID NO: 31300 - protein, 81 aa, Vicugna pacos
FQELLTFKDICVDFTQEEWKQLAPAHRNLYREVMLENYGHLVSVGYQLSKPSVISQLEKGEEPWMTEKEGPGDLSSDLKSK

SEQ ID NO: 31301 - protein, 81 aa, Vicugna pacos
SQSLLTFEEVAIYFSQEEWELLDPTQKALYGDVMQETYETVISLALFVVPKPKVISCLEHGEEPWIQRSPEFKDSPGELLT

SEQ ID NO: 31302 - protein, 81 aa, Vicugna pacos
AKFQELLTFKDICVDFTQEEWKQLAPAHRNLYREVMLENYGHLVSVAGYQLSKPSVISQLEKGEEPWMTEKEGPGDLSSAS

SEQ ID NO: 31303 - protein, 81 aa, Delphinapterus leucas
SQELLTFKDVSVDFTQEEWGQLAPAHQNLYREVMLENYGNLVSVVGCQLSKPSVISQLEKGEAPWMTEKEGPGDPSSDLKS

SEQ ID NO: 31304 - protein, 81 aa, Carlito syrichta
FQSLLTFEEVAMYFSQEEWELLDPTQKALYNDVMQENYETVISLALFLLPKPKVISCLEQGEEPWVQVSLEFKDSAKESPA

SEQ ID NO: 31305 - protein, 81 aa, Odobenus rosmarus
GPLTFGDIPFYFSREEWGSLDPAQRELFWDIKRENSRNVALGAGLQSQSQRSGLEEAVTALPGQAGGGGGRGDVTVSWSPE

SEQ ID NO: 31306 - protein, 81 aa, Colobus angolensis
SQEPVKDVHVARGFSYKKSVHQIPAHRDLYRDFRKENVGNMVSLGSTASTSNKITRVEQRKEPWTLGLHSSNKRSMLRSSY

SEQ ID NO: 31307 - protein, 81 aa, Tupaia chinensis
SQGLVTFKDVAVCFSQDQWSDLDPTQKEFYGEYVLEEDCGIVVSLSFPIPRLDEISRVREEEPWVPDIQELQEPQEPEILS

SEQ ID NO: 31308 - protein, 81 aa, Delphinapterus leucas
LTSVPFQPPRIQEEWGLLDRSQKEVYWDAMLQKYGTVVSLGLAPDGPPTPAGLPCPLPEARTEPEPEALSTGSEGARSLLP

SEQ ID NO: 31309 - protein, 81 aa, Erinaceus europaeus
QPQEAVTFKDVEVTFSQDEWRWLCPAQRNLYRDVMLENHRNVASLAGPSSKPALISWLEAQDPWALSVQGAQPTRKPGAAP

SEQ ID NO: 31310 - protein, 81 aa, Vicugna pacos
FQELVTFKDVVVDFSPEELTYLSAAQRHLYREVMLENYRNLVSLGHQFPKPDIISRLEEEEACAAEGDGSAMMCPDLEKKP

SEQ ID NO: 31311 - protein, 81 aa, Mustela putorius
SQELLTFKDISVDFTQEEWGQLPLAHRNLYREVMLENYGNLVSVGYQLSKPSVISQLEKGQEPWMTEKEGPEDPSSGETKT

SEQ ID NO: 31312 - protein, 81 aa, Odobenus rosmarus
IRDQDFGASFFQAAPLEEWRHLDSTQKEQYWDLMLETYGKMVSGGISSSKSDLTNSTEYGEELVGLHLPVGEKIPRPTCIG

SEQ ID NO: 31313 - protein, 81 aa, Ornithorhynchus anatinus
SAWSQTPVMLEEVAVYLSQEEWERLDPAQRDRYRDVLQDNYGLSIPKPGLITRLEQGEEPWNCDLECSQQRIVSRNDHTGF

SEQ ID NO: 31314 - protein, 81 aa, Colobus angolensis
LAGQSDTPAAQMPALFQREGCPGDQVIPPKSLTAQLQETMTFKDVEVTFSQDEWGWLDSAQRNLYRDVMLENYRNMAFLSK

SEQ ID NO: 31315 - protein, 81 aa, Ornithorhynchus anatinus
DKETAGSQLPVTFEDVAVYLSRDEWGHQDSAKENQENYESAVALGEDLSENKEENPQPVRFEEEEPQETPSGRSEVEVPWS

SEQ ID NO: 31316 - protein, 81 aa, Gulo gulo
SQGLVTFKDVAVCFSQDQWSDLDPAQKEFYGEYVLEEDCGIVVSLSFPIPRLDEISHVREEEPLVPDISEPQEPQEPEILS

SEQ ID NO: 31317 - protein, 81 aa, Cervus elaphus
HDSPAPEASALSQEENPRNQLMALMLLTAQPQELVMFEEVSVCFTSEEWACLSPVQRALYWDVMLENYGNVTSLGKDPFSP

SEQ ID NO: 31318 - protein, 81 aa, Gulo gulo
MAEGFTFKDVAIYFSQKEWESLHSAQKGLYCDVMLENYNNLISLAAAASKPDVISLLEQGKEPWMVKNQEKKEWCPDWESR

SEQ ID NO: 31319 - protein, 81 aa, Vicugna pacos
KGLVTAQDVAASLTWEEWQYLGPALRDAYREGTLKGCGSTASPGSETGTENRELIPKQETLDEVEPQEQLPGSQERLSCEW

SEQ ID NO: 31320 - protein, 81 aa, Carlito syrichta
SHETITFKDVTVNFSRGEWRKLEPFQKDLYKEVLLENFRNLEFLGFPVSKLDLVSRLKWVDLPWLLEKEVSKGSRPECEPR

SEQ ID NO: 31321 - protein, 81 aa, Ornithorhynchus anatinus
DQEVVPALFPARPQEEWGGLDANQRELCGDPEQDKLEKIIALSQESAGIPIPHPDLMAMLERGEDPWGLEPHTVQEMDIPR

SEQ ID NO: 31322 - protein, 81 aa, Odobenus rosmarus
ERQPGLVTITNMAVDFSRQLDPAQKSFCKNVIWENHGDLGSVGPCVSKPDLVSLLEQGKEPWMVERELTRGLFSGQQSINE

SEQ ID NO: 31323 - protein, 81 aa, Delphinapterus leucas
LTSVPFQPPRIQEEWGLLDRSQKEVYWDAMLQKYGTVVSLGLPCPLPEARTEPEPEALSTGSEGARSLLPGGESESSREGR

SEQ ID NO: 31324 - protein, 81 aa, Vicugna pacos
APSEQSVSVEGVSQVSMTFKYLAMTFTWEEWGQLDMAQKTLYREVMLETCGLLVSLDAPLSWILISSIIADLSPGMTFHHN

SEQ ID NO: 31325 - protein, 81 aa, Mustela putorius
ERQPGLVAIANVAVDFSQQLDPARKSICKNMRWESHGDLGSVGPCVSKPDLVSLLEQGREPWLVRTELTRGLCPGQQSIHE

SEQ ID NO: 31326 - protein, 81 aa, Carlito syrichta
IRSQDFGASLLPVAPQEQWRHLDSTQKEQYWDLMLETYGKMVSGAGISNSKPDSTNLTEYGEELTGLHFNVIEKIPRPTCV

SEQ ID NO: 31327 - protein, 81 aa, Delphinapterus leucas
DNESVTFEDVAINFTQEEWALLDTSQKTLFRNVMLENVTHLVSVGYQISKSDVISQLEQGKELWSEATGCLQSQSPDGESL

SEQ ID NO: 31328 - protein, 81 aa, Delphinapterus leucas
SQELLTFKDVSVDFTQEEWGQLAPAHQNLYREVMLENYGNLVSVGCQLSKPSVISQLEKGEAPWMTEKEGPGDPSSDLKSK

SEQ ID NO: 31329 - protein, 81 aa, Gulo gulo
SQGLLTFKDISVDFTKEEWGQLAPAHRNLYREVMLENYGNLVSVGYQLSKPGVISQLEKGEEPWLIEREISGSPSSGKSKA

SEQ ID NO: 31330 - protein, 81 aa, Gulo gulo
VKIEDVADVAVSFILEEWGHLDQSQKSLYRDDRKEKFGSITSMDYESGHDNVELAIKQVSDDAEPHWMTSGSPERNVPQSQ

SEQ ID NO: 31331 - protein, 81 aa, Gulo gulo
LLTFEDVAVSFSEEEWRLLDPAQKSLYNDVMQENYETIVSLGLKLKNDTGNDQPISLSALEIQASGCRVLRKARMKVAQKT

SEQ ID NO: 31332 - protein, 81 aa, Erinaceus europaeus
SQGSVTLKDVVVSFSRGEWRKLEPFQKELYKEVLLENFMNLDFLGFPVSKSDLLSQLRWVELPWLLGKDVSRPDVLMKEST

SEQ ID NO: 31333 - protein, 81 aa, Delphinapterus leucas
LTSVPFQPPRIQEEWGLLDRSQKEVYWDAMLQKYGTVVSLAGLPCPLPEARTEPEPEALSTGSEGARSLLPGGESESSREG

SEQ ID NO: 31334 - protein, 81 aa, Colobus angolensis
ATFEDMAVSLTWEEWERLDPARRDFRRESAQKDSGSTVPPSLESRAENKELIAMQEILEAEPQGRLQETIQGKRPLLSKCG

SEQ ID NO: 31335 - protein, 81 aa, Erinaceus europaeus
FQELVTFEDVCVDFTSEELSCLSTSQRTLYREVMLENYRNLVSLGHQFSKPELISRLEEEEFQAMAADSSAVAGDSGAVAG

SEQ ID NO: 31336 - protein, 81 aa, Erinaceus europaeus
KIEDVADVAVSFILEEWGHVDQSQKPLHKDDKEDNYASITSMGYESRNDNMELIVKQMSDESESHWMTSGSPERNVSQNPE

SEQ ID NO: 31337 - protein, 81 aa, Ornithorhynchus anatinus
AQAAVLFADVAVPLSREEWRSLDADQRAFYREVTLDNYENVVSLGLAFPKPEVISWLEQGRELGASEDGEAPRIPCLETEE

SEQ ID NO: 31338 - protein, 81 aa, Mustela putorius
SQELVTFQDVVVDFSPEELTYLSAAQRNLYREVMLENYRNLVSLGYQFSKPDIISQLEEEESRVREEDINTELCQDGEERP

SEQ ID NO: 31339 - protein, 81 aa, Odobenus rosmarus
QAMVKIEDMAVSLILEEWGCQNLARRNLNRDNRQENYGNVFSQGCENRNENEESTSKAEIAEDSVSRGETTGRFQKDFGEK

SEQ ID NO: 31340 - protein, 81 aa, Carlito syrichta
TVEGLKFKDVVIYFSQKEWECLLSTQKDLYRDVMLENYNNLISLGLSDTKPNVISLLEQEKAPWMVKRKDTKELCPEWETG

SEQ ID NO: 31341 - protein, 81 aa, Erinaceus europaeus
PQLPESLEDVAMYISQEEWGHQDPSKRALSRDLVQESYENVDTVVSQLPSQETLSTHMEQGGKPWGPSVQPCKEGPSPRTS

SEQ ID NO: 31342 - protein, 81 aa, Ornithorhynchus anatinus
SQEPVPCEDTTGSPTRAELRHLAPAQKALCRVIVQENHGNVIPMGFPIPNPNVISVLERRENTRIPKLQGSEEKRVSRGSP

SEQ ID NO: 31343 - protein, 81 aa, Tupaia chinensis
SRALVTFRDVAVTFTKEEWRQLDLAQRTLYQEVMLETCGLLVSLGHWVPKPELIHLLEHGQELWMVKGGLSHGTCAGERAQ

SEQ ID NO: 31344 - protein, 81 aa, Carlito syrichta
LEHQEPVSASFHPPRIQEWGLLDPSQKELYWDAMLEKYGTVVSLGLQPPQPEAQTQLEPGTLPVGTDVSRSVCPGECPVPR

SEQ ID NO: 31345 - protein, 81 aa, Ornithorhynchus anatinus
RSTRDREAASSLLPVGAQEQWEQPDPAPGALFGDVVWEDAGTAAALVPKPDPVVAMGRGDEPWGPDLHEPEERGGLRGTGT

SEQ ID NO: 31346 - protein, 81 aa, Vicugna pacos
SQNLLTFEEVAMYFSQEEWELLDPTQKALYNDVMQENYETVISLALFVLPKPKVISCLEQGEEPWIQRSLEVRESSELPPG

SEQ ID NO: 31347 - protein, 81 aa, Odobenus rosmarus
PGHREPASMSFHPPRIQEEWGLLDPSQKELYWDAMLEKYGTVVSLAGIPAPPPEARAESGPGAVRTGTEGRRNLHPGEESE

SEQ ID NO: 31348 - protein, 81 aa, Ornithorhynchus anatinus
RKVPVTFEDVAVYFSREEWAALDGRQQELYRDVMRGNYELVASLGTLDPKPDVLYRIEHGEEPWVGVSGHAALRDVLARSF

SEQ ID NO: 31349 - protein, 81 aa, Ornithorhynchus anatinus
CQKSLPLKDPAFSFSKEDWEHRDPAQGTRNRDIKKENCGVRVSVGEFPVPKSNVISVRERGEDTWIPDLRGFQGQELLNCS

SEQ ID NO: 31350 - protein, 81 aa, Carlito syrichta
SQEPVKDIHMTRDFSYKKHVQQIPAHRDPYQDIRKKSVGNMVSLGSTVSTSNKIARLEQRKEPWSLGRHSSSKRNILQSDY

SEQ ID NO: 31351 - protein, 81 aa, Cervus elaphus
ESDAEQGPGEGWFLVEQWRHLDSTQKEQYWDLMLETYGKMVSGGAGISNARPDLTDPAGYGAELAGPHLQASEKVPRPTCV

SEQ ID NO: 31352 - protein, 81 aa, Propithecus coquereli
GPVALGDIPFYFSREEWGTLDPAQRDLFWDIKRENSRNTALGLGLKSHSEGSQLEEVVTAPPGQAGGVTVSWSREEAEAWE

SEQ ID NO: 31353 - protein, 81 aa, Propithecus coquereli
LVTKESMTFKDVAVDITKEDWELMRPVQKELYKTVTLQNYWNMVSLGLTVYRPTVIPILEEPWMVIKEILEGPSPEWETEA

SEQ ID NO: 31354 - protein, 81 aa, Saimiri boliviensis
EELPVVFEDVAVYFTREEWGMLDKRQKELYRDVMRMNYELLASLGPAAAKPDLISKLERRAAPWIKDPNGPTWGKGRPPGN

SEQ ID NO: 31355 - protein, 81 aa, Mustela putorius
VTFGDIPFYFSREEWGSLDPAQRELFWDIKRENSRNVALALVPEPSGTEEAAPSRLAGLGLRSHREQPGLEESVMAPGGQA

SEQ ID NO: 31356 - protein, 81 aa, Mustela putorius
MAEGFTFKDVAIYFSQKEWECLHSAQKGLYCDVMLENYNNLISLGLSDSKPDVISLLEQGKEPWVVKNQDKKEWCPDWESR

SEQ ID NO: 31357 - protein, 81 aa, Mustela putorius
VRDQDFGASFLQAAPPEQWRHLDSSQKEQYWDLMLETYGKMVSGGVSNSKSDLTISTEYGEELAGLHLHVSEKIPRTPCTG

SEQ ID NO: 31358 - protein, 81 aa, Carlito syrichta
SQERLTFKDISIDFTQEEWGQLAPAHQNLYREVMLENYRNLVSVGYQLSKPCVISQLEKGEEPWMTKKEGPDPSSDLKSKR

SEQ ID NO: 31359 - protein, 81 aa, Mustela putorius
FQELVTFRDVAIDFSRQEWEYLDPIQRDLYRDVMLENYRNLVSLGHSVSKPDVVDLLEQGKEPCMILREETQRQYTDLDLH

SEQ ID NO: 31360 - protein, 81 aa, Cervus elaphus
LQGLVTVQDVAVSLTWEEWERLGPAQKHFFRESAPKDHGNSVSPNQGVTHISDLRNSPSEEDVKNNEFRTSTESSDFVPET

SEQ ID NO: 31361 - protein, 81 aa, Cervus elaphus
SQGPVKDVHMARGFSYKKSVHQIPAHKDLYRDIRKESVGNMVSLGSTVPAANKIAQLEPRKEPWTIGLQSSNKRTVLQNNY

SEQ ID NO: 31362 - protein, 81 aa, Mustela putorius
PQLPESLEDVAMYISQEEWGHQDPSKRALSRDTVQESYENVDSLESQVPNQEALSTQVEQGGKPWDPSVQTCKEGPSPSSP

SEQ ID NO: 31363 - protein, 81 aa, Tupaia chinensis
QGTLTFKDVEVTFSQDEWGWLGLAERNLYRDVMLENFRNVDSVGGGRRHTQDKPFACRVCGKAFRWNSNCVRHEKTHTGAT

SEQ ID NO: 31364 - protein, 81 aa, Carlito syrichta
VKIEDMAVSLILEEWGCQNLARRNLSRDNRQENYGNVFSQGENKNDNEESTSKAEIVEDSASHGKTAGRFQKEFGEKREQQ

SEQ ID NO: 31365 - protein, 81 aa, Gulo gulo
ERQPGLVAITNVAVDFSQQLDPARKSVCKNVRWESHGDLGSVGPCVPKPDLVSPPEQGRAPWMVRTELTRGLGPGQQSIRE

SEQ ID NO: 31366 - protein, 81 aa, Mustela putorius
LVMFEEVSVCFTSEEWECLGPIQRALYWDVMLENYGNVTSLEWETMTENEEVTPKPSISQRADSQKGTSKRLQGGVPQNLD

SEQ ID NO: 31367 - protein, 81 aa, Vicugna pacos
QAMVKIEDMAVSLILEEWGCQNLARRNPSRDNRQENYGNVIPQGCENRNENEESTSKAEIADDPASQGETAGKFQKDFGEK

SEQ ID NO: 31368 - protein, 81 aa, Vicugna pacos
SQGPVKDVRVARGFSYKKSVHQIPAPRDLYQDVRKESVGNTVSLGSTVSTSNKIARLEQRKEPWTIGVHSSNKRTVLQSNY

SEQ ID NO: 31369 - protein, 81 aa, Carlito syrichta
AEQTLAPSEQKSSKGWKMVSMNILPESQSLLTIEDVAVYFSGEEWLLLVPAQKTLYEEVMQENYENAISVGKESYFPLCRS

SEQ ID NO: 31370 - protein, 81 aa, Carlito syrichta
DTAAYEDLSVDYTQKKWKGPALSQKALYRNMMPENYHSMVSLADANMMEHSVLTLKQKMSKGSLSSDRTSGGLFGVAPGKP

SEQ ID NO: 31371 - protein, 81 aa, Ursus arctos
SQSLLTFEEVAMYFSQEEWELLDPTQEALYNDVMRENYETVISLALFVLPKPKVISYLDHEEEPWVQGPLEFKNSPGDLPA

SEQ ID NO: 31372 - protein, 81 aa, Muntiacus reevesi
QTQLTFEDVALSFSKEEWQIMDPNQKTLYIDVMREIYETHKGKNHRPNVPKSSWTFLESLFEVNVHIGRGENSLIGAFIRA

SEQ ID NO: 31373 - protein, 81 aa, Muntiacus reevesi
QGLVAVQDVAVSLTWEEWERLGPAQKHFFRESAPKGHGNSVSPSSETRIENKELIPKQEILEVELQGQLQGFQEKAPLSSE

SEQ ID NO: 31374 - protein, 81 aa, Ursus americanus
CFQEAVTFKDVEMTFSQDEWGWLDPAQRNLYRDVMLENYRNVVSLVGPFTKPVLISWLEAREPWGLNAQGAQPKGNLGVAP

SEQ ID NO: 31375 - protein, 81 aa, Myotis brandtii
PVTLNDVAVVFTEEELALLDPSQRKLYRDVMLENFRNLVSVGSKNQNEVEILQKVALKYLSHEKLFWQIWRQIASDSARCP

SEQ ID NO: 31376 - protein, 81 aa, Propithecus coquereli
QEPVTFKDVVVEFSEEEWGQLDPAVKNLYRDVMLENYRNLNSLHKVNLLTKPVEIPELESKKKRWIMEEEIPRRTVLGKKV

SEQ ID NO: 31377 - protein, 81 aa, Oryctolagus cuniculus
KTVAESQEPITFKDVAVSFSRGEWKKLEPFQRELYKEVLLENLRDLEFLGSPVSKIELVSQLKWVELPRQLEKEISKGSRP

SEQ ID NO: 31378 - protein, 81 aa, Oryctolagus cuniculus
PSRASPFKDMILCFSEEDWSLLDPGQTGFYGEFIIGEDCGVSVTPNDPAALPGPFQGEEIELLPEVLELQGKEAPQASPTD

SEQ ID NO: 31379 - protein, 81 aa, Rhinolophus ferrumequinum
QEPVTFKDVVLEFSKEEWGQLDPAVKNLYRNVMLENYKNLNSLHKEHLFSKPVEVPKLESKKKGWLMEQEIPKTTIFDRQR

SEQ ID NO: 31380 - protein, 81 aa, Camelus ferus
AGFQTLEKIEDMAVSLIREEWLLDPSQKDLSRDNRPENYRNMFSLVVLLPQECSGLKIPPDSWDVKTSESYPEPLQTKMST

SEQ ID NO: 31381 - protein, 81 aa, Myotis brandtii
SQTLLTFEEVAVFFSQEEWELLDPGQKALYNDVMQENYETVISLAIFVLPKPKVISCLEQGKEPWVQGSTEIMDSPGELPI

SEQ ID NO: 31382 - protein, 81 aa, Myotis brandtii
YQDDMNFEDVAIAFSQEEWGLLDEDQRHLYCDVMLEVFALVSSVGCWHKTEEEEECSDGSVSVQVESKFMASKTVPPTQKT

SEQ ID NO: 31383 - protein, 81 aa, Balaenoptera acutorostrata
FVTKESMTFTDVAVDITREDWERMRPVQKELYKTVTLQNYWNMVSLGLTVYRPTVIPILEEPWMVIKEILEGPSPGWETEA

SEQ ID NO: 31384 - protein, 81 aa, Propithecus coquereli
PQLPESLEDVAMYISQEEWGHQDPSKRALSRDTVQESYENVDSLESHIPSQGAPATRVEHGGKPWDPSGQTCREGLSPGSP

SEQ ID NO: 31385 - protein, 81 aa, Ursus maritimus
SQESMTFKDVIVSFSRGEWRRLEPFQKELYKEVLLENFRNLEFLGFPVSKLDLISQFKWVELPWLLEKEIAKGSRPDVLLE

SEQ ID NO: 31386 - protein, 81 aa, Saimiri boliviensis
QEPVTFKDVVVEFSKEEWGQLDSAVKNLYRDVMLENFRNLNSLHKAHLLSKPVESLELKNKKKRWITEKEISKKTISDMQS

SEQ ID NO: 31387 - protein, 81 aa, Vombatus ursinus
QTSVKTEEEVKFLVSEEWQHFDPAQKNTYGNVALKNFRNLDLLTGEIIIKDGMLLPKQEISKEIESQEEVCHALRRDCSPQ

SEQ ID NO: 31388 - protein, 81 aa, Panthera pardus
QEPISFKDVIVEFSKEEWGQLDPAVKNLYRDVMLENYRNLNSLHQEHVFSKPVELSELENKDRRWIIEQEIPSTSFFDREV

SEQ ID NO: 31389 - protein, 81 aa, Myotis brandtii
VAFEDVAVNFTLEEWALLDSSQKKLYRDVMRETFRNLASIVIFSVLTNMKGITMEKKPINVRNVGRPLVLQLHFKYMKDPI

SEQ ID NO: 31390 - protein, 81 aa, Vombatus ursinus
ARADLTFADVTVSFSWEEWGHLAPGQKELYRDVLWESYGHLGALGIPVPKPDLIALIDGEEEAKDGQLCLAGEENVPGGAQ

SEQ ID NO: 31391 - protein, 81 aa, Myotis brandtii
EPVTFLDVAVDFNRDEWELLDPTQRTEYHDVMLETFRHLVSVGWETTVEGEQLPPKSAVPAAEPAPDLKVEELSGAEAQPS

SEQ ID NO: 31392 - protein, 81 aa, Propithecus coquereli
LPGQSDPPAAQVPAFSQREGCPGDQVMVTKSLTAQPQEAMTFKDVEVTFSQDEWGSLDSAQRNLYRDVMLENYRNMVSLGK

SEQ ID NO: 31393 - protein, 81 aa, Vombatus ursinus
TGDEEKPSVLLLTSSQDGWGQMNSSQTDTYEDTKQEKCWNLMSLGVPVPKPDVIPELDGGKEPRILTVQGTEEPLGPRGSC

SEQ ID NO: 31394 - protein, 81 aa, Rhinopithecus bieti
ATFEDMAVSLTWEEWERLDPARRDFRREGAQKDSGSTVLPSLESRAENKELIPMQEILEAEPQGRLQEVFQGKRPLLSKCG

SEQ ID NO: 31395 - protein, 81 aa, Lynx pardinus
PQELVTFQDVAVDFSLEELTYLSAAQRNLYREVMLENYRNLVSLGYQFSKPDIISQLEEEESHVMEADSDTEMHHDGEKRP

SEQ ID NO: 31396 - protein, 81 aa, Oryctolagus cuniculus
PQEPVKGVHVTRGFPYKKSLHQIPAHRDLCRDIRRESGRNVVSLGSSVSTSNKTARLEQRKEPWTVGLPSSNKRNILRSNY

SEQ ID NO: 31397 - protein, 81 aa, Camelus ferus
GLVTFKDVAVCISQDQWSDLDPAQKEFYGEYVLEEDCGIVVSLCKEFQVFLECPEHRDLLLLLEIKGALDLRVRYLAHRKT

SEQ ID NO: 31398 - protein, 81 aa, Saimiri boliviensis
GHQEPASTSFHPPRIQEEWGLLDRSQKELYWDAMLEKYGTVVSLGLPPHQPEAQAQSELGMLLTGAGVCRNMGSGDENEGL

SEQ ID NO: 31399 - protein, 81 aa, Balaenoptera acutorostrata
FAELVTFKDVAVDFSPEELTYLSAAQRKLYREVMLENYRNLVSLGYQFPKPDIISGLEAEESRAVEEDSSTMICQGEESSP

SEQ ID NO: 31400 - protein, 81 aa, Rhinolophus ferrumequinum
SQSLLTFEEVAVYFSQEEWELLDHSQKALYNDVMQKNYETVISLAIFVLPKPKVISCLEQGEEPWVQGSLNFKDSPQELPA

SEQ ID NO: 31401 - protein, 81 aa, Propithecus coquereli
PPNRASPFKDMILCFSEEDWSLLDPAQTGFYGEFIIEEDCRVSVPPNDPAAQPDLSQGEENEPQVSELQDLQGKEAPQVSY

SEQ ID NO: 31402 - protein, 81 aa, Ursus arctos
PVTFGDIPFYFSREEWGSLDPAQRELFWDIKRENSRNVALALVPEPSGTEEAAPSRLAGLGFKSQSEQSGLEEAVTLPGQA

SEQ ID NO: 31403 - protein, 81 aa, Myotis brandtii
DMDFEDVAIAFSQEEWGLLDEAQRLLYCDVMLEVFALVSFVVIRPQSVCFEEVNDEGNTFGKVSTRIFNLNRQKRVHTRKK

SEQ ID NO: 31404 - protein, 81 aa, Propithecus coquereli
VMFEEVSVCFTSEEWACLGPIQRALYWDVMLENYGNVTSLEWETMTENEEVTSKPSISQRADSQKGTSKRLQGGVPRFLDF

SEQ ID NO: 31405 - protein, 81 aa, Propithecus coquereli
ETQPGFMHVTNMAVDLSQQLDPAQKSLCKNVLWENHGDPGSVGPCVPKPDLVSLLERATEPWMVKRALTGGLFAGQQSVCE

SEQ ID NO: 31406 - protein, 81 aa, Rhinopithecus bieti
DTQPGLVAIKNLAVDFPQHLHPAQKNFCKNGIWENHSDLGSAGHCVAKPDLVSLLQQEKEPWMVKRELTGSLLSGECRRSR

SEQ ID NO: 31407 - protein, 81 aa, Balaenoptera acutorostrata
QGLVTVPDVAVSLTWEEWERLDPAQRDLYRESAPKDYGNAVSPSLETRIENKELILKQEIQEEVEPQGQLQGSQEKGPRSS

SEQ ID NO: 31408 - protein, 81 aa, Vombatus ursinus
LVKIEDMAVSLIQEEWGLLDPAQKDLCSDGRPDNYGHVYSLGGETRSENRDLTQKQVISAEMEPNGERTAKRNGNVPESID

SEQ ID NO: 31409 - protein, 81 aa, Macaca nemestrina
VCPNTESRESITLKDVAVNFSRGEWKKLEPFQKELYKEVLLENFRNLEFLDFPVSKLELISQLKWVELPWLLEEVSKGSRP

SEQ ID NO: 31410 - protein, 81 aa, Myotis brandtii
FQERLTFKDITVNFTQEEWGQLTPAHRNLYREVMLENYGNLVSVGYEFSKPRVISQLEKGEEPWITEKEGSGHPSADLKSK

SEQ ID NO: 31411 - protein, 81 aa, Myotis brandtii
KDMNFEDVSIAFSQEEWGLLDEAQRLLYCDVMLEVFAVVSSVGCWHKTDNVEACSEQNISVQGESQLSLFYSQTMGSENFP

SEQ ID NO: 31412 - protein, 81 aa, Vombatus ursinus
SQLPVTFEDVAVYLSQEEWEHQEPSKKALSREAMQENYENVVTLESQIPNQDPATQVEQEEKSWDPNLQSTKEQGSFRVEE

SEQ ID NO: 31413 - protein, 81 aa, Vombatus ursinus
QALVKIEDMAVSLILEEWGCQNLARRNLCRDNRQENYGNMFSQGCGSRTTNEESTSKEEISEATGSHGEISGKFQKEFGET

SEQ ID NO: 31414 - protein, 81 aa, Propithecus coquereli
VMAGLKFKDVVIYFSQKEWECLFSTQKDLYRDVMLENYNNLISLGLSDTKPSVISLLEQGKEPWLGKRKETKEWCPDWESG

SEQ ID NO: 31415 - protein, 81 aa, Balaenoptera acutorostrata
QEPVTFKDVVVEFSEEEWGQLDPAVKNLYRDVMLENYRNLNSLPKEHLLSKPVETSRLESKEKSWIMEQEILRTTVFDREI

SEQ ID NO: 31416 - protein, 81 aa, Saimiri boliviensis
PQLPESLEDVAMYISQEEWGHQDPSKRALSRDTVQESYENVDSLESHIPSQEVPSTQVKQGGKLWDPSVQSCKEGLNPRGP

SEQ ID NO: 31417 - protein, 81 aa, Cervus elaphus
PQLPESLEDVAMYISQEEWGRQHPSKRALSRDTVQESYENVDSLESQVPSQEALSIQVEHGGRPWHPSVQTCKEGLSSRTP

SEQ ID NO: 31418 - protein, 81 aa, Rhinolophus ferrumequinum
LLTFEDVAVSFSEEEWKLMNNTQKILYNDVMQENYETVISLGLKLKNDTGNEQPISTSTLEIQASGCKVLRKARMKVAQKT

SEQ ID NO: 31419 - protein, 81 aa, Muntiacus reevesi
EPTSAPFQPPRLQEWGLLEPSQKELYWDAMLEKYGSVVSLGLPHPLPESREKSQPEALSTGSRSEGRRNLRPGDESEGRPG

SEQ ID NO: 31420 - protein, 81 aa, Muntiacus reevesi
SQGLVTFKDVAVCFSQDQWSGLDPTQKEFYGEYVLEEDCGIVVSLSFPIPRLDEISLVREEEPLVPDAPEPQEPEEPEILS

SEQ ID NO: 31421 - protein, 81 aa, Muntiacus reevesi
EALPVVFEDVAVYFTREEWGALDKRQKEMYRDVMRMNYELLASLGPAAAKPDLISKLERRAAPWIKDPHGLKWGKGRPPGK

SEQ ID NO: 31422 - protein, 81 aa, Ursus americanus
PVTFKDVIVEFNEEEWGQLDPAVKTLYRDVMLENYRNLNSLHQGGFRVIYLFFPKQRISGKESSSGVIMTRLTKSGSPSLD

SEQ ID NO: 31423 - protein, 81 aa, Myotis brandtii
PQGTVSFKDVTVDFTQEEWQQLDTDQKALYRDVMLENYYHLISVEEDGKAEDVLMKFKQYQDRHFRSVVFINHERLIKEKN

SEQ ID NO: 31424 - protein, 81 aa, Pteropus alecto
PVTFLDVAVDFSTEEWGLLDTTQRTEYHDVMLETFGHLVSVGWETTVESKPVTPPSAAPEEGSTRDPKMEEPSGALARPST

SEQ ID NO: 31425 - protein, 81 aa, Ursus americanus
EVGPVKDVHMARGFSYKKSVHQIPAHRDLYRDFRKESVGNMVSLGSTVSVSNKISRLEQRKEPWTLGLHSSNKRNIILRSN

SEQ ID NO: 31426 - protein, 81 aa, Camelus ferus
VTARDVAASLTWEEWQHLGPALRDAYREGTLQDCGNTASPGSETGTENRELIPKQETLDEVEPQGQLPGSQEHLSCEWGEA

SEQ ID NO: 31427 - protein, 81 aa, Propithecus coquereli
QPQEAMTFKDVEVTFSQDEWGSLDSAQRNLYRDVMLENYRNMVSLVGPFTKPALISWLEAREPWGLNVQAAQPKGNPGAAP

SEQ ID NO: 31428 - protein, 81 aa, Propithecus coquereli
VKIEDVADVAVSFILEEWGHLDQSQKSLYRDDRKENYGSITSMDYESRDNNMELIVKQISDDTESHWMTSGSTERNVPQSQ

SEQ ID NO: 31429 - protein, 81 aa, Propithecus coquereli
VPEASALSQEENPRNQLMALMLLTAQPQELVMFEEVSVCFTSEEWACLGPIQRALYWDVMLENYGNVTSLVYRKYRRQKNK

SEQ ID NO: 31430 - protein, 81 aa, Balaenoptera acutorostrata
SQGPVKDVHMARAFSYKKSVRQIPAHRDLYRDIRKESIGNMVSLGNTVSTANKMAQLEQRKEPWTIGLQSPNKRNVLRSNY

SEQ ID NO: 31431 - protein, 81 aa, Panthera pardus
QPQEAVTFKDVEVIFSQDEWRWLDPAQRNLYRDVMLENYGNMVSLVGPFTKPVLISWLEAREPWGLNVQGAQPKGNPGVAP

SEQ ID NO: 31432 - protein, 81 aa, Panthera pardus
PVTFGDVPFYFSREEWGSLDPAQRDLFWDIKRENSRNVALALVPEPSGTEEAAPSRLAGLGSESQSEQSRLEEAATALQGQ

SEQ ID NO: 31433 - protein, 81 aa, Propithecus coquereli
SQGLVTFKDVAICFSEDQWSDLDPTQKEFYGEYVLEEDCGIVVSLSFPIPRPDEISQVREEEPWVPDIQEPQETQEPEILS

SEQ ID NO: 31434 - protein, 81 aa, Lynx pardinus
SLLTFEEVAMYFSQEEWELLDPTQKALYNDVMRENYETVISLAVPAHQILAFPEQTIPKDWTVAPELVLPESQSLLTFEEV

SEQ ID NO: 31435 - protein, 81 aa, Ursus americanus
GRQPGLVTITNMAVDFSQQLDPAQKSFCKNVVWENRGDLGSVGPCVSKPDLVSLLEHGKEPWMVEREVTRGLFSGQRSIHE

SEQ ID NO: 31436 - protein, 81 aa, Propithecus coquereli
PSESITFKDVTVNFTRGEWKRLDPAQKDLYKEVVLENFRNLEFLGIPVSNLDLLSQLKWIDLPWLLEKIISKSSRLEESTL

SEQ ID NO: 31437 - protein, 81 aa, Propithecus coquereli
QTDLVTFDSVAVEFTQEEWALLDPTQRKLYGDVMLENYNNLSSVGYQLFKPSLISWLEEEFRTVQGEWKMCLKTNESALRQ

SEQ ID NO: 31438 - protein, 81 aa, Colobus angolensis
SQELLTFKDVSVDFTQEEWGQLAPAHRNLYREVMLENYGNLVSVGCQLSKPGVISQLEKGEEPWLMEREISGVPSSDLESK

SEQ ID NO: 31439 - protein, 81 aa, Balaenoptera acutorostrata
SQSLLTFEEVAMYFSQEEWELLDPTQKALYNDVMQENYETVISLALFVLPKPKVISCLEQGEEPWVQRSLGFKDNSGELPT

SEQ ID NO: 31440 - protein, 81 aa, Lynx pardinus
DESLLTFEDVAVSFSEEEWKLLDPAQKILYNDVMQENYETVISLEIQASGRKVLRKARMKVAQKTTGKENHGATCRLRKRH

SEQ ID NO: 31441 - protein, 81 aa, Vombatus ursinus
MTFEDMAMSLALEKWGQLDPVQKSLCRDKGQDNYGNMVSLDGVTTMESGESAQNQDIKTDMESKGELPNRLNGHIPQGLEL

SEQ ID NO: 31442 - protein, 81 aa, Colobus angolensis
DTVAYEDLCVDYTQKKWKGPALSQRALQWNMMLENDHSMASLAGESMMKGSELTPKQEIFKGSESSNRTSGGLFGVVPGGA

SEQ ID NO: 31443 - protein, 81 aa, Panthera pardus
ERPPGLVTITNMAVDFSQQLDPAQKSFCKNVMWENRSDLGSVGSCVSKANLVSLLQQEKEPWMVDRELPKGLGSGQQSIHE

SEQ ID NO: 31444 - protein, 81 aa, Myotis brandtii
VGVTFEDIALYFSKEEWSLLDEGQRQLYLNVMLENFELISSLVNVENLLPRAVPFIFIREFTQEKSLINAVNVENLLPRAV

SEQ ID NO: 31445 - protein, 81 aa, Propithecus coquereli
SQKPLKDVHMMRGFSYKKSVHQIPAHRDLYRGVRKESVGNMVSLGSTVSTSNKIAQLEERKEPWTLGLYSSSKRNIKEKSI

SEQ ID NO: 31446 - protein, 81 aa, Saimiri boliviensis
VKIEEVADVAVSFILEEWGHLDQSQKSLYRDDRKENYGSISSMDYESRDNMELMVKQVSDDTESHWVAPEHMERSVPQGPD

SEQ ID NO: 31447 - protein, 81 aa, Propithecus coquereli
EELPAVFEDVAVYFTREEWGMLDKRQKELYRDVMRLNYELLASLGPAAAKPDLISKLERRAAPWIKDPNGPKWGKGGPPGK

SEQ ID NO: 31448 - protein, 81 aa, Vombatus ursinus
TRDKNEAASVPASGSQEQWQCLNHTQKELYWDAMLEDYGKVVSLAIPISKPNPTNLVDGKEEPDGSHSHADEGIPRNICIG

SEQ ID NO: 31449 - protein, 81 aa, Colobus angolensis
GHQEAASTSFHPPRIQEEWGLLDRSQKELYWDTMLEKYGTVVSLGLPPHQPEAQAQSEPGMMLMGTGVCRSLRSENESEGP

SEQ ID NO: 31450 - protein, 81 aa, Camelus ferus
GSGIVPELWGTECGGLMLFQAMVKIEDMAVSLILEEWGCQNLARRNPSRDNRQENYGNVISQGKTDAGLLSDEIVLPFCFG

SEQ ID NO: 31451 - protein, 81 aa, Propithecus coquereli
SQEPVTFADVAVVFTPEEWVFLDSAQRSLYRDVMLENYRNLASVAGDRLCRPCTLSHLEQREELWTKDKGDVSGTCPEPQL

SEQ ID NO: 31452 - protein, 81 aa, Vombatus ursinus
VKIEDVADVAVSFILEEWGHLDQTQKDLSRNDRQENYETVTSVDYEPRNENMELIVKQEISEEAESLWMTPGSIQKNDSQD

SEQ ID NO: 31453 - protein, 81 aa, Colobus angolensis
QEPVTFKDVVVEFSKEEWGQLDSAVKNLYRNVMLENFRNLNSLRKAYLLSKPVESLKLESKKKRWIMEKEIPRKTIFDMQS

SEQ ID NO: 31454 - protein, 81 aa, Lynx pardinus
GPVTFGDVPFYFSREEWGSLDPAQRDLFWDIKRENSRNVALGWGPESQSEQSRLEEAATALQGQAGGGGGRGGDVTVSWSP

SEQ ID NO: 31455 - protein, 81 aa, Saimiri boliviensis
GPVAPGDIPFYFSQEEWGTLDPAQRDLFWDIKRENSRNTTLGLGLKGQSERSRLEEVVPALPGQAALGGARRGRPPTRRRQ

SEQ ID NO: 31456 - protein, 81 aa, Saimiri boliviensis
SQELLTFKDISIDLTQEEWGQLTPANQNLYREVMLENYSNLVSVGYQLSKPIVISQLEKGEEPWMTEKEGPGDTSSDLKSN

SEQ ID NO: 31457 - protein, 81 aa, Vombatus ursinus
GQKELVTFEDVSVDFAKKEWKSSAPAQRAFFRDLMLENYRDVVSLAGFPFSKPTGISRREEEPWGLSRQGPLDLEGGKSTC

SEQ ID NO: 31458 - protein, 81 aa, Colobus angolensis
QLQETMTFKDVEVTFSQDEWGWLDSAQRNLYRDVMLENYRNMAFLMGPFTKPALISWLEAREPWGLNLQAAQPKGNASVAP

SEQ ID NO: 31459 - protein, 81 aa, Eschrichtius robustus
EEPVTFLDVAVDFSREEWGLLDPTQRTEYHDVMLETFGHLVSVGWETTLESKQLTPNPNTPEEEPACHLKVEEFSRDGAQP

SEQ ID NO: 31460 - protein, 81 aa, Vombatus ursinus
LMEALTFQDVAVDFTWEEWGQLDPAQQNLYRDVMLDNYQNLIFLGFPVSKPDVISQLEQGEVPWALEREVAKSSLKDHECN

SEQ ID NO: 31461 - protein, 81 aa, Cervus elaphus
QVPVTLGGVAVYLSQEEWGCLDLAQQDHSCDVLLEDAGAVGRRRQMPRCVSEGKEKARGTQLEQPQGQGRSLVEPVQGVEG

SEQ ID NO: 31462 - protein, 81 aa, Cervus elaphus
LPALQVSSLPLKDSQELTASLLSTGSQKLVKIEDVADVAVSFILEEWGHLDQSQKSLYRDDRKENYGSMTSLGKNDFACVV

SEQ ID NO: 31463 - protein, 81 aa, Vombatus ursinus
SQELVTFGDVAVYFSQEAQGQLDPTPPPDLFQDQTQENYENGVSQRFPIPRPNMISQLEQEEKLQNPDLQGSKENGNSKDS

SEQ ID NO: 31464 - protein, 81 aa, Colobus angolensis
VKIEEVADVAVSFILEEWGHLDQSQKSLYRDDRKENYGSITSMGYESRDNMELIVKQISDDAESHWVAPEPTERSVPQDPD

SEQ ID NO: 31465 - protein, 81 aa, Mustela putorius
LLTFEDVAVSFSEEEWRLLDPTQKSLYNDVMQENYETVVSLGLKLKNDTGNDQPISLSALEIQASECRVLRKARMKVAQKT

SEQ ID NO: 31466 - protein, 81 aa, Nomascus leucogenys
PPNRVSPFKDMILCFSEEDWSLLDPAQTGFYGEFIIGEDYGVSVPPNDLAAQPDLSQGGENEPRVPELQDLQGKEVPQVSY

SEQ ID NO: 31467 - protein, 81 aa, Canis lupus
MAEGFKFKDVAIYFSQKEWECLHSAQKSLYRDVMLENYNNLISLGLFDSKPDVISLLEQEKEPWMVKSKEPKEWCPDWESR

SEQ ID NO: 31468 - protein, 81 aa, Ailuropoda melanoleuca
MMKAQESLTLEDVAVYFSWEEWQLLAPAQKELYRDVMLENYRNLVSVETGYQASQPDALSELEQGEPPWILEDEVQSQTHP

SEQ ID NO: 31469 - protein, 81 aa, Rhinolophus ferrumequinum
QAMVKIEDMAVSLILEEWGCQNLARRNLSRDSRPENYGNVFSQGCESRNENEESTSKAEIAEDTASHGETRGRVQKDFGEK

SEQ ID NO: 31470 - protein, 81 aa, Ursus maritimus
SQSLLTFEDVAMYFSQEEWELLDPTQEALYNDVMWENYETVISLALFVLPKPKVISYLDHEEEPWVQGPLEFKNSPGDLPA

SEQ ID NO: 31471 - protein, 81 aa, Ailuropoda melanoleuca
SQELVTFKDVVVDFSPEELTYLSAAQKNLYREVMLENYRNLVSLGYQFSKPDIISQLEEEESRVREEDSNAEICQDLYQVN

SEQ ID NO: 31472 - protein, 81 aa, Puma concolor
GHREPAATSFHPPRIQEEWGLLDRSQKELYWDAMLEKYGTVVSLGLPAPLPEARVESEPGVLRLGTEGQRSLHPGDHCEGP

SEQ ID NO: 31473 - protein, 81 aa, Ailuropoda melanoleuca
LKHQVEARPEELSLQEGSGCFSQQPPAQQSHRPKRGPQLWPKREQWHGIEWLAFQQVPVTLEDMAAYLSQEEWECLDPAQR

SEQ ID NO: 31474 - protein, 81 aa, Ailuropoda melanoleuca
MIQVQEFLTFDDVAVDFTWEEWQLLAPAQKDLYRDMMLENYRNLVSVGTGYQASKPDALSKLERGEELWMIEDEIHSQICP

SEQ ID NO: 31475 - protein, 81 aa, Oryctolagus cuniculus
VMFEEVSVCFTAEEWACLSPIQRALYWDVMLENYGTVTSLEWESMVEDGEVTSKPSVSQRADSQKGTSKRLHADAPQALEP

SEQ ID NO: 31476 - protein, 81 aa, Puma concolor
SQELLTFKDISVDFTQEEWGQLAPAHRSLYREVMLENYGNLVSVAGYQLSKPGVISQLEKGEEPWLIEREVSGGPRSDLES

SEQ ID NO: 31477 - protein, 81 aa, Phascolarctos cinereus
AMADLTFADVTVSFSWEEWGHLAPGQKELYRDVLWESYGHMGALGIPVPKPDLIALIDGEEEAEDGQLCLAGEESVPGGAQ

SEQ ID NO: 31478 - protein, 81 aa, Myotis lucifugus
QEPVTFKDVVVEFSAEEWGQLDSAVKNLYKDVMLENYRNLSSLRKELLFSKPVEVPKLESKIKEWIMEQEIPRTAILDTQI

SEQ ID NO: 31479 - protein, 81 aa, Puma concolor
LVTKESMTFKDVAVDITQEDWEIMRPVQKELYKTVTLQNYWNMVSLGLTVYRPTVIPMLEEPWLVIKEILEGPSPEWKTEA

SEQ ID NO: 31480 - protein, 81 aa, Puma concolor
QQVPVTLEDVAAYLSQEEWECLDPAQRGCVWDVLPDSGGLGLQLEDGEGARQDVLTRREQDRELVGGMTRPEQSLERGGPR

SEQ ID NO: 31481 - protein, 81 aa, Sapajus apella
QEPVTFKDVVVEFSKEEWGQLDSAVKNLYRDVMLENFRNLNSLRKAHLLSKPVESLELKNKKKRWITEKEMSRKTISDMQS

SEQ ID NO: 31482 - protein, 81 aa, Ursus maritimus
DWTVAPELILPESQEEWELLDPTQEALYNDVMWENYETVISLAVPAHQILAFPEQIITKDWTVAPELVLPESQSLLTFEEV

SEQ ID NO: 31483 - protein, 81 aa, Ursus maritimus
NEPVTFKDVIVEFNEEEWGQLDPAVKTLYRDVMLENYRNLNSLHQEQLLSKPVESSKLESKERRWTVEQETPSTSVSDREI

SEQ ID NO: 31484 - protein, 81 aa, Ursus maritimus
VTFGDIPFYFSREEWGSLDPAQRELFWDIKRENSRNVALALVPEPSGTEEAAPSRLAGLGFKSQSEQSGLEEAHRRIHTGE

SEQ ID NO: 31485 - protein, 81 aa, Phascolarctos cinereus
NHVTQLKDVILCFSEEEWSLLDPAQTGFYGEFIIEEDYGVSLPMRDSNMNKKELPQQKNLGEEVSIEIVLSSSGDEDPKQS

SEQ ID NO: 31486 - protein, 81 aa, Phascolarctos cinereus
SQKSMEFKDVAVDFTLEEWEQLHFAQRELYKDVMLENYRNLVFLGLSVSKPDVITQLEQLQAPVMLDKEVLRCTSPDRETA

SEQ ID NO: 31487 - protein, 81 aa, Rhinolophus ferrumequinum
VKIEDVADMAVSFILEEWGHLDQSQKSLYRDDRKENYESITSMDYESRNDNVELIVKHISDEAESHWMTSGGTERNVPQSQ

SEQ ID NO: 31488 - protein, 81 aa, Ailuropoda melanoleuca
SLLTFEDVAMYFSQEEWELLDPTQEALYNDVMRENYETVISLAVPAHQILAFPEQIITKDRTVAPELVLPESQSLLTFEDV

SEQ ID NO: 31489 - protein, 81 aa, Sapajus apella
QAMVKIEDMAVSLILEEWGCQNLARRNLSRDNRQENYGSAFPQGGENRNENEESTSKAETAEDSASRGETAGRFQKEFGEK

SEQ ID NO: 31490 - protein, 81 aa, Oryctolagus cuniculus
IRDQDFGASLLPTAPQEQWRHLDSTQKEQYWDLMLETYGKMVSGGRQENDKENLNLENHRDQEPLAGSRQASGEAAPQASL

SEQ ID NO: 31491 - protein, 81 aa, Rhinopithecus bieti
SQEPVTFADVAVVFTPEEWVFLDSTQRSLYRDVMLENYRNLASVEPQLQPQEAIPSQDPFTEILSIDVKGEQPQPGEKLYK

SEQ ID NO: 31492 - protein, 81 aa, Panthera pardus
RGSISFEDVTVNFTQEEWGQLDPDQRTLYRDVMLENDGFFISLVDGMVESKENQDRHLWQDAFINNKKSDYTERKCIKENI

SEQ ID NO: 31493 - protein, 81 aa, Ursus americanus
HDSPTCEASALSQEENPRNQLMALMLLTAQPQELVMFEEVSVCFTSEEWECLGPIQRALYWDVMLENYGNVTSLGKDSFFP

SEQ ID NO: 31494 - protein, 81 aa, Saimiri boliviensis
VKIEDMAVSLILEEWGCQNLARRNLSRDNRQENYGSAFPQGSENRNENEESTSKAETVEDSASHGETAGRFQKEFGEKHDQ

SEQ ID NO: 31495 - protein, 81 aa, Rhinolophus ferrumequinum
PQLPESLEDVAMYISQEEWGHQDPSKRALSRDTVQESYENVDSLESQVPSQEALSTQVEQEGKPWDPSVQSCKEGLSPRSP

SEQ ID NO: 31496 - protein, 81 aa, Ursus arctos
DWTVAPELILPESQEEWELLDPTQKALYNDVMRENYETVISLAVPAHQILAFPEQIITKDWTVAPELVLPESQSLLTFEEV

SEQ ID NO: 31497 - protein, 81 aa, Myotis brandtii
SPVGVAFEDVAVCFSRTEWRLLDEAQRRLYLEVMLENFALVSSQGCCCGSQDLEASTEQSVSVRVSQAQKTNVASSSQTSH

SEQ ID NO: 31498 - protein, 81 aa, Rhinopithecus bieti
YKFLMGYKRVAVEFTQEEWTLLDPTQRNLYSDVMLENYKNLSSVGYQLFKPSLISWLEEEEELSTLPRVLQEWKMCLKTKG

SEQ ID NO: 31499 - protein, 81 aa, Muntiacus reevesi
SQGPVKDDHMARGFSYKKSVRQIPAHKDLYRDIRKESVGNMVSLGSTVPTANKIAQLEPRKEPWTIGLQSFNRRTVLRSNY

SEQ ID NO: 31500 - protein, 81 aa, Muntiacus reevesi
VKIEDMAVSLILEEWGCQNLARRNLNRDARQENYGNVISQGCENRNETEESTSKAESAEDSASRGETAGKFQKDIGEKREQ

SEQ ID NO: 31501 - protein, 81 aa, Camelus ferus
KVSVTFEDVAIYFSQAEWGLLDEAQKFLYRDVMLENFALTRSLDCWRGAEDEEVLSEQSVSISESQIRTSKLVPLNPKTRP

SEQ ID NO: 31502 - protein, 81 aa, Rhinolophus ferrumequinum
EELPVAFEDVAVYFTREEWGMLDKRRKELYRDVMRRNYELLASLGPAAAKPDLISKLERGAAPWIKDPNGPKWGKGKKKMV

SEQ ID NO: 31503 - protein, 81 aa, Ursus americanus
PCRPLEPPSHPVKEESDMEQELAMAAPPPAPPEERLIRDQDFGASFLQEQWRHLDSTQKEQYWDLMLETYGKMAFPIPSLI

SEQ ID NO: 31504 - protein, 81 aa, Myotis brandtii
LVTKESMTFRDVAVDITQEDWELMRPVQKELYKTVTLQNYWNMVSLGLTVYRPTVIPILEEPWMVMKEVLEGPTPGWETEA

SEQ ID NO: 31505 - protein, 81 aa, Panthera pardus
SQSSLTFEEVAMYFSQEEWELLDPTQKALYNDVMRENYETVISLAVPVHQILAFSEKTNTKDWTVAPELVLPESQSSLTFE

SEQ ID NO: 31506 - protein, 81 aa, Ursus arctos
SQSLLTFEDVAMYFSQEEWELLDPTQKALYNDVMRENYETVISLALFVLPKPKVISYLDHEEEPWVQGPLEFKNSPGDLPA

SEQ ID NO: 31507 - protein, 81 aa, Rhinopithecus bieti
IRDQDLGASLLPAAPQEQWRHLDSTQKEQYWDLMLETYGKMVSGGISHSKPDLTNSIEYGEELAGLYLHVNEKIPRPTCIG

SEQ ID NO: 31508 - protein, 81 aa, Phascolarctos cinereus
SQKSVTFKDVAPDFTWEEWAQLNPVEQALCREVLLETYRNLVFLGLSATSKPDVISQLEDGKVPGMLGSETPKGTSSYWNT

SEQ ID NO: 31509 - protein, 81 aa, Panthera pardus
EPISFKDVIVEFSKEEWGQLDPAVKNLYRDVMLENYRNLNSLHQDREVISENQDSVTKERISGESSSHGEIMRRLTKSGPP

SEQ ID NO: 31510 - protein, 81 aa, Macaca nemestrina
QTDLVTFDSVAVEFTQEEWTLLDPTQRNLYRDVMLENYKNLSSVGYQLFKPSLISWLEEEEELNTLPRVLQEWKMCLKTKG

SEQ ID NO: 31511 - protein, 81 aa, Gorilla gorilla
QLQETMTFKDVEVTFSQDEWGWLDSAQRNLYRDVMLENYRNMASLVGPFTRPALISWLEAREPWGLNMQAAQPKGNPVAAP

SEQ ID NO: 31512 - protein, 81 aa, Puma concolor
GAPLGQSRTSPIVLSSDEYVTLTAWDPALRPPYNWPNLVSFLGAGPPGFKPDVISRLERGEEPSMEKREGWQMACPDLETR

SEQ ID NO: 31513 - protein, 81 aa, Oryctolagus cuniculus
GLLKMDSVALSLTPEWTQPDSSQMNLYRDERLENYSSLISLGADEQTKVRDLPPAEPHPEQEPGQTPGHLGGDTARITTGA

SEQ ID NO: 31514 - protein, 81 aa, Ursus maritimus
KVVSVLPSTESQVNCILCWRRLEPFQKELYKEVLLENFRNLEFLGFPVSKLDLISQFKWVELPWLLEKEIAKGSRPESTLD

SEQ ID NO: 31515 - protein, 81 aa, Ailuropoda melanoleuca
ESVTFEEVAVDFSQEEWALLDAAQKILYRDVMLENYRNLASLGAGYPLCKHSLITEVKQEALGTEEGGILQDWDIQLKSKD

SEQ ID NO: 31516 - protein, 81 aa, Sapajus apella
SCESITLNDVAVNFSRGEWKKLEPFQKELYKEVLLENFRNLKFLDFPVSKLELISQLKWVELPWLLEKEVSKGSQPDESAL

SEQ ID NO: 31517 - protein, 81 aa, Panthera pardus
LQLPESLEDVAMYISQEEWGHQDPSKRALSRDTVQESYENVDSLEAQVPIREALSTQVEQGGKPWDPSVQTCKEGLSPRGP

SEQ ID NO: 31518 - protein, 81 aa, Muntiacus reevesi
QEPVKFKDVAVEFSKEEWGQLDPAVKTLYRHVMLENYRNLNSLQEGEHLLSKPVETSKLESKKESWIMEQEIPRTAVVDRE

SEQ ID NO: 31519 - protein, 81 aa, Rhinolophus ferrumequinum
SQELLTFKDVSVDFTQEEWGQLAPAHRNLYREVMLENYGNLVSVGYQLSKPGVISQLEKGEEPWLMERDISGSPTSDLESK

SEQ ID NO: 31520 - protein, 81 aa, Panthera pardus
SQGPVKDVRVARGFSYKKSVHQIPVHRDLYRDIRKESAGNMVSLGSTVSVSNKIARLEQRKEPWTLGVHSSNKRSILRSNY

SEQ ID NO: 31521 - protein, 81 aa, Ursus arctos
SQELVTFKDVVVDFSPEELTYLSAAQRNLYREVMLENYRNLVSLGYQFSKPDIISQLEEEESRVMEEDSNAEICQDGEKRP

SEQ ID NO: 31522 - protein, 81 aa, Pteropus alecto
RGSVTFKDVFVCFSREEWELLEEVQRCLYRDVMLENFVLVASLEQVLWAVGSVPSITEQSQQLLPKALKEEVRDSGLFQSA

SEQ ID NO: 31523 - protein, 81 aa, Panthera pardus
LPESQSSLTFEEVAMYFSQEEWELLDPTQKALYNDVMRENYETVISLAVPAHQILAFPEQTITKDWTVAPELVLPESQCLT

SEQ ID NO: 31524 - protein, 81 aa, Muntiacus reevesi
LLTFEEVAMYFSQEEWELLDPTQKALYNDVMQENYETVISLGLKLKNDTENIQSLCLSDLEIQAPVAIASRKAKLKVLQKT

SEQ ID NO: 31525 - protein, 81 aa, Oryctolagus cuniculus
VTFEDVAASLTWEQWERVDPARRDLCKDSAREVYGGTIPAGLETRAETKELIPKREMSEVEPQGQLPEVSQGMACPSAEGG

SEQ ID NO: 31526 - protein, 81 aa, Ursus arctos
LLTFEDVAVSFSEEEWKLLDPSQKILYNDVMQENYETVISLGGCRGFRELMCTTQTAPSRSRHGKVHWAMVSDSGLEIQSP

SEQ ID NO: 31527 - protein, 81 aa, Ursus arctos
LLTFEDVAVSFSEEEWKLLDPSQKILYNDVMQENYETVISLGGCRGFRELMCTTQTAPSRSRHGKASSVVLLPKPSVASTS

SEQ ID NO: 31528 - protein, 81 aa, Oryctolagus cuniculus
QPQEIMAFKDVEVTFSQDEWGWLDSAQRNLYRDVMLENYRNFSALMGPFCKPALISWLEAREPWGLNVQEAQPKREPDDAP

SEQ ID NO: 31529 - protein, 81 aa, Lynx canadensis
ERPPGLVTITNMAVDFSQQLDPAQKSFCKNVMWENRSDLGSVGPCVSKADLVSLLQQEKEPWMVDRELPKGLGSGQQSIHE

SEQ ID NO: 31530 - protein, 81 aa, Oryctolagus cuniculus
KGHLGHGEQASTSRIQEWGLLDPLQKELYWDVMLEKYGTVVSLGLPPPQPGPQHLESEVRGSHRPASESQSLREDPPGCPE

SEQ ID NO: 31531 - protein, 81 aa, Rhinolophus ferrumequinum
VQEPVTFADVAVLFTPEEWMFLDSAQRSLYRDVMLENYRNLASVGDQLCKPSTFSHLEQSEELWTTGRGIFPGDCLESQLQ

SEQ ID NO: 31532 - protein, 81 aa, Macaca nemestrina
ATFEDMAVSLTWEEWERLDPARRDFCRESAQKDSGSTVPPSEVDSKQKILKQAATRRTTRSVPGKRPLLSKCGTVEKHSVN

SEQ ID NO: 31533 - protein, 81 aa, Rhinolophus ferrumequinum
MAEGLKFKDVAIYFSQNEWECLHSAQKDLYRDIMLENYNNLISLGLSESKPDVISLLEQRKEPWMVERKETKEWFPDWESR

SEQ ID NO: 31534 - protein, 81 aa, Macaca nemestrina
VKIEDMAVSLILEEWGCQNLARRNLSRDHRQENYGSTFPQGGENRNENKESTSKAETTEDLASRGETAGRFQKEFGEKRDQ

SEQ ID NO: 31535 - protein, 81 aa, Balaenoptera physalus
SQSLLTFEEVAMYFSKEEWELLDPTQKALYNDVMQENYETVISLALFVLPKPKVISCLEQGEEPWVQRSLGFKDNSGELPT

SEQ ID NO: 31536 - protein, 81 aa, Oryctolagus cuniculus
LETKESMTFTDVAVDITQEDWALMRPVQKELYKTVTLQNYWNMVSLGLTVYRPTVIPILEEPWMVIKEILEGPSQEWETEA

SEQ ID NO: 31537 - protein, 81 aa, Panthera pardus
SLLTFEEVAMYFSQEEWEFLDPTQEALYNDVMRENYETVISLAVPAHQILAFPEQTITKDWTVAPELVLPESQISLTFEEV

SEQ ID NO: 31538 - protein, 81 aa, Puma concolor
ELVKIENVAVSLNCEEWEPLDPAPREFCWEGAQEDHRTSVSLVSPSLETRMENKDFIPKQEILEEVEPQGQLQEGSHRKAP

SEQ ID NO: 31539 - protein, 81 aa, Oryctolagus cuniculus
VALGEIPFYFSREERGSLDPAQRDLFWDIKRENSQNTALGAGLRGQSRRSRPEAAVPGQAGAHGTVAWSPEDSEAWESENR

SEQ ID NO: 31540 - protein, 81 aa, Saimiri boliviensis
LAGQSDPPAAQMPALFQREGCPGDQVTATRSLTAQLQENMTFKDVEVTFSQDEWGLLDSAQRNLYRDVMLENYRNMVFLGK

SEQ ID NO: 31541 - protein, 81 aa, Candidatus Rokubacteria bacterium
MEGLDHRDTVTDFTLPEGTFFDVAMVHLLTTATLDRLRELYPQGRFEVRRFRPNIVVRLASGEKGFAENAWVGHTLAIGTA

SEQ ID NO: 31542 - protein, 81 aa, Pantherophis guttatus
NEPPVPLKDIDVKFSNEEWALLTEEQRALYDDVTLQNFQNMSTLGIPLEKPEVITRIQQGGELYFQNNTINSPKDRFIANQ

SEQ ID NO: 31543 - protein, 81 aa, Xenopus tropicalis
AQDPVTFDEVAVYFSREEWALLDLGQKQLYREVMAENYRALLSVGYVMEQPGLVPRIEQEQQEPWEGRPIRSSLHGRHCGF

SEQ ID NO: 31544 - protein, 81 aa, Micrurus paraensis
LIDSSPFSAGDEKAVEHPTQILVSFEEVAVHFSKEEWSRLDPDQKSLYREIMLENSRNLAFLRNHVQENKEASQIFGDEER

SEQ ID NO: 31545 - protein, 81 aa, Geotrypetes seraphini
WQLLEDWQKDLYRKVMKETYDNLISLMPLTFHDIAIYFSEEEWQLLGEHQKALYRNVMKENYDTLISLGMTTTIPTQRGVA

SEQ ID NO: 31546 - protein, 81 aa, Geotrypetes seraphini
VQALVTFKDVAAYFLEVEWDILEECQKEHYKRIIEKIHDILLLRGYSIVNPDVIFKMKKEDEKYFTQHFEWEGKENPNGPT

SEQ ID NO: 31547 - protein, 81 aa, Geotrypetes seraphini
SNMQVKFEDVAVSFSQEEWEYLDEGQKELYREVMKENYETLLSLGSVRISPVLFSWIKQDGEPNIQNPQESGEREVRHSDT

SEQ ID NO: 31548 - protein, 81 aa, Geotrypetes seraphini
NEAVVSFKDVAAYFLEEEWDILGEWKKGLYMTVIKEVHDILMSRGYSIVNPDVIFKIEKEDEKNFTQHIEWEGKENPNDPT

SEQ ID NO: 31549 - protein, 81 aa, Geotrypetes seraphini
QPASVTFTDVAAYFWEVEWNILGERQKERYKKAIKEIHSILMSRGYSIVNPDVIVKIKNEDKKYFTQCCEWERKEDVEAPP

SEQ ID NO: 31550 - protein, 81 aa, Geotrypetes seraphini
DSMQVTFEDVAVSFSQEEWEYLNEEQKELYREVMKENYQTLLSLGSPTFTPKIISLIKQEEEPYFRDEPESEERETGKSSC

SEQ ID NO: 31551 - protein, 81 aa, Geotrypetes seraphini
YEAMVAFKDVAAYFLEAEWGILGEWKKALYKKVIKEVHDLLMSRGYSIVNPDVIFKIEKEDKSFNQHFEWEGKENPNDSSK

SEQ ID NO: 31552 - protein, 81 aa, Pseudonaja textilis
GLVSFKEVAVYFSEEEWSELDPDQKALHWEVMMENYRNVASLEEIPIQILKVEVGEKNQWQTKSEDRIQLNDPRGKNPPFS

SEQ ID NO: 31553 - protein, 81 aa, Pelodiscus sinensis
VQGPVTFEEVAVNFSEEEWTLLDPGQRSLYRDVMQENYENVTSLDFPISSPDAVSQLVPGEVPDLQCTKEKDILRSSYTGY

SEQ ID NO: 31554 - protein, 81 aa, Colinus virginianus
GEEPVNFEEVAVYFSREEWALLDPAQRALYRDVMLETYECVASLAPLPAPKPMVISLLEEGEEPWIPDVGSPEAVAGDVSP

SEQ ID NO: 31555 - protein, 81 aa, Geotrypetes seraphini
TEMQLKFEDVAVSFSQEEWEYLDEGQKELYREVMKENYETLISLGSVRISPDLLSWIKQDGETHIQDPQESGEREVRHSDT

SEQ ID NO: 31556 - protein, 81 aa, Geotrypetes seraphini
NEASVTFKDVAAYFLDVEWSILGERQKELYKKAIKEIHDILTSQGYSIVNPDVLFKIKKEDEKHFTQQFEREGKEKPNDPP

SEQ ID NO: 31557 - protein, 81 aa, Pelodiscus sinensis
LVEPVSFEEVAVYFSEKEWALLDPSQRALYRDVMQENYEAVSWLGFPDSKPHVFSWVDLGHSLGMFPFFYFSSRVFFQLRK

SEQ ID NO: 31558 - protein, 81 aa, Micrurus corallinus
QGVVSFEDVAVYFSKEEWSQLDADQKALHGEVMLENSRNLASLGLNGQENKKGGKEKFADQMQPKSDKTKQLQSRIKKGFP

SEQ ID NO: 31559 - protein, 81 aa, Micrurus corallinus
DHSNESTPESRKLSLEILESPPLCGGAEELAEPQLQGVVSFEDVAVYFSEEEWSQLDADQKALHGEVMLENSRNLASLVSH

SEQ ID NO: 31560 - protein, 81 aa, Micrurus corallinus
QDIVSFEEVAVHFSAEEWSQLDADQKALHGEVMLENSRNLASLGLNGQENKKGGKEKFADQMQPKSDKTKQLQSRIKKGFP

SEQ ID NO: 31561 - protein, 81 aa, Micrurus corallinus
VSFEEVAVYFSEEEWSQLDHDQKTLHGEVMLENSRNLASLENNVQEDKNYKEQCQTIHPKEEKGKFATQLEPKTDERNRSQ

SEQ ID NO: 31562 - protein, 81 aa, Pelodiscus sinensis
MVEPVTFEEVAVYFSEDEWALLDLSQRALYRDVMQENYEAVSWLGFPVSKTHVLSWVEKGEELQIPDFQSCEEGEIISDTH

SEQ ID NO: 31563 - protein, 81 aa, Geotrypetes seraphini
NEALVTFKDVAAYFLEVEWSMLGEWQKELYKNVIKEIHDILQSRGYSIVNPDGIVKIEKENEKYFTQHFEWEGKENPNGPT

SEQ ID NO: 31564 - protein, 81 aa, Geotrypetes seraphini
QKVSVTFSDVAAYISEEEWEILEDWEKDLYRNVMKEIHMVLISLGYTIVNPSILLRIKPGEALNFQDPLDCKGTVGTSNPE

SEQ ID NO: 31565 - protein, 81 aa, Notechis scutatus
EDPSQDTSGEKQIMKISGSYDGNQTAVEPPNQEGLVSFDEVAVYFSEEEWSQLDPDQKALHSEVMLENHRNVVSLGKFSSP

SEQ ID NO: 31566 - protein, 81 aa, Notechis scutatus
VSFEDVAVYFSKEEWSLLDADQKALHREVMLENSRNLFSLGFNGQENKNCNEECHAIHLKKEKGKFAGHQNVPPRDNTVVS

SEQ ID NO: 31567 - protein, 81 aa, Pantherophis guttatus
SVVSFEEVAVYFSEEEWSQLDPHQRALHWEVMLENYKNVVSLGENDNKDSGEPIKVFRQGDVMEKPAIQTEFQRQERNLSN

SEQ ID NO: 31568 - protein, 81 aa, Paroedura picta
CVSFEEVAVYFTEAEWALLDPGQRALYVEVMLDNFVNVAFLEGRKRRGTTLEAEEDLKDLSRASQQNISFPGEPTAAGDLK

SEQ ID NO: 31569 - protein, 81 aa, Paroedura picta
PGATFPDGAMKLVMFSSPSFCDEAATVKPEQGLVTLEEVSVHFTEEEWALLNPDQRMLYQEVMEDNRQNVAFLGKAARPVL

SEQ ID NO: 31570 - protein, 81 aa, Paroedura picta
VQDPFCLEDVSVSFTEAEWALLDPGQRALHREVMMENSGNVAFLAQEDQRNEEGERLQQQMPDRVNNEVLKEIGSNRSRSR

SEQ ID NO: 31571 - protein, 81 aa, Paroedura picta
DGGRVTLEEVSVHFTEEEWALLDLGQRRLHQEVMEENGQNVAFLDAHSPQNKSEGEPEYPADPGELDFTPLNVEVLLSHWG

SEQ ID NO: 31572 - protein, 81 aa, Paroedura picta
VSFKEVVVDFMEAEWALLDPAQRALYREEKFWTWFDNLISGHMRVDRFPQSDLTEEKGKVMEEQDPEGPGVSQTARKGHHP

SEQ ID NO: 31573 - protein, 81 aa, Micrurus lemniscatus
RKPTLDFLESPLCAGAEGLAELLLQDVVCFEEVAVYFSEEEWSQLDADQKELYREVMVENSRNLLSLGLTSLVQPLDVCLN

SEQ ID NO: 31574 - protein, 81 aa, Micrurus spixii
PETRKLSLEILESPSLCGGAEELAELQLQGVVSFEDVAVYFSKEEWSQLNTDQKALHGEVMLENSRNLFSLDMEKCIKCPD

SEQ ID NO: 31575 - protein, 81 aa, Micrurus lemniscatus
LTGLSLLERHGKKALVTFEEVSMYFSEEEWRLLDESQRKIFTKVMMENYENVRALGFPTNNPDLVFKMRRNENHEVYTDKI

SEQ ID NO: 31576 - protein, 81 aa, Micrurus spixii
FRENFQEDQSQDSMQESRKPTLDFLESPLCAGAEGLAESLLQDIVSFEEVAVYFSEEEWSQLNADQKALQGEVMLENSRNL

SEQ ID NO: 31577 - protein, 81 aa, Micrurus spixii
LEERRDPPEPSQNLLFREIFHEDQSQATSTRDSALIDSSPFSAGDEKAVEHPTQVLVSFEEVAVHFSKEEWSRLDPDQKSL

SEQ ID NO: 31578 - protein, 81 aa, Micrurus spixii
GVVSFEDVAVYFSKEEWSQLNTDQKALHGEVMLENSRNLFSLGFNGQENKNCKEKHQAIHLKGGKRKFVDQKQLKSNEAKQ

SEQ ID NO: 31579 - protein, 81 aa, Micrurus spixii
MFFRKVSQDDPNQDTTRGKNSRKLALAEGGAESGVKTPIQEGIVSFEDVAVYFSKEEWSQLDPDQKALHREVMLENYRNVA

SEQ ID NO: 31580 - protein, 81 aa, Pantherophis guttatus
QNLVTFEDVAVYFTDEEWALLDPEQRSLHVEMMEENCGNLAFLAGDSWKAKTEEEVHGLFLEKAANKEEKKQSQNMEEKKK

SEQ ID NO: 31581 - protein, 81 aa, Pantherophis guttatus
GSDPFEEVTVDFTLEEWELLDSGQKTLCREVMWENLNNMAALDDGLEYENSKQGRLKTEKCEVEEVIFGHEEDTRRQDRRH

SEQ ID NO: 31582 - protein, 81 aa, Pantherophis guttatus
GSDPFEEVTVDFTLEEWELLDSGQKTLCREVMWENLNNMAALGDDGLEYENSKQGRLKTEKCEVEEVIFGHEEDTRRQDRR

SEQ ID NO: 31583 - protein, 81 aa, Micrurus lemniscatus
DIISFEEVAVYFSEEEWSQLDADQKELYREVMVENSRNLFFLGFNGQEKKNCKEECQAIHSKGGNRKFVDQMQLKSDETKQ

SEQ ID NO: 31584 - protein, 81 aa, Micrurus lemniscatus
QSQATSTRDSALIDSSPFSAGDEKAVEHPTQVLVSFEEVAVHFSKEEWSRLDPDQKSLYREIMLENSRNIAFLSKDPRSLF

SEQ ID NO: 31585 - protein, 81 aa, Micrurus lemniscatus
RRIPWEDQSQDTSGETQRVKLSGFYEGDQPTLEPRNQEGLVSFEEVAVYFSEDEWSQLDPDQKALHSEIMLENHRNVVSLG

SEQ ID NO: 31586 - protein, 81 aa, Micrurus lemniscatus
DVVCFEEVAVYFSEEEWSQLDADQEELYREVMVENSRNLLSLGFNGEEKKNCKEECQAIHSKGGNRKFVDQMQLKSDETKQ

SEQ ID NO: 31587 - protein, 81 aa, Alligator sinensis
TELGEVFEAVAVYFTRKEWELLGDEDKVLYRDQMLRNFHALVSLGYGGPTPNLICRVQQGELELWVCEDEDHGEISRSEDL

SEQ ID NO: 31588 - protein, 81 aa, Microcaecilia unicolor
WQLLEDWQKDLYRNVMKETYDNLLSLMPVTFHDIAICFSEEEWQLLGEHQKALYRNVMKENYDILISLGMTTTIPTQRGVA

SEQ ID NO: 31589 - protein, 81 aa, Notechis scutatus
LVPLSFEDVAVYFTEEESPLLNASQLSLQMEVMVENYQNLSSLGREVWQNKEEDESQRVSLKRSRSTQEELQFEGIEERPK

SEQ ID NO: 31590 - protein, 81 aa, Pogona vitticeps
QLEQGPVAFEDLAVLFSEEEWALLDPGQKALHWEVMEENWAHLMSLGKLSYPFCWSHFHSGSRSSLFFPAGIRNKTKQNRL

SEQ ID NO: 31591 - protein, 81 aa, Alligator sinensis
MELPKVFEEVAVYFTRKEWELLEDEDKVLYRDQMLKNYQALVSLGYQGPTPDLICRIQRGEVELWACDDEDGGKISRLEDL

SEQ ID NO: 31592 - protein, 81 aa, Pogona vitticeps
LAFRDVAVCFTQEEWELLDKDQRMLYYNVMQENSENMASLELLPSDPKGTQHNSKNNVIFQKTKEKKIQVPKEEKIPRGRS

SEQ ID NO: 31593 - protein, 81 aa, Pantherophis guttatus
PAQGRVSFEEVAVYFSKEEWSQLDSHQKALHGEVMLENSRNIASLGSDGQDEVIQDGKGKEEFRNWTESRISEKNKSIYRN

SEQ ID NO: 31594 - protein, 81 aa, Micrurus spixii
PESRKLSLEIFESVCLCAGAEGLAEPLLQGGVSFEEVAVYFSKEEWSQLNTDQKALHGEVMLENSRNLSSLGFKGQENKNC

SEQ ID NO: 31595 - protein, 81 aa, Pogona vitticeps
QGSVTFEDVAVYFTDEEWAVLDPDQRGLHREVMEESSGILESLGDERKRNKEDMAQKTEAEQKLRKKPSGDEEGEFHKMAG

SEQ ID NO: 31596 - protein, 81 aa, Pogona vitticeps
GADPELVTFEDVAVCFTKKEWNLLDWSQRLLYKEVMMENCENVFSLVLMPELISGTVQGNARWLPESQDLGGMVILDTRSG

SEQ ID NO: 31597 - protein, 81 aa, Pogona vitticeps
FIFWGPVTFEEVAVDFTREEWVLLDPDQRALHKEVMEENHEIVAFLIANLKLISERERREKSQSLDEGETSGPRSGSSLGY

SEQ ID NO: 31598 - protein, 81 aa, Pogona vitticeps
NWQMISSLRSVKMPTTGIASSLPEDAALPDQGSVTFEEVAVSFTQEEWALLDPNQKALHQEVMEENWQMISSLGNAPSFSI

SEQ ID NO: 31599 - protein, 81 aa, Pogona vitticeps
KVQKLLLAFEEVAVYFSQEEWDVLDLGQRALYRGVMLENYGNVASVAPKPALISMLEEGDDPFVQDSLDTEMSAGGCPGDR

SEQ ID NO: 31600 - protein, 81 aa, Cavia porcellus
IRDQGLGAALLSVTPQEQWRHLDSTQKEQYWDLMLETYGKMVSRAGISNSKPSLTNSAEYGEEPAGLHLHVSEKIPRLSCV

SEQ ID NO: 31601 - protein, 81 aa, Mesocricetus auratus
SRDQDMGTAFLPAVHQEQWRNLDSTQKEQYWDFMLETYGKMVSGAGISNSKPDLTNIAEYGEELAGLQLHISEKIPRLTCK

SEQ ID NO: 31602 - protein, 81 aa, Rattus norvegicus
VTFQDVAVGFSQEEWRLLGPVQRTEYHDVMLETLGNLVSVGWEPTLENRAISPDSPIPVVKPIHDPNPKDLSRNGIQSTVF

SEQ ID NO: 31603 - protein, 81 aa, Mus musculus
VTFQDVAVDFSQEEWQLLGPMQRTKYHDVMLETLGNLVSVGWEPTLGNRELTPDSPIPVVKPIHDPNPKDLSRNRTQSTLF

SEQ ID NO: 31604 - protein, 81 aa, Macaca fascicularis
EEPVTFQDVAVDFSREEWGLLGPTQRTEYRDVMLETFGHLVSVGWETTLENKELAPNSDIPQEEPAPSLKVQESSRDCTLS

SEQ ID NO: 31605 - protein, 81 aa, Paroedura picta
GRVTLEEVSVHFTEEEWALLDPGQRRLHQEVMAENGQNVASLEAEGSEMTFVEEPHHHLLEKKQQKRIKGTKWKKETKSSL

SEQ ID NO: 31606 - protein, 81 aa, Podarcis muralis
GTSFFQAPVSLEEVAVDFKEDEWALLDPSQRALHKEVMEENYASLVFLGKAPPWFWLIDPESRNSGCSLYAAVHCGKRHGV

SEQ ID NO: 31607 - protein, 81 aa, Paroedura picta
AQGPVPFEEVAIYFTVEEWAFLDPCQRVLYREVMLENYGMVVSVERHWSSTPPLISWLKEGSLLLPNSIENSHSAGDALEI

SEQ ID NO: 31608 - protein, 81 aa, Paroedura picta
FSLEDVSVPFTEAEWALLDPGQRALHREVMLENYESVAFLAEDDERNEEGVKVHQETAVRIKDENMKENLRNRGRPQRNKG

SEQ ID NO: 31609 - protein, 81 aa, Paroedura picta
RVTLEDVAVGFSEEEWALLDPDQRRLHREVTEENGQNVASLASALQSRENSSEHYAVSPARNEHEGQTMGLHESCSLLPLD

SEQ ID NO: 31610 - protein, 81 aa, Paroedura picta
FSFEEVAVSFSEAEWALLDQDQRALYREMLENYGSVASLGEDQRNEEDEEVHPLSPEEFRYQEADGPREVCSRLHLLCSHW

SEQ ID NO: 31611 - protein, 81 aa, Paroedura picta
AQGGVSFEEVAVYFTWGEWALLCPAQRALYKEVMRENFGHVASLGPPLATPGLISWLEKEEEPFLLTDEEEGVAGSCIDIF

SEQ ID NO: 31612 - protein, 81 aa, Microcaecilia unicolor
QGLVSFEDIAVYFSQEEWEDLEEQQKELYKDVMKENYQTLNSLGTGRVSITPDVISQIEQGEEPYIRTEPRSEEGEAGKSS

SEQ ID NO: 31613 - protein, 81 aa, Lithobates catesbeianus
EVPIRCQDVTVYFSMEEWEYLEGHKDLYKDVMMENRPPLTSPDAPDVLNTSESHPILPLECKEEEEEDDLTQFSLDVKPVS

SEQ ID NO: 31614 - protein, 81 aa, Alligator sinensis
TQRRLTFDDVAVYFTRKEWALLDDGDKALYRDQMLRNYQALVNLGHRGPTPDLICRIQRGELELWVCGDDDARESSWSMGS

SEQ ID NO: 31615 - protein, 81 aa, Paroedura picta
SPASFEEVAVTFTGEEWALLDPGQRKLYWNVTEEIFETMASLGKDLSVFLISRHTLIGHREKNGALTPGSAEDGKHSNGLN

SEQ ID NO: 31616 - protein, 81 aa, Paroedura picta
VSFEEVAVFFTREEWALLDLAQRALYWEVMRENYKMVASLAGDATDTERQGQVGEVSSEGDKDLEEEPWDQDGPLRQLKRK

SEQ ID NO: 31617 - protein, 81 aa, Paroedura picta
QRPFSFEEVAVYFTEAEWALLDPGQRDLYTEVMLENYGSVASLGGDQNHGEYKELHRLSPDEDLRRNFRSQSRPKRPKRSH

SEQ ID NO: 31618 - protein, 81 aa, Paroedura picta
APVTFEDVAVHFTEGEWALLDPEQRALYKEVMQENYSALASLECGKSFVKKRSQQLHQRIHMGEKPYQCLDCGRAPVTFED

SEQ ID NO: 31619 - protein, 81 aa, Anolis carolinensis
LLSRMEEEKVLQEERLEREVLQAQEAPLETRETASMEHDQVTFEDVSVHFSEEEWVLLDPDQRALHWGVMGENYKTLASFG

SEQ ID NO: 31620 - protein, 81 aa, Chelonia mydas
FQGPVTFEEVAVYFTLGQGALLDPTQRALYRDVMQENYETVTSLGFPIPKPDLITQLERGEEPWVPDLQDSKERESPRGTS

SEQ ID NO: 31621 - protein, 81 aa, Pogona vitticeps
GPVAFEDIAVFFTEEEWALLDPGQRALHREVMEENLAHVVSLAASVTEGKFKEEPLQVCFEKVTEEEKPQGIKTEIGEQRD

SEQ ID NO: 31622 - protein, 81 aa, Pogona vitticeps
NHFPLVSFQEVAIYFTQEEWELLNPGQRALYNEVMLENYGTVSSLEIPKPDLISWLEVIDDPFVQDSEEQKRWSRTCLDDC

SEQ ID NO: 31623 - protein, 81 aa, Thamnophis sirtalis
VSFEEVAVYFSEEEWSQLDHDQKALHGEVMLENSRNLASLENNVQEDKNYKEQCQTIQPKEEKGKFADQLKPKSDERNRSQ

SEQ ID NO: 31624 - protein, 81 aa, Peromyscus maniculatus
VTFQDVAVDFNQEEWQLLGPVQRTEYHDVMLETLGNLVSVGWEPTLGNKELSPKSPSSMVETIRDPKPKSFSSNGTQSSVI

SEQ ID NO: 31625 - protein, 81 aa, Cricetulus griseus
VTFQDVAVDFSQDEWQLLGPMQRNEYCDVMLETLDNLVSVGWQPTSGKQELTPESPTSVAEPIHIPKPKDFSRNDTQSTVS

SEQ ID NO: 31626 - protein, 81 aa, Mus musculus
VTFQDVAVDFNEEEWRLLGPTQKTEYHDVMLETLGNLVSVGWEPTLGNRELTPDSPIPVVKPIHDPNTKDLSRNGTQSTVF

SEQ ID NO: 31627 - protein, 81 aa, Cricetulus griseus
VTFQDVAVDFSQDEWQLLGPMQRNEYCDVMLETLDNLVSVGWQPTSGKQELTPESPTSVAEPLHIPKPKDFSRNDTQSTVS

SEQ ID NO: 31628 - protein, 81 aa, Cricetulus griseus
PVTFHDVAVDFSQDEWQLLGRMQKTEYRDVMLETLGNLVSVGWKPTSGKQELTQESSSSVLEPICVPKSKHFSRNDTKFTV

SEQ ID NO: 31629 - protein, 81 aa, Marmota monax
PVTFQDVAVGFSREEWGLLGPTQRTEYHDVMLETFGNLVSVGWESTPEGKELTPDSDVPAEKPLHDPKMKQSSGEGRQSSP

SEQ ID NO: 31630 - protein, 81 aa, Dipodomys ordii
EEPVTFQDVAVDFSQEEWGLLGPVQRTEYRDVMLETLGNLVSVGWETALGSKELTSDSPFPVEEAVRDLKMKKFSRDNTHR

SEQ ID NO: 31631 - protein, 81 aa, Fukomys damarensis
ETFEDMAVDGLQVEEPLMNPTQTSVHSDEMVKNYENLATVGCQTPIKPSPMACLKEELLTGQKGVLPALEMQLQTKDSALQ

SEQ ID NO: 31632 - protein, 81 aa, Octodon degus
EEPVTFQDVSVDFTQEEWGLLGPLQKTQYHDVMLETLGNLVSVGWETAVENKELIPDSNVPAEEPIYDPEMNELSREDKQP

SEQ ID NO: 31633 - protein, 81 aa, Tupaia chinensis
SQELLTFKDISVDFTQEEWGQLAPIHQNLYREVMLENYGNLVSVVFFRLTRLGIPTVVTMWDLAFLKEHISSEPAHPYLNI

SEQ ID NO: 31634 - protein, 81 aa, Gulo gulo
EEPVTFLDVAVDFSKEEWGLLDPTQRTEYHDVMLETFGHLVSLGWETTLESKELTPKSDIPEKEPAHDLKLEEFSRDDTWS

SEQ ID NO: 31635 - protein, 81 aa, Carlito syrichta
LKREKQKFIDTCIICVLEWVFLDPTQQILYRNVMLENHRNLVFLGHAVSKPDLITCLEQRKEPWEMKKHNASGFGGYKTTH

SEQ ID NO: 31636 - protein, 81 aa, Delphinapterus leucas
SQRLLTFEEVAMYFSKEEWELLDPTQKALYNDVMQENYETVISLALFVLPKPKVISCLEQGEEPWVQRSLEFKDNSGELPT

SEQ ID NO: 31637 - protein, 81 aa, Chelonia mydas
GTALVSFEDVAVYFSPEEWALLAEWQQELYREVMMENYELIASLGSAGPKPEMICKMERGEEPHAAAPQGERDRGILDAPS

SEQ ID NO: 31638 - protein, 81 aa, Chelonia mydas
AQMPVTFEEVAVYFTQGQGALLDPAQRALYRDVMQENYETVTSLGFPFPKPDLIARLERGEGPWVPDLQAWVEKEIPRGTC

SEQ ID NO: 31639 - protein, 81 aa, Mandrillus leucophaeus
EEPVTFQDVAVDFSREEWGLLGPTQRTEYRDVMLETFGHLVSVGWETTLENKELAPNSDIPQEEPAPSLKVQESSKDCALS

SEQ ID NO: 31640 - protein, 81 aa, Sus scrofa
QEPVTFLDVAVDFSREEWGLLEPTQRTEYHDVMLETLGHLVSVGWETTLESSRLAAPMLGAPEEEPARDLQVEEASGAASG

SEQ ID NO: 31641 - protein, 81 aa, Nomascus leucogenys
EEPVTFQDVAVDFSREEWGLLGPTQRTEYRDVMLETFGHLVSVGWETTLENKELAPNSDIPEEEPAPNLKVQESSRDCALS

SEQ ID NO: 31642 - protein, 81 aa, Muntiacus muntjak
EDPVTFLDVAVDFSTEEWGLLDPIQRTEYHDVMLETFGHLVSVGWETTLDSKQLTPQPGSPEEGPACPLKEEEGSADDARP

SEQ ID NO: 31643 - protein, 81 aa, Neophocaena asiaeorientalis
TVAPELVLPESQSLLTFEEVAMYFSQEEWELLDPTQKALYNDVMQENYETVISLGGRAVGSKIPGVQGQFWRAAYRAKAQK

SEQ ID NO: 31644 - protein, 81 aa, Ailuropoda melanoleuca
EEPVTFLDVAVDFSKEEWGLLDTTQRTEYHDVMLETFGHLVSVGWETTLESKELTSKSDIPEKELAHDLKIEEISRDDTWS

SEQ ID NO: 31645 - protein, 81 aa, Pteropus alecto
SQAPVTFEDMAMYLTREEWRPLDPTQRDIYRDVMQENYGNVVSLDFEIRSENEVNPKQEISENVEFGTTSERPVGNAEENP

SEQ ID NO: 31646 - protein, 81 aa, Oryctolagus cuniculus
EEPVTFQDVAVDFSQEEWRMLDPTERTEYHDVMLETFEHLVSVGWETTLGNKQLIQKSDIPEEEAGHDLKVEEFSRNDTGS

SEQ ID NO: 31647 - protein, 81 aa, Neophocaena asiaeorientalis
VAPELVLPESQSLLTFEEVAMYFSQEEWELLDPTQKALYNDVMQENYETVISLGGRAVGSKIPGVQGQFWRAAYSRAKAQK

SEQ ID NO: 31648 - protein, 81 aa, Phyllostomus discolor
EEPVTFLDVAVDFNREEWDLLDPAQRTEYHDVMLETFRHLVSVGWENTLESKELTPKSPIPEAEPAHDQKVEKPSRAEALS

SEQ ID NO: 31649 - protein, 81 aa, Phyllostomus discolor
SQTLLTLEEVAVYFSREEWELLDPGQKALYNDVMHENYETVISLALFVLPKPKVISCLEQGKEPWVQGSTEFMESPGELPI

SEQ ID NO: 31650 - protein, 81 aa, Ovis aries
EDPVTFLDVAVDFSTEEWGLLDPTQRTDYHDVMLETLGHLVSVGWETTVDSRQFTPQPGPPEERPACALKEEDAASAAAAR

SEQ ID NO: 31651 - protein, 81 aa, Ovis aries
SQSLLTFEEVAMYFSQEEWELLDPTQKALYNDVMQENYEAVISLALFVLPKPKVISCLEQGEEPWVQRPLEFKDSSQELPT

SEQ ID NO: 31652 - protein, 81 aa, Cebus imitator
EEPVTFQDVAVDFSREEWGLLGPTQRTEYRNVMLETFGHLVSVGWETTLENKQLAPNSGIPGEEPAASLKVQESSRDCALS

SEQ ID NO: 31653 - protein, 81 aa, Camelus dromedarius
DQELLTLEDVAVDFTWDEWQLLGPTQRDLYRDVMLENYNNLVSLGYQDPNPDTLSKLKHGAEPWIIEDGIHNGSCPGEKQE

SEQ ID NO: 31654 - protein, 81 aa, Aotus trivirgatus
EEPVTFQDVAVDFSREEWGLLGPTQRTEYRDVMLETFGHLVSVGWETTLENKQLASNSGIPGEEPAASLKVQESSRDCALS

SEQ ID NO: 31655 - protein, 81 aa, Myotis davidii
VSFEDVAVDFTQEEWALLDTPQRKLFTEVMLESISHLVSIAFRQHSNTQNGEKSFECHVCGKAFGNSSNCRRHEIIHTGVK

SEQ ID NO: 31656 - protein, 81 aa, Ovis aries
LPSYPSWPAKALPEDPVTFLDVAVDFSTEEWGLLDPTQRTDYHDVMLETFGHLVSVGWETTLDSRQFTPQPGPPEEPAACD

SEQ ID NO: 31657 - protein, 81 aa, Camelus dromedarius
FQEPVAFEDVAVYFTQNQWDSLAPAQRALYREVMLENYANVASLAFPFPKPVLISQLEREEAPWGPDPWEAEVLRDICPGG

SEQ ID NO: 31658 - protein, 81 aa, Camelus dromedarius
SQSLLTFEEVAMYFSQEEWELLDPIQNALCSDVMQENYETVISLALFVLPKPKVISCLEQGEEPWIQRSLEVRESSELPPG

SEQ ID NO: 31659 - protein, 81 aa, Camelus dromedarius
EPVLFKDVAVVFTEEELGLLDPAQRELYRDVMLENFRNLLSVGLLNRATILNVQIVLQIPDFELKYPEFCGSYLCYWCSQR

SEQ ID NO: 31660 - protein, 81 aa, Cercocebus atys
EEPVTFQDVSVDFSREEWGLLGPTQRTEYRDVMLETFGHLVSVGWETTLENKELAPNSDIPQEEPAPSLKVQESSRDCALS

SEQ ID NO: 31661 - protein, 81 aa, Myotis davidii
SLLTFEEVAVYFSQEEWELLDISQKTLYNDVMQENYETVISLAVPTHQILYFPEQTNTKDWTVAPELILPESQSLLTFEEV

SEQ ID NO: 31662 - protein, 81 aa, Physeter macrocephalus
TVAPELILPESQSLLTFEEVAMYFSKEEWELLDPTQKALYSDVMQENYETVISLGGRAVGSKIPGVQGQFWRAAYRAKAQK

SEQ ID NO: 31663 - protein, 81 aa, Callithrix jacchus
EEPVTFQDVAVDFSREEWGLLGPTQRTEYRDVMLETFGHLVSVGWETTLENKQLAPNSGIPGEEPAASLKVQESSRDCALS

SEQ ID NO: 31664 - protein, 81 aa, Physeter macrocephalus
SQSLLTFEEVAMYFSKEEWELLDPTQKALYSDVMQENYETVISLALFVLPKPKVISCLEQGEEPWVQRSLEFKDNSGELPT

SEQ ID NO: 31665 - protein, 81 aa, Sus scrofa
LQEPVTFLDVAVDFSREEWGLLEPTQRTEYHDVMLETLGHLVSVGLLLTKPDVISHLEQGEDPWKAEWGPPRDQKSALERK

SEQ ID NO: 31666 - protein, 81 aa, Chrysochloris asiatica
QEAVTFQDVAVGFSREEWSLLGPTQRTEYRNVMLETFGNLVSVGWETTLENKELTPAAVSKEEPAHSLKEEEPSRGGPSPS

SEQ ID NO: 31667 - protein, 81 aa, Capra hircus
EDPVTFLDVAVDFSTEEWGLLDPTQRTDYHDVMLETFGHLVSVGWETTLDSKQFTPQPGPPEEGPACALKEEDGASAAAAR

SEQ ID NO: 31668 - protein, 81 aa, Physeter macrocephalus
VAPELILPESQSLLTFEEVAMYFSKEEWELLDPTQKALYSDVMQENYETVISLGGRAVGSKIPGVQGQFWRAAYSRAKAQK

SEQ ID NO: 31669 - protein, 81 aa, Trichechus manatus
EEAVTFQDVAVDFSREEWKLLGPTQRTEYRDVMLETFGNLVSVGWETTVESKELTPTPDASEQEPTHSLKVDESSKGGPMS

SEQ ID NO: 31670 - protein, 81 aa, Equus caballus
QEPVTFLDVAVDFSREEWGLLDPTQRTEYHDVMLETFGHLVSVGWETTLENKQLTPNSDTPEEEPAHDLKVEEFSKDDAWS

SEQ ID NO: 31671 - protein, 81 aa, Monodelphis domestica
RPQGLLTFEDVAVSFSQDEWGYLNSAQRSLYRDVMLENFGNMILLGFPISKPDLICMLEQEEEPWSLDPRGAEERSFQGGE

SEQ ID NO: 31672 - protein, 81 aa, Pteropus vampyrus
PVTFLDVAVDFSTEEWGLLDTTQRTEYHDVMLETFGHLVSVGWETTVESKPVTPPSAAPEEGSTRNPKTEEPSEARARPST

SEQ ID NO: 31673 - protein, 81 aa, Eschrichtius robustus
SQEFSGRSLDRDVAINFSQEEWECLDPIQRDLYREVMVENYSHLISLAGCSIPKPDVFSLLEREKEPWMVVRAMTRWSSGE

SEQ ID NO: 31674 - protein, 81 aa, Balaenoptera acutorostrata
SQSLLTFEEVTMYFSKEEWELLDPTQKALYNDVMQENYETVISLALFVLPKPKVISCLEQGEEPWVQRSLGFKDNSGELPT

SEQ ID NO: 31675 - protein, 81 aa, Myotis brandtii
VSEAVTFQDVAVVFTEEELGLLDPSQRKLYRDVTLENFRNLVSVGTQLFKPDLIFQLEREEKHLMVETETQKDGCSGIKNQ

SEQ ID NO: 31676 - protein, 81 aa, Saimiri boliviensis
EEPVTFQDVAVDFSREEWGLLGPTQRTEYRDVMLETFGHLVSVGWETTLDNKQLAPNSGIPGEEPAASLKVQKSSRDCALS

SEQ ID NO: 31677 - protein, 81 aa, Delphinapterus leucas
PVTFLDVAVDFSREEWGLLDLTQRTEYHDVMLETFGHLVSVGWETTLESKQLTPNPNTPVEEPACHLKVEEFSRDDTQPST

SEQ ID NO: 31678 - protein, 81 aa, Myotis brandtii
VVTFEDIALYFSREEWSLLDEGQRQLYLNVMLENFELLSSLGCCCGAENVEAATEQNVFRDHTGERPYECSEYGKAFSSIN

SEQ ID NO: 31679 - protein, 81 aa, Propithecus coquereli
EEPVTFRDVAVDFTQEEWGLLGPKQRTEYHDVMLETFGHLVSVGWETTPESKKLIPNSDVAEEEAAHSLKGQEFSRDCAAS

SEQ ID NO: 31680 - protein, 81 aa, Tupaia chinensis
QLTFRDVAIEFSQMEWKCLDPAQKALYKDVMLENYRNLVSLDVSPECLIEELVPKGKGNTGEVFHTVTLEGHKRHDIEEVC

SEQ ID NO: 31681 - protein, 81 aa, Erinaceus europaeus
QESVTFQDVSVDFSREEWRLLDPTQRNEYHNVMLETLGNLVSVGWETTLESKQLTPESSTSKEVPGLGTEVLREESSNSGN

SEQ ID NO: 31682 - protein, 81 aa, Tupaia chinensis
LKESVTFQDIAVDFTDKEWPLLDSSQRKLYKDVMLENYSNLTSLGYQVGKPSLISHLEQEEELRTEERGVHRGPCTDWETP

SEQ ID NO: 31683 - protein, 81 aa, Carlito syrichta
EEPVTFQDVAVDFSREEWGLLGPTERTEYHDIMLETFGHLVSVGWETTLENKQLTLNSDIPEEEPAHNPKVQESARKCASS

SEQ ID NO: 31684 - protein, 81 aa, Tupaia chinensis
SQAPVTFEDMAMYLTREEWRPLDPAQRDLYRDVMQENYGNVVSLDFEIRSENEVNPKQEISEEVEFGTTSERPVGNAEENP

SEQ ID NO: 31685 - protein, 81 aa, Myotis brandtii
ADSVSFEDVAVNFSLEEWALLESSQKKLYRDVMRETFRNLASIGSKWEDLDMEDQYKNQKRKQRSRMLERTCEGKMDSVSF

SEQ ID NO: 31686 - protein, 81 aa, Panthera pardus
SQISLTFEEVAMYFSQEEWELLNPTQKALYNDVMWDNYETVISLAVPVHQILAFSEKTNAKDWTVAPELVLPKSQSLLTFE

SEQ ID NO: 31687 - protein, 81 aa, Myotis brandtii
GEDMNFEDMAIAFSQEEWEILDEAQRRLYCDVMLEVFALVASVGCWHKMNDEEAYSDQSVSIEEESHVRDSETPSASQKSH

SEQ ID NO: 31688 - protein, 81 aa, Myotis brandtii
VISVGVTFEDIALYFSREEWSLLDESQRQLYLNVMLENFELISSLGKTPTLAGSGDLALHVLIPPSPLGVLCPHLWTVYIA

SEQ ID NO: 31689 - protein, 81 aa, Myotis brandtii
VNVGVTFEDIALYFSREEWSLLDEVQRQLYLNVMLENFELISSQGCCCGAEDVAEPTEQKVSVRVSQASIPKLPLSSQESH

SEQ ID NO: 31690 - protein, 81 aa, Pteropus alecto
NNPYPGIDSREQLAKEIGVPESRVQGRVNFEEIAVDLAQEEWQQLSPEQRNLYRDVTQESYSHLVSVSEHSFLARGRKAEA

SEQ ID NO: 31691 - protein, 81 aa, Panthera pardus
SLLTFEEVAMYFSQEEWEFLDPTQEALYNDVMRENYETVISLAVPAHQILAFPEQTITKDWTVAPELVLPESQSLLTFEEV

SEQ ID NO: 31692 - protein, 81 aa, Muntiacus reevesi
EDPVTFLDVAVDFSTEEWGLLDPMQRTEYHDVMLETFGHLVSVGWQTTLDSKQLTPQPGPPEEGPACPLKEEEGSADDARP

SEQ ID NO: 31693 - protein, 81 aa, Panthera pardus
LLTFEEVAMYFSQEEWEFLDPTQEALYNDVMRENYETVISLGIKHKSDTENHQPICVSDLEIQAPGDIVSKKARAKVPQKT

SEQ ID NO: 31694 - protein, 81 aa, Pteropus alecto
EKDGVTFEDVAVFFSWEEWKLLDEAQRCLYLDDVLQNFALVSSLGCCCGAEDGEAPFEQSVSARGSQARNPKEALSSRKTH

SEQ ID NO: 31695 - protein, 81 aa, Balaenoptera physalus
SQSLLTFEEVAIYFSQEEWELLDPTQKALYNDVMQENYETVISLALFVLPKTKVICCLEQGEEPWVQGSPVFKDSPGELFS

SEQ ID NO: 31696 - protein, 81 aa, Panthera pardus
SQSLLTFEEVAMYFSQEEWEFLDPTQEALYNDVMRENYETVISLAVPVHQILAFSEKTNAKDWTVAPELVLPKSQSLLTFE

SEQ ID NO: 31697 - protein, 81 aa, Colinus virginianus
ILPREFRMSQPPNLFQRLAQDPDRHEQALYETVMLRDRFTTLLTTPLPAPKPMVISLLEEGEEPWIPDLGSPEAVAGDVSP

SEQ ID NO: 31698 - protein, 81 aa, Hirundo rustica
PKVPVTFVDIAVYFSAEEWKNLEEWQKELYNNLVKENYEALLSLDGALSRSEAQPRSERGDAPCVPEPRELEQRELPPDAC

SEQ ID NO: 31699 - protein, 81 aa, Lepisosteus oculatus
QRKLEGANPAAITSDELKLGFEKESWCRAALAMAQGEQGVNVRASQAAEGLAVEIQVECLLDQATDPNILGRVYMGWEPWI

SEQ ID NO: 31700 - protein, 81 aa, Mus caroli
VTFQDVAVDFSQEEWRLLGPTQRTEYHDVMLETLDNLVSVGWEPTLGDRELTPDSPIPVVKPIHDPNTKDLSRNGTQSTVF

SEQ ID NO: 31701 - protein, 81 aa, Paroedura picta
PPFSFEEVAVSFSEAEWALLDPGQRALYREVMLETYGSVPSLAGNVTEMMMETDKGLASKERLESFSRGYQEHTSFPGDEQ

SEQ ID NO: 31702 - protein, 81 aa, Paroedura picta
GPFSFEEVSVSFSEAEWDLLDPGQKALYREVMLENYGSVASLGGGSTRETLVEKDNGRASEERLEGFSGGSEEDISFPDEP

SEQ ID NO: 31703 - protein, 81 aa, Paroedura picta
AQRLVSFEEVAIYFTMEEWALLDPCQIALYKEVMLENYAMVVSMEGCQSSRPPLISCLQEGILLVQDSSEEPRSAGYFRET

SEQ ID NO: 31704 - protein, 81 aa, Pantherophis guttatus
RLVSFEEVAVYFSEEEWSQLDSDQKALHSEVMLENHRNVVSLVSTQRVFTSQWETSSKGFHSKVSSLRSRNGLSRSPAWKT

SEQ ID NO: 31705 - protein, 81 aa, Pantherophis guttatus
LVSFEEVAVYFSEEEWSQLDSDQKALHSEVMLENHRNVVSLANNGQENQDSCELLQVINAKDGREKSGIRMEFESHERNQS

SEQ ID NO: 31706 - protein, 81 aa, Paroedura picta
GQSEKMNGGNPPSGPPVSFEEVAVFFTPEEWALLDPAQQTLYWEVMRENYEAVASLAGDSPERQKNPGEVSLERDKTLEVM

SEQ ID NO: 31707 - protein, 81 aa, Paroedura picta
VQVGEGPFSLEEVFVSFTEAEWALLDPGQRALHGEVMREISQDLAFLVEDDLRNEEGEEPGVGKEDLKDQGRNQGQPQRKE

SEQ ID NO: 31708 - protein, 81 aa, Chelonia mydas
PKVPVTFDDISVYFNEQEWENLEEWQKELYKNVMKGNYETLISLDYAVSKPDILSRIERGEEPCVRDRWESLGGLEERIQK

SEQ ID NO: 31709 - protein, 81 aa, Heterocephalus glaber
FQGLVTFEDVAVYFSLEEWERLDVNQRALYQEVMQENYGILVSLGYPVPKPELIFRLEQGEEPWVPDSPHPEEGDIVTGVY

SEQ ID NO: 31710 - protein, 81 aa, Fukomys damarensis
QLDSVTFEDVAVDFTKEEWTSLDPIQRNLYKDVMLENYQNLSTVGRQLLKPSLISWLEEEVELTIVERGFLQEWEMHLKTK

SEQ ID NO: 31711 - protein, 81 aa, Fukomys damarensis
QQGCVTFEDVAVYFSWEEWRLLDEAQRLLYFNVMLQNFALTSSLGCGHGLEDAETSSEQMVSVAVSQAQTFKSGPSIQKTC

SEQ ID NO: 31712 - protein, 81 aa, Chelonia mydas
PVTFEEVAVYFTQGQGALLDPAQRALYRDVMQETSETVTSLVSSPSPLDTQKCPGDRTVSENKEENQQQEGPGKVEPQERF

SEQ ID NO: 31713 - protein, 81 aa, Chelonia mydas
DKMPVTFEDVAVYFTEEEWALLDSSQRAFYADVMQENYENVTLLGFLISKPDMISQLEQGEEPWVPDLQDSEESRILKGAR

SEQ ID NO: 31714 - protein, 81 aa, Ovis aries
TSEPVSFADVAVYFSPEEWGYLRPAQRALYRDVMRETYGHLGALGFRGTKPALISWVEEEAELWRPDAEPPEMGECLTEAD

SEQ ID NO: 31715 - protein, 81 aa, Odocoileus virginianus
MEDAVTFTDVAVNFSQDEWEWLTLAQRTLYKKVMLENYSNLASLGLCVSKPDVISLLERDKEPWTAKGELTGGPCAGLCVS

SEQ ID NO: 31716 - protein, 81 aa, Vulpes vulpes
PKAENFAEVAAYFIPEEWGCLRPPPRPVCRDVIRETYSHLGALGSVSLPLAAPRPWAPWWAFEGPAAASQPAAPRPGPGQS

SEQ ID NO: 31717 - protein, 81 aa, Monodelphis domestica
SQESVTFQDVTVDFTQEEWCMLDCSQKKLYREVMLENVQNLLSVGLPVPRENLLSSCQQGDSPWLLEQKGTRIFRADAEIC

SEQ ID NO: 31718 - protein, 81 aa, Camelus dromedarius
LTFKDICVDFTQEEWKQLAPDHQNLYREVMLENYGHLVSVDLKSKTETSASTAKNDILQKQLNHGTMMGKFMRDDVMYSTW

SEQ ID NO: 31719 - protein, 81 aa, Myotis davidii
SQSLLTFEEVAVFFSQEEWELLDISQKTLYNDVMQENYETVTSLAIFVLPKPKVISCLEQAKEPWVQGSTEIMDSPGELPI

SEQ ID NO: 31720 - protein, 81 aa, Myotis davidii
GVTFEDIALYFSREEWSLLDEGQRQLYLNVMLENFELLSSLGIEPTNPAFFQSKNVISNSLVHGIMPNLLIHTGEKPYKCN

SEQ ID NO: 31721 - protein, 81 aa, Trichechus manatus
MVIEDVAVDFTPEEWALLDVAQRKLYRDVMMETFKNLASVGSGSRNLNDREKLSSEHLILRFKRNDSWSSVLGEICKLHGF

SEQ ID NO: 31722 - protein, 81 aa, Bos mutus
SRSLENDGVCFSEQEWENLEDWQKELYANVMKSNYETLVSLKVLGQPEGEMELGAEMPGDLEEEESRGVHPVEEVVVKQET

SEQ ID NO: 31723 - protein, 81 aa, Monodelphis domestica
TQESVTFQDVTVDFTQEEWCILDRSQKKLYREVMLENVQNLLSVGLPVPREDLISSCQQGESPWLLEQKGTRSFCPDAETS

SEQ ID NO: 31724 - protein, 81 aa, Trichechus manatus
KAEPVSFAEVAVYFSPEEWACLRPAQRALYRDVMRETYGHLGALGFRGTKPALISWVEEEAELWSPDAQDPEAGKDLIADT

SEQ ID NO: 31725 - protein, 81 aa, Myotis brandtii
MDSVSFEDVAVNFSLEEWALLESSQKKLYRDVMRETFRNLASIGSKWEDLDMEDQYKNQKRKQRSRMLERTCEGKMVSQCG

SEQ ID NO: 31726 - protein, 81 aa, Panthera pardus
SQISLTFEEVAMYFSQEEWELLNPTQKALYNDVMWDNYETVISLALFVLPKPKVISYLEQGEEPWVQGSTELKDSPGELPT

SEQ ID NO: 31727 - protein, 81 aa, Myotis brandtii
MNDSVAFEDVNVEFTMEEWAFLDPTQKKLYTDVMLETFWNLASVACILEEQCDDHDSEDQYENHWMHLSSHMVERLCTRKD

SEQ ID NO: 31728 - protein, 81 aa, Panthera pardus
RPGAVCFADVAVYFSPEEWGCLRPAQRALYRDVMRETYGHLGALGFRGTKPALISWVEEEADLWGPDALDPEVGECLTTAD

SEQ ID NO: 31729 - protein, 81 aa, Pteropus alecto
SKETVTFKDVAVTFTKEELGLLNSAQRKLYQDVMLENFRNLVSVGGKIQSEIKTIPEAGPCEELFCWQIWQQIASDLTRHQ

SEQ ID NO: 31730 - protein, 81 aa, Paroedura picta
GPFSFEEVSVSFTEAEWALLDPGQRALHREVMLENSGNVAFLEGRSIRESMVDTDNALKSEERMESSSGASQDHISFPSEL

SEQ ID NO: 31731 - protein, 81 aa, Paroedura picta
PFCLEDVSISFTEVEWALLDPGQRALYREVMLENSGHVAFLAEDDQRNEEGEKPQKQIPARVKNEDFKENIRNQSRSKRKI

SEQ ID NO: 31732 - protein, 81 aa, Paroedura picta
KTVISFQEVAVEFTEAEWALLDPGQRALHWEVMLENYGSVASLGDHEGNEKEEELHHLSPGEIKNEDLSGNFRNRGSGEML

SEQ ID NO: 31733 - protein, 81 aa, Paroedura picta
GPFSFEEVAVSFTEAEWALLDLGQRALYKEVMRENSGNVASLGDISKTLVEKNKDLKSEERPESFLGSSRIHIAFTDELTA

SEQ ID NO: 31734 - protein, 81 aa, Lithobates catesbeianus
QHGLSPTSVPPPYFWKPDVKYKQKILEVTRKIIELLTGEVPIRCQDVTVYFSMEEWEYLEGHKDLYKGVMMDNQPPLTSPG

SEQ ID NO: 31735 - protein, 81 aa, Paroedura picta
QPPFSFEEVAVSFSEAEWALLDPGQRALYGEVMLENYGSVASLEPQDVRETVVETDKGLAPKESLWSFSNGSPESTSFPDE

SEQ ID NO: 31736 - protein, 81 aa, Paroedura picta
FSFEEVAVYFTEVEWALLDPGQRAFYAEVMLENYGSVASLAEDVKETVEEFEGLLVKRDEEEESGCGFWDRDGPERQEGSP

SEQ ID NO: 31737 - protein, 81 aa, Microcaecilia unicolor
QVPVTFEDITVYFSREQWEYLDEGQKELYREVMKENYETLISLGTGPEGFNPEVLARIKLEEESHVWDPKEPGQKEVTRSY

SEQ ID NO: 31738 - protein, 81 aa, Pipra filicauda
PKVPVAFNDASFSFSEEEWKSLNEWQKELYRHIMKGNYEAVISMDAAISKPDMLSRIEQGEDPNAEEQEDSEAGESPTDPS

SEQ ID NO: 31739 - protein, 81 aa, Cricetulus griseus
ALLGLEDMAVNFTLEEWALLGSSQKKLYNTVMKETFSNLISIELRLLRKTVDMNVIVSVMRTRSLFWRTRLHKSPPYIKET

SEQ ID NO: 31740 - protein, 81 aa, Cricetulus griseus
LEEMLSSWNAFIDYSPEESEYLDPAQWSLYRDVMLENYSNLLFLGLAVPKPHLVTFLEQRQEPSDVKRQAAATVYPGTLPN

SEQ ID NO: 31741 - protein, 81 aa, Cricetulus griseus
ENYNMDAVIYDDVYINFTQEEWAFLDPSEKRLCKDVTLDTYRNLIDIGYSWEDHNIEENFHIGRLMKLLCDSTVDEFTGEK

SEQ ID NO: 31742 - protein, 81 aa, Mesocricetus auratus
SQGLLTFRDVTVDFSQEEWECLDSAQRSLYINVMLENYNNLVFVENYCKCDPVHHHVKTEKESCQCDELDKVLHDPSTCAL

SEQ ID NO: 31743 - protein, 81 aa, Fukomys damarensis
VSRALENDGVCFSEQEWENLADWQKELYRNVMQSNYEALVSLKVLGQPEGEAELGAEMLGDLEEEGLVGTHPADGTMLRPE

SEQ ID NO: 31744 - protein, 81 aa, Chrysochloris asiatica
SQGLVTFEDVAVYFSLEEWDRLDTCQRDLYKDVMQENYGILVSLGYPIPKPDLIFRLEQGEDPWVPDSPRPEEGDIVTGVY

SEQ ID NO: 31745 - protein, 81 aa, Chrysochloris asiatica
VPVTFDDVAVYFSEQEWGKLDEWQKELYKHVMRGNYETLVSLDYAISKPDILTWLERGEEPCSEVQWGQEKEMVHPREPVS

SEQ ID NO: 31746 - protein, 81 aa, Monodon monoceros
SSSAMQLGVPRARPGIRDAAPSPLRSQNPMAAALRDPPQGGVTFPDVAVRFSWGEWKLLDEAQRRLYLSVTLDIYALISSL

SEQ ID NO: 31747 - protein, 81 aa, Myotis davidii
QSEMNFEDVAITFSQEEWGLLDEAQRLLYCDVMLEIYALAASLGCWHNLANEEAPSAHSVSVEGESQVRASETVPAARRTH

SEQ ID NO: 31748 - protein, 81 aa, Myotis brandtii
FQSAVTFGDVDVAFSQEEWGRLSCAQKALYRDVMLENYRNLVSLGLCLSKPDVISSLEQRTEPCMAKNGLTGGRCPRAKQT

SEQ ID NO: 31749 - protein, 81 aa, Geotrypetes seraphini
VTFEDITVAFSQEEWEYLDEGQKELHREVMKENYEILKSLGKNDPKNNHWKLSEKPEGVKMLSEAEKMNWGEKEKNQNPKY

SEQ ID NO: 31750 - protein, 81 aa, Alligator sinensis
GPVTLEEVAVCLPEGKQALLDSSQRVLCRDVMLENNETLVSLGNETVKENKAENPQLCCWGHAELPGTALGRAEGNVHQCP

SEQ ID NO: 31751 - protein, 81 aa, Alligator mississippiensis
GPVTLEEVAVCLPEGKQALLDSSQRVLCRDVMLENNETLVSLGNETVKENKAENLQLCCWGQAELPGTALGRAKGNVHQCP

SEQ ID NO: 31752 - protein, 81 aa, Lepidothrix coronata
PKVPVTFDDVSVYFNDKEWEKLEEWQKELYKNVMKGNYESLISLDYAISKPGVLSQIEQGEESRGRSEQDLEESEIITDAT

SEQ ID NO: 31753 - protein, 81 aa, Paroedura picta
FSLEEVSVSFTEAEWALLDPGQRALYKEVMLENSGHVAFLDSFQEFKTVIIALRSSQEVLRIKSGDTSIFAEDDQRNEEDE

SEQ ID NO: 31754 - protein, 81 aa, Thamnophis sirtalis
RQDVVSFEEVAVYFSNEEWSQLDADQKALHGEVMLENSRNLFSLGYNGQKNKNCKQECQAIHSKWGERKFEDQMQPKNDET

SEQ ID NO: 31755 - protein, 81 aa, Pogona vitticeps
KVPMSFDEVSSVYVSEQEAGSLEKWPRELYKKNVAKGNCESLLSMDYTIAKPDLLSRVEGGEDPPCVVDQGRSEEEEAPGD

SEQ ID NO: 31756 - protein, 81 aa, Pogona vitticeps
AEGSVPLNDVAGALDNTEWSTLNPTQGTMHWEVMQENSEDISSLGGFVIPKPEAVSQMEQGEMAFPQDSEAHEVFPGSISD

SEQ ID NO: 31757 - protein, 81 aa, Chelonia mydas
FNGPVTSEAVAVYFTREEGALVDPTQRALYRDIMQENYENVTSLAFPVSKPDVISQLEQGEEPWVPHQQGSEKRVILRGPC

SEQ ID NO: 31758 - protein, 81 aa, Phascolarctos cinereus
FQGSVTFEDVAVYFTPEEWRQLDPTERSLYAKVMLENFCNVASLGGLPLFKPELICQLEQGKAPWVLDPLGGPESSSRKAC

SEQ ID NO: 31759 - protein, 81 aa, Camelus ferus
EELPVVFEDVAVYFTREEWGVLDKRQKELYRDVMRMNYELLASLGPAAAKPDLISKLERRAAPWIKDPNGPKWGKGRVPAC

SEQ ID NO: 31760 - protein, 81 aa, Myotis brandtii
VQESLTFHDVAVDFTWEEWQLLGPEQKDLYTDVMLETYSHLVSVGCEASKPDLLSKLGNGEAPWTVAGEIHCGTRSEICKH

SEQ ID NO: 31761 - protein, 81 aa, Myotis brandtii
FQRPLSFLDVCVHFTWEEMQLLDPAQKHLHRSVMLENYSNLVSVGYQHTKPDIILQLEQEELRVVQDRILSHSHPDRRPAR

SEQ ID NO: 31762 - protein, 81 aa, Aythya fuligula
PKVPVAFSDASFSFSEEEWKNLNEWQKELYRHIMKGNYEAVISMDTAISKPDLLSRIEQGEDPNTEDQDDSEGGETPTDPS

SEQ ID NO: 31763 - protein, 81 aa, Paroedura picta
ASDSCRERQLLLVAAMEQYVLLDPRQRALYRDVMQESYETLMALEFPLSKPDLLSQLDRGNEATLDLQEPGAVPPAVRKNI

SEQ ID NO: 31764 - protein, 81 aa, Alligator sinensis
MEILEAFEDVAVYFTREEWELLEDESKGLYRDQMLRNYQALVSLGYRGPVPDLICCIQQEKVELWVCAEEHHGEISRWEDL

SEQ ID NO: 31765 - protein, 81 aa, Paroedura picta
AFSFEEVAVSFTEAEWALLDLGQRALYREVMLENYGSVASLGAKSIRETTVGKDNGLASEERLESFSRCSQEHISFPQELA

SEQ ID NO: 31766 - protein, 81 aa, Paroedura picta
QYPFSFEEVAVCFTEAEWALLDPGQRALYREVMLEIFRSVASLAKETIEEFKEFSLKIEDEEESECNFLDGAGPERQEGSP

SEQ ID NO: 31767 - protein, 81 aa, Paroedura picta
VQGPFSLEEVSVSFTEAEWALLDPGQRALHAEVMREISQDLAFLAEESRSTREILVEADKGLAGQEYLENPSRGSRGQVSS

SEQ ID NO: 31768 - protein, 81 aa, Chelonia mydas
LMSAGPLTFEEVAVYFTREEGALLDPIQRTLYRDVMQENYETVAFLVPKPDVISQLEQGEEPWVPDLQGSEKEVLLRAACT

SEQ ID NO: 31769 - protein, 81 aa, Thamnophis sirtalis
NDVPVAFGDVAICFSAEEWAALAGWQKDLYRDVMAENFQLVSSLECLLAIPELLSQLARGEVPQIDAGPPPAQDGECPVGR

SEQ ID NO: 31770 - protein, 81 aa, Chelonia mydas
QVPVSFEEVAVFFSQEEWGLLDEGQRQLYRDVMQENYQALISLAHPHWCQALPMCRVREELPPQGAPDGKSFGKSSEFIKP

SEQ ID NO: 31771 - protein, 81 aa, Pteropus alecto
ESVTFKDVAVDFTQEEWGQLDSPQRALYRDVMLENYQNLLALEWEPRPEMKEESCQQQVIYKEEPWQASITEWLARSSLSP

SEQ ID NO: 31772 - protein, 81 aa, Phascolarctos cinereus
SQESVTFKDVAVNFTQEEWQQLNPAQRDLYKDVMLENYRNLISLGLPISKPDVIFQLEQGEEPWILDLQGSEEKAVLRNTS

SEQ ID NO: 31773 - protein, 81 aa, Myotis davidii
LKEEVTFQDVAVVFTEEELALLDPSQRKLYRDVMLENFRNLVSVGGKIHYEMETLTELEPHEELSCWQIWQQIASDLIRSQ

SEQ ID NO: 31774 - protein, 81 aa, Tupaia chinensis
FQEFVTFEDVAVHLTREEWGCLDSVQRDLYREVMLENYGNVVSLGFPISKSDGFSQLERDLQVFDLETKNREGLKDDCSDG

SEQ ID NO: 31775 - protein, 81 aa, Pteropus alecto
LQESLTFDDVAVDFTWEEWQLLAPAQKDLYRDVMSENYSNLVSVGCQARKPDRLSRLDQGEPPWTMADEVHSRSRSGIWKV

SEQ ID NO: 31776 - protein, 81 aa, Pogona vitticeps
QALMTFEEVAVNFTREEWALLDPDQRSLHRDVMAENHQTMASLTDQESYAREEPYISTMSGTRFAEDVARPLHERLHTANF

SEQ ID NO: 31777 - protein, 93 aa, Homo sapiens
VAFEDVAVNFTQEEWALLGPSQKNLYRYVMQETIRNLDCIRMIWEEQNTEDQYKNPRRNLRCHMVERFSESKDSSQCGETFSLIRDSIVNNSI

SEQ ID NO: 31778 - protein, 110 aa, Homo sapiens
VTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLEC

SEQ ID NO: 31779 - protein, 87 aa, Homo sapiens
VAFEDVAVNFTQEEWALLDPSQKNLYREVMQETLRNLTSIGKKWNNQYIEDEHQNPRRNLRRLIGERLSESKESHQHGEVLTQVPDD

SEQ ID NO: 31780 - protein, 83 aa, Mus musculus
LTFRDVTVDFSQEEWECLDSAQRALYIEVMLENYSNLVYVENYCICDTVCQHVKTEKESCNELGEMLHEPSNCALYNRSDTTE

SEQ ID NO: 31781 - protein, 87 aa, Homo sapiens
VAFEDVSVSFSQEEWALLAPSQKKLYRDVMQETFKNLASIGEKWEDPNVEDQHKNQGRNLRSHTGERLCEGKEGSQCAENFSPNLSV

SEQ ID NO: 31782 - protein, 83 aa, Homo sapiens
VAFEDVAVNFTQEEWSLLDPSQKNLYREVMQETLRNLASIGEKWKDQNIEDQYKNPRNNLRSLLGERVDENTEENHCGETSSQ

SEQ ID NO: 31783 - protein, 114 aa, Pongo abelii
VTFEDIAVYFSQEEWGLLDEAQRCLYHDVMLENFLLMASVGCLHGIEAEEAPSEQTISAQGVSQARTPKLGPSIPNAHSCEMCILVMKDILYLTEHQGTLPWQKPYTSVASGKW

SEQ ID NO: 31784 - protein, 100 aa, Mus musculus
MAMYLTREEWRPLDPTQRDLYRDVMQENYGNVVSLDFEIRSENEANPKQEFSDDVEFATMSEEPLENAEKNPGSEEAFESGDQAERPWGDLTAEEWVSYP

SEQ ID NO: 31785 - protein, 94 aa, Homo sapiens
VAFEDVAVNFTQEEWALLDPSQKNLYRDVMQETFRNLASIGNKGEDQSIEDQYKNSSRNLRHIISHSGNNPYGCEECGKKPCTCKQCQKTSLSV

SEQ ID NO: 31786 - protein, 85 aa, Homo sapiens
LSFSDVAIEFSQEEWKCLDPGQKALYRDVMLENYRNLVSLGEDNVRPEACICSGICLPDLSVTSMLEQKRDPWTLQSEVKIINNP

SEQ ID NO: 31787 - protein, 84 aa, Homo sapiens
VTFEDVAIYFSQEEWGLLDEAQRLLYRDVMLENFALITALVCWHGMEDEETPEQSVSVEGVPQVRTPEASPSTQKIQSCDMCVP

SEQ ID NO: 31788 - protein, 87 aa, Homo sapiens
VAFEDVDVNFTQEEWALLDPSQKNLYRDVMWETMRNLASIGKKWKDQNIKDHYKHRGRNLRSHMLERLYQTKDGSQRGGIFSQFANQ

SEQ ID NO: 31789 - protein, 114 aa, Homo sapiens
VTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKW

SEQ ID NO: 31790 - protein, 87 aa, Homo sapiens
VAFEDVAVNFTHEEWALLGPSQKNLYRDVMRETIRNLNCIGMKWENQNIDDQHQNLRRNPRCDVVERFGKSKDGSQCGETLSQIRNS

SEQ ID NO: 31791 - protein, 96 aa, Homo sapiens
VIFEEVAVNFTPEEWALLDHAQRSLYRDVMLETCRNLASLDCYIYVRTSGSSSQRDVFGNGISNDEEIVKFTGSDSWSIFGENWRFDNTGDQHQIP

SEQ ID NO: 31792 - protein, 94 aa, Homo sapiens
MVFEDVAIHFSQEEWGILNDVQRHLHSDVMLENFALLSSVGCWHGAKDEEAPSKQCVSVGVSQVTTLKPALSTQKAQPCETCSSLLKDILHLAE

SEQ ID NO: 31793 - protein, 83 aa, Homo sapiens
LTFKDVAVVFTEEELGLLDPVQRNLYQDVMLENFRNLLSVGHHPFKHDVFLLEKEKKLDIMKTATQRKGKSADKIQSEVETVP

SEQ ID NO: 31794 - protein, 104 aa, Homo sapiens
VSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRP

SEQ ID NO: 31795 - protein, 94 aa, Homo sapiens
VAFEDVAVNFTQEEWALLGPSQKSLYRNVMQETIRNLDCIEMKWEDQNIGDQCQNAKRNLRSHTCEIKDDSQCGETFGQIPDSIVNKNTPRVNP

SEQ ID NO: 31796 - protein, 88 aa, Mus musculus
VTYDDVHVNFTWEEWALLDPSQKDLYRDVMLETYRNLAAIGYYWKGHNISEGHFQNSRRNGRHERSDTEEKLSEFTQYDKDFAYQSHP

SEQ ID NO: 31797 - protein, 87 aa, Homo sapiens
VTFEDVAVTFTQEEWGQLDVTQRALYVEVMLETCGLLVALGDSTKPETVEPIPSHLALPEEVSLQEQLAQGVPRYSYLGQAMDQDGP

SEQ ID NO: 31798 - protein, 83 aa, Homo sapiens
VAFDDVAVNFTQEEWALLDISQRKLYKEVMLETFRNLTSVGKSWKDQNIEYEYQNPRRNFRSLIEKKVNEIKDDSHCGETFTQ

SEQ ID NO: 31799 - protein, 91 aa, Mus musculus
VTFEDVAVDFTQEEWQYLNSPQRTLYRDVMLETYSNLVSVCEVASIGSEDQGGISHLSSLEQQVTKPDLIIKLEVEEPDPEDGEIPVWSFP

SEQ ID NO: 31800 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTARHSV

SEQ ID NO: 31801 - protein, 87 aa, Homo sapiens
VAFEDVAVNFSQEEWSLLSEVQRCLYHDVMLENWVLISSLGCWCGSEDEEAPSKKSISIQRVSQVSTPGAGVSPKKAHSCEMCGAIL

SEQ ID NO: 31802 - protein, 83 aa, Homo sapiens
VALEDVAVNFTREEWALLGPCQKNLYKDVMQETIRNLDCVGMKWKDQNIEDQYRYPRKNLRCRMLERFVESKDGTQCGETSSQ

SEQ ID NO: 31803 - protein, 87 aa, Pongo abelii
VAFEDVDVNFTQEEWALLDPSQKNLYRDVMWETMRNLASVGKKWKDQNIKDHYKHRGRNLRSHMLERLYQTKDSSQRGGIFSQFANQ

SEQ ID NO: 31804 - protein, 94 aa, Homo sapiens
MVFEDVAIYFSQEEWGILNDAQRHLHSNVMLENFALLSSVGCWHGAKDEEVPSKQCVSVRVLQVTIPKPALSTLKAQPCKMCSSILKDILHLAE

SEQ ID NO: 31805 - protein, 87 aa, Homo sapiens
VAFEDVAVNFTQEEWALLGPSQKSLYRDVMWETIRNLDCIGMKWEDTNIEDQHRNPRRSLRCHIIERFSESRQPDSTVNEKPPGVDP

SEQ ID NO: 31806 - protein, 84 aa, Homo sapiens
VTFEDVAVYFSQEEWELLDAAQRHLYHSVMLENLELVTSLGSWHGVEGEGAHPKQNVSVEVLQVRIPNADPSTKKANSCDMCGP

SEQ ID NO: 31807 - protein, 87 aa, Homo sapiens
VAFEDVAVNFTQEEWALLDSSQKNLYREVMQETCRNLASVGSQWKDQNIEDHFEKPGKDIRNHIVQRLCESKEDGQYGEVVSQIPNL

SEQ ID NO: 31808 - protein, 110 aa, Homo sapiens
VTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQ

SEQ ID NO: 31809 - protein, 83 aa, Homo sapiens
VTFEDVAVYFSWKEWGLLDEAQKCLYHDVMLENLTLTTSLGGSGAGDEEAPYQQSTSPQRVSQVRIPKALPSPQKTNPCEICG

SEQ ID NO: 31810 - protein, 83 aa, Homo sapiens
VALEDVAVNFTREEWALLGPCQKNLYKDVMQETIRNLDCVVMKWKDQNIEDQYRYPRKNLRCRMLERFVESKDGTQCGETSSQ

SEQ ID NO: 31811 - protein, 83 aa, Homo sapiens
VAFKDVAVNFTQEEWALLDISQKNLYREVMLETFWNLTSIGKKWKDQNIEYEYQNPRRNFRSVTEEKVNEIKEDSHCGETFTP

SEQ ID NO: 31812 - protein, 87 aa, Homo sapiens
VSFEDVAVAFTQEEWALLDPSQKNLYRDVMQEIFRNLASVGNKSEDQNIQDDFKNPGRNLSSHVVERLFEIKEGSQYGETFSQDSNL

SEQ ID NO: 31813 - protein, 87 aa, Pongo abelii
VAFKDVSVSFSQEEWALLAPSQKKLYRDVMQETFKNLASIGEKWEDPNVEDQHRNQGRNLRSHMGERLCEGKEGSQCAETFSPNLSV

SEQ ID NO: 31814 - protein, 83 aa, Homo sapiens
VACEDVAVNFTQEEWALLDISQRKLYREVMLETFRNLTSIGKKWKDQNIEYEYQNPRRNFRSLIEGNVNEIKEDSHCGETFTQ

SEQ ID NO: 31815 - protein, 90 aa, Bos taurus
VMFRDVAIDFSQEEWDCLDSAQRDLYRDVMLENYSNLVSLDLPSRGANKLLSPKKDIYETGLSQWEMSARLENCDLENSSSRDYLEVKGT

SEQ ID NO: 31816 - protein, 104 aa, Homo sapiens
VTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCS

SEQ ID NO: 31817 - protein, 87 aa, Macaca fascicularis
VTFDDVAVDFTPEEWALLDTTEKYLYRDVMLENYMNLASVEWEIQPRIKRSSFQQGFLKNQIFSGIQMTRGYSGWKLCDCKNCGEVF

SEQ ID NO: 31818 - protein, 83 aa, Homo sapiens
VAFKDVAVNFTQEEWALLDISQRKLYREVMLETFRNLTSLGKRWKDQNIEYEHQNPRRNFRSLIEEKVNEIKDDSHCGETFTP

SEQ ID NO: 31819 - protein, 83 aa, Homo sapiens
FTFKDVAIEFSQEEWECLDPAQRALYRDVMLENYRNLLSLDEDNIPPEDDISVGFTSKGLSPKENNKEELYHLVILERKESHG

SEQ ID NO: 31820 - protein, 82 aa, Homo sapiens
VTFEDVAVEFIQEWALLDSARRSLCKYRMLDQCRTLASRGAGAVPEDAAGALHRREGDTIDSRGPASSPGAALVSGMHGTEG

SEQ ID NO: 31821 - protein, 100 aa, Homo sapiens
VNFEDVFVYFSQEEWVLLDEAQRLLYRDVMLENFALMASLGIPQTMAAFGLKYLLNDTGYTSSKSNTITATDSPADLPRKPEPHTPSWSWKKQAMSIRTV

SEQ ID NO: 31822 - protein, 96 aa, Homo sapiens
VTFEDVAVHLTREEWGYLDPVQRDLYREVMLENYGNVVSLGILLRLPTTRIHSVNSCPALSHTQASAFSGETLAVLTAGISKRWPKYRLPIDIARP

SEQ ID NO: 31823 - protein, 106 aa, Homo sapiens
VTFGDVAVHFSREEWQCLDPGQRALYREVMLENHSSVAGLAFSDPTLWFGYLCPCFPRDGNLWAWPSRGAAAFPGFLVFKPELISRLEQGEEPWVLDLQGAEGTEA

SEQ ID NO: 31824 - protein, 96 aa, Homo sapiens
VVFEEVAVNFTPEEWALLDHAQRSLYRDVMLETCRNLASLDCYIYVRTSGSSSQRDVFGNGISNDEEIVKFTGSDSWSIFGENWRFDNTGDQHQIP

SEQ ID NO: 31825 - protein, 83 aa, Homo sapiens
REDPGTSESQEMEEWALLDISQRKLYKEVMLETFRNLTSVGKSWKDQNIEYEYQNPRRNFRSLIEKKVNEIKDDSHCGETFTQ

SEQ ID NO: 31826 - protein, 89 aa, Homo sapiens
LTFRDVAIEFSQAEWKCLDPAQRALYKDVMLENYRNLVSLGSSYALGSNAEDKPIKKQLGVSFHLHLSELELFPDERVINGCNQVENFI

SEQ ID NO: 31827 - protein, 85 aa, Homo sapiens
VAFEDVAVNFSQEEWSLLSEVQRCLYHDVMLENWVLISSLGCWCGSEDEEAPSKKSISIQRVSQNVRLSAQAGVARSQLTAASTS

SEQ ID NO: 31828 - protein, 86 aa, Homo sapiens
VVFEDVAVNFTQEEWALLGPSQKKLYRDVMQETFVNLASIGENWEEKNIEDHKNQGRKLRSHMVERLCERKEGSQFGETISQTPNP

SEQ ID NO: 31829 - protein, 85 aa, Homo sapiens
VVFEDVAIYFSQEEWGHLDEAQRLLYRDVMLENLALLSSLGFIAVAAMLMDAGQDYMVFEDVAIHFSQEEWGILNDVQRHLHSDV

SEQ ID NO: 31830 - protein, 82 aa, Homo sapiens
AVAVNFSQEEWCLLSEAQRCLYRDVMLENLALISSLDCPLHLCQFPDLSPCWRVCLDKPYLFLRPAALRWVKEWNVCASAKA

SEQ ID NO: 31831 - protein, 103 aa, Homo sapiens
VTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGEC

SEQ ID NO: 31832 - protein, 82 aa, Homo sapiens
VTFEDVALYLSREEWGRLDHTQQNFYRDVLQKKNGLSLGAVEVGQRVQTSSVAALGNVKPFRTRAGRVQWGVPQCAQEAACG

SEQ ID NO: 31833 - protein, 85 aa, Homo sapiens
VTFEDVAVNFSLEEWSLLNEAQGCLYHDVMLETLTLISSLKGCTRQQFCNRSTLNKEDRVIYNLRRSPSCRFPLPGTGPHILYVS

SEQ ID NO: 31834 - protein, 85 aa, Homo sapiens
MASPSPPPESKEEWDYLDPAQRSLYKDVMMENYGNLVSLGLTLLPRLVCSDANTACCSLNLLGLSDQSSHLSYLSSWDYRCFEQR

SEQ ID NO: 31835 - protein, 84 aa, Homo sapiens
VTFRDVTVIFTEAEWKRLSPEQRNLYKEVMLENYRNLLSLDGVSLLLPRLECNRAISAHHNLCLPGSSNSPATASRVVGITAEP

SEQ ID NO: 31836 - protein, 94 aa, Homo sapiens
VTFEDVAVNFTQEEWALLGPSQKSLYRNVMQETIRNLDCIEMKWEDQNIGDQCQNAKRNLRSHTCEIKDDSQCGETFGQIPDSIVNKNTPRVNP

SEQ ID NO: 31837 - protein, 90 aa, Homo sapiens
VSFKDVTVGFTQEEWQHLDPSQRALYRDVMLENYSNPVSVGYCDHLKERSQENQSKHLWEVVFINNEMLTKEQGNVIGIPFNMDVSSFPS

SEQ ID NO: 31838 - protein, 83 aa, Homo sapiens
VTFRDVAVTFTKQEWRKLDPGQKNLYRDVMLENYQSLVSLGRKVLKPFGLLPWLQDLFTISPKLEQGEEPWVNYTPFNSLVFP

SEQ ID NO: 31839 - protein, 91 aa, Myotis brandtii
VAFEDVAVKFTLEEWSLLDPSQKKLYRDVMRETFRNLASIGMHLEKKWEDHNIEYQYKTQGRKLRSDMVEKLHESKGGSQCGETISQIPNP

SEQ ID NO: 31840 - protein, 94 aa, Colobus angolensis
MVFEDVAIHFSQEEWGILNDVQRHLHSDVMLENFALLSSVGCWHGAKEEEAPSKQCVSVGVSQITTLKPALCTQKAQPCETCSSLLKDILHLAE

SEQ ID NO: 31841 - protein, 82 aa, Kineothrix alysoides
KKISDKRLDFITKSWKLQDDCQKKMYNNAIPKQYQMLLNASCILIPLFKQKNDLLKPKNLSSLNAFASIWCCIENIFLAATA

SEQ ID NO: 31842 - protein, 84 aa, Mus musculus
MTYADVHVNFTWEEWALLNPSQKSLYKEVMLETYENLTAIGYNWEDHYIEEQFQSSRRDGRHKRGHTGEKPYECNHCGTAFARH

SEQ ID NO: 31843 - protein, 84 aa, Mus musculus
LTYDDVYVNFTQEEWALLNPSQKSLYKDVMLETYRNLIAVGYNWEDHNIEEHCQSSRRHGRNERILTGENPYEGIQCGEAFVHH

SEQ ID NO: 31844 - protein, 84 aa, Rattus norvegicus
LTFRDVTVDFSQEEWECLGSDQRALYMDVILENYNNLVFVENHRISGKNEKILYQGTKHIVHQHVNIQEKSYKCNKFGKMVHES

SEQ ID NO: 31845 - protein, 87 aa, Rattus norvegicus
LTFKDVAVDFSQEEWECLDCAQRALYMDVMLENYNNLFYVGNHCMCHKYENILDQGIQHIVPQHVNIQVKSDKCYEFGNTIHESTQS

SEQ ID NO: 31846 - protein, 85 aa, Rattus norvegicus
VNYDDVHVNFTWEEWALLDPSQKSLYKDVMLETYRNLAAIGTKEVILKRNFLNLRSMIKTLHIRVILKDMKEFILERNLMKVSNI

SEQ ID NO: 31847 - protein, 93 aa, Mus musculus
VTYKDVHVNFTQEEWALLDPSQKKLYKDVMLETYRNLIAIGFNWDDKNIEEHCQSFGRHTRHERIQSAEKPSEYTQGGKAFALHAHSHAQRHE

SEQ ID NO: 31848 - protein, 83 aa, Mus musculus
VAFEDVAVNFSLEEWAMLNPSQKNLYKDVMQETLRNLASIGSSLEHHIIENIYRNSWKRLSGQVVEGLYDCKDDHQCAEIFDF

SEQ ID NO: 31849 - protein, 85 aa, Rattus norvegicus
LSFTDVAIDFSPEECECLEPAQWNLYKEVMLENYSNLLFLGSKAHKCKECGKAFDRNSVLIQHQRIHTGERPYKCEECGMAFTVR

SEQ ID NO: 31850 - protein, 95 aa, Mus musculus
VSFEDVAVHFTQDEWALLDSSQKSLYRDVMLEICRSLATIGNRWEEENVEDHYKNPWRNMSGSMSETPCERTEDDQVEETLTWISNLHASMTVFP

SEQ ID NO: 31851 - protein, 84 aa, Rattus norvegicus
VTYEDVYVSFTQEEWALLNPSQKNLYKDVMMQTCRNLIAIGYKWNSQNIEEHCQSSGKHERDIICHSGYKPFEHKDYGKMQFTS

SEQ ID NO: 31852 - protein, 96 aa, Mus musculus
VTFKDVAVVFTKEEFRLLDSAQRTLYQDVMVENFRNLLSVGINGQSARGAVRGRGSPEALPCWQIWQWVTDDLTTSQNSVVNTPQLQGKAPCQSRP

SEQ ID NO: 31853 - protein, 93 aa, Octodon degus
VTFEDVTVNFTKEEWALLTPSQKKLYRDVMQETFRNMTAVGRSWDNQQFEEEYKDITRNLRNEEVAKCDLYESWIQQEEVFLWTPDANVGMKQ

SEQ ID NO: 31854 - protein, 86 aa, Fukomys damarensis
VTFEDVAVNFSMEEWALLDPSQKKLYRDVMWENFRNVTAIGRNWNDQRMEDEFRNYRKSLRSAEVDKCYQYKLWYQHRELAPDTNV

SEQ ID NO: 31855 - protein, 87 aa, Paroedura picta
ITLEDVTVSFTEKEWALLEAREKDLYWEIMQHNYDNVASLENSPRKAENNPVKKNPENSSKPKTPERVERQSTSCSLSKGLPRKAEA

SEQ ID NO: 31856 - protein, 88 aa, Paroedura picta
VSFEEVAVYFTWGEWALLSPAQKVLYKEVMLENFGIVASLGETTEMPEMQKKLWKEMINYIKKTNYVSNFGVGDECYEYHGQPKLPTR

SEQ ID NO: 31857 - protein, 85 aa, Paroedura picta
VTFEDVAIYFSRQEWAELTGWQKALYWEVMEELYCQLARKLPGRATEGVHRVTSPRPYSGSHDGRPPPKTPAWVRLRRTSLPGEP

SEQ ID NO: 31858 - protein, 89 aa, Lithobates catesbeianus
IRCQDVTVYFSMEEWEYLEGHKDLYKDVMMENQLPLTSPDGSSNGNPPERCPRPLYSRDSLWEDHNYVHHDQNEELKDIKVEIKEEEEE

SEQ ID NO: 31859 - protein, 89 aa, Podarcis muralis
LCFEDVTIRFTDEEWAFLDPDQRALHQDVMEETRGILTGLTAQNVLHLGRIFLNIQESCFFVLSDFRFLLRHGRRNVCIFRWFILLNIQ

SEQ ID NO: 31860 - protein, 85 aa, Podarcis muralis
ASFEDVAVNFTEEEWALLDADQRALHKEVMEETCGIMDSLGEAPRCIFILKTIILYVMKTHFSPSKNEGEMCVRLMGRMQAFAEA

SEQ ID NO: 31861 - protein, 89 aa, Terrapene carolina
VTFEEVAVYFTQGQGALLDPAQRALYRDVMQENHETVTSLGKGFLGPQLLEAVGSACLNLVSCPALPPPLPQAHRIPTPPPISQRFSPS

SEQ ID NO: 31862 - protein, 88 aa, Lithobates catesbeianus
IRCQDSTLLFSMEEWECLGGHKDLYKHVMMKNRPPLTSPDGSSLYPPERCPHPLYSRDSTQEHQEIPQKDQNEEPYLRVDEQWREEKA

SEQ ID NO: 31863 - protein, 89 aa, Lithobates catesbeianus
IRCQDVTVYFSMEEWEYLEGHKDLYKDVMMENQPPLTSPDGSSNGNPPETCPRSLYSQVSTQEEHEIPHHHQGKDLIDMKVEIKEEEES

SEQ ID NO: 31864 - protein, 98 aa, Lithobates catesbeianus
IRCQDVTVYFSMEEWEYLEGHKNLYKDVMMEDHHTLADSAAERWLLLLFFLPAFVLLQRETYKGSVPVAIGVNWKITIVCLLRSKWDRSYQNEDLPKP

SEQ ID NO: 31865 - protein, 107 aa, Lithobates catesbeianus
IRCQDVTVYFSMEEWEYLEGHKDLYKDVMLENQPPLTSPDGTSNGNPPERCPHSLYSLDSTQEDQNISEDHQEEELFIIKVEDEENPYLRGDEPWKEKEIPPEISTD

SEQ ID NO: 31866 - protein, 85 aa, Gopherus agassizii
VTFEEVAVYFTREEWALLDPAQRALYWDVMQENYETVVLLGKESCLLETRREHQKLPRCREVVPAESNGTKGRGVGRKGTQEVDW

SEQ ID NO: 31867 - protein, 87 aa, Phasianus colchicus
LLFAQVAVYFSREEWALLDPAQRALYRDVMLETYQCVASLGEVTKETQRSMSFMGAYCVQHSDKSPRVSVGKQASAMEGRTISLQTA

SEQ ID NO: 31868 - protein, 84 aa, Gopherus agassizii
VSFEEVAVYFTREEWALLDPAQRALYRAVMQENYENVTSPMSVSSPALRGNSPFLTTREQCSTLGEVRHKQECSDLINHEGIQT

SEQ ID NO: 31869 - protein, 85 aa, Gopherus agassizii
VTFEEVAVYFTEGQGALLDPSQRALYRDVMQENYETVTSLGKDLCLLFELQGTFFRRAEENFSQCLEQRKAWSNWHKSERKLGNC

SEQ ID NO: 31870 - protein, 84 aa, Gopherus agassizii
VTFEEVAVYFTSEEWALLDPTQRALYWDVMQENYENVTSLGKGYCPLSSWKGKWRVPRKQGCGKTFSCSSSLSVHQRIHTGERP

SEQ ID NO: 31871 - protein, 102 aa, Gopherus agassizii
PDFEEVAVYFTQGQGALLDPTQRALYRDVMQENYEMVTSLSKRFPSPWLLEAVGSACLNLVSWIAGEDCVVHSCSEREIFISIPPSREQESQKHNGRVNSSP

SEQ ID NO: 31872 - protein, 83 aa, Podarcis muralis
VCFEDVAVRFTDEEWALLDPDQRALHNDVMEENCGIMASLGKAPCGIIISPLWTASQHIYKNDSNPFLSPWQIVMNQKSRTKV

SEQ ID NO: 31873 - protein, 82 aa, Paroedura picta
FSLEDVSVSFSPAEWALLDPAQRALFKEVMVEISEKVAFLEEAGRKGGTLGETSYRFSSKGSLEPCPRGSQEQISSPNLLAE

SEQ ID NO: 31874 - protein, 88 aa, Podarcis muralis
MCFEDVAVHFTDEEWALLDLDQRALHKEVMEENCGIVASLSKAPLWIITSLWKFHTYLSVISLPDFEGALQGHLHLTSHQRIHSGEKP

SEQ ID NO: 31875 - protein, 83 aa, Podarcis muralis
LCFEDVAVRFTDEEWALLDPDQRALHNDVMEENYLLKMWFSKPLWIFFFSRHKYACQPNLLSKPSKSSKSVFFNFIHSFNQQR

SEQ ID NO: 31876 - protein, 86 aa, Podarcis muralis
VCFEDVAVRFTDEEWALLDPDQRALHKDVMEENRGIVASLGKVPCGIVISAWKFKKYVYGPTSYIFTELNSGPYNTWEPNTPTIKS

SEQ ID NO: 31877 - protein, 86 aa, Podarcis muralis
LCFEDVAVRFTDEESALLDPDQRALHKDVMEENCGILASLGKAPCGIILSAWKFKKYVYGPTSYIFTEFNSAPYNTWEPNTTTINS

SEQ ID NO: 31878 - protein, 85 aa, Paroedura picta
FSLEDVSVSVSEAEPSLLDPAQRALWRDVTLENSGNVAFLGARRIGENLVETKNSLVPKDKLESFSRGSQENISFPNGLAERDDQ

SEQ ID NO: 31879 - protein, 88 aa, Podarcis muralis
VTFEDVAMYFSNKEWALLSTRQKSLHREVTLENSWNVASLGKNGSPLQEGKKTYWPGINLHEVPVQEHNPKGKKRNICPVCGKHFSYK

SEQ ID NO: 31880 - protein, 83 aa, Paroedura picta
FSFEDVYVSFSEAEWALLDPGQRALHREVMLEIQKSMSFLARSIRETMGETHKDLASEERLERSLRGAREHLSFPDELAGTED

SEQ ID NO: 31881 - protein, 86 aa, Alligator sinensis
EAFEDLALFFTRKEWELLGDGDKVLYRDQMLRNYQALVSLADAWMESRAEQQHLREAPAYLELVPVRNQLPVQWAQKAAEPRKSPA

SEQ ID NO: 31882 - protein, 84 aa, Paroedura picta
VSLGDVSVSFSPAEWALLDPAQRALWREVMRENSGNVAFVEARTIGEALGETKKGPAFEESLESFPGGSQEQISSLNELAETED

SEQ ID NO: 31883 - protein, 82 aa, Paroedura picta
VSFEEVAVYFTMEEWALLDPYQKTLYRDVMLENYGIVVSLGCWGSMPIVIAWLKEEGDLQSSIEEAQSAESQKVREASTSEN

SEQ ID NO: 31884 - protein, 87 aa, Phasianus colchicus
PGEREVAVYFSREEWALLDPAQRALYRDVMLETYQCVASLGEGFAQGERFKKSLGNYPGKRARNPVGLSAGQQQPIDARKREVRWKK

SEQ ID NO: 31885 - protein, 95 aa, Paroedura picta
VSFEEVVVDFSEAEWALLDPAQRALYREVMLENYRSVAFLEASHVRDTTVETDRGLVSTKDLESFARGFPECILFPSDLAETGDHHREEEEEELH

SEQ ID NO: 31886 - protein, 90 aa, Paroedura picta
VTFEDVAVCFSPEEWSLLEGWQRELHQEVMGENCALLLSLGRAIPSGAFSSIIHQREGTVEGRRPRAAPSAGGDEEEPLIPEDVGEAEAP

SEQ ID NO: 31887 - protein, 90 aa, Paroedura picta
VSFVEVAVFFTREEWALLDPAQRALYWGVMRENYEMAASLEDGISGAEEGLASEVLESFLGRSQEDFPLTTELGDAPANERQGQPGEVSS

SEQ ID NO: 31888 - protein, 83 aa, Paroedura picta
VTFEEVHVYFTEEEWSLLGPDQRALYIEVMLENCGNVASLAGTVWEPKNEGEPYHDMSGGTRYIEREEQGWKTESEEQGDQPF

SEQ ID NO: 31889 - protein, 86 aa, Gopherus agassizii
VTFEEVAVYFTEGQGALLDPSQRALYRDVMQENYETVTSLGKDLCLLFEAMGSAFLNLVWVLLGRTLERRMGPIIHNYSGGHELNG

SEQ ID NO: 31890 - protein, 85 aa, Alligator sinensis
EVFEDVAVYFSRKEWELLEDEDKVLYRDQMLKNYQALVSLGKVLVLASSVRALKFIAFSLCFSSLVLMQFLGWGFNFPSSPLLCQ

SEQ ID NO: 31891 - protein, 82 aa, Paroedura picta
ISFEEVAVRFTNAEWGLLNLDQRALYREVMVENYGNVAWLGRGGDDGNYSERWAVSLVMSSCGGEEEPPWNPEQPKREGESQ

SEQ ID NO: 31892 - protein, 87 aa, Paroedura picta
VFFEEVAVFFTEEEWALLDPAQRALYWEVMRENYATVASLGFTPETEREGQPGGASSEREHDLQIQNWDRGGPQKQLKRKQGGKEKE

SEQ ID NO: 31893 - protein, 84 aa, Terrapene carolina
VTFEEVAVYFTREEGALLDPTQRALYRDVMQENYETVVLLGKESLVITLYLYSSYTFTSLYISPPNIIILTLDLRLPLITPLSV

SEQ ID NO: 31894 - protein, 89 aa, Lithobates catesbeianus
LSCRDVSVYFSMEEWEYLEGHKDLYKDVMMENQPPLTSPDGSSNGNPPERCPRPLYSPDSTQEDHTIPQLDQGKKLKGIKVEVKEEEEE

SEQ ID NO: 31895 - protein, 90 aa, Lithobates catesbeianus
IRCQDVTVYFSMEEWEYLEGHKDLYKDVMMENLQTLSFVKTERKEFPRNEKIMNLTLEVLSLLTREVGVMKGLNLTPLYTGMYSESLKVF

SEQ ID NO: 31896 - protein, 86 aa, Lithobates catesbeianus
IRCQDVTVYFSMEEWKYLEGHKDLYKDVMMETQRTLNDGKLRKDEAILDLTLEIIYLLTGEDCAKAIETSLENTTKRKSPRLSTRM

SEQ ID NO: 31897 - protein, 87 aa, Terrapene carolina
VTFEDVAVYFTQGQGALLDPAQRAIYRDVMWENYETRRSLSRPHTLIWSDVTPSTGFPLPKPDLITRVSENKEGNQQQEVPGHGELK

SEQ ID NO: 31898 - protein, 89 aa, Lithobates catesbeianus
IRCQDVTVYFSMEEWEYLEGHKDLYKDVMMENQPPLTSPDGSSNGNPPERCPRPLYSWDSTQEDHTIPHHHQHEEQMYVKVEVKEEEEE

SEQ ID NO: 31899 - protein, 82 aa, Lithobates catesbeianus
IRCQDVTVYFSMEEWEYLEGHKDLYKDVMMEEQPPLTSPSDLHNEVAEEVHLTIVKEENLSSMEHLSSSYISPPMDSPSYVF

SEQ ID NO: 31900 - protein, 88 aa, Lithobates catesbeianus
IRCQDVTVYFSMEEWEYLEGHKDLYMDLMMENQPPLTSPVHGRKMRKTSEDCLTLAPDCEVEDEDITQYSPGENPATSDVHPAPHSVD

SEQ ID NO: 31901 - protein, 163 aa, Terrapene carolina
PGETRVAVYFTQGQGALLDPAQRALYRDVMQENYETVTSLGKGFPSPQLLEAVGSACLNILGTPSEGVKIPLTSPNICLSQEGSATTFLSSWVPCSPAEHRDRFRSQNVLCYRRSLNPPCTLIWSDFTPCTGFSLPKPELISRLERGEEPSERLQGNHRRKKV

SEQ ID NO: 31902 - protein, 100 aa, Lithobates catesbeianus
IRCQDVTVYFSMEEWEYIEGHKDLYKDAVMENRPPLTSPDGSRNRNPPERCPRPLYSRDSTQEDHSIFKDDQGKDLIIVKVEDEEEPYVMSDKPCKEEEI

SEQ ID NO: 31903 - protein, 89 aa, Lithobates catesbeianus
IRCQDVTVYFSMEEWEYLEGHKDLYKDFMMENQPPFTSPDGSNHGNPPERCHRPLYSWDSPWEDHIYVHHDQGEELKDIKAETKEEEKI

SEQ ID NO: 31904 - protein, 88 aa, Lithobates catesbeianus
IRCQDVTVYFSMEEWEYLEGHKDLYKDVMMENQPPLTSPDGSSNGNPPERCHHPLFSRDSTEDHTIPHCYKSGDPIDIEFQVKAEEEE

SEQ ID NO: 31905 - protein, 88 aa, Lithobates catesbeianus
IRCQDVTVYFSMEEWEYLEGHKDLYKDVMMDNQPPLTSLEYKADDKRNLPGTKSLNRTIHPRPYQLVRPRDPSNPEESSDKSHTMTSD

SEQ ID NO: 31906 - protein, 85 aa, Terrapene carolina
VTFEEVAVFFTQGQGALLDPAQRALYRDVMRENYETVTSLGKGFLAPWLLEAGGVSVSHTSQVLPSSLSNETRVSKPKAHTKSSP

SEQ ID NO: 31907 - protein, 104 aa, Lithobates catesbeianus
IRCQDVTVYFSMEEWEYLEGHKDLYKDVMIDNQPPLTSPDRSSNGNPSERCPRPLYSRDSTQEDHTIPLHHQSGNLRESKVEVKAEEEEEMYVRDDQQSMEEYG

SEQ ID NO: 31908 - protein, 90 aa, Terrapene carolina
VTFEEVAVYFTQGQGALLDPAQRALYRDVMQENYETVTSLGKGFPSPQLLEAVGSACLNVFRFFPGQLDQRQMGSIMHSCRVREICISVP

SEQ ID NO: 31909 - protein, 82 aa, Lithobates catesbeianus
IRCQDVTVYFSMEEWEYLEGHKDLYKDVMMENQPPLTSPEEEVETYVGGDQLSMEEVGMIIKSEQDEISPPINTDGCDVRNS

SEQ ID NO: 31910 - protein, 94 aa, Microcaecilia unicolor
VTFEDIAVSFSQEEWECLDEGQKELYREVMEENYETLMFLADNEVTQGKVTEENRKEHPLQWKLRPRDVDVSQGTEWGKSGRSHQESQKKRRHP

SEQ ID NO: 31911 - protein, 83 aa, Paroedura picta
VSFEEVAVDLTLEEWALLDPCQRSLYREVMLENYGLVIALGCWGFTPAIISWLREEGLLQSSSQNLQSTGICLDASWGTPLTT

SEQ ID NO: 31912 - protein, 111 aa, Paroedura picta
VTFEEVAVRFTEGEWGLLDPSQRALYREVMVENYGNVASLEKNRRRTGFLPPAFHYLKESQSRLPSPSLPLPRADTLGEGPPVAKPDLISWLEEKEEVFEGDAKERGKPAG

SEQ ID NO: 31913 - protein, 86 aa, Podarcis muralis
VCFEDVAVHFTDEEWALLDLDQRALHKEVMEENCGIVASLRFSPLMVVIVHNSLHKLLAQCTILIDLPLGIEELATHLPCQYTCPG

SEQ ID NO: 31914 - protein, 82 aa, Podarcis muralis
GGFEDVAVHFTDEEWALLDPDQKALHKEVMEENCEIMDSLSKTAFWITISLLKFSMDLYEMNLKYGDVSEMKNKGDHDKVYT

SEQ ID NO: 31915 - protein, 84 aa, Alligator sinensis
EAFEEVAGYFTQEEWELLETGDKGLYQDQMLRNYRALVSLADAESLGRDEQQQHHEEEPANLNLFQTGNQLPSQQEERPVETKR

SEQ ID NO: 31916 - protein, 85 aa, Alligator sinensis
EVFEDVAVYFSRKEWELLEDDDKVLYRDQMLKNYQALVSRGKARVLASPVRALKFIAFSLCFSSLALMHFSGWGFNFPSSPLLCQ

SEQ ID NO: 31917 - protein, 123 aa, Paroedura picta
VSFAEVAVDFTEAEWALLDAGQRALYLEVMLENYGSVAFLASNGRAIAVEPNRGLVCTGELGNFSRGSSESISFPSDPMKEETAEEVNGFTSVEVKIEDAEGNFGDGKEPQSQERSHRENAED

SEQ ID NO: 31918 - protein, 109 aa, Paroedura picta
VCFEEVAVFFTQEEWALLDPAQRTLYREVMWENYETAASLGITCGILLSCVATCVQSEKVNRGNPSSGSLGSFKEVAVFFTREEWALLDLAQRTLYWEVMQENYETGAS

SEQ ID NO: 31919 - protein, 82 aa, Paroedura picta
VTFEEVAVRFTEEEWALLDQDQRALHSEVMQGNFANVAYLAVYGEARMLGPPEQVKPVGPSQRRMAENVLQKDEQPSQNPCA

SEQ ID NO: 31920 - protein, 94 aa, Microcaecilia unicolor
FTFEDIAVSFSQEEWEYLDEEQKELYREVMKENYQTLISLDQLLPQERKREKNQHKDSVKIEQSQRQSENVYENIFQDPKRKNAKKDHQESEEK

SEQ ID NO: 31921 - protein, 82 aa, Micrurus paraensis
EEVAVYFSEDEWSQLDPDQKVLHLEVMLENHRNVVSLGNNGQENLDSCELFQVINAKDRMEKFGIGIEFKSHERNQSKNWNQ

SEQ ID NO: 31922 - protein, 86 aa, Pantherophis guttatus
LTFEDVAVRFTDEEWMLLDAGQQDLYREVMAENSGMVASLIQELQPEKNAEDQEAGAADKPGQKAQDGEGKSRPFFQRPTESELKT

SEQ ID NO: 31923 - protein, 88 aa, Pantherophis guttatus
VSFKDVAVFFSVEEWALLDSKQKALYREVMLENKRNMASLGQDTVPFHQLLPLRQGVSSQGKRPSSTPAQHGGDGWEMEDFGQEAAAP

SEQ ID NO: 31924 - protein, 89 aa, Pantherophis guttatus
VSFKDVAVFFSVEEWALLDSKQKALYREVMLENKRNMASLGQDTVPFHQLLPLRQGVSSQGKRPSSTPAQHGAGDGWEMEDFGQEAAAP

SEQ ID NO: 31925 - protein, 82 aa, Xenopus laevis
VMFDEVAVYFSEEEWGYLAETQKLLYVNVMLDNYETLCYLETAKRRPSILQRSISSPWLVTDRHRFHPPAAVCLWLLLPLCA

SEQ ID NO: 31926 - protein, 92 aa, Xenopus laevis
VKFDEVAVVFSEDEWNLLTDQQRGLYMEVMKENYEHLIYLGCEVPVILSLLQDGGGMVRDTVSQSKPQQVAGAEGSKANSKVGGNIPESLCL

SEQ ID NO: 31927 - protein, 85 aa, Alligator mississippiensis
EAFEEVAVYFTREEWELLEASDKGLYQDQMLRNYQALVSLGEKLFSCSQCGKSFSNRSTLTYHLRVRMGEKPFSCDQCGKSFIRN

SEQ ID NO: 31928 - protein, 101 aa, Alligator mississippiensis
EVFEDVAVYFTQKEWELLEDEDKVLYRDQMMKNYQALISLDPAEVNESLLSFCCYNTWMMHFFIFSSDIGTNIRKIDSIGNWPDVADKWPVRACSTQAARS

SEQ ID NO: 31929 - protein, 103 aa, Xenopus laevis
MPHGEVAVYFSEDEWQCLRKGEKELYRTVTMDSYYMLLSLGNLKSKEEDCSVLLPGRNLGRCSFLTVTRVSDLLNVKPEIVQRIEQGRDPSVSCHQEMLWRKK

SEQ ID NO: 31930 - protein, 89 aa, Pantherophis guttatus
VSFEEVAVYFSEEEWSLLDSDQKALHSEVMLENYRNVVSLGKFFCPKSESSRSQIIVSFLLNKSLIRYCLLGGRRKGSGLLVLQRRKES

SEQ ID NO: 31931 - protein, 85 aa, Pantherophis guttatus
VSFEEVAVSFSEEEWSLLDPDQKALHSEVMLQNHRNLVFLGNDGQENQVSCELLQVINAKDRTEKFGIRTELESHERNHSKNSNQ

SEQ ID NO: 31932 - protein, 85 aa, Pantherophis guttatus
VSFEEVSVYFSEEEWSQLDSDQKALHSEVMLENYRNVVSLGNNGQKNQNSCELFQVINAKDGTEKFGIRMEPETHDRNQSNDWNQ

SEQ ID NO: 31933 - protein, 93 aa, Pantherophis guttatus
VSLEDVAVFFSVEEWALLDSEQKALYREVMLENERNIISLAGDGWEREDSGQEAAAPLPKEKKEVAENQLMGELENCSGLPCPDPNVLLDTDD

SEQ ID NO: 31934 - protein, 88 aa, Pantherophis guttatus
VTLEEVAVHFSKEEWVLLDPDQKTLHREVMEQIGRIVASLGDERKVDKIDNQSIQEITLTRRKRRISGTRSNQRAKSDGDQFSQTGDE

SEQ ID NO: 31935 - protein, 82 aa, Alligator mississippiensis
EVFEDVAVYFTRKEWELLEEHDKVLYQDQMLRNYEALISLGIDIAWLRDRWVLNNTPSALQRSLNGICNFTLTYAFTPARSN

SEQ ID NO: 31936 - protein, 89 aa, Notechis scutatus
VSFEDVAVYFSKEEWSQLDANQKALHGEVMLENSRNLFSLGYNGHENKNFKEECQAIHLKVGKGKLYQCMERGKHFRKKSILIHHKTVH

SEQ ID NO: 31937 - protein, 95 aa, Alligator mississippiensis
DVFEDVAVYFTQEEWELLEAGDKVLYQDQMLRNYQALVSLALVQPEAKVQEQDPGGVKVTVNVKVKEVSSDEMQRARRGASVQPGGRQGGAGTLS

SEQ ID NO: 31938 - protein, 87 aa, Notechis scutatus
VSFEDVAVFFSVEEWALLDSEQKALYQEVMLENKRNMASLGQNTVLFHQLFLRLEVSSQGKRPSSTPAQHGGDGWEMEDSGQEVAAP

SEQ ID NO: 31939 - protein, 91 aa, Notechis scutatus
VSFKEVAVYFSEEEWSQLNVDQKALYWEVMLENHRNVASLGNDSEEDEKSRELFQMISRGYNTKNPTVLMEVESRERSHSNCNQECSSDVH

SEQ ID NO: 31940 - protein, 90 aa, Alligator mississippiensis
VTLEEVAVGFPGKQRSPLDSSQRALYWDVMLEKNETLVSLASKETFSQNKAENPQQPYPEEAEPCSSVLGRAKGDDPQCLEHKEAHESQH

SEQ ID NO: 31941 - protein, 91 aa, Notechis scutatus
VSFEEVAVYFSDEEWSQLDPVQKVLHSEVMLENHRNVVSLGNNGQENQDSCELFQVICAKDGTEKLGIQMEFENHEKNQSMNLESSSSTDA

SEQ ID NO: 31942 - protein, 87 aa, Notechis scutatus
VSFEEVAVYFTEEEWALLNPSQRALHKEVMLENFRNVAALGYRQKQNNYKETRVTLLQMIKSEEGMLGNQGASRRSKKTCIMNGRKS

SEQ ID NO: 31943 - protein, 96 aa, Alligator mississippiensis
DVFEDVAVYFTRKEWELLEDEDKVLYQDEMLKNYQALISLGRAWLLSGAEEQTPAKRSPDLEPAQTSPGSLGKMDSLRPEKEPWHKSQGRPQKQKE

SEQ ID NO: 31944 - protein, 89 aa, Notechis scutatus
VSFKEVAVYFSEEEWSQLDPDQKALHWEVMLENYSSVASLGKGLSYSPVRDFRKPFCSWIPLAVSYFRKSQIDVISGEEAGRNTPFSCS

SEQ ID NO: 31945 - protein, 86 aa, Alligator mississippiensis
VVFEDVAVYFTRKEWELLEDEDKVLYWDQMMKNYQTLISLGVSTLWNSTIWRQATVPFYSFLMTDVRGQSGGAWLLSRAEEQRAEE

SEQ ID NO: 31946 - protein, 91 aa, Notechis scutatus
VSFEEVAVYFSEEEWSQLDAHQKELHWEVMLENHRNVISLGNNGQENKDSREPFQVIRPGNGIEKPAIKMELENHERNQSNDWKQESSSST

SEQ ID NO: 31947 - protein, 101 aa, Athene cunicularia
DVSVYFNDKEWEKLEEWQKELYKNVMKGNYESLISLDSPENPELHGMSGQSEGSFQSPDEEAGLGCEAQCSSKTQPRSLAAARVGKPPASIAQQRNRTRER

SEQ ID NO: 31948 - protein, 86 aa, Notechis scutatus
MSLKEVAVNFTEEEWALLDSTQKALHREVMLENSRNMNILAGDEKENENCQEPNMVTSPAIQLKLRKEIFGVQWRSQTHQESPSKP

SEQ ID NO: 31949 - protein, 92 aa, Notechis scutatus
MYFAEIQWALLDPCQRPVYRDIVQDNFGTLLSLDGGTMNSNSQPGGPEGMQKQVHGRPEGSAYGGQPSAGQLSEEAEKGWVKPPLLPPVTKD

SEQ ID NO: 31950 - protein, 87 aa, Lepidothrix coronata
VRFEEVALQFSPREWDTLDEGQRELYRSVMEGNYEMLVSLCRLCLPRGALSGSLFCLFAFHWDLSSSQMILSIPCPLRQRLELGRDA

SEQ ID NO: 31951 - protein, 87 aa, Alligator mississippiensis
KAFEDVAVYFTRKEWELLEDEDKLLYRDQMLRNYQALVFMGAGIPSRAEQRAPEEGLAAAKPQTRPVCGDGLEEQRAPSRQEDGVHS

SEQ ID NO: 31952 - protein, 82 aa, Notechis scutatus
VTFEDVVVYFTAAEWAPLTNWQRDFYQAVMVETYELVVSLAGDGVPMAEGEEGGEERPVWQYIPQGKRRRKTPQPRADTAVR

SEQ ID NO: 31953 - protein, 87 aa, Alligator mississippiensis
EAFELVALRFTRAEWRLLRDGDKGLYRDQMLRNYRALVSLDSSDMEDTWDLSAEEIAVDSFPRPDSSQQAGFETLSRAEQQPPEEEP

SEQ ID NO: 31954 - protein, 87 aa, Notechis scutatus
VSFEDVAVFFSMEEWTLLDCEQKTLYQEVMLENAKNVASLSDGWEMESSGQEAVTPFLKDKKEVVEKFSGKPSPVEKQLKGEPGKCS

SEQ ID NO: 31955 - protein, 110 aa, Notechis scutatus
VSFEDVAVFFSMEEWALLDSEQKALYREVMLENKRNVASLGQDTVLFHQLFLRLEVSSQGKQPSSTPAQHGGKKQRKSINLVLKMKIIKAHEEGKKVKTLEKGGGLACST

SEQ ID NO: 31956 - protein, 94 aa, Alligator mississippiensis
EVFEDVAVYFTRNEWELLDDEDKVLYRDQVVKNYQALVSLGKALGLASPWRYDRCIPRGRITHHCTECRKNFTCLQDLSQHECVQQHCTKCGKR

SEQ ID NO: 31957 - protein, 94 aa, Gopherus agassizii
VTFEEVAVYFTREEWALLDPTERALYRDVMQENYENVTSLGKDSRPLTCFGLVFPFPSLFEVSVSITAGDAMACEKEEQNSQQENVEQMDKHRA

SEQ ID NO: 31958 - protein, 87 aa, Micrurus lemniscatus
VSFEDVAVFFSVEEWALLDCEQKALYQEVMLENKRNVASLGQDTVLFHQLFLRLEVSSQGKQPSSTQAQHGGDGWEMEDSGQEAAAP

SEQ ID NO: 31959 - protein, 85 aa, Gopherus agassizii
VTFEEVAVYVTKEEWALLDPTQRALYRDVMQENYENCGSKSHSPFYQSPGHGNVSPSNRKDVYKRQGSGRGWMGAWARLFGEAQP

SEQ ID NO: 31960 - protein, 88 aa, Gopherus agassizii
VTFEEVAVYFSKEEWALLDQGQRALYTDVMQENYETVNLLGKDSCSVRCWKLCVFVCVVINSGQTAVGSRGRNQSQRVKRPSSLSTGG

SEQ ID NO: 31961 - protein, 86 aa, Podarcis muralis
VCFEDVTIRFTDEEWAFLDPDQRALHQDVMEETRGIVASLGKAPCGIIISAWKFKTYLYGTNLIYFHRSANLTFHQKIHTGEKLYQ

SEQ ID NO: 31962 - protein, 84 aa, Gopherus agassizii
VTFEEVAVYFTQGQGTLLDPAQRALYRDVMQENYETVTSLGKGFLSPQLLETVGSACLTLGNQKRKNITVASVFPLIPLRSGKN

SEQ ID NO: 31963 - protein, 83 aa, Podarcis muralis
VCFEDVTIRFTDEEWAFLDPDQRALHQDVMEETRGIVASLDHLMWGSNDFWDMNLSQEEFGVFGAFGLGRSSFRKSSNLTSHQ

SEQ ID NO: 31964 - protein, 86 aa, Podarcis muralis
VCFEDVAIHFTDEEWALLDPDQRALHKEVMEENRRIVASLSKAPSSLRSFVIASLSQKLQRVQNCLKCGKSFTWKKSLTSHQGIHS

SEQ ID NO: 31965 - protein, 88 aa, Podarcis muralis
VCFEDVAVHFTDEEWALLDLDQRALHKEVMEENGIVASLSKAPLWIITSFGNSTHISLATCSTWDSNIPQTPLNGGLLILTVDMMKPA

SEQ ID NO: 31966 - protein, 94 aa, Microcaecilia unicolor
ITFEDIAVSFSQEEWEYLDEEQKELYREVMKENYQTLISLDQLLPEERKREKNQHKDPVKIEQIQRQSENVCENIFQGPKRKNAKKDHQESEEK

SEQ ID NO: 31967 - protein, 98 aa, Microcaecilia unicolor
VTFEDITVYFSQEQWWYLNERQKELYREVMKENYEILISLGKDDPRSSNTEANHWKLSGKPEGEKMLIERDKEETLSYSNWGEKQWVSENKQKNSTGG

SEQ ID NO: 31968 - protein, 108 aa, Microcaecilia unicolor
VTFQDIAVSFSQEEWEYLDEGQKELYMEVMEENLELLTSVGNGVGVGLGMEQTTLPVDQQCWDPRWKNSANPLQRSCVDLVNPGQIPKKEVKRKYWRKPREVQEFKCP

SEQ ID NO: 31969 - protein, 95 aa, Xenopus tropicalis
VSFEEVAVFFSDEEWQHLDVWQKELYNEVMQDILETLLSLEDSPMEGDGGPNPTGYSLMPQWRVNEGAKPNVYSCSVTARQIHDHGINRDMLGNL

SEQ ID NO: 31970 - protein, 91 aa, Lithobates catesbeianus
IRCQDVTVYFSMEEWEYLEGHKDRYKDVIMEDQQTLGFVKLERMEFPWNENILNLALEILSLLTREDCEVVMKNSTEHDTPRRHHQTSTRC

SEQ ID NO: 31971 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQGEELKDIKIEIKKEEEE

SEQ ID NO: 31972 - protein, 100 aa, Terrapene carolina
VTFEEVAVYFTQGQGALLDPAQRALYRDVMQENYETVTSLGKGFLSPQILESNWSVFVLGFPFVLFLFLPSTMTPVWIVSLPAGAERGSENEEGNHHEEV

SEQ ID NO: 31973 - protein, 108 aa, Microcaecilia unicolor
VTFHDAVVCFSQEEWQLLEEWQKELYARVVKEIHRALFSLGCAIVHSDVLFRIKKGTRFKDECDAKGQRIINGCTTCCTCLNPDILLRIKEEEEEESCDPQDTEGQDI

SEQ ID NO: 31974 - protein, 86 aa, Microcaecilia unicolor
VTFEDIAVSFSQEEWKYLDEGQKNLYWEVMKENYETLISLEQEDPKNSNSETHHWKLSEKPEGENVLSEREKEETLSCPDWGEKEK

SEQ ID NO: 31975 - protein, 98 aa, Microcaecilia unicolor
VTFKDVAASFLEADWDLLGEWQKELYKKVIKEIHDILMSRGYSIEDEKYFNQQIEREGKENPNDFNNLPIVTSVFSLSIKQEEDIPFMENPESQMSEQ

SEQ ID NO: 31976 - protein, 90 aa, Terrapene carolina
GTFCEVAVYFTREEGALLDPTQRALYRDVMQENYETVVLLGKESCPFGDRGGHSYWSVCLWLKRNPILQLAKWGGGSLALSVLRLAKTHY

SEQ ID NO: 31977 - protein, 87 aa, Lithobates catesbeianus
IRCQDVTVYFSMEEWEYLEGHKDLYKDVMMDNQPPLTSPDGREMRKTSEDCLTLSPDCKVEDEDITQYSPGENPTTSNVHPAPHSVD

SEQ ID NO: 31978 - protein, 91 aa, Microcaecilia unicolor
VTFKDVSAYFLEAEWDILGEWEKELYNKVIMEVHDILTSKDEKYLTQYFEWEGKENPNKSFPIVTSVFSLSVKQEEDLPLMDPPKSEVSEQ

SEQ ID NO: 31979 - protein, 108 aa, Xenopus tropicalis
VTFDDVAAYFSEDDWQCLEEWQKELYQNAVQEIHGVLLAMGNCYIDIYIAWQYGYYYVFPMAISLSCHRKAFSGGTCFRRHQDLGSFNIFEKNEPKSIPKEGPNESER

SEQ ID NO: 31980 - protein, 92 aa, Xenopus tropicalis
VKFDEVAVVFSEDEWNLLTDQQRGLYMEVMKENYEHLIYLGFEVPVILSLLQDGGGIGSDTVTQSKSQQVAGAEESKSSVTLEGPIPETLPS

SEQ ID NO: 31981 - protein, 87 aa, Lithobates catesbeianus
IRCQDVTVYFSMEEWEYLEGHKDLYKDVMMENQPPLTSPDGCDVRNSSERHLLLSADCKSEDNVITQDPPGGNPNTQNIHHTPSCPE

SEQ ID NO: 31982 - protein, 89 aa, Lithobates catesbeianus
IRCQDVTVYFSMEEWEYLEGHKDLYKDVMMEDQPALTSPDGASNGNPPERCPHPLYSQDSTQEDHTIPHHHQGKDLKTEDKADVSSKKN

SEQ ID NO: 31983 - protein, 97 aa, Xenopus tropicalis
VTFHDVAACFSDEDWRLLEDWQKELYKNVMREIHTALQAMGKGAVTGYGGDPHCPAGHGYGIRGRSTLPCWPWVRGQLRDMGEIHTALLAMGKGAFT

SEQ ID NO: 31984 - protein, 87 aa, Lithobates catesbeianus
WCQDVTVYFSMEEWEYLEGQKDPYKDVMMENQPSLTSPAGSSNGNPPERCPRPRYSRNSTQEGHTIPHHQHEEQMFVKIVVKEEEEE

SEQ ID NO: 31985 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQGEELKNIKPEIKEEEEE

SEQ ID NO: 31986 - protein, 89 aa, Lithobates catesbeianus
IRCQDVTVYFSMEEWEYLEGHKDLYKEVMMENQPPLTSADGSSNGNPPERCPYPLYSRDSTQEDHTIPYHDQCEDLKDIKVEIKEEEEE

SEQ ID NO: 31987 - protein, 89 aa, Lithobates catesbeianus
IRCQDVTVYFSMEEWEYLEGHKDLYKDVMMENQPPLTSPDGSSNGNPPERCPSPLYSQDSTQEGHTIPHHHQYQEQIYMKVEVKEEEEE

SEQ ID NO: 31988 - protein, 94 aa, Microcaecilia unicolor
VTFEDIAVSFSQEEWGYLSEGQKELYREVMKENYETLISLATQLIPQEGKRAKNQEDPVAMEQIQKQSDNVCENISQGPKKRNTRNEQQESEEK

SEQ ID NO: 31989 - protein, 89 aa, Lithobates catesbeianus
IRCQDVTVYFSMEEWEYLEGHKDLYKDVMMDNQPPLTSPDGSSNGNPPERCPRPLYSQDSTQEGHTIPHHHQSGDPIDIEFEVQAEEEE

SEQ ID NO: 31990 - protein, 89 aa, Lithobates catesbeianus
IRCQDVTVYFSMQEWEHLEGHKDLYKDVMMENQPPHTSPDGSSNGNPSERSHHPLYSWDSPWEDHNYVHHDQGEERKAIKTETEEEEKI

SEQ ID NO: 31991 - protein, 82 aa, Terrapene carolina
VTFEEVAVYFTQGQGALLDPAQRALYRDVMQENYEVVISLGKGFPSPQLLETGVSRRAGRVGGDEEPGGQWWGSSYLGRVRR

SEQ ID NO: 31992 - protein, 89 aa, Terrapene carolina
VAFENDSVYFSEQEWQNLDEWQKELYKNVMKGNYESLISLGFLYSQADTIKFSVFYFCFIPADNGIMFQTELLEHGERLKHLQLRRTFS

SEQ ID NO: 31993 - protein, 88 aa, Lithobates catesbeianus
IRCQDVTVYFSMEEWEYLEGHKDLYKDIMMDNQPPLTSPVDGREMRKTSEDCLTLSPDCKVEDEDITWYSPGENPATSNVHPAPHSVD

SEQ ID NO: 31994 - protein, 87 aa, Terrapene carolina
MAFEDVAVCFSPEEWAALAEWQRELYWAVMRENFELVASLGELPPSWPCCPPLGQPVLPSHPLQGSRTQQRPSAPRFGHHSKLPPPP

SEQ ID NO: 31995 - protein, 89 aa, Lithobates catesbeianus
IRCQDVTVYFSMEEWEYLEGHKVLYKDVMIEDQPPLTSPDVSSNGNPPERCPRPLYSRDSTQEGHTIPHHHQGVKLGDLKVEDEEEKEE

SEQ ID NO: 31996 - protein, 89 aa, Lithobates catesbeianus
IRCQDVTVYFSMEEWEYLEGHKDLYKGVMMDNQPPLTSPDGSSNGNPPERCPRPLYSRDSTQEDHTIPHHHQGEDLMIIKTEGEVEGTY

SEQ ID NO: 31997 - protein, 107 aa, Terrapene carolina
CTTVLCQSHIIPSGWKSLNLLQEELQVSQEPSGHPKGALGTFFHLLNFYKGTHPTHLWVRITVKFLSRLFSFPGAGFPIPKPDVISQLERGEEPWVLDLQGSKEREI

SEQ ID NO: 31998 - protein, 85 aa, Lithobates catesbeianus
IRCQDVTVYFSMEEWEYLEGHKDLYKDIMMEDQPPLTSPDGSSNGNTPERCPHPLYSTQEDHTIPHHQGYEQMYLKVKVKEEEEE

SEQ ID NO: 31999 - protein, 86 aa, Microcaecilia unicolor
VTFEDITVHFSQDQWEYLDEGQKELYREVMKENYETLISLEKDNPRNSNTEIHHWKLSEKPEEEKRLSQKEVTYSCCDWGEKGKNQ

SEQ ID NO: 32000 - protein, 86 aa, Lithobates catesbeianus
LRCQDVTVYFSMEEWEYLEGQKDLYKDVMMENQPPVTPPGESSNRNPPERCPHPLCSAQEDLSISHHGQGGRNFNIKKEIKEEEDN

SEQ ID NO: 32001 - protein, 89 aa, Lithobates catesbeianus
IRCQDVTVYFSMEEWEYLEGHKDTYKNVMTENQPSLTSPDESSNGNPPERCPRPLYSRDSTQEDHTIPHHHQSEERINIKVEVKEQKEE

SEQ ID NO: 32002 - protein, 84 aa, Microcaecilia unicolor
PSLDNITVNVTPEEWEDLEKWQKALYDEVTVETLELLASLRPIFGSQEMRSLEENIGIPQLPPMLPQSLNDSEKAARNPEREIP

SEQ ID NO: 32003 - protein, 88 aa, Microcaecilia unicolor
VTFDDVAVYFSEEEWEKLEEGQKELYKETMKDNYEALISLDDGLIKEIKVEEERLDECASVPDVQITSSEKLSERGSLHSHEEKSLKE

SEQ ID NO: 32004 - protein, 89 aa, Lithobates catesbeianus
IRCQDVTVYFSMEEWEYLEGHKDLYKDVMMENQLPLTSPDGSSNGNPPERCPRPLYSRDSLWEDHNYVHHDQGEELNDIKAETEEEVKI

SEQ ID NO: 32005 - protein, 89 aa, Lithobates catesbeianus
IRCQDVTVYFSMKEWEYLEEHKDLYKDVMMEDWPPLPSLDGSSNGNPPERCPHPLYSRDSTQEDQEIPLHDSGEEVIDVKIEVKEEEED

SEQ ID NO: 32006 - protein, 87 aa, Terrapene carolina
ATFEEVAVYFTEEEWALLDPTQRALYGDVMQNYENVTSLGKDSRPLSCGRAPLPRQRQVRGRSTLGPVGRGASPHCGRSTLGRGISP

SEQ ID NO: 32007 - protein, 89 aa, Lithobates catesbeianus
IRCQDVTVYFSMEEWEYLEGHKDLYKDIMMDNQPPLTSPDGSSNGNPPERCPHPLYSRDSTQEDHTIPHHHQGEELKDIKVEDKEEEEE

SEQ ID NO: 32008 - protein, 82 aa, Terrapene carolina
VTFEEVAVYFTQRQGALLDPTQRALYRDVMQENYEMVTSLGKGFPYPQILEAVADRPAGTRGRAVGVRSPALQGKKASEMHP

SEQ ID NO: 32009 - protein, 94 aa, Microcaecilia unicolor
VTLEDIAVSFSQEEWEYLDEGQKELYREVMKENYETLISLDEKIKDETKRLSLKTYQLLQGGSPQKKPSTCTSCNKSFSQSWLLKRHQMIHSGM

SEQ ID NO: 32010 - protein, 124 aa, Xenopus tropicalis
VTFEDIAVRFSEEEWKGLQEGQKELYREVMQDNYQNLTALGEEPPRRVAGSCNAPQIVTNMYPVFPSFLLGTPTLTSCSAHSQGALQLDCPSRLVITKPEIVLKIEKGEDPIIGVCLAPAHKRP

SEQ ID NO: 32011 - protein, 89 aa, Lithobates catesbeianus
VRCQDVTVYFSMEEWEYLEGHKDLYKDVIMENQPPLTSPDGSSNGNPTERCPRPLYSRDSTQEGHTIPHHHQGEELKDIKAEIKEEEEE

SEQ ID NO: 32012 - protein, 95 aa, Microcaecilia unicolor
VTLEDIAVSFSQEEWEYLDEGQKELYREVMKENYETLISLADEKIKDETKRLSLKTYQLLQGGSPQKKPSTCTSCNKSFSQSWLLKRHQMIHSGM

SEQ ID NO: 32013 - protein, 85 aa, Microcaecilia unicolor
VTFDDIAVYFSQEEWDSMKEWQKELHREVMEENLQLLISLGYGAETEHKNECPENLQIQQMIPVGDDQNAEQWIFSDWNYISQCE

SEQ ID NO: 32014 - protein, 89 aa, Lithobates catesbeianus
IRCQDVTVYFSMEEWEYIEGHKDLYKDVMMENRPPLTSPDGSSNRNPPERCPRPLYSRDSTQEDQEIPQEDQGMDLVVIKVEPVDDEEE

SEQ ID NO: 32015 - protein, 82 aa, Pantherophis guttatus
VSFGEVAIHFTSEEWLLLDSSQKALYQEVMLETSRMLASLAFDAQKKENDQEPNLVPLQIITTEIAEETSTNKQRRKKHEKK

SEQ ID NO: 32016 - protein, 89 aa, Xenopus laevis
VTFDDVAAYFSEDEWKDLEECQKELYKDMMKENYEALISLGNFTPYSTNSLLLDDGPVSDKEKSKYNDKLESIETPSLPMLDQVLPCPN

SEQ ID NO: 32017 - protein, 91 aa, Pantherophis guttatus
VSFKEVAVYFSEEEWSQLDADQKALYREVMLENHRNVASLGNNGEEDEDSRELFQMISRSYSMKNPAVLMEVESHERNHSNNWNQESSPSI

SEQ ID NO: 32018 - protein, 83 aa, Pantherophis guttatus
VSLKEVAVGFTEEEWALLDSSQRALHQEVMLENSRTLASLGRKMHMTSGHSNGPGEGKENLAWQDLGTTPLGKSMHPIKEEKL

SEQ ID NO: 32019 - protein, 87 aa, Pantherophis guttatus
YCLKKITEFFSMEECVLQDCEQKAQHQEVMVENASNMASLGDELTIEGAGQEMVAPFLTVNKEVAQRMSEKERPEEKELKEELGKHS

SEQ ID NO: 32020 - protein, 84 aa, Pantherophis guttatus
VTIEDVTVYFSEEESSQLDPDQKALHKEVMLENSRNVASLVALNRMKRRQNFPVRISKKPRLESVVSEMALDDIKQSQPQQAQP

SEQ ID NO: 32021 - protein, 105 aa, Xenopus laevis
VAFHDVAACFSAKEWGLLEDWQKELYRNVIREIHATLKAMGCTIVNSDVLLRIKEEGVGRKESDSDKTDTGTAPSGSCNPDILLRIKHDELPDWRDMDVAVKEEE

SEQ ID NO: 32022 - protein, 89 aa, Gopherus agassizii
VTFKEVAMYFSEEEWALLDPGQRALYRNVMQENYETVTSLGKDSCPLSYQKLCGLWSSWRLSPPRPLPCDSRFRDITMVLLFPQPRFQC

SEQ ID NO: 32023 - protein, 86 aa, Gopherus agassizii
VTFEEVAVYFTQGQRALLDPAQRALYRDIMQENYKTVTSLGKGVLCLRLLDPVWLLLRFFPIPLGYDCTASGRWDSQLGENEEENP

SEQ ID NO: 32024 - protein, 86 aa, Micrurus lemniscatus
SFEDVAVFFSMEEWALLDSEQKALYREIMLENKRNVASLGQDTVLFHQLFLRLEVSSQGKQPSSTQAQHGGDGWEMEDSGQEAAAP

SEQ ID NO: 32025 - protein, 87 aa, Gopherus agassizii
VRRSQLVVRGCKQEWKSLDEWQKELYRHIMKGNYEAVISLGKDCLQNEAFVMPLDDVNVSVLSVLTDEQQCGEEGPANLDLPSLLPG

SEQ ID NO: 32026 - protein, 85 aa, Gopherus agassizii
VTFEEVAVYFTREEWALLDPVQRALYRDVMQENYETVVLLGKDSCFVHSPFLEELEAVAPEYDGMVSQNEEEKPHQEDAEQREPH

SEQ ID NO: 32027 - protein, 87 aa, Gopherus agassizii
VTFKEVAVYFTREEGALLDSAQRALYRDVMQENYENVTLLCKGSCPLISSFPLPRTKVHASPPVPPLLCPGSASPQYASDTHTSTEP

SEQ ID NO: 32028 - protein, 83 aa, Gopherus agassizii
WGWDSVAVYFTREEWALLDPTQRALHRNVMQENYENVSLSITAGDVTVHEKEEQNSQPENVEQVDKHRELSQRSKRNVSRSHE

SEQ ID NO: 32029 - protein, 100 aa, Gopherus agassizii
VTFEEVAVYFTREEWARLDPRQRALCRDVMQENYENVTSTCFGLAFPFPSLSEVSVSITAGDAMECEKEEQNSQQGNVEQVDKDRELWQRSKRNVSRSHE

SEQ ID NO: 32030 - protein, 93 aa, Gopherus agassizii
MVTYEVAVYFTQGQGALLDPGPKALYRDVMQENYEMVTSLGKGVVLPWFLEARRGGRVCDVAILIPTQVLLWSLSPGMETCEPINHGGDCEDL

SEQ ID NO: 32031 - protein, 109 aa, Gopherus agassizii
VTFEEVAVYFTSEEWALLDPTQRALYWDVMQENYENVTSLGKGYCPLSSWKGKWRGKVYASPTMPLLLCPQVAKHRELSQRSKRNVSRSHEQGKSCEIQHRPEREQGNQ

SEQ ID NO: 32032 - protein, 89 aa, Gopherus agassizii
CGAGDVAVYFTQGQGALLDPTQRALYRDVMQENYETVTSLGKSVKGWITETLLGAATRCAKTPPVPVFPASSGLQQPVLLSQTLPSAPT

SEQ ID NO: 32033 - protein, 82 aa, Gopherus agassizii
LTFDDVSVYFNEQEWENLEEWQKELYKNVMKGNYETLISLEEEKPQEGCLEKLKPKEEVLQSLQQGVAAQLSNPAVIRMEQS

SEQ ID NO: 32034 - protein, 82 aa, Gopherus agassizii
VTFEEVAVYFTKEEWALLDPAQRALYRDVMQENYENKVGRSVNDQGTHNGHKETTAQQRIPMGERNNARVECGKKFSRRSHL

SEQ ID NO: 32035 - protein, 85 aa, Gopherus agassizii
VYFTQGQGALLDPAQRALYRDVMQENYEMVTSLGKRFPSPWLLEGNEPIVPTAHLTDFKPHSLTGLVNEKENPQQENCEDVDLQG

SEQ ID NO: 32036 - protein, 90 aa, Gopherus agassizii
VTFEEVAVYFTQGQGALLDPAQRALYRDVMQENYEMVTSLGKGFSSPQLLESVGPVLLSLVRSHVLSHLYCFSFTQRIPFHLPPWELLQP

SEQ ID NO: 32037 - protein, 82 aa, Gopherus agassizii
VTFEEVAVYFTREEWALLDPTQRALYWDVMQENYENVTSLGKCYCPPRFLEGEMETLSVHQRIHTGERPYECRECAKSFTSS

SEQ ID NO: 32038 - protein, 92 aa, Gallirallus okinawae
VAFNDASFNFSEEEWKSLNEWQKELYRHIMKGNYEAVISMGKDKLGSVLSRPVPGGWKHHCAREGLGMHSATFHQQLWGLVESHPVPLPAPG

SEQ ID NO: 32039 - protein, 89 aa, Gopherus agassizii
VTFEDVAVYFTQGQGDLLDPTQRALYRDVMQENYETVTSLGAERGSEDEDGNHHEEVPGEVEPQGTFVERAEGNFPWCLEQAESWGNWI

SEQ ID NO: 32040 - protein, 88 aa, Gopherus agassizii
QGFEEVAVYFSKEEWALLDPGQRALYRDIMQESYETVTCLGKDSFFLTKKRRLRGHMITVFNYLAGCCEGDGNPLLFMSTKGRTGRNQ

SEQ ID NO: 32041 - protein, 82 aa, Gopherus agassizii
VTFEEVAVYFTEGQGALLDPSQRALYRDVMQENYETVTSLGKDLCLLFEAMGSAFLNLVWVLLGRTLERSLELDHGSRISRP

SEQ ID NO: 32042 - protein, 84 aa, Gopherus agassizii
FNGYKVAVYFTQGQGALLDPGPKALYRDVMQENYEMVTSLGKGVVLPWFLEARRGGRVCDVAILIPTQVLLWSLRLHLHSIREV

SEQ ID NO: 32043 - protein, 95 aa, Micrurus lemniscatus
LSFREVSVYFSEEEWSWLDPDQKALYWEVMLENHRNMASLGDDGQENKDSYELLQGITARDTMETSAIEMEVERYKEKQSDDWNQESSSSTDAPM

SEQ ID NO: 32044 - protein, 88 aa, Gopherus agassizii
VTFEEVAVYFTESEWSLLDPAQRALYRDVMEENYENVTSLDGGMVNGNEENAQQDDAEQVEAHGTLSEGSKGNVSWSCAEANICESQH

SEQ ID NO: 32045 - protein, 87 aa, Gopherus agassizii
VTFEEVAVYFTESEWALLDPAQRALYRDVMEENYENVTSLDDGMMNEVENLQQDDAEQVEAHGTLSEVSRGNVSWSCAEANACESQH

SEQ ID NO: 32046 - protein, 83 aa, Gopherus agassizii
SGGWEVAVYFTREEWALLDPTQRALHRNVMQENYENVSLSITAGDVTVHEKEEQNSQPENVEQVDKHRELSQRSKRNVSRSHE

SEQ ID NO: 32047 - protein, 86 aa, Gopherus agassizii
VTFEEVAVYFTREEWALLDPAQRALYWDVMQENYETVVLLGKESCLLGEEPWVPDLQGSKKEVLPRAARTGEELVKPTQQLFGNAG

SEQ ID NO: 32048 - protein, 84 aa, Gopherus agassizii
ETNLSVAVYFTESEWALLDPAQRALYRDVMEENYENVTSLGKHSCPFGIFSLQKRRLRVDMIENLQQDDAEQVEAHGTLSEVSR

SEQ ID NO: 32049 - protein, 82 aa, Gopherus agassizii
RGCLFVAVYFTSEEWALLDPTQRALYWDVMQENYENVTSLGKGYRPLSSWKGKWRVKLYIKRVKKGIIYKYNSKHFSNYTHI

SEQ ID NO: 32050 - protein, 91 aa, Gopherus agassizii
VTFEEVAVYFTQGQGALLDPAQRALYRDVMQENYKMVTSLGKCQGVPGRCSGTAPHKASQDFGEPPLSWSRLSSGQEASQLVTHQTIHTGE

SEQ ID NO: 32051 - protein, 109 aa, Xenopus laevis
VTFSDVAAYFTQDEWQLLEERQKEFYKNVMEGIHSVLIGLGHTIVNSDVLFRVKEEPFHHKELQNSVRTDCSRNIPERQLDIKPDILLRLQCDQIPMYKAEEEAKPRSN

SEQ ID NO: 32052 - protein, 98 aa, Gopherus agassizii
VTFEKVAVYFTQGQGALLDPTQRALYKDVMLENYELVTSLGKGILSSPLLGAVGSACLTLVRFFPGQFDLRRVTENEENQQEEGPGKVVSQEMVFRKA

SEQ ID NO: 32053 - protein, 90 aa, Podarcis muralis
LCFEDIAVRFADEEWALLDSDQRALHKEVMEENGGIMNSLSKAPYTWGQEKSLCLVLCSFTPRNHDNAYTMEKRCKYTECKGNFSQSSHS

SEQ ID NO: 32054 - protein, 82 aa, Paroedura picta
FSSKEVSVSFTEAEWALLDPGQRALHREVKLENSGNVALLAEDDHRNEEGEELHQQIPDRVKTEDLKENIRNRAPLAASARP

SEQ ID NO: 32055 - protein, 86 aa, Paroedura picta
VSLEEVAVSFTEEEWALLDPGQRKVFWEVMEENYEAVASLVADVREMESEKGSGGRCVGKDNYLQGEAKFGDHMVPKRHCRRKRGA

SEQ ID NO: 32056 - protein, 95 aa, Paroedura picta
LLFEEVAVYFTEAEWALLDPGQIALYREVMLETYETVVGALARNVGETTVETDKSLASEERLESFSRGSPESISFPDEWAETEDVKETTEEFKEF

SEQ ID NO: 32057 - protein, 87 aa, Paroedura picta
VTFEDVSVDFSEEEWALLDPGQRALYREVMEENYGNLASLGKENKSHEEQPRRENEVKQRVTFEDVSVDFSEEEWALLDPGQRALHR

SEQ ID NO: 32058 - protein, 84 aa, Paroedura picta
MSFGEVAVFFTEEEWALLDPDQRVLYWEVMLENYQTVASLAADPANVKGFYRFGYENEMAAGTSMDSFKRRLERHLEQRSIISS

SEQ ID NO: 32059 - protein, 82 aa, Paroedura picta
VTFEDVALYFTLEEWALLDPLQRALYRIVMLEMYWVVVSVEGSRGSTPTLISWLKRQDLFLPRTSGLPQAAASGRSHEGEAP

SEQ ID NO: 32060 - protein, 104 aa, Podarcis muralis
VCFEDVSVRFTDEEWALLDPDQRALHKDVMEENRGIMASLGKAPCGIVLSAWIFKKYLCVRTSYISTELSSAPYKTWEPNTPTNLECGESSHSSSQQRNLNGKK

SEQ ID NO: 32061 - protein, 89 aa, Podarcis muralis
VCFEDVTIRFTDEEWAFLDPDQRALHQDVMEETRGIVASLGKAPWEKPYQCVECGKSFRQSANLTFHQKIHTGQKPYQCVECGKSFRQS

SEQ ID NO: 32062 - protein, 88 aa, Paroedura picta
PFSGTSCSCICPREWALLDPGQRALHREVMLENYETVALLAVEDLGYEEGEELHQQRPSRVNEEDLKENVMIHGRPERKLDVHMDENQ

SEQ ID NO: 32063 - protein, 88 aa, Podarcis muralis
CALKMSAVRFTDEEWALLDPDQRALHKDVMEENWGIVASLGKCGESCSQSSHSTSHQQNVIGKKLYQCMECGKSFRQSSHLISHQRIH

SEQ ID NO: 32064 - protein, 83 aa, Podarcis muralis
LCFEDVTIRFTDEEWAFLDPDQRALHQDVMEETRGIVASLGKAPCGIIISSFSHGSSLTRHQRIHTGEKPYQCVECGKSFSRS

SEQ ID NO: 32065 - protein, 86 aa, Podarcis muralis
GPEWDVAVRFTDEESALLDPDQRALHKDVMEENCGILASLGKAPCGIILSAWKFKKYVYGPTSYIFTEFNSAPYNTWEPNTTTINS

SEQ ID NO: 32066 - protein, 90 aa, Paroedura picta
VTFEDVAVYFTKGEWALLDPKQRALYKEVMQENYSIVVSLGGGHLSEEPDLPNKDKEKLLHRAQKSLSRRQERGEDSGVPHGPERPPGKQ

SEQ ID NO: 32067 - protein, 82 aa, Ruminococcus flavefaciens
KGISDEDMDALIKEWNLTDSLQQECYRNAVPKQYRMLFDASAIIIPLLKQKTDIFHPDNISHLNGFASIWCSIENIFLAATA

SEQ ID NO: 32068 - protein, 85 aa, Anolis carolinensis
VTFEDVAVDFTEEEWALLDPEQRALHQQVKEQNLRIMSFLGKPILFTTYLARGFGPLNAKDILLISQKVDQCFQITSCVGWDRTP

SEQ ID NO: 32069 - protein, 107 aa, Gallus gallus
EASESETACFAEQEWENLEEWQKELYRNMLRGNSESLNSLDYSVSRSDLSQLQRGEAPCSEVTSAQKEVPTEPSADFSIPEPSFTGTLKQNEEVCAEEQEATEGAEF

SEQ ID NO: 32070 - protein, 87 aa, Anolis carolinensis
LTFEDVAVSFSPQEWEMLSDGQRELHWEVMMDNYKMLVSLGVPPLGPVRRGDFPASFSTPGNDLYLLSSDGMFWNTLEDESVPADCR

SEQ ID NO: 32071 - protein, 86 aa, Anolis carolinensis
VTFQEVAVSFSEEEWALLNTDQRDLHQQVMKENVETVSSLSKAPSFINLFSFVYGLTLVPPTTSNKIEQETYTKRKRFQCLECGKC

SEQ ID NO: 32072 - protein, 83 aa, Anolis carolinensis
VTFEDVSVAFSEEEWALLDPSQKALHQDVMEENLGIVSSLATNHACDGGGSETRASLEDCSAHVDISDEIVALNVCRLYHRTH

SEQ ID NO: 32073 - protein, 108 aa, Gallus gallus
EASESETACFAEQEWENLEEWQKELYRNMLRGNSESLNSLDYSVSRSDLSQLQRGEAPCSEVTSAQKEVPTEPSAADFSIPEPSFTGTLKQNEEVCAEEQEATEGAEF

SEQ ID NO: 32074 - protein, 88 aa, Anolis carolinensis
VTFEEVSVNFTEEEWALLSPGQRALHGEVMDENLRMVFSLGWDVQESENNREPSKAFLQRNKQEQMTRNERKSDTNGNGRDMYPASQE

SEQ ID NO: 32075 - protein, 89 aa, Anolis carolinensis
VMFEDVAVHFSVEEWALLDPDQRALHWEVIEKNYRMVASLVFFNERHKLDYYNGFFHEASYLNDDITNKTEKGQPECHQLEESFGSSTH

SEQ ID NO: 32076 - protein, 91 aa, Thamnophis sirtalis
VSFKEVAVYFSEEEWTQLDDNQKALYREVMLENHRIVASLGNNGEEDEDSRELFKMISRRYSLNNPTILMEVGSHERNESNNCNQESSSSV

SEQ ID NO: 32077 - protein, 86 aa, Micrurus surinamensis
LSFEDVAVRFTDEEWMLLDAGQQDLYREVMAENSGMVASLIQELHAEINAEDQRAGAADQPEQKAEDGEGKSLPLFQHPAESELKI

SEQ ID NO: 32078 - protein, 93 aa, Chelonia mydas
VTFQEVAVCFTEEEWALLDPGQRALYRVVMQENYEAVTSLVAKGNKNSLCQTFCLCWGSPSSMLFCSPSLLQGLQKPQDCRGLYGGAPQCQTV

SEQ ID NO: 32079 - protein, 91 aa, Pogona vitticeps
VTFEEVAVYFTEEEWTLLDPDQRSLHTEVMEENLGTVASLGSGGQEGANERHKGKKRPFQTLQAKCHCLECGRSFSCKSSLNLHRRTHTGG

SEQ ID NO: 32080 - protein, 82 aa, Micrurus surinamensis
VSFGEVAIHFSSEEWLLLDPSQKALYQEVMLETSRMVASLAFDAQKNEVDQEPKFVPLPIIKTEIPGETSTNKRGRRKREKH

SEQ ID NO: 32081 - protein, 115 aa, Chelonia mydas
VTFEDVAMYFSPAEWVLLGEEQRQLYKHVMWENYQTLVSLDFPDAEETWDWSLIESCLGFFLTHSSSPGAGERPYRCAECGKRFFQITALTIHKRIHSGERPYACGECGKRFMDS

SEQ ID NO: 32082 - protein, 82 aa, Micrurus spixii
ISFNKFSICFTEEEWDLLDSDQKALHVEVMLEMSRNVASLGNELKNEIYQQSEEISIQILKVEVGEENQWQIKSEDGIQLND

SEQ ID NO: 32083 - protein, 91 aa, Aquila chrysaetos
VTFEDIAVHFSRQEWASLDDGQKELYRTVMEGNYEMLVSLCSSLRVTFLPLCVSLGSPGRKLPPSPGSASCRSGASQPFILTHHCALRLAE

SEQ ID NO: 32084 - protein, 88 aa, Aquila chrysaetos
VTFVDIAVYFSAEEWKNLEEWQKELYNNLVKENYESLISLGKHPFSPLSRHAGVMGRPSPPGPSFPAVPDCSPLYSRGPPRVIPENPP

SEQ ID NO: 32085 - protein, 98 aa, Columba livia
VTFEDVALSFSPEEWAKLSGCQRQLYREVMLENYQMVASLGAALSCSQVSCLQESGRGDGGEARGGCWANVKPEIICKMERQETPCVPDDPGEQQRDQ

SEQ ID NO: 32086 - protein, 82 aa, Pogona vitticeps
MSFQEVAVSFTRQEWDLLDPGQRALYKEVMLEICGMVASLGGGQEDENCQKLPLVSWEVKEQEERGEAFGNQEEPKDDLQNQ

SEQ ID NO: 32087 - protein, 92 aa, Columba livia
VTFEDVALYFSPEEWAKLSGCQRQLYREVMLENYQMVASLGCPCCSPWGGVQHAHDVGASDPVFSSPAAVGPGTQREVNGVRSFVQRQHLLS

SEQ ID NO: 32088 - protein, 98 aa, Pogona vitticeps
VSFEEVAMYFTKEEWDLLDPGQRALYKEVMLENYRNILCLEFLRLELPSLPEDQRLFAEDSKDRKPLAGLLKPDLVCQPEVKEEPSDWILEEKKWSKD

SEQ ID NO: 32089 - protein, 92 aa, Pogona vitticeps
VSFEEVAVYFTNAEWALLGAAQKALHREVMLENSRSVASLAGNRGDGNPGDGPCEVSSEKTNHLETDEVFGNQEGPKQPEGSPAEKAQDASS

SEQ ID NO: 32090 - protein, 87 aa, Pogona vitticeps
VTFEDVAVYFTEEQALLLDPGQRALYKEVMLENFGNVASLGECTKNGLWLGHGRCFTRKASLTQHQRIRLGGDASSCSEREKCSSQP

SEQ ID NO: 32091 - protein, 84 aa, Pogona vitticeps
MTFEDVAVYFTEEEWVLLDPGQKVLYQEVMMENYRMFVSLVQEVPPGINMEEQDSTAAHQAWQRTEREEQDGPVVLHGGADREK

SEQ ID NO: 32092 - protein, 85 aa, Pogona vitticeps
VTIEDVAVHFTLEEWALLDPDQKALHQEVMRENHINIATLAYPHASEFEERIGRREQDDPDGLNRTSSRREMGSVSLLCVESRGA

SEQ ID NO: 32093 - protein, 87 aa, Pogona vitticeps
VSFEEVAVYFTEEEWALVDPDQRALYGEVMEDNLQTFVFLDDVKQTGQHNGASPKKVDAGVTKHFFNPNRGGRKKRCEREEWRNKSV

SEQ ID NO: 32094 - protein, 83 aa, Pogona vitticeps
VTFEEVAVHFTEEEWEWLDPDQKALHREVTEEICWMLYTLETDDEQHGENNPGLSVEPFERIDHEAGKQRYGKSRGEKWYRGN

SEQ ID NO: 32095 - protein, 90 aa, Pogona vitticeps
LTFEEVAVHFTQEEWAFLSPDQKALHREVMEEIWWLLEFLGDHNLAVQHCKEPSVPLLKITPTEKTPCNCIECGKNFTDSTSLSLHRRPY

SEQ ID NO: 32096 - protein, 93 aa, Chelonia mydas
VTFDEISVYFNVQEWGNLDEWQKELYKNVMKSNYETLLSLDECFDISSVTQKKLEFGKRLLLTKTAVPTLNVCPSMNGNPQSLSQPKGRGAFR

SEQ ID NO: 32097 - protein, 95 aa, Micrurus surinamensis
VSFEDVAVYFSEEEWTELDPDQKALHREVMLENYRNVASLGDDEQDHKEPRESFQGFRHGDVMEKRAIQTKFQRQKRNPSNIWNKESSSSIEAHM

SEQ ID NO: 32098 - protein, 102 aa, Chelonia mydas
VTFEEVGVYFTREEGALLDPAQRALYRDVMQENYENMTSLGNFPTTIGNHLCKDQISTQASSRGTWSEATGFPVSKPDVISQLEKGEEPWVSEIQDSEEQGI

SEQ ID NO: 32099 - protein, 82 aa, Pogona vitticeps
MTFEDIAVHFTEEEWTLLDEDERALHRDIMEENIATLISLATRMREEGRENEETTVCLGADKEKKRKEPFKNDRSFKVRSRL

SEQ ID NO: 32100 - protein, 85 aa, Pogona vitticeps
VTFEEVAVGFDQEEWALLDPDQKTLHREVMEENYKMVASFDNWTKTKAGANCGKCFQDKLDLARQQGTHAEEDSNSRENYTGEKP

SEQ ID NO: 32101 - protein, 91 aa, Pogona vitticeps
VTFEEVAVSFTREEWALLDPDQRSLHREVMEENRLIVASLDCGEDILEAMECPEDPAAIITSLHNNEIEEQCLTGDQECYIRRELYQCGEN

SEQ ID NO: 32102 - protein, 94 aa, Geotrypetes seraphini
VMFSDVTAYFLEAEWDILREWQKEIYKKVIKEIHSFLISQGLNTFQQVERSCGALSVTMRITEDLSWGAHCTKQIKKEDEKYFTQHYESEEKEN

SEQ ID NO: 32103 - protein, 95 aa, Geotrypetes seraphini
VTFEDIAVSFSQEEWEYLDEGQKELYREVMKENYQTLISLVDHQISQGWKREKNRGEDLVETEQIHTQSEKVCANIFQGSERINTNNWKHESKEK

SEQ ID NO: 32104 - protein, 85 aa, Terrapene carolina
VTFEEVAVYFTVEEWALLDSAQRALYRDVMRENYETVTWLGNPDLSCSLFPGAGFPIPKPDLISHMERGEQLWMHQAGIPFLLPS

SEQ ID NO: 32105 - protein, 109 aa, Xenopus tropicalis
VTFEDIAVRFSEEEWKGLQEGQKELYREVMQDNYQNLTALGEEPPRRRVGSLGQKQPPEEPSAKRCPVKRKPTQRSLKLLRRSPKVVMDTGLGNHVTHGTLNQPQPEKP

SEQ ID NO: 32106 - protein, 109 aa, Geotrypetes seraphini
VTFHDVAVYFSEEEWQLLEEWQKELYRNVMKEIHGALISLGYTILNSEVYFRIREESGMCFKADDSERSKGIKECTTSYPGVIPDVLLRIKEENNEYYTSQHISEGWNV

SEQ ID NO: 32107 - protein, 102 aa, Micrurus lemniscatus
VSFEDVAVYFSKEEWSQLHPAQKALHGEVMLENSRNLSSLGYYNGQKNTNCKEECQAIHSKEGKGKRYQCIECGNTFTHSSSLHSHKRIHTGEKSYQCMECG

SEQ ID NO: 32108 - protein, 84 aa, Patagioenas fasciata
VAFEDVALYFSPEEWAKLSGCQRQLYREVMLENYEMVASLAAVNPGTQKKTKHVPERLPGPTFLLPGMPNPGTRHQMGLACGQS

SEQ ID NO: 32109 - protein, 91 aa, Micrurus spixii
VSFKEVAVYFSEEEWSQLDVDQKALYWEVMLENHRNVASLGNDSEEDEKSRELFQMISHGYNTKNPTVLMEVESHERSHSICNQECSSDVH

SEQ ID NO: 32110 - protein, 82 aa, Micrurus lemniscatus
VSFEEVAVYFSEEEWSQLDPDQKALHWEVMLENYSNVASLGDNGQDDKESRESFQGSDMETKWRSLKFKWNSKGRREISQII

SEQ ID NO: 32111 - protein, 86 aa, Micrurus lemniscatus
LSFEDVAVRFTDEEWMLLDAGQQDLYREVMAENSGMVASLIQELHPEINAEDQKAGAADQPEQKAEDGEGKSLPLFQHPAESELKI

SEQ ID NO: 32112 - protein, 95 aa, Micrurus spixii
VSFEDVAVYFSEEEWTELDPDQKALHREVMLENYWNVASLGNDEQDHKEPRESFQGFRHGDVMEKRAIQTKFQKQKRNPSNIWNKESSSSIEAHM

SEQ ID NO: 32113 - protein, 96 aa, Anolis carolinensis
VMFEDVAVHFSEGESALLDPDQQALHWEVMEENYRMVASLGKNPSVSWFIKARRNNSPLGTTSEELLFSGTLTQYLLEHGLVAHSKGFSSLFSCLP

SEQ ID NO: 32114 - protein, 82 aa, Anolis carolinensis
VTFEDVSVAFSEEEWALLDPSQKALHQEVMEENLEIVSSLGKGSHFPCSQTMKIEKTPFKYLEDGMNLNWKEVFSFCQETHT

SEQ ID NO: 32115 - protein, 90 aa, Anolis carolinensis
VTFQEVSVDFTEEEWALVSPGQRALHGEVMDENLRMVFSLGKTPFSSFQISLQEQKHCFRTLLWPSCICHVQANFLPETEISQKSRSFSQ

SEQ ID NO: 32116 - protein, 85 aa, Anolis carolinensis
IAFEDVAVDFSLEEWVLLNPDQKALHKQVMEENYKRFTKNTFLNGKGLVTVLHQNIFYNKSIEKAVQYTVTLWINYSIYEFSTKT

SEQ ID NO: 32117 - protein, 88 aa, Thamnophis sirtalis
VSFEDVAVFFSVEEWTLLDCEQKTLYQEVMLENAKNVASLTGDGWEMENSGQAAVALLPKDKKEVVEKFSGKPSPGEKELKGEPGKCS

SEQ ID NO: 32118 - protein, 98 aa, Anolis carolinensis
LTFEDVAVSFSPQEWEMLSDGQRELHWEVMMDNYKMLVSLGIYSSISRPEYKPGHLILPRKLGKLIDLSIRRENCNLRSTTSRDILILSRKHQNDPEE

SEQ ID NO: 32119 - protein, 82 aa, Thamnophis sirtalis
VFFKELVVYFSEEEWALLDRGQRTLYREVMLETYRIVASLSSVLEDSPAQELGCISSRMAKDEDQEEIAGDLKGSGGQEGQK

SEQ ID NO: 32120 - protein, 85 aa, Anolis carolinensis
VTFEEVAVDFTEEEWALLDPGQMALHQKVMEESLEILFSLGKGHPVFCLVNSHKIKEPKQLKKHQRKKPFHCWVCRKDFIWKSHL

SEQ ID NO: 32121 - protein, 95 aa, Anolis carolinensis
MQEWANLEDWQKEIYKNITKGNYKPLTSLDSAISKVEPPPQREAVVQEFAERKGLSALPKTEPELLASKDDLLSWIKQEEPPGKEKWDPEEELPS

SEQ ID NO: 32122 - protein, 98 aa, Thamnophis sirtalis
LSFEDVAVYFTEEECPLLNASQVALQLEVMVENYQNLTFIGREAWWNEAEDESQRVSLKRSRSIQEGLQSEGKEERVKVMRWDEFSLSERHPIQGATG

SEQ ID NO: 32123 - protein, 109 aa, Anolis carolinensis
VMFEDVAVHFSEEEWALLDVDQRSLHWEIMEENYKMVASLGQMSPILYLCISCLLPKNPCRLFVSTAFLFNFLQIASFIICNKSGDGQGSENGEAPYKVWLKTENFEEE

SEQ ID NO: 32124 - protein, 86 aa, Thamnophis sirtalis
VSLQEVVVCFSEEEWALLDPTQKSLHGEVMKENSRHVASLETGEDNSENCQAPDTESSQPKRAKVENEIFENRWRLGTFGERKKRT

SEQ ID NO: 32125 - protein, 84 aa, Thamnophis sirtalis
VSFEEVAVYFSEGEWSQLDPDQKALHWEIMLENHRNMASLGNDGQENKDSGEPFQVIIAGDRMETSAIGMEIERDEKNQPDSWN

SEQ ID NO: 32126 - protein, 86 aa, Thamnophis sirtalis
VSFREVAIHFNSEEWLLLDPSQKALYQEVMLETSRIVASLAFDTQKKENNQEPKLVSLLIIKTKIPEETSINKWGRRKHEKKNNRR

SEQ ID NO: 32127 - protein, 86 aa, Thamnophis sirtalis
VSFGEVAIHFNNEEWLLLDPSQKALYQEVMLETSRMVTSLASDVQKKKNDQEPNLVHLQIIKTKIPEETSKRKWGGRKHEKKHNRR

SEQ ID NO: 32128 - protein, 83 aa, Thamnophis sirtalis
VSFEELSIYFTEEEWGLLDCDQKALHGEVMLEMSKNVASLAGSKQKNEIYQESEETPIQILKVEVEEENQWQPKSEDGVQLND

SEQ ID NO: 32129 - protein, 82 aa, Thamnophis sirtalis
VTFEEVSVRFSKGEWGMLDPEQRALYQEVMVENYGTVVSLGDPWGKDGENRPVGTVPSEGPGKEAEDNLWNERGGKEEEENQ

SEQ ID NO: 32130 - protein, 87 aa, Micrurus corallinus
VSFEEVAVYFSEELDSNQKTLHSEVMLENYRNVTSLGNNGQENTDSSEPFQVFSPGDGMEKPAIQMKLESHERNLSYNWNHKSSSSI

SEQ ID NO: 32131 - protein, 85 aa, Micrurus corallinus
ASVEFTEEEWALLDSGQKALCREVMLEISRNMAMLGDRLENDNEKQMRLMPMETANLQAEEVIFDHQQDAKPQEKSYSEDQEARS

SEQ ID NO: 32132 - protein, 82 aa, Micrurus corallinus
VSFEEVAVRFSKGEWGMLDPEQRALYQEVMVENYGTVVSLGDTWENDGKNRPVRMVPSEGPGKEAEDNLWNQREGKEEENQP

SEQ ID NO: 32133 - protein, 98 aa, Pelodiscus sinensis
VSFEEVAVYFSEEEWALLDPGQRALYRDVMQENYEAVSWLGWVGSGGAGAVPSFNNNNNTITCCETAPALSFHEPPRGAANGRLGWPLEEVWKTTQTR

SEQ ID NO: 32134 - protein, 84 aa, Pseudonaja textilis
VSFEEVAVYFSEEEWSQLDPDQKVLHLEVMFENHRNVVSLGLGRHDRNNGLENQDSCELFQVINAKDGTEKFGIQMEFESHEKN

SEQ ID NO: 32135 - protein, 88 aa, Pseudonaja textilis
LFFLYVAMNFSEEQWALLNSDQKNFHREVTLENSRIVASLSKDLSSYLNFFQMGNKEAFQINSTFPSTEIQGFLPRKYQNEKINVGST

SEQ ID NO: 32136 - protein, 93 aa, Callipepla squamata
VSFAEVAVYFSREEWALLDAAQQAPYRDVMLETYKCVASLGAGIANIKKDLQESGVAKRQWGSISVDEMRRDVRVDLEQGQSEHIKKQNESTC

SEQ ID NO: 32137 - protein, 85 aa, Alligator mississippiensis
EAFEDVAVYFTREEWELLEDAQKGLYRDQMLSNCRALVFLGKKPHQCPECGKSFTHSSSLAYHQRIHTGEKPHQCSKCGKRFRGS

SEQ ID NO: 32138 - protein, 154 aa, Callipepla squamata
MSFEEVAVYFSREEWALLDPAQRALYRDSAGDVRVCGLTGISAGQKASARRGRTISLQSALFLLKKISLHVFRDGKAIFAPKEAAVFRASVIQAFIFTSLLGGTLCQNDGKAFLSPISVVAAPLPAPKPMVISLLEEGEEPWIPDVGSLEAVAG

SEQ ID NO: 32139 - protein, 84 aa, Alligator mississippiensis
EAFEDVAVYFTQREWELLGDEDKELYQDQMLRNYQALLSLDSCDLEDTWDSAAEESSIGSLPASDLCLEAASRSSTCPRHLRSI

SEQ ID NO: 32140 - protein, 82 aa, Notechis scutatus
VSFGEVAIHFNSEEWLLLDPSQKALYQEVMLETSRMVASLAFDAQKKENDQEPNLVPLQIIKTEIPEETSTNKWGRRKSEKK

SEQ ID NO: 32141 - protein, 82 aa, Notechis scutatus
VSFEDVAVYFTEEEWALLDSSQRALYREVMLENSRNLAALGKGLFRSDIQAFVEVFSCHKCSESSFCLEGGHFGLLFVFLRP

SEQ ID NO: 32142 - protein, 85 aa, Pantherophis guttatus
DPFEEITVDFTEEEWELLDSGQRTLCREVTLDAFRNMSALGDLMEKEKQGRSMLLHTLNYEVEVMFDHQGNPETQERSHSEGGEE

SEQ ID NO: 32143 - protein, 85 aa, Pantherophis guttatus
VSFEEVAVYFSEEEWSQLDPDQKALHSEVMLENHRNVVSLGNNGQENQDSCELYQVINAKDRMKKFGIQMELESHERNHSKNWNQ

SEQ ID NO: 32144 - protein, 84 aa, Mus caroli
VVFEDVAVNFTEEEWALLNSSQKHLYRDVMLEIYNNLACVGNKWEDQSMEDEHTNPRRSQRMCTFERLYESTESDQSGEIFTKT

SEQ ID NO: 32145 - protein, 84 aa, Mus musculus
VTFEDVAVNFSPGEWALLDSSQKKLYRDVMTETFMNLISIGKTEENIEEDYANVRSLRTQMIGRNCKYEDSFQRGEAHHRIPEY

SEQ ID NO: 32146 - protein, 84 aa, Cricetulus griseus
ITYDDVHIDFTWKEWTLLDTSQKNLYKDVMLETNKNLTDIGYSREDNTPEDHYTSSRRHERHEGRHTGEKPSAYTQCLKIFAHN

SEQ ID NO: 32147 - protein, 88 aa, Rattus norvegicus
VTFEDVAVNFTLGEWTMLDSSQKKLYRDVMKETFMNLISIGKTEEEDNEEYQNPKGSLRTLMVERLCKYHHGNQYGETQRQSPDHVVS

SEQ ID NO: 32148 - protein, 91 aa, Cavia porcellus
VSFEDVVVDFTWEEWKNLDDAQRTLYRDVMLETYSNLLSLDFKKTQDQIERNQKSQDRHLWQFVINSNTSAVDTGESVKIFNLNSNHISKM

SEQ ID NO: 32149 - protein, 85 aa, Cricetulus griseus
VSFKDVTVDFTQEEWTSLNPAQRSLYREVTLENYQNLASAEWKMQLETKCLAPQQGVLKGSSISNGMQMQTESQNGRELYNWTKS

SEQ ID NO: 32150 - protein, 92 aa, Mus caroli
LLFEDLDVYFSQEECVSLHPAQKTLSREAPLESFENLDSIGGEDQTESSQKLSLEPVKLEELSLEKDSIAAPLVHYSEQSEQDDEIHEDKMS

SEQ ID NO: 32151 - protein, 86 aa, Cricetulus griseus
VTFEDVAVDFTQEEWQYLNPPQRTLYRDVMLETYSNLVSVGSEDQGGIYHLSSLEQQVTKPDLIIKLEVEEPEPDGEISVWNFSEF

SEQ ID NO: 32152 - protein, 88 aa, Cricetulus griseus
LIFKDVAVDLSQEEWECLDCAQKELYMDVMLENYTNLVFRRPLLSPLYLKISGLHVLIKLKKTSVIECFTHALFLIISDCSNFPENHF

SEQ ID NO: 32153 - protein, 87 aa, Mus musculus
VTFEDVCVTFTQEEWDLLRPVQKKLYKDVMWETVRNLASVASELEDQDVSNQYRIQEENVRSYVIQRLYESKEVIEHGESFSQIPNT

SEQ ID NO: 32154 - protein, 83 aa, Cricetulus griseus
LSFRDVSVDLSQEEWESLDCAQRALYMDVMLENYGNLLFVENHRLCGKREKVLHRDTNDCIHGHENIQEKTNTCNEPAKGIHE

SEQ ID NO: 32155 - protein, 83 aa, Mus musculus
VTYDDVHVNFTQEEWALLDPSQKNLYRDVMLETYRNLAAIGYSWEDHNPEEHFQSSRRHGRSGRIHNSSFWMLSYLFLPFVGS

SEQ ID NO: 32156 - protein, 99 aa, Mus musculus
VLFHDVYIDFSQEEWECLTEEQRDLYRDVMLENYSNLLSMVLESRCEAQKLFLKKELYEIETAQWEIMRKLTRQDLQCSSLSSAREWHGHRERQRGSQE

SEQ ID NO: 32157 - protein, 83 aa, Cricetulus griseus
MRASPPRTSDSREWACLDSAQRAFYRDLMLETYSNLVTVEQEREPWMVVKEGTNRPSPECQDLLKNTAETWEGRHGHSKCCHR

SEQ ID NO: 32158 - protein, 84 aa, Cricetulus griseus
VTYDDVHIHFTWEEWALLDLSQKNLYKDVMLETCRNLTAVGCSWEDHNIGEGCQSSGRHRRYERSCTGEKPSEYTQCCTAFACH

SEQ ID NO: 32159 - protein, 87 aa, Cricetulus griseus
GIIKDVTVGFSQEERYLDPGQRSLYRGVMLENYSCVVSMGKATFCVMHNCEASGHFVKFNDISIKTILVNVEYQKIVEYTSFSEDNH

SEQ ID NO: 32160 - protein, 82 aa, Cricetulus griseus
VTFEDVAVNFTLGEWALLDSYQKELYRDVMKETFSNLISIGRTEEENIGEDYQNIRRNLSTHVIKGFYEFQHGIQYGEAHQQ

SEQ ID NO: 32161 - protein, 95 aa, Rattus norvegicus
LLFEDLDVYFSQEECVSLHSSQKTLSREAPLESFEDLNLTGEDRTETSQKLSLEPLELEELSLETYSTAVPLVRYLEQPEEDVEVHERKMSGGTL

SEQ ID NO: 32162 - protein, 84 aa, Mus musculus
VTFDDVHVDFTSEEWALLDPSQKSLYKDVMLETYWNLTAIGYNLEDQTIEEHFQSSRRHGRPERSHTGEKPYEEIKYGEAFAHH

SEQ ID NO: 32163 - protein, 91 aa, Mus caroli
VTFEDVAVDFTQEEWQYLNSPQRTLYRDVMLETYSNLVSVCEVASIGSEDQGGISPLSSLEQQVTKPDLIIKLEVEEPDPEDGEIPVWSFP

SEQ ID NO: 32164 - protein, 84 aa, Mus musculus
VTYDDVHMNFTEEEWDLLDSSQKRLYEEVMLETYQNLTDIGYNWQDHHIEEHCQSSRRHERHERSHIGEKPYERNQCGDYSYMI

SEQ ID NO: 32165 - protein, 84 aa, Octodon degus
VTFEDVAVNFYREEWALLDPSQKKLYRDVMWETFRNLAAVGRSSDDQHLDDKDRKCGKQLRSEEAEQSCEYELWCQRGEMGSQP

SEQ ID NO: 32166 - protein, 91 aa, Cricetulus griseus
LTFSDVAVDFSPDEWECLDPPQQSLYRDVMLENYRNLVSVALSHHCSQNFPPEQILKHSFKRVTNGRLGSHSLKSLRNWADSDENRGQTAC

SEQ ID NO: 32167 - protein, 90 aa, Cavia porcellus
VKFEDVAVDFTQEEWQYVNPPQRTLYRDVMLETYSHLVSLGKKGSWEMWLGISHFSLSGQQVTKPDLILKLEVEEPCLIEDRVPIWSFPE

SEQ ID NO: 32168 - protein, 95 aa, Cricetulus griseus
VSFEDVAVHFTQEEWALLDPSQKSLYRDVMLETCRNLAAIGNKWEKENVADCYRIPGRNLRTSVLETPHESTEDGQDEETMMWIANLHSSVAVFP

SEQ ID NO: 32169 - protein, 94 aa, Cricetulus griseus
MKYDDLNIYYSWEEWTLLATSQKNLYKDMMLETYKNLNDIGYIWEDHTIEEHCGEWTLLDISQKNVYKDTMLETYKNLNDIGYIREDHTIEEYC

SEQ ID NO: 32170 - protein, 83 aa, Cricetulus griseus
VAFEDVAVNFNSGEWALLNSFQKKLYRDVMKETFLNLISIEKAVEEKIGEDCKDFSRNSRIQVIEKDCGYACVHECDKTQEPI

SEQ ID NO: 32171 - protein, 88 aa, Mus musculus
LTFKEVAVDFSQEEWECLDCAQRALYMDVMLENYNNLLFVENNHHVCVKHDEVLGQGSKYSAPEHVNIQEKSNKWKECGKMIHESSKS

SEQ ID NO: 32172 - protein, 119 aa, Castor canadensis
VSFADVAVYFSPEEWGSLRPAQRALYRDVMRETYGLLGALGEAPPARLGPLSRSPWVLHVEWEALDPGSRDRMGRPPRSVGFAFLPPGGGGTKPALISWVEEEAELWGPDAQDPEVARC

SEQ ID NO: 32173 - protein, 83 aa, Peromyscus maniculatus
VTFEDVAVNFSLEEWAMLNPSQKNLYKDVMQETLRNLATIGNSLEHHIIENIYRNSWRKLSGQVVEGLYDFKDDHQCAEIFDF

SEQ ID NO: 32174 - protein, 84 aa, Peromyscus maniculatus
VTYNDVHIDFTWEEWTLLDLSQKNLYKDVMLETYWNLLTIGYSWEDHNIEEHCQSSRRYERHERSQAGEKPSIYTQCIKAFEHL

SEQ ID NO: 32175 - protein, 92 aa, Peromyscus maniculatus
VTYEDVRVNFTHEEWALLDPSQKSLYKDVMLETYWNLTCIGYKWEDCNIEKHCQNSRRNGRCIICHSRYKPCEHKGHEKKHCNSVCLRTTER

SEQ ID NO: 32176 - protein, 99 aa, Rattus norvegicus
VLFHDVYIDFSQEEWECLTEEQRDLYRDVMLENYSNLLSMVLESRCEAQKLFLKKELCEIEMAQWEIMRKLTRQNLQCSSLSGAREWNGHCERLRGSQE

SEQ ID NO: 32177 - protein, 90 aa, Rattus norvegicus
VTFEDVAVNFTVEEWALLGPSQKKLHRDVMEETFRNLAAIGKTQEDQNIDDDHRYSRRNQRNGVVERLLEHRKGCECKAIFRQIPDTTGN

SEQ ID NO: 32178 - protein, 85 aa, Cricetulus griseus
VTFADVAIDFTQEEWILLDTKQRNLYREVMLENYQNLATLEWAMRLKTGGTLLQQDIFQSDSYSGKELSKPPGEIFKEPSCSLTH

SEQ ID NO: 32179 - protein, 82 aa, Peromyscus maniculatus
LTFRDVTVDFSQEEWECLDSAQRALYIDVMLENYSNLVSVENYCICDPVHQHVNNEKESCQCNELGKVLHDLSKYALFKTSE

SEQ ID NO: 32180 - protein, 89 aa, Mesocricetus auratus
VTFEDVAVNFTLGEWTMLDSSQKKLYRDVMKETFLNLISIGKTEEEDIEEEYQKPKGTLRTLVVERLCKYDDGGPSGESCRQSPEHVVN

SEQ ID NO: 32181 - protein, 83 aa, Mesocricetus auratus
LTFRDVTVDFSQEEWECLDFAQRALYIDVMLENYSNLVFVENHRDSKHIVHHHVTTQEKSYNCNELGKSLHDSSQCTPHDTSD

SEQ ID NO: 32182 - protein, 86 aa, Ictidomys tridecemlineatus
LTFRDIAIDFSEEEWECLEPAQQNLYRDVMLETYRNLVFLGMTSHHTQKISSEPGIEYLFKKVIKRRYGNCDLYYLQQKKVCVSVG

SEQ ID NO: 32183 - protein, 97 aa, Ictidomys tridecemlineatus
VTFEDVAVHLTREEWGCLDPVQRDLYREVMLENYENVVSLGILLRLPITRIHCVNSCPALSHTQASAFSGETLAVLTAGISKRWWPKYRIFIGSARP

SEQ ID NO: 32184 - protein, 130 aa, Mesocricetus auratus
LTFWDLSVDFSQEEWECLDSVQRALYIDVMLENYSNLLYVENCCKCDPVQYNVKTEKESCQCDELDKVLHDPSTCALHRKSETTENSNDYTCSSHRDASVDSSNPDRRESIYTGEEPWQCKDCEKSVNLC

SEQ ID NO: 32185 - protein, 84 aa, Mus musculus
VSYDDVHVNFTQEEWVLLDPSQKSLYKDVMLETYRNLSAIGYNWEAHPTEEHCQSSRRRGRHERSPTGEEPYECNKSGKAFAYH

SEQ ID NO: 32186 - protein, 120 aa, Cricetulus griseus
VSFADVAVYFSPEEWGCLRPAQRALYREVMRETYGLLGALGEGLSWPPGLVLRVTLCVQRCSGEPWERAAGTKLFVLPASWRLLSFSPGVGGAKPALISWVEEEAELWGPGAQDPEVAMC

SEQ ID NO: 32187 - protein, 84 aa, Cricetulus griseus
VTYDDVHIDFTWDEWALLDPSQKSLYKNVMLETYRNLTAIGYKWEEHNIKELSQRPRRNGRHERCHTGEKPYECSQCDRKSVVY

SEQ ID NO: 32188 - protein, 84 aa, Peromyscus maniculatus
VTYDDIHVDFNWEEWTLLDPSQKTLYKDVMLETYSNLTAIGYSWEDHTIEKHHQHSTRHKRYERSHIGEEPSVYTQYSKVFAYD

SEQ ID NO: 32189 - protein, 83 aa, Peromyscus maniculatus
LSFRDVAVDISQEEWECLDCAQKALYMDVMLENYNNLLFVGKNFLIVEFLIHPFYLPTLCICKLADPRESLKCQNRSTHAVKK

SEQ ID NO: 32190 - protein, 84 aa, Peromyscus maniculatus
VTYNDVHVDITQEEWALKVPSQRNLYKDVVVETYMNLTAIGYNWEDLEVEEHCQNPLKHGRYERTHTGEKPYKCNQCGKAFARP

SEQ ID NO: 32191 - protein, 84 aa, Peromyscus maniculatus
LTFRDVVVDFTQEEWECLESSWRALYIDVMLENYNNLVFVEKHRTCRKNEKFLDQDSKHIAYQSVNIQKKPNKCNKLGKMVRES

SEQ ID NO: 32192 - protein, 83 aa, Mesocricetus auratus
VTYDDVHIDFTWEEWTLLDPSQKKLYEDVMQETYWNLTTIGYSWEDCHVEEYYQSSRRYGRNERSQTGEKPSLYTQCVKASSY

SEQ ID NO: 32193 - protein, 96 aa, Mesocricetus auratus
VTYDDVHIDFSWEEWTLLDPSQKNLYEDVMLETYRNLTAIGYSWEDHRTEEYYQHSRRYEKNERSQTGEKPSVYTQCCGKAYAYSSHLQRHKRTHT

SEQ ID NO: 32194 - protein, 84 aa, Mesocricetus auratus
VTYNDVHVNFTWEKWTLPDPSQKSLYKDVMLETYRNLTAIVNTGGACDSGVPFLQLLHLEAVTVEHSSRHRWALDSGDCSSKAS

SEQ ID NO: 32195 - protein, 85 aa, Peromyscus maniculatus
VTFEDVAVDFTQEEWQYLNPPQRTLYRDVMLETYSNLVSVGSEDQGGIYHLSSSEQQVTKPDLIIKLEVEEPEPEDGEISVWSFP

SEQ ID NO: 32196 - protein, 84 aa, Peromyscus maniculatus
VTYEDVHVNFTHEEWALLDPSQKSLYKDVMLETYWNLTCIGYKWEDCNSEEHCQSSRRNGRCVICHSGHTPWEHKGYGKKHCSS

SEQ ID NO: 32197 - protein, 82 aa, Peromyscus maniculatus
LTFRDVTVDFPQEEWECLDSAQRALYIDVMLENYSNLVSVENYCKCDPIHPHVKAEKESCQCYELGKMVHQSSKCALYGTSE

SEQ ID NO: 32198 - protein, 83 aa, Mus musculus
VAFEDVAVNFTHEEWALLDDSQKELYQDVMQETVDNLASIGENWQDQSIRDQCKTQGKYISAHVEQRPREWKSACREVFTQLP

SEQ ID NO: 32199 - protein, 89 aa, Cricetulus griseus
VSFADVAVYFSPEEWGCLRPAQRALYREVMRETYGLLGALGEGLSWPPGLVLRVTLCVQRCSRPVVVPSDCRQEERKRPKEETEATQKT

SEQ ID NO: 32200 - protein, 82 aa, Cricetulus griseus
VTFEDVAVNFTSGEWALLDSSQKKLYRDVMKETFLNLMSIEKGLEQNIEEHYKDFCRNLRTQLVEKDGGYEYNSQCDDNLQT

SEQ ID NO: 32201 - protein, 82 aa, Peromyscus maniculatus
VTYEDVHVNFTHEEWALLDPSQKSLYKDVMLETYWNLTIVGYKWEDHNIEEHYPNSTRHSRLMKFRLTLNFRHFCFHLKLLE

SEQ ID NO: 32202 - protein, 84 aa, Peromyscus maniculatus
VTYDDVHIHFSWEEWALLDPSQKSLYKYVMRETYRNLTAIGCSWEDCNIEEGCQSSRRHERHERSHTGEEHYECNQCGKAFGSH

SEQ ID NO: 32203 - protein, 83 aa, Peromyscus maniculatus
VAFEDVAVNFSHEEWALLDPSQKKLYRDVMQETFTNLASIGENWEDQSIGDEYETQGRNIRAHVEQRPCEWKSPCRETFIQVP

SEQ ID NO: 32204 - protein, 85 aa, Peromyscus maniculatus
VTYNDVHVDITQEEWALMDPSQRNLYKDVMVETYMNLTAIGMKDLIPQRNPVNIWGVVKPLYVIVMLKGMKKHKLERNPMNIINV

SEQ ID NO: 32205 - protein, 85 aa, Peromyscus maniculatus
VTYNNVHVDFTQEEWMLLDLSQKSLYKDVLLETYRNLTAIGMKEVIQKRNPLSIFNVLKPSYIAVLFRGMKEFILERNSMKVFSM

SEQ ID NO: 32206 - protein, 110 aa, Ictidomys tridecemlineatus
VTFEDVFVYFSWEEWELLEEAQKFLYRDVMLENFALVATLGCWCDADNEKALFEQSISVERQLEIRHPESDLFIQKAYPCFMSVPLLKDILHLGEHQGSCPVEKLHMCGP

SEQ ID NO: 32207 - protein, 82 aa, Ictidomys tridecemlineatus
LTFRDVAIDLSEEEWECLEPAQRNLYRDVMLENYRNLVFLAMTSHHTQKILPEPSRQHLFIKMLKRRYEYCKLDHLQEKKIQ

SEQ ID NO: 32208 - protein, 85 aa, Mus caroli
VSFEDVTVDFSQEEWQHLDSAQRRLYQDVMLEIYSHLLSVGKLQLDTQHQQIFVKASFLSDAASEVTKHGSIYCSVLEKLWQEGD

SEQ ID NO: 32209 - protein, 83 aa, Mus musculus
VTLEDVAVNFTLEEWTMLNASQKELYKDVMQDTLRNLSYIGNKWEHQNIENEYETLWRKLSSQLLERLCEYTEGHQRAEIFNW

SEQ ID NO: 32210 - protein, 87 aa, Mus musculus
VTYEDVHVNFTQEEWALLDPSQKKLYKDVMVETYRNLNAIGVKGVRVQRNPLNILNVVKPLLYMLTVMPKGMKGFIQKRSPLKLFTV

SEQ ID NO: 32211 - protein, 96 aa, Mus musculus
VTFEDVAVHLTREEWGCLDPVQRELYREVMLENYGNVVSLGILLRLPTTRIHCVNSCPALSHTQASAFSGETLAVLTAGITKRWPRDRLSIGSAHP

SEQ ID NO: 32212 - protein, 84 aa, Peromyscus maniculatus
MYDDVHVDFTQEEWALLDPSQKSLYKDVMLETYRNLTSIGIKEIILKRNILNILKVLMHMHIIIIFKGMKESILERNPMNATNV

SEQ ID NO: 32213 - protein, 95 aa, Peromyscus maniculatus
VTYDDVHVGFTWEEWALLDPSQKNLYKDVMLQTYWNLTTIGYCWEDHNTDEHCQSSRRHGRHERSQTGEKTSVYILCGKAFAYESHLHGHERTHT

SEQ ID NO: 32214 - protein, 83 aa, Cricetulus griseus
GSIENDGVCFSEQEWENLEDWQKELYRNVMESNYETLVSLKVLGQPEEEAELGAEMVGDLVEEGTHLADRAMVKQEGPAGLPS

SEQ ID NO: 32215 - protein, 84 aa, Cricetulus griseus
LTFRHVAVDLSREEWECLDHAQRTLYIDVMLENYSNLVFVETHRLCGQYEKILDQGTKHEHGNIQEKSYEFSELDKMILESSQC

SEQ ID NO: 32216 - protein, 82 aa, Peromyscus maniculatus
VTFEDVAVKFTSGEWALLDSSQKKLYKDVMKETFLNLTFIEKTLEENIEEDYKDLCRNLGTQVVEKDCGYECDSQCDEIQEP

SEQ ID NO: 32217 - protein, 112 aa, Peromyscus maniculatus
VTYNDVHVDITHDEWALLDLAQRNLYKDVMLETYMNFNDIGYNWEDLEVEEHCQSSQKHGRHERSHTTEKSYEHAQCGKAFVNHSHPPRYEKTHTGERPYEYNQYIKAFAQD

SEQ ID NO: 32218 - protein, 84 aa, Peromyscus maniculatus
VTYNDVHVDITQEEWALMDPSQRNLYKDVMVETYMNLTAIGYNWENLEVEEPCQNPLKHGRHERPHTGEKPYEYNQCGKAFAQP

SEQ ID NO: 32219 - protein, 83 aa, Peromyscus maniculatus
LSFRDIAVDLSQEEWECLDCVQRELYMGVMLENYSNLIFVETHRIYGQYEFVDQGTKHILHNCDNIHEKSYICNKLDNLIDES

SEQ ID NO: 32220 - protein, 94 aa, Peromyscus maniculatus
VSFEDVAVYFSWEEWKLLDDSQRLLYQTVMTEIFALVSSLRLELSGINDTTQMECCGDLSVPALRFMTPCLWTGCWIKVESETPRFEQSLSTEG

SEQ ID NO: 32221 - protein, 84 aa, Rattus norvegicus
VTYDDVHVNFTHEEWALLDPSQKNLYKDVMLETYLNLCGIGCKWEDCNIEEHCQSSGRHERDLLNMAYPFLMGTQSKEDRWTTT

SEQ ID NO: 32222 - protein, 85 aa, Cricetulus griseus
LSFRDVAIDFSAEERECLGRDQWSLYRNVMLENYSHLVYLGKKPHKCKECGKAFAKNSILTHHLRIHTGEKPYKCDICGKAFSLP

SEQ ID NO: 32223 - protein, 83 aa, Mus musculus
MTYDDVHVNFTEEEWALLSPSQKRLYKDVMLETYKNLTAIGYNWEDHNSEHFQHSRRHGRHERSHTGEKPSVYTQCGKVFAYR

SEQ ID NO: 32224 - protein, 86 aa, Cricetulus griseus
VLFKDVSVVFTQKEWQLLGAAQRRLYREVMLETYRHLQAVALSSFVKPCHPPMTGCNVTKPELICRLERGEGPWEPPGCSLSGELM

SEQ ID NO: 32225 - protein, 83 aa, Mesocricetus auratus
VTFEDVTVKFSVEEWTLLSPSQKELYRDVMQETFRNLASIGMEPEDQNFENDYRSSQRNPKSQKGQGLCEHNEDGQCVENSWI

SEQ ID NO: 32226 - protein, 87 aa, Marmota monax
LTFKDVAVDFSEEEWECLEPAQQNLYADVMLENYRNLVFLATTSHHIHESPPEQEIKSLFQKMMKGRYHDSDKPHKFKECGKIFNQR

SEQ ID NO: 32227 - protein, 84 aa, Peromyscus maniculatus
ITYEDVAVDFTQEEWECLTEKQKAVYQNVLSETFKNLTFVDQNTMQNGKGRRRSGFHPPKTAGHKRKSQKPSSNLEDEERDDEE

SEQ ID NO: 32228 - protein, 86 aa, Mesocricetus auratus
LTFDDVAVNFTLEEWDLLDSSQKQLYIDVMQETFKNLVAIGLTEEGQRIEDDDHSRRNLRNRVVEILFEPSEGRQCEEIFSEFPDT

SEQ ID NO: 32229 - protein, 85 aa, Cricetulus griseus
LSFRDVAVDFSPEESECLDPAQWDLYSDVMLENYSNLVSLGTKPYKCKECDKAFVRNSLLIQHQRIHTGEKPYKCEQCGKTFSCS

SEQ ID NO: 32230 - protein, 84 aa, Marmota monax
VTFEDVTIIFTWEEWKFLDSSQKNLYWEVMWENYTNVMSLGNLNESYKPQEERFKYLQYENFSFLQSWRNASTQIYENQNYNET

SEQ ID NO: 32231 - protein, 82 aa, Marmota monax
LTFRDVAIDLSEEEWEYLEPAQRNLYRDVMLENYRNLVFLAMTSHHTQKILPEPSRQHLFIKVIKRRYEYCKLDHLQQKKIQ

SEQ ID NO: 32232 - protein, 82 aa, Mus musculus
VTFEDVAVNFTSGEWTLLDSSQKKLYRDVMKENFLNLISIEKTREENVEEDYQNLRTQVIEKDGECERGCQCEQTQAQSPEY

SEQ ID NO: 32233 - protein, 83 aa, Cavia porcellus
VTIRDIIVEFTPEEWLMLDSAQRNLYKDVMFENYRNLTAVEDQLCTLSVNSFLDQEEISMKRISQALCPDWMIEFKTKESIPT

SEQ ID NO: 32234 - protein, 82 aa, Cricetulus griseus
STFRDVTVDISQKEKECLGSAQRALYIDVMLENYNNLVSVENYCKCDPVHHHVKTETESCQCNELGKVLHDPSSCALYRTSE

SEQ ID NO: 32235 - protein, 112 aa, Peromyscus maniculatus
MSYNDVHVDITQEEWALMNPSQRNLYKDVMVETYMNLTAIGYNWEDLEVEEPCQNPLKHGRHERPHNTEKSCEYMGCGKAFVCRSHPPRHERTHTGEKPYEYSQCGKAFAHP

SEQ ID NO: 32236 - protein, 82 aa, Peromyscus maniculatus
LTFRDVTVDFSQEEWECLDSAQRALYIDVMLENYSNLASVENYCICDPVHQHVKTEKESCQCNELGKVLHDLSKYALYRTNE

SEQ ID NO: 32237 - protein, 84 aa, Mesocricetus auratus
VTYDDVQIHFIQEEWALLNPSQKRIYKDVMLDTYRNIIALGETEEDQNFEEYCQTSRRHRRHKRSHMGEKPYECIQCGKAYAYQ

SEQ ID NO: 32238 - protein, 100 aa, Mesocricetus auratus
VTFRDVAVVFSKEELELLDAAQRKLYRDVMLETFRTLLSVGEDGAWVSPGMHGTSCVGARGLLDVFSRCLTGSTGGFSWLLHTGEKPYKCEECGKSFSRS

SEQ ID NO: 32239 - protein, 95 aa, Heterocephalus glaber
VTFEDVAVNFTMEEWALLNPSQKKLYRDVMGETFRSMAAVGHLVNSLSKFLSRHENRTCSGKSLIWRPILLWLFYFFYSNKAWNQYKEIFLWTPD

SEQ ID NO: 32240 - protein, 82 aa, Heterocephalus glaber
VTFDDVVVNFTLDEWDLLDYSQRELYRDVVGEIFMSLAFIGEKWNQNIEDWYRNQGRNLSHIVESHCESDEGGQCGETFTEI

SEQ ID NO: 32241 - protein, 83 aa, Mesocricetus auratus
VTFEDVAVNFSLEEWAMLNPSQKNLYKDVMQETLRNLATIGSSLEHHIIENIYRNSWRKLSGQAVEGLYDYKEDHQCAELFDF

SEQ ID NO: 32242 - protein, 85 aa, Mesocricetus auratus
VTCEDVHVNFTQDEWALLDPSQKSLYKDVMRETYRNLIAIGMKEVILEKKPMNVINVVKPLQITVVSKYIEELILEKNPTNVINV

SEQ ID NO: 32243 - protein, 86 aa, Ictidomys tridecemlineatus
LAFTDVTIDFSEEEWECLEPAQRNLYKEVMLETYRNLVFLGMTSHHTQKISSEPGIEYLFKKVIKRRYGNCDLYYLQQKKVCVSVG

SEQ ID NO: 32244 - protein, 95 aa, Marmota monax
LTFRDVAIDFTEEEWECLQPAQKNLYRDVMLENYRNLAFLAMTSNHTQEYSPEKGLKHIFHEVISAKYRSCDLDCLQQKKIWKTTSESEHQKSYK

SEQ ID NO: 32245 - protein, 87 aa, Marmota monax
MTFEDVAVNFTLEEWALLDHSQKDLYREVMLETFRNLTSVGIQWEDQNIDNEYKNCRRNLRSQVIERLCGYKEGSPYEEIFSQISDH

SEQ ID NO: 32246 - protein, 92 aa, Heterocephalus glaber
VVFEDVAIYFSQEEWGHLSEAQRLLYCDVMLENLALLSSLGCWHGAKDEEALFEQGISVGASQVTTPKPGSSTEKTQPRESLLKDILHLAEH

SEQ ID NO: 32247 - protein, 83 aa, Heterocephalus glaber
VTFEDVAVNFTMEEWALLDPSQKKLYRDVMWENFRNVAAIGRNWDDQQIEDEYKNCRRNLRSEGEKCCQYKLCQQHGETFFWT

SEQ ID NO: 32248 - protein, 95 aa, Mus musculus
VSFEDVAVHFTQDEWALLDSSQKSLYRDVMLETCRSLATIGYKWEDQNLEDHCINPGRNLRSYMFQTFCENEGDDQGGENLPWKPNLSMNMRCST

SEQ ID NO: 32249 - protein, 82 aa, Cricetulus griseus
LTFGDVSVDFPQEEWECLDSAQRALYIDVMLENYSNLVSVENYCKCEPVHHHVKTEKESCQCNELGKVPHDPSTCALHRTSE

SEQ ID NO: 32250 - protein, 84 aa, Peromyscus maniculatus
LTYEDVHVNFTPEEWALLNPSQKSLYEEMMLETCRNLTAIGYKWEDQNIEEHHPSSRRHERYLICPSGYKPFEHKGYGKKQCTS

SEQ ID NO: 32251 - protein, 83 aa, Peromyscus maniculatus
VSFEDVAVHFTQEEWALLDPSQKSLYRDVMQETCRNLAVIGHKWENQNIEDHYKSPRRNLRSYLLQTCENEGGNQDRENLTWK

SEQ ID NO: 32252 - protein, 82 aa, Mesocricetus auratus
VTFEDVAVNFTLGEWALLDSYQKELYRDVMKETFMNLLSIEKTQEENIEEDYQNLRRNLGTQVVEKDGEYEHENQCEETQQQ

SEQ ID NO: 32253 - protein, 83 aa, Mesocricetus auratus
VTYDDVCIDFTWEEWTLLDPSQKKLYKDVMLETYRNLTAIGYNWENHHVEEYYQSSRRNARNEKSQTAEKPSVNTQCVKAFTH

SEQ ID NO: 32254 - protein, 84 aa, Mesocricetus auratus
VTYDDVHIEFTWEEWTLMDPSQKNLYKDVMLETYRNLTTIGYSWKDRHVEGYYQSSGRNERHERSQTGEKPSGYTQCVKAFAYD

SEQ ID NO: 32255 - protein, 95 aa, Cricetulus griseus
VVFRDVAVEFCKDEWECLGPDQRSLYRDVMLETYSNFVSLDLLSVNETKNLSLESGIFGKESLKWKIIERVGNSCLEESCFGNDWKFKGLLETQP

SEQ ID NO: 32256 - protein, 104 aa, Cricetulus griseus
VTFEDVAIYFSQEEWALLDKAQRFLYCTVMLENLALVASLGSCPGMQGEEITYAVPSEGVLSKTSPSTQVTNRFETPAPALEEVLHQAEFPSSHTMQPLYLAGA

SEQ ID NO: 32257 - protein, 85 aa, Cricetulus griseus
LKYKDVHIDFTWEEWALLDTSQKNLYKDVMLETYKNLNDIGLKEFKPERSLPYIHNVIKTLKIPFIFKHIKEHTLERNPMNATNV

SEQ ID NO: 32258 - protein, 91 aa, Cricetulus griseus
LSFRDVDVDFSQEEWECLDSAQRTLYMDVMLESYSNLVFVVLAQHDLNPSTLDAGARVYEYHRICDKCGKVLDQGTEHNVHEHAKIQEKTY

SEQ ID NO: 32259 - protein, 83 aa, Peromyscus maniculatus
GSLENDGVCFSEQEWENLEDWQKELYRNVMESNYETLVSLKVLGQPEEEAELGAEMVGDLVEEGTHLADRAMVKQEALYKQEG

SEQ ID NO: 32260 - protein, 96 aa, Peromyscus maniculatus
VTFEDVAVHLTREEWGCLDPVQRELYREVMLENYGNVVSLGILLRLPTTRIHCVNSCPALSHTQASAFSGETLAVLTAGITKRWPRYRLSIGSARP

SEQ ID NO: 32261 - protein, 84 aa, Peromyscus maniculatus
VTYDDVHVDFTWEEWTLLDPSQKTLYKDVMLETYSNLTAIGYSWEDHNIEKHHQNSRRHERHERNHTGEEPSVYTQCVKVFEYD

SEQ ID NO: 32262 - protein, 93 aa, Peromyscus maniculatus
VTFEDVAVNFTLGEWALLDSYQKELYKDVMKETFSNLISIGKAEEEHIGEDYQNIRRNLSTHMVKGFYEFERGIQYGEAPQQIQEHIVNECTP

SEQ ID NO: 32263 - protein, 82 aa, Mesocricetus auratus
VTFSDVAIDFSQEEWACLDSAEGLYWDVMLEKASNLISLDTEASSGTNILAIRRSIYGLNFCKRNSSDKSVSSHGIGEGEHE

SEQ ID NO: 32264 - protein, 99 aa, Mesocricetus auratus
VLFRDVYIDFSQEEWECLTEEQRDLYRDVMLENYSNLLSMVLESRCEAQKLFLKKELYEIESAQWEIMRKLTRQDLQCTSLSGAWEWSGQCTGQRGSQE

SEQ ID NO: 32265 - protein, 87 aa, Cricetulus griseus
VTFEDVAVNFTSGEWTLLDSNQKKLYRDVMKETFMNLLSIEKTQEENNEEDHQNLRRNLGTQVVEKDSEYEHENWCEETQQQIPVHI

SEQ ID NO: 32266 - protein, 83 aa, Cricetulus griseus
LSFRDVSVDLSQEEWESLDCAQRALYMDVMLENYGNLLFVENHRLCGKREKVLHQDTNDCIHGHENIQEKTNTCKEPAKGIHE

SEQ ID NO: 32267 - protein, 82 aa, Cricetulus griseus
LTFRDVAVDFSREEWECLDCTQRALYIDVMLENYSNLLSVENCCICNPVHHHVKTEKESCQCNELGRVLHDPSTCALYRTSE

SEQ ID NO: 32268 - protein, 120 aa, Ictidomys tridecemlineatus
VSFADVAVYFSLEEWGCLRPSQRALYRDVMRETYLHLSALGESPACPPAPTCPLYPGLCPRSGRPQVGEVGTVWGGLSTTRGLRSFFPGGGGTKPALISWVEEEAELWHPDAQDPEVAKC

SEQ ID NO: 32269 - protein, 101 aa, Heterocephalus glaber
VTFKDVAVDFTREEWHHVDSAQRSLYRDVMLENYSHLVSLDWKTRPEAKSSKLQHSTSEVSPSTDDFSHVTLEDAWDISSQLERQQKNWRRYLGPEVSTQK

SEQ ID NO: 32270 - protein, 92 aa, Cricetulus griseus
VTFEDVAVDFTQEEWQYLNPPQRTLYRDVMLETYSNLVSVGKMASSSSEDQGGIYHLSSLEQQVTKPDLIIKLEVEEPEPDGEISVWNFSEF

SEQ ID NO: 32271 - protein, 84 aa, Mesocricetus auratus
VTYDDVHIDFTWEEWTLMDPSQKKLYEDVMLETYRNLTTVGYNWEDHHVEEYCQSSRRYERNERSQTGEKPSVYTQCVKAFAYD

SEQ ID NO: 32272 - protein, 85 aa, Mesocricetus auratus
VTYDDVHITFTQEEWALLDPSQKSLYKDVILETYRNPSAIGMKEAIQKRNPMYILSVLKPLHVASIFKGMKKFILQRSHMKVFIM

SEQ ID NO: 32273 - protein, 84 aa, Marmota monax
MDIAIDFTEEEWECLQPAQKNLYRDVMLENYRNLTFLAITPNHTQEYSPDKGLKHIFHEVISVKYRSCDLDYLPQKKLWKTTSE

SEQ ID NO: 32274 - protein, 87 aa, Heterocephalus glaber
VTFEDIAVYFSQEEWGLLDETQRFLYLDVMLENFALTTSLVCGQETEDGEAPSVQSVSVEVASQVKTLKAGPSTQKAHACDICVPAL

SEQ ID NO: 32275 - protein, 94 aa, Mus caroli
VTYEDVHVNFTKEEWVLLHPSQKSLYKDVMLETCRNLTAIGYKWEDHNIEESCQSSGRYKRNNICHSGPQPCEYQGYGKKQCTVASNSVLQTYG

SEQ ID NO: 32276 - protein, 83 aa, Mus caroli
VTYEDVHVNFTKEEWSLLDPFQKKFYKDVMLETYANFNAIGVSWKDQNSEEHYQISRRHGRFERSQSAEKSSEYTQLGKAFDL

SEQ ID NO: 32277 - protein, 116 aa, Mus caroli
VTFEDVAVNFTSGEWTLLDSSQKKLYRDVMKENFLNLISIEKTQEENVEEDYQNLRTQVIEIDGECEQTQAQSPEYIVNEDMPPAATGCGSSLYVRNIIGNSPWDVHLSDQTREKP

SEQ ID NO: 32278 - protein, 89 aa, Peromyscus maniculatus
VSFADVAVYFSPQEWGCLRPAQRALYREVMRETYGLLGALAASVTFHSQGFLGSLHSGFPGPKPALISWMEQESEAWSPAAQDPEEGES

SEQ ID NO: 32279 - protein, 92 aa, Peromyscus maniculatus
VAYEDVQVNFTHEEWALLDPSQKNLYRDVMLEICDNLTAIGYKWEDHNIGEHCQGSRRHGRYIICHSGYKPCEHKGSEKKIGTSLSPRKIKR

SEQ ID NO: 32280 - protein, 89 aa, Peromyscus maniculatus
VTFEDVAVKFTLGEWALLDSSQKKLYTDVMMETFMNLISIGKTEEENIDVDYRKQQRNLRIQVIERFCGYEHGSQCGKTHQQIPENTVN

SEQ ID NO: 32281 - protein, 109 aa, Peromyscus maniculatus
VTFEDVAVKFTLEEWTLLSPLQKNLYRTVMRETIRNLHAIGQKLGEQNTENEYKNPGGNLRCQVVERLCDYEGSHWEEIFKEMPDPVVNQKTGEKPCESPEYEDFIGPS

SEQ ID NO: 32282 - protein, 123 aa, Marmota monax
VTVTSMAMDFSRQPDPAQRTFCKDVLWEEQSGQESVGKASLSRPGLSAEPRCTHRGGSSEVLPGLRPWLCGNESLSLEGHSVTTPSLAPHAGRGVSKPDVASFLEQEEEPWRVPRELAAGLFS

SEQ ID NO: 32283 - protein, 87 aa, Marmota monax
LTFGDVVIDFSEEEWECLEPAQQNLYRDVMLETYRNLVFLGMTSHHTQKISSEPGIEYLFKKVIKRRYGNCDLDYFQQKKVCDSVGE

SEQ ID NO: 32284 - protein, 97 aa, Heterocephalus glaber
ILFDDLAVYFSQEECVNLNPAQKSLTREATQECSNDVTLMGGESNTEINEQLSLESLELEQLSLENYSIAAPEVHSQRSSEDGVGIPERKKSGGTST

SEQ ID NO: 32285 - protein, 94 aa, Mus musculus
VSFEDVAVYFSWEEWTLLDDSQRLLYQTVMTEIFTLVSSLRLELSGIHDSTQVESCGDLSVPALRFLTPCLWTGCWIKVESETPPFNQSLSTEG

SEQ ID NO: 32286 - protein, 87 aa, Cricetulus griseus
VSFEDVAVKFTQEEWAMLDPSQKKLYKDVMQETLRNLAFIGNKLKNQKIVSEYENLWRKLSSQLVEQFYEYKESFQCTEICSWIPEP

SEQ ID NO: 32287 - protein, 84 aa, Cricetulus griseus
VTFEDVAVNFTDEEWALLDPMQKNLYRDVMQETYRNLTSIETEWEQWDLEAYYRSLKQNLRIQVIKRDRELADSGRHRKAVAKN

SEQ ID NO: 32288 - protein, 85 aa, Cricetulus griseus
LTFMDVAVYFPQEEWECLDSAQRALCIDVMLENYNNLVFVGRSPKVWNSRLKIQRSICRPETSGAAVPPLAARPGKVSSQQRSGG

SEQ ID NO: 32289 - protein, 85 aa, Mesocricetus auratus
VTYQDLHINFTQEEWALLDPSQKNLYKDVMLEAYMNLKAIGYKWEDDNIKEHHQHSQRHASVIWSLIWCREFWNPDPGAQKSGCS

SEQ ID NO: 32290 - protein, 88 aa, Mesocricetus auratus
VTYDDVHINFTQEEWALLNPSQKSLYKDVMLDTYMNLSAVGYSWDDHSIEEHCQSSRRPIRCLQSHEKIHTGEKPYKCFLYGEVFASH

SEQ ID NO: 32291 - protein, 84 aa, Mesocricetus auratus
VSFEDVAVHFTQEEWALLDPSQKSLYRDVMLETCRNLAAIGYIWEEQTIEDDCKNFGRYQRHTISHSEYTPYEHEECGNMPCDP

SEQ ID NO: 32292 - protein, 84 aa, Neotoma lepida
VTFEDVAIFFSKEEWRLLDEAQRQLYLRVMLENFALVTSLDCWQGMENGKLPFDQVSVERLSLVRTPKASPAKEESHPCDMYLP

SEQ ID NO: 32293 - protein, 97 aa, Mus musculus
VTFRDVAVVFSKEELGLLDAAQRKLYHDVMLENFRNLLAVGGQSPNKIETLHAMGVRCLSLERLPCWQMTSHDVNKLARTPEDGINTQGKGSHFLEP

SEQ ID NO: 32294 - protein, 83 aa, Cricetulus griseus
VTFEDVAVNFSLEEWAMLNPSQKNLYKDVMQETLRNLASIGSSLEHHIIENIYRNSWRKLSGQVVEGLYDYKDDHQCTEIFDF

SEQ ID NO: 32295 - protein, 94 aa, Cricetulus griseus
VTFEDVAVTFTDEEWRHLVPVQRALYKAVMLETYETIISLDQETKPESLAASEGTLGESHRQQSPLCPKPKVQTLAGGSGPEKERLEAETCKKP

SEQ ID NO: 32296 - protein, 83 aa, Peromyscus maniculatus
VSFADVAVYFSPQEWGCLRPAQRALYREVMRETYGLLGALGDTSDKKEEGCKEGAERPAETPALLPSKEVVEHKTHSMVPKSS

SEQ ID NO: 32297 - protein, 84 aa, Peromyscus maniculatus
VTYDDVHVNFTWEEWTFLGPSQKSLYKDVMLETYRNLTTVGYNWEAHNIEEHIQSSRRDERHEKNQIGEKPSIYTQCVKALAYP

SEQ ID NO: 32298 - protein, 84 aa, Peromyscus maniculatus
VTYDDVHVNFTWEEWTLLDPSQKNLYKDVMLETYRNLTTIGYSWEDHNFEEHCKSSRRRERHERSHTGEQPSEYTQCVKAFVYD

SEQ ID NO: 32299 - protein, 86 aa, Ictidomys tridecemlineatus
LAFRDVAIDFSEEEWKCLEPAQQNLYRDVMLENYRNLIFLAMNSQYTQKISPESCIKLFFKKVIKRRYRNCDLDHLQQKKVQDSVG

SEQ ID NO: 32300 - protein, 87 aa, Heterocephalus glaber
VAFEDVSVDFTQEEWALLDPLQKKLYRDVMWETFRNLAYVGSKWEDQQIKDQYKKQGRNLRSYLIQRLCESKEDGQYGETLSRISDP

SEQ ID NO: 32301 - protein, 97 aa, Heterocephalus glaber
VTLEDVAVNLTKVEWASLNPPQKKLYRDVMWEAYMHMTAIERTCGNQQIRTVYKNCSRNVRNDADKYLRFEEILYKCSEHGKTCSDFQSFQKREMRK

SEQ ID NO: 32302 - protein, 93 aa, Heterocephalus glaber
VTFEDVAVNFTVEEWALLNPSQKKLYRDVMEETFRNMAAIGRAWDNQEVEEECKNSWRYLRNVELEKYYQYTAWNQCKEVFLCSRAANVDMKQ

SEQ ID NO: 32303 - protein, 87 aa, Mus caroli
VTYKDVHVNFTQEEWALLDPSQKKLYKDVMLETYRNLMAIGFNWDDKNIEEHCQSFGRHTRHERSQSTEKPSEYTQCGKAFALHAHS

SEQ ID NO: 32304 - protein, 105 aa, Mus caroli
LRFKDVAVDFSQEEWECLDCAQRALYMDVMLENYNNLFFVVFSENDHICYKYKNVLDEDAQQIVHQHLNIQEKSYKCHEPAKITHASTQNSPYKINLRDTTVESS

SEQ ID NO: 32305 - protein, 89 aa, Mus musculus
VTFEDVAVNFTLGEWTMLDSSQKKLYRDVMKETFLNLISIGKTEEEDTEEEYQNPKGNLRTLMVERLCKYDYGNQYGETHQQSPEHVAN

SEQ ID NO: 32306 - protein, 84 aa, Cricetulus griseus
VTCDDVHIALTWEEWTLLNPSQKNLYEDVMLETYRSLTSIGYSWEDHHIEEYCQHSRRYERKERSETGEKPSVYACCVKAFVYD

SEQ ID NO: 32307 - protein, 82 aa, Cricetulus griseus
LTFFDVAVNFSREEWQCLDSAQRALCIDVMLENYSNLAYVENYYKCDPVHRHVKTEKESCQCNELGKVPHDPSTCALYRTSE

SEQ ID NO: 32308 - protein, 84 aa, Cricetulus griseus
VSFEDVAVQFTQEEWDLLDASQKSLYGDVMLETCRNFTAIERPYKCQQCSKAFRCLNALQSHERIHTGEKPYECKHCGTAFSRL

SEQ ID NO: 32309 - protein, 103 aa, Peromyscus maniculatus
VSFEDIAVYFTWQEWQDLDIAQKLLYRDVMLENYSSLVSLGCCMVKPELILTLEHEFGLWRVADTSVWNLPGYCVTRPGLNIKLQHGFEPWSASQASLWSLPD

SEQ ID NO: 32310 - protein, 82 aa, Mesocricetus auratus
VNYDDVHINFTQEEWNFLDLSQKSLYKDVMLEAYRNLISIGCSWEDHNIEGYFHSSTKLIKHLQRHEKIHTGEKPYESLQYG

SEQ ID NO: 32311 - protein, 85 aa, Neotoma lepida
LTFQDATVDFSQAESECLDSAQGTLYIDVILETYNNLVFVDENILLNDCKCDPVHQHVKTETESVSVMSLAKYFMTPPHVHFIKQ

SEQ ID NO: 32312 - protein, 86 aa, Mus musculus
VSFDDVTVDFSQEEWQHLDSAQRRLYQDVMLEIYSHLLSVGKLQLDTQHQQIFVKASFLSDAASEVTKHGSIYCSVLEKLWQEGDP

SEQ ID NO: 32313 - protein, 89 aa, Cavia porcellus
VNFEDVTVKFTPEEWDLLTPFQKKLYRGVMWETYMNITVTRRIWHNLQIKEEDKNCSRNLRCDKDNYLRIEKQQYKYNEDMETCSDFQS

SEQ ID NO: 32314 - protein, 92 aa, Cricetulus griseus
VTYDSVCIKFTQEEWSLLDPSQKSLYKDVMLDTYRNLSAIGDSWCWSRLHSWCWSEVTQVGIEVTPVLTDTTADSGFEVTAGVGHEVRADDG

SEQ ID NO: 32315 - protein, 84 aa, Cricetulus griseus
VTYDDVHVDFTWEEWTLLDPCQKNLYQTVMLETYMNLTSIGYKWEDHNTEEHCQSSRRRERHEKRQTGEKPSAYTHCVKAFAYD

SEQ ID NO: 32316 - protein, 87 aa, Ictidomys tridecemlineatus
MTFRDVAVDFSEEKWKCLDPAQQNLYRDVMLENYRNLVFLAMTSHHTHESPPKQEIKYLFQKMMNGRYHDSDKPYKFKECTKILNQR

SEQ ID NO: 32317 - protein, 83 aa, Marmota monax
VSFRDVTIDFSREEWQHLDPAQRILYRDVMQETYSHLLSVEELRQIGDQIVNYHQTGSKSINDTAFIKKIWTTKSHHEYEGIT

SEQ ID NO: 32318 - protein, 83 aa, Heterocephalus glaber
LTIEDVTIKFTPEEWALLGTPQRKLYRNVMAENINHLLSLGGRRWGSKEKKRKDYISPHFVKIHYLGQEWKNIQKNTCENHLC

SEQ ID NO: 32319 - protein, 82 aa, Neotoma lepida
LSFTDVAINFSAEESECLEPAQWNLYKEVMLENYSNLVFLGEDHVHTISGHISGAKYRALECEEKSSSGQPSRCVGVNTVEP

SEQ ID NO: 32320 - protein, 83 aa, Neotoma lepida
LTFRDVAVDLSHEEWECLDSVQRALYMDVMLENYSNLIFVEIHRICGKYEVVDQGTKHILHNCENIHEKSYVCNKLDKLIHES

SEQ ID NO: 32321 - protein, 87 aa, Mus musculus
VTFEDVAVHFTMEEWALLDLSQKELYKDVMKEILRNVVSIGDIRKHQKIDNKYQNSGRKLRCQLVEKLHDCKEGHECAEIFKFSTEG

SEQ ID NO: 32322 - protein, 82 aa, Cricetulus griseus
LTLRDVAVDFSQEEWQCLDATQRALYTDVMLENYNNLLYVENYYKCDLVYQHVKTEKESCRCNELGKVPHDPSTCALYRTSE

SEQ ID NO: 32323 - protein, 108 aa, Cricetulus griseus
MKYKDVHIDFTWEEWTMLDTSQKNLYKDVMLETYENLNDIGYSWDDNIIEEHCASSKRHDRIFKSRVVVPILSILAEFDSSVTGICFPSSLIIHQAHSVEKPYDSMTL

SEQ ID NO: 32324 - protein, 85 aa, Cricetulus griseus
VTYDDVHINFTWEEWTLMDPSQKNLYKDVMLETYRNLTTIGYSWEDHHHTEEYYQSSRRYERNERSQTGEKTSVLEIWCNLLVNK

SEQ ID NO: 32325 - protein, 84 aa, Peromyscus maniculatus
VTYDDVHVNFTQDEWALLDPSQKSLYKNVMLETYQNLTAIGYKWDDHNIKEDFQRSRRLGRHERSHTGEKPYECSQCGKAFSRQ

SEQ ID NO: 32326 - protein, 89 aa, Ictidomys tridecemlineatus
VNFNIVTVDFTHEEQDTLNPAYRIPDRSVILENHRNLVSWDLATALGRKESTSKQSIFDVESSPGVKIERLTRDDPWLSSCEEVHNHKD

SEQ ID NO: 32327 - protein, 106 aa, Marmota monax
LTFRDVAIDFSEEEWECLEPAQRNLYRDVMLETYKNLVFLVMTSHHTQEISPEPGIEHLFIKVINRIYGNCDLGFLQQKKVQDIAVESEGQKSYYDEQDQFVVTAP

SEQ ID NO: 32328 - protein, 82 aa, Marmota monax
VTFEDVVVTFTLGEWTLLDPSQKQLYRDVMWDTFKNLASIKKERGDQTTEDVHQNPRREIRSQEEGRCCEHKESNQCGESVS

SEQ ID NO: 32329 - protein, 89 aa, Heterocephalus glaber
MTFEDVAVDFTMEEWALLDPSQKKLHRDVMWENFTNVTAIGRNWENQQQIEDEYQNFRKTLSCHPCVQIQDSPFLSMWAMLGAVSCEAL

SEQ ID NO: 32330 - protein, 95 aa, Mus musculus
LIFMDVALEFSKEEWGCLDSAQRALYRDVMLENYSNLVSVDQEAQDTLLERTQSQNLKAHYRISTQVTSYKCNECGKSFTQSSSLKVHHRIHTED

SEQ ID NO: 32331 - protein, 96 aa, Mus musculus
VTYDDVQVNFTQEEWALLDPSQKSLYKDVMLETYRNLKAIGYIWEGHTSEDHFQTSRSHGRHERSCTAVKPSEFIQCGKAFAYQSLRQRHERTHKG

SEQ ID NO: 32332 - protein, 99 aa, Peromyscus maniculatus
VLFRDVYIDFSQEEWECLTEEQRDLYRDVMLENYSNLLSMVLESRCEAQKLFLKKELYEIESAQWEIIRKLTRQDLQCSSPRGAWEWNSQCSRQPGSQE

SEQ ID NO: 32333 - protein, 84 aa, Peromyscus maniculatus
VTYEDVHVNFTREEWALLDPSQKNLYKDVMVETYRNLTAIGYKWENQSIEEYCQHHRTLKIHERIHTGQKPYKCNQCDKVFLCS

SEQ ID NO: 32334 - protein, 89 aa, Peromyscus maniculatus
VSFEDVTVDFSQEEWRRLDPAQRRLYQDVMLEIYSHLLAVEVESEFYTPPQKVSENAAFQISKASEIIRHGLWCSVLEELWQDPDPTKR

SEQ ID NO: 32335 - protein, 84 aa, Peromyscus maniculatus
VTYGDVQVNFNEEEWALLDPSQKSLYKDVMLETYENLTAIGYKWEDQNIEDHCQSSRRHGRYIICHPGYKPCEHNRYGKKHCTS

SEQ ID NO: 32336 - protein, 84 aa, Peromyscus maniculatus
VTYDDVHIDFTWEEWTLLDHSQKNLYKDVMQETYRNLTAIGYSWEDHNIEEHCQCSGRHGRHERTHTVEKPYKCNQCDKAFSRV

SEQ ID NO: 32337 - protein, 84 aa, Peromyscus maniculatus
VTYDDVHVDFTWEEWTLLDPSQKTLYKDVMLETYSNLTAIGYSWEDHTIEKHHQSTTRHKRHERSHIGEEPSVHTQYSKVFAYD

SEQ ID NO: 32338 - protein, 84 aa, Peromyscus maniculatus
VTYDDVHIGFTWEEWTLLDPSQKNLYKDVMLETYRNLTAIGYKWEDHNIEEHCKSSRRHGRHERSHTGEKPFEYIQSVKAYAYL

SEQ ID NO: 32339 - protein, 86 aa, Ictidomys tridecemlineatus
VTFEDVAVNFTLEEWALLDPSQKKLFKDVMQETFWNLTTIGKNWKNQAIDDHYISWRNLRIQVIERLWEQKEDNQYGEIFSQILDP

SEQ ID NO: 32340 - protein, 84 aa, Mus caroli
VTYEDVHVNFSHEEWALLDSSQKSLYRDVMLETCRNLMAIGYRLEDHNIEEHCQSSRRPGRYNICNCGYKPCENEDHGKKQCTF

SEQ ID NO: 32341 - protein, 84 aa, Mus caroli
LTYDDVYVNFTQEEWSLLNPSQKSLYKDVMLENYTNLIAVEKRYKCSQCGKAYAGPHTLQIHERTHSGEKAYECKQCSKSFASH

SEQ ID NO: 32342 - protein, 85 aa, Mus caroli
LSFRDVAIDFSPEECECLDAAQWDLYSDVMLENYSNLVSLGTKPYKCKECNKTFVRNSLLIQHQRVHTGEKPYKCEQCGKAFSCS

SEQ ID NO: 32343 - protein, 87 aa, Mus musculus
VTYRDVHVNFTQEEWALLDPSQKKLYKDVMLETYRNLNAIGVKGVRVQRNPLNILNVIKPLLYVLTVMPKGMKGFIQKRSPLKIFTV

SEQ ID NO: 32344 - protein, 84 aa, Mus musculus
VTYDDVHVNFTGEEWNLLDPSQKSLYKDVMLETYWNLAVIGYTWENHHIERHCQSSRRNERYVSNHSGEKLYECNERSKAFSCP

SEQ ID NO: 32345 - protein, 87 aa, Peromyscus maniculatus
VNFEDVAVKFTKEEWALLDPSQKKLYKDVMQETLRNLAAIGNKLENQKAVNECENLWRKLRSQLVEKFCEYKESLQSTELFSCIPEL

SEQ ID NO: 32346 - protein, 90 aa, Heterocephalus glaber
LTFRDVAIEFSQEEWKCLNPAQRTLYRDVMLENYRNLVSLDTSPKCIIKGSSPKGKKSTGEIFKRVMLERHERSDIKGFSFRDVQKNIHG

SEQ ID NO: 32347 - protein, 93 aa, Mus caroli
VSFEDVAVNFTAEEWALLNSSQKRLHRDVMQETFRNLAAIAKKQEDWILEDSSENLRKIPPISVQTDYKLCESQECTEKPGTCKKCGKFFSSP

SEQ ID NO: 32348 - protein, 83 aa, Mus caroli
MTYDDVHVNFTGEEWALLSPSQKRLYKDVMLETYRNLTAIGYNWEDHNSEHFQHSRRHGRHERRHTGEKPSVYTQCGKVFAYH

SEQ ID NO: 32349 - protein, 85 aa, Mus musculus
VTYDDVHVNFTWEEWALLDPSQKDLYRDVMLETYRNLAAIGMKEVILKRNFLNLLNMIKTLHIRAILKGMKEFILERNPMKVSNI

SEQ ID NO: 32350 - protein, 104 aa, Mus musculus
LTYDDVHVNFTREEWALLNPSQKSLYKDVMLETYRNLNAIGYNWEDNNIEEHCQSSRRHGRHERRLTGEKPSENIQCGKDFASHSYPQRHEKIHTGEKPYEVMY

SEQ ID NO: 32351 - protein, 93 aa, Mus musculus
VSFEDVAVNFTAEEWALLNSSQKRLHRDVMQETFRNLAAIAKKQEDWILEDGSKNLRKIPPISVQTDYKLCESQECTEKPGTCKKCGKFFSSP

SEQ ID NO: 32352 - protein, 93 aa, Mus musculus
VTYDDVHVNFTREEWALLDSSQKNLYKEVMLETYRNLAAIGYVWEDHNTEEHLHISRRYGRHERSHTEQLLSEFIQCDKAFAFQSHNQRQERI

SEQ ID NO: 32353 - protein, 130 aa, Cricetulus griseus
LTFRDVAVHFSQKEWQCLDSAQRALCIDVMLENYSNLVFVENYCKCDPGHQYVKIEKKSCQCNAFGKVLHDPSICALYRTSETTENSNNYACSNHRDASVDSSNPDRQESMHTGEEPCRSKECEKSVNLC

SEQ ID NO: 32354 - protein, 82 aa, Cricetulus griseus
LTFRDVAVDFSREEWECLDSAQRALCIDVLLENYSNLVFVENYRKCDPVHHHVKTETESCQCNDLGKVPHDHSICALYRTTE

SEQ ID NO: 32355 - protein, 84 aa, Peromyscus maniculatus
VTYNDVHINFTQEEWALLDLSQKNIYKDMMLETYMNLTAIGYNWENLDVEEHCQSSQRHERAERSQTGEKPYECNQYGKAFPHH

SEQ ID NO: 32356 - protein, 101 aa, Peromyscus maniculatus
VTFSDVAIDFSQAEWACLDSVQRDLYWDVMLENYSNLISLDGKLSKGANILAIRRSIYGLSSCKRNPSDKSISPHPDGIGEGECEQPQGSEEENVNDVTHR

SEQ ID NO: 32357 - protein, 84 aa, Peromyscus maniculatus
LTYEDVHVNFSHEEWALLDPSQKSLYKDVMLETYWNLTSIGYKWEDHSIEEHCQSSRRHGRHINCPSGYKPCEHKRFGTKQYTS

SEQ ID NO: 32358 - protein, 84 aa, Mesocricetus auratus
LTFWDVAVDLSQEEWECLDSAQKTLYMDVMLENYSNLVFVDNHHMCVEYKKALHHASKDIVHDYVNLQEEPFKCNDLNKVAHES

SEQ ID NO: 32359 - protein, 101 aa, Heterocephalus glaber
MEEWALLDPFQKKLHKDVMWENFRNVASIGRKCDDQQIEDEYRNYWTNLRSADADKCCQDKLRCQHGEMVCVTPGPDVPMKLLGVKPSESLECGKPLIGHS

SEQ ID NO: 32360 - protein, 84 aa, Peromyscus maniculatus
VTYNDVHVDFTQEEWALLDLSQKNIYKDVMLETYINLTAIGYRWEDLNIEEHCQSPRRHGRYERSHTGEKPYECNQCDKGFSPH

SEQ ID NO: 32361 - protein, 84 aa, Peromyscus maniculatus
VTFEDVAIFFSKEEWRLLDEAQRQLYLHVMLENFALVTSFDCWQGMENGKLPFDQVVVEGLSLVRTPKASPANQESHPCDIYLP

SEQ ID NO: 32362 - protein, 91 aa, Mesocricetus auratus
LTFSDVAIDFSPDEWECLDPPQQTLYRDVMLENYRNLVSVALSHHCSQNFPPEQTLKYSFKRATNGRLGSHGLKSLRNWAEADENRGQTAC

SEQ ID NO: 32363 - protein, 84 aa, Heterocephalus glaber
VSFKDVVVGFTQEEWHQLNPAQRALYRDVMLETYSNLVSVEHSSLNCAFYYGSYTVHTSNLRAFLKVDLLQLIISIKIHKNDSL

SEQ ID NO: 32364 - protein, 84 aa, Mus caroli
VTYDDVHVNFTGEEWDLLDSSQKSLYEEVMLETYQNITAIGYNWQDHHIEEHCQSSRRHERHERSHIGEKPYEHNQCGKTFACY

SEQ ID NO: 32365 - protein, 99 aa, Mus caroli
VLFHDVYIDFSQEEWECLTEEQRDLYRDVMLENYSNLLSMVLESRCEAQKLFLKKELYEIETAQREIMRKLTRQDLQCSSLSSAREWNGHRERQRGSQE

SEQ ID NO: 32366 - protein, 95 aa, Mus caroli
VSFEDVAVHFTRDEWALLDSSQKSLYRDVMLETCRSLAAIGYKWEDQNLEDHCISPGRNLRSYMFQTFCENEGDDQDGGNLPWKPNLSMNMRCST

SEQ ID NO: 32367 - protein, 87 aa, Mus caroli
LTFKDVAVEFSVDEWECLSYSQRALYRDVMMENYSNLFFLENFLHCEKVLNQGTKHIVHKRVTIQEKSYKCNEPVNMIHQSSQGTPS

SEQ ID NO: 32368 - protein, 86 aa, Mus musculus
VTYDDVHVNLTREEWALLDPSQKRLYKDVMLETYKNLTAIGMKEVILERNPLYSTLNVVKPLHVTLILKGMKEFILERNPMKVFNM

SEQ ID NO: 32369 - protein, 84 aa, Mus musculus
VVFEDVAVNFTEEEWALLDSSQKHLYRDVMLEIYNNLACVGNKWEDQSMEDEHTNPRRSQRICKFERLYESTEGDQSGEIFTKT

SEQ ID NO: 32370 - protein, 88 aa, Mus musculus
VTYDDVHVNFTQDEWALLDPSQKSLYKGVMLETYKNLTAIGYIWEEHTIEDHFQTSRSHGSPDILWYEYQCGNCEWIPFPPQLLLGHN

SEQ ID NO: 32371 - protein, 90 aa, Cricetulus griseus
LSFRDVSVDLSQEEWECLDCVQRALYTDVMLENYSNLLFVENHRICGKHEKVLHQCTNYCIHGNENIQKKTNTYNEPGNVIQESYQYSPY

SEQ ID NO: 32372 - protein, 96 aa, Cricetulus griseus
VTFQDIAVDFTEKEWPLLDSSQRKLYKDVMLENYSILTSLDWGTPSKAKWSIVMDDILGEEASNGVQLEKSHLLEKSSEFTHLFEVFSIGPHLTQP

SEQ ID NO: 32373 - protein, 82 aa, Cricetulus griseus
LTFRDVAVDFSQEEWECLDSGQRALCIDVMLENYSNLDFVENYYKCDPVHQHVKTEKESCQCNDLGKAPHDPATCALYRTSE

SEQ ID NO: 32374 - protein, 99 aa, Cricetulus griseus
LSFWDVVIYFSAEEWECLGPAQWKLYRDVMLENYNNLVFLGEDHFHDVFSMKPLSFVQCLLGACDSNSLASCKPYLVTFLEQRHGPSHVKRQAAGAMQA

SEQ ID NO: 32375 - protein, 84 aa, Peromyscus maniculatus
VTYDDVHVGFTWEEWTLLDRSQKNLYKDVMLETYRNLTTIGYSWEDHNIEEHCQSSRRHERHERIHTGEKPYECNQCGKAFAHH

SEQ ID NO: 32376 - protein, 84 aa, Peromyscus maniculatus
LTFRDVAVDFSQEEWECLESAWRDLYIDVMLENYSNLVFVAQHDFNPTSMEAEARSSGKHHEKVMDQGSKHIVYEFMNIQEKSH

SEQ ID NO: 32377 - protein, 84 aa, Marmota monax
MDISIDFTEEEWECLHPAQKNLYRDVMLENYRNLAFLAMTPNHIQEYSPEKGLKHIFHEVISAKYRSCDLDYFPQRKIWKTTSE

SEQ ID NO: 32378 - protein, 99 aa, Marmota monax
LTFSDVAIDFSQEEWECLNSDQRDLYRDVMVENYINLVSLDFDFSTETNKLSSEKNICEINSHHKETLKRNKTFNLMGFIFSNEPPWRIEFGRQQGTKV

SEQ ID NO: 32379 - protein, 99 aa, Heterocephalus glaber
VSFDDVAVDFTQEEWTLLDPTQRNLYGDVMLENYQNLATVGIHNGGGLYDWKQCEEFFSEHTCGKTHMKTQSIGDTYDCDQRGKDFLTVQQETSTREKL

SEQ ID NO: 32380 - protein, 87 aa, Mus caroli
VTFEDVCVTFPQEEWDLLRPVQKKLYKDVMWETVRNLASVASELEDQDVSNQYRIQEENVRSYMIQRLYESKEVIEHGERFSQIPNT

SEQ ID NO: 32381 - protein, 93 aa, Mus caroli
VTYEDVHVNFTQEEWALLDPSQKKLYKDVMLETYRNLNAIGFSWEAQNIEEHCQSFGRHRRCERSQRAEKPSEYTQPDKGFALRAHSHAQRHE

SEQ ID NO: 32382 - protein, 84 aa, Mus caroli
VTFEDVAVNFSLGEWALLDSSQKKLYRDVMTETFMNLISIGKTEENIEEDYANGRSLRTQMIGRDCKYENSFQYGEAHRRIPEY

SEQ ID NO: 32383 - protein, 84 aa, Mus musculus
LAFDDVHVHFTREEWSLLDPSQKRLYKDVMLENYRNLTTIGYNWKDHNIEEHCQNDRRYGRHERTPAGEKPYEYTQWDKAFKYH

SEQ ID NO: 32384 - protein, 84 aa, Cricetulus griseus
VTYEDVHVNFTHEEWALLDLSQKNLYKDVMLETYWSLTSIGYKWGDHNIEEHCQRSRRNGRYVICHSGYKPYEHKGYGNKHCTS

SEQ ID NO: 32385 - protein, 84 aa, Cricetulus griseus
LTYDDVQINFTSEEWSLLDTSQKNLYKDVMLETYKNLTDIGYTWEDCSIEEHCASSKRKERPKRSQTGEKPSAYTQCAKDFAYS

SEQ ID NO: 32386 - protein, 83 aa, Cricetulus griseus
VSFEDVAVNFTPEEWALLNSSQKRLHRDVMQETFRNLAAIAKKQEDQTLEDDYEYLRKILPIAVQTGYKPCENQEYAEKPGTN

SEQ ID NO: 32387 - protein, 84 aa, Peromyscus maniculatus
VTYKDVHVNFTHEEWALLDPSQKSLYKDVMLETCENLTAIGYKWEDQNIEEHCQSSRRHGRHERSHSGEKPYGCNQCGKVFAQK

SEQ ID NO: 32388 - protein, 96 aa, Mesocricetus auratus
VTFEDVTVHLTREEWGCLDPVQRELYREVMLENYGNVVSLGILLRLPTTRIHCVNSCPALSHTQASAFSGETLAVLTAGITKRWPRYRLSIGSARP

SEQ ID NO: 32389 - protein, 82 aa, Mesocricetus auratus
VTFEDVAVNFTLGEWALLDSYQKELYRDVMKETFSNLISIGKTEEENIGEDYQNIRRNLSTHEVKGFYEFQHGVQYGEAHQR

SEQ ID NO: 32390 - protein, 91 aa, Marmota monax
VTFEDVAVGLSQEWALLDDVRRDLCRYVLLDNYQTLACRGEAGIAPFLAAYVCRILPQCLPCGRACGHRDSTVQVPPGLLGGDRSRAKAVE

SEQ ID NO: 32391 - protein, 84 aa, Mus musculus
VTFEDVAVNFTQEEWTLLDPSQKNLYINVMLETCSNLASVGIKSEYQTIEDQYKQPGKNIRNIITRSGYTPYALEDCGEKPYHS

SEQ ID NO: 32392 - protein, 90 aa, Cavia porcellus
MKFEDVAVDFTQEEWQYVNPPQRTLYRDVMLETYSHLVSLGKKGSWEMWLGISHFSLSGQQVTKPDLILKLEVEEPCLIEDRVPIWSFPE

SEQ ID NO: 32393 - protein, 85 aa, Cricetulus griseus
LTFRDVAVDFSREEWECLDSAQRALCIDVLLENYSNLVFVVEGHLGNFQVLVITNNIAMTMVEHMSLLYECALFVYMPKIGIAGS

SEQ ID NO: 32394 - protein, 87 aa, Marmota monax
LTFRDVAIDFTEEEWECLQPAQKNLYRDVMLENYRNLAFLAMTSNHTQEYSPEKGLKHIFHEVISAKYRSCDLGYLQPKKIWKSTSE

SEQ ID NO: 32395 - protein, 85 aa, Mus musculus
VTYDDVQVNFTRDEWALLDPSQKSLYKGVMLETYRNLTAIGMKEVVLQSNPLSLFNVVKPLHMRVVDKGIKLNIMERNTMTVTNV

SEQ ID NO: 32396 - protein, 83 aa, Mus musculus
LTFDDVHVHFTREEWSLLDPSQKRLYKDVMLENYRNLTAIGYNWKDHNIEEHCQNDRRYGRHTRREHGIPLEMVESHHMEAGI

SEQ ID NO: 32397 - protein, 112 aa, Mus musculus
MTYDDVHVNFTGEEWALLSPSQKRLYKDVMLETYRNLTAIGCSWENRNIEEYFQRSRRYGRHERSHTGEKPSVYTQCNKAFAYQSHPQRHHRIHTGEKPYEGIQHDKAFAHH

SEQ ID NO: 32398 - protein, 87 aa, Mus musculus
VTYEDVHVNFTQEEWALLDPSQKKLYKDVMLEIYRNLSALGVKGVRVQRNPLNILNVIKPLLYMITVMPKGMKGFIQKRSPLKLFTV

SEQ ID NO: 32399 - protein, 84 aa, Cricetulus griseus
MEFEDVSLTFTEEEWAQLDHEQKCLYKEIMLENYNNVISVGITCCPWHSSIAIIGVCHPAKLLLWFSFTGSSGPSLDTGIKSFP

SEQ ID NO: 32400 - protein, 84 aa, Cricetulus griseus
VTYDDVYIDFTWEEWTLMDPSQKKLYEDVMLETYRNLTTIGYRWEDHHVEECYQNSRRYERNEKRQNGEKPSVNAQCVKAFTYD

SEQ ID NO: 32401 - protein, 101 aa, Peromyscus maniculatus
VTYDDVHIDFTWEEWTLLDSSQKNLYKDVMLEIYRNLTAIGCSWEDHNIEEHCESSGRNGSIFTGSKNVILERNPVNIFNVTFSGEKPYKCNHCDKDFAYA

SEQ ID NO: 32402 - protein, 92 aa, Marmota monax
VTFEDVAVYFSREEWRLLDNAQRLLYREVMMENFTLVTSLGCWHRAETVEASSEQRVSTEGVQSENRHQHQKLCCGEKPLIREEGRVSVLRG

SEQ ID NO: 32403 - protein, 97 aa, Marmota monax
VSFADVAVYFSPEEWGCLRPAQRVLYRDVMRETYGHLGALGEAPGQSPPPSPGFLGDMTQKDPVDRFPGPKPALISWMEQESEAWSSAAQDPEEGES

SEQ ID NO: 32404 - protein, 85 aa, Mus musculus
LTYDDVHINFTPEEWALLDHTQRNLYTDVMLETYKNLVAIGIKEVLPERNPMNILNVVKPLHVTLVFKGMKEFILERNLINVINV

SEQ ID NO: 32405 - protein, 103 aa, Rattus norvegicus
VTYEDVHVNFTQEEWALLDPFQKKLYKDVMLETYRNLNAIGMKEVRVQRFPPNILTVENPLLYMLTVILKGMKRFIQKRSPLKLFSVLKPLLLTQVSKYIKEH

SEQ ID NO: 32406 - protein, 92 aa, Rattus norvegicus
VTFGDLAIYFSQEEWEWLSPNQKDLYEDVMLENYHNLVSIYRTFYPKAKGYTFFSAPHGTFSKIDHFGLPTIKSQGQDGYSAEFNQTFIGDL

SEQ ID NO: 32407 - protein, 84 aa, Marmota monax
MDIAIDFTEEEWECLQPAQKNLYRDVMLENYRNFAFLAMTPNHTQVYSPEKGLNYIFHEVISTKYKSSDLEYLPKKKIGKTPSE

SEQ ID NO: 32408 - protein, 112 aa, Mus musculus
VTYDEVHVNFTQEEWALLDHSQKSLYRDVMLETYKNLTAIGYNWDDHNIEEHCQSSRRHGRHETSHPGEKPSQYTHCGKAFVYWSHPQRHERIHTGEKPYGCNHCGQHFLNL

SEQ ID NO: 32409 - protein, 88 aa, Dipodomys ordii
VTIKDVALNFTMEEWALLDASQRKLYGNVTSEMYRNLASIEIKEEENTEGGYRNRKRIVRTAKVEKLCEETGDIPCGESFQQVPDCSV

SEQ ID NO: 32410 - protein, 87 aa, Dipodomys ordii
VTFEDVAVCFSQEEWGILGEAQKLLYLDVMLETFVLTTSVHCWHEMKNEETSSLQFISVEEPSVVRTPKAGASTLKMHLCDSFAPVL

SEQ ID NO: 32411 - protein, 82 aa, Octodon degus
VTFEDVTIYFSQEEWGLLDEAQRLLYCNVMVENFTLIASLGFCSRTEVKVLPSQQRISVQGMIQAGNPKTALSMQKAYSSDT

SEQ ID NO: 32412 - protein, 89 aa, Octodon degus
VTFEDVTVDFTQEEWALLDRGHRDLYREVMLENYENLASVGDLSQDPSQLLKLQQSLNSGCELVKPSLIWLEHEEDWRTQQRGDRQEWE

SEQ ID NO: 32413 - protein, 106 aa, Ictidomys tridecemlineatus
LTFRDVAIDFSEEEWECLEPAQRNLYRDVMLETYRNLVFLAMTSHHTQEISPEPGIEHLFIKVINRIYGNCDLDFLQQKKVQDIAVESEGQKSYYDGQDQFVVTAP

SEQ ID NO: 32414 - protein, 85 aa, Marmota monax
VSFEDVTMDFTREEWQQLDPAQRPLNKDVMLEIYSHLFSVEEFGLDILQQEVSEKASFQNDMVSEITRSGSGCSILEELWQDADL

SEQ ID NO: 32415 - protein, 112 aa, Marmota monax
VTFEDVAIYFSQEEWGLLDEDQRVLYLGVMLENFALVTSLVCWHGMEDEEIPSEQISVGLSQGKTTKAGVSTQETYPCELCVPVLKDLLHLADQPGQEPYLTGICANLNQEQ

SEQ ID NO: 32416 - protein, 94 aa, Heterocephalus glaber
VFYEDVAVNFTLEEWALLNPSQKTLYRDVMLEVFKNLASIGNKWEDQNIEDQNKRALRNLRHIIPHSEHKVYKSDEYGKKPYEFKKHGKSLISL

SEQ ID NO: 32417 - protein, 93 aa, Octodon degus
VSFEDVSVNFTMEEWALLDPSQKKLYRDVMWETFRNVADLGRNLGSKKIEDEYKNFRRNLSSEEVEKYDDYELCYQHEEMNFQASNINMNTKP

SEQ ID NO: 32418 - protein, 82 aa, Fukomys damarensis
FLSKEPTKSNSRSPYALVGRRRFPGFKDQKPEAFTGFALATCRTCWVHLRMFEASRPDVLSVLERGEPLWTLEDEIHSEAHP

SEQ ID NO: 32419 - protein, 87 aa, Rattus norvegicus
VFRDVAIEFGKEEWECLGPEQRSLYRDVMLENYSHFVSLGKSVPLYLIVEQCSKAFRQRSHLTQHQRIHTGEKPYECKECGQAFTRL

SEQ ID NO: 32420 - protein, 84 aa, Mus caroli
VTYEDVHVNFTRKEWALLDPSQKSLYKDVMLETYRNLRAIDSYWEDHSNEEKSQTSRRSRRHKRTHTGEKPYECNHCGKAFARH

SEQ ID NO: 32421 - protein, 87 aa, Mus caroli
LTFRDVAVEFSVDEWECLNCSQRALYTDVMMENYSNLLFLENFLKCEKVLDQGTKHIVHKHMSIQEKSYKCNEPVKVIHESSQITHS

SEQ ID NO: 32422 - protein, 116 aa, Mus caroli
LTFDDVAVYFSELEWAKLEDWQKRLYKHVMGAAMRYSFPWVRLQRNTWAFILQWLPAVFAFALGSQTQIFLHALPILYEDYAISNPVILTQIERGEEPCPAGPWGQEKRGEEETVC

SEQ ID NO: 32423 - protein, 91 aa, Mus caroli
VTFRDVAVSFSQDEWLHLDPAQRTLYQEVMLENYSNLASLAKGHRSVRTSRRLPDGGKWNVSRCVPRHIWSALGSPLAGTLRREMAVDLLA

SEQ ID NO: 32424 - protein, 82 aa, Peromyscus maniculatus
VTFEDVAVKFTSGEWALLDSSQKKLYRDVMKETFLNLISIEKALEENIEEDYKNFSRNLGTQMVEKDCGYEFDSQHNENQDP

SEQ ID NO: 32425 - protein, 84 aa, Peromyscus maniculatus
ITYDDVHVNFTWEEWTLLDPFQKNLYKDVMLETYRNLTTIGYSWEDSNIEVHCQSSGRHERHERSHTGEKPSVYTQCVETFAHH

SEQ ID NO: 32426 - protein, 95 aa, Peromyscus maniculatus
VSFEDVAVHFTQEEWALLDPSQKSLYRDVMQETCRNLAAIGNKWEEENVEGCHKIPGRNLRSSMLETPHENTGDGQDEETVMWIADLHTSMAVFP

SEQ ID NO: 32427 - protein, 86 aa, Mesocricetus auratus
MAFEDVAVYFSQEEWMFLDAAQRALYRHVMLENFALVDSIGKVLNPPLEAKLGPGLSVSRPRVIIQLQRGEEPWVPNRTNPGPGRS

SEQ ID NO: 32428 - protein, 83 aa, Mesocricetus auratus
VTFEDVAVNFTLEEWAMLDPFQKDLYKDVMQETLRNLASIGNNWEHQNIEHEYENLWRKLSSQLLERLCEYTEGRQCAEIFNW

SEQ ID NO: 32429 - protein, 84 aa, Heterocephalus glaber
VTFEDVAVTFTVEEWALLNPSQKQLYRDVMRETFRNMAAIAEDLACRKPLVGHLSLNEPIIAHTVLKTSEYLGLEEKLYKCNEY

SEQ ID NO: 32430 - protein, 82 aa, Mus musculus
VSFEDVAVNFTAEEWALLNSSQKRLHRDVMQETFRNLAAIAKKQEDWILEDGSKNLRKIPPISVQTDYKLCESQECTEKPGT

SEQ ID NO: 32431 - protein, 82 aa, Mus musculus
LTFMDVALEFSKEEWERLDSAQRALYRDVMLENYNKLVSVDQEAPDTLPERTQSPNPKAHYRLSTRVTSYKCNECGKSFTKL

SEQ ID NO: 32432 - protein, 87 aa, Mus musculus
VTYEDVHVNFTQEEWALLDPSQKTLYKDVMLETFRNLNAIGVKGVRVQRNPLNILNVIKPSLYMITVMPKGMKGFIQKRSPLKLFTV

SEQ ID NO: 32433 - protein, 83 aa, Rattus norvegicus
VTFEDVTVNFSRDEWALLDTSQRELYRDVMLEIFTNLASVGGNWENQSTGDQCKTQERDISAHIEQRPREWESSPREIVTQVP

SEQ ID NO: 32434 - protein, 93 aa, Peromyscus maniculatus
LTFWDVAVNFSHEEWECLDPAQRALYVEVMLENYSNLVYIENHHKCKYGKVLDRGSKHIVHHHVTIQEKSYNCSELGESLHRSSQCTPHDTSD

SEQ ID NO: 32435 - protein, 82 aa, Mesocricetus auratus
VAFEDVAVNFTSGEWALLDSSQKKLFRDVMKETYLNLISIEKSVEENIGEDCKDLSRNMGTQVIDKDCGYTCDRECDKNQEP

SEQ ID NO: 32436 - protein, 94 aa, Ictidomys tridecemlineatus
VKFEDVAVDFTQEEWQYLNPLQRTLYRDVMLETYSNLVSVGKMASSGSEELYQEAICHLSLTGQQVCKPDLILKLEVEELCPAEDRIPIWSFPE

SEQ ID NO: 32437 - protein, 86 aa, Mus musculus
MAFSDVAIYFLRGEWRLLDDSQRRLYHQVMMEVFVLMSSLGLIPSGTDITQLGSSGNRFIPALRFLTPMGRDKWCRNPGPESPTEE

SEQ ID NO: 32438 - protein, 99 aa, Octodon degus
VTFEDVAVSFTMEEWALLDPSQKELFRDVMSETFMNVAAIGGAWDNQEVEEESKNDWRNQRYEELQKYYALYMPTITLTGLETCELWESEEKLYQCNEH

SEQ ID NO: 32439 - protein, 92 aa, Octodon degus
VTLEDVLIKFTLEEWAVLNPSQKKLYREVMWETFMNMTAVGRTWDTQQIEEYKNCSRNLRNKKVAKCSQSKVCDQHEEVFLWASEETVHMQQ

SEQ ID NO: 32440 - protein, 87 aa, Octodon degus
VTFEDVAVSFTSEEWALLNPSQKKLYRDVMGETFRNMTAIGRAGEKQKVGKEYQSDWRYLRNEKVGKCYQYKDWNQYEEILLCTLDA

SEQ ID NO: 32441 - protein, 85 aa, Heterocephalus glaber
VSFTDVTVDFTQEEWEQLDLSQRILYMDVMLENYSNLLSVEVWKADDQMCKKTFSHKANLIKHQRIHTGEKPFECPECGKAFTHQ

SEQ ID NO: 32442 - protein, 84 aa, Neotoma lepida
ALFEEVAIYFSDEEWKVLTEQQKTLYREVMRMNYETVLSLESEESDFKTPHWASPVNATSYFPYPQHLNSFWHLPRDITELPEW

SEQ ID NO: 32443 - protein, 89 aa, Mus caroli
VTFEDVAVNFTLGEWTMLDSSQKKLYRDVMKETFLNLISIGKTEEEETEEEYQNPKGSLRTLMVERLCKYDYGNPYGETHQQSPEHVVN

SEQ ID NO: 32444 - protein, 85 aa, Mus musculus
VTYDDVHVNFTQEEGALLETSQKNLYKDVMLETYRNLSAIGMKEVVLQCNPLNLFNVVKPLHIIVLDKGMKEHIMGRKTITVTNV

SEQ ID NO: 32445 - protein, 95 aa, Mus musculus
LTFMDVALEFSKEEWGCLDSAQRALYRDVMLENYSNLVSVDQEAQDTLLERTQSQNLKAHYRISTRVTSYKCNECGKSFTQSSSLKVHQRSHTGD

SEQ ID NO: 32446 - protein, 119 aa, Dipodomys ordii
VTFEDVAVHFSWEEWDLLEETQQCLYRHVMMENLALVTSLGFWHGAEDEKTPSQLSAAFEASQARTSGEGLSPHTSHTGVIWGPVSRDIMHTCGPEGTHCEQASEAWQRQFCCSADTHP

SEQ ID NO: 32447 - protein, 88 aa, Octodon degus
VTFEDVTVDFTQEEWALLDRGHRDLYREVMLENYENLASVVLCFCSSSECAVRLSTSEYIHQPEFLMEQSSGGQHMERRKSVGELQQS

SEQ ID NO: 32448 - protein, 87 aa, Octodon degus
VAFEDVSVDFSHEEWALLDPLQKKLYRDVMQETFRNLAYIGSKWEDQNIKDQYKKQERNLRSYLIQRLYESKESCQYGENGSQISDP

SEQ ID NO: 32449 - protein, 93 aa, Octodon degus
VTFEDVAVNFTVEEWTLLDPPQKRLYRNVMKETFRNMAAIGRVLGNQEVEEEYKNYWRNLRNEDVEKCYQNKCWNQYEEMFLWMPDADMDMKL

SEQ ID NO: 32450 - protein, 85 aa, Octodon degus
VTFEDVTVTFTTEEWVLLNPSQKKLYRDVMWETFRNMAALGNWVSQHINEEYKTFWRNLRSQQVEKYCGYQDWTQHEENFLGTSD

SEQ ID NO: 32451 - protein, 87 aa, Mus caroli
LTFKDVAVEFSVEEWEYLSCSQKSLYIDVMMENYNNLSFVENHHKCKKVLDQGMNHIVHEHVDIYEKSYKCNELVKMIHEPSHGTHF

SEQ ID NO: 32452 - protein, 85 aa, Mus caroli
VTLEDVAVNFTLEEWTMLNASQKELYKDVMQDTLRNLSYIGEGNKWEHQNIENECETLWRKLSSQLLETLCEYTEGRQRAETFNW

SEQ ID NO: 32453 - protein, 123 aa, Neotoma lepida
VTFEDVAVHLTREEWGCLDPVQRELYREVMLENYGNVVSLGILLRLPTTRIHCVNSCPALSHTQASAFSGETLAVLTAGITKRWPRYRLSIGFPISKPDGISQREQDLQVFDLETKNREVIRD

SEQ ID NO: 32454 - protein, 92 aa, Neotoma lepida
LTFRDVAVDLSKEEWECLDCAQRALYMDVMLENYNNLVFVGQNQRVHRGKKEHKNTELDKYFDSQNKLTVKQTDSGKKPYQSRESGKCFKTD

SEQ ID NO: 32455 - protein, 87 aa, Mus musculus
VTFEDVAVNFTLEEWTLLNPSQENLYRAVMRETIRNLHDIGQKLGEQNTENAYKNPGGNLRYQVVEKLCEYEEDSQWEEIFSEIPDP

SEQ ID NO: 32456 - protein, 88 aa, Peromyscus maniculatus
VSFADVAVYFSPQEWGCLRPAQRALYREVMRETYGLLGALASVTFHSQGFLGSLHSGFPGPKPALISWMEQESEAWSPAAQDPEEGES

SEQ ID NO: 32457 - protein, 87 aa, Peromyscus maniculatus
VTYNDVHVNITQEEWALMDPSQRNLYKDVMVETYMNLTAIGYNWEDLEVEEHCQKSLKHGRHERPHTTEKSYEYIGCGKAFVCHSHP

SEQ ID NO: 32458 - protein, 84 aa, Peromyscus maniculatus
MTYDDIHVDFNWEEWTLLDPSQKTLYKDVMLETYSNLTAIGYSWEDHTIEKHHQHSTRHKRYERSHIGEEPSVYTQYSKVFAYD

SEQ ID NO: 32459 - protein, 87 aa, Mus caroli
VTYDDVHVNFTQEEWALLDPSQKSLYKGVMLETYRNLTAIGYIWEGHTGEDHFQTSRSHGRHERSCSAEQPSEFIQCGKAFAYESHS

SEQ ID NO: 32460 - protein, 83 aa, Neotoma lepida
GSLENDGVCFSEQEWENLEDWQKELYRNVMESNYETLVSLKVLGQPEEEAELGAEMVGDLVDEGTHLADRAMVKQEGPAGLSS

SEQ ID NO: 32461 - protein, 83 aa, Mus musculus
VSFEDVAVHFTQDEWALLDSSQKSLYRDVMLEICRSLATIGTHQEAHSGKTPYQYKECGKNSVCAHGGSPTMGKFYECNICGK

SEQ ID NO: 32462 - protein, 87 aa, Dipodomys ordii
ITFKDVAINFTPEEWTLLKLCQKKLYRDVMLETLTNLASIEKKQEKENTEVNYKNPRAEVRTQYLERHYEDEEDIQCDKAFQQNVEH

SEQ ID NO: 32463 - protein, 92 aa, Octodon degus
VSFEDVAVNFTVEEWDILDPSQKKLYRDVMCENFRNVAAVGRNWEEQQTEDAYKNCWENLRSEEMKKCCKYKVYQHEEAVFLTPDNGINVKP

SEQ ID NO: 32464 - protein, 84 aa, Octodon degus
VTFEDVAVTFSREEWALLDPSQKKLYRDVMWEIFRSLTTIETNSEDQQSQDEYKNCKKSLRNEEVEKSYQYKLWYQHGEMFAQM

SEQ ID NO: 32465 - protein, 86 aa, Heterocephalus glaber
ISFKDLAVRFSEEEWRLLEEGQREFYRDVMRENYEALVSVGTAELLPLSAFLSPTEPRGAAGAGSCTEEGQEPPVGRSPQGGQPQH

SEQ ID NO: 32466 - protein, 85 aa, Dipodomys ordii
VSFQDVLVTFSREEWQHLDLAQKNLYRDVMLDNYFNLISVDEAIGFENLQQGPCKAVSVQSERISLFQGHDSYCAIRELWQDEKQ

SEQ ID NO: 32467 - protein, 90 aa, Mus musculus
VVFSDVSIAFSQEEWESLDLEQRNLYKDVMMENYHNVASLDSETKDETNQVFSENGIYEMNLSQWKIMERIGNSGLKSLLLKNGWESRRK

SEQ ID NO: 32468 - protein, 84 aa, Mus musculus
VTFDDVHVNFTKEEWNLMDPSQMNLYKDVMLETYWNLTSIGYKWEDHHIEESCQSSRRHTRHGRSHRWKKLYECNQCGKVFARP

SEQ ID NO: 32469 - protein, 104 aa, Octodon degus
VTFEDVAVNFTMEEWAVLDPSQKVLYRDVMKETFRNMADVGRAWDNQEAEKENSNDWNNQRNEKLKKCYALSLLTITNAGLETCELWGSEEELYQCNEHGGTCS

SEQ ID NO: 32470 - protein, 86 aa, Peromyscus maniculatus
MAFEDVAVYFSQEEWTFLDAAQRALYRHVMLENFALVDSIGKALNPPLEAKLGPGLSVSRPRVIIQLQRGEEPWVPNRTNTGPGRR

SEQ ID NO: 32471 - protein, 84 aa, Mus musculus
VTYDDVRVNFTEEEWDLLDPSQKSLYEEVMLETYQNITAIGYKWEDHHIEEYCQSSRRHERHERIHIGEKPYERNQCGKAFASD

SEQ ID NO: 32472 - protein, 102 aa, Cricetulus griseus
LVFEDILFDLQEEWALLDPSEKSLYKDMMLDTYRNLIDIGERERERKKKKKKKKKKKKKKKKKKKHITVCNIAQTSLKLLILLPLPTKCWDYRSSGLSNFRC

SEQ ID NO: 32473 - protein, 88 aa, Mus caroli
VSFADVAVYFSPQEWGCLRPAQRALYREVMRETYGLLGALGDILNETERGCKEGGERPAEAPTQLQPKEVVEHKTYSMATKSSAGAQP

SEQ ID NO: 32474 - protein, 84 aa, Mus caroli
LTYDDVHMNFTREEWALLNASQKSLYKDVMLENYRNLIAVGYNWEERNIEEHCKSSRRHGRHERSHTGEKPYEGIQYGETFVYH

SEQ ID NO: 32475 - protein, 83 aa, Mus caroli
VTLEDVAVNFTLEEWTMLNASQKELYKDVMQDTLRNLSYIGNKWEHQNIENECETLWRKLSSQLLETLCEYTEGRQRAETFNW

SEQ ID NO: 32476 - protein, 84 aa, Mus caroli
VTYDDVCVNFTLEEWSLLDPSQKSLYRDVMQETYRNLTAIGYNWEDDNIEDYFQSSKRHGRHERTPSGEKPYASNQCDKAFSCH

SEQ ID NO: 32477 - protein, 87 aa, Mus musculus
VTYEDLHVNFTQEEWALLDPSQKKLYKDVMVETYRNLNAIGVKGVRVQRNPLNILNVVKPLLYMLTVMLKGMKGFIQKRSPLKLFTV

SEQ ID NO: 32478 - protein, 89 aa, Octodon degus
ITIEDVAITFTPEEWAMLDTAQKTLYRAVMLETISTLESAGCKCGKSGFLFHMDDTEILQMEKHTAFPTNQNPEETNSHDEEGQMTTEH

SEQ ID NO: 32479 - protein, 97 aa, Octodon degus
LTFEDVAVNFTMEEWALLNPSQKRLYRDVMRETFRNIATIGRAWENQKAEEKNDCRNQRIEELGKCNPLEMPTVTDTGVKTYEFLGLEKMLYKCSER

SEQ ID NO: 32480 - protein, 101 aa, Mus musculus
LTFRDVAVDFSPDEWECLDPPQQRLYRDVMVENYRNLVSVGEDSIPAELPTHCHHFMPFLSKMSAIACAFHKQYKPLSHHCTQNFSPEQILKYSFTEVTNG

SEQ ID NO: 32481 - protein, 87 aa, Marmota monax
LTFRDVAIDFTEEEWECLQPAQQKLYSDVMLENYRNMVFLGMASHHIQEFSQDQGIKHILQKVINGKYGNYELDYSQQRKIWKIVSE

SEQ ID NO: 32482 - protein, 106 aa, Marmota monax
LTFRDVAIDFSEEEWECLESAQRTLYRDVMLETYRNLVFLAMTSHHTQKISPEPGIENLFKKVIQRRCGNCDLDFLQQKKVWDIAGENEGQKSYYKEQDQLVVTVH

SEQ ID NO: 32483 - protein, 83 aa, Heterocephalus glaber
VTFEDVAVNFTMQEWALLDPSQKKLHRDVMWENFRNVAAVGRNWNDEQIEDEYKNYRKNLRSAEVDKCCPYKLWYQHGEKVFM

SEQ ID NO: 32484 - protein, 112 aa, Mus musculus
MTFDDVHVNFTKEEWNLLEPSQMNLYKDVMLETYWNLTSIGYKWEDHHIEEPCQSSRRHTRHVRSHSWKKLYECNQCGKAFTSHSSLRYHKRTHTGEKPYECNHCGKAFARP

SEQ ID NO: 32485 - protein, 87 aa, Mus musculus
VTFEDVAVNFTLEEWTLLNPSQENLYRAVMRETIRNLRDIGQKLGEQNTENAYKNPGGNLRYQVVEKLCEYEEDSQWEEIFSEIPDP

SEQ ID NO: 32486 - protein, 86 aa, Octodon degus
VTFEDVTVTFTTEEWVLLNPSQKKLYRDVMWETFRNMAALGGNWVSQHINEEYKTFWRNLRSQQVEKYCGYQDWTQHEENFLGTSD

SEQ ID NO: 32487 - protein, 92 aa, Ictidomys tridecemlineatus
VTFEDVAVYFSREEWRLLDNAQRLLYREVMMENFTLVISLGCWHRAETVAPSSEQSVSTEGVQSENRHQHQKLCCGEKPLIREEDRVSVLRG

SEQ ID NO: 32488 - protein, 87 aa, Ictidomys tridecemlineatus
MTFEDVAVNFTLEEWALLDHSQKDLYREVMLETFRNLTSVGIQWEDQNIDDEHKNFRRNLRSQVIERLCGYKEGSPCEEIFSQLKPY

SEQ ID NO: 32489 - protein, 84 aa, Marmota monax
VAFEDVAVKFTQKEWALLDSSQKKLYRDVMWETFRNLVFVGKKWRDHNIEDDDKSQGRNRRCIRSHAGHRPYEYQECGEKLYIC

SEQ ID NO: 32490 - protein, 82 aa, Heterocephalus glaber
VIFEDVAVNFTMEEWALLDPPQNKLYRDVMWETFQNVTAIGRNIDDQQIEDEYKNYRKNLRKLTLGEKPYLCKQCGKAFRTH

SEQ ID NO: 32491 - protein, 86 aa, Heterocephalus glaber
VTFKDVAVNFTMEEWALLNPSQKKLYRDVMRETFRNMTAIGTVWDQKVGEEYKNYWRNLRNEEVEKCYQSKDWNECEEIFLYTPDA

SEQ ID NO: 32492 - protein, 85 aa, Mus caroli
VTYDDVHVNFTWEEWALLDPSQKTLYKEVMLETYRNLAAIGMKEVILKINFLNLFNMIKTLHIRAILKGMKEFILERNPMKVFNI

SEQ ID NO: 32493 - protein, 84 aa, Mus musculus
VTYDDVHMNFTEEEWDLLDSSQKRLYEEVMLETYQNLTDIGYNWQDHHIEEHCQSSRRHERHERSHIGEKPYERNQCGKAFERY

SEQ ID NO: 32494 - protein, 99 aa, Octodon degus
MTFEDVAVSFTMEEWALLDPSQKQLYRDVMRETLGNVAAVGRALDNHEGEEEHTNDWRNQRNEDLEICYPLNMSTIAHTGLKTYEIWGLEDKLYQCNEH

SEQ ID NO: 32495 - protein, 84 aa, Octodon degus
VTLEDVLVNFTLEEWAVLNPSQKKLYREVMWETFRNVTAVGETWDTQKIKEEYKNFSRHLRVEKIAKFYEDKIWDQQEKMCLWA

SEQ ID NO: 32496 - protein, 83 aa, Octodon degus
VSFEDVSVNFTMEEWALLDPSQKKLYRDVMWETFRNVADLGRNLGSKKIEDEYKNFRRNLSEEVEKYDDYELCYQHEEMNFQA

SEQ ID NO: 32497 - protein, 90 aa, Peromyscus maniculatus
VTYEDVHVNFTHEEWALLDPSQKSLYKNVMLDWNLSAIGYKWEDHNIEEHYQSFRRHGRYIVCHSGYKPCEHKGYGKNIVLLSLSEQLED

SEQ ID NO: 32498 - protein, 82 aa, Peromyscus maniculatus
LSFEDVAVNFTSEEWALLNSSQKRLHRDVMQETFRNLAAIAKKQDKTLEDDYENLRKILPIAVQTGYKLCENQEYAEKPAKY

SEQ ID NO: 32499 - protein, 84 aa, Peromyscus maniculatus
VTYEDVHVNFTHEEWALLDPSQKSLYKDVMLDTYWNLTSIGYKWEDHNIEEHCQSSRRHGRCVICHSGYNPYQHKGYGKKHCTS

SEQ ID NO: 32500 - protein, 84 aa, Mesocricetus auratus
VTYDDVHVDFTWEEWTLLDPSQKNLYKDVMLETYRNLTTIGYKWEDHNIEEHCHSPRRRERTEKRQPGEKSSVCIQCVKAYAYG

SEQ ID NO: 32501 - protein, 84 aa, Mesocricetus auratus
VTYQDLHINFTLEEWALLDLTQRNLYKDVMLETYMNLNAIGYIWEDNNTEEHCQSSQRHRRHERNPTGEKPHSCNECGKAFACP

SEQ ID NO: 32502 - protein, 93 aa, Mus caroli
VTYEDVHVNFTQEEWALLDPSQKKLYKDVMLETYRNLSAIGFNWDDKTTEEHCQSSRRQRRHERSQSTEKVSEYTQRGKAFALHAHSHAQRHE

SEQ ID NO: 32503 - protein, 84 aa, Mus caroli
VTFEDVALNFTQEEWALLDPSQKNLYIKVMLETCSNLASVGIKSEYQTIEDQYKQPGKNIRDIITRSGYTPYELEDCGEKPYHS

SEQ ID NO: 32504 - protein, 118 aa, Octodon degus
VTFEDIAVYFSQEEWGLLDETRRFLYLDVRMGNFELTTSLVCGRETEDGVGPSAQSVSVETVSQVKPLKAGSSTQKAQPCEICVPVLKDILNLDDVPMIHTGERPYEYSECGKSFSQK

SEQ ID NO: 32505 - protein, 83 aa, Mus musculus
LRFKDVAVEFSQEEWECLDCAQRALYMDVMLENYNNLFFVVFSENDHICYKYKNVLDEDAQQIVHQHLNIQEKSYKCHELAKI

SEQ ID NO: 32506 - protein, 89 aa, Cricetulus griseus
AKDQGSVVDFSTEEWECLDYAQRTLYMDVMVESYNNLVFVVLAQHDLNPSTWMLMQEYMFVYMVDFIAGISYVEPSLRLWDEAYLVMVD

SEQ ID NO: 32507 - protein, 90 aa, Cricetulus griseus
VTYDDVHVNFSREEWALLDLSQKNLYKDVMLETYWNLTVIGYNWEDHNIEEHCQTSRRHGSVLKPLPITVIFEYIEEHIGENPYKCSQCD

SEQ ID NO: 32508 - protein, 84 aa, Cricetulus griseus
LSFRDVSVDLSQEEWEFLDCDQRALYMDVMLENYSNLLFVGNHCRFDKYETVLDQGTKHDHVNIQEKPSEYNELGKIMLESSES

SEQ ID NO: 32509 - protein, 85 aa, Cricetulus griseus
VTFGDVFVDFSWEEWELLDELQRLLYLSVMLENLSLVTTLGCRCGADSREAPCEESVSVEAAPQAGAAESSLWIRTALPWEKYGP

SEQ ID NO: 32510 - protein, 97 aa, Peromyscus maniculatus
LTFRDVTVDFSKEEWGCLDTAQRALYIDVMLENYSNLLFLENYYKCDPVHHHVKTENESCQCNELGKVLHDPSTCAHDKIGETPENSNNYRCSNYRE

SEQ ID NO: 32511 - protein, 87 aa, Mesocricetus auratus
LIFKDVAVDLSQEEWECLDCAQKELYMDVMLENYNNLVFVENHFMCNRYEKISDQDIKRILHEHVNIQEKSYKCNVFGQVIHESSQC

SEQ ID NO: 32512 - protein, 112 aa, Mus musculus
VTYDEVHVNFTQEEWALLDHSQKSLYRDVMLETYKNLTAIGYNWDDHNIEEHCQSSRRHGRHETSHPGEKPSQYTHCGKAFVYWSHPQRHERIHTGEKPYGCNHCGKAFAHH

SEQ ID NO: 32513 - protein, 84 aa, Mus musculus
VTFEDVAVRFTQEEWTLLDPSQKILYGDVMQETYRNLTSVGINWECWDLEAYFRSLGRNLRVQLVKRDCDLKNSDPCGETVAQP

SEQ ID NO: 32514 - protein, 98 aa, Ictidomys tridecemlineatus
VTFSDVAIDFSQEEWACLTSAQRDLYWDVMLENYSTLVSLNLESSYEAKSLAIQKSIYKMNLHKRNSGSKSKSHPPNRMPEGESEVPQGSQERNRSRV

SEQ ID NO: 32515 - protein, 93 aa, Heterocephalus glaber
VTFEDVAVNFTIEEWALLKPSQKKLYRDVMWETFKNMTVIGRTWDNQQIEQTYKNCSRNLRNEEVVKCHQYKAWKQQEEIFLWTPDANRDRQQ

SEQ ID NO: 32516 - protein, 92 aa, Heterocephalus glaber
VTFEDVVIRFNQEEWDQLDLSKRTLYWEVMLETCGLLIAVADSVCSRSVQEHISPDPATCICDSNMPAADPSIREGENSYKCKECGKVFKNE

SEQ ID NO: 32517 - protein, 105 aa, Heterocephalus glaber
LTFEDLAVDFSPEEWALLDLAQRKLYRDVMLETFRNLASLVLCALPIHPSLSLNPLSATDFVLSLVILPCTGCCIVGIRSSGFKILLKTNESVVLPDNNLEKVSN

SEQ ID NO: 32518 - protein, 86 aa, Heterocephalus glaber
VTFEDVAVTFTMEEWALLNLSQKNLYRDVMWETFINMAAVGTTWDNQEIDEAYKSCWKNVTNEEVEKCYQYKAWSQHEEICLGTPD

SEQ ID NO: 32519 - protein, 105 aa, Mus caroli
VTFEDMAMYLTREEWRPLDPTQRDLYRDVMQENYGNVVSLDFEIRSENEANPKQEFSDDVEFATMSEAPLENAEKNPGSEEAFESGDRAERPWGDLTAEEWVSYP

SEQ ID NO: 32520 - protein, 84 aa, Mus caroli
VTFDDVHVNFTKEEWNLLDPSQMNLYKDVMLETYWNLTSIGYKWEDHHIEEPCQSSQRHRRHVRSHRWKKLYECNQCGKVFARP

SEQ ID NO: 32521 - protein, 94 aa, Mus musculus
VTYEDVHVNFTKEEWTLLHPSQKSLYRDVMLETCRNLTAIGYKWEDHNIEESCQSSGRYKRNNICHSGPQPCEYQGYGKKQCTVASNSVLQTYG

SEQ ID NO: 32522 - protein, 96 aa, Mus musculus
VTFRDVAVVFSKEELGLLDAARKLYHDVMLENFRNLLAVGGQSPNKIETLHAMGVRCLSLERLPCWQMTSHDVNKLARTPEDGINTQGKGSHFLEP

SEQ ID NO: 32523 - protein, 84 aa, Mus musculus
VTFDDVHVNFTKEEWNLMDPSQMNLYKDVMLETYWNLTSIGYKWEDHHIEESCQSSRRHTRHGRSHRWKKLYECNQCGKAFARP

SEQ ID NO: 32524 - protein, 84 aa, Octodon degus
VTFEDVAVNFSREEWALLDPSQRKLYRDVMWETLRHLAAVGRNSGEEHFGDEHSRCRKSLRSEDVEKSCKDTLWSQYGQGASQT

SEQ ID NO: 32525 - protein, 84 aa, Mus caroli
VTYDDVHVNFTGEEWNLLDPSQKSLYKDVMLETYWNLTVIGYTWENHHIERHCQSSRRNERYVSNHSGEKLYECNERSKPFSCP

SEQ ID NO: 32526 - protein, 94 aa, Mus musculus
VTYDDVQVNFTREEWALLDPSQKNLYRDVMLETYRNLAAIGYVWEDHNIEDHFQSSRRRGRYERSHTEEQPSEFIQRGKKAYVFQSHNQRHERI

SEQ ID NO: 32527 - protein, 87 aa, Octodon degus
VTLEDVLVNFTMEEWAVLNPSQKKLYREVMWETFVNMTAVGRTWNIQQIEEVYKNCSRNLRNENIAKIDENKVWTQHEKMFLEILDE

SEQ ID NO: 32528 - protein, 84 aa, Peromyscus maniculatus
VTYDDVHIDFTWEEWTLLDPSQKNLYKDVMLETYRNLTTVGYSWEDHLIEEHCKSSRKHERHERIPTGEQPSESTQSFRAFAHH

SEQ ID NO: 32529 - protein, 90 aa, Peromyscus maniculatus
VTFEDVAIDFTQEEWTLLDTKQRNLYREVMLENYQNLATVEWAMRLNTRGTMFQQDIFQLKISNEIQLLNSHNGKELCDFKPHEDNFKEP

SEQ ID NO: 32530 - protein, 82 aa, Mesocricetus auratus
VTFEDVAVNFTSGEWALLDSSQKKLYRDVMKETFLNLISIEKGLEPNIEEHYKDFCRNLRTQLVEKDWGYEYNRQWDDNLQT

SEQ ID NO: 32531 - protein, 84 aa, Octodon degus
VTFEDVAVNFSREEWALLDPPQRKLYGDVMWETLRHLAAVERNSDGQQLEDKYRHYRKRLRTEELEQSCEHTLWHKHEMASQTP

SEQ ID NO: 32532 - protein, 86 aa, Octodon degus
VTYEDVTVNFTVEEWALLDSSQKKLYNEVMWENFMNVTAVGRSWDDQQIEDEYTNHGNTLRSADIDQCCQYNFWYQHKEMALMTPI

SEQ ID NO: 32533 - protein, 83 aa, Octodon degus
VTFEDVAVNFTLEEWALLDPSQKRLYRDVIQETFWNLAAIGNNWEEQNIADEYENSRRNLRSQVVESFCEYKESSQCGEIFSP

SEQ ID NO: 32534 - protein, 93 aa, Fukomys damarensis
VTFEDVAVTFTVEEWALLNTSQKNLYRDVMWETFMNIVATGKILDNQEIDEAYKCCWKNIRNEEVEKCYLYKSWNQCEEICYGTPDNNVNMKK

SEQ ID NO: 32535 - protein, 93 aa, Rattus norvegicus
VSFEDVAVHFTQDEWALLDPSQRSLYRDVMLETCRSLAAVGSRWEEENVEDRCKNPGRNMRGSMIETPCERTEDDQVEETLTRIPDLHTSTTA

SEQ ID NO: 32536 - protein, 82 aa, Octodon degus
VTFKDVAVNFSKEEWALLDPSQKKLYRDVMWETFRNLAAVGRSSGDRHVDDKDGKCGKQLRRILAGHSSARGPMIANTAVKP

SEQ ID NO: 32537 - protein, 93 aa, Rattus norvegicus
ISFKDVAVNFTAEEWALLNSSQKRLYRDVMQETCRNLAAIAKKQEDCILEDDSENLWKNFPISIQTEYKLCESQEYAEKPGTCKECGKFFSSP

SEQ ID NO: 32538 - protein, 87 aa, Octodon degus
VTFEDVAVNFTSAEWAFLSPAQKKLYRDVMWETLTNMTAIGRIRDNHHIKEEYKSCLRNLRNDADKYLRFGEKLHQCNEHEKTCSDS

SEQ ID NO: 32539 - protein, 99 aa, Octodon degus
VTFEDVAVNFTLEEWALLDPSQKKLYRDVMRETFRNVAAVGRACGNQEVEEKYKNDWRSQRNEELEKCYPLNIPTVIHTGLTTCEFWGLEEKLYKYKEH

SEQ ID NO: 32540 - protein, 83 aa, Octodon degus
VVIEDVVVRFTQEEWALLDSAQRDLYRDVMLETFWNLASIEISWWRNSVEVMTSAEKPSAKCQILTCIRKSLLGQNSIQQQAH

SEQ ID NO: 32541 - protein, 86 aa, Octodon degus
VSFEDITVDFSREEWQYLDLAQKSLYRDVMLENYFNLVSVGGDIGFEPSQQELSQGFFSQSERIHLFIKHLELWKGDKWRRRYEEN

SEQ ID NO: 32542 - protein, 110 aa, Mus musculus
LTFMDVALEFSKEEWECLDSAQRALYRDVMLENYNNLVSVDQEAPDTLPERTQSPNPKAHCRLSTHVTSYKCIECGKSYTKLSSLKVHQRLHTGDKPYKCNECGKYFTKS

SEQ ID NO: 32543 - protein, 101 aa, Mus musculus
LTFRDVAVDFSPDEWECLDPPQQRLYRDVMVENYRNLVSVGEDSIPAELPTHCHHFMPFLSKMSAVACAFHKQYKPLSHHCTQNFSPEQILKYSFTEVTNG

SEQ ID NO: 32544 - protein, 83 aa, Fukomys damarensis
LTFEDVAVNFTQEEWALLDPSQKKLYRDVMWETFRNLAAIGRHSDDQHIEDEYNTCRKSLRSEEGEKSCQYKLRYQGGEAVVQ

SEQ ID NO: 32545 - protein, 86 aa, Octodon degus
VTFEDVALNFTIEEWALLNPSQKKLYRDVMGETFRNMAALGRAGNKHGGGKEHKDYWRYMRNEEVGKCYQYTAWNQCEEIFPGTED

SEQ ID NO: 32546 - protein, 86 aa, Fukomys damarensis
MVAEGAFLRITQIAALCLAASQGQAMLSTLRERGGKDMSGVRVTVGVRGGGGLRGLCVAKPEMIFKLERGEELWILEEESSCHAYA

SEQ ID NO: 32547 - protein, 87 aa, Rattus norvegicus
LTFEDVAVNFTLEEWDLLDPSQKQLYTDVMQETFKNLIAIGQIEEGRRSKDDDEESRRSLRSGLVELLCKPRESRQCEEIFSEFPDT

SEQ ID NO: 32548 - protein, 86 aa, Mus caroli
LTYDDVHVNFTREEWALLNPSQKSLYKDVMLETYRNLNTIGYNWEDNIEEHCQSSRRHGRHERRLIGEKPSENIQCGKDFASHSYP

SEQ ID NO: 32549 - protein, 95 aa, Mus musculus
VSFEDVAVHFTQEEWALLDSSQKSLYRDVMLETCRSLATIGYKWEDQNLEDHCINPGRNLRSYMFQTFCENEGDDQGGENLPWKPNLSMNMRCST

SEQ ID NO: 32550 - protein, 89 aa, Dipodomys ordii
VLFEDVVVNFTLEEWALLDSAQKNLYGEVVGEIFMNLASIGENWDQKIEDWYRNQGRNLSIHIAETLCESEEGTECTERASRIADDLKK

SEQ ID NO: 32551 - protein, 84 aa, Fukomys damarensis
VTFEDVAVNFTKDEWALLNPSQKKLHRDVMWENFTNVTAIGRNWKDQQVEDEYKNLRKNIRHERTHTGEKPYVCKQCGKGFSTH

SEQ ID NO: 32552 - protein, 88 aa, Rattus norvegicus
VTFPRDVAVFSQEEWRKLDPLQKLYDVMLENYPTLVSVGQKPIRIISLEQLKPWGDPKRGHPPLLSLSPETLFPPWMLARHAVPRLLW

SEQ ID NO: 32553 - protein, 83 aa, Mus musculus
VAFEDVAVNFSLEEWAMLNPSQKNLYKDVMQETLRNLASIGSSLEHHIIENIYRNSWKKLSGQVVEGLYDCKDDHQCAEIFDF

SEQ ID NO: 32554 - protein, 87 aa, Mus musculus
VTYEDLHVNFTQEEWALLDPSQKKLYKHVMLETYRNLNAIGVKGVRVQRNPLNILNVIKPLLYLLTVMPKGMKGFIQKRSPLKIFTV

SEQ ID NO: 32555 - protein, 87 aa, Dipodomys ordii
VTFDDVFVNFTLEEWALLDPAQQKLYRSVMGETFRNLASVGKTQEDQNMEEEYKNPAMELRNEVVEGLSEHKEVIPFEDIFISASAS

SEQ ID NO: 32556 - protein, 92 aa, Octodon degus
VSFEDVAVNFTVEEWDMLDPSQKKLYRDVMCENFRNVAAVGRNWDEHQTEDSYKNCRENLRSEEMKKCCKYKVYQHEEAVFLTPDNGINVKP

SEQ ID NO: 32557 - protein, 84 aa, Mus musculus
VTFRDVAVVFSEEEMGLLDAAQRKLYHDVMLENFLNLLAVGWFHSLLAAFLSRYPTALAPLTSCGLQGNPGFTSQASHSTGIVR

SEQ ID NO: 32558 - protein, 87 aa, Mus musculus
VTYEDVHVNFTQEEWALLDPSQKKLYKDVMLETYRNLSALGVKGVRVQRNPLNILNVVKPLLYMLTVMPKGMKGFIQKRSPLKLFTV

SEQ ID NO: 32559 - protein, 82 aa, Rattus norvegicus
VTLKDVAMDFTLEDWEDLESELGQRDLFWDATLNNYQDLFSFTHPPQPSLIFQPDVREELEAIVRGGPEATSDEATEAKNPP

SEQ ID NO: 32560 - protein, 84 aa, Octodon degus
VSFEDVAVNFTVEEWDILDPSQKKLYRDVMCENFRNVAAVGRNWEEQQTEDAYKNCWENLRSEELEKCCEYKVYQHEEVVFLTP

SEQ ID NO: 32561 - protein, 88 aa, Octodon degus
MEDVAVNFTREEWTLLNSAQKKLYRDVMWETFRNIKAIGKTWDNQQMEEKYKNCPTNLSGEKPHDYLGFGDKLSKYNEHGKTSNDNQS

SEQ ID NO: 32562 - protein, 94 aa, Octodon degus
VTLEDVLVKFTKQEWAVLNPSQKELYQDVMWETFMHMTAVGMTWDNQQIEEYKNCLRNLRNEKVTFDQNKVWSQHEKVLLWASYENVEIEQAAP

SEQ ID NO: 32563 - protein, 94 aa, Rattus norvegicus
VAFDDVAINFTQEEWALLDPSQKSLYRDVMEEVFRNLTSIEKGWEDQNIEDEDKSPETNLRHIIANSGCNLYESEEHSEKPYKFTQYRNSFISL

SEQ ID NO: 32564 - protein, 84 aa, Mus musculus
VTYDDVHVNLTREEWALLDPSQKRLYKDVMLETYKNLTAIGYNWEYHNIEEHCQSSRRHRRHERSHTGEKPSVFNTQCGKAFAC

SEQ ID NO: 32565 - protein, 110 aa, Mus musculus
LTFMDVALEFSKEEWECLDSAQKALYRDVMLENYNSLVSVDREAQDTLSERTKSPNPKTQYRISTRVTFYKCIECGKSFTKLSSLKVHQRLCTGDKPYKCNECGKSFKHL

SEQ ID NO: 32566 - protein, 91 aa, Rattus norvegicus
VTFMDVHVNFSQEEWALLDPSQKSLYKDVMLETYWNLTFIGYEWEDHNSEECCQGSRSHGRYFNCPQYSTCKAKGYGKKQYTSLFPRTIRR

SEQ ID NO: 32567 - protein, 89 aa, Rattus norvegicus
VTFEDVSVNFSLGEWALLDSYQKKLYRDVMMETFMNLISIGKTEEESMDVNYPMVQRNRRIQVVEKFCDCEHGSQCGKTHQQKTEHIAN

SEQ ID NO: 32568 - protein, 84 aa, Rattus norvegicus
VTYEDVYVSFTQEEWALLNPSQKNLYKDVMMQTCRNLIAIGYKWNSQNIEEHCQSSGKHKRDIICHSGYKPFEHKDYGKMQFTS

SEQ ID NO: 32569 - protein, 83 aa, Peromyscus maniculatus
GSLENDGVCFSEQEWENLEDWQKELYRNVMESNYETLVSLKVLGQPEEEAELGAEMVGDLVEEGTHLDRAMVKQEALYKQEGP

SEQ ID NO: 32570 - protein, 84 aa, Peromyscus maniculatus
VTYDDVHVDFTWEEWTLLDPSQKNLYKDVMLETYRNLTTVGYGWEEHNIEEHCQSSRRHERCERSQPGEKPSIYTQCVKAFACE

SEQ ID NO: 32571 - protein, 83 aa, Peromyscus maniculatus
VTYEDVHVNFTHDEWALLDPSQKSLYKDVMLETYWNLTIVGYKWEDHNIEKHYQNATRHGRLGSPGTAVAQQAVWKLEEVLDL

SEQ ID NO: 32572 - protein, 94 aa, Mus musculus
VTYEDVHVNFTKEEWTLLHPSQKSLYRDVMLETCRNLTAIGYKWEDHNIEESCQSSRRYKRNNICHSGPQPCEYQGYGKKQCTVTSNSVLQTYG

SEQ ID NO: 32573 - protein, 90 aa, Mus musculus
VTYDDVHMNFTEEEWDLLDSSQKRLYEEVMLETYQNLTDIGYNWQDHHIEEHCQSSRRHERGLQLHDWMTLRRDFELWNFNIFETGIDDG

SEQ ID NO: 32574 - protein, 99 aa, Octodon degus
MTFEDVAVNFTMEEWALLDPSQKKLYRDVMRETFRNVAAIGRAWDNQEDEEQYKNDWRNQRNKEVEKCYPVNMPTISHSGMMTYEFLGLEEELYKCNEH

SEQ ID NO: 32575 - protein, 94 aa, Mus caroli
VTYDDVHVNFTREEWALLDPSQKNLYKDVMLETYRNLTAIGYIWEDHNIEDHFQSSRRRGRHERRHTGEQPSEFIQRGKKAYVFQSHNQRHERI

SEQ ID NO: 32576 - protein, 112 aa, Mus caroli
VTYDEVHVNFTQEEWALLDHSQKSLYRDVMLETYKNLTAIGYNWDDHNIEEHCQSSRRHGRHETSHPGEKPSQYTHCGKAFVYQSHPQRHERIHTGEKPYGCNHCGKAFAHH

SEQ ID NO: 32577 - protein, 89 aa, Mus caroli
VTFEDMTVDFTQEEWALLDSSQRNLYREVVGEIFMNLASVGERWDQNIEDWYRNQGRILSSHIVERLSDSKQGSHCWETISQILDHDLK

SEQ ID NO: 32578 - protein, 103 aa, Mus caroli
VSFEDVAIHFSQEEWVLLDKAQRLLYCSVMLENLALVASLGSCTRLGGEDVTCEPAEGVVCNTSPSPQETHLLEIPVPALEEVLHQNEFLSIHPVQTLDLSRT

SEQ ID NO: 32579 - protein, 104 aa, Dipodomys ordii
VTSEDVAVYFSREEWGLLDVAQRRLYCDVMLGNFMLLSSLGLWHRARAEHGASRVRTPGPGPASRKTRPCGACGLLLKAILHLAAQRGPRPGQELRARLEDLYR

SEQ ID NO: 32580 - protein, 94 aa, Dipodomys ordii
VTLEDITVSFSQEEWGLADEAQKSLYHDVMMENFVLVALVGCWHRMKDEELPSEKSTCTGVSDARASQGAPLPQKAYPCETWGLDLNHILHVAE

SEQ ID NO: 32581 - protein, 84 aa, Octodon degus
VFFEDVAVNFTQEEWALLDPSQKELYRDVMQETFINLASIEESWDDHSIEDNHKNQGKNLRHMKSHNGCQPYECHKYGEKLYEC

SEQ ID NO: 32582 - protein, 93 aa, Octodon degus
VTFEDVAVNFTVEEWTLLDPPQKRLYRDVMKETFRNMAAIGRVLGSQEVEEEYKNYQRNLRNEEVKKCYQNKCWNQYEEIFLWTPDAYMDMKQ

SEQ ID NO: 32583 - protein, 96 aa, Octodon degus
ITIEDVTITFTPEEWALLDTAQRKMYRAVMLETISNLQSLGDLKIHMRTHTGAKPYKCNVCQKTFTHCNTLKIHKRTHTGEKPYECRLCGKAFAQL

SEQ ID NO: 32584 - protein, 97 aa, Octodon degus
VTFEDVAVHFTTAEWALLNLSQKKLYQDVMWETFVNMTAIGGTPNNQQIAEECKNCSRNLRNEADGYLRFEEKLYKCKEHGTPCTNFQSFQRHGIRK

SEQ ID NO: 32585 - protein, 99 aa, Fukomys damarensis
MEEWALLNPSQKKLYRDVMGEIFMNMAAIGRVWDNQEVEEEYKRYWRKLRNKHVEKFYQYNAWNQHEEILLWTPDAIVDMKQASLTSAESLACRKPLTG

SEQ ID NO: 32586 - protein, 82 aa, Rattus norvegicus
VEFKDVVIYFSEEEWTLLDDSQRLLYHSVMMETFVLMTSLGLIPAGVRDITQLESSGDLFTPTLRFKAPGFWNREGEMSSIQ

SEQ ID NO: 32587 - protein, 82 aa, Rattus norvegicus
VTYDDVHVNFTHEEWALLDPSQKNLYKDVMLETYLNLCGIGCKWEDCNIEEHCQSSGRHESISAQGKEPHTVSRSSKLNGLS

SEQ ID NO: 32588 - protein, 95 aa, Dipodomys ordii
VTFQDVFVSFSREEWELLNKAQKVLYFDVMLEIFALAAIPGCWCEAEAGEALSEKHVSVEGVSPVRSPEPGVRIQNACLREDWEPLLEHTVCLAE

SEQ ID NO: 32589 - protein, 87 aa, Octodon degus
VSFEDVAVDFTQQEWRRLDSAQRTMHKDVMLETYSNLASVESLSLLCGNTSIGSNALNLLQHQKMQTLNENVDFNRCGKGFHKETVF

SEQ ID NO: 32590 - protein, 84 aa, Octodon degus
VTFEDVAVNFSREEWALLDPPQRKLYRDVMWETLRHLAAVGRSSDDQQSEDEFRNFQKRVRSEEVEKASQYTLWYQHGEMDSRT

SEQ ID NO: 32591 - protein, 84 aa, Octodon degus
VTFEDVAVNFSREEWALLDPSQKKLYGDVMWETFRNLAAVGKNSDYQQIEDTYRNCSKHLRSEDVEQSYDYKLCYQYGEMVSET

SEQ ID NO: 32592 - protein, 83 aa, Octodon degus
VTFEDVAVIFTMEEWALLDPSQKELFRDVMWENFRNVTAIGGSWGDQQIEDEDRIFQKNLRKSYIYNHSWKSLNSSTSFGKHE

SEQ ID NO: 32593 - protein, 83 aa, Fukomys damarensis
SCPWRLALALALPLWCCALWPFSLLVVHLELLARLTLRITAVDNPVFLFLSGLQVSKPDVISQLEQGTEPWTVEPGVAVATCG

SEQ ID NO: 32594 - protein, 84 aa, Fukomys damarensis
VTFDDVAVYFSEQEWGKLEDWQKELYKHVMRGNYETLVSLGPTPCPEQLISPAQEEARGRLGPVQQQDEEAGLTPAQSGAGGSA

SEQ ID NO: 32595 - protein, 88 aa, Rattus norvegicus
LTFGDVAVDFPQEEWECLDSAQRALYIDVMLENYSNLVSVENYCICDTVHQHVKTKKDSCQCNELSEMLHDSPHCALYKRGETAETSN

SEQ ID NO: 32596 - protein, 95 aa, Dipodomys ordii
VTFEDVAIYFSVEEWGLLDEAQRLLYLGVMLETFALITSLVCWHGVENEDTPSEQVSVGLSRVRTSNTDPSGPEAHPCGTCNPVLRGCLHLADQP

SEQ ID NO: 32597 - protein, 83 aa, Tokudaia muenninki
VTFEDVALYLSREEWGRLDHTQQNSYRDVLQGRNGLALGAVDMGKVVPTLAVATLEDPKSIRTRARWAPGEDLECGQQLTSGP

SEQ ID NO: 32598 - protein, 87 aa, Rattus norvegicus
VNYDDVHVNFTWEEWALLDPSQKSLYKDVMLETYRNLAAIGYIWKDHNTEGHFLSSGRDGRHERSYTEEKLSEFTQYDKDFAYQSHP

SEQ ID NO: 32599 - protein, 84 aa, Octodon degus
VTFEDVALNFSREEWALLDPSQRKLYRDVMWENFRNLASIGRISGAQNIEDEHSSCGKIPRSVGMEKSSQYKLLYRHEEINSQT

SEQ ID NO: 32600 - protein, 87 aa, Octodon degus
VTFEDVAVNFTMEEWALLDPSQKDLFRDVMWENFRNVTAIGRNLDDQKIEEEYRNCRKILRSSVVDKFPRYKLWYQHGEMAFITPNT

SEQ ID NO: 32601 - protein, 112 aa, Mus musculus
LTYDDVHVNFTQEEWILLNPSQKNLYKDVMLETYRNLTAIGYNWKDHNIEEHCQSCRRHGRHKRSPTGEKPNEYTQCGKAFACHSYPQRYGRIHIGEKPYGESFAPTSGLQI

SEQ ID NO: 32602 - protein, 96 aa, Octodon degus
VTFEDVAVYLTREEWGRLDPVQRDLYREVMLENYGNVVSLGILLRLPTTRIHCVNSCPALSHTQASAFSGETLAVLSAGISKRWPKCRLPIDSARP

SEQ ID NO: 32603 - protein, 110 aa, Octodon degus
VTFDDVAVKFTNEEWALLSPFQRKIYKDVMKETFRNLADIGRAWDIQKVGKEHKNYSRNLRNEEIQKCYQYKGWNRYEGILLCTPDVNVDVNQTDIHDNVEIYQTNYRGE

SEQ ID NO: 32604 - protein, 83 aa, Octodon degus
VTFEDVAVTFTREEWALLDPSQKKLYRDVMGETFSNVAALERNWNEHQIEDEHNNDRKNLRNEVKKCQQYKLFDQHGEMVYVT

SEQ ID NO: 32605 - protein, 83 aa, Fukomys damarensis
VTFEDVAVNFTMEEWALLNPSQKKLYRDVMRETFRNMTAVGRAWDNQEVEAEYENYWRNLRCPAEHSLSEFLRRHQSRTCGKA

SEQ ID NO: 32606 - protein, 92 aa, Rattus norvegicus
VSFDDVTVDFSQEEWQHLDSAQRCLYQEVMLEIYSHLLAVGKLQLDIQHQQIFVKASFLTDATNEVTRHGSCCSVLEKLWQDDDTAAKRDQQ

SEQ ID NO: 32607 - protein, 83 aa, Colobus angolensis
VAFEDVAVNFTQEEWALLDPSQKNLYRDVMQETFRNLASIGNKGKDQSIEDQYKNSSRNLRHVVSHSGNNPCGCEECRKKPYP

SEQ ID NO: 32608 - protein, 86 aa, Odobenus rosmarus
VVFEDVVVDFTQEEWALLNPAQRKLYKDVMLETFRNLVSVENWEDQCIEDKHNNEWRHLRSHRVERLCESSKGNTCGETVSRIPNI

SEQ ID NO: 32609 - protein, 82 aa, Carlito syrichta
VTFSDVAIDFSQEEWACLDSSQRDLYWDVMLENYSNLVSLGLGNTAAWMMFCSSITKHLISDLESSYEAKRLPTEKNIRGIN

SEQ ID NO: 32610 - protein, 103 aa, Carlito syrichta
VTFEDVTIIFTWEEWKFLDSSQKRLYREVMWENYTNVMSVGNLNKSYKPQEERFRYLEYENFFCCQDLWIASTQINKNQNYEETVQGIDSRDLKQQDLAQCQE

SEQ ID NO: 32611 - protein, 83 aa, Carlito syrichta
VAFEDVAVNFTLEEWALLDPSQKNLYRDVMRETFKNLASIGTQWEDQNINNQSKNPRTNLSHILERFCESKVGSQNGIVNNRT

SEQ ID NO: 32612 - protein, 83 aa, Erinaceus europaeus
VTFRDVAVVFTEEELGLLDPTQRQLYRDVMLENFRNLLSVEDKCLNDMGTLQQVQSRVYLPPRELFCSQIWQQVIKELTRHED

SEQ ID NO: 32613 - protein, 94 aa, Ornithorhynchus anatinus
VTFKDVAIFLTQQEWESLADAQRELYTTVMLENYGHLQSLGKDTESLAGQGYSPPGRKLVVDEIPIRGFPNLRLTTDGFSPKKPGKQMPSTAFA

SEQ ID NO: 32614 - protein, 103 aa, Odobenus rosmarus
VTFEDIAVSFSWEEWDLLDEAQRHLYQDVMLENLALITSLGCWHGAEDEEAPSEQSISVGVSHVRAPKTGLFPQKANPYEVCGPVLKDNFYLAEHQETQFSQK

SEQ ID NO: 32615 - protein, 96 aa, Gulo gulo
VTFEDVAVHLTREEWGCLDPVQRDLYREVMLENYGNVVSLGILLRLPTTRIHSVNSCPALSHTQASAFSGETLAVLSAGISKRWPKYRLPIDIARP

SEQ ID NO: 32616 - protein, 82 aa, Erinaceus europaeus
VTCEDIIVTFTQEEWALLDPSEKKLYRDVMWETFRNLLSLGKLQKDHYTEEHCCSSLRAHERTHNGQKPYECKQCSKTFTQS

SEQ ID NO: 32617 - protein, 90 aa, Odobenus rosmarus
VVFEDVAVDFTLEEWALLDSAQRELYREVMLENLKNLASVDDETQFKTSGSISQQDVYGNKISKEHKIAKFTRNDSWASVLGEIWEEFST

SEQ ID NO: 32618 - protein, 104 aa, Carlito syrichta
VTLEDVAVDFSQEEWALLDPAQRGLHQEVMLETYRNLLFLDGLKSQHADTGFGGGLFSPAHTPQVTSLSPWTEHSLFRPVEPFHLGQAEALWMEEKGDPQASCL

SEQ ID NO: 32619 - protein, 90 aa, Gulo gulo
VTFSDVAINFSQEEWACLDSSQRDLYWDVMLENYSNLVSLDLESPYGTKSLPTEKRLYEINLSKWNSNGKSKSLGLGWMCEGECAGPRGP

SEQ ID NO: 32620 - protein, 114 aa, Colobus angolensis
VTFEDIAVYFSQEEWGLLDEAQRCLYHDVMLENFSLMASVGCLHGIETEEAPSEHTISSQGMSQARTPKPGPSIPNTHSCEMCILVMKDILYLTEHQGTLPWQKPYTSAASGKW

SEQ ID NO: 32621 - protein, 89 aa, Vicugna pacos
VVFEDVAVDFTVEEWALLDSAQKELYRDVMLENFRNLASVDDDTQFKANGSVSQQGICGNKIPKEQKISKFTGSDSWASVVGRIWEALS

SEQ ID NO: 32622 - protein, 89 aa, Erinaceus europaeus
VTYEDVTMIFTPEEWTLLNPSEKKLYRDVMWETFRNFLSVEKLQKDHSNKEQQHNHQGTKQSNTVKITDIKERSQSGEKTQGEISATFR

SEQ ID NO: 32623 - protein, 94 aa, Cervus elaphus
VVFEDVAVYFSQEEWGLLDEAQRHLYRAVMTENLALVTSLGCWHGAQGEEASSEQDVSIGMSEVRTAKPDPSSRKAQSSDMCGPLSRDHLPLPE

SEQ ID NO: 32624 - protein, 86 aa, Cervus elaphus
LTFQDVTIDFTQEEWECLDPGQRELYRDVMLENYGNLACLVFETPGISVNTSYAVLNVDSVAAICQTNDTNVQWYVGYTQVSSYER

SEQ ID NO: 32625 - protein, 83 aa, Colobus angolensis
VAFEDVAVNFTQEEWSLLDPSQKSLYREVMQETLRNLASIGKKWKDENIEDQYKNPRNNLRSLLGERVDENTEENHCGEIFSQ

SEQ ID NO: 32626 - protein, 95 aa, Colobus angolensis
VTFQDVAVDFTAEEWQLLDCTERTLYWDVMLENYRNLISVESDCPLDEPGKHRESKDNFLKSVLLTFNKILTMERIHHYNMSTSLNSMRKKSYKS

SEQ ID NO: 32627 - protein, 87 aa, Colobus angolensis
VAFEDVAVNFSQEEWSLLSEVQRCLYHDVMLENWVLISSLGYWCGSEDEEAPSKRNISIQRVSQVNTPRVGVSPKKAHSCEMCGAIL

SEQ ID NO: 32628 - protein, 87 aa, Colobus angolensis
VAFEDVAVNFTHEEWALLGPSQKNLYRDVMRETIRNLNCVGMKWENQNIDDQYQNLRRNARCDVVERFGKSKDGSQCGETLSQIQNS

SEQ ID NO: 32629 - protein, 90 aa, Mustela putorius
VTVKDEEMDFTHVEEEQLNSAQRYMGMDMKVENCGSLVFWDSESIPETKECFLKQGLYDEISSERDLIMERLKKDESWDSRLIETWQCED

SEQ ID NO: 32630 - protein, 112 aa, Vicugna pacos
LSFMDVFVDFTWEEWRLLDPAQKHLYRSVMLENYNNLASLDEVQEIDDRVEWHQESHGKLGSRAESYQCTAFGRLSLHSTNYVSSRQELHKCVTHGKSLKHIDSSSNYAGKY

SEQ ID NO: 32631 - protein, 83 aa, Delphinapterus leucas
VTFEDVAVYFTQTEWAGLSPAQRALYRSVMLEIYGNLTSLDAGTNTDNELTPTWGVSEERDMMMSHGPQKNVLKRNSFLETCE

SEQ ID NO: 32632 - protein, 89 aa, Ursus americanus
ISFEDVTVNFTQEEWGQLDPDQRTLYRDVMLENYSIFISLGKQNFSEKQHQHFTPFYVYLEVHSHVILIFIKENQDRHLWQDAFVNNKK

SEQ ID NO: 32633 - protein, 86 aa, Lynx pardinus
LTFRDVAIEFSQEEWECLDPAQRALYREVMLENYRNLVSLGEDNFSPEVGIPSDGFAIKELSPTEDINKGEFCHLVILERNESYGI

SEQ ID NO: 32634 - protein, 85 aa, Saimiri boliviensis
VTFDDVAVEFTPEEWALLDTTQKYLYRDVMLENYKNLASVEWEIQPRSQGPSHQQGFLKNEIFNGLQMERSYRLGKLCDCKNCGE

SEQ ID NO: 32635 - protein, 126 aa, Cervus elaphus
VTFRDVAVFFSRDEWLCLDSAQRTLYQEVMLENYSTLSSLGKAFPGDVESAGGAPWCPLRGGHLEGMARFSPQVDSESSSCCCPQLQGQVSAWQRILFSKPKVILQLEQGEDPWMVENGVSQSTYL

SEQ ID NO: 32636 - protein, 93 aa, Colobus angolensis
VSFEDVAVAFTQEEWALLDPSQKNLYRDVMQEIFRNLASVGNKSEDQNIQDDFKNPERNLSSHVVERLFEIKEVSQYGETFSQDSNLNLNKKV

SEQ ID NO: 32637 - protein, 82 aa, Cervus elaphus
VTFDDVAVTFTQEEWGHLDPAQRTLYQEVMLENCGLLVSLGKASHSAVRAPATAFIPDPGSVLASQEELRNPPSLLLPHSST

SEQ ID NO: 32638 - protein, 87 aa, Cervus elaphus
VNFKIVTVDFTQEEEGTLSSAQRTLDRDVILENHRDSWDSATALGRRESRLKQSIFDDKLSPSVKTEKLTRDDPWLSSCEEFQDCKE

SEQ ID NO: 32639 - protein, 82 aa, Vicugna pacos
AAPGQQGGGPQEQEWENLEDWQKELYTNVMKSNYETLVSLTNDPYSLLGSHGAVSNPEVLGQPEGDSELGTEMLGDLEEEGP

SEQ ID NO: 32640 - protein, 89 aa, Vicugna pacos
VNFKIVTVDFTQEEEGTLDAVQRTLNRDVILEDHRDLVSWDSATALGSRESTSQQSIFHDEPSLEVKLERLTRDDPWLSSCEEVRDCKD

SEQ ID NO: 32641 - protein, 89 aa, Vicugna pacos
VMFEEVSVCFTSEEWACLGPIQRALYWDVMLENYGNVTSLEWETMTENEEVTSKSSISQRADSQKGTSKRLQGGVPKVLDFEEDCEWQV

SEQ ID NO: 32642 - protein, 94 aa, Odobenus rosmarus
VVFEDVVVDFTPEEWALLDRGQRRLYRDVMLETCRNLASLGENWKCPGIEHQHKNEGTCMRCHVVEVPSENNGSIQCGETNQISNFIVHKRLST

SEQ ID NO: 32643 - protein, 102 aa, Vicugna pacos
VTLEDVAVHFSWEEWELLDPAQRRLYRDVMRETCRNLASVEASTRGPGAGAAGGAAPLARAAAAAAALRSAVPVRRRHAPAFLQRCLSPGLEEKPCAWRGKE

SEQ ID NO: 32644 - protein, 92 aa, Carlito syrichta
LTFKNVAVVFSRDEWKRLDPAQRAFYRDVMLQNYRNLVSLGEDNFLPEVKTCYCGIFEFVCMCVSMGTYLCVAVLALIFPFLDSIEDLLTQK

SEQ ID NO: 32645 - protein, 97 aa, Erinaceus europaeus
VTFEDVTVTFTLEEWTLMQPSEKQLYGEVMWETFTNLVSVGGFILGKVEEVPAARDPCPTQSRTHRNNTRVCEGKERRQHGEKPYECKVCSKAYDRP

SEQ ID NO: 32646 - protein, 93 aa, Erinaceus europaeus
VTYEDVTVIFTQEEWILLNPSEKKLYRDVLWENYWNFLSVGKLLEEHSTNKQQQNHQRSKQSNILNYLRLHERTHNGEKPYECKQCCKAFSSA

SEQ ID NO: 32647 - protein, 91 aa, Mustela putorius
VAFEDVTVKFTMEEWALLDPSQKKLYRDVMQETFRNLASIVCGSEEKWDIHDSEDQNENHGTDLSSQMVERLHKSKECSQYEEIFSQIPYH

SEQ ID NO: 32648 - protein, 87 aa, Odobenus rosmarus
VVFEDVAVDFTLDEWALLDSMQKNLYRDVMIETFQNLVSSHREGKTYECKQCSIAFHEFSSLTRHERTRTGEKPYKCKECGKAFIYP

SEQ ID NO: 32649 - protein, 93 aa, Erinaceus europaeus
VNCEDVIVTFTPDEWALLHTSEKKLYGDVMGETFGNLVSIGTLWEDHAIRDHYNNQGRKQRYIVEIIWEGKEGNKDGENPYEYKVCSDAFSFP

SEQ ID NO: 32650 - protein, 90 aa, Carlito syrichta
VMFRDIAIDFSQEEWECLDSAQRDLYRDVMLENYSNLVSLDLPSRCASKDLSPKNKTYATELSQWEMSERLENCDLEKSNSRNYLEVKSK

SEQ ID NO: 32651 - protein, 91 aa, Gulo gulo
VVLEDVAICFSQEEWGLLDEAQRFLYHAVMLETCALLSSVGCWHGAQDEQAPSEQGDSIGGSQLRTPKLGPLTRKSQPWEMCGPLWKDLLR

SEQ ID NO: 32652 - protein, 91 aa, Delphinapterus leucas
VTFEDVAVYFSREEWGILNLTQRSLYRDVMLENFALIGSLGFLCRLRDEEAPPEQVKSHRVRLSENPFLCRVSGKDIPAALGFLQPQATHR

SEQ ID NO: 32653 - protein, 85 aa, Erinaceus europaeus
VSYEDVAVIFTQEEWTLLNPSEKKLYRDVMCENLRNFLSLEKIQEHSTKGQHILHGSKQSNTTVKISEGKDSHNARLSQECELRA

SEQ ID NO: 32654 - protein, 84 aa, Erinaceus europaeus
ISYEDVTVSFPPDEWALLDPSQKKLYIDVMRETYWNMASVGKNGDIPGAGCGDAAERDRDRGDEVSQDQDDGGRTPDGNPNTET

SEQ ID NO: 32655 - protein, 92 aa, Carlito syrichta
LTFKDVAIVFSRDEWKHLDPAQRVFYKNVMLQNYRNLVSLGEDNFLPEVKTCYCGIFEFVCMCVSMGTYLCVAVLALIFPFLDSIEDLLTQK

SEQ ID NO: 32656 - protein, 87 aa, Carlito syrichta
VVFEDVAVNFTQEEWALLGPSQKKLYRDVMQETFVNLASIGEKWEDQNIEDHHKNQGRTLRSHMVEKLSEKNESSQLGETFSQTPNL

SEQ ID NO: 32657 - protein, 92 aa, Erinaceus europaeus
VTYEDVTVIFTQEEWALLNPSEKKLYRDVMWETFMNFVSIEKLQGDHSTKEQHNHQGSEQSNIVNITEAKERSQNGQKPEEYELNNKVFTYS

SEQ ID NO: 32658 - protein, 96 aa, Erinaceus europaeus
VTFEDVTVHLTREEWGCLDPVQRDLYREVMLENYGNVVSLGILLRLPTSRIHNVNSCPALSHTQACAFSGETLAVLSAGISKRWPKCRLPVDIARP

SEQ ID NO: 32659 - protein, 87 aa, Mustela putorius
VAFEDVAVNFTLEEWALLDPSQKKLYRDVMRETLRNLASIGKKWKDRNIEDEYKNQGRKLRSHTVERFCQSKEGNQCGGNFSPIPNL

SEQ ID NO: 32660 - protein, 88 aa, Tupaia chinensis
VTFQDVAVDFNREEWELLGPTQRTEYHDVMLETFGNLVSVDSEDGYVCKKKKAKVSKINIKDDVLNKITENGKQPVILEPPILISDDE

SEQ ID NO: 32661 - protein, 87 aa, Carlito syrichta
VTFEDVAVTFTEEEWTLLDPFQKNLYRDVMQETFRNLASIGNKQEDQIIEDHFKHAGRNLRSHVVERLCESKEGSQYGETFNQNPNL

SEQ ID NO: 32662 - protein, 87 aa, Delphinapterus leucas
VTFEDVALYFSWEEWALLDEAQRCLYHDVMLENFALTSSLGCWHGVEDKEAPSQQSISVDGVSQIRTLKAGSSPQKAQPFEMCGPIL

SEQ ID NO: 32663 - protein, 98 aa, Gulo gulo
VTFRDVVISFSPEEWEYLDSAQRSLYWDVMMENYSNLVSLDLESNYDTKCSSTRKDITENSGSQCSKFIGLESSIFRNDRQSNGKSVVQRPEVGYFSQ

SEQ ID NO: 32664 - protein, 95 aa, Carlito syrichta
VVFEDVTIYFSQEEWRLLDKAQRCLYSDVMLENFALLSSVGCCHGAEDDEESPLEQAVSVGVSQVTAPKPGLSTQKSQPCETCSSLLKNILHVTE

SEQ ID NO: 32665 - protein, 89 aa, Mustela putorius
VNFKIVTVDFTQKEESTLNPAQRILDRDMILENHRDLVSWDLAMALGRRESTSKQNIFDEEPSHGVKLERLTGDDPWLSSCEEVQDCKD

SEQ ID NO: 32666 - protein, 83 aa, Tupaia chinensis
ISFEDVAMDFTWEEWQNLEDAQKILYKDVMLETYSNLMFLGEKPYECEQWKKMFSQNSDLIVHQRSQIDEKSYENEICGKIFY

SEQ ID NO: 32667 - protein, 89 aa, Gulo gulo
VNLKVVTVDFTQKEEGTLNPAQRILDRDMILENHRDLVSWDLAMALGRRESASKQNIFDEEPSHGVKLEKLTRDDPWLSLCEEVQDCKD

SEQ ID NO: 32668 - protein, 85 aa, Vicugna pacos
VSFEDVTMDFSREEWQQLDPAQRRLYQDVMLEIYSHLFSVGELGLESPQQESSEKASLHTDVASKVTRDGAQWFVLEELWEGADQ

SEQ ID NO: 32669 - protein, 82 aa, Vicugna pacos
RSLENDGVCFSEQEWENLEDWQKELYTNVMKSNYETLVSLTNDPYSLLGSHGAVSNPEVLGQPEGDSELGTEMLGDLEEEGP

SEQ ID NO: 32670 - protein, 92 aa, Odobenus rosmarus
VTFEDVFVYFSREEWELLEEAQRLLYRDVMLENFALVASLGCWRETDNEETPSEQSISIGLSQLRTPESGAFIQKAHPCEVCDPLLKDILHL

SEQ ID NO: 32671 - protein, 89 aa, Odobenus rosmarus
VNFKIVTVDFTQKEEGTLNPNQRCDPRDVILENYRDLVSWDLAVALGRRESTSKQNIFDDEPSRGVKVERLTRDDPWLSSCEEVQDCKD

SEQ ID NO: 32672 - protein, 88 aa, Vicugna pacos
VIFEDVTLGFNPEEWEMLDLEQKSLYREVMLENYRNLVSVECPEAHLAPQFDPFPAGNPLMKIEVVEVLTLNQEVARPRNAQIRALYA

SEQ ID NO: 32673 - protein, 89 aa, Vicugna pacos
VTFEDVAVYFSWEEWDLLDEAQRCLYHNVMLENLALITSLVLQWRLQISPPGNSGNSLVALGSPSGFPRIRTRPEDVRAGRLAPPGGHF

SEQ ID NO: 32674 - protein, 92 aa, Ornithorhynchus anatinus
VTFEDVAIFLTRWEWKSLTDAQRELYKSVMSENYEHLRSLGKDTPREERATDHHGAESDGRPPSPSRPKACRGRDSGLSASVVYYFSLILKE

SEQ ID NO: 32675 - protein, 82 aa, Mustela putorius
VTFRDVAVVFTEEELALLDQTQINLYQDVMLENFKNVVSVGDRIKNNTSHLQGKALSYLSQGVLYCWQIWKQRISELTVSQE

SEQ ID NO: 32676 - protein, 85 aa, Tupaia chinensis
VAFEDVVLTFTPEEWALLDPLQKNLYGDVMLETIRNLASIGKKDQNIEDHYRNSRRILRNHMVERLCERECIQFGDTVTQNPRRI

SEQ ID NO: 32677 - protein, 84 aa, Erinaceus europaeus
LAFEDVAVSFTVEEWALLNASQKKLYREVMRETLKNLASIGEKREDHNIEDQYINQGRILRSFMVETVCEGEEDCQHGENYTHP

SEQ ID NO: 32678 - protein, 87 aa, Erinaceus europaeus
VTFEDVALYLSQEEWGRLDHAQQNCYRDILQRTTGLSLGLSVGRPLRASQVQAKTEASSLHPHTEGALHWGKEEPSSSLATSEDAES

SEQ ID NO: 32679 - protein, 92 aa, Erinaceus europaeus
VTYEDVTVTFTQEEWALLNPSEKKLYRDVMWENLRNIFSTGKIQGDNYNEEQHNHQGSKQSCRVVKISGGQKRSQNDEKQRMQSEGKSYECE

SEQ ID NO: 32680 - protein, 136 aa, Delphinapterus leucas
VTFKDVAVTFTQEEWRQLDLDQRTLYQEVMLEICGLLVSLGPSCLRHHHMLSEAWAVILPWAGDHFRRCTGMSWNATGGHPAKASPFTFSVWHADCCQEKVSDQWHPVPKPELIHLLEHGQELWMGRRGLPRSMCP

SEQ ID NO: 32681 - protein, 95 aa, Chelonia mydas
VSFEEVAVYFSKGEWALLDPTQRAFYRDVMQDNYEMVVLLDLITCERINLEETRYTCHECGKSLNRSSDLLTHWRTHSGEKPYTCSECGKSFSQR

SEQ ID NO: 32682 - protein, 118 aa, Chelonia mydas
VTFEDVAVYFTEEKWALLDPAQRALCGDIMQESYENVTSLVSGGSSGNYSCGYEIKDSDNQVIRSQLSFPQRLIITGTLPAPTLYLNHTSARPGDSVRLQCSVFSWALATRIIFFKDG

SEQ ID NO: 32683 - protein, 97 aa, Chelonia mydas
VTFEEVAVYFTKGQGALLDPGQRALYRDVMQENYETVTSLGDDTKSENEEGNPQQKCPEQVELQGTFLRRAEENFSQCLEQRRAWSNWRRSERKLGT

SEQ ID NO: 32684 - protein, 90 aa, Chelonia mydas
VTFEEVAVYFTQGQGALLDPAQRALYRDVMQENYETVTLPAGDGMENDKKEENLQREGPEQVASQGTLSERSKGNFPQSGEQGKIWEKQH

SEQ ID NO: 32685 - protein, 92 aa, Chelonia mydas
KLAHERAVELQAKAAEGQERGKVNLPRDAAISVSGQVLSVAGNEHPISMQRQPPHCRHEVGFPVSKPDVISCLERGEEPWVPDLRDSEERET

SEQ ID NO: 32686 - protein, 88 aa, Chelonia mydas
VTFEEVAIYFTQGQGALLDPAQRALYRDVMQENYEMVTSPAGGAVQRLDLRILQLFGAKIRQRVLALQKLQAMCLWLLRVQAKQRLGM

SEQ ID NO: 32687 - protein, 95 aa, Chelonia mydas
VTFEEVAVYFSEEEWALLDVGQRALYRDVMQENYETVTSLAGDGMVNEEENPQKESPKRVEPQGMVSGRSDVSQSPEQGEACEIQHRPERKQGNY

SEQ ID NO: 32688 - protein, 90 aa, Capra hircus
VTFSDVAIDFSQEEWACLDSRQRDLYWDVMLENYSNLVSLDLESPYETKSLPSQKNSYGMNFSKRTSNRKSKSRGLGWTCEGELDRSRAP

SEQ ID NO: 32689 - protein, 94 aa, Chrysochloris asiatica
VIFEDVAVEFTQEEWALLDFSQRKLYRDVMIETFRNLDSVFKQDSDGQAFSLKNDCRSSGLGEMFAVCGSDCHQTDQGRHGRVPTVENLYETKV

SEQ ID NO: 32690 - protein, 88 aa, Mandrillus leucophaeus
VTFEDVTLGFTPEEWGLLDLKQKSLYREVMLENYRNLVSVEYSQLQLDPKLDPLPAESPLMNIEVVEVLTLNQEVAGPRNAQIQALYA

SEQ ID NO: 32691 - protein, 96 aa, Sus scrofa
VTFEDVAVHLTREEWGCLDPVQRDLYREVMLENYGNLVSLGILLRLPTTRIHSVNSCPALSHTQASAFSGETLAVLSAGISKRWPKYRLPIDSARP

SEQ ID NO: 32692 - protein, 90 aa, Neophocaena asiaeorientalis
VTFEDVAVYFSREEWGILNLTQRSLYRDVMLENFALIGSLGFLCRLRDEEAPPEQVKSHRVLSENPFLCRVSGKDIPATLGFLQPQATHR

SEQ ID NO: 32693 - protein, 84 aa, Nomascus leucogenys
VTFRDVTVIFTEAEWKRLSPEQRNLYKEVMLENYRNILSLDRVSLLLPRLECNGAISAHHNLCLLGSSDSPASASRVAGITAEP

SEQ ID NO: 32694 - protein, 88 aa, Bos indicus
VTFEDVALGFTPDEWGKLDLEQKSLYREVMLENYRNLVSVECPEAQLEPQLDPFPAGNPLMNIEVVEVLTLNQEVAVPRNAQIRALYA

SEQ ID NO: 32695 - protein, 87 aa, Sus scrofa
VTFEDVALYLSREEWGRLDHTQQSFYRDVLQQRNGLSLAGCPFSRPVWASPAQGKGEAPSSSRLMGEEEKRESPWVPRASLSLAGNP

SEQ ID NO: 32696 - protein, 87 aa, Mandrillus leucophaeus
VAFEEVAVNFTQEEWALLDSSQKNLYREVMQETCRNLASVGNKWKDQNIEDHFEKPGKDIRNDMVQRLCESKEGSQCGEVVSQIPNL

SEQ ID NO: 32697 - protein, 87 aa, Neophocaena asiaeorientalis
VAIEDVAVNFTLEEWALLNPSQKKLYRDVMWETFRNLASVGKKWEDHDIEDQYKNQGRKLRSHVVERLCESKEGSQCAGNFSLIPKL

SEQ ID NO: 32698 - protein, 92 aa, Bos mutus
MDDWQRADKRPMLRESTQEIRKMTTELLKAKKECQYQECIKNLGAFPKDRPASIDLFLLSYILFSKLELICQLEQGEEPWIKERQRSLGLCP

SEQ ID NO: 32699 - protein, 104 aa, Nomascus leucogenys
VTFEDVSVDFSQEEWELLEPAQKNLYREVMLENYRNVISLEALKNQCTDVGIKEGLLSPAQTSQVTSLSSWTGYLRFEPVASSHLEQREALWMEEKGTPQASCS

SEQ ID NO: 32700 - protein, 92 aa, Nomascus leucogenys
MVFEDVAIYFSQEEWEILNDAQRHLHSNVMLENLALLSSVGCWHGAKDEEVPSKQCVSVRVLQVTTPKPALSTLKAQPCKICSSLLKDILHL

SEQ ID NO: 32701 - protein, 84 aa, Chrysochloris asiatica
MTFEDLAVHFSKEEWACLDPVQRALYRDVMLETFGNLLVLGTKRLPHQERCSSRLPSTPTSIPGRGSGRCPTLQSPTCGRRSRR

SEQ ID NO: 32702 - protein, 87 aa, Suricata suricatta
WSLLDEAQRRLYYDVMLENFTLVWNLCFHRNDAVCKEFVPGSGHLQQEATHSGQTPVTVSQRRATSQSSKGRSTWGPRRAACGPGDT

SEQ ID NO: 32703 - protein, 86 aa, Suricata suricatta
VTFKDVAVAFTEEELGLLDSAQRKLYQDVMLENFRNLVSVGHQPLKQDKWHLEREEKRSLMKTATQLERNVGGWRQITSLLADTRY

SEQ ID NO: 32704 - protein, 97 aa, Mandrillus leucophaeus
VTFEDVAVDFTQEEWTLLDQTQRNLYRDVMLENYKNLVAVDWESHINTKWSAPQQNFLQGKTSNVVEMVRFRRYNLLPSMLEEDWKLRKMEKPHSNL

SEQ ID NO: 32705 - protein, 87 aa, Mandrillus leucophaeus
VAFEDVDVNFTQEEWALLDPSQKNLYRDVMWETMRNLASIGKKWKDKNIKDHYKHRRRNLRSHMLERFYQSKDGSQRGGIFSQFANQ

SEQ ID NO: 32706 - protein, 84 aa, Nomascus leucogenys
LAFRDVALEFSPEEWECLDPAQRSLYRDVMLENYRNLFSLGEDNFNMQFLFHSLAVSKPELIMCLEARKEPWNVNTERTAKHSA

SEQ ID NO: 32707 - protein, 104 aa, Capra hircus
VTFKDVAVDFSMEEWELLDPGQRKLYRDVMLETCGNLASVEALRNQRPNSGFEDGTIFLASASQVTTFSLWTTYSLFQPVVSLHLEQGEAMWMVGKGTLRASCS

SEQ ID NO: 32708 - protein, 84 aa, Chrysochloris asiatica
LVIEDVAVVFSPEEWALLDLTQRKLYRDVMMETFRNLAAVGIVVSSVERTYSGFPMNKKLSHTCKVCGKDFICISTLKTPVTTL

SEQ ID NO: 32709 - protein, 83 aa, Chrysochloris asiatica
VIIDDVAVVFTHEEWDLLDPVQRKLYRDAMMETLRNLDSVGKITESHGWKHHLDNHRKHLRTRSIDNFCECSEGSQCGETSIP

SEQ ID NO: 32710 - protein, 86 aa, Suricata suricatta
LTFQDVALEFSQEEWECLNHSQRELYADVILETYGHLLFLAVSSPCTQSFLPTSCLELSPQKVSIGEQSTRENFYLLIDPVSNGES

SEQ ID NO: 32711 - protein, 114 aa, Mandrillus leucophaeus
VTFEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPYTSAASGKW

SEQ ID NO: 32712 - protein, 84 aa, Nomascus leucogenys
VTFEDVAIYFSQEEWGLLDEAQRLLYRDVMLENFALITALVCWHGIEDEETPEQSVSVEGVPQVMTPEASPSTQKTQSCDMCVP

SEQ ID NO: 32713 - protein, 82 aa, Canis lupus
LSFEDLFVDFTQKEWQLLDARQKDLYKDVMLENYSSLVSLEQVLQVNGHMTWHQDNQEKLRNMKQDDECDAFGKKFNLSMNL

SEQ ID NO: 32714 - protein, 92 aa, Suricata suricatta
LTFGDVAIEFCEEEWGCLNRSQRELYRDVMLENYGHLLFLGEMTPPDFPDHTRNLGKAIIMIPGSNPTRFQRTQCPEIQYKSNKCGNVSYES

SEQ ID NO: 32715 - protein, 83 aa, Chrysochloris asiatica
LVFEDVAVDFTQEEWALLDFPQRKLYRDVMVETFQYLDSEQRYKCKECGKAFSQASSLTKHIRCHSGEKPYECKECGKAFSLS

SEQ ID NO: 32716 - protein, 82 aa, Mandrillus leucophaeus
VTLEDVAVEFIQEWALLDSARRSLCRYGMLDQCRTLTSRGAGAVPEDAAGALYRSEGDTIDSRGPASSPGAALVSGMHGTEG

SEQ ID NO: 32717 - protein, 96 aa, Mandrillus leucophaeus
VTFEDVAVHLTREEWGYLDPVQRDLYREVMLENYGNVVSLGILLRLPTTRIHSVNSCPALSHTQASAFSGETLAILTAGISKRWPKYRLPIDIARP

SEQ ID NO: 32718 - protein, 87 aa, Mandrillus leucophaeus
VSFKDVAVDFTQEEWGQLDSPQRALYRDVMLENYQNLLALEWQLKAVPSQQQGICKEEPAQEPITERPLGGAQAWGRQAGALRRSQA

SEQ ID NO: 32719 - protein, 113 aa, Mandrillus leucophaeus
VTFEDVAVYFTQNEWASLHPMQRALYREVMLENYANVTSLYPTAGGFPLSTERTEKVPGALPSFLPSSSSLEVILALLPMSAFPFSKPDLIFQLEQGEAAWGPDPWTLAGGEA

SEQ ID NO: 32720 - protein, 101 aa, Sus scrofa
VVFEDVAVDFTLEEWALLDSAQRELYREVMLENFRNLASVDDETQFKAIGSVSQQDVYGNKISRKHNIPKFTGNDSWASVLGKIWEELNLEDQHTNQRRHP

SEQ ID NO: 32721 - protein, 87 aa, Sus scrofa
GTWHDVAIDFSPEEWECLDLGQRHLYRDVMLEICRHLVSLALSSHDTQGLMPPNPGMELFLPTMLLGKYESSAVGTFDLIRGSEGKG

SEQ ID NO: 32722 - protein, 89 aa, Neophocaena asiaeorientalis
VMFEEVSVCFTSEEWACLGPIQRALYWDVMLENYGNVTSLEWETMTENEEVTSKSSLSQRADSQKGASKRLQGNVPQVLDFEEEYEWQV

SEQ ID NO: 32723 - protein, 87 aa, Nomascus leucogenys
LQFRDVAIEFSLEEWHCLDTAQRDLYRDVMLENYRHLVFLVMCSHFAQDLWSEQSIKDSFQKVILRRYEKCRHDNLHLKKGCESVDE

SEQ ID NO: 32724 - protein, 90 aa, Suricata suricatta
VTFSDVAIDFSQEEWACLDSTQRDLYWEVMLENYSNLVSLDLESPYGTKSLPTEKGIYEINLSRWAANGKSKSRGLGWVFGGEPRRRQGP

SEQ ID NO: 32725 - protein, 99 aa, Mandrillus leucophaeus
VSFEDVAVAFTQEEWALLDPSQKNLYRDVMQEIFRNLASVGNKSEDQNIQDDFKNPGRNLSSRVVERLFEIKEGSQYGETFSQDSNWNLNKKVSAGVKP

SEQ ID NO: 32726 - protein, 110 aa, Mandrillus leucophaeus
VTFEDVAVNFTQEEWNLLSEAQRCLYRDVMLENLALISSLGCWCGVEDEEAPSKQSIYIQRETQVRIPMAGVSLKKAHPCEMCGPILGDILHMGDHQGTHPRQKLHSCEA

SEQ ID NO: 32727 - protein, 104 aa, Sus scrofa
LTLEDVAVDFTWEEWQLLTPAQKDLFRDVMLENYRNLVAVGCQASELAVLSVVDLGGQPRAMGNDIRYWSHSGDQVSQPDTLSRWEGGEELGPVEDAVSCGICP

SEQ ID NO: 32728 - protein, 92 aa, Sus scrofa
VTVKDVTLAFTKKEWEQLDATQRSLYKDVMLENYSNLASTEEVQQDDDQLENHQESPNKLLGEVAFKKKNLTKKKGHECSSLEKKNMSTKHV

SEQ ID NO: 32729 - protein, 83 aa, Sus scrofa
LTFEDVAIDFSPEEWECLDLGQRHLYRDVMLEICRHLVSLGEDPFLPEFLFSHWVWDPAFAECLLPFSCPYNRFSDPTILGVT

SEQ ID NO: 32730 - protein, 83 aa, Nomascus leucogenys
FTFKDVAVEFSQEEWECLDPAQRALYRDVMLENYRNLLSLDEDNIPPENDISVGFTSKGLSPKENNKEELYHLVILERKESHG

SEQ ID NO: 32731 - protein, 89 aa, Chrysochloris asiatica
VAFEDVAVDFTPEEWMLLDPSQRTLYREVMMETYRNLASLEKGPIGDLSEDVCFVFCFSTFSMYYSLVGISPALDLWCPKDALHSRLFL

SEQ ID NO: 32732 - protein, 104 aa, Sus scrofa
LSFRDVAVDFTWEEWQLLTPAQKDLFRDVTLENYRNLVAVGCQASELAVLSVVDLGGQPRAMGNDIRYWSHSGDQVSQPDTLSRWEGGEELGPVEDAVSCGICP

SEQ ID NO: 32733 - protein, 91 aa, Mandrillus leucophaeus
LAFRDVALEFSPEEWECLDPAQRNLYRDVMLENYRILFSLGEDHFNMQFVFHHKDFIFFRLAMSKPELIIYLEARKEPWNVNTEKTAKHSA

SEQ ID NO: 32734 - protein, 86 aa, Sus scrofa
MGNDLPLLQRLGDIAQALPLESLGPVVGNCSRATSYTFRDFSIFPRPAKYEEILWYCIPKPELIFRLEQGEQPWILEEESPSQSYP

SEQ ID NO: 32735 - protein, 84 aa, Sus scrofa
VVFEDVAVNFTLEEWALLAPSEKKLYRYVMQETFRNLASIGKHDNFLHFVSSKMSFSCPSMLFQYVECGKGRIPCGRNLSLIPS

SEQ ID NO: 32736 - protein, 82 aa, Bos mutus
LTFRDVFVDFTQEEWQQLDAAQKNLHRDVMLENYSHLVSVEKEANERNKAIINQRKLKVLQKRRLAEDTGSVPELGRSPEEG

SEQ ID NO: 32737 - protein, 87 aa, Neophocaena asiaeorientalis
VTFEDVSVKFTTEEWALLDLSQKKLYRDVMQETFKNLTSIGEKWEDPDTEDQYENHGTNLSSHMVERLCKNNEGSQYGETFSQISNH

SEQ ID NO: 32738 - protein, 114 aa, Nomascus leucogenys
VTFEDIAVYFSQEEWGLLDEAQRCLYHDVMLENFSLMASVGCLHGIEAEEAPSEQTVSAQGASQARTPKLGPSIPNAHSCEMCILVMKDILYLTEHQGTIPWQKPYTSVASGKW

SEQ ID NO: 32739 - protein, 87 aa, Nomascus leucogenys
VAFEDVAVNFTQEEWALLDPSQKNLYREVMQETVRNLASIGKKWNNQYIEDEHQNPRKNLRRLIGERLSESKESHQHGEVLTQVPDD

SEQ ID NO: 32740 - protein, 82 aa, Nomascus leucogenys
VTFEDVAVEFIQEWALLDSARRSLCRYRMLDQCRTLASRGTGAVPEDAAGTLHRREGDTIDSRGPASSPGAALVSGMHGTEG

SEQ ID NO: 32741 - protein, 93 aa, Bos indicus
VSFEDVAVGFSQEEWQILGPSQKALYWDVMLENYCNLVSVVLVDHPGSNAQHRPSRDFPFTGYQAPTPNSLFQLEQGGPPWTVEGAALSPTCS

SEQ ID NO: 32742 - protein, 87 aa, Pteropus vampyrus
VTFEDVSVNFSLEEWSLLDPSQKKLYRDVMQETFRNLASVGKKREDHDIDDQYKNQERICRSHRVERLCEGKEDSQCGENFSLILKK

SEQ ID NO: 32743 - protein, 90 aa, Trichechus manatus
LTFSDVTIDFSQEEWECLNSDQRNLYRDVMLENYTNFISLGSSPVYHIAFSRHVSLVSSNTVVPSYPRSRFPRFQLPAVNRRPKILNGKF

SEQ ID NO: 32744 - protein, 92 aa, Chlorocebus sabaeus
MVFEDVAIYFSREEWGILNDAQRHLHSNVMLENLALLSSVGCWYGAKDEEVLSKQCVSVRVLQVTAPKPALSTLKAQPCKTCSSLLKDVLQL

SEQ ID NO: 32745 - protein, 110 aa, Sus scrofa
VTFEDVAVYFSWEEWCLLDEVQIHLYLDVMLENLALVSMLGPWREVENEGTHPEQNVSGEGVLHMRTPRAGLSPEKAQPCKMYVPGLRDSFYLGEQQGAHKEQKEYTCGP

SEQ ID NO: 32746 - protein, 85 aa, Neophocaena asiaeorientalis
VTFEDVFVYFSREEWELLEEAQRLLYRDVMLENFALVASLGCWCEADNEEAPSEQSVFVEGVSEVRTPESCPFIQKAHPCEICDP

SEQ ID NO: 32747 - protein, 82 aa, Trichechus manatus
VTFEDVTVVFTEGEWKRLSSEQKHLYKEVMLEIYRNLLSLAEPKPELHPCSSCLLAVSCQRFLSQHVLPIFPGFCAEHHFHP

SEQ ID NO: 32748 - protein, 95 aa, Chrysochloris asiatica
VTFKDVAVVFTEEELGLLDPAQKKLYQDVMAENFRNLVSVGGKIPRQMETFPQAGAHEELSCSPVWQQIPSNSIRCQDSMINWSQFYKQDDSPSS

SEQ ID NO: 32749 - protein, 88 aa, Sus scrofa
VTLEDVAVYFTVEEWELLDPAQKRLYRGVMLEICGNLASVDWKTRLKSQESIYRKDVFGEEPPGTVNIIKLPREDWGDAQLEEKHEEP

SEQ ID NO: 32750 - protein, 85 aa, Bos indicus
VTFEDVAVLFTRDEWRKLAPPQRNLYQDVMLENYNNLVSLGWKNSYKTTKSTQTQDRSFQELIMKRSKRSGPWDFKSEKPCRYEG

SEQ ID NO: 32751 - protein, 85 aa, Bos indicus
VTFEDVAIYFSQEEWGLLDEVQRHLYCKVMLENFALTASMVCLHETQTKETPSEQNVSLEALSQVRTPKVGPFTENAHPCEKCVP

SEQ ID NO: 32752 - protein, 89 aa, Canis lupus
VNFKIVTVDFTQKEEGTLNPAQRILDRDVILENHRDLVSWDLTTSLGRRASTSKQNIFNDEPSHGVKLERLTRDDPWLSSCQVQDCRDQ

SEQ ID NO: 32753 - protein, 82 aa, Equus caballus
VTFEDVAVVFTEEELGLLDATQRQLYRDVMLENFRNLLSVGDKNLNDMETLQEVGSRSLPHEELFHSQIWHQVMKELTRCRD

SEQ ID NO: 32754 - protein, 91 aa, Sus scrofa
VTFDDVAVYFSREEWGLLDSTQRGLYHDVMLENFTLVGSLGCLCRLQDKEAPPQQRKSCRVLLPEKPVLCRASGKAISATLSFLQPQTTHR

SEQ ID NO: 32755 - protein, 102 aa, Mandrillus leucophaeus
VTFEDVAVVFTDEEWSHLVPIQRDLYKEVMLENYNSIVSLETKPEIHDASDEKSEGSLRECLGRQSPLCPKFEVYAPDGRMGTEKQSPSGETRKKSLSREKG

SEQ ID NO: 32756 - protein, 87 aa, Canis lupus
VAFEDVTVNFTLEEWALLNPSQKKLYRDVMQETFRNLASIGRDDIILTYLINQKSSITHSLINAVIRGDRWKGHMSVNKSAMMTKQN

SEQ ID NO: 32757 - protein, 95 aa, Chrysochloris asiatica
VTFEDVTVVFTEAEWKRLSSEQKNLYKDVILEIYRILLSLEKSHVCSECGRGFNRKSNLLVHQRTHTGKKPHVCGECGRSFDWKLNLLQHQRTHS

SEQ ID NO: 32758 - protein, 94 aa, Mandrillus leucophaeus
VAFEDVAVNFTQEEWALLGPSQKSLYRNVMQETIRNLDCIETKWEDQNIGDQCQNPRRNLRSHTCEIKDDSQCGETFGQIPDSIVNKNTPQVNP

SEQ ID NO: 32759 - protein, 83 aa, Mandrillus leucophaeus
VAFEDVAVNFTQEEWSLLDPSQKNLYREVMQETLRNLASIGEKWKDENIEDQYKNPRNNLRSLLGERVDENTEENHFGEIFSQ

SEQ ID NO: 32760 - protein, 87 aa, Mandrillus leucophaeus
VSFEDVAVNFTLEEWALLDSSQKKLYEDVMQETFKNLVCLGKKWEDQDIEDDHRNQGRNRRGHMVERLCESRKGSKCGETTSQMPNV

SEQ ID NO: 32761 - protein, 96 aa, Mandrillus leucophaeus
VTFQDVAVDFTAEEWQLLDCTERTLYWDVMLENYRNLISVESDCPLVDEPRKHRESKDNFLKSVLLTFNKILTMERIHHYSMSTSLNPMRKKSCKS

SEQ ID NO: 32762 - protein, 85 aa, Sus scrofa
VTFEDVFVYFSREEWELLEEAQRLLYRDVMLENFALVSSLGCWCEADYEEAPSEQSTFVEGVSQVRTPKAFPFIQKAHPCEICDP

SEQ ID NO: 32763 - protein, 84 aa, Nomascus leucogenys
VTFEDVAVYFSWKEWGLLDEAQKCLYHDVMLENLALTTSLGGCGAGDEEAPYQQSTSPQRVSQVRIPNTLPYPQKTNPCEICGP

SEQ ID NO: 32764 - protein, 87 aa, Nomascus leucogenys
VAFEDVSVSFSQEEWALLAPSQKKLYRDVMQETFKNLASIGEKWEDPSVEDQHKNQGRNLRSHMGERLCEGKEGSQCAETFSPNLSV

SEQ ID NO: 32765 - protein, 89 aa, Chrysochloris asiatica
VAIEDVTVSFTQEEWALLDLTQKKLYRDVMMETLRNLASVGTPRGERSYDCKQCGRVFSQSSHLIRHTRIHTGEKPYECPECGKSFSQS

SEQ ID NO: 32766 - protein, 111 aa, Neophocaena asiaeorientalis
LAFEDVAVNFTLEEWVLLDSSQRKLYRDVMWENFQNLVSVETKQEDHDIEDQYKNQGRKLRSSMVERLYESKGSSFCGENFTLIPTLNLKKKTPGLKPWECSASAKVFMHH

SEQ ID NO: 32767 - protein, 87 aa, Bos mutus
LTFKDVAVEFSQEEWECLDPAQRAFYMDVMVETLRNLISVGKKPIKNRLVLSFQDELHIFKKNIYKCHECGKFFNYGSSLSRHLLIH

SEQ ID NO: 32768 - protein, 83 aa, Nomascus leucogenys
VAFEDVAVNFTQEEWTLLDISQRKLYREVMLETFRNLTSIGKKWKDQNIEYEYQNPRRNFRSIIEGNVNEIKEDRHCGETFTQ

SEQ ID NO: 32769 - protein, 83 aa, Nomascus leucogenys
VAFKDVAVNFTQEEWALLDISQRKLYREVMLETFGNLASIGKSWKDKNIEYEYQNPRRNFRRLIEKKVNEIKEDSHCGETFTP

SEQ ID NO: 32770 - protein, 114 aa, Chlorocebus sabaeus
VTFEDIAVYFSQEEWGLLDEAQRCLYHDVMLENFSLVASVGCLHGIETEEAPSEHTISAQGVSQARTPKPGPSIPNAHSCEMCILVMKDILYLTEHQGTLPWQKPYTSAASGKW

SEQ ID NO: 32771 - protein, 84 aa, Sus scrofa
LTLEEVAIEFSQEEWACLDPAQRALYRDVMLETYRNLLSLGEDVLLQKLGSALGYLFIFLILNPLRPEIEPATSWFLVWFVSTA

SEQ ID NO: 32772 - protein, 82 aa, Bos mutus
VTYKDVAVNFTQEEWSLLDKSRKNLFRNVMLETVTHLVSVGESVNRDVPAPVSILFNHSLNKHLEQLPCVPLWLLPDSLIVL

SEQ ID NO: 32773 - protein, 87 aa, Sus scrofa
VTIDDVAVNFTLEEWALLHPSQRKLYRDVMQETFRNLSLIGTKWKDHDIEDQYKNPGRKLRSAMVKRLPESKDSSSCGKNFNLIPTL

SEQ ID NO: 32774 - protein, 121 aa, Bos mutus
VTFEDVAVYFTQNQWASLDSAQRALYREVMLENYANVASLEPLCGSLVPQAVPFSPPNSTRLPWGGQRDLSNSSGCLPSTCLSLSLVGVVSPFPRPDLISQLERGEAPWDPDPWEAEDLRG

SEQ ID NO: 32775 - protein, 82 aa, Nomascus leucogenys
VAFEDVAVSFTQEEWALLDPSQKNLYRDVMQETFKNLTSVGKTWKVQSIEEYKNPRRNLSLALSQAGVQWCGFSSLQLPLLG

SEQ ID NO: 32776 - protein, 84 aa, Muntiacus muntjak
VTFEDVAVLFTRDEWRKLAPSQRNLYQDVMLENYSNLVSLECNSSKTTKATQTQDSSFSGLIRKTLKKDEPWNFISENPCMYED

SEQ ID NO: 32777 - protein, 83 aa, Bos indicus
FTFKDVAIEFSQEEWECLAPSQRALYRDVMLETYRNLVSLGDDNFSPEDYLIGILSAGFAINKLSPRENINLVELYGDENHGI

SEQ ID NO: 32778 - protein, 87 aa, Canis lupus
VTFRDVAIEFSQEEWKCLEPAQRDLYKDVTLENFSNLVSLELESRCEKFPQKDISEVESFNWEIVESLKRCDFDGSGLRDDWEYKGQ

SEQ ID NO: 32779 - protein, 97 aa, Muntiacus muntjak
VVFEDVTVNFTLEEWALLDFSQRKLCRDVMGETFRNLALVGTTWEDRDIDDQYRNQGRQLRVRPWGHKVCGKDLMLHSSHNRSTKSHTGHKPYEYQA

SEQ ID NO: 32780 - protein, 94 aa, Mandrillus leucophaeus
MVFEDVAIHFSQEEWGILNGVQRHLHSDVMLENFALLSSVGCWHGAKDEEAPSKQCVSVGVSQVTTLKPALCTQKAQPCETCSSLLKDILHLAE

SEQ ID NO: 32781 - protein, 126 aa, Sus scrofa
MLENYSHLVSVGEGSLLSDLLMYPGFISNLSTLNLMRQMCYLGYQAGHLVFNSTWVLILVQHLCCVACKAALPSHDRSGSPAARFRFSLLFLLTGCHIIKPEVITKLEQGEDPWIVEGEFLLQTYP

SEQ ID NO: 32782 - protein, 90 aa, Neophocaena asiaeorientalis
VVFEDVAVDFNLEEWALLDSAQRELYRDVMLENFRNLASVEDETQLKANGSVSQQDIYGNKISKEHKISKFTGNDSLASVLGKIWEELSL

SEQ ID NO: 32783 - protein, 87 aa, Neophocaena asiaeorientalis
VTFKDVAVVFTEEELGLLDSAQKKLYQEVMLENFQNLVSVGEEGHSGTEHRISPCGHQSFTPDVISQLKREEKLWMIKIATQSRRSV

SEQ ID NO: 32784 - protein, 87 aa, Nomascus leucogenys
VSFEDVAVAFTQEEWALLDHSQKNLYRDVMQEIFRNLASVGNKSEDQNIQDDFKNPGRNLSSHVVERLFEIKEGSQYGETFSQDSNL

SEQ ID NO: 32785 - protein, 89 aa, Chrysochloris asiatica
VRYADVAVEFTQEEWSLLNFSQRKLYRDVMLEILSYLDSVFENLFLMIVSVSQQGNNGQKVCSELKLAKLMNNDAWWFTSGEICEFHGS

SEQ ID NO: 32786 - protein, 83 aa, Mandrillus leucophaeus
VAFEDVAVNFSQEEWALLDSSQKNLCREVMQETCRNLASVEIIWYRDCVKAKKVVSMDKLTFLLDENNVNAVFVEKSLYVIPS

SEQ ID NO: 32787 - protein, 101 aa, Neophocaena asiaeorientalis
VIFEDVAVSFSQEEWGLLNDAQRLLYCDVMLENLSLIASLGCWSALGTEEAASEQCVSVEQVTQDRNPNPDLSILKTLTSDMGALVEKYVLYLAEHQGVHP

SEQ ID NO: 32788 - protein, 87 aa, Nomascus leucogenys
LSFEDVAVAFTQEEWALLDHSQKNLYRDVMQEIFRNLASVGNKSEDQNIQDDFKNPGRNLSSHVVERLFEIKEGSQYGETFSQDSNL

SEQ ID NO: 32789 - protein, 87 aa, Neophocaena asiaeorientalis
VTFEDVAVSFTLEEWALLDPSQKKLYRDVMRETLRNLASVGEKWEDHDIEDQYKNQGRKLRSHVVERLCESKEGSQCGENFSLIPNL

SEQ ID NO: 32790 - protein, 86 aa, Bos indicus
LSFRDVTVGFTQEEWQHLDPAQRMLYRDVMLENYSHLISVELINNSRKKFDFNKGRKWSHDDKHERIHYGEKSYEYNKNENGLCLN

SEQ ID NO: 32791 - protein, 88 aa, Muntiacus muntjak
VTFEDVALGFTPDEWGKLDLEQKSLYREVMLENYRNLVSVEYPEAQLEPQLDPFPAGNRLMKIEVVEVLTLNQEMAVPRNAQIRALYA

SEQ ID NO: 32792 - protein, 83 aa, Mandrillus leucophaeus
VAFEDVAVNFTQEEWALLDPSQKNLYRDVMQETFRNLASIGNKGKDQSIEDQYKNSSRNLRHIISHSNNPYGCEGCRKKPYTC

SEQ ID NO: 32793 - protein, 83 aa, Sus scrofa
WALLDPAQRKLYRDVILENCRNLAYVDWVTQCKSKGSIPQWNILARETFHEANRACLASSSSQLSALGEDWTWHQKEVPGKQR

SEQ ID NO: 32794 - protein, 86 aa, Sus scrofa
VTFEDVALYLSREEWGRLDHTQQSFYRDVLQQRNGLSLGCPFSRPVWASPAQGKGEAPSSSRLMGEEEKRESPWVPRASLSLAGNP

SEQ ID NO: 32795 - protein, 104 aa, Sus scrofa
VTLEDVAVYFTVEEWELLDPAQKRLYRGVMLEICGNLASVEALRNSSPEIGIEDGTISSAQASQVTSLSPWTAYSLFRPVVSSHLEQGEAMWTMGKETLQASCS

SEQ ID NO: 32796 - protein, 90 aa, Neophocaena asiaeorientalis
VTFSDVAIDFSQEEWACLDSTQRDLYWDVMLENYSNLVSLDLESPYETKSLPTQKGTYEINFSKQNSNRKSKSLGLDWMCEGEFEGPQAP

SEQ ID NO: 32797 - protein, 88 aa, Neophocaena asiaeorientalis
VAFEDVAVNFTLEEWALLGPSQKKLYRDVMRETLRNLASIGEKWEDRNTEDQYKNQGINLRSHTLRRCCESEEGSQCGENISLIPNLN

SEQ ID NO: 32798 - protein, 84 aa, Neophocaena asiaeorientalis
VTFPDVAVRFSWGEWKLLDEAQRRLYLSVTLDIYALISSLGCCCGAEGEETPCEETVPVGVSQAGSPKAAPFSQKTHPCEMCGP

SEQ ID NO: 32799 - protein, 92 aa, Neophocaena asiaeorientalis
VTFEDVAVYFSQEEWRLLDEAQRLLYRDVILETFALVASLDSDHISITASLSAVLWVPRLRLAFSRSHVVFQLELGDEPWVHDRVDMTPGCW

SEQ ID NO: 32800 - protein, 91 aa, Bos indicus
VTFEDVAVYFSQEEWRILDETQRRLYSYVMLETFALVASLGCWQRAEMKEKTSEQNASVEVPQIITSKTDLSIQKAYPWEMGNADVEGGLH

SEQ ID NO: 32801 - protein, 89 aa, Bos indicus
VMFEEVSVCFTSEEWACLSPVQRALYWDVMLENYGNVTSLEWETMTENEEVTSKLNISQRADSQRGISKRFQGGVPYLLDFEEECEWQI

SEQ ID NO: 32802 - protein, 91 aa, Neophocaena asiaeorientalis
VTFEDVLVYFSREEWELLEEVQRLLYRDVMLENFALVASLGCWCEADNEAPSEQSIFVGVSEVRTPESCPFIQKAHPCEICDPLLKDILHL

SEQ ID NO: 32803 - protein, 100 aa, Sus scrofa
VKFADVAVYFSPEEWAYLRPAQKALYRDVMRETYGLLGALGSRDQEEKRQREETEALGKIFSVDAQPPGLTALKPLSAGFSGGWEQPSKMPRRGRPPLCA

SEQ ID NO: 32804 - protein, 88 aa, Nomascus leucogenys
LTFRDVKIEFSLEEWQCLDTAQRNLYRDVMLENYRNLVFLVMCSHFAQDVWPEQSIKDSFQKVILRTYGKYGHENLQLRKDHKSVDAC

SEQ ID NO: 32805 - protein, 96 aa, Canis lupus
VTFEDVAVHLTREEWGCLDPVQRDLYREVMLENYGNVVSLGILLRLPTTRIHSVNSCPALSHTQASAFSGETLAVLSAGISKRWPRYRLPIDIARP

SEQ ID NO: 32806 - protein, 87 aa, Nomascus leucogenys
VSFKDVAVDFTQEEWGQLDSPQRALYRDVMLENYQNLLALEWELKAVPSQQQGICKEEAAQEPIMERPLGGAQAWGRQAGALQRSQA

SEQ ID NO: 32807 - protein, 82 aa, Nomascus leucogenys
LTFMDVAIEFSQEEWKSLDPGQRALYRDVMLENYRNLVSLGRSCILGSNAENKPIKNQLGLTLESHLSEFQLFQAGRKIYRS

SEQ ID NO: 32808 - protein, 90 aa, Muntiacus muntjak
VTFKDVAVAFTEEELGLLDSAQRKLYQDVMVENFWNLVSVDTKHIEKEERLWMMNSLSPVHISQFSVVIDENNQSELRAVQERGLHEELS

SEQ ID NO: 32809 - protein, 87 aa, Muntiacus muntjak
VNFKIVTVDFTQEEEGTLSSAQRTLDRDVILENHRDSWDLATALGRRESRLKQSIFDDKLSPSVKIEKLTRDDPWLSSCEEFQDCKE

SEQ ID NO: 32810 - protein, 90 aa, Muntiacus muntjak
LTFKDVFIDFTPEEWECLDPAQRTLYKDVMMETLRNLLSLGMSHTHISQKLPTKASSDKGEVFHTVMLGRPESHKITYFFLREVQEHLHE

SEQ ID NO: 32811 - protein, 97 aa, Bos mutus
VTFEDVAVNFTWEEWALLDSAQRQLYRDVTLETCGHLACVDWATRHQTKDSTPRQNSLAKRTFQGVNRACLASSGSRLSDFREDWMSHRIEEPGKQR

SEQ ID NO: 32812 - protein, 82 aa, Bos mutus
VTFEDVTVIFTWEEWKFLDSSQKKLYREVMWENYTNVMLVVFKMISMQPITFFFISNSTCSHLTTGLSAYILGNWKESCKLQ

SEQ ID NO: 32813 - protein, 85 aa, Nomascus leucogenys
LSFRDVAIEFSQEEWKCLDPGQKALYKDVMLENYRNLVSLCEENVPPEACLCSGICLPDLSVISMLEQKKDPWTLQSEVKIAKNP

SEQ ID NO: 32814 - protein, 87 aa, Nomascus leucogenys
VAFEDVAVNFTQEEWALLNSSQKNLYREVMQETCRNLASVGSKWKDQNIEDHFEKPGKNIRKHMVQKLCESKEGSQYGEVVSQIPNL

SEQ ID NO: 32815 - protein, 83 aa, Muntiacus muntjak
MTFKDVAVNFTQEEWALLDAAQRQLYRDVILGTCGHLACSIPRQNNLAKRRFQEVNRAHLVSSVAAAHEKDAFPIGFWEYPEM

SEQ ID NO: 32816 - protein, 94 aa, Neophocaena asiaeorientalis
VTFEDVSVKFTTEEWALLDLSQKKLYRDVMQETFKNLTSIGEKWEDPDTEDQYENHGTNLRHMTSRTTPKPREYQEYEEKPYKCKECGKAFKHR

SEQ ID NO: 32817 - protein, 145 aa, Neophocaena asiaeorientalis
ITFEDVAMDFTQEEWALLNSSQRKLYRDVMLENYRNLVSLGLSLLWPPVAEHRLWTRRNALLLLSLSEFCHFAAYKVTTAYLQNLREQSCCHSLMVVFVVYCMVLSYVSFPIIGHQLSKPPLITQMEQEDEMEIVERRIHQDTCS

SEQ ID NO: 32818 - protein, 82 aa, Muntiacus muntjak
LTFQDVAIDFTQKEWECLDLGQRELYRDVMLENYRNLASLDSKNSTCRNIFYQTSGLPLKKSTHIGEKTYNCEYSDISNQSS

SEQ ID NO: 32819 - protein, 85 aa, Sus scrofa
VTFGDVAVHFSREEWQCLDPGQRALYKEVMLENHSSVAGLDSMIGSNSQQACEDVDILKPDSRVTMVKLLPQDFPQSPCFGATSD

SEQ ID NO: 32820 - protein, 82 aa, Bos indicus
LVFEDVAVNFTQDEWVLLDSSQKKLYRDVMLENIRNLASVAAKQQDHDTEDLEKNPGKKLRSPMRGKLPENKDLSSFEENLI

SEQ ID NO: 32821 - protein, 90 aa, Canis lupus
VTFSDVAIDFSQEEWACLDSRQRDLYWDVMLENYSNLVSLDLESPYGTKSLPTEKGIYEINLSKWNSNGKSKSLGLDWMCEGEFEGPQGP

SEQ ID NO: 32822 - protein, 104 aa, Bos mutus
LTFEDVAVFFTQEEWDYLDPAQRSLYKDVMMENYGNLVSLGGHCCSVAKLCLTLQPCGLQHARLPCPSLSHRICSDSCPLNVLNRDKDEEPTVKQEIEEIEEEM

SEQ ID NO: 32823 - protein, 84 aa, Bos indicus
FTFKDVAIEFSQEEWECLAPSQRALYRDVMLETYRNLVSLGDDNFSPEGDYLIGILSAGFAINKLSPRENINLVELYGDENHGI

SEQ ID NO: 32824 - protein, 88 aa, Bos indicus
LSFKDVAVEFTWEEWQLLTPAQKTLYRDVMLENYSNLVSVAPAQFSGTKSSIISHKRYRVSKSDVLFKLEQGEERWMTEDEIHSHTWP

SEQ ID NO: 32825 - protein, 102 aa, Crocuta crocuta
LTLEDVAVDFSREEWRLLAPSQKDLYRDVMLENYRNLVSVGEDDSPVSQKVSSVGFGELWRVCAALQCRFSVPSLAPDLRVSCAFPERSLSLPSSKLQLHGP

SEQ ID NO: 32826 - protein, 87 aa, Mandrillus leucophaeus
VTFEDVAVTFTQEEWGQLDVTQRALYVEVMLETCGLLVALGDSTKPETVEPIPSHLALPEEVSLQEQLAQGVPGYSYFGQAMDQDGP

SEQ ID NO: 32827 - protein, 84 aa, Sus scrofa
VTFKDVAVVFTEEELGLLDLAQRKLYQEVMLENFRNLVSVGENGCPVTERQPPAVFMCPWMCRALELLNWFQFSHQHKIQRWHF

SEQ ID NO: 32828 - protein, 94 aa, Neophocaena asiaeorientalis
VTFEDIALYFSWEEWKLLDEAQRRLYHDVMLENFALISSLGGVSTSMALLCPRFCSFLSSDISFCLHMPGIEGCCCGAEDAEAPFQRSISISMS

SEQ ID NO: 32829 - protein, 87 aa, Nomascus leucogenys
VSFEDVAVNFTLEEWALLDSSQKKLYEDVMQETFKNLVCLGKKWEDQDIEDDHRNQGRNRRCHMVERLCESRKGSKCGETTSQMPNV

SEQ ID NO: 32830 - protein, 90 aa, Bos indicus
VTFSDVAIDFSQEEWACLDSRQRDLYWDVMLENYSNLVSLDLESPYETKSLPSQKNTYGMNFSKRTSNRKSKSRGLDWTCEGELDRSRAP

SEQ ID NO: 32831 - protein, 85 aa, Canis lupus
VTFEDVAVLFTRDEWRKLGPSQRHVYQEVMLENYSNLVSLGWKSSHKTTKSTQTQDSSFQELIMRRSKRHGPWDFKSEKSCIYED

SEQ ID NO: 32832 - protein, 85 aa, Muntiacus muntjak
VTFEDVFVYFSREEWELLEEPQRLLYRSVMLENFAHVAALGCWCEADNEEAPSEQSVCVEGVSEVRTPGSCPLIQKDHPCERSDP

SEQ ID NO: 32833 - protein, 104 aa, Gorilla gorilla
VTFEDVSVDFSQEEWELLEPAQKNLYREVMLENYRNVVSLEALKNQCTDVGIKEGPLSPAQTSQVTSLSSWTGYLLFQPVASSHLEQREALWMEEKGTPQASCS

SEQ ID NO: 32834 - protein, 87 aa, Nomascus leucogenys
VDFEDVAVNFTQEEWALLGPSQKNLYRYVMQETIRNLDCIRMIWEDQNTEDQYKNPRRSLRCHMVERFSESKDSSQYGETFSLIRDS

SEQ ID NO: 32835 - protein, 85 aa, Bos indicus
VTFEDVFVYFSREEWELLEEAQRLLYRDVMLENFAHVAALGCWCEADNEEAPSEQIVCVEGVSEVRTPGSCPLIQKVHPCERSDP

SEQ ID NO: 32836 - protein, 87 aa, Gorilla gorilla
VAFEDVAVNFSQEEWSLLSEVQRCLYHDVMLENWVLISSLGCWCGSEDEEAPSKKSISIQRVSQVSTPGAGVSPKKAHSCEMCGTIL

SEQ ID NO: 32837 - protein, 88 aa, Nomascus leucogenys
VIFEDVTLGFTPEEWGLLDLKQKSLYREVMLENYRNLVSVEYPELQLDPKLDPLPAESPLMNIEVVEVLTLNQEVAGPRNAQIQALYA

SEQ ID NO: 32838 - protein, 83 aa, Nomascus leucogenys
VAFKDVAVNFTQEEWALLDISQRKLYREVMLETFRNLTSIGKSWKDKNIEYEYQNPRRNFRSVIEEKVNEIKDDSHCGETFTP

SEQ ID NO: 32839 - protein, 84 aa, Nomascus leucogenys
VAFEDVAVNFTQEEWALLDPSQKNLYRDVMQETFRNLASIGNKGEDQSIEDQYKNSSRNLRQIIPHSGNNPYRCEECGKKLCTC

SEQ ID NO: 32840 - protein, 86 aa, Canis lupus
VSFEDVTVDFSREEWQQLDSTQRRLYQDVMLENYSHLLSVDGRFGIKTPQKRISGKASFHNEMDGEDTRDDSLYSILEELWQDSEQ

SEQ ID NO: 32841 - protein, 87 aa, Canis lupus
MAFEDVTVNFTLEEWALLNPSQKKLYRDVMQETFRNLASIGRDDIILTYLINQKSSITHSLINAVIRGDRWKGHMSVNKSAMMTPTR

SEQ ID NO: 32842 - protein, 87 aa, Bos mutus
VVFEDVTVNFTLEEWALLDFSQKKLYRDVIGETFRNLASVGTTWEDHDIEDQYRNQGRKLRSQKAERICEGKEDSPCGENVNLIPNH

SEQ ID NO: 32843 - protein, 87 aa, Nomascus leucogenys
VALEDVAVNFTREEWALLGPCQKNLYKDVMQETIRNLDCVGMKWKDQNIEDQYRYPRKNLRCHMLERFVESKDGSQCGETSSQIQDS

SEQ ID NO: 32844 - protein, 87 aa, Nomascus leucogenys
LSFRDVAIEFSLKEWQCLDTAQQNLYRNVMLENYRNLVFLVVCSHFAQDLWPEQNIKDYFQKATLKRYGKCRHENLPLRKGCESVDE

SEQ ID NO: 32845 - protein, 98 aa, Nomascus leucogenys
LKMEDVALTLTPGWTQLDSSQVNLYRDEKQENHSSLVSLGDGIQTKSRDLPPVKKLPEKEHGKISCHLRGDIAQIPTCAEAGEQEGRLQRKQKNAIGS

SEQ ID NO: 32846 - protein, 95 aa, Bos indicus
VVFEDVAVYFSQEEWGLLDETQRHLYHAVMTENLALVTSLGCCHGAQGEEASSEQGVSIGMSEVRTAKPDPSSRKAQPGDMCAPLSRDLLPLPEH

SEQ ID NO: 32847 - protein, 103 aa, Muntiacus muntjak
VTFEDVTVIFTWEEWKFLDSSQKKLYREVMWENYTNVMLVGNWKESCKPQEERFRYLEHENLSCWQGWKTASTQIYENKNYVEMVQGIDSKDLKQQHLSHYQE

SEQ ID NO: 32848 - protein, 83 aa, Canis lupus
LTFKDVAVDFTQEEWQQLEPTQRDLYRDVMLENFQNLSSLSKTNHSGEGPLSGSGPVPSPCVLHGGKVKGPFWGPFYEGTNLI

SEQ ID NO: 32849 - protein, 85 aa, Gorilla gorilla
VTFVDIAVYFSEDEWKNLDEWQKELYNNLVKENYKTLISLAMSSSVPRSRAPGACRKKDTKQCHSLSPGAEPLVPAQDASSQVKR

SEQ ID NO: 32850 - protein, 88 aa, Bos mutus
VSFTDVTVDFTQEEWEQLDPSQRILYMDVMLENYSNLLSVENSIETCILSYVKQIASPGLMHETGCSGLVHWDDPEGWDGEGDEQARP

SEQ ID NO: 32851 - protein, 104 aa, Bos indicus
VTFKDVAVDFSMEEWELLDPGQRKLYRDVMLETCGNLASVEALRNQRTNSGFEDGTICLASASQVTTFSLWTAYSLFQPVVSFHLEQGEAMWMAGKGTLRASYS

SEQ ID NO: 32852 - protein, 96 aa, Ailuropoda melanoleuca
VTFEDVTIYFSQEEWGLLDEAQRLLYCDVMLENFALIASLGFCCGTEGECNVSAKGVSQDRKLKAALSNQKDYSCDTCGLHLKDILHLTEHQATHP

SEQ ID NO: 32853 - protein, 110 aa, Nomascus leucogenys
VNFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQ

SEQ ID NO: 32854 - protein, 87 aa, Nomascus leucogenys
VAFEDVAVNFSQEEWSLLSEVQRCLYHDVMLENWVLISSLGCWCRSEDEEAPSKRSISIQRVSQVSTPRAGVSPKKAHSCEMCVILL

SEQ ID NO: 32855 - protein, 88 aa, Canis lupus
VTFEDVVVDFTQEEWGQLEPAQRTLYRDVMLETFRLLVSVDLETRPKTRLSALTQDIAEETPSSVLVERFLWDSLWCSEGDDAEGQGG

SEQ ID NO: 32856 - protein, 85 aa, Canis lupus
MTFDDVALYFSEQEWEILEKWQKEMYQQVMKNNYETLDSLGDQGTLGAKEEEGHLDGLLKQGSCATLPGEEGKILPDQRATLQHP

SEQ ID NO: 32857 - protein, 104 aa, Muntiacus muntjak
VTFKDVAVDFSMEEWELLDPGQRKLYRDVMLETCGNLASVEALRNQRPNSGFEDGTICLASASQVTTLSLWTAYSLFQPVVSFHLEQGEAMWMAGKGTLRASCS

SEQ ID NO: 32858 - protein, 86 aa, Muntiacus muntjak
LTFKDVAIDFSPEEWECLDPAQRALYRDVIVETYTNLLSLDISPIHVIKQLQLKSNSDTRKVLQTVLLRRPKSLEIKHFYLREMQE

SEQ ID NO: 32859 - protein, 87 aa, Ailuropoda melanoleuca
VSFKDVTVDFSREEWQQLDLAQKSLYRDVMLENYFNLISVGKNSSTGDKVYLFEYIFILTGIFFFPSFLDGDIGFETSQQGMTEEVS

SEQ ID NO: 32860 - protein, 84 aa, Lynx canadensis
LTFRDVAIEFSQEEWGCLNHSQRELYRDVMLETYGHLLFLDNHFECNKGNEVLSQRSKHIIQTSMPIKENLYKYNACGKDLKES

SEQ ID NO: 32861 - protein, 93 aa, Lynx canadensis
LTFRDVAIEFSQEEWGCLNQSQRELYRDVMLETYGHLLFLGEDNSFQTSQTSLAGLFLPWKTVSWKHPLCMTGIRCLQSEKEVERSPIETTAR

SEQ ID NO: 32862 - protein, 87 aa, Sus scrofa
LTVEDVAIDFSPEEWECLDLGQRHLYRDVMLEICTHLVSLALSSHDTQGLMPPNPGMELFLPTMLLGKYESSAVGTFDLIRGSEGKG

SEQ ID NO: 32863 - protein, 85 aa, Muntiacus muntjak
LTFRDVTIDFTQEEWECLDLGQRELYRDVLLENYGNLASLAKDNCLPESLIHPLGLVSKLDLVTFLEQLKDPRNIRRMETTAFYP

SEQ ID NO: 32864 - protein, 87 aa, Nomascus leucogenys
VAFEDVAVNFSQEEWSLLSEVQRCLYHDVMLENWVLISSLGCWCRSEDEEAPSKRSISIQRVSQVSTPRAGVSPKKAHSCEMCGAIL

SEQ ID NO: 32865 - protein, 86 aa, Canis lupus
VTFEDVALYFSWEEWDLLDEDQRCLYHDVMLENFVLTSSLGCWHGVEDEEVPSKESISVGVSQIGTLRSGSFPQKAQPFELRGSIL

SEQ ID NO: 32866 - protein, 83 aa, Mandrillus leucophaeus
VTFKDVAVVFSEEELRLLDLAQRKLYREVMLENFRNLLSIGHQPLHRDTFHFLKEEKFWMMETVTQREGNLGDKIQTEMETVP

SEQ ID NO: 32867 - protein, 84 aa, Bos indicus
VTFKDVAVTFTPEEWGQLDLDQRTLFREVMLETCGLLVSLGTCSALRPLGTPGSSWFLADQKVTGVTFPAPHGPCSLLAPPPPA

SEQ ID NO: 32868 - protein, 91 aa, Ailuropoda melanoleuca
VVFEDVAIYFSQEEWGLLDEAQRFLYHAVMLENFALLSSLGCCHGAQVEQAPSEQGVSVGGSQVRTPKPAPSIQKSQPWEMCGPVWKDILH

SEQ ID NO: 32869 - protein, 87 aa, Ailuropoda melanoleuca
VAFEDVAVNFTLEEWALLDPSQKKLYRDVMQETLRNLASIGKKWKDHSIEDQYKNQGRKLRSHVVEALCQSKEGSQCGGNFSPIPNL

SEQ ID NO: 32870 - protein, 94 aa, Gorilla gorilla
VAFEDVAVNFTQEEWALLGPSQKSLYRNVMQETIRNLDCVEMKWEDQNIGDQCQNAKRNLRSHTCEIKDDSQCGETFGQIPDSIVNKNTPRVNP

SEQ ID NO: 32871 - protein, 86 aa, Sapajus apella
MVFEDVAIHFSQEEWGILNDVQRHLHSDVMLENFALLSSVGCWHGARDEEAPSKQYVSVGVSQVTTLKQALSTQKAQPCETCSSLL

SEQ ID NO: 32872 - protein, 85 aa, Sapajus apella
VRFGDVAVYFSREEWGCLRPAQRALYRDVMRETYSHLGALDSGNKEEERQREGTGALEKPLPVATGPPGLKTPQAPFGRLELPSK

SEQ ID NO: 32873 - protein, 98 aa, Sapajus apella
LKMEDVALTLSPGWTQLDSSQVNLYRDEKQDNHSSLVSLGGEIQTKSRDLPPAEELPEKEHGKISCRLSEDIAQIPTCAEAGEQEGRLQRKQKNAIGS

SEQ ID NO: 32874 - protein, 87 aa, Sapajus apella
LEFMDVAIEFSLEEWQCLDTAQRNLYRDVMLENYRNLVFLVMCSHFAKDLWPEQSTKDSFQKVILRRYEKYRHDNLQIKNGCESVDE

SEQ ID NO: 32875 - protein, 87 aa, Macaca fascicularis
LTFRDVAIEFSLEEWQCLDTAQQGLYRKVMLENYRNLVFLGMRAFGIFLCHLIYIVRLVNCIYLFICSHFAQDLWPERDIKDSFQES

SEQ ID NO: 32876 - protein, 92 aa, Phascolarctos cinereus
VTFQDVAVEFTREEWCLLDFSQKVLYRDVMLEISQNLLSLDEETGPETKESTPKLRVSYDFSLKEIGRCGTKVEKKPDNWESHSGQLKITFR

SEQ ID NO: 32877 - protein, 87 aa, Macaca fascicularis
VSFKDVAVDFTQEEWQQLDPAQRTLYRDVMLENYSHLVSMDRKSNLHNSQSCILGTVSFHHKILKGVTKDGSLCSILKVCQGDGQLQ

SEQ ID NO: 32878 - protein, 89 aa, Puma concolor
MFRDVAVDFSQEEWEFLDLKQRNLYRDVMLENYSNLVSWDMKSQCATKELSPNDDSYKIKSSQWKIMERLPTHEFGCSIFQDDWKYNHH

SEQ ID NO: 32879 - protein, 88 aa, Ailuropoda melanoleuca
VTFEDVAVDFSRDEWEMLDSAQRRLYREVMRDTCANLAALVNTVGKPYECYHCGKMFNRRHSLSEHQRIHTGERPYECQECGRAFTHS

SEQ ID NO: 32880 - protein, 126 aa, Phyllostomus discolor
VSFADVAVYFSPEEWGCLRPVQRALYRDVMRETYGHLGALGESPTVHLGAHPHPPCPAFGLCTGSVTSSVPDVGTVGTAGWAVTPRQRLCSSPPGFQDTKPALISWMEEEAELWGSDARDPELGEC

SEQ ID NO: 32881 - protein, 96 aa, Lynx canadensis
VTFEDVAVHLTREEWGCLDPVQRNLYREVMLENYGNVVSVGILLRLPTTRIHSVNSCPALSHTQASAFSGETLAVLSAGISKRWPRYRLPIDIARP

SEQ ID NO: 32882 - protein, 85 aa, Phyllostomus discolor
VSVEDVTVDFSKAEWQQLNPAQRCLYLDVMLEIYSHLFSVEMKFVLNTPQQDISGTASFHDMAGKVTRDGSWYSILAELWKDAAS

SEQ ID NO: 32883 - protein, 183 aa, Phyllostomus discolor
VTFGDVAVDFSQEEWELLTCAQRALYRDVMLENYRNLVSLEQREEPWMAKRKVTRGPCPDWQALPGATESPAEGAVCEAPWSEAMLMEKLASCHVQCSILRERWDYEAVFERQLGLVTIVNMASDFSQQLDPSPESFHKNMTWETRDLEAAGCCVSRPDVVSVLDQGKEPWLVKREFTGLLSG

SEQ ID NO: 32884 - protein, 89 aa, Sapajus apella
LTFSDVAIEFSLAEWKCLTPAQRALYREVMSENYRNLESTESHSVLRCQAGVQWRNLGSLQPPPPRFKKFSYLSLPSSWDFRYLFQMHK

SEQ ID NO: 32885 - protein, 96 aa, Oryctolagus cuniculus
VTFDDVAVVFTDEEWRHLIPVQRDLYKEVMLENYKSIVSLDWETKPEIQGAWRERCGRQSPLRPKFDVRAPEAGLETEKRSAAAANCKKPLSREKS

SEQ ID NO: 32886 - protein, 87 aa, Desmodus rotundus
VTLRDVIVDFTQEEWQQLKPAQKDLYRDVMMENYWNLVSLDVETRPDTKESDPQEDEWEDKPSVVVMVQEGPKRNGAQSYNCEEAGT

SEQ ID NO: 32887 - protein, 110 aa, Macaca fascicularis
VTFEDVAVNFTQEEWNLLSEAQRCLYRDVMLENLALISSLGCWCGVEDEEGPSKQSIYIQRETQVRIPMAGVSLKKVHPCEMCGPILGDILHMGDHQGTHPKQKLHSCEA

SEQ ID NO: 32888 - protein, 87 aa, Macaca fascicularis
LQFRDVAIEFSLEEWHCLDTAQRNLYRDVMLENYRNLVFLVICSHFAQDVWSEQSIKDSFQKVILRRYEKCGHDNLQLKKGCESVDE

SEQ ID NO: 32889 - protein, 95 aa, Phascolarctos cinereus
LMFRDVAVDFTREEWRRLSPAQRDLYRDVMLENYENLVSVGQVQCADQGNRCPTVSSLRPKILQTSLSKPEVICRLERGETPWVPRRGASRTTCP

SEQ ID NO: 32890 - protein, 155 aa, Sapajus apella
MGFWDVAVAFTQKEWKLLSFAQRTLYREVMLGKLAIWSRWLRLACLRFQILLVHILSSYIAAAVLLTWKEKQFFPYSPRKCSAFIVKLCVCVCVCVCVCVCVLCVCGMSDTAFSGLFTLAGLLRIAFSKPKLITQLERGDEPWREENKHLLDLCP

SEQ ID NO: 32891 - protein, 84 aa, Sapajus apella
VTFQDVAVDFTPEEWQLLDCAERTLYWDVMLENYRNLISVESDCPLVDEPGKCWESKDNFLKSVLLTFNKLLTMERIHHYNMST

SEQ ID NO: 32892 - protein, 86 aa, Pteropus alecto
LTFKDVFVTFTREEWEFLYPAQKTLYRKVILETCKLLVSLDDKAKTKTAEPPASQPASSKGCLLHRSPTHEDSSVSKLGRATKQKG

SEQ ID NO: 32893 - protein, 90 aa, Macaca fascicularis
VAFEDVAVNFTQEEWALLGPSQKSLYRNVMQETIRNLDCIETKWEDQNIGDQCQNPRRNLRSHTCEIKDDSQCGETFGHVPDSIVNKNTP

SEQ ID NO: 32894 - protein, 87 aa, Macaca fascicularis
VAFEDVAVNFTQEEWALLDSSQKNLYREVMQETCRNLASVGNKWKDQNIEDHFEKPGKDIRNDMVQRLCESKEGSQCGEVVSQIPNL

SEQ ID NO: 32895 - protein, 82 aa, Phascolarctos cinereus
VTFKDVAVYFTQEEWGNLDPSQKELYRDVMLENYRNLVFLGWETRPGTKDTVQERFRKDGFHDSKLEEPWEYCARLQGLQHN

SEQ ID NO: 32896 - protein, 84 aa, Phascolarctos cinereus
VSFGDVPFYLSREEWGCLDPAQRDLFWDIKRENFRNVSLGLGIKHQNEEASYQASVKEVEPLPGRSGGDVPWSTEEGEVWESEN

SEQ ID NO: 32897 - protein, 83 aa, Sapajus apella
ITFKDLAVRFSEEEWRLLEEGQREFYRDVMRENYETLVSVEPGGAVGGGSRTDEGQEPAGCGGLQEGQPRHSLHLTALVQLVK

SEQ ID NO: 32898 - protein, 87 aa, Sapajus apella
VTFEDVAVRFTQDEWPLLDPSQKNLYRDVMQETIRNLKSIGIKWKDQNIEDHCKDSRRNPRNHMAERLCECKDGQCDKTFSLIPDAI

SEQ ID NO: 32899 - protein, 90 aa, Pteropus alecto
VMFRDVAIDFSQEEWECLDFAQRDLYRDVMLENYSNLVSLDLPLRCANKDLSPKKDTYKTELSQWEISDRLENCDLKEFSSRDFLEVRGT

SEQ ID NO: 32900 - protein, 82 aa, Muntiacus muntjak
VTFEDVFVYFSREEWELLEEAQRLLYRDVMLENFALVSSLGLAHPAPRHGEKPRGHVRSLFSAVIAMGSFWVLDSRWARKHN

SEQ ID NO: 32901 - protein, 97 aa, Muntiacus muntjak
MTFEDVAVNFTREEWALLDTAQRQLYRDVILETCGHLACVDWATRHQTKDSTPQQNNLAKRTFQEVNRAHLASSSSRLSDLREDWMSHRIEVPGKQR

SEQ ID NO: 32902 - protein, 87 aa, Gorilla gorilla
VAFEDVSVSFSQEEWALLAPSQKKLYRDVMQETFKNLASIGEKWEDPNVEDQHKNQGRNLRSHTGERLCEGKEGSQCAENFSPNLSA

SEQ ID NO: 32903 - protein, 83 aa, Gorilla gorilla
VAFEDVAVSFTQEEWALLDPSQKNLYRDVMQETFKNLTSVGKTWKVQNIEDEYKNPRRNLRRSFTLVAQAGVQRRDLGSPQPP

SEQ ID NO: 32904 - protein, 86 aa, Lynx canadensis
LTFRDVAIEFSQEEWGCLNHSQRELYRDVMLETYGHLLFLATSTKQCVSVTKNSSQRFKHNYLLKENLENLESYLIQVENKYLNQF

SEQ ID NO: 32905 - protein, 87 aa, Macaca fascicularis
VSFEDVAVNFTLEEWALLDSSQKKLYEDVMQETFKNLVCLGKKWEDQDIEDDHRNQGRNRRGHMVERLCESRKGGKCGETTSQMPNV

SEQ ID NO: 32906 - protein, 87 aa, Macaca fascicularis
VVFEDVAIYFSQEEWGHLDEAQRLLYRDVMLENLALLSSLGCWHGAEDEEAPSQQGFSVGMPEVTTSKSYLSTQKVHPSETCDPPLK

SEQ ID NO: 32907 - protein, 104 aa, Macaca fascicularis
VTFEDVAVNFSQEEWSLLSEVQRCLYRDVMLENLALISSLDCWCGSKDKEAPSTQSISVQRESQNRTPRAVVSPKKAHPCEMCGLISGDDLHFVEHQETHQKQK

SEQ ID NO: 32908 - protein, 91 aa, Sapajus apella
LTFRDVAIEFSLEEWQCLNTDQQDLYRKVMLENYRNLVFLGRSDHLSAGRKRSLEYEETQYGSQAPSYIFSFCPRPLARAGHKRFFPRSHI

SEQ ID NO: 32909 - protein, 185 aa, Canis lupus
MTFEDVAVEFTQWEWGQLDPAQKDLYSEVMLENFKNLASLGELGSSKAQCLPIRPAIFISLVFKNLEFLGLLAEFCPGVMESDIYTVFGVLMPKKGPVPYEIVISFMILLLMFYNAYSLETLHTYSISPPERPRAKPLASNICSHGPFLFLPSGLPVSKPYVISQLEEGKEPCVLEGEISTDWEK

SEQ ID NO: 32910 - protein, 87 aa, Canis lupus
LTFEDVAVYFSQEEWRLLDEAQRHLYRDVMLEVFALFASLGCGQRTEDEEALSEQNISVGESQINSTQETCVLDSEGDLHPAESLEA

SEQ ID NO: 32911 - protein, 90 aa, Phyllostomus discolor
VVFADVAVNFTQEEWALLDGAQRKLYRDVMLETFRNLASVASCTQAITSGSSPGWETLETEISSEDNIVRITRNDSCSVSGEHWTFHDTG

SEQ ID NO: 32912 - protein, 84 aa, Sapajus apella
VAFEDVFVYFSREEWELLEEAQRFLYRDVMLENFALVATLGFWCETENEEAPSEQSISVGGVSQVRTAEPGLFQKAHPCELCDP

SEQ ID NO: 32913 - protein, 97 aa, Canis lupus
VAFRDVAVDFTQEEWRLLSPAQRTLHREVMLETYNHLVSLGSKLNIQLCPHCPLAFTSQQGLSQHVWFSHLPQLFSSLHAGNHLHPGKHYPEDQKQQ

SEQ ID NO: 32914 - protein, 83 aa, Gorilla gorilla
FTFKDVAIEFSQEEWECLDPAQRALYRDVMLENYRNLLSLDEDNIPPENDISVGFTSKGLSPKENNKEELYHLVISERKESHG

SEQ ID NO: 32915 - protein, 90 aa, Lynx canadensis
VVFEDVAVDFTLEEWALLDSAQRKLYRDVMLENLKNLAAVDDETQLKANGSVSQQDAYGNKISKGNKLAKFTRNESWASVLGKIWEELST

SEQ ID NO: 32916 - protein, 87 aa, Phyllostomus discolor
VTFEDVAVNFSLEEWALLDSLQKKLYRDVMQETFRNLASIGKKRGDHDIEDQCKNQERKCRSQMVERLCKGRKGSQCGQNFSLIPSL

SEQ ID NO: 32917 - protein, 90 aa, Puma concolor
LSFRDVAVGFTRKEWQHLDPAQRTLYRDVMLENYSHLVSVGWSEAKNRGWRRKNSSDGAFQPYKCSECDKTFSHKSRLVEHHRSHTGEKP

SEQ ID NO: 32918 - protein, 97 aa, Macaca fascicularis
VTFADVAVNFTKEEWTLLDPAQRNLYRDVMLENSRNLAFIDWATPCETKDAAPQPDILPKRTYPEANSVCLTSISSQLSTLREDWRCPKTEGPHRQG

SEQ ID NO: 32919 - protein, 85 aa, Phascolarctos cinereus
VTFEDVAIYLSREEWRQLDPAQRDLYTDIVQEKNGLALEAVKIGKVGFIPLEAAGDAKMLGTGLGRAHGDVPQAMEQEGSRESSR

SEQ ID NO: 32920 - protein, 87 aa, Oryctolagus cuniculus
VTFQDVAVVFSEEELRLLDTAQRALYRAVMLENFRNLLSVGEDGRARILGVTLCSDLVCPGIKALERAHRGERRCKCAECGKEFSQS

SEQ ID NO: 32921 - protein, 96 aa, Canis lupus
VTFEDVAVYFSKEEWRLLDEAQRHLYCNVMLENLALIASLGCWHGVNAEEAFFEQCVFVERVPQARTSDPGRSIPKVHSGNMCVSVEKDILYLAEH

SEQ ID NO: 32922 - protein, 87 aa, Muntiacus muntjak
VTLEDVAVDFTQEEWSLLDKSQKNLFRNVMVETITHLVSVGDWNKGKSCGVKQQASKVRVQVSILGDINESLKCSSLSRHKIIHTGE

SEQ ID NO: 32923 - protein, 146 aa, Myotis lucifugus
VNFEDVAIAFSQEEWGLLDEAQRLLYFHVMQEVFALVSSVGCWHKMEDEEACSDDSVSIRVESQVRASKKAADTQKTHLCKRCFSVLQHTFHLTGSHAAYFEQKAFCTDACLGDFYFSANPHQEQRNECGEEPWKQAMVRASYVSR

SEQ ID NO: 32924 - protein, 85 aa, Oryctolagus cuniculus
VTFEDVAVLFTRDEWRKLDPPQRILYRDVMLENYSNLLSLDWKSGPKTTTSTQTQDSSFQGLIMKRSRRNRPWDLKSEKPYIHKD

SEQ ID NO: 32925 - protein, 101 aa, Lynx canadensis
AAYEFLSVDYTERKWKGPALSQRAVYRSLMPENYRRVASLGNDSCPDLPAKQEVSKGLGSSDGTSGGLCGVVSGEPEAGTACEGALEKLEGQPSDEEGSRL

SEQ ID NO: 32926 - protein, 91 aa, Puma concolor
VSFADVAVYFSPEEWGCLRPAQRALYRDVMRETYGHLGALGGTPNKKKEAPEEGPGAKGPRKTPGKEPSKELVKHNPDWTVRKVSARAQQP

SEQ ID NO: 32927 - protein, 98 aa, Sapajus apella
LTFKDVAVVFTEEELGLLNPVQRNLYRDVMLENFRNLLSVADKIHSEMEAGPHEELSWGQIWKQIASDLVKYEDSMINISQFPKQGDLSCQVRAGLYT

SEQ ID NO: 32928 - protein, 87 aa, Rhinolophus ferrumequinum
VAFEDVSVKFTLEEWALLDPSQKKLYRDVMRETFRNLASIGEICKDIEDHFEKHGTNLNLSSHIVERLGNSKEGGQYVKTFSHIPIH

SEQ ID NO: 32929 - protein, 83 aa, Macaca fascicularis
VTFEDVFVYFSREEWELLEEAQRFLYRDVMLENFALVATLGFWCEAENEEAPSEQSVSVGVSQVRTAEPGLFQKAHPCEMCDP

SEQ ID NO: 32930 - protein, 95 aa, Macaca fascicularis
VAFEDVAVNFSQEEWSLLSEVQRCLYHDVMLENWVLISSLGYWCGSEDEEAPSKRNILHLADHQGTHHKQKLHRCEDWGNKLYDSSNHQHQNQYL

SEQ ID NO: 32931 - protein, 83 aa, Sapajus apella
VAFEDVAVRFTQEEWALLVPSQKNLYRDVMQETFKNLASVGKTWKVQNIEDEYKDFRGNLREKRIESKESNHCGESFNQIADD

SEQ ID NO: 32932 - protein, 87 aa, Phyllostomus discolor
VAIEDVAVDFTLEEWALLDPPQKKLSRDVMQETFKNLDSVGKKWEDHDIEDQDKNQGGKLRNQMVERLCESKEGSQCEENFSLISNL

SEQ ID NO: 32933 - protein, 95 aa, Desmodus rotundus
RSLDSDAVCFSEQEWENLEDWQKELYRNVMMSNYETLVSLKVLGQPEGEAELGTEMLGDLEEEGLGGVHPEGVVIKQEIESPQGQERSEGLPGEF

SEQ ID NO: 32934 - protein, 94 aa, Macaca fascicularis
MVFEDVAIHFSQEEWGILNGVQRHLHSDVMLENFALLSSVGCWHGAKDEEASSKQCVSVGVSQVTTLKPALCTQKAPPCETCSSLLKDILHLAE

SEQ ID NO: 32935 - protein, 86 aa, Phascolarctos cinereus
MTFKNVAVDFTQEEWGLLDHPQKELYKEVMLENAQNLLSLEGEIRLEMRLLQHAAFLAKKKTHKQRFRSNGPCGFIYREICATHQR

SEQ ID NO: 32936 - protein, 84 aa, Puma concolor
VVFEDVAIHFSQEEWGLLDGAQRLLYRAVMMENLALLSSLGCWHGAQDEEASQVRTPKPDSSVQEAQCEKDMLPSAEQDGMYSD

SEQ ID NO: 32937 - protein, 89 aa, Sapajus apella
MFRDVAIDFSQEEWECLDAAQRDLYRDVMLENYSNLVSLDLPSRCARKDLSPEKNTYETELSQWEMSNRLEKCDLEESNSREYLEAKAK

SEQ ID NO: 32938 - protein, 90 aa, Macaca fascicularis
VTFRDVAIDFSQKEWECLDTTQRKLYRDVMLENYSNLVSLGLLSRHKTKKLPSEKDIHEISLSKGSIIEKSKTLRLKGSILRNEWQSKSE

SEQ ID NO: 32939 - protein, 83 aa, Macaca fascicularis
VAFEDVAVNFTQEEWTLLDISQKNLFREVMLETFRNLTSIGKKWKDQNIEYEYKIPRRSFRSLIEEKVNEIKEDSHCGETFTQ

SEQ ID NO: 32940 - protein, 89 aa, Macaca fascicularis
LTFRDVAIEFSQEEWKCLDPAQRTLYRDVMLENYRNLVSLDISSKCMMKEFSSTAQGNTEVIHTGTIQRHERHHIGDFCFQEMEKDIHD

SEQ ID NO: 32941 - protein, 89 aa, Ailuropoda melanoleuca
VTFKDVLVTFTQEEWELLDLPQRTLYWKVMRETFRLLVSLDDKAKTNTTKPSAPQPALFEGCSPHRLLTEEDFSVSTLGEAREQERPSE

SEQ ID NO: 32942 - protein, 82 aa, Lynx canadensis
VTFEDVAVIFTDEEWRHLVPIQKDLYKEVMLENYKSIVSLDWETKPEPQGASEEERPGRIVRERLGRKVPLCPKFEARALEG

SEQ ID NO: 32943 - protein, 90 aa, Myotis lucifugus
VMFRDVAIDFSQEEWECLDFAQRDLYRDVMLENYSNLVSLDLSSRYANNYLPPKEDTYETELFQWEMNDRLQIYDIKKSISRDYLEVRGT

SEQ ID NO: 32944 - protein, 83 aa, Oryctolagus cuniculus
IAFEDLAVYFTWEEWQNMNNAQKILYRDVMLEIYSSLFSLVGMERGDLIRINQKSQDKNLNQDFMKNNKTSASKRVELKKTLS

SEQ ID NO: 32945 - protein, 85 aa, Pteropus alecto
VTFDDVAVYFSELEWGRLDEWQKELYKHVMRGNYEMLVSLGKAAEKRSGPLFADYAISKPDILTRMERGEEPCPEGLWGQEEGKE

SEQ ID NO: 32946 - protein, 83 aa, Macaca fascicularis
VAFEDVAVNFIQEEWALLDSSQKNLYREVMQETCRNLASVEIIWYRDCVKANKVISMMDKLTFLLDENNVNAVFVEKSLYVIP

SEQ ID NO: 32947 - protein, 95 aa, Oryctolagus cuniculus
VVFSEEELRLLDTAQRALYRAVMLENFRNLLSVGEDGRARILGVTLCSDLVCPGIKALECGKGFSRRATLTVHHKLHTGEKPHTCEESGRAFVHA

SEQ ID NO: 32948 - protein, 93 aa, Macaca fascicularis
VSFEDVSVYFTKTEWKLLDLRQKVLYKRVMLENYSHLVSLGSPHTFPSSHELPSLPAGQRVLYSLLPEDIENALSSGDRTQSKTSTSTQKHSG

SEQ ID NO: 32949 - protein, 87 aa, Sapajus apella
ISLEDVAVNFTLEEWALLDPGQRNIYRDVMRATFKNLACIGEKWKDQDIEDDHKNQGRNLRDAMVETLCENKEDRQCGKSTSQIPDL

SEQ ID NO: 32950 - protein, 87 aa, Pteropus alecto
VAFEDVAVNFTLEEWALLEPLQKKLYRDVMRETLRNLASVGKKWEDHNIEDQYKNQRRNIRSHTVKRLCESKEGNQCGENFSHIPNL

SEQ ID NO: 32951 - protein, 103 aa, Pteropus alecto
VTFKDVVVEFSEEEWGHLDPAVKSLYRDVMLENYRNLNSLRKDRQTISENQDSVLKQRISGEESSHGVIMTRLTQSGPSLDAWKSDDWDHWDINLPQGAFIHK

SEQ ID NO: 32952 - protein, 107 aa, Rhinolophus ferrumequinum
VSFEDLSIDFTQKEWQLLDACQKDLYKDVMLENYSSLVSLASESHIDGASGVVVPPAHSFLDTTLCSVTDQSCLAGYEVTKPDVIFKLEQGREPWTGGGALPSSGSL

SEQ ID NO: 32953 - protein, 96 aa, Myotis lucifugus
VTFEDVAVHLTQEEWGCLDPVQRDLYREVMLENYGNVVSLGILLRLPTTRIHSVNSCPALSHTQASAFSGETLAVLSAGISKRWPKYRLPIDIAHP

SEQ ID NO: 32954 - protein, 104 aa, Sapajus apella
VTFEDVSVDFSQEEWELLDPAQKNLYREVMLENYRNLVSLEAVKNPCADAGIEEGPFSTVHTLQATRLSSWMGHLLLQPVASVHMEQSEALRMEEKGTPQASCS

SEQ ID NO: 32955 - protein, 113 aa, Sapajus apella
VTFEDIAVYFSQEEWGLLDEAQRCLYHDVMLENFSLMTSVGCLHGIGAEEAPSEQTVSLEVSQARTPKPSSSIPNAHSCEMCILVMKDILYLTDHQETLPWQKPYTSAASGKW

SEQ ID NO: 32956 - protein, 86 aa, Sapajus apella
VRFGDVAVYFSREEWGCLRPAQRALYRDVMRETYSHLGALADSGNKEEERQREGTGALEKPLPVATGPPGLKTPQAPFGRLELPSK

SEQ ID NO: 32957 - protein, 83 aa, Sapajus apella
VTFEDVAVYFSWKEWSLLDEAQKCLYHDVMLENLTLTTSLGGCGTEDEEAPYQQSTSPQQVSQVRIPKALPSPQKTNSCEICG

SEQ ID NO: 32958 - protein, 147 aa, Myotis lucifugus
MNYEDVAIVFSQEEWELLDEAQRLLYCDVMLEVFALVSSVGCWHKVDGDEACSAQSVSIKGESQVRASKTAPATQKIPLCKRCFSVLKGILHLSGSHATDFEQKAFFCSDPCVGDSCSCANPHEQQRNECGEEPWKQGMDRASSVSR

SEQ ID NO: 32959 - protein, 88 aa, Sapajus apella
ITFRDVAIDFSLQEWEYLNLVQKTLYQEVMMENYDHLVSLDLDSRCEIISDRKMDIYRKHSSVTLHQRIHNGQKPYECKECQKAFSHL

SEQ ID NO: 32960 - protein, 86 aa, Sapajus apella
VVFEDVAVNFTQEEWALLGPSQKKLYRDVMQETFVNLASIGENWEDKNIEDHRDHGRKLRSHMVERLCESKEGNQLGEAISQTPNP

SEQ ID NO: 32961 - protein, 90 aa, Sapajus apella
VAFEDVAVNFTQEEWALLGPSQKSLYRNVMQETIRNLDCIEMKWEDQNIEDQCQNPRRNLRSHTCEVIDDSQCGETFSQIPESLVNKNTP

SEQ ID NO: 32962 - protein, 84 aa, Macaca fascicularis
LAFRDVALEFSPEEWECLDPAQRNLYRDVMLENYRNLFSLGEDHFNMQFLFHRLAMSKPELIIYLEARKEPWNVNTEKTAKHSA

SEQ ID NO: 32963 - protein, 145 aa, Myotis lucifugus
MNFEDVAIAFSQEEWELLDEAQRRLYCDVMLEVFTLVSFVGPWHKMHDVEAYSEHSVSVGESQVRASKTAAATQRTHLCKLCFSVLKDILHLSELQVVHFEKNVFLSDACVRDLCFSANPHQQQKDASGEKPWKEDMESALLVRS

SEQ ID NO: 32964 - protein, 87 aa, Myotis lucifugus
LTLEDVAVDFTWEEWQLLGPDQKILYRDVMLETYSHLVSVEPRGVSSSSSSVVSYEYQVSNPDALSKLELGEEPWTIDNELHRLVCP

SEQ ID NO: 32965 - protein, 83 aa, Puma concolor
LTFRDVTIDFSQEEWECLDPAQRALYREVMMENYRNLVSLEPYKCNDCGKAFRGSSNLTNHQRIHSGQKPYKCNDCDKSFNRI

SEQ ID NO: 32966 - protein, 91 aa, Macaca fascicularis
VAFEDVAVNFTQEEWALLDPSQKNLYREVMQETLRNLASIGKKWNNQYIEDEHQNPRRNLRRLTKERLSESEESHQHGEVLTQVPDDTLKK

SEQ ID NO: 32967 - protein, 89 aa, Phascolarctos cinereus
VTFKDVTVDFIPEEWGLLDHSQKDLYEEVMLESAQNLFALGIQDRMSGMVLLLLSWGVMLFQDPRLQTGLEAGPETTLCSWNKNHVAVA

SEQ ID NO: 32968 - protein, 87 aa, Sapajus apella
VSFEDVAVTFTQEEWALLDLSQKSLYRDGMQDIFRNLASVGNKSENQNMQDDFKSPVRNLSSHMVERLFEIEEGSQYGEAFNQDSNF

SEQ ID NO: 32969 - protein, 87 aa, Oryctolagus cuniculus
VTYEDVTLGFTPEEWGLLDVKQKSLYREVMLENYRNLVSVECSETQLDSQIDLPAENPLTKIKVVEVLTLNQEVAGPRNAQIQALYA

SEQ ID NO: 32970 - protein, 88 aa, Oryctolagus cuniculus
VTFSDVAIDFSQEEWACLTSAQRDLYWDVMLENYSNLVALNLESTYETKSLTIDNTVYEINFPKVNSGIKTKSFGPKAVPKLPRVSRE

SEQ ID NO: 32971 - protein, 86 aa, Macaca fascicularis
VVFEDVAVNFTQEEWALLGPSQKKLYRDVMQETFVNLASIGENWEEKNTEDHKNQGRKLRSHMVERLCERKEGSQFGETISQTPNP

SEQ ID NO: 32972 - protein, 88 aa, Phascolarctos cinereus
VTFQDVAVEFTREEWEHLRPAQRELYRDVMLENYRNLVSLDSQSQETNFIAMESTSNLSISIEESLQERWSRKIPWDYKLGEVWECDV

SEQ ID NO: 32973 - protein, 82 aa, Lynx canadensis
ISFEDVAVDFTLEEWRLLNPTQKNLYRDVMLENYSNLVFLEKVWLDNNLKMWHQDNQDELRSMERGDECDVFRKIFHSSINF

SEQ ID NO: 32974 - protein, 93 aa, Macaca fascicularis
VTFRDVAIEFSLEEWKCLEPAQRDLYREVTLENFGHLASLGKEIVSHRPDGKQGTGDYNHGVLFPSLPKWFSDLESRCEKFLQKDIFEIGAFN

SEQ ID NO: 32975 - protein, 102 aa, Macaca fascicularis
VTFEDVAVVFTDEEWSHLVPIQRDLYKEVMLENYNSIVSLETKPEIHDASDEKSEGSLRECLGRQSPLCPKFEVYAPDGRMGTEKQSPSGETHKKSLSREKG

SEQ ID NO: 32976 - protein, 85 aa, Sapajus apella
VTFEDVAVYFSQEEWGLLDAAQRHLYHNVMVENFELITSLGCWHGVEGQEAHLKKNASVEEVLQVRSANADPSTQRAYPCDMCGP

SEQ ID NO: 32977 - protein, 114 aa, Gorilla gorilla
VTFEDIAVYFSQEEWGLLDESQRCLYHDVMLENFSLMASVGCLHGIEAEEAPSEQTVSAQGVSQARTPKLGPSIPNAHSCEMCILVMKDILYLTEHQGTLPWQKPYTSVATGKW

SEQ ID NO: 32978 - protein, 85 aa, Phascolarctos cinereus
VTFKDVVVDFTQEEWKCLDSSQKEFYRDVMLENYSNLVSLDKDSFPWCSRFSHWKAYVHTLVNITGYKDQPNWLLRTCISQTICH

SEQ ID NO: 32979 - protein, 110 aa, Macaca fascicularis
VTFEDVAVNFTQEEWNLLSEAQRCLYRDVMLENLALISSLGCWCGVEDEEGPSKQSIYIQRETQVRIPMADVSLKKVHPCEMCGPILGDILHMGDHQGTHPKQKLHSCEA

SEQ ID NO: 32980 - protein, 87 aa, Phascolarctos cinereus
VTFKDVVVDFTEEEWGLLDHSQKELYKEVMQENVQNLLSLGVETKFEVNEVPRNLGIFVEERDLHRFMSDGPCGFNWREIHDSNMKL

SEQ ID NO: 32981 - protein, 89 aa, Puma concolor
VTFTDVAVNFTKEEWALLDPAQRNLYRDVMLENCRNLASVGFDPMRGELCPLRFICIRFMINSPRGILRLCVCISDADKVEKNVYHSEN

SEQ ID NO: 32982 - protein, 82 aa, Puma concolor
VTFEDVAVIFTDEEWRHLVPIQKDLYKEVMLENYKSIVSLDWETKPEPQGASEEEKPGRIVRERLGRKVPLCPKFEAHALEG

SEQ ID NO: 32983 - protein, 86 aa, Macaca fascicularis
VAFEDVAVNFTLEEWALLDPSQKNLYRDVMRETFRNLASIGKQWEDQNIEDPFKIPRRNISHIPERLCEGKEGSQGEETFSLIPDG

SEQ ID NO: 32984 - protein, 104 aa, Macaca fascicularis
VTFADVSVDFSQEEWELLEPAQKNLYREVMLENYRNVVSLEALKNQCTDAGIKKGSRSPAQTPQVTSLSSWTRYVLLQPAASSHLEQRAALWMEEKGTPQASCA

SEQ ID NO: 32985 - protein, 87 aa, Macaca fascicularis
VAFEDVAVNFTHEEWALLGPSQKNLYRDVMRETIRNLNCVGMKWENQNIDDQYQNLRRNPRCDVVERFGKSKDGSQCEETLSQIRNS

SEQ ID NO: 32986 - protein, 85 aa, Macaca fascicularis
LLFRDVAIEFSQEEWKCLNPGQKALYRDVMLENYRNLISLGEDNVPPEAWICSGICLPDLSVISILEQKRDPWTLQSDVKVANNP

SEQ ID NO: 32987 - protein, 82 aa, Macaca fascicularis
VTLEDVAVEFIQEWALLDSARRSLCRYGMLDQCRTLTSRGAGPVPEDAAGALRRSEGDTIDSRGPASSPGAALVSGIHGTKG

SEQ ID NO: 32988 - protein, 87 aa, Phascolarctos cinereus
VTLKDVLVDFTEEEWGLLDHSQKELYKEVMLENVQNLLSLDVEIKFKVNEMARKVGIFVEEHDLHRFMSDGPCDFKLGEIHDSNIKV

SEQ ID NO: 32989 - protein, 88 aa, Myotis lucifugus
VNFKIVTVDFSQEEGILNPAQRTLDRDAILENHRDLVSWDLATALGRRESTSKQRIIDDEPSHGVKLERLTRDDPWLSSCEEVWICKD

SEQ ID NO: 32990 - protein, 130 aa, Myotis lucifugus
MIFEDVAIAFSQEEWELLDEAQRRLYCDVMLEVFALLSIVGHWQKMDDVEAYSEHNVSVGESQVRASKTAAATQRTHLCKPCFSVLKDILHLTELQVVYFENANPHQQQKDGSGEKPWKEDMESASLVTS

SEQ ID NO: 32991 - protein, 89 aa, Sapajus apella
VVFEDVAVNFTQEEWALLDLAQRNLYRDVMLENFQNLASLGFETQLKTNESVAPPDICGEKISNEQKIVRFKRNDSWFSSLHENQESCG

SEQ ID NO: 32992 - protein, 84 aa, Sapajus apella
LTFTDVAIEFSQEEWKCLDPAQRALYKDVMLENYRNLVSLGSSCALGGNAENKQIKTQLGVSFHLHLSELELFPDERVINGCNQ

SEQ ID NO: 32993 - protein, 82 aa, Muntiacus muntjak
PTLEDVAVAFTWEEWQLLVPAQKALYWDVTLENYSDLVSVKEPPWTLDDEVPSHLHPDIKEVDDHVQLQWQNQNMLKCYEEN

SEQ ID NO: 32994 - protein, 85 aa, Phascolarctos cinereus
MTFKDVAVEFTREEWVYLGPSQKELYRDVMLENYKNLVCLGEKPYKYNECRKAFSIKVQLIYHQRIHTGEKPYECDECGKAFGRR

SEQ ID NO: 32995 - protein, 105 aa, Phascolarctos cinereus
MTLQDVAVDFTPEEWGHLDPSQKELYRDVMLENYTSLVCLGERYFLGGAGDFQLDGVDVGVLAPILLSLLNSPGFADTKPNVINQLEQRERPWMLKGDVPASLCP

SEQ ID NO: 32996 - protein, 83 aa, Gorilla gorilla
VAFDDVAVNFTQEEWALLDISQRKLYREVMLETFRNLTSIGKSWKDQNIEYEYQNPRRNFRSLIEEKVNEIKEDSHCGETFTP

SEQ ID NO: 32997 - protein, 84 aa, Gorilla gorilla
LAFRDVALEFSPEEWECLDPAQQSLYRDVMLENYRNLISLGEDNFNMQFLFHSLAMSKPELIICLEARKEPWNMNTEKTAKHSA

SEQ ID NO: 32998 - protein, 94 aa, Gorilla gorilla
MVFEDVAIHFSQEEWGILNDVQRHLHSDVMLENFALLSSVGCWHGAKDEEAPSKQCVSVGVSLVTTLKPALSTQKAQPCETCSSLLKDILHLAE

SEQ ID NO: 32999 - protein, 91 aa, Lynx canadensis
VKFADVAVYFSTEEWGCLRPAQRALYRDVMRETYGHLGALGGTPNKKEEAPEEGPGTKGPRKTPGKEPSKDLVKHNPDWTVRKVSARAQQP

SEQ ID NO: 33000 - protein, 97 aa, Macaca fascicularis
VTFADVAVNFTKEEWTLLDPAQRNLYRDVMLENSRNLAFIDWATPCETKDAAPQPDILPKRTYREANSVCLTSISSQLSTLREDWRCPKTEGPHRQG

SEQ ID NO: 33001 - protein, 84 aa, Macaca fascicularis
VTFRDVAVIFTEAEWKRLSPEQRNLYKEVMLENYRNLLSLDRISLLLPRLECNGAISAHHNLCLLGSRDSPASASQVAGITAEP

SEQ ID NO: 33002 - protein, 95 aa, Phascolarctos cinereus
LTFRDVAVDFSREEWRRLSPAQRALYRDVMLENYGNLGGCGASSVQTRHDLPVGERRSAMDARVIGLPSLFLLGCLGSAGDKWSKSSKEQTVPQN

SEQ ID NO: 33003 - protein, 93 aa, Phascolarctos cinereus
VTFKDVAVDFTWEEWGQLGPSQKELYREVMLENYRNLVCLDWDTRPDIKESSPKLSMSIKEPSQKTLPWGGLCVSKLRCSWEYGAELERQLSQ

SEQ ID NO: 33004 - protein, 87 aa, Canis lupus
IEEKDVTVNFTLEEWALLNPSQKKLYRDVMQETFRNLASIGRDDIILTYLINQKSSITHSYCRIHERTHTGEKPYECKQCGKAFSYA

SEQ ID NO: 33005 - protein, 90 aa, Desmodus rotundus
VVFEDVAVDFTLEEWALLNAAQRELYREVMLETLRNLASVDDETQFKANRSVFQQDIYGNKISNEDKIAKFARNSWVPVLGKIWEELSVE

SEQ ID NO: 33006 - protein, 87 aa, Macaca fascicularis
LSFEDVAVAFTQEEWALLDPSQKNLYRDVMQEIFRNLASVGNKSEDQNIQDDFKNPGRNLSSHVVERLFEIKEGSQYGETFSQDSNL

SEQ ID NO: 33007 - protein, 88 aa, Macaca fascicularis
VTFEDVAVYFSQEEWRLLDEAQRLLCRNVMLENFSLLASLGCWHGAEAEEAPEQSASVGLCSSNVQQHQKQHCGEKSLKRQEGRVPVL

SEQ ID NO: 33008 - protein, 99 aa, Phascolarctos cinereus
VTFEDLAVKFSSDEWHLLEEWQREFHRDVMRENYETLVSLVGQQQGSLHLNALVRLVKEIPEFLFGETKAMDTPETPESKESGSEGERLSLEAAMTVDA

SEQ ID NO: 33009 - protein, 88 aa, Lynx canadensis
VTFEDVTLGFTSDEWGLLDLEKKSLYREVMLENYRNLVSVECPAAQLDPQVDPLPAGNPLMKIEVVEVLTLNQEVARPRNAQIRALYA

SEQ ID NO: 33010 - protein, 84 aa, Lynx canadensis
VTFGDVAVDFSQEEWEWLNPAQRNLYRKVMLENYRSLVSLDWEYAFKNNAFSSKQVIYEESSKVLTMGRSHLSYSLDCPSLRED

SEQ ID NO: 33011 - protein, 82 aa, Lynx canadensis
VVFEDVAIHFSQEEWGLLDGAQRLLYRAVMMENLALLSSLGCWHGAQDEEASQVRTPKPGSSVQEAQCEKDMLPSAEQDGMY

SEQ ID NO: 33012 - protein, 87 aa, Macaca fascicularis
VTFRDVTVDFTQEEWQQLEPAQKDLYRDVMLENYRNLVSLDWETRPEMKELDPKKDISEDKPSVVGVATGGPTRNSARGPGSEGVWE

SEQ ID NO: 33013 - protein, 88 aa, Canis lupus
VVFEDVAVDFTQEEWALLDLAQRSLYRDVMLENFQNLASLGFKIQLKTNESAQDIYEQKISSEQKIVRFKRNDSWSSILHQNWEYHDT

SEQ ID NO: 33014 - protein, 87 aa, Canis lupus
VAFEDVTVNFTLEEWALLNPSQKKLYRDVMQETFRNLASIGRDDIILTYLINQKSSITHSLINAVIRGDRWKGHMSVNKSAMMTRPC

SEQ ID NO: 33015 - protein, 93 aa, Macaca fascicularis
VAFEDVAVNFTQEEWALLGPSQKNLYRYVMQETIRNLDCIRKIWEGQNTEDQKKNPRRNLRCHMLERFSESKDSSQCGETFSLIRGSIVNNSI

SEQ ID NO: 33016 - protein, 86 aa, Phascolarctos cinereus
VTFKDVTVDFTQEEWGQLGPPQRNLYRDVMLENYQNLVSLAPDQCSGRGQPLGQRLHTRENRFECNECEKSFSWRSSLIYHQRIYT

SEQ ID NO: 33017 - protein, 84 aa, Ailuropoda melanoleuca
ISFEDVTVNFTQEEWGQLDPDQRALYRDVMLENYSIFISLGSFSYVLYHFSLSRHCITKPGEILKLEQEAPWVLEKECASQCMF

SEQ ID NO: 33018 - protein, 85 aa, Lynx canadensis
VTFEDIAVDFTKEEWALLDTSQRKLFRDVMLESINHLIFLGDCKRSFQLEQEGELQSEGTGFLQEHSPGEQQGSVGQEEQVPTVS

SEQ ID NO: 33019 - protein, 88 aa, Macaca fascicularis
LTFRDVKIEFSLEEWQCLDTAQRNLYRDVMLENYRNLVFLVICSHFTQDVWPEQSIKDSFQKVILRTCGKYGHENLQLRKDHKSVDAC

SEQ ID NO: 33020 - protein, 83 aa, Macaca fascicularis
VAFEDVAVNFTQEEWSLLDPSQKNLYREVMQETLRNLASIGEKWKDENIEDQYKNPRNNLRSLLGERVDENTEENHCGEIFSQ

SEQ ID NO: 33021 - protein, 88 aa, Ailuropoda melanoleuca
VVFADVAVNFTPEEWALLDGGQRRLYRDVMLETCRNLASLGSCGAVQAGFTGGSVPSEQSTRPRLDQVLEKGMHLHTSIRNGHVRGHC

SEQ ID NO: 33022 - protein, 83 aa, Ailuropoda melanoleuca
MLFEDLAVYFSQEEYVSLHPAQRSLSRDTIQECFEDMALMATGGEGKTEISQQLNLESTGFEELAPGNSSITVPLVYYPEKSD

SEQ ID NO: 33023 - protein, 85 aa, Phyllostomus discolor
LSFSDVAVYFTWEEWQLLDTAQRNLYQDVMLENHSNLMSLGPNTAQVLCDYPLAGCQATKPEAMVCLEKEEQGIIEREFPSHFSP

SEQ ID NO: 33024 - protein, 83 aa, Macaca fascicularis
VTFKDVAVVFTEDELGLLDPAQRKLYRDVMLENFRNLLSVGNQPFHQDTFHFLRKEKLRMMKTTSQRGGNSGGKIQIEMETVP

SEQ ID NO: 33025 - protein, 87 aa, Ailuropoda melanoleuca
VTFKDVAVVFTEEELGLLDPAQRKLYGDVMLENFRNLISVGEDRRPVDLSPLRCLLYPWLWPHLILFILLGDKNLNDLETLQEIGLK

SEQ ID NO: 33026 - protein, 83 aa, Macaca fascicularis
LTFRDVAIEFSLEEWQCLDTAQQDLYRKVMLENYRNLRIRARFMLFIFNKAGIDVSKPNLITCLEQGKYPWNMKRHSMVVKPP

SEQ ID NO: 33027 - protein, 90 aa, Puma concolor
VTFSDVAIDFSQEEWACLDSSQRDLYWDVMLENYSNLVSLDLESPYGTKSLPTEKGIYEINLSRWNSNGKSKSLSLNWMCEGEFERSQGP

SEQ ID NO: 33028 - protein, 90 aa, Ailuropoda melanoleuca
VTFSDVAIDFSQEEWACLDSTQRDLYWDVMLENYSNLVSLDLESPYGTKSLPTEKGIYEINLSKRNSNGKSKSLGLDWMCEGEFEGPQGP

SEQ ID NO: 33029 - protein, 88 aa, Ailuropoda melanoleuca
LTFEDVAVGLIQEWALLDGARRNLCQFVILDKCRILAPRGVGSPPCKPSLGSQVGPEEELRTPRVWVNVCGVPTGWGSDWESQLKSKA

SEQ ID NO: 33030 - protein, 89 aa, Myotis lucifugus
VTFEDIALYFSREEWSLLDEGQRQLYLNVMLENFELTSSQGCCCGAENVEAPTEQKVSVRVSQAGIPKLPLSSEESHPCERCGLVLEKI

SEQ ID NO: 33031 - protein, 91 aa, Canis lupus
VTFEDVAVYFSWEEWGLLDEAQRLLYRDVMLENFSLMASLGWWHRAEIEEGPLEQNVYLKGVLREKLQHQRLHCGEKPLRREEAGEVGKDF

SEQ ID NO: 33032 - protein, 86 aa, Canis lupus
VTYEDVAVDFTQEEWQHLDPAQKTLHRDVMLEIYSHLVSVDREESFDSSQQVISEELLFQKEIMETSPKDNSLYSLLKVWHIDGQI

SEQ ID NO: 33033 - protein, 90 aa, Muntiacus muntjak
VTFSDVAIDFSQEEWACLDSRQRDLYWDVMLENYSNLVSLDLESPYETKSLPSQKNTYGMNFSKGTSNRKSKSRGLNWTCEGELDRSRAP

SEQ ID NO: 33034 - protein, 90 aa, Muntiacus muntjak
VMFRDVAINFSQEEWDCLDSAQRDLYRDVMLENYSNLVSLELPSRGANKLLSPKEDIYEIELSQWEMSARLENCDLENSSSRDYLEVKGT

SEQ ID NO: 33035 - protein, 88 aa, Gorilla gorilla
LTFRDVKIEFSLEEWQCLDTAQRNLYRDVMLENYRNLVFLVMCSHFAQDVWPEHSIKDSFQKMILRTYGKYGHENLQLRKDHKSVDAC

SEQ ID NO: 33036 - protein, 92 aa, Ailuropoda melanoleuca
VSFKDVAVTFTGEEWRHLDLAQRTLYREVMLETCGLLVSLGGAWAGTVDGEERPLQKHLHRMRSSSIVIPTGFPSGEKPYKCSECGKAFKRR

SEQ ID NO: 33037 - protein, 90 aa, Lynx canadensis
VTFSDVAIDFSQEEWACLDSSQRDLYWDVMLENYSNLVSLDLESPYGTKSLPTEKGIYEINLSRWNSNGKSKSLGLNWMCEGEFERSQGP

SEQ ID NO: 33038 - protein, 84 aa, Crocuta crocuta
LTFRDVAIEFSQEEWGRLSHSQRDLYRDVMLENYGHLLFLGEDKCLQFSQNTLRFLFLPALVTFLEQKRELWDVKSKDTVALYP

SEQ ID NO: 33039 - protein, 84 aa, Nomascus leucogenys
VVFEDVAVDFTLEEWALLDSAQRNLYRDVISVARFEMWERTKTDMFTQDMYGQDKSKEQTIPTFTGNNSCAYTLEKNGRQITRS

SEQ ID NO: 33040 - protein, 102 aa, Muntiacus muntjak
FTFRDVAIEFSQEEWECLAPSQKALYRDVMLETYRNLVSLGILSVGFAINKLSPRENTNVGELYGNENHGIKDFGLEEVCENMQKSESEWGCDARNDKELLL

SEQ ID NO: 33041 - protein, 87 aa, Muntiacus muntjak
VTFEDVAVNFTLEEWAFLDPSQKKLYRDVMRETLRNLISIGEKWEDHAIEDQYKNQGRKLRSHVVERLCESKEGSQRGENFSIIPNL

SEQ ID NO: 33042 - protein, 87 aa, Phyllostomus discolor
VAFEDVAVNFSLEEWALLDPSQKKLYRDVMRETLRNLASVGRKWEDHNIEDQYKNQGRNLRCHMVERLCESKEGSQCGENFSHISNL

SEQ ID NO: 33043 - protein, 104 aa, Macaca fascicularis
VTFEDVSVDFSQEEWELLEPAQKNLYREVMLENYRNVVSLEALKNQCTDAGIKKGSLSPAQTPQVTSLSSWTRYVLLQPAASSHLEQREALWMEEKGTPQASCA

SEQ ID NO: 33044 - protein, 87 aa, Nomascus leucogenys
VVFEDVAVYFTRIEWGCLAPDQQALYRDVMLENYGNLASLGSPRSLSLLSVGHPLPVSFPFLLSDSRMEAGIMESPQQRKLSRGNGV

SEQ ID NO: 33045 - protein, 96 aa, Canis lupus
VTFEDVAVYFSLEEWERLDTDQRDLYKDVMQENYGILVSLEATGGEESDDRGDEGVEGLSRRAAGYPIPKPDLIFRLEQGEEPWVPDSPRPEEGDI

SEQ ID NO: 33046 - protein, 87 aa, Lynx canadensis
VAFEDVTVKFTMEEWALLDPSQKKLYRDVMQETFRNLASIEEKWEVYDSEDRDENHGTHLISQMVGRLCKCKECSQYEGIFGQIPNQ

SEQ ID NO: 33047 - protein, 99 aa, Phyllostomus discolor
VTFRDVAIDFSQEEWECLDPAQRDLYVDVMLENYSNLVSLDLESTHETKNTFSGKGISEINFSEWKIKEKSKTLDIVTSIFKNNWKYKSKIEGLQEYQE

SEQ ID NO: 33048 - protein, 91 aa, Lynx canadensis
VSFADVAVYFSPEEWGCLRPAQRALYRDVMRETYGHLGALGGTPNKKEEAPEEGPGTKGPRKTPGKEPSKDLVKHNPDWTVRKVSARAQQP

SEQ ID NO: 33049 - protein, 84 aa, Lynx canadensis
LTFKDVAVVFTEEELRLLDPTQRKLYRDVMLENFQNLLSLGKGNLGDKNEKDLEYIQERELKCLSCRELSYWKIGEQAAGELTG

SEQ ID NO: 33050 - protein, 89 aa, Lynx canadensis
MFSDVSIVFSQEEWEYLDLEQRDLYRDVMLENYSNLVSLDLETRYETKKLSSENDIYEINLPQWKIMERIKNHGLKGLILKSDWESKRK

SEQ ID NO: 33051 - protein, 88 aa, Phyllostomus discolor
VIFEDVTLGFDPEEWGLLDLEHKSLYREVILENYRNLVSVECPKTQLYPHLDPFPAEEPLMKIEVVEVLTLNQEVARSRNAQIRALYA

SEQ ID NO: 33052 - protein, 87 aa, Canis lupus
VAFEDVAVNFTLEEWALLEPSQKKLYRDVMQETLRNLASIGKTWKDYNSEDQYKNQGRKLRSHMVERLNQSKEGSQCGGNFSPIPNL

SEQ ID NO: 33053 - protein, 87 aa, Desmodus rotundus
VAFEDVAVNFSLEEWALLNPSQKQLYRDVMRETFRNLASIGGKWKDPDIEDQYKKQGRKLRSHMVEKLCESKENSQCEENFNLISNF

SEQ ID NO: 33054 - protein, 85 aa, Macaca fascicularis
EDVAVDFTLEEWALLDSAQRDLYRDVISVSRFEMWERTKQDTYREEKSKEQTIPNFTRNNSCAYTLEKTCEGYGTEDHHKNLRNR

SEQ ID NO: 33055 - protein, 90 aa, Nomascus leucogenys
VTFEDVAVTFTQEEWGQLDVTQRALYVEVMLETCGLLVALGDSTKPETVEPIPSHLALPEEVSLQEQLAQEVPGYSYWGQAMDQDGPSEM

SEQ ID NO: 33056 - protein, 85 aa, Gorilla gorilla
VAFEDVAVNFSQEEWSLLSEVQRCLYHDVMLENWVLISSLGCWCGSEDEEAPSKKSISIQRVSQSLHLSAQAGVARSQLTAASAS

SEQ ID NO: 33057 - protein, 90 aa, Phyllostomus discolor
VAFEDVSVKFTLEEWALLDSSQKKLYRDVMRETFRNLASIGEICKDRDIEDHYKHHGTNLSSHKVERLGKSKQGSQCGENFSQIPNHNQK

SEQ ID NO: 33058 - protein, 87 aa, Phyllostomus discolor
VAFEDVAVNFSLEEWALLDSLQKKLYRDVMQETFRNLASVRKKWEDHDIEVQYKHQGRRRRNPLLERLCGGERSSQCGENFSLFPDL

SEQ ID NO: 33059 - protein, 87 aa, Muntiacus muntjak
VTFEDVFVYFSREEWELLEEAQRLLYRDVMLENFALVSSLAAPTSAAGNFEMKYLGVTVSAPAITGTITPVDAFHKQNSHAPGKASM

SEQ ID NO: 33060 - protein, 85 aa, Canis lupus
VTFKDVLVTFTQEEWELLDLHQRTLYWKVMTETRRLLVSLGKSSPCLYVGTCLHPVYDKAKANTTEPSASQPALFERFSPHTLLT

SEQ ID NO: 33061 - protein, 85 aa, Ailuropoda melanoleuca
VSFADVAVYFSPEEWGCLRPAQRALYRDVMRETYGHLGALGEARRRTQCFPSAGFSGPKPAFISWVEGEVEAWSPEAQDPEGESP

SEQ ID NO: 33062 - protein, 87 aa, Ailuropoda melanoleuca
VTFEDVAVEFTQEEWTLLDQTQRRLCRDVMLENYKSLAAIELTAAKFCSSVFCITSGHIFGITVFPSAENSKFNWNTDISTHKPIVD

SEQ ID NO: 33063 - protein, 87 aa, Gorilla gorilla
VSFKDVAVDFTQEEWGQLDSPQRALYRDVMLENYQNLLALEWELKAVPSQQQGICKEEPAQEPIMERPLGGAQAWGRQAGALQRSQA

SEQ ID NO: 33064 - protein, 83 aa, Gorilla gorilla
VTFEDVFVYFSREEWELLEEAQRFLYRDVMLENFALVATLGFWCEAEHEAPSEQSVFVEGVSQVRTAESGLFQKAHPCEMCDP

SEQ ID NO: 33065 - protein, 88 aa, Lynx canadensis
LTFRDVAIEFSQDEWGCLNQSQRELYRDVMLETCGHLLFLASYYICPSHGRTSAIQHIMLLHSLRILSSVPVMVHHLHSECQETPLGA

SEQ ID NO: 33066 - protein, 94 aa, Lynx canadensis
LTFRDVAIEFSQDEWGCLNQSQRELYRDVMLETYGHLLFLDSFGKRTQKGENTSKYDECGKALKQSSSIAGHQRIRVGENPYTGNESGNMFSQS

SEQ ID NO: 33067 - protein, 111 aa, Lynx canadensis
VTFKDIAVDFTQEEWALLDASQRKLYRDVMLENIGHLVSVGESVNTDKFIQQVSSFHLIPPLSALIQILSWFLTLFEHNLFFLILTYTYFVTPKEYSFPDPSFVPFLLLGL

SEQ ID NO: 33068 - protein, 94 aa, Phyllostomus discolor
VTFRDVMVDFTQEEWQQLKPAQKDLYRDVMMEIYWNLVSLVCPLFSGCALCLGKILSAVVNYMCVLISFPLPSDLETRPDTKESDPQENNCEDR

SEQ ID NO: 33069 - protein, 90 aa, Phyllostomus discolor
VVFADVAVDFTLEEWALLDAAQRELYRDVMLETLRNLASVDDETQFKANRSVFQQDIDGNKISKEDKIAKFARNSRVSVLGKIWEELSVE

SEQ ID NO: 33070 - protein, 87 aa, Macaca fascicularis
VAFEDVSVSFSQEEWALLAPSQKKLYRDVMQETFKNLASIGEKWEDQNVEDQHKNQGRNLRSHMGERLSEGKESSQCAETVSPNLSV

SEQ ID NO: 33071 - protein, 82 aa, Lynx canadensis
LTFRDVAIEFSQEEWGCLNHSQRELYRDVMLETYGHLLFLAVSSQCTQNFLPKPCLEPFLQKVSMGEHSTLENLHLMIDCDN

SEQ ID NO: 33072 - protein, 112 aa, Phyllostomus discolor
VVFADVAVDFTLEEWALLDSAQRNLYRDVMLENFQNLASVANNGEDQSIDDEQQNHRRPLRNHVVDSFCEHNDGNQHGETFIHIPNLNLHKTISMGIKPYECTKCGKGFTHL

SEQ ID NO: 33073 - protein, 87 aa, Macaca fascicularis
VAFEDVSVSFSQEEWALLAPSQKKLYRDVMQETFKNLASIGEKWEDQNVEDQHKNQGRNLRSHMGERLCEGKESSQCAETVSPNLSV

SEQ ID NO: 33074 - protein, 87 aa, Ailuropoda melanoleuca
VAFEDVTVKFTMEEWALLDPSQKKLYRDVMQETFRNLASIEEKWEIHDREDQDENHGANLSSQMVERLCKSKEYSQYEEIFSQIPYH

SEQ ID NO: 33075 - protein, 90 aa, Ailuropoda melanoleuca
LTFRDVAIEFSPEEWECLDPAQRALYRDVMVENYRNLLSLADKALGRTQDVIYRFPCQQESLSELNIISPVEQGRALGRQEWGETSHKTQ

SEQ ID NO: 33076 - protein, 104 aa, Lynx canadensis
MTFEDVAVYFSQEEWRLLDEAQRRLYRDVMLEVFALVVSLGCWHGAGAEEAPSEQSVPLGVSQVSIAKADLSPHEVRSPDSEGDLHPAESPGASPGQKVCGTGG

SEQ ID NO: 33077 - protein, 87 aa, Phyllostomus discolor
LAIEDVVVIFTLEEWALLDSSQKKLYKDVMRKTFKNLASIGKKWNTHDIEELYKNQGRKLRNYMVEKLCKNKEGSQCGENFILISNR

SEQ ID NO: 33078 - protein, 84 aa, Phyllostomus discolor
VTFEDVFVYFSREEWGLLDEAQRCLYRDVMLENFALVSSLGCWREVDHEEAPSDQSASAEVLPVRTLESGLFIQKTHLCELCDP

SEQ ID NO: 33079 - protein, 88 aa, Macaca fascicularis
VNFEDVTLGFTPEEWGLLDLKQKSLYREVMLENYRNLVSVEYSELQLDPKLDPLPAESPLMNIEVVEVLTLNQEVAGPRNAQIQALYA

SEQ ID NO: 33080 - protein, 83 aa, Macaca fascicularis
VTFKDVAVVFSEEELRLLDLAQRKLYREVMLENFRNLLSVGHQPLHRDTFHFLKEEKFWMMETVTQREGNLGDKIQTEMETVP

SEQ ID NO: 33081 - protein, 89 aa, Lynx canadensis
ENFKIVTVDFTQKEEGTLNPVQRTLDRDVNLENHRDLVSWDLATALGRRESISKQNIFDDEPFHGVKLERLTRDDPWLASCEEVRDCKD

SEQ ID NO: 33082 - protein, 93 aa, Lynx canadensis
LTFRDVAIEFSQEEWECLDPAQRALYRDVMLENYRNLVSLGEDNFPPEVGNYFYVCIFFFFFLIFFFPNVYLFMWDRETEHERGRGRERGRHR

SEQ ID NO: 33083 - protein, 87 aa, Desmodus rotundus
VAIEDVAVDFTLEEWALLDPPQKKLFRDVMQETFKNLDSVGKKWEDHDIEDQDKNQGRKLRSQMVERLYESKEDSQCGENFSLISNL

SEQ ID NO: 33084 - protein, 87 aa, Macaca fascicularis
VSFKDVAVDFTQEEWGQLDSPQRALYRDVMLENYQNLLALEWQLKAVPSQQQGICKEEPAQEPITERPLGGAQAWGRQAGALQRSQA

SEQ ID NO: 33085 - protein, 85 aa, Macaca fascicularis
MASPSPPPESKEEWDYLDPAQRSLYKDVMMENYGNLVSLGLTVLLRLVCSDANMACCSLNLLGLSDQSSHLSYLSSWDYRCFEQR

SEQ ID NO: 33086 - protein, 99 aa, Lynx canadensis
ESGWDVAIEFSRKELGCLNHSQWELYRDVMLENYGHLLYLGEDNSFHIAQTTLRDLFLPLKTVSWNLPLCMTGIQIPAVRERSRGLWMYRKISMVFPFQ

SEQ ID NO: 33087 - protein, 90 aa, Phyllostomus discolor
VAFRDVIVDFTQEEWQQLKPAQKDLYRDVMMEIYWNLVSLDLETEGDMNEPDPEKDSWEDRTSIVVVEGLMRNGAQGYACEKAGIQGCRV

SEQ ID NO: 33088 - protein, 85 aa, Macaca fascicularis
VTFDDVALYFSEQEWEILEKWQKQMYKQEMKTNYQTLDSLDHEGTLRTKEEDCRLNGPQKQDLGAALPGKERKILSARRDTFQSP

SEQ ID NO: 33089 - protein, 85 aa, Muntiacus muntjak
VTFEDVAVYFSQEEWGLLDEAQRHLYHKVMLENFALTASMVCLHETETKETPSEQNVSLEALSQVRTPKVGPFTENAHPCEKCVP

SEQ ID NO: 33090 - protein, 97 aa, Lynx canadensis
VTFDDVAVTFTQEEWGQLDPAQRTLYQEVMLETCRLLVSLGDNVKPETTEPSPSHLALSEETSPREQRTSRAPGYFQLGQGKSQDRPSEMLEGQLEP

SEQ ID NO: 33091 - protein, 86 aa, Canis lupus
MAFRDVAVNFSQEEWMLLSPAQRSLYREVMLENYSNLVSLAEPKPELHLCPLCPSDFSSQKRHTQHMLCNHPPWVFACLCAETHVD

SEQ ID NO: 33092 - protein, 82 aa, Ailuropoda melanoleuca
VMFRDVAIDFSQEEWEYLDSAQRDLYRDVMLENYSNLVSLVDLPSRSANKDLSPKKDTYETELSQWEMSARLENCDLEESSS

SEQ ID NO: 33093 - protein, 88 aa, Ailuropoda melanoleuca
VNFKIVTVDFTQKEEGTLNPAQRTLDRDVILENQRDLVSWDLAPALGRRESTSKNIFDDEPSHRVKLERLTRDDPWLSSCEEVQDCKD

SEQ ID NO: 33094 - protein, 97 aa, Macaca fascicularis
VTFADVAVNFTKEEWTLLDPAQRNLYRDVMLENSRNLAFIDWATPCETKDATPQPDILPKRTYPEANSVCLTSISSQLSTLREDWRCPKTEGPHRQG

SEQ ID NO: 33095 - protein, 83 aa, Macaca fascicularis
FTFKDVAIEFSQEEWEYLDPAQRALYRDVMLENYRNLLSLDEDNVLPENDISVGFTSKGLSPKENNKEELYHLVILERKESHG

SEQ ID NO: 33096 - protein, 86 aa, Bos indicus
FLQKQQKMITLQEEWQHLDPAQRMLYRDVMLENYSHLISVELINNSRKKFDFNKGRKWSHDDKHERIHYGEKSYEYNKNENGLCLN

SEQ ID NO: 33097 - protein, 85 aa, Ailuropoda melanoleuca
VTFKDVAVVFTEEELGLLDPAQRKLYGDVMLENFRNLISVGEKPYQCAECGKGFSVGSQLQAHQRCHTGEKPYQCEECGKGFCRA

SEQ ID NO: 33098 - protein, 84 aa, Phyllostomus discolor
VTFEDVVVYFSWEEWGLLDETQRCLYHDVMLENFALVISLGSWYGMEEEALSMQSVSVAQTSPSLTPNPDPAIEENHPCEKCIL

SEQ ID NO: 33099 - protein, 87 aa, Rhinopithecus roxellana
VAFEDVAVNFTQEEWALLDPSQKNLYREVMQETLRNLASIGKKWNNQYIEDEHQNPRRNLRRLIKERLSESKESHQHGEFLTQVPDD

SEQ ID NO: 33100 - protein, 103 aa, Cebus imitator
VNFEDVFVYFSQEEWVLLDEAQRLLYRDVMLENFALMASLGKAITSTPVTWTGPCPSLVATGTLSGRLSQIRIPKGSPFTQKETHPGQKPYIREKSKAFLVNN

SEQ ID NO: 33101 - protein, 84 aa, Cebus imitator
VTLEDVAIYFSQEEWGLLDEAQRLLYRDVMLENFALLTSLVCWHGIEDEETPEQSVSVKGVPQVRTPEASPSIQKTQSCDMCVP

SEQ ID NO: 33102 - protein, 87 aa, Macaca mulatta
VTFDDVAVDFTPEEWALLDTTEKYLYRDVMLENYMNLASVEWEIQPRIKRSSFQQGFLKNQISSGIQMTRGYSGWKLCDCKNCGEVF

SEQ ID NO: 33103 - protein, 89 aa, Ovis aries
VVFEDVAVNFTLEEWALLDSAQKELYRDVMLETFRNLASVDDETQCKANGSISQQDIYGNKIPKEHKISKFIGNDSWPFVLGKIWEELS

SEQ ID NO: 33104 - protein, 84 aa, Rhinopithecus roxellana
VTFRDVAVIFTEAEWKRLSPEQRNLYKEVMLENYRNLLSLDRVSLLLPRLECNGAISAHHNLCLPGSRDSPASASQVAGITAEP

SEQ ID NO: 33105 - protein, 87 aa, Rhinopithecus roxellana
VVFEDVAIYFSQEEWGHLDEAQRLLYRDVMLENLALLSSLGCWHGAEDEEAPSQQGFSVGVPEVTTSKSCLSTQKVHPSETCGPPLK

SEQ ID NO: 33106 - protein, 87 aa, Cebus imitator
VASEDVAVNFTLEEWALLDPSQKKLYRDVMRETFRNLACVGKKWEDQSIEDWYKNQGRILSNHVGVGLSESKEHDQCGEAFSQILNL

SEQ ID NO: 33107 - protein, 93 aa, Callithrix jacchus
VTFEDVAVKFSLEEWNLLNDAQRCLYGDVMLETMTLISSLGKEFNPRSFLRNQIVLFHPCRNVNIATTMANIDLISSYYSQISVTVLEEIVTC

SEQ ID NO: 33108 - protein, 104 aa, Callithrix jacchus
VTFEDVSVDFSQEEWELLDPAQKELYREVTLENYRNLVSLEALKNPCADAGMEEGPFSTAHTPQATRLSSWMWHLRLQPVASAHVEQSEALWMEERGTPRASCS

SEQ ID NO: 33109 - protein, 93 aa, Rhinopithecus roxellana
VSFEDVAVAFTQEEWALLDPSQKNLYRDVMQEIFRNLASVGNKLEDQNIQEDFKNPGRNLSSHVVERLFEIKEVSQYGETFSQDSNLNLNKKV

SEQ ID NO: 33110 - protein, 87 aa, Rhinopithecus roxellana
VAFEDVAVNFTHEEWALLGPSQKNLYRDVMRETIRNLNCVGMKWENQNIDDQYQNLRRNPRCDVVERLGKSKDGSQCGETLSQIRNS

SEQ ID NO: 33111 - protein, 87 aa, Cebus imitator
VSFKDVAVDFTQEEWGQLDSPQRALYRDVMLENYQNLLALEWEMKEVPPQQQGMCKEELAQEPTLEWPLGGAQAWGRQACALQRSQA

SEQ ID NO: 33112 - protein, 84 aa, Macaca mulatta
LAFRDVSIDLSQEEWECLNPAQRDLYKDVMLENYSNLVSLDLEYKYITTNLLSEKNVCKLYLSQLHTGEKSKNTIHEDTIFRNA

SEQ ID NO: 33113 - protein, 94 aa, Macaca mulatta
MVFEDVAIHFSQEEWGILNGVQRHLHSDVMLENFALLSSVGCWHGAKDEEAPSKQCVSVGVSQVTTLKPALCTQKAPPCETCSSLLKDILHLAE

SEQ ID NO: 33114 - protein, 87 aa, Macaca mulatta
VAFEDVAVNFTHEEWALLCPSQKNLYRDVMRETIRNLNCVGMKWENQNIDDQYQNLRRNPRCDVVERFGKSKDGSQCEETLSQIRNS

SEQ ID NO: 33115 - protein, 85 aa, Callithrix jacchus
GFHRDVSVEFSSAEWKCLTPAQRALYRDVMLENYRNLESVGEENVPPDTRNPSLFIWALPGLYSLIHRISPCWPGWSQISDLIIC

SEQ ID NO: 33116 - protein, 90 aa, Ovis aries
VTFSDVAIDFSQEEWACLDSRQRDLYWDVMLENYSNLVSLDLESPYETKSLPSQKNTYGMNFSKRTSNRKSKSRGLGWTCEGELDRSRAP

SEQ ID NO: 33117 - protein, 90 aa, Ovis aries
VMFRDVAIDFSQEEWDCLDSAQRDLYRDVMLENYSNLVSLDLPSRRANKLLSPKKDIYETELSQWEMSARLENCDLENSSSRDYLEVKGT

SEQ ID NO: 33118 - protein, 90 aa, Bison bison
LTFKDVFIDFTPEEWECLDPAQRTLYKDVMVETLRILLSMDMSDTHINQKLPTKVNSDKGEVFHTVMLGRPESREITDFFLREIQENLHE

SEQ ID NO: 33119 - protein, 90 aa, Cebus imitator
VTFADVAIDFSQEEWACLNSAQRDLYWDVMLENYSNVVSLDLESAYETKNLPTEKSLHEVRVSKRNSDRRSKSLGHNWIYEGTPERPQRS

SEQ ID NO: 33120 - protein, 98 aa, Cebus imitator
VTFEDVFVYFSREEWELLEEAQRFLYRDVMLENFALVATLAFIFPVSCSCPSGEGQKALVNVDFTSIFLLSGFWCETENEEAPSEQSISVGGVSQVRT

SEQ ID NO: 33121 - protein, 84 aa, Callithrix jacchus
MDVAIEFSLEEWQCLDTAQQNLYRNVMLENYRNFVFLVIYSDFAKDLWPEQDIKNTFQQVILTRYGKCGHQNLQLRKSCKSVDQ

SEQ ID NO: 33122 - protein, 97 aa, Rhinopithecus bieti
VTFADVAVNFTKEEWTLLDPAQRNLYRDVMLENSRNLAFIDWATPCETKDATPQPDILPKRTFSEANRVCLTSISSQLSTLREDWRCPKREGPHRQG

SEQ ID NO: 33123 - protein, 87 aa, Rhinopithecus roxellana
VSFEDVAVNFTLEEWALLDSSQKKLYEDVMQETFKNLVCLGKKWEDQDIEDDHRNQGRNRRGHMVERLCESRRGSKCGETTSQMPNV

SEQ ID NO: 33124 - protein, 87 aa, Rhinopithecus roxellana
VAFEDVAVNFSQEEWSLLSEVQRCLYHDVMLENWVLISSLGYWCGSEDEEAPSKQSISIQRVSQVNTPRVGVSPKKAHSCEMCGAIL

SEQ ID NO: 33125 - protein, 89 aa, Bison bison
VVFEDVAVNFTLEEWALLDSSQKELYRDVMLETFRNLASVDGETQYKANGSVSQQDIYRNKISKEHKISKFTGNDSWPFVLGKIWEELS

SEQ ID NO: 33126 - protein, 87 aa, Callithrix jacchus
VTFDDVAVEFTPEEWALLDTTQKYLYRDVMLENYKNLASMEWEIQPRTQGLSLQQRFLKNEIFNGIQMQTSYSGWKLCKNCGEVFSE

SEQ ID NO: 33127 - protein, 82 aa, Rhinopithecus roxellana
VTFEDVAVNFSLEEWSLLNEAQRCLYRDVMLETLTLISSLGGVPPHRLFPTGACGPQVPSSRIRPSSGHCPRPSLYLSFSPP

SEQ ID NO: 33128 - protein, 84 aa, Rhinopithecus roxellana
LAFRDVALEFSPEEWECLDPAQRNLYRDVMLENYRNLFSLGEDHFNMQFLFHRLAMSKPELIICLEARKEPWNVNTEKTAKHSA

SEQ ID NO: 33129 - protein, 85 aa, Odocoileus virginianus
VTFEDVAVNFSWEEWGLLDESQKRLYHDVMLENLALISSLASCVVFWLALRGVRSRIQDADLPKPSPTLTLPWIQSRYTLKKTRD

SEQ ID NO: 33130 - protein, 87 aa, Odocoileus virginianus
VTFEDVAVNFTLEEWAFLDPSQKKLYRDVMRETLRNLISIGEKWEDHDIEDQYKNQGRKLRSHVVERLCESKEGSQCGENFSIIPNF

SEQ ID NO: 33131 - protein, 83 aa, Cebus imitator
LTFKDVAVVFTEEELGLLNPVQRNLYRDVMLENFRNLLSVGHHPFKHGVFLLEGEKKLDMMKKATQRKEKSADKIHSEMEAGP

SEQ ID NO: 33132 - protein, 88 aa, Cebus imitator
VTFDDVAVDFTQEEWTLLDPSQRDLYRDVMLENYENLASVEWQLESKGSALQQDRAWFRASDETQMARSHSGGQLCDRMQCGEAVSEP

SEQ ID NO: 33133 - protein, 85 aa, Callithrix jacchus
VTFDDVAVEFTPEEWALLDTTQKYLYRDVMLENYKNLASVEWEIQPRSQGPSHQQGFLKNEIFSGLQMERSYRLGKLCDCKNCGE

SEQ ID NO: 33134 - protein, 82 aa, Rhinopithecus roxellana
MTFEDVAIYFSQEEWELLDESQRFLYCDVMLENFAHVTSLGYCHGTENEVIASEQSVSTQVRTSKGDTPPQKSLSEIKMCVP

SEQ ID NO: 33135 - protein, 82 aa, Bison bison
LTFEDVALYFSKEEWKIMTPDEKTLYLDVMQELYEDVASVGLKLKNDPENDPPVSLPTLEIQPSGCEVLGKATMKDAETTVG

SEQ ID NO: 33136 - protein, 85 aa, Bison bison
VTFEDVALSFSWKEWKLLDAAQRRLYHDVMVENYALISSLASCVVFWLALRGVRSRIQDADLHKPIPTLTLPWIQVRCLEDPVEL

SEQ ID NO: 33137 - protein, 92 aa, Bison bison
VPFDDVAVYFSEQEWGKLDEWQKELYKHVMRGNYETLVSLDDVCVIAGLKATRCAYEVGADYAISKPEVLSQIEQGKEPCSWRRAGPKVPDV

SEQ ID NO: 33138 - protein, 97 aa, Callithrix jacchus
LTFEDVAVLFTRDEWRKLAPSQRNLYRDVMLENYRNLVSLGKEISLLETEFKRLKSSRKTTKSTQTQDSSFQGLILKRSNRNGPWDLKLEKPYIYES

SEQ ID NO: 33139 - protein, 88 aa, Bos taurus
LSFKDVAVDFTWEEWQLLTPAQKTLYRDVMLENYSNLVSVAPAQFSGTKSSIISHKRYRVSKSDVLFKLEQGEERWMTEDEIHSHTWP

SEQ ID NO: 33140 - protein, 86 aa, Bos taurus
FTFKDVALEFTQEEWECLDPAQRALYKDVINYCLTHAYKDFSPMISFNRLIVLGFTFESLIHLASSFVCGMKQGSTFVFFHDDIQL

SEQ ID NO: 33141 - protein, 87 aa, Rhinopithecus roxellana
VTFEDVAVTFTQEEWGQLDVTQRALYVEVMLETCGLLVALGDSTKPETVEPNPSHLALPEEVSLQEQLAQGVPGYSYFGQAMDQDGP

SEQ ID NO: 33142 - protein, 86 aa, Cebus imitator
VAFEDVAVYFSQEEWRLLDEAQRLLYRNVMLENFSLMASLGCWHGVEAKEAPKQSASVGAPGSNVQQHQKQHCGEEPLKREEGRIP

SEQ ID NO: 33143 - protein, 89 aa, Bos taurus
VVFEDVAVNFTLEEWALLDSSQKELYRDVMLETFRNLASVDGETQYKANGSVSQQDIYRNKISKEHKISKFTGNDSWPFVLGKVWEELS

SEQ ID NO: 33144 - protein, 89 aa, Callorhinus ursinus
VNFKIVTVDFTQKEEGTLNPNQRCDPRDVILENYRDLVSWDLATALGRRESTSKQNIFDDEPSRGVKVERLTRDDPWLSSCEEVQDCKD

SEQ ID NO: 33145 - protein, 86 aa, Callorhinus ursinus
VTFRDVAIEFSPEEWECLDPAQRALYRDVMVENYWNLVSLGEDSFPPEVGCLSAGFEIKELPPIEDINEGELYHLVILERNESHSI

SEQ ID NO: 33146 - protein, 86 aa, Acinonyx jubatus
LTFRDVAIEFSQEEWECLDPAQRALYRDVMLENYRNLVSLGEDNFSPEVGIPSDGFAIKELSPTEDINKGEFYHLVILERNESYGI

SEQ ID NO: 33147 - protein, 83 aa, Rhinopithecus roxellana
FTFKDVAIEFSQEEWECLDPAQRALYRDVMLENYRNLLSLDEDNVPPENDISVGFTSKGLSPKENNKEELYHLVILERKESHG

SEQ ID NO: 33148 - protein, 96 aa, Cebus imitator
VTFEDVAVHLTREEWGYLDPVQRDLYREVMLENYGNVVSLGILLRLPTTRIHSVNSCPALSHTQASAFSGETLAVLTAGISKRWPKYRLPIDIAHP

SEQ ID NO: 33149 - protein, 113 aa, Cebus imitator
VTFEDIAVYFSQEEWGLLDEAQRCLYHDVMLENFSLMTSVGCLHGIGAEEAPSEQTVSLEVSQARTPKPSSSIPNAHSCEMCILVMKDILYLTDHQGTLPWQKPYTSAASGKW

SEQ ID NO: 33150 - protein, 114 aa, Callithrix jacchus
VTFEDIAVYFSREEWGLLDEAQRCLYHDVMLENFSLMTSVGCLHGIGAEEAPSEQIVSVETVSQARTPKPSSSIPNAHSCEMCILVMKDILYLTEHQGTLPWQKPYTSAASGKW

SEQ ID NO: 33151 - protein, 87 aa, Pan troglodytes
VSFEDVAVAFTQEEWALLDPSQKNLYRDVMQEIFRNLASVGNKSEDQNIQDDFKNPGRNLSSHVVERLFEIKEGSQYGETCSQDSNL

SEQ ID NO: 33152 - protein, 90 aa, Rhinopithecus roxellana
VTFRDVAIDFSQKEWECLDTTQRKLYRDVMLENYSNLVSLGLLSRHKTKKLSSEKDIHEISLSKGSIIEKSKTLRLKGSILRNEWQSKSE

SEQ ID NO: 33153 - protein, 83 aa, Rhinopithecus roxellana
VAFEDVAVNFTQEEWALLDIFQKNLYREVMLETFRNLTSIGKSWKDQNIEYEYQNPRRNFRSLIEEKVNEIKEDSHCEETFTQ

SEQ ID NO: 33154 - protein, 96 aa, Bison bison
VTFEDVAVYFSLEEWERLDAEQRELYKEVMRENYGILVSLGEQSPPSAGGILKQLLAGAGKGLLARCLLTSPVVFSSPSGAWFWTDDIEDHEEDDD

SEQ ID NO: 33155 - protein, 86 aa, Bison bison
LTFKDVAMVFSKEDLALLDSAQVNLYQDVMLENFRNLVSVEDRIKNNLMNLQEKGLTYLSPEVLCCLLYFWQIWNQRISELTMSHD

SEQ ID NO: 33156 - protein, 94 aa, Bos taurus
VTFEDVAVYFSQEEWRILDETQRRLYSYVMLETFALVASLGCWQRAEMKEKTSEQNASVEVPQIITSKTDLSIQKAYPWEMGNLDVEGGLHLTE

SEQ ID NO: 33157 - protein, 106 aa, Ovis aries
ITFEDVAVYFSWEEWALLDKAQKLLYCDAMLENFALMASLGYWHGGEDEEAPSGQSVSVEGMSQVRTPKAGPFPYEAHSCEVCVSILKDILHLAEERGTHPKQKPF

SEQ ID NO: 33158 - protein, 109 aa, Callorhinus ursinus
VTFEDVFVYFSREEWEFLEEAQRLLYRDVMLENFALVASLGCWRETDNEETPSEQSISIGLSQLRTPESGAFIQKAHPCEVCDPLLKDVLHLAEHQGSHPLQKLYTRGP

SEQ ID NO: 33159 - protein, 87 aa, Rhinopithecus roxellana
LQFRDVAIEFSLEEWHCLDTAQRNLYRDVMLENYRNLVFLVMCSHFAQDVWSEQSIKDSFQKVILRRYEKCGHDNLQLKKSCESVDE

SEQ ID NO: 33160 - protein, 91 aa, Macaca mulatta
VAFEDVAVNFTQEEWALLDPSQKNLYREVMQETLRNLASIGKKWNNQYIEDEHQNPRRNLRRLTKERLSESEESHQHGEVLMRVPDDTLKK

SEQ ID NO: 33161 - protein, 82 aa, Ovis aries
LTIEDVAIEFTPEEWECLAPAQRTLYWDVMLETYRNLLSVGKDHFPLKESFLLIFHLNIIKNLQPKENTNSTDTFQTVILGR

SEQ ID NO: 33162 - protein, 85 aa, Ovis aries
LTSEDVAIEFTPEEWEFLDPAQRALYRDVMLETYRNLLSVDISPTHVIKHLQPTANNDKPETFQTLMLGSPESCEIKHVHLWESQ

SEQ ID NO: 33163 - protein, 110 aa, Ovis aries
VAFEDVAVNFTLEEWALLGPSQKKLYRDVMRETLSNLALIRDKWEDHNTEDQYRIQERNLRCHTLQRLCESKESSQCGENSSLIPNLNLNTKNSTKPWECSVCGKVFMSR

SEQ ID NO: 33164 - protein, 85 aa, Odocoileus virginianus
VTFEDVAVNFSWEEWGLLDESQKRLYHDVMLENLALISSLASCVVFWLALRGVRSRIQDADLPKPSPTLTLPWIQSSGSIPQTRK

SEQ ID NO: 33165 - protein, 90 aa, Cebus imitator
VAFEDVAVNFTQEEWALLGPSQKSLYRNVMQETIRNLDCIEMKWEDQNIEDQCQNPRRNLRSHTCEVIDDSQCGETFSQISESLVNKNTP

SEQ ID NO: 33166 - protein, 86 aa, Macaca mulatta
VAFEDVAVNFTLEEWALLDPSQKNLYRDVMRETFRNLASIERLCEGKEGSQGEETFSLIPDGVLNKKTPGVKPCERSVCGEVGMGP

SEQ ID NO: 33167 - protein, 103 aa, Bos taurus
MTFQDVAIDFTQEKWECLDLDQRELYRDVMLEKYGNLASLGLVSTLDLVAFLEQWKDPRNMRRMETTAICPGLVVSKVDLVTFLEQMKDPRNISRMETMAMYP

SEQ ID NO: 33168 - protein, 85 aa, Ovis aries
VTFEDVAVNFSWEEWGLLDESHKRLYHDVMLENYALISSLASCVVLWLALFGVRSRIPDADLHRPSLTLTLPWIQVRCLEEPAEL

SEQ ID NO: 33169 - protein, 88 aa, Acinonyx jubatus
VTFEDVVVDFTQEEWGQLEPAQRTLYRDVMLETFRLLVSVDLETRPQTKVSTPTQDITEGIRTSALAERFLWDSLWYSEGDDAEGCHG

SEQ ID NO: 33170 - protein, 104 aa, Cebus imitator
VTLKDVAMDFTLEDWEQFGLDQGDLFWDTALDNYQNLFLLNPPRPNPTSHPDGSEDLEPLARGSPEAVGPDLAETTNSPLMQDFLEEGLSQEIIEMISKEGFWN

SEQ ID NO: 33171 - protein, 83 aa, Cebus imitator
MASPSPPPEPKEEWDYLDPAQRSLYKDVMMENYGNLVSLGLTLLPRLECSDTIMPRCSFDLLGLSDQSSCYLSSWDYTCFEQR

SEQ ID NO: 33172 - protein, 94 aa, Cebus imitator
MVFEDVAIHFSQEEWGILNDVQRHLHSDVMLENFALLSSVGCWHGARDEEAPSKQYVSVGVSQVTTLKPALSTQKAQSCETCSSLLKDILHLAE

SEQ ID NO: 33173 - protein, 93 aa, Cebus imitator
LTFRDVAIEFSQEEWRCLDPAQRTLYRDVMLENYRNLVSLGRRCAVSSKTGNNRVTNPLGLTFQLPLPGLEIFQGEGKFYECSQVEKFISHSS

SEQ ID NO: 33174 - protein, 84 aa, Callithrix jacchus
VTFEDVAIYFSQEEWGLLDEAQRLLYRDVMLENFALLTSLVCWHGMEDEETPEQSVSVNGVPQVRTPEASPSIQKTQSWDMCVP

SEQ ID NO: 33175 - protein, 87 aa, Monodon monoceros
VVFEDVAVNFTLEEWALLDFSQKKLYRDVMGETFRNLASVGETWKDHDIEDKCKNQGTKLRSRKVGRICEGKEDSPCRENLSLIPNL

SEQ ID NO: 33176 - protein, 109 aa, Bos taurus
LTFWDVTIDFTLEEWECLNLGQRELYREVMLENYGNWPPWVRIISFQNPLSTLRVLVPAFLECLLELSASYNRVSDPCLLVSKPDLVIFLEQRKHLWDVRRMETTATYP

SEQ ID NO: 33177 - protein, 85 aa, Bos taurus
LTFKDVAIKFTPEAWECLNPVQRALYRDVMIETLRNMLSVVKDNLPLKFGVCPGGGSLHFLCMPLGSPFLVTELKALLTQTRKAS

SEQ ID NO: 33178 - protein, 85 aa, Ovis aries
LTSEDVAIEFSQEEWEFLDAAQRALYRDVMLETYRNLLSVDISPTHVTKHLQPKATSDKRETFQTLMLGPESCEIKHVHLWDSQE

SEQ ID NO: 33179 - protein, 86 aa, Ovis aries
VTFEDVAVYFSWEEWALLDEAQRCLYHDVMLENFALTSSLGCWHGVEDKEAPSEQSICIGVSQIRTLKADSSPQKGDPFEMCGTVL

SEQ ID NO: 33180 - protein, 104 aa, Vulpes vulpes
VTFEDVAVDFSREEWEMLDPAQRRLYREVMLETCRNLAALDALKNQRASMGIEDGTLSPTPASQATGPSSWAGCSLLLPGAAFHLEQGEAMWTGGEGAPQTSCS

SEQ ID NO: 33181 - protein, 84 aa, Otolemur garnettii
VTFEDVAVTFTQEEWGQLDLTQRTLYQEVMLETCGHLVSLGDNTKPMTSEHALLHLDMPEEVSLQEQLTQGTSWDPQLGEAQDQ

SEQ ID NO: 33182 - protein, 90 aa, Zalophus californianus
VTFSDVAIDFSQEEWACLDSTQRDLYWDVMLENYSNLVSLDLESPYGTKSLPTEKGIYEINLSKWNSNGKSKSLGLDWMCEGEFEGPRGP

SEQ ID NO: 33183 - protein, 114 aa, Pan troglodytes
VTFEDIAVYFSQEEWGLLDEAQRCLYHDVMLENFSLMASVGCLHGIEAEEAPSEQTVSAQGVSQARTPKLGPSIPNAHSCEMCILVMKDILYLTEHQGTLPWQKPYTSVASGKW

SEQ ID NO: 33184 - protein, 87 aa, Rhinopithecus roxellana
VSFKDVAVDFTQEEWGQLDSPQRALYRDVMLENYQNLLALEWELKAVPSQQQGICKEEPAQEPITERPLGGAQAWGRQAGALQRSQA

SEQ ID NO: 33185 - protein, 90 aa, Cebus imitator
LTFSDVAIEFSLAEWKCLTPAQRALYREVMSENYRNLESVANDNLNCSSFLRKQINHLGKKQYECDVCGKVFNEKRCLESHRRCHTGEKP

SEQ ID NO: 33186 - protein, 86 aa, Bos taurus
IAFQDLAVRFSEDEWRLLGEGQRALYLDVMRENYDTLASLGEEQGRCWMGGCRRSSSRVQGCLGARVSCGALVFVHTARWRQRAGA

SEQ ID NO: 33187 - protein, 92 aa, Rhinopithecus roxellana
VAFEDVAVNFTQDEWALLDPSQKNLYRDVMRETFRNLASIGKQWEDQNIEDPFKIPRRNISHIPERLCESKEGSQGEETFSLIPHGILNKKT

SEQ ID NO: 33188 - protein, 104 aa, Odocoileus virginianus
VTFKDVAVDFSMEEWELLDPGQRKLYRDVMLETCGNLASVEALRNQRPNSGFEDGTICLASASQVTTLSLWTAYSLFQPVVSFYLEQGEAMWMAGKGTLRASCS

SEQ ID NO: 33189 - protein, 87 aa, Cebus imitator
VAFEDIDVNFTQEEWALLDPSQKNLYRDVMWETMRNLASVGKKWKDQNIKDHYKHQGRNLRRHMVERLYESKDGSQHGGIFSQFVNH

SEQ ID NO: 33190 - protein, 84 aa, Callithrix jacchus
VTFSDVAIDFSHEEWEWLDSAQRDLYKDVMVQNYENLASLGKDITPSTPIRNTFQVKKKKAVLCFISDWESRWENKELSTKKDI

SEQ ID NO: 33191 - protein, 89 aa, Ovis aries
LTFKDVAIEFSQEEWECLDPAQRALYRDVMLETYRNLLSVAVSHIHVIKKLKQKANRDTGVFQRMMLGRYESHEIRDFYFMEIQENIHV

SEQ ID NO: 33192 - protein, 85 aa, Ovis aries
VTFEDVFVYFSREEWELLEEAQKLLYRDVMLENFAHVAALGCWCEADNEEAPSEQSVCVDGVSEVRTPGSCPLIRKVHPCERSDP

SEQ ID NO: 33193 - protein, 90 aa, Ovis aries
LTIEDVDIKFTPEEWECLDPAQRALYRDVMVETYKNLLSVDVSRIDMTMKLQAKGNSGKGEIFQRVIFGRAETSEIKDFFLRQIQENVDG

SEQ ID NO: 33194 - protein, 84 aa, Macaca mulatta
LKFMDVAIEFSQEEWKCLEPAQRTLYRDVMLENYRNLVSLERSSKLGSNAGNKPCKSQLGFTSQLHLNDLQLFLAERKISGSKH

SEQ ID NO: 33195 - protein, 94 aa, Callithrix jacchus
MVFEDVAIHFSQEEWGILNDVQRHLHSDVMLENFALLSSVGCWHGAKDEEAPSKQYVSMEVSQVTTLKPALSTQKAQPCETCSSLLKDILHLAE

SEQ ID NO: 33196 - protein, 85 aa, Ovis aries
VTFEDVAIYFSQEEWGLLDEAQRHLYHKVMLENFALTASMVCLHETETKETSSEQNVSLEALSQIRIPKSLIVLPKPIGGHYLQQ

SEQ ID NO: 33197 - protein, 97 aa, Vulpes vulpes
VTFRDVTVDFTQEEWQQLEPAQKDLYRDVMLENYRNLVSLDLETRVEMKQSGPTEDNVEHRLPVRVLGEGPARHGARGMAYEGMWMRDLRERQQGEA

SEQ ID NO: 33198 - protein, 82 aa, Acinonyx jubatus
VTFEDVVVYFSWEEWGLLDETQRCLYHDVMLENFALVISLGCWYGMEDEEALSVPRMSLGKATDPGPPVWKAHPCEKCVLVG

SEQ ID NO: 33199 - protein, 94 aa, Acinonyx jubatus
VVFTDVAVRFSQEEWGLLDEAQRRLYHSVMLDTVALLSSLGCWHGARDEEAPSGHSVSVGASQVRTPKPGPSFQEAQPCETCSSLLKDLLRLAE

SEQ ID NO: 33200 - protein, 89 aa, Rhinopithecus roxellana
LTFRDVAIEFSQEEWKCLDPAQRALYKDVMLENYRNLVSLGSSYALGSNAKDKPIKKQLGVSFHLHLSELELFPDERVINGCNQVENFI

SEQ ID NO: 33201 - protein, 83 aa, Bison bison
FTFKDVAIEFSQEEWECLASSQRALYRDVMLETYRNLVSLGDDNFSPEDYLIGILSAGFAINKLSPRENINLVELYGNENHGI

SEQ ID NO: 33202 - protein, 103 aa, Bison bison
VTFEDVTVIFTWEEWKFLDSSQKKLYREVMWENYTNVMLVGNWKESCKLQEERFRYLDHENLSCWQGWTTARTPIYENKNYVEMVQGIDSKALKQQHLSHYQE

SEQ ID NO: 33203 - protein, 84 aa, Cebus imitator
LTFTDVAIEFSQEEWKCLDPAQRALYKDVMLENYRNLVSLGSSCALGGNAENKQIKTQLGVSFHLHLSELELFPDERVVNGCNQ

SEQ ID NO: 33204 - protein, 87 aa, Panthera pardus
VAFEDVAVNFTLEEWALLDPSQKKLYRDVMRETLRNLASVGKKWKDHNIDDQYRNQGRNLRSPMVERLHQSKEGGPCGGNFSLIPHL

SEQ ID NO: 33205 - protein, 104 aa, Sus scrofa
LTFDDVAVDFTWEEWQLLTPAQKDLFRDVMLENYRNLVAVGCQASELAVLSVVDLGGQPRAMGNDIRYWSHSGDQVSQPDTLSRWEGGEELGPVEDAVSCGICP

SEQ ID NO: 33206 - protein, 89 aa, Panthera pardus
ENFKIVTVDFTQKEEGTLNPVQRTLDRDVILENHRDLVSWDLATALGRRESTSKQNIFDDEPFHGVKLERLTRDDPWLASCEEVRDCKD

SEQ ID NO: 33207 - protein, 85 aa, Sus scrofa
VAFEDVFVYFSREEWELLEEAQRLLYRDVMLENFALVSSLGCWCEADYEEAPSEQSTFVEGVSQVRTPKAFPFIQKAHPCEICDP

SEQ ID NO: 33208 - protein, 98 aa, Camelus dromedarius
VTFKDVTVDFTQEEWEHLDPSQRHLYSEVMLENYGNLISVGENSIFLSPPALSVVPWCGVNPKGISGHLLSKPEMISHFEQDDVWLELKIPRSSYSGE

SEQ ID NO: 33209 - protein, 91 aa, Acinonyx jubatus
VSFADVAVYFSPEEWGCLRPAQRALYRDVMRETYGHLGALGGTPNKKEEAPEEGPGAKGPRKTPGKEPSKELVKHNPDWTVRKVSARAQQP

SEQ ID NO: 33210 - protein, 87 aa, Odocoileus virginianus
CEFKDVAIDFSREEWGLLDEAQRLLYYSVMLETFALVASVGCWHGTEDEEAPSEQSLSVEAESQVRVSKAGLSTWKIHPCEMCVPIL

SEQ ID NO: 33211 - protein, 97 aa, Odocoileus virginianus
MTFEDVAVNFTWEEWALLDAAQRQLYRDVILETCGHLACVDWATRHQTKDSTPRQNNLAKRTFQEVNRAHLASSGSRLSDLREDWMSHRIEVPGKQR

SEQ ID NO: 33212 - protein, 85 aa, Cebus imitator
LTFSDVAIEFSLVEWKCLTPAQRALYREVMSENYRNLESMESCSDTQVGQFSCLNLPNTWDYRCLFQMHNEEVFINRERQYRSSS

SEQ ID NO: 33213 - protein, 104 aa, Macaca mulatta
VTFEDVSVDFSQEEWELLEPAQKNLYREVMLENYRNVVSLEALKNQCTDAGIKKGSLSPAQTPQVTSLSSWTRYVLLQPVASSHLEQREALWMEEKGTPQASCA

SEQ ID NO: 33214 - protein, 91 aa, Macaca mulatta
VSFQDVTVEFTQEEWQHLGPVERTLYRDVMLENYSHLISVGYFKVDHIKGIWEKQEKPLWQEIFISDADKTLSKEREKVLEKPSNLEIAPE

SEQ ID NO: 33215 - protein, 87 aa, Rhinopithecus roxellana
LTFRDVAIEFSPEEWKCLDPAQQNLYRDVMLENYRNLVSLAMCSHFTQDFLPGQGIEDSFHKCILRRYEKFSSLFSSCHVISHGLSR

SEQ ID NO: 33216 - protein, 87 aa, Rhinopithecus roxellana
LSFKDVAVVFTEEELGLLDSTQRQLYRDVMLENFRNLLSVSERNPPGDENGRDMEYIQDEELRLFSHKELFCKIWEEVVGELPGSQD

SEQ ID NO: 33217 - protein, 84 aa, Cebus imitator
VTFDDVALYFSEQEWEILEKWQKQMYKQEMKTNYETLDSLDDRGTLGTKEDCHLNGPQKQDLCAALPGRERKILSAQRASFQSP

SEQ ID NO: 33218 - protein, 113 aa, Cebus imitator
VTFEDVAVYFTQNEWTSLQPSQRALFREVMLENYATVTSLYLIEGGFPLGTERTEKVSGALPSFLPSSSSWEVILALLPISAFPFPKPDLIFRLEQGEAAWGPDPWTLAGEEA

SEQ ID NO: 33219 - protein, 84 aa, Cebus imitator
VTFEDVFVYFSREEWELLEEAQRFLYRDVMLENFALVATLGFWCETENEEAPSEQSISVGGVSQVRTAEPGLFQKAHPCELCDP

SEQ ID NO: 33220 - protein, 88 aa, Rhinopithecus roxellana
LTFRDVKIEFSLEEWQCLDTAQRNLYRDVMLENYRNLVFLVMCSHFTQDVWPEQSIKDSFQKVILRTCGKYGHENLQLKKDHKSVDAC

SEQ ID NO: 33221 - protein, 104 aa, Acinonyx jubatus
MTFEDVAVYFSQEEWRLLDEAQRHLYRDVMLEVFALVVSLGCWHGAGAEEAPSEQSIPIGVSQVSIAKADLSPHEVHSPDSEGDLHPAKNPGASPGQKVCGTGG

SEQ ID NO: 33222 - protein, 94 aa, Rhinopithecus roxellana
MVFEDVAIHFSQEEWGILNDVQRHLHSDVMLENFALLSSVGCWHGAKDEEAPFKQCASVGVSQITILKPALCTQKAQPCETCSSLLKDILHLAE

SEQ ID NO: 33223 - protein, 94 aa, Callorhinus ursinus
VTFEDVAVYFSWEEWGLLDEAQRCLYQDVMLENLALITSLGCRHGAEDEEAPERKVSVQGVSQVRTFKAVVSPQKAHSREVCGQDLRDILLSTE

SEQ ID NO: 33224 - protein, 87 aa, Cebus imitator
VAFEDVSVNFSQEEWALLAPSQKKLYRDVMQETFKNLASIGKKWEDQNVEDRHKNQGKNLRSHMVERLCESKEGSQCGETFSSSLCV

SEQ ID NO: 33225 - protein, 86 aa, Cebus imitator
LTFSDVAIEFSLVEWKCLTPAQRALYREVMSENYRNLESVDKRNLPLSILDVSSKCIMKKFSSTGKGNTESSHWGFSFQEIEKNIH

SEQ ID NO: 33226 - protein, 86 aa, Callithrix jacchus
VTFEDVAIYFSQEEWGLLDEAQRLLYRDVMLENFALLTSLGKALTPTLTSWSSSILFFPRGRIWLQRKPGLSQWHLGEGVTSVCWH

SEQ ID NO: 33227 - protein, 104 aa, Acinonyx jubatus
VTFEDVAVAFSREEWALLDPAQKRLYREVMLETYRNLAALETLKTRSADAGIEFGALSATQASQAAGPSPWVGGSLFLPVVPFQLEQGVAVWLGGEGTPQTSCS

SEQ ID NO: 33228 - protein, 83 aa, Rhinopithecus roxellana
VAFEDVAVNFTQEEWALLDISQRNLYREVMLETFRNLTSIGKSWKDQNIEYEYQNPRRNFRSLIEDKVNEIKEDSHCGETFTQ

SEQ ID NO: 33229 - protein, 84 aa, Rhinopithecus roxellana
VTFEDVFVYFSREEWELLEEAQRFLYRDVMLENFALVATLGFSCEAENEEAPSEQSVSVEGVSQVRTAEPGLFQKAHPCEMCDP

SEQ ID NO: 33230 - protein, 87 aa, Callithrix jacchus
ISLEDVAVNFTLEEWALLDPGQRNIYRDVMRATFKNLACIGEKWKDQDIEDDPKNQGRNLRGPMVETLCENKEDRECGKSTSQIPDL

SEQ ID NO: 33231 - protein, 87 aa, Callithrix jacchus
VTFEDVAVTFTQEEWGQLDVTQRALYVEVMLETCGLLVALGDSTKPETLEPVPSHPALPEEVSLQEQLAQGVPGYSQWGQAMDQDGP

SEQ ID NO: 33232 - protein, 96 aa, Odocoileus virginianus
LTFTDVNIEFSQEEWECLNPAQRTLYRDVMLETYRNLLSVDDGFQNVLCYFVGIRYMQDIFYKPVIKKLQLKTNSDRGEVFKSWILGRPERNEMDL

SEQ ID NO: 33233 - protein, 86 aa, Cebus imitator
VVFEDVAVNFTQEEWALLGPSQKKLYRDVMQETFVNLASIGENWEDRNIEDHRDHGRKLRSHMVERLCESKEGNQLGEAISQTPNP

SEQ ID NO: 33234 - protein, 90 aa, Callithrix jacchus
VTFKDVAVAFTEEELGLLGPAQRKLYQEVMVENFRNLLSVGHQPFKRDVSPIERKEQLCIMKTATQRQRNLGENNQSKLMTVEDRESEEE

SEQ ID NO: 33235 - protein, 103 aa, Cebus imitator
VTFEDVTIIFTWEEWKFLDSSQKRLYREVMWENYTNVMSVGNWNEGYKSQEEKYRYLEYENFSCWQGWWNAGTQIYEIQNYGETIQGEDSKDLKQQSFSQCQK

SEQ ID NO: 33236 - protein, 85 aa, Ovis aries
VTFEDVAVNFSWEEWGLLDKSHKRLYHDVMLENYALISSLASCVVLWLALFGVRSRIPDADLHRPSLTLTLPWIQVRCLEEPAEL

SEQ ID NO: 33237 - protein, 105 aa, Ovis aries
LTFQDVAIDFTQEEWECLDLSQRELYRDVMLENYRNLASLGCGNTLNQNSELSQDQQVHTGKKLYECKECGKAFMSSSNLSRHQRIHTGEKPYKCTKCGKAFNQK

SEQ ID NO: 33238 - protein, 82 aa, Otolemur garnettii
LTFRDVAITFSPEEWEYLDTAQQNLYQDVMLENYRNLVSVVLFCSNLDGIRSLILEPCCSLARAGWNLPPSVCGACALLTEP

SEQ ID NO: 33239 - protein, 110 aa, Pongo abelii
TVSPETHMDLTKDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 33240 - protein, 97 aa, Pongo abelii
VTFTDVAVNFTKEEWTLLDSAQRNLYRDVMLENSRNLAFIDWATPCKTKDATPQPDILPKRTFPEANRVCLKSISSQLSTLREDWRCPKTEEPHRQG

SEQ ID NO: 33241 - protein, 90 aa, Cebus imitator
VTFEDVAVTFTQEEWGQLDVTQRALYVEVMLETCGLLVALGDSTKPETLEPIPSHSALPEEVSLQEQLVQGVPGYSQWGQAMDQDGPSEM

SEQ ID NO: 33242 - protein, 87 aa, Cebus imitator
LTFMDVAIEFSLEEWQCLDTAQQNLYRNVMLENYRNFVFLVICSDFAKDLWPEQEIKNSFQQVILTRYGKCGHQNLQLRKSCKTVDE

SEQ ID NO: 33243 - protein, 84 aa, Macaca mulatta
LTFEDVAVYFSEEEWQLLDPPEKTLYNDVMQDIYETVISLGLKLKNDTGNDHPISVSTSEIQTSGCKVSKKTRMKIAQKTMGRE

SEQ ID NO: 33244 - protein, 87 aa, Callithrix jacchus
VAFEDIDVNFTQEEWALLDPSQKNLYRDVMWETMRNLASIGKKWKDQKIKDHYKHQGRNLRRHMVERLYQSRDGGQHGGTFSQFANH

SEQ ID NO: 33245 - protein, 87 aa, Ovis aries
VTFEDVAVNFTLEEWAFLDPSQKKLYRDVMRETLRNLVSIGEKWEDHDIEDQYKSQGRKLRSHVVERLCESKEGSQCGENFSIIPNL

SEQ ID NO: 33246 - protein, 84 aa, Otolemur garnettii
VSFKDLTVDFTQEEWQHLDPAQRFLYRDVMLENYSYLVWLGLKANPPQQGIFEKFSFHSKCVKTHKLARHLWLKRLRCQPHIPE

SEQ ID NO: 33247 - protein, 94 aa, Odocoileus virginianus
VTFEDVAVYFSWEEWALLDEAQRCLYHDVMLENFALTSSLGCWHGVEDKEAPSEQSICIGVSQIRTLKADSSLQKDQPFEMYGPVLRDILHFPE

SEQ ID NO: 33248 - protein, 89 aa, Bos taurus
MTFQDVAIDFTQEKWECLDLDQRELYRDVMLEKYGNLASLGEDNCLPESLIYPLGFSSIMSRMSSEIFCFAQFQISFFTSDCQSIGASA

SEQ ID NO: 33249 - protein, 196 aa, Otolemur garnettii
VTFEDVAVVFTDEEWQHLVPVQRDLYKEVMLENYKSIISLETCVTKRKLGVTADWQILMRNFIQDWSKKQMLMLQINLIMPNSFPHRRECLGGITETAEPLSLALAAENQHTTQEMIFSPNKNVLLFPKLGPRYKELAIHSVLKSYVKNQFYNIKMNREKNKKAGLPVPRPDVIFQLKREEEPWIVDLHGSEERES

SEQ ID NO: 33250 - protein, 83 aa, Macaca mulatta
VTFDDVAVTFTKEEWGQLDLAQRTLYQEVMLENCGLLVSLVTAANQTAQQPSSPAMRRLKIDDFEIGRPLGKGKFGNVYLARL

SEQ ID NO: 33251 - protein, 85 aa, Callithrix jacchus
VAFEDVAVNFTQEEWALLSPSRKQLYRDVMLETFKNLASVGIRWKDQDMENLYQNLGIEPRSLVERLCGRKEGSDHRETFGQFPD

SEQ ID NO: 33252 - protein, 86 aa, Macaca mulatta
LTFRDVAIEFSLEEWQCLDTAQQGLYRKVMLENYRNLVFLVICSHFAQDLWPERDIKDSFQESILKKYRNYEHDNLQLQKGCKSVD

SEQ ID NO: 33253 - protein, 87 aa, Ovis aries
LSFKDVAVDFTWEEWQLLAPAQKTLYRDVMLENYSNLVSVAPVQFSGTKSSIISHEYRVSKSDVLSKLKQGKERWMTEDEIHSRTWP

SEQ ID NO: 33254 - protein, 90 aa, Cebus imitator
VMFRDVAIDFSQEEWECLDAAQRDLYRDVMLENYSNLVSLDLPSRCARKDLSPEKNTYETELSQWEMSNRLEKCDLEESNSREYLEAKAK

SEQ ID NO: 33255 - protein, 102 aa, Macaca mulatta
VSFADVAVYFSREEWGCLRPAQRALYRDVMRETYGHLGALGESPTCSPGPCAPTRPAAPLGAARGVGGPGAGQAASPQRGVCVLLPQESEAASRRSSPGWRR

SEQ ID NO: 33256 - protein, 89 aa, Callithrix jacchus
VTFDDVAVAFTQEEWTLLDPSQRDLYRDVMLENYENLASVEWRLKSKGSALQQDRAWFHSASDETQTARSHNGGQPCDRMQCGEAVSEP

SEQ ID NO: 33257 - protein, 94 aa, Otolemur garnettii
VVFEDVAIYFSQEEWGHLDEAQRSLYRDVMLENMALLSSLGCCHRAEDEEVLFEHGVSVGASYVMTPKPFLSTQKTQPCETCSSLLKDILHLVG

SEQ ID NO: 33258 - protein, 86 aa, Otolemur garnettii
MTFKDIVVDFTQEEWALLDTSQRKLYRDVMLENINHLVSIGESLNIYYIWGSKLKGYPFCSCVLSHLEPGEELAREGGSFIQGQSP

SEQ ID NO: 33259 - protein, 95 aa, Otolemur garnettii
VTFEDVAVNFSQEEWSLLSEAQKCMYHDVMLETLALLFSLGGCSGAEDEEAPCKQSTSILGVSPLRTCKTDVSLKSAHPCEMYAAVSRDIVHLSE

SEQ ID NO: 33260 - protein, 104 aa, Macaca mulatta
VTFEDVSVDFSQEEWELLEPAQKNLYREVMLENYRNVVSLEALKNQCTDAGIKKGSLSPAQTPQVTSLSSWTRYVLLQPAASSQLEQREALWMEEKGTPQASCA

SEQ ID NO: 33261 - protein, 84 aa, Callithrix jacchus
RWSFDVAIYFSQEEWGLLDEAQRLLYRDVMLENFALLTSLGKALTPTLTSWSSSILFFPRGSSALSIARLWWGECRKDSSHKHT

SEQ ID NO: 33262 - protein, 87 aa, Macaca mulatta
MAFEDVAVNFTQEEWVLLDSSQKNLYREVMQETCRNLASVGEANQRMRFPREGASEEFKTLGKESLAACLWDLPWKVDKFTASSNFL

SEQ ID NO: 33263 - protein, 88 aa, Callithrix jacchus
LTFRDVAIEFSPEEWRCLDPAQQNLYRDVMLENYRNLVSLAVCSHFTQDLWPEHSIEDSFHKPILKRHEKCGHENLRKSFKNVNEYKV

SEQ ID NO: 33264 - protein, 103 aa, Callithrix jacchus
VTFEDVTIIFTQEEWKFLDSSQKRLYREVMWENYTNVMSVGNWNESYKSQEEKFRYLEYENFSCCQGWWNAGTQIYEIQNYGETVQGEDSKDLKQQGFSQCQE

SEQ ID NO: 33265 - protein, 104 aa, Ovis aries
VTFKDVAVDFSMEEWELLDPGQRKLYRDVMLEICGNLASVEALRNQRPNSGFEDGTICLASASQVTTFSLWTTYSLFQPVVSLHLEQGEAMWMVGKGTLRASCS

SEQ ID NO: 33266 - protein, 87 aa, Otolemur garnettii
VTFDDVAVGFTQEEWDILDSAQRDLYREVMLEICENLDSVVAVDVLNKPLTVMWVSGQIYLCFIFLMCLSFTSEWQLKTSGSALLQS

SEQ ID NO: 33267 - protein, 87 aa, Enhydra lutris
VAFEDVAVNFTLEEWALLDPSQKKLYRDVMRETLRNLASIGKKWKDHNTEDEYKNQGRKLRSHTVERFCQSKEGNQCGGNFSPIPNL

SEQ ID NO: 33268 - protein, 84 aa, Enhydra lutris
VTFEDVTVIFTWEEWRFLDSSQKKLYREVMWENYTNVMSVGNWKESYKPQEERFRYLKHENLPCWQGWRNARTQIYENRNYVET

SEQ ID NO: 33269 - protein, 93 aa, Pongo abelii
VAFEDVAVNFTQEEWALLGPSQKNLYRYVMQETIRNLDCIRMIWEEQNTEDQYKNPRRNLRCHMVERFSESKDSSQCGETFSLIRDSIVNNST

SEQ ID NO: 33270 - protein, 84 aa, Bos taurus
VTFEDVAIYFSQEEWGLLDEVQRHLYCKVMLENFALTASMGKALTPTKETPSEQNVSLEALSQVRTPKVGPFTENAHPCEKCVP

SEQ ID NO: 33271 - protein, 92 aa, Ovis aries
ARELRGRGRVLLPEWGYLRPAQRALYRDVMRETYGHLGALGEAPPARLCSQPHPPRPASGCFRGTKPALISWVEEEAELWRPDAEPPEMGEC

SEQ ID NO: 33272 - protein, 87 aa, Otolemur garnettii
FTFKDVAIEFSQEEWECLDPTQKALYRDVMLENYRNLLSLGEDTFPSEINISDGFTGKGLSPKEDSNKEELYNLVRLERNKSHGIKD

SEQ ID NO: 33273 - protein, 83 aa, Vulpes vulpes
VTFDDVAVIFTQEEWGQLDPAQRTLYQEVMLENCGLLVSLGKSTRLLHGGPATSLSEHPVAPGLAGQEGLWSLPLPPACSFSH

SEQ ID NO: 33274 - protein, 103 aa, Pongo abelii
VTFEDVTIIFTWEEWKFLDSSQKRLYREVMWENYTNVMSVENWNESYKSQEEKFRYLEYENFSCWQGWWNAGAQMYKNQNYGETVQGTDSKDLTQQDHSQCHE

SEQ ID NO: 33275 - protein, 103 aa, Pongo abelii
VTFEDVTIIFIWEEWKFLDSSQKRLYREVMWENYTNVMSVENWNESYKSQEEKFRYLEYENFSCWQGWWNAGAQMYKNQNYGETVQGTDSKDLTQQDHSQCHE

SEQ ID NO: 33276 - protein, 89 aa, Vulpes vulpes
VTFKDVLVTFTQEEWELLDLPQRTLYWKVMTETRRLLVSLDDKAKANTTEPSASQQALFERCSPHTLLTEEDSSVSTLGEAREQEGPSE

SEQ ID NO: 33277 - protein, 92 aa, Enhydra lutris
VTFEDVFVYFSREEWELLEEAQRLLYRDVMLENFALVASLGCWRETDNEETPSEQSISVGVSQLGTPESGAFIQKAHPCEVWDPLLKDTLHL

SEQ ID NO: 33278 - protein, 93 aa, Enhydra lutris
VAFEDVTVHFSLEEWALLNPSQKKLYRDVMQETLRNLALVGEKWEDRDSKSQYEHHQTNLSRPVVERPCKNKEGSPCEESFSQNPNHKQINKS

SEQ ID NO: 33279 - protein, 90 aa, Callithrix jacchus
VAFEDVAVNFTQEEWALLGPSQKSLYRNVMQETIRNLDCIEMKWEDQNIEDQCQNHRRNLRSHTCEIIDNSQCGETFSQIPESIVNKNTP

SEQ ID NO: 33280 - protein, 92 aa, Monodon monoceros
PGDYVSQKRLRRWPNRDTPAKGLCASALSSGSRVRRYGGGSAPGAARGATTGATGPEEAAGFAISKPDVISFLEQGREPWMVEKVATGGQCP

SEQ ID NO: 33281 - protein, 85 aa, Macaca mulatta
LTFKDVFVDFTLEEWQQLDSAQKNLYRDVMLENYSHLVSVGEGPRHGVMQNAPRYLVAKPDVIFRLGPGEESWMADGGTPVRTCA

SEQ ID NO: 33282 - protein, 97 aa, Ovis aries
LTLEDVAVNFTQEEWALLDTAQRQLYRDVTLETCGHLAYVDWVTRHQTKESTPQQNSLAKRTFQGVNRAHLASSGSRLSDLREDWMRTLKHVAATHE

SEQ ID NO: 33283 - protein, 92 aa, Pongo abelii
MVFEDVAIYFSQEEWGILNDAQRHLHSNVMLENFALLSSVGCWHGAKDEEVPSKQCVSVRVLQVTTPKPALSTLKAQPCKTCSSLLKDILHL

SEQ ID NO: 33284 - protein, 88 aa, Pongo abelii
VTFEDVTLGFTPEEWGLLDLKQKSLYREVMLENYRNLVSVEYPELQLDPKLDPLPAESPLMNIEVVEVLTLNQEVAGPRNAQIQALYA

SEQ ID NO: 33285 - protein, 83 aa, Pan troglodytes
FTFKDVAIEFSQEEWECLDPAQRALYRDVMLENYRNLLSLDEDNIPPENDISVGFTSKGLSPKENNKEELYHLVILERKESHG

SEQ ID NO: 33286 - protein, 87 aa, Macaca mulatta
LTFKDVAIEFSLEEWQCLDTAQRDLYRNVLLENYRNLVFLVMSFHFAQDLWPEQNIKDSFQKVTLRRYGRCEYENLQLRKGYKHVDE

SEQ ID NO: 33287 - protein, 87 aa, Callithrix jacchus
VTFRDVTVDFTQEEWQQLEPAQKDLYRDVMLENYRNLVSLDWETRPEMKELDSKNDILEDKPSVVGVAMGGPARNGSQGPASEGAWE

SEQ ID NO: 33288 - protein, 91 aa, Ovis aries
VTFEDVAVYFSQEEWRILDETQRHLYCYVMLETFALVASLGCWQRAEVKEKSSEQNASVEVPQIITSKTDPSIQKAYPWEMGNLDVEGGLR

SEQ ID NO: 33289 - protein, 85 aa, Ovis aries
LTFKDVAIEFSQEEWECLDPAQRALYRDVMLETYRNLLSVVLGRELETRILRCSLCVQKEAVDECVKYFPRPPPCNVLTPQLSEE

SEQ ID NO: 33290 - protein, 83 aa, Callithrix jacchus
VSFEDVTVDFSKEEWQHLDPVQRCLYWDVTLENYSHLLSVGKHGRPMHLLRLLSAAPHLNYMKVSSWICLGFKNVAHIHHGIL

SEQ ID NO: 33291 - protein, 93 aa, Vulpes vulpes
VTFEDVAVSFTLEEWALLDSSQKKLYRDVMRETFRNLSSIGKKWKEHDTEDRDNTQERKLRSHVVEKPCESKEGHQSGETISQTPDRNLNKKS

SEQ ID NO: 33292 - protein, 82 aa, Pongo abelii
VTFADVAIDFSQEEWACLNSAQRDLYWDVMLENYSNLVSLDLESAYENKSLPTEKNIHEIRASKRNSDRRSKSLGRNWICEG

SEQ ID NO: 33293 - protein, 89 aa, Pongo abelii
MFSDVSIDFSPEEWEYLDLEQKDLYRDVMLENYSNLVSLDLETKYETKKLSLENDIYEINLSQWKIMERVENHGLKGLILKNDWESTGK

SEQ ID NO: 33294 - protein, 83 aa, Pongo abelii
VAFDDVAVNFTQEEWALLDISQRKLYREVMLETFRNLTSIGKSWKDQNIEYEYQNPRRKFRSVIEKKVNEIKEDSHCGETFTQ

SEQ ID NO: 33295 - protein, 98 aa, Pongo abelii
LKVEDVALTLTPEWTQQDSSQGNLCRNEKQENHGSLVSLGDEKQIKSRDLPPAEKLPEKEHGKISCHLTEDIAQIPTCAEAGEQEGRLQRKQKNGTGG

SEQ ID NO: 33296 - protein, 90 aa, Pongo abelii
VALEDVAVNFTREEWALLGPCQKNLYKDVMQETIRNLDCVGMKWKDQNIEDQYRYPRKNLRCCMLERFVESKDGSQCGETSRQIQDSIVT

SEQ ID NO: 33297 - protein, 87 aa, Callithrix jacchus
VTFKDVAVAFTEEELGLLGPAQRKLYQEVMVENFRNLLSVGHQPFKRDVSPIERKEQLCIMKTATQRQRNLDTLLVKAVLFYDLAQT

SEQ ID NO: 33298 - protein, 103 aa, Bos taurus
VTFEDVTVIFTWEEWKFLDSSQKKLYREVMWENYTNVMLVGNWKESCKPQEERFRYLDHENLSCWQGWKTARTPIYENKNYVEMVQGIDSKALKQQHLSHYQE

SEQ ID NO: 33299 - protein, 87 aa, Pongo abelii
VTFADMALNFSQKKWSLLSEVQRCLYCDVMLKNLALLSSLGCWCGVKDEEAPGKQSISIQRESQVRTLRAGGSSKKAHPCEMCSPIL

SEQ ID NO: 33300 - protein, 83 aa, Pongo abelii
VTFEDVFVYFSREEWELLEEAQRFLYRDVMLENFALVATLGFWCEAENEAPSEQSVSVEGVSQVRTAESGLFQKAHPCEMCDP

SEQ ID NO: 33301 - protein, 83 aa, Macaca mulatta
EDVAVNFTLEEWALLDPSQKNLYRDVMRETFRNLASIGKQWEDQNIEDPFKIPRRNISHIPERLCEGKEGSQGEETFSLIPDG

SEQ ID NO: 33302 - protein, 87 aa, Ovis aries
ITFEDVAVYFSWEEWALLDKAQKLLYCDAMLENFALMASLGYWHGGEDEEAPSGQSVSVEGMSQVRTPKAGPFPYEAHSCEVCVSIL

SEQ ID NO: 33303 - protein, 87 aa, Pongo abelii
VAFEDVAVNFTHEEWALLGPSQKNLYRDVMRETIRNLNFIGMKWENQNIDDQYQNLRRNSRCDVVERFGKSKDGSQCGETLSQIRNS

SEQ ID NO: 33304 - protein, 92 aa, Callithrix jacchus
MVFEDVAIYFSQEEWGILNDAQRHLHSNVMLENFALLSSVGCWHGANDKEASSKQCVSVRVLQVTTPKSALSTLEAQPCKTCSTLLKDILHL

SEQ ID NO: 33305 - protein, 85 aa, Bos taurus
LTFKDVAFKFTPEAWECLNPVQRALYRDVMKETLRNMLSVVKDNLPLKFGVCPGGGSLHFLCMPLGSPFLVTELKALLTQTRKAS

SEQ ID NO: 33306 - protein, 82 aa, Ovis aries
VTFEDVAVYFSQEEWGLLSLTQRSLYRDVMLENFALIGSLGCLCRLQDEDGPRELGESCQVCLSEKPSLWGTSGQAFPASLG

SEQ ID NO: 33307 - protein, 83 aa, Otolemur garnettii
VTFEDVFVYFSQEEWELLEEAQRFLYRDVMLENFALVATLGCWCEAYNEEAPSEQSISVGVSQVRTPESGPFMQKAPCEMCDP

SEQ ID NO: 33308 - protein, 87 aa, Enhydra lutris
LSFVDVFVDFTWEEWRLLDPSQKHLYRSVMLENYSNLVSLGFEIVLVQVVCDFTFIGYQDSKPDIIFTLEQEEPWMMLAQIPSQGHP

SEQ ID NO: 33309 - protein, 110 aa, Pongo abelii
VTFEDIAIYFSQDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 33310 - protein, 90 aa, Bos taurus
VMFRDVAIDFSQEEWDCLDSAQRDLYRDVMLENYSNLVSLDLPSRGANKLLSPKKDIYETGLSQWEMSARLENCDLENSSSRDHLEVKGT

SEQ ID NO: 33311 - protein, 83 aa, Pongo abelii
VAFEDVAVSFTQEEWALLDPSQKSLYRDVMQETFKNLTSVGKTWKVQNIEDEFKNPRRNLRRSFTLVAQAGVQWRDLGSPQPP

SEQ ID NO: 33312 - protein, 84 aa, Pongo abelii
LTFEDVAVLFTWDEWRKLAPSQRNLYRDVMLENYRNLVSLGCKSTPKMTKSTRTQDSFQEQMRKRLKRDEPWNFISERSCIYEE

SEQ ID NO: 33313 - protein, 104 aa, Pongo abelii
VTFEDVSVDFSQEEWELLDPAQKNLYREVMLENYRNVVSLEDMKNQCTDGGIKEGPLSPAQTSQVTSLSSWTGYLLFQPVASSHLEQREALWMEEKGAPQASCS

SEQ ID NO: 33314 - protein, 83 aa, Pongo abelii
LTFKDVAVVFTEEELGLLDPVQRNLYRDVMLENFRNLLSVGHHPFKHDVFPLEKEKKLDIMKTATQRKGKSADKIQSEMETVP

SEQ ID NO: 33315 - protein, 89 aa, Pongo abelii
LTFRDVAIEFSQAEWKCLDPSQRALYKDVMLENYRNLVSLGSSYALGSNAEDKPIKKQLGVSFHLHLSELELFPDERVINGCNQVENVI

SEQ ID NO: 33316 - protein, 91 aa, Bos taurus
LTFKDVFIDFTPEEWECLDPAQRTLYKDVMVETLRILLSVGEDHFLPKCQKLPTKVNSDKGEVFHTVMLGRPESREITDFFLREIQENLHE

SEQ ID NO: 33317 - protein, 87 aa, Otolemur garnettii
VAFEDVAVSFTQEEWALLDPSQKNLYRDVMRETIRNLASIGKKRKDQNIEDHYKHQGRNLRSHMVERLCQSKIPNHNLSKKTPGVKP

SEQ ID NO: 33318 - protein, 87 aa, Otolemur garnettii
LVFEDVAVNFTLEEWALLDPSQKNLYRDVMEETFRNLASIGEKWEDENIEDQYRNPRRNQRGHILERLYESKEGSQCGETFSQIPDH

SEQ ID NO: 33319 - protein, 88 aa, Callorhinus ursinus
VTFEDVVVDFTQEEWGQLEPAQRTLYRDVMLETFRLLVSVDLETQPQTRLSAPKQDITEKIASSVLVERFLWDSLWYPEGDEAEGHWG

SEQ ID NO: 33320 - protein, 88 aa, Acinonyx jubatus
LTLEDVAVDFTQEEWRLLAPAQKDLYWDVMLENFRNLVSVDHGPVHRACLFCRFPRTGYVASMPAALSRLERGGQWMTEDETRHWICP

SEQ ID NO: 33321 - protein, 104 aa, Callorhinus ursinus
VTLEDVAVDFSREEWAMLDSAQRRLYREVMLDTCANLAALGALKNQSSDTGIDDGTLSPTQASPATSPSPWAGCPLFLPVVPSHLEPGEAMWMGPQGTPQTSCS

SEQ ID NO: 33322 - protein, 88 aa, Vulpes vulpes
VTFEDVALYLSREEWGRLDHTQQSFYRDILQKRNGLALGFPFSRPFWTSQGQGKGEASSSCQQMGDEEEEKTELPWVPHESLSLAGNP

SEQ ID NO: 33323 - protein, 89 aa, Rhinolophus ferrumequinum
VNFKIVTVDFTQEEEGILNPAQRTLDTDMILENHRDLVSWDSAAALGRRESSSKQSIFDDEPSHGVKIERLTRDDPWLSSCEEVWVCKD

SEQ ID NO: 33324 - protein, 88 aa, Cebus imitator
VTFDDVAVEFTPEEWALLDTTQKYLYRDSMLESYKNLVSVVLQQWEIQPTTKGSSLQQSFLKNEIFNGLQMLRSYRLGELCDCKNCGE

SEQ ID NO: 33325 - protein, 85 aa, Acinonyx jubatus
LTFRDVAIEFSQEEWECLDPAQRILYRDVMLENYRNLVSLGEDNFPPEVGSSAGFAIKELSPIQDINKGEFYHLVILERNESHDI

SEQ ID NO: 33326 - protein, 87 aa, Rhinopithecus roxellana
VAFEDVDVNFTQEEWALLDPSQKNLYRDVMWETMRNLASIGRKWKDQNIKDHYKHRRRNLRSHMLERFYQSKDGSQRGGIFSQFANQ

SEQ ID NO: 33327 - protein, 83 aa, Rhinopithecus roxellana
VAFEDVAVNFTQEEWALLDISQRNLYREVMLETFRNLTSIGKKWKDQNIEYEYKIPRRSFRSLIEEKVNEIKEDSHCGETFTQ

SEQ ID NO: 33328 - protein, 94 aa, Cebus imitator
MVFEDVAIYFSQEEWGILNDAQKHLHSNVMLENFALLSSVGCWHGAKDKEAPSKQCVSVRVLHVTTPKPALSTLEAQPCKTCSTLLKDILHLAE

SEQ ID NO: 33329 - protein, 104 aa, Cebus imitator
VTFEDVSVDFSQEEWELLDPAQKNLYREVMLENYRNLVSLEAVKNPCADAGIEEGPFSTVHTPQATRLSSWMGHLLLQPVASAHMEQSEALRMEEKGTPQASCS

SEQ ID NO: 33330 - protein, 89 aa, Cebus imitator
VAFEDVAVNFTLEEWALLDPSQKNLYRDVMRETFRNLASIGKQWEDQNIEDPFKLPGRNTSHIPERICERKEGSQSEETFSQIPDGILN

SEQ ID NO: 33331 - protein, 89 aa, Delphinapterus leucas
VNFHRVTVDFTQEEEGTLNPARRTLDRDVILENHRHLVSWESATALGRRESTSKQSIFGDEPSHRVKIERLTRDDPWLSSCEEVQDCKE

SEQ ID NO: 33332 - protein, 89 aa, Acinonyx jubatus
ESFKIVTVDFTQKEEGTLNPVQRTLDRDVNLENHRDLVSWDLATALGRRESISKQNIFDDEPFHGVKLERLTRDDPWLASCEEVQDCKD

SEQ ID NO: 33333 - protein, 86 aa, Acinonyx jubatus
LTFRDVAIEFSQEEWECLDPAQRALYRDVMLENYRNLVSLGEDNFSPEVGSPSAGFTVKELSPVENINKGEFYHLIILERNESHGI

SEQ ID NO: 33334 - protein, 92 aa, Bison bison
LTFKDVFIDFTPEEWECLDPAQRTLYKDVMVETLGNLLSVVHQRIHTGEKPYKCNVCGKAFSHSANLTVHRRLHTGEKPYKCDVCGKAFNQT

SEQ ID NO: 33335 - protein, 88 aa, Rhinopithecus roxellana
VTFEDVAVYFSQEEWRLLDEAQRLLCRNVMLENFSLLASLGCWHGAEAEEAPEQSASVGLCSSNVQQHQKQHCGEKSLKTQEGRVPVL

SEQ ID NO: 33336 - protein, 94 aa, Bison bison
VTFEDVAVYFSQEEWRILDETQRRLYSCVMLETFALVASLGCWQRAEMKEKTSEQNASVEVPQIITSKTDLSIQKAYPWEMGNLDVEGGLHLTE

SEQ ID NO: 33337 - protein, 97 aa, Bison bison
VTFEDVAVNFTWEEWALLDSAQRQLYRDVTLETCGHLACVDWATRHQTKDSTPRQNSLAKRTFQGVNRACLASSGSRLSDFRENWMSHRIEEPGKQR

SEQ ID NO: 33338 - protein, 87 aa, Bison bison
VTFEDVAVDFTLEEWAFLDPSQKKLYRDVMRETLRNLVSIGEKWEDHDIEDQYKNQGRKLRSHVVERLCENKEGSQCEENFSIIPNL

SEQ ID NO: 33339 - protein, 84 aa, Cebus imitator
VTFEDVAVNFSLEEWNLLNEAQRYLYRDVMLETLTLISSLKEDEVAPSKQSTCIHIYKDQRVHSGERPCEYSNYGKLFHQNTTL

SEQ ID NO: 33340 - protein, 90 aa, Cebus imitator
VAFEDVAVNFTQEEWALLDPSQKNLYREVMQETLRNLISIGKRWSNQNAEDKHQNPRRNLSVHRRLIGERLFQSKESHQHVEVLTQVPDD

SEQ ID NO: 33341 - protein, 93 aa, Macaca mulatta
VSFEDVAVAFTQEEWALLDPSQKNLYRDVMQEIFRNLASVGNKSEDQNIQDDFKNPGGNLSSHVVERLFEIKEGSQYGETFSQDSNLNLNKKV

SEQ ID NO: 33342 - protein, 88 aa, Macaca mulatta
LTFRDVKIEFSLEEWQCLDTAQRNLYRDVMLENYRNLVFLVMCSHFTQDVWPEQSIKDSFQKVILRTCGKYGHENLQLRKDHKSVDAC

SEQ ID NO: 33343 - protein, 88 aa, Ursus maritimus
VTFGDVAIEFSQEEWKCLEPAQRDLYRDVTLENFSNLVSLGKDVVIMQGQTGNKAPRDYNSGRLLPPLVKGENCYWTMVRAGVMEKGP

SEQ ID NO: 33344 - protein, 87 aa, Odocoileus virginianus
VNFKIVTVDFTQEEEGTLSSAQRTLDRDVILENHRDSWDSATALGRRESRLKQSIFDDKLSPSVKIEKLTRDDPWLSSCEEFQDCKE

SEQ ID NO: 33345 - protein, 90 aa, Odocoileus virginianus
VTFSDVAIDFSQEEWACLDSRQRDLYWDVMLENYSNLVSLDLESPYETKSLPSQKNTYGMNFSKGTSNRKSKSRGLDWTCEGELDRSRAP

SEQ ID NO: 33346 - protein, 83 aa, Cebus imitator
VTFKDVAVVFTEEELGLLDPAQRKLYQDVMLENFRNLLSIGNQPFHQDTFHFLRKEKFWMMKTTSQGEGNLGGKIQIETVPEA

SEQ ID NO: 33347 - protein, 85 aa, Bison bison
VTFEDVFVYFSREEWELLEEAQRLLYRDVMLENFAHVAALGYACEADNEEAPSEQIVCVEGVSEVRTPGSCPLIQKVHPCERSDP

SEQ ID NO: 33348 - protein, 86 aa, Odocoileus virginianus
VVFEDVAVYFSQEEWGLLDEAQRLLYCQVMLQNIALLSSIGGDRGSELDPSHGPTTPRGVCGFRRLFNTVLLTGPHGGCAYELGSV

SEQ ID NO: 33349 - protein, 87 aa, Cebus imitator
MSFEDVAVTFTQEEWALLDLSQKSLYRVVMHEIFRNLASVGNKSENQNMQDDFKSPVRNLNSHMVERLFEIEEGSQCGEAFNQDSNF

SEQ ID NO: 33350 - protein, 113 aa, Pan troglodytes
VTFEDVAVYFTQNEWASLHPMQRALHREVMLENYANVTSLYPTAGGFPLDTERTEKVPGALSSFLPSSSSLELILALLPMSAFPFPKPDLIFQLEQGEAAWGPDPWTLAGGET

SEQ ID NO: 33351 - protein, 103 aa, Sapajus apella
VTFEDVTIIFTWEEWKFLDSSQKRLYREVMWENYTNVMSVGNWNEGYKSQEEKYRYLEYENFSCWQGWWNAGTQIYEIQNYGETVQGEDSKDLKQQSFSQCQK

SEQ ID NO: 33352 - protein, 85 aa, Rhinopithecus roxellana
MASPSPPPESKEEWDYLDPAQRSLYKDVMMENYGNLVSLGLTVLPRLVCSDANMACCSLNLLDLSDQSLHLSYLSSWDYRCFEQR

SEQ ID NO: 33353 - protein, 83 aa, Rhinopithecus roxellana
VTFKDVAVVFTEEELRLLDLAQRKLYREVMLENFRNLLSVGHQPLHRDTFHFLKEEKFWMMETVTQREGNLGGKIQTEMETVP

SEQ ID NO: 33354 - protein, 103 aa, Aotus trivirgatus
VTFEDVTIIFTWEEWKFLDSSQKRLYREVMWENYTNVMSVGNWNESYKSQEEKFRYLEYENFSCWQAWWNAGTQIYEIQNYGETVQGEDSKDLKQQGFSQCQE

SEQ ID NO: 33355 - protein, 82 aa, Acinonyx jubatus
VTFEDVAVYFSKEEWGLLDAGQRDLYHNVMLENFELMTSLGCWHGVEDEGAHSKQNASIQGMLQVRIPTANLSMQKADTCDM

SEQ ID NO: 33356 - protein, 89 aa, Cebus imitator
VTFDDVAVEFTPEEWALLDTTQKYLYRDSMLESYKNLVSVGFLQQWEIQPTTKGSSLQQSFLKNEIFNGLQMLRSYRLGELCDCKNCGE

SEQ ID NO: 33357 - protein, 100 aa, Monodelphis domestica
VTFRDVAVDFTQEEWGCLEPWQKQLYREVTLDNYRNLLSLAGLPGPGADVISQVERGETPGELPGGGTGLPVCKPDVIAQLEQGEAPWMLEREGPPRASL

SEQ ID NO: 33358 - protein, 104 aa, Panthera pardus
MTFEDVAVYFSQEEWRLLDEAQRRLYRDVMLEVFALVVSLGCWHGAGAEEAPSEQSVPVGVSQVSSAKAALSPHEVHSPDSEGDLHPAESPGASPGQKACGTGG

SEQ ID NO: 33359 - protein, 90 aa, Odocoileus virginianus
VMFRDVAIDFSQEEWDCLDSAQRDLYRDVMLENYSNLVSLDLPSRGANKLLSPKKYIYETELSQWEMSARLENCDLENSSSRDYLEVKGI

SEQ ID NO: 33360 - protein, 87 aa, Pan troglodytes
VAFEDVAVNFTQEEWALLDSSQKNLYREVMQETCRNLASVGSQWKDQNIEDHFEKPGKDIRNHIVQRLCESKEGGQYGEVVSQIPNL

SEQ ID NO: 33361 - protein, 96 aa, Tursiops truncatus
VTFEDVAVHLTREEWGCLDPVQRALYREVMLENYGNLVSLGILLRLPTTRIHSVNSCPALSHTQASAFSGETLAVLSAGISKRWPRYRLPIDSARP

SEQ ID NO: 33362 - protein, 93 aa, Enhydra lutris
VTFEDIAVSFSWEEWDLLDEAQRHLYQDVMLENLALITSLGCWHGAEDEEARSEQSITVERVSQVRTPKTGLFPQKANPCEVCDLVLKDNFHA

SEQ ID NO: 33363 - protein, 113 aa, Pongo abelii
VTFEDVAVYFTQNEWASLHPTQRALYRGVMLENYANVTSLYPTAGGFPLGTERTEKVPGALSSFLPSSSSLELILALLPMSAFPFPKPDLIFQLEQGEAAWGPDPWTLDGGEA

SEQ ID NO: 33364 - protein, 112 aa, Macaca mulatta
FEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPYTSAASGKW

SEQ ID NO: 33365 - protein, 85 aa, Pan troglodytes
VTFEDVAVLFTEAEWKRLSLEQRNLYKEVMLENLRNLVSLAESKPEVHTCPCCPLAFGSPQFLSQDELHNHPIPGFHAGNQLHPG

SEQ ID NO: 33366 - protein, 82 aa, Phascolarctos cinereus
VTFKDVAVEFTQEEWVQLNPSQKKLYRDVMLENYKNLVSLGYQCHAMKPNPLHLNCHSKILKMKWPKYPALRSFLYLNCQAF

SEQ ID NO: 33367 - protein, 84 aa, Physeter macrocephalus
VTFEDVTINFTWEEWKFLDSSQKKLYREVMWENYTNVMSVGNWKESYRPQEERFRYFEHEHLSCWQGWRNASTQIYDNQNYVEM

SEQ ID NO: 33368 - protein, 83 aa, Physeter macrocephalus
LTFEDVAIEFSQEEWECLDPAQRALYRDVMLETYRNLISLGKAEGKKWMENVINAYRTLLTSFFQNLTRGFSFILKQLLGQRR

SEQ ID NO: 33369 - protein, 86 aa, Zalophus californianus
VTFEDVVVYFSWEEWGLLDETQRCLYHDVMLENFALVISLGCWYGMENEEKMALGKTPSPDSSVWKAQPCEKCVLLGRDILYVAED

SEQ ID NO: 33370 - protein, 84 aa, Rhinolophus ferrumequinum
VTFEDVFVYFSREEWELLEEAQRCLYRDVMLENFALVASLDCWRGAAHEGSHSEQSISVGVSQVRTPESGPFIQKVHPCEMCEP

SEQ ID NO: 33371 - protein, 87 aa, Sus scrofa
VVFEDVAVNFTLEEWALLAPSEKKLYRYVMQETFRNLASIGKTWEDHDIEDQHKNQGSKLRSHMVEAFCANKESSPCGRNLSLIPSL

SEQ ID NO: 33372 - protein, 90 aa, Ursus arctos
VTFSDVAIDFSQEEWACLDSTQRDLYWDVMLENYSNLVSLDLESPYGTKSLPTEKGIYEINLSKWNSNGKSKSLGLDWMCEGEFEGPQGP

SEQ ID NO: 33373 - protein, 89 aa, Pteropus vampyrus
VVFADVAVNFTREEWALLDNSQRRLYRDVMLETCRNLAFVGCYTEVKISGSCSQRNILDNNIANKEKTVRFTRNDSWSVWGENQTLNDN

SEQ ID NO: 33374 - protein, 91 aa, Equus caballus
VTFEDVFVSFSREEWELLEKAQRLLYRDVMLENFAHVASLACWREADSEEAPSEQSNSIGVLQIRTAMSGSFIREAHPWEMRDPLLKDILH

SEQ ID NO: 33375 - protein, 90 aa, Rhinopithecus roxellana
VAFEDVAVNFTQEEWALLGPSQKSLYRNVMQETIRNLDCIETKWEDQNIGDQCQNPRRNLRSHTCEIKDDSQCGETFGQIPDSIVNKNTP

SEQ ID NO: 33376 - protein, 87 aa, Delphinapterus leucas
VTFKDVAVVFTEEELGLLDSAQKKLYQEVMLENFQNLVSVGEEGHSGTEHRISPCGHQSFTPDVISQSKREEKLWMIKIATQSRRSL

SEQ ID NO: 33377 - protein, 84 aa, Odocoileus virginianus
MDHLASTQRALYREVMLENYRAVASLDRPGRSPGVAVCHPAHLPVPIPSRRAACPFPTPALIFQLERGGTPWSLASQEGLNGES

SEQ ID NO: 33378 - protein, 94 aa, Odocoileus virginianus
VTFEDVAVYFSQEEWRILDETQRRLYCYVMLETFALVASLGCWQRAEMKEKTSEHNTSVEVPQIITSKTDLSIQKACPWEMGNLDVEGGLRLAE

SEQ ID NO: 33379 - protein, 83 aa, Cebus imitator
VAFEDVAVRFTQEEWALLVPSQKNLYRDVMQETFKNLASVGKTWKVQNIEDGYKDFRRNLRRSFTLVAQVGVQWRDLGSPQPP

SEQ ID NO: 33380 - protein, 113 aa, Callorhinus ursinus
LTFRDVAIEFSQEEWGCLNLVQRELYRDVMLENYGNLLFLGEDNFLPDFPNHTQGFLPSLEDRLLEDSSLHDWDSDRCSKGSLVVSKPDLVIFLEQKRELWDVKGKETVAIHP

SEQ ID NO: 33381 - protein, 96 aa, Rhinolophus ferrumequinum
VTFEDVAVHLTREEWGCLDPVQRELYREVMLENYGNVVSLGILLRLPTTRIHSVNSCPALSHTQASAFSGETLAVLSAGISKRWPKYRLPIDIARP

SEQ ID NO: 33382 - protein, 83 aa, Odocoileus virginianus
RSLENDGVCFSEQEWENLEDWQKELYANVMKSNYETLVSLKVLGQPEGDMELGAEMPGDLEEEESHGGHPAVEEVVVKQETQY

SEQ ID NO: 33383 - protein, 94 aa, Odocoileus virginianus
VRFADVAVYFSPEEWGCLLPAQRALYRDVMRETYGHLGALGATPNKREEESEAGLGAQAPKKAPGKEKPEELVKHNPGTTVSKTSARAQPPKQA

SEQ ID NO: 33384 - protein, 113 aa, Rhinopithecus roxellana
VTFEDVAVYFTQNEWASLHPTQRALYREVMLENYANVTSLYPTAGGFPLGTERTEKVPGALPSFLPSSSSLEVILALLPMSAFPFPKPDLIFQLEQGEAAWGPDPWTLAGGEA

SEQ ID NO: 33385 - protein, 87 aa, Rhinopithecus roxellana
VAFEDVSVSFSQEEWALLAPSQKKLYRDVMQETFKNLASIGEKWEDQNVEDQHKNQGRNLRSHMGERLCEGKEGSQRAETFSPNLSV

SEQ ID NO: 33386 - protein, 84 aa, Cebus imitator
RDVVTEFSPEEWACLDPAQRNLYRDVMFENYRNLVSLGEDNFNTQLILHTTDFIFFTSKMLPESLSFGLNYLHLMKDRKTVSEG

SEQ ID NO: 33387 - protein, 104 aa, Ovis aries
VTFKDVAVDFSMEEWELLDPGQRKLYRDVMLETCGNLASVEALRNQRPNSGFEDGTICLASASQVTTFSLWTTYSLFQPVVSLHLEQGEAMWMVGKGTLRASCS

SEQ ID NO: 33388 - protein, 86 aa, Acinonyx jubatus
LTFRDVAIEFSQEEWECLDPAQRALYRDVMLENYRNLVSVGEDNLPPEVGSTSAGFAIKELSPTEDINKGEFYHLVLLERNESHGI

SEQ ID NO: 33389 - protein, 96 aa, Bison bison
LTFKDMFIDFTPEEWECLNPAQRTLYQDTMVETLRNLLSDSEITGHQRIHTGGKPYKCDMCGKAFNQTTKLAVHWRIHTGEKPCKCDVCDKAFIQI

SEQ ID NO: 33390 - protein, 84 aa, Odocoileus virginianus
VTFEDVAVSFSQEEWGLLGEAQRLLYYDVMLENLSLIASLGCWQGGEAEKAISKQCVSVKQVTRNRNPQPDPSILKTLASTMRA

SEQ ID NO: 33391 - protein, 84 aa, Rhinopithecus roxellana
VAFEDVAVNFTQEEWALLDPSQKNLYRDVMQETFRNLASIGNKGKDQSIEDQYKNSSRNLRHIISHSGNNPYGCEECRKKQYTC

SEQ ID NO: 33392 - protein, 83 aa, Rhinopithecus roxellana
VAFEDVAVNFTQEEWALLDISQRNLYREVMLETFRNLTSIGKSWKDQNIEYEYQNPRRNFRSLIEEKVNEIKEDSHCEETFTQ

SEQ ID NO: 33393 - protein, 90 aa, Bison bison
LTFDVVAVDFTWEEWQLLAPAQKALYRDVMLENYSNLVFLGNSFFFSFLEVWKFDDHLLEYLQNESMEKRLEQWHEQNPLENAVHQSITH

SEQ ID NO: 33394 - protein, 88 aa, Bison bison
VTFSDVAIDFSQEEWACLDSRQRDLYWDVMLENYSNLVSLGEKPYECKECGKAFRWGSSLVKHERIHTGEKPYKCTECGKAFNCGYHL

SEQ ID NO: 33395 - protein, 94 aa, Bison bison
VVFEDVAVYFSQEEWGLLDETQRHLYHAVMTENLALVTSLGCCHGAQGEEASSEQGVSIETSEVRTAKPDPSSRKAQSSDMCDPLSRDLLPLPE

SEQ ID NO: 33396 - protein, 86 aa, Lynx canadensis
LTFRDVAIEFSQEEWECLDPAQRALYRDVMLENYRNLVSLGEDNFPPEVGIPSDGFAIKELSPTENINKGEFYHLVILERNGSHGI

SEQ ID NO: 33397 - protein, 104 aa, Rhinopithecus roxellana
VTFEDVSVDFSQEEWELLEPAQKNLYRKVMLENYRNVVSLEALKNQCTDAGIKNGSLSPARTPQVTSLSSWMGYLLLQPAASSHLEQREALWMEEKGAPQASCS

SEQ ID NO: 33398 - protein, 92 aa, Bison bison
VSFKDMSVEFTWKEWQHVNPAQRTLYRDVMLENYSHLVSPVAMYGCESWTVKSIGTHLEFVYFECRLDNLLKKSLANEGKLLQRDFTQHQTT

SEQ ID NO: 33399 - protein, 88 aa, Bison bison
SGVVHVAVNFTWEEWLLLDSSQKKLHRDVMLENIRNLASVVAKQPDHHDIDEQEKNHGKKLRRPMIEKLCKSKDISSFGENFNLITTL

SEQ ID NO: 33400 - protein, 97 aa, Pongo abelii
VTFTDVAVNFTKEEWTLLDPAQRNLYRDVMLENSRNLAFIDWATPCKTKDATPQPDILPKRTFPEANRVCLKSISSQLSTLREDWRCPKTEEPHRQG

SEQ ID NO: 33401 - protein, 83 aa, Pan troglodytes
VAFKDVAVNFTQEEWALLDISQRKLYREVMLETFRNLTSIGKKWKDQNIEFEYQNPRRNFRSLIEGNVNEIKEDSHCGETFTQ

SEQ ID NO: 33402 - protein, 82 aa, Acinonyx jubatus
VMFRDVAIDFSQEEWECLDSAQRDLYRDVMLENYSNLVSLVDLPSRSANKDLSPKKDTYETELSQWEMSARLENCDLEESSS

SEQ ID NO: 33403 - protein, 90 aa, Trichechus manatus
VTFEDVAVYFTQSQWASLGPLQRALYREVMLENYANVASLGKGGVLDPERKDSSGSTVAFPFPKPVLISQLEREEAPLGPDPWETEVLRD

SEQ ID NO: 33404 - protein, 103 aa, Callithrix jacchus
VTFEDVTIIFTQEEWKFLDSSQKRLYREVMWENYTNVMSVGNWNESYKSQEEKFRYLEYENFSCCQGWWNAGTQIYEIQNYGETVQGEDSKDLKQQSFSQCQE

SEQ ID NO: 33405 - protein, 90 aa, Sapajus apella
VTFADVAIDFSQEEWACLNSAQRDLYWDVMLENYSNVVSLDLESAYETKNLPTEKSLHEIRVSKRNSDRRSKSLGHNWIYEGTPERPQRS

SEQ ID NO: 33406 - protein, 89 aa, Trichechus manatus
VVVEDVAVDLTQEEWALLDLAQRKLYIDVMLETFINLASVVSRNLNDGENLSSEYLIVQFTKNDSLFYKLEEISELHGIEDQHENQGRH

SEQ ID NO: 33407 - protein, 87 aa, Sus scrofa
VTFEDVAVNFTLEEWALLNPSQKSLYRDVMKETFRNLASIEKKWDSHNIEDWYKTQGRKARSHMVEKLCESKENSQHGKTVSQISNL

SEQ ID NO: 33408 - protein, 90 aa, Pteropus vampyrus
VTFSDVAIDFSQEEWACLDSTQRDLYWDVMLENYSNLVSLNLESPYETKNLLTEKGINEINFSKWNPDGKSKSLGLYWLCEGELVGAQGP

SEQ ID NO: 33409 - protein, 90 aa, Vicugna pacos
VMFRDVAIDFSQEEWECLDSAQRDLYRDVMLENYSNLVSLDLPSRSANKDLSPKEDTYETELSRWEMSARLENCDLEEPSSRDYLDVNST

SEQ ID NO: 33410 - protein, 90 aa, Physeter macrocephalus
VTFSDVAIDFSQEEWACLDSTQRDLYWDVMLENYSNLVSLDLESPYETKSLPTQKGTYEINFSKQNSNRKSKSLGLDWMCEGEFERPQAP

SEQ ID NO: 33411 - protein, 94 aa, Saimiri boliviensis
MVFEDVAIHFSQEEWGILNDVQRHLHSDVMLENFALLSSVGCWHGAKDEEAPSKQYVSVGVSQVTTLKPALSTQKAQPCETCSSLLKDILHLAE

SEQ ID NO: 33412 - protein, 99 aa, Ursus maritimus
LTLALTTVKTQASLLPSLSQAILDLLERAALVSPRDLSYLCQLWPGTFPREHRRGENGSCASNSQTAGLLVPKPDVIFQLKRGEEPWKLDFQEDEKSEV

SEQ ID NO: 33413 - protein, 87 aa, Monodelphis domestica
IALKDVTVDFTWEEWRLLDHSQKELYLEVMLENVQNLLSVEAETTFEVTEMTTMPSFFVKRYDPQRCMNEGPSGFILREIIDSNIKV

SEQ ID NO: 33414 - protein, 103 aa, unidentified
  REGION 1..103: note = Bos indicus x Bos taurus
LTFQDVAIDFTQEEWECLDPGQRKLYRDVMVENYRNLASLGLVSKVDLVTFLELLKDPRNMRRMETTAIYPGLVVSKVDLVTFLEQMKDPRNISRMETMAMYP

SEQ ID NO: 33415 - protein, 94 aa, Sapajus apella
MVFEDVAIYFSQEEWGILNDAQKHLHSNVMLENFALLSSVGCWHGAKDKEAPSKQCVSVRVLQVTTPKPALSTLEAQPCKTCSTLLKDILHLAE

SEQ ID NO: 33416 - protein, 89 aa, Acinonyx jubatus
VVFEDVAVYFTPEEWALLDRGQRKLYRDVMLETCRNLAAVDCCTQVKTCGSRTQLNILENELSSEEKIVRFTRNDPWALFRENPVFHNI

SEQ ID NO: 33417 - protein, 87 aa, Rhinopithecus roxellana
LTFRDVAIEFSPEEWKCLDPAQQNLYRDVMLENYRNLVSLAMCSHFTQDFLPGQGIEDSFHKCILRRYEKCGHENLQLRRDCKSMNV

SEQ ID NO: 33418 - protein, 93 aa, Acinonyx jubatus
VTFEDVAVNFTLEEWALLDSSQKKLYRDVMRETFRNVASVEKKWKDHDTEYRCKTQGRKTGSPTVGKPCESKEGRQWEETTSQIPDVNLNKKT

SEQ ID NO: 33419 - protein, 92 aa, Aotus trivirgatus
VTFEDVAVRFTQDEWPLLDPSQKNLYRDVMQETIRNMKSIGIKWKDQNIEDHCKDSRRNPRNHMAERLCECKDCQCEETFSLIPDAIMNKKT

SEQ ID NO: 33420 - protein, 85 aa, Planctomycetes bacterium
LSLRDISIEELSANWKYLDPVGRQRARHVLLENQRVADGLAALEAGDLMTLGILMSRSHKSSMTDFQNSSDALDALVESALTAPG

SEQ ID NO: 33421 - protein, 85 aa, Macaca mulatta
FEDVAVNFTHEEWALLGPSQKNLYRDVMRETIRNLNCVGMKWENQNIDDQYQNLRRNPRCDVVERFGKSKDGSQCEETLSQIRNS

SEQ ID NO: 33422 - protein, 84 aa, Bos taurus
VTFEDVAVDFTQEEWQRLSPEQRDLYRDVTLENYRNLVSMGERGVPCIGRGVLIHGTTRKSVSLYSVLGKDWAIEEQSWRFQDI

SEQ ID NO: 33423 - protein, 84 aa, Pan troglodytes
LAFMDVAVEFSPEEWECLDPAQRSLYRDVMLENYRNLISLGEDNFNMQFLFHSLAMSKPELIICLEARKEPWNVNTEKTAKHSA

SEQ ID NO: 33424 - protein, 82 aa, Pan troglodytes
EDVAVDFTLEEWALLDSAQRDLYRDVISVARCEMWERDMYGQEKSKEQTIPNFTGNNSCAYTLEKNCEGYGTEDHHKNRRNR

SEQ ID NO: 33425 - protein, 87 aa, Leptonychotes weddellii
VTFRDVAIEFSQEEWKCLEPAQRDLYRDVTLENFSNLVSLELESRCEKFPQKDISEVESFSWEIMESLKCCDFDGSSLRDGWEYKGQ

SEQ ID NO: 33426 - protein, 86 aa, Leptonychotes weddellii
VTFRDVAIEFSEEEWECLDPAQRALYRDVMVENYRNLVSLGEDSFPPEVGSLSAGFAIKDLSPIEDINKGELYHLVILERNETHSI

SEQ ID NO: 33427 - protein, 93 aa, Leptonychotes weddellii
LTFEEVAMYFSQEEWELLDPTQKALYNDVMRENYETIISLAVPVHQILAFSEKTNTKDWTVAPEFVLPESQSLLTFEEVAMYFSQEEWELLDP

SEQ ID NO: 33428 - protein, 90 aa, Felis catus
LMFSDVSIVFSQEEWEYLDLEQRDLYRDVMLENYSNLVSLDLETRYETKKLSSENDIYEINLPQWKIMERINHGLKGLILKSDWESKRKF

SEQ ID NO: 33429 - protein, 83 aa, Pongo abelii
VAFKDVAVNFTQEEWALLDISQKNLYREVMLETFRNLTSTGKKWKDQNIEYEYQNPRRNFRSVIEERVNEIKEDSHCGETFTP

SEQ ID NO: 33430 - protein, 84 aa, Myotis davidii
VTFEDVAVYFTQNEWDILDPVQRALYREVMENYANVAFVGGETRIEREKSTPKEHIAKESESRRLTLAGLPGNVPQDLDLGSSP

SEQ ID NO: 33431 - protein, 87 aa, Myotis davidii
VAFEDVAVKFTLEEWALLGPSQKTLYRDVMRETFRNLASIGKRWEEHDIEDQYKNQRRKLRNPMVEKLCESKEVSQYGENFSLISNL

SEQ ID NO: 33432 - protein, 104 aa, Cercocebus atys
VTFEDVSVDFSQEEWELLEPAQKNLYREVMLENYRNVVSLEALKNQCTDAGIKKGSLSPAQTPQVTSLSSWTGYVLLQPAASSHLEQREALWMEEKGTPRASCA

SEQ ID NO: 33433 - protein, 84 aa, Felis catus
VVFEDVAIHFSQEEWGLLDGAQRLLYHAVMMENLALLSSLGCWHGAQDEEASQVRTPKPDSSVQEAQCEKDMLPSAEQDGMYSD

SEQ ID NO: 33434 - protein, 99 aa, Callithrix jacchus
VSFEDVAVTFTQEEWALLDLSQKSLYRDVMQEIFRNLASVGNKSENQNMQDDFKSPGRNLSSHMVERLFEIKEGSQYGEAFNQDSNFNLNKKISTGVKP

SEQ ID NO: 33435 - protein, 91 aa, Vulpes vulpes
VAFEDVTVKFTMEEWALLDHSQKKLYRDVMQETFRNLASIVCMSEEKWKIHDSEDQVENHETNLSSQMVERLSKSKECNQYEEIFSQIPYH

SEQ ID NO: 33436 - protein, 86 aa, Vulpes vulpes
LTFRDVAIEFSEEEWECLDPAQQALYRDVMLENYRNLVSLGEDNFPPEVGGLSAGFATKELSPIEDINKGELYHLVILERNKSDDI

SEQ ID NO: 33437 - protein, 86 aa, Pongo abelii
LTFMDVAIEFSLEEWQCLDTSQQNLYRHVMLENYRNLVFLAVAFTFDLSGLNILSFQSILPFISALYVMGNRNQCLQKHLEAGNKD

SEQ ID NO: 33438 - protein, 83 aa, Pan troglodytes
VALEDVAVNFTREEWALLGPCQKNLYKDVMQETIRNLDCVGMKWKDQNIEDQYRYPRKNLRCRMLERFVESKGGSQCGETSSQ

SEQ ID NO: 33439 - protein, 84 aa, Pan troglodytes
VTFRDVTVIFTEAEWKRLSPEQRNLYKEVMLENYRNLLSLDGVSLLLPRLECNRAISAHHNLCLPGSSNSPATASRVAGITAEP

SEQ ID NO: 33440 - protein, 90 aa, Cercocebus atys
LQFRDVAIEFSLEEWHCLDTAQRNLYKNVMLENYSNLVFLVVCSHFAQDLWPEQNMKDSFQKMIPRRYEKRGHGNVQLIKWRESMDECKV

SEQ ID NO: 33441 - protein, 83 aa, Cercocebus atys
FTFKDVAIEFSQEEWECLDPAQRALYRDVMLENYRNLLSLDEDNVLPENDISFGFTSKGLSPKENNKEELYHLVILERKESHG

SEQ ID NO: 33442 - protein, 88 aa, Leptonychotes weddellii
VAFEDVTVNFTLEEWALLNPSQKKLYRDVMQETLRNLASIGEKWEDRNSKSLYEHQQTDLSRPVVESPCKNKEGSLCGESFSQNPDHK

SEQ ID NO: 33443 - protein, 92 aa, Felis catus
GEGGDVAVYFSWEEWRLLDEAQRCLYHDVMLENFALISSLGLVSSMSHVVAQGLQRRVLAYYRMDMTPDVARWTQRGKGWAGPVSLRSGCCC

SEQ ID NO: 33444 - protein, 90 aa, Myotis davidii
RNCTDVAIDFSQEEWACLDSTQRDLYWDVMLENYSNLVSLDLESPHETKNLPTEKGICEMRFSKWNSDGKSKSLGLDWVCEGELAGARGP

SEQ ID NO: 33445 - protein, 91 aa, Leptonychotes weddellii
VSFADVAVYFSPEEWGCLRPAQRALYRDVMRETYGLLGALGEVEAWSAEAQDPEGETPAAVIRDRGKITGSRDESEEKEELKKSPKRKEME

SEQ ID NO: 33446 - protein, 82 aa, Neomonachus schauinslandi
VTFKDVAVVFSEEELGLLDSTQRKLYRDVMLENFRNLVSVGTKSQHIMESNQEVGLGYISPKELSSRQTWQQGAGGLTRCQD

SEQ ID NO: 33447 - protein, 87 aa, Physeter macrocephalus
LAIEDVVVNFTLEEWALLDPSQKKLYRDVMQEIFWNLASVGKTWEDHDIGDQYKNQGGNLRSPMVERLSERKDSSSCGEHFSLIPSL

SEQ ID NO: 33448 - protein, 95 aa, Monodelphis domestica
VTFQDVAVVFTREEWRLLSPPQKELYKEVMLENARNLLSVGEMRSEMTNPTEVSLPVEELNLQRFMSYGPNNIAFREFCVSPKNLSHIEHQRMHT

SEQ ID NO: 33449 - protein, 89 aa, Camelus dromedarius
VTFRDVTVDFTQEEWQHLEPAQRDLYRDVMLENFRNLVSLDLETRPEMKELDPQEDILEDRPSFGVVAGGPTRKGAWGSALDGARTQGA

SEQ ID NO: 33450 - protein, 86 aa, Cercocebus atys
LTFRDVAIEFSLEEWQCLDTAQQGLYRKVMLENYRNLVSLVICSHFAQDLWPERDIKDSFQESILKKYRNYEHDNLQLQKGCKSVD

SEQ ID NO: 33451 - protein, 85 aa, Leptonychotes weddellii
VTFEDVAVYFTQNEWVILDSSQRALYREVMLENYANVASLGGETRAEKEESTPKEHISKETESHRLTLGGLPGNVPQRLDFGSSP

SEQ ID NO: 33452 - protein, 82 aa, Leptonychotes weddellii
VTFRDVAIDFSQEEWECLDPAQRDLYMDVMLENYSNLVSLGPTLDRQKRVCIYTRSPDLESTYETKNTISEKDIFEINFSQW

SEQ ID NO: 33453 - protein, 91 aa, Felis catus
VMFRDVAIDFSQEEWECLDSAQRDLYRDVMLENYSNLVSLVDLPSRSANKDLSPKKDTYETELSQWEMSARLENCDLEELSSRDYLEVRGT

SEQ ID NO: 33454 - protein, 86 aa, Monodelphis domestica
LTFKDVSVDFTREEWCLLSPPQKELYKEVMLENARNLLSVGDIRPEMKANPREVSFPVEEMELQRFMRHGPNNFSSREFSVAPQNS

SEQ ID NO: 33455 - protein, 87 aa, Monodelphis domestica
LTFRDVAVDFTQEEWRRLAPAQRALFRDVMLDNYENLVSLDSLSWHSVFETKDLNVFQCSMQPSAKKNLPNDSPWHPEMSQIGGEYD

SEQ ID NO: 33456 - protein, 88 aa, Aotus trivirgatus
VTFEDVTLGFNPEEWGLLDLKQKSLYREVMLENYRNLVSVEYSELQLDAKLDPLSAESPLMNIEVVEVLTLNQEVAGPRNAQIQALYA

SEQ ID NO: 33457 - protein, 87 aa, Papio anubis
VVFEDVAIYFSQEEWGHLDEAQRLLYRDVMLENLALLSSLGCWHGAEDEEAPSQQGFSVGMPEVTTSKSCLSTQKVHPSETCDPPLK

SEQ ID NO: 33458 - protein, 114 aa, Papio anubis
VTFEDIAVYFSQEEWGLLDEAQRCLYHDVMLENFSLMASVGCLHGIETEEAPSEHTISAQGVSQARTPKPGPSIPNAHSCEMCILVMKDILYLTEHQGTLPWQKPCTSAASGKW

SEQ ID NO: 33459 - protein, 89 aa, Leptonychotes weddellii
VTFEDVALYFSWEEWDLLDEAQRCLYHDVMLENFALTSSLGCWHGVEDEDAPSEESISIGVSQIGALKAVSSSQKAQPFELHGPILRNI

SEQ ID NO: 33460 - protein, 107 aa, Monodelphis domestica
VTLEDVAVYLSREEWRQLDPAQRNLYRDVMQEKNGLTLGEEPFACGFYAGSGFSSFLEPFLDACLGGLYSLGSTFMLTVSPDSSCECQRKTQKPNICQDKGSRGPPA

SEQ ID NO: 33461 - protein, 82 aa, Leptonychotes weddellii
VVFEDVVVDFTPEEWALLDPGQRRLYKDVMLETCRNLASLGENWKCPGIEHQHKNEGTCMRSGIEKDEERGRHENSEGGKKT

SEQ ID NO: 33462 - protein, 91 aa, Neomonachus schauinslandi
VSFADVAVYFSPEEWGCLRPAQRALYRDVMRETYGHLGALGDTPNKKEEAPQEGPGAKGPRKPPGKEPSKELVKHSPDWTIGQFSARAQRP

SEQ ID NO: 33463 - protein, 87 aa, Monodelphis domestica
ITFKDVAVDFTQEEWCLLDHSQKELYLEVMLENVQNLLSVAVNFEAKVMCTKLSPFVDGSGPQRCTNEDPHDFIWREICDSTIKVNK

SEQ ID NO: 33464 - protein, 86 aa, Monodelphis domestica
VTFQDVAVDFTREEWRLLSPPQKELYKEVMLENVRNLLSVGEIRPEMKVNPSEVSLPVEEMDLQRFMSDGLDNFASRKFCVAPQNS

SEQ ID NO: 33465 - protein, 96 aa, Monodelphis domestica
MFQDVAVDFTREEWCLLSPPQKELYREVMLENVRNLLSVEREIRPEKKLTATEVSLSVEEMNLQRFMIDCPDNFAFREFCVAPQNSSHFEHQGIHP

SEQ ID NO: 33466 - protein, 104 aa, Papio anubis
LTFRDVAIEFSPEEWKCLDPAQQNLYRDVMLENYRNLVSLAMCSHFTQDFLPVQGIEDSFHKCILRRYEKFFSLFSSCHVISHRLSRGRNRDAEKNDLLTTEEP

SEQ ID NO: 33467 - protein, 93 aa, Myotis davidii
VTFGDLAIYFSREEWERLSPAHDVRGPGHLLLPGGVGEAEPTQRGLYKDVMLENYQTLVSLGLSRQKPNMIALLEKGKAPWMERFVRRPRGLG

SEQ ID NO: 33468 - protein, 85 aa, Cercocebus atys
MAFEDVAVYFSQEEWGLLDTAQRALYRRVMLENFTLVTSLGSWSVAEDGDVSGECPPAFPDTPPGMTTGVFPVAGAYHSVKSLQR

SEQ ID NO: 33469 - protein, 87 aa, Cercocebus atys
VAFEDVAVNFTQEEWALLDPSQKNLYREVMQETLRNLASIGKKWNNQYIEDEHQNPRRNLRRLIKERLSESKESHQHGEVLTQVPDD

SEQ ID NO: 33470 - protein, 82 aa, Monodelphis domestica
LRFQDVVVNFTQEEWSLLDPAEKDLFWDVMLENYENFISLAPFQMFLHEQGLPDSKPLLISQLERRETSWLPMEEILKSLYL

SEQ ID NO: 33471 - protein, 87 aa, Monodelphis domestica
LTFKDVAVDFTREEWHLLSPSQKKLYEEVMLENARNLLSVEGETRPEMKVNPTEMSPSVEEMDVQRFMSDGPDNFAFKKFFVAPQHS

SEQ ID NO: 33472 - protein, 93 aa, Camelus dromedarius
VVLEDVAVAFSPEEWALLDVAQRSLYRDVMLETFRNLASIGENWGCHSTRGQRRNQGPCLRRHVVERPSENRDGGARGEADRTARLTVQERLP

SEQ ID NO: 33473 - protein, 87 aa, Cercocebus atys
LQFRDVAIEFSLEEWHCLDTAQQNLYKDVMLENYRNLVFVVVCSHFAQDLQPEESIKDSFQKVILRKFEKCGHGNLQFKKGCESVDE

SEQ ID NO: 33474 - protein, 83 aa, Cercocebus atys
VTFKDVAVVFSEEELRLLDLAQRKLYQEVMLENFRNLLSVGHQPLHRDTFHFLKEEKFWMMETVTQREGNLGDKIQTEMETVP

SEQ ID NO: 33475 - protein, 91 aa, Leptonychotes weddellii
MTFRDVAIEFSQEEWECLDPAQRALYRDVMVENYRNLVSLGEDNVPPEVGICPKSSARFIIKELLPKKEISNRELCQPVVLGRHESHGLED

SEQ ID NO: 33476 - protein, 87 aa, Neomonachus schauinslandi
VAFEDVAVNFTLEEWALLDPSQKKLYRDVMRETLRNLASIGKKWKDHNIEDQYKNQGRKLRSHMVERLCQSKEGSQCGGNFSPIPNL

SEQ ID NO: 33477 - protein, 94 aa, Physeter macrocephalus
VTFEDVAVYFSQEEWKLLDEAQRLLYRDVLLETFALVASLGCWHRAEDEETPSEQKVSVEVPQINTSKTDLSTLKSYPWQRFCLHLEGGLHLAE

SEQ ID NO: 33478 - protein, 83 aa, Pan troglodytes
VAFKDVAVNFTQEEWALLDISQKNLYREVMLETFWNLTSIGKKWKDQNIEYEYQNPRRNFRSVIEEKVNEIKEDSHCGETFTP

SEQ ID NO: 33479 - protein, 104 aa, Camelus dromedarius
VTFKDVAMDFTPEEWGRLDPAHRDVMLENYRSLVSLCKDGLSPRPATRWGGHQRFIESEVAEQSLHSGIRGSEGLPVSKAEHYDLENGKDPLVLERKAPKSSCS

SEQ ID NO: 33480 - protein, 93 aa, Camelus dromedarius
MTFEDVAVEFTWWEWGQLDAAQKDLYREGLSFGGCPQHFSTLETKGQSLGLKYDLLHSLPSGFPVSKPHVICQLEKGEEPCMMEREVSTGAHP

SEQ ID NO: 33481 - protein, 110 aa, Cercocebus atys
VTFEDVAVNFTQEEWNLLSEAQRCLYRDVMLENLALISSLGCWCGVEDEEAPSKQSIYIQRETQVRIPMAGVSLKKVHPCEMCGPILGDILHMGDHQGTHPKQKLHSCEA

SEQ ID NO: 33482 - protein, 99 aa, Leptonychotes weddellii
MNFEDVAIDFSQEEWGLLDETQRLLYCDVMLENFALVASLDLHQQQRHGSWEKPWKRDVARASYVTSCNFCVSGQPFTCRKVGEDFPATSGHLQLQTSP

SEQ ID NO: 33483 - protein, 84 aa, Felis catus
VTFGDVAIHFSQQEWEYLDSVQKNLYRDVMMENYDNLVSLDLESKYEIISCEKVHVYKKHSPLTLRQKIHTREKPYECDECGKA

SEQ ID NO: 33484 - protein, 91 aa, Vulpes vulpes
VTFEDVAVYFSREEWGLLNLTQRSLYRDVMLENFALIGSLGCPCRLEDEEAPPEQMKSYGVYLSEKPFLCGESGRGVPATLGLLQHQATHS

SEQ ID NO: 33485 - protein, 82 aa, Vulpes vulpes
VTFEDVAVEFSQEEWALLDPSRRTLYRDVMRENCRNLASLASELKKNRNKPWRAQDTSVLTSGGCSETVGMLALHHSLSFPQ

SEQ ID NO: 33486 - protein, 82 aa, Vulpes vulpes
VTFEDVVVYFSWEEWGLLDETQRCLYHDVMLENFALVISLGCWYGMEDEAALSVQRMSLGKTPSPDPSIWKAQPCEKCVLLG

SEQ ID NO: 33487 - protein, 85 aa, Pan troglodytes
MTFEDVAVYFSQEEWGLLDTTQRALYRHVMLENFTLVTSLGKALVHLVTIRTASSLSSWMPQATTVSLRLGSWSLTEDGDVSGEW

SEQ ID NO: 33488 - protein, 85 aa, Camelus dromedarius
VSFKDVTVDFSREEWQQLDLAQKSLYTDVMLENYFNLISVGKHSSAGQGCISLRCQVPKPEVIFTLELGEEPCMLDDGISSQSCL

SEQ ID NO: 33489 - protein, 85 aa, unidentified
  REGION 1..85: note = Bos indicus x Bos taurus
VTFPDIAVRFSQREWRLLDETQRLLYLDVMLENYTLISSLASCVVFWLALRGVRSRIQDADLHKPLPTLTLPWIQVRCLEDPIEL

SEQ ID NO: 33490 - protein, 83 aa, Pan troglodytes
VAFDDVAVNFTQEEWALLDISQRKLYREVMLETFRNLTSIGKSWKDQNIEYEYQNPRRNFRSLIEKKVNEIKEDSHCGETFTP

SEQ ID NO: 33491 - protein, 83 aa, Pan troglodytes
VAFEDVAVNFTQEEWSLLDPSQKNLYREVMQETLRNLASIGEKWKDQYIEDQYKNPRNNLRSLLGERVDENTEENHCGETSSQ

SEQ ID NO: 33492 - protein, 93 aa, Leptonychotes weddellii
VVFEDVVVDFTPEEWALLDPGQRRLYKDVMLETCRNLASLGENWKCPGIEHQHKNEGTCMRCHVVGIPSENNGSNQCGETNQISNFIVHKRLP

SEQ ID NO: 33493 - protein, 90 aa, Pongo abelii
VAFEDVAVNFTQEEWALLGPSQKSLYRNVMQETIRNLDCIEMKCEDQNIGDQCQNPRRNLRSHTCEIKDDSQYGETFGQIPDSIVNKNTP

SEQ ID NO: 33494 - protein, 91 aa, Cercocebus atys
LEMAVSEPEASAAEWKQLDPAQRNVYHDVMLENYSNQASVEVQQDDDQLENNQKFQNKLLREVVVKKKTQTKENGSDCGSLGKKNNLHTKH

SEQ ID NO: 33495 - protein, 85 aa, Pongo abelii
MASPSPPPESKEEWDYLDPAQRSLYKDVMMENYGNLVSLGLTLLPRLVCSDANTACCSLNLLGLNDQSSHLSYLGSWDYRCFEQR

SEQ ID NO: 33496 - protein, 85 aa, Pongo abelii
VSFADVAVYFSPEEWGCLRPAQRALYRDVMRETFGHLGALGEAGRSGRDTQSVGFSGPKPAFISWVEGEVEAWSPEAQDPDGESS

SEQ ID NO: 33497 - protein, 87 aa, Cercocebus atys
VVFEDVAIYFSQEEWGHLDEAQRLLYRDVMLENLALLSSLGCWHGAEDEEAPSQQGFSVAMPEVTTSKSCLSTQKVHPSETCDPPLK

SEQ ID NO: 33498 - protein, 91 aa, Enhydra lutris
VMFRDVAIDFSQEEWEYLDSAQRDLYRDVMLENYSNLVSLVDLPSRSANKDLSPKNDTYETELSQWEMSARLENCDLEESSSRDYLEVRDT

SEQ ID NO: 33499 - protein, 87 aa, Pongo abelii
VTFRDVTVDFTQEEWQQLEPAQKDLYRDVMLENYRNLVSLDWETRPEMKELDPKNDISEDKPSVVGVATGGPARNGARGPGSEGVWE

SEQ ID NO: 33500 - protein, 85 aa, Pan troglodytes
MASPSPPPESKEEWDYLDPAQRSLYKDVMMENYGNLVSLGLTLLPGLVCSDANTACGSLNLLGLSDQSSHLSYLSSWDYRCFEQR

SEQ ID NO: 33501 - protein, 96 aa, Pan troglodytes
LTFRDVAIEFSLEEWQCLDTAQQNLYRNRNLVFMGEDNFNIQFPNIPYKFYFSFFKIHVICNKTGIAASKPDLITCLEQGKEPWNVKRHEMVAEPP

SEQ ID NO: 33502 - protein, 85 aa, Pan troglodytes
LSFSDVAIEFSQEEWKCLDPGQKALYRDVMLENYRNLISLGEDNVPPEACFCSGICLPDLSVTSMLEQKRDPWTLQSEVKIVNNP

SEQ ID NO: 33503 - protein, 83 aa, Camelus dromedarius
VTFEDVAVYFSWEEWELLDPAQRRLYRDVMQETCRNLASVGETRPFLRAPIRSRVLSICSVSRSLLGSGALVLGKGAMVAAPV

SEQ ID NO: 33504 - protein, 90 aa, Camelus dromedarius
VTFEDVAVNFTMEEWTLLGPSQKKLYRDVMRETFRNLASVGKTWEDHDTEDQYKNQERKLSAILPVILRVIPEVKEVGVMNSNDRMTTSI

SEQ ID NO: 33505 - protein, 90 aa, Felis catus
VTFSDVAIDFSQEEWACLDSSQRDLYWDVMLENYSNLVSLDLESPYGTKSLPIEKGIYEINLSRWNSNGKSKSLGLNWMCEGEFERSQGP

SEQ ID NO: 33506 - protein, 84 aa, Leptonychotes weddellii
LSFKDVVVDFTSEEWQLLDAVQKNLYWDVMLENYSNLVSVASSLFITNTAHVAFLLLNVSPMNRNYISKKPEKLFFHTMHKNTH

SEQ ID NO: 33507 - protein, 90 aa, Enhydra lutris
VTFSDVAINFSQEEWACLDSSQRDLYWDVMLENYSNLVSLDLESPYGTKSLPTEKGLYEINLSKWNSNGKSKSLGLDWMCEGECEGPRGP

SEQ ID NO: 33508 - protein, 96 aa, Pongo abelii
VVFEEVAVNFTPEEWALLDHAQRSLYRDVMLETCRNLASLDCCIYVRTSGSSSQRDVFGNGISNDEEIVKFTRSDSWSIFGENWRFDNIGDQRQSP

SEQ ID NO: 33509 - protein, 97 aa, Pongo abelii
LTFRDVAIELSQEEWKCLDPAQRALYRDVMLENYRNLVSLVANLASHHRIHTGEKPYRCNECGKTFNQTFNLTTHQRIHTGQKPYKCDICGKGFRQI

SEQ ID NO: 33510 - protein, 82 aa, Pan troglodytes
VTFEDVALYLSREEWGRLDHTQQNFYRDVLQKKNRLSLGAVEVGQRVQTSSVAALGNVKPFRTRAGRVQWGVPQCAQEAACG

SEQ ID NO: 33511 - protein, 88 aa, Leptonychotes weddellii
VTFEDVVVDFTQEEWGQLEPAQRTLYHDVMLETFRLLVSVDLETRPKTRLSAPKQDVTERTASSVLVGRFLGDSLWYPEGGDAEGRRG

SEQ ID NO: 33512 - protein, 87 aa, Vulpes vulpes
LTFEDVAVYFSQEEWRLLDEAQRHLYRDVMLEVFALFASLGCGQRTEDEEALSGQNISVGESQINFTQETCGLDSEGDLHPAESLEA

SEQ ID NO: 33513 - protein, 83 aa, Pan troglodytes
VMFRDVAIDFSQEEWECLDSAQRDLYRDVMLENYSNLVSLDLPSRCASKDLSPEKNTYETELSQWEMSDRLENCDLEESNSRD

SEQ ID NO: 33514 - protein, 104 aa, Pan troglodytes
VTFEDVSVDFSQEEWELLEPAQKNLYREVMLENYRNVVSLEGLKNQCTDVGIKEGPLSPAQTSQVTSLSSWTGYLLFQPVASSHLEQREALWMEEKGTPQASCS

SEQ ID NO: 33515 - protein, 85 aa, Camelus dromedarius
VTFSDVAVTFTREELGLLDSAQRELHRDVMLENFRNLLSVGEDRPSILQVRVDITGRERGEALDDGDRNPRRWVFKRELCRFLSS

SEQ ID NO: 33516 - protein, 89 aa, Camelus dromedarius
VTFSDVAIDFSQEEWACLDSTQRDLYWDVMLENYSNLVSLDLESPYETKRLPTHKGIYEINFSKRNSNGKTKSLGLAWMSEEYQKSYQR

SEQ ID NO: 33517 - protein, 103 aa, Myotis davidii
VIFSDVSIVFSQEEWEYLDLQQRDLYRDVMLENYSNLVSLGKSGSPQGWEVTRRSGEGDAPITPLLLPLMAVQALAGPDLETRIHTGEKPYECKECGMAFRQT

SEQ ID NO: 33518 - protein, 98 aa, Leptonychotes weddellii
VTFKDVVVTFTREEWELLDLPQRTLYWKVMRETCRLLVSLDDKAKTSTTELSASQPALFEGCSPHRLLTEDDSSVSTLGEAGEQERPSEKQGGHLRAG

SEQ ID NO: 33519 - protein, 83 aa, Macaca mulatta
VAFEDVAVNFTQEEWALLDIFQKNLYREVMLETFRNLTSIGKKWKDKNIEYEYKIPRRSFRSLIEEKVNEIKEDSHCGETFTQ

SEQ ID NO: 33520 - protein, 93 aa, Macaca mulatta
LTFEDVAIYFSEQEWQDLEAWQKELYKHVMRSNYETLVSLGSQQAVNSRKTKSHFQLDLLESQCSFGSFVSLRSDRGITLRSPQRHNARTPPP

SEQ ID NO: 33521 - protein, 87 aa, Callithrix jacchus
AAFKDVAVNFTQEEWALLDSSQKNLYREVMEETCRNLAIVGNKWKDQNTEDYFKKPGKDIRNHMVQRLCERKEGNQYGEVVSQIPNL

SEQ ID NO: 33522 - protein, 102 aa, Enhydra lutris
VTFADVAVLFTPEEWMFLDSAQRSLYRDVMLENYRNLASVGKDRLIASSTHSCNTYASPEMCWFGKSRGAGDQLGKPSMLSLSEPGEELWAPERRTFPGTRP

SEQ ID NO: 33523 - protein, 113 aa, Enhydra lutris
VIFEDVIVYFSWEGWGLLDENQRHLYHDVMLENLALVTTLGCWHGAEDGKIPSEPTAFVGVSQVGTHHGGPYPQKADPCGICYLVLKDILGVALHQRTCPQLRSYKCRKPVSF

SEQ ID NO: 33524 - protein, 91 aa, Enhydra lutris
VNFADVAVYFSPEEWGCLRPAQRALYRDVMRETYGHLGALGDTPNKKKAAREEGPGAKGPRKTPGKEPSKELVKHNPDWTVRKVSSRAQPA

SEQ ID NO: 33525 - protein, 83 aa, Camelus dromedarius
VTFRDVVISFSQEEWEYLDSAQRDLYWDVMMENYSNLVSLGKYSFSCNLESECCISKSVVITLLEEGKLLWRVARDVTGTQSQ

SEQ ID NO: 33526 - protein, 88 aa, Myotis davidii
VTFEDLAVYFSSEEWELLDEAQRRLYHDVMLENLALMASLAVTAPPDNNLRLSYDVCVRILEWYLSPSCTRTEFDWEKAMTNLMSAAH

SEQ ID NO: 33527 - protein, 111 aa, Myotis davidii
VTFEDVAVNFSLEEWALLDSLQKKLYKDVMRETFRNLASIGGKWEDHEIEDQYKNQGSKQRSQMVERSCKRKEDSQCGENLTLIPNLNLTKSLPGAKPWEYSACGEVFMHH

SEQ ID NO: 33528 - protein, 83 aa, Cercocebus atys
VAFEDVAVNFTQEEWMLLDISQKNLFREVMLETFRNLTSIGKKWKDQNIEYEYKIPRRSFRSLIEEKVNEIKEDSHCGETFTQ

SEQ ID NO: 33529 - protein, 87 aa, Leptonychotes weddellii
VAFEDVAVNFTLEEWALLDPSQKKLYRDVMRETLRNLASIEKKWKDHNIEDQYKNQGRKLRSHMVERLCQSKEGSQCGGNFSPIPNL

SEQ ID NO: 33530 - protein, 87 aa, Leptonychotes weddellii
VTFEEVAVYFSQEEWRLLNEAQRQLYRDVMLEVFALVASLGCGHGTEDEAAPSEQNVSVGRSQINSTKKAYTQERGLDSEGDLHSPS

SEQ ID NO: 33531 - protein, 85 aa, Aotus trivirgatus
VIFEDVAVYFSQEEWGLLNAAQRHLYHNVMVENFELITSLGCWHGVEGEEPHPKKNASVEEVLQVRIANADPSTQKPNPCDMCGP

SEQ ID NO: 33532 - protein, 83 aa, Pan troglodytes
VAFKDVAVNFTQEEWALLDISQRRLYREVMLETFRNLTSVGKRWKDQNIEYEYQNPRRNFSSLIEEKVNEIKEDSHCGETFTP

SEQ ID NO: 33533 - protein, 89 aa, Camelus dromedarius
VTFEDVAVYFSREEWCLLDEVQICLYLDVMLENFALVSMLGSCHGVEDEQPPCEQSSPVGVSQIRTSGAEGEGREHRFGRRNQLFTHME

SEQ ID NO: 33534 - protein, 143 aa, Monodelphis domestica
LTFRDVAVLFTWDEWRRLGPAQRSLYREVMLETFEHLVALGEAGLCQEGVGVGGAQQPEVPPLRPGWAGGDPLLGQGPRPLGASSPWGAGPTRDSRTAFGPRTASFLSPPPGLPVMKPDVLSGPEKGEAPSDPQPGSLCQEQQ

SEQ ID NO: 33535 - protein, 87 aa, Physeter macrocephalus
VTFEDVALNFTQEEWALLNPLQKKLYRDVMQETLRNLTSIGKKWDNHNIEDWYKTQGRKLRSHMVEKLCESKEGNQDGETVSQIPNL

SEQ ID NO: 33536 - protein, 104 aa, Felis catus
MTFEDVAVYFSQEEWRLLDEAQRRLYRDVMLEVFALVVSLGCWHGAGAEEAPSEQSVPIGVSQVSIAKADLSPHEVRSPDSEGDLHPAESPGASPGQKVCGTGG

SEQ ID NO: 33537 - protein, 93 aa, Aotus trivirgatus
VTFEDVAVNFSREEWSLLSEVQRCLYHDVMLENWVLISSLGCWCESEDEEAPSKQNISIQRVSQVSTPRAGVSLKKAHPCEMCGAILGDILQL

SEQ ID NO: 33538 - protein, 91 aa, Papio anubis
LEMAVSEPEASAAEWKQLDPAQRNLYHDVMLENYSNQASMEVQQDDDELENNQKSQNKLLREVVVKKKTQTKENGSDCGSLGKKNNLHTKH

SEQ ID NO: 33539 - protein, 87 aa, Papio anubis
VAFEDVSVSFSQEEWALLAPSQKKLYRDVMQETFKNLASIGEKWEDQNVEEQHKNQGRNLRSHMGERLCEGKESSQCAETVSPNLSV

SEQ ID NO: 33540 - protein, 90 aa, Aotus trivirgatus
VAFEDVAVNFTQEEWALLGPSQKSLYRNVMQETIRNLDCIEMKWEDQNIEDQCQNPRRNLRSHTCEIIDNSQCGETFSQIPESIVNKNTP

SEQ ID NO: 33541 - protein, 84 aa, Neomonachus schauinslandi
VMFEDVAIDFTKEEWALLDISQQRLFRDVMLENISHLVFLGTSIYSLLKVLLHGLTFRSSFYSSLVKPTLDLVIAKVNLHRTQV

SEQ ID NO: 33542 - protein, 87 aa, Monodelphis domestica
MYFTQEEWGQLDSVQKDLYRDVMLETYKNLVSLGWKTRYITNDSISEVESPNAREQFIRIIPQGFRCEELDAEKWLSRKRESFIGET

SEQ ID NO: 33543 - protein, 90 aa, Aotus trivirgatus
VTFADVAIDFSQEEWACLNSAQRDLYWDVMLENYSNVVSLDLESAYETKNLPTEKSLHEIRVSRRNSDRRSKSLGHSWIYEGTPERPQRS

SEQ ID NO: 33544 - protein, 92 aa, Myotis davidii
VTFEDVAVYFSREEWTLLTPAQRSLYREVMLENFALTGWLGCPRRLNDAEAPPQARSCRIHLLERHPRCGEPEEDGPAPPGHPRHQGTLGEG

SEQ ID NO: 33545 - protein, 87 aa, Aotus trivirgatus
VSFEDVAVNFTLEEWALLDSSQKKLYKDVMQETFKNLVCLGKRWEDQDIEDDHRNLGRNRRGHMVERLCESRKGSKCRETTSQMPNV

SEQ ID NO: 33546 - protein, 83 aa, Pan troglodytes
LTLEDVAVDFTWEEWQLLSPAQKDLYRDVMLENYSNLVSVGEDSCPVSLRGCPVSGLPFSAAYLQKIDDPLQHHLQNRSIQKS

SEQ ID NO: 33547 - protein, 86 aa, Leptonychotes weddellii
VTYEDVAVDFTQEEWQHLDPAQKTLHRDVMLEIYSHLVSVDREKSLDSSQQIISEELSFQKEILEKTPKDNSLYSLLKVWHTDGQI

SEQ ID NO: 33548 - protein, 99 aa, Neomonachus schauinslandi
VTFQDVAVDFTQEEWLLLDLTQRNLYRNVMLENYQNLVAVEIKFWIHRKLCHRLHKPLLLMCLFLWTEYQLSKPKLIAWLEQQELRTVEKGVFQEWETQ

SEQ ID NO: 33549 - protein, 85 aa, Neomonachus schauinslandi
VTFRDVAIEFSQEEWECLNPAQRALYRDVMVENYRNLVSLGEDSFPPENDLSAGFAIKDLSPIEDINKGELYHLVILERNESHSI

SEQ ID NO: 33550 - protein, 86 aa, Felis catus
LTFRDVAIEFSQEEWECLDPAQRSLYRDVMLENYRNLVSLGEDNFPPEVGIPSDGFAIKELSPTEDINKGEFYHLVILERNGSHEI

SEQ ID NO: 33551 - protein, 90 aa, Leptonychotes weddellii
VLFEDVAVDFTLEEWALLDSAQRELYREVMLENLKNLASVDDETQFKASGSVSQQDVYGNKIFKEHKIAKFTRNDSWASVLGKIWEEFST

SEQ ID NO: 33552 - protein, 90 aa, Neomonachus schauinslandi
VVFEDVAVDFTLEEWALLDSAQRELYREVMLENLKNLASVDDETQFKASGSVSQQDVYGNKIFKEHKIAKFTRNDSWASVLGKIWEEFST

SEQ ID NO: 33553 - protein, 87 aa, Monodelphis domestica
ITFKDVAVDFTHEEWCLLDHFQKQLYLEVMLENVQTLLSVEAEANFEVKEISTKLRFFVKVSCPQRCMNEGPHDFILRENCDSTINL

SEQ ID NO: 33554 - protein, 98 aa, Aotus trivirgatus
VTFEDVAVHFSWEEWGLLDEAQRCLYHDVMLENLALLTSLDVHYQKQHFGEKHFRSNVDRALFVKTCIFHVSGETSTCIEVGKDFLAKLGFLHQQDTH

SEQ ID NO: 33555 - protein, 84 aa, Monodelphis domestica
VTFKDVAVDFTREEWSLLDDPQKLLYKEVMLENAHNLLSVGEDRPEMKKASTKIALSVEGLQTVEKVHEYPDCGKTFSENSSTP

SEQ ID NO: 33556 - protein, 90 aa, Aotus trivirgatus
VTFEDVAVYFSQEEWRLLDEAQRLLYRNVMLENFSLMASLGCWHGVEAKEAPKQSASVGVLSSNTQQHQKQHCGEKPLKREEGRIPVLRS

SEQ ID NO: 33557 - protein, 104 aa, Felis catus
LSFEDVAVSFSREEWRLLVPAQKDLYRDVMLENYRNLVSVGYQASEPGSLFQLEHAGPLRAVEGAAPRPPCPGYPATNPHMILNFEHGGKPWSIEDELQCQYSS

SEQ ID NO: 33558 - protein, 87 aa, Physeter macrocephalus
VTFEDVAVYFSWEEWDLLDDAQRCLYHNVMLENLALINSLGCWRGAEDEEAPPEQSISVHRMSQVSTPKAGVSTQKAHFCEICSPDL

SEQ ID NO: 33559 - protein, 87 aa, Aotus trivirgatus
VSFKDVAVDFTQEEWGQLDSPQRALYWDVMLENYQNLLALEWEMKEVPSQQQGMCKEEPAQEPILEWPLGGAQAWGRQACALQRSQA

SEQ ID NO: 33560 - protein, 114 aa, Aotus trivirgatus
VTFEDIAVYFSQEEWGLLDEAQRCLYHDVMLENFSLMTSVGCLHGIGAEEAPSEQIVSVEGVSQARTPKPSSSIPNAHSCEMCILVMKDILYLTEHQGTLPWQKPYTSAASGKW

SEQ ID NO: 33561 - protein, 91 aa, Myotis davidii
ISFEDVSVHFSKTEWKLLDLKQRILYKQVMLENYRHLVSLDERIKSKALSSKKKHCPKECASGSKDQGARLLEETPEQTQKHVRSPETGSS

SEQ ID NO: 33562 - protein, 82 aa, Monodelphis domestica
LDFADVAVYFSPEEWGRLRPEQRALYRDVMRETYGHLGALGEERVHEAEGPSSFPGPKPALISWMEEAAWDSEASFPEGEKE

SEQ ID NO: 33563 - protein, 110 aa, Pan troglodytes
VTFRDVAIYFSREEWACLEPSQRTLYRDVMLDNFSSVAALAPDRTSSLAWNSGRSRGLKTGRDLSSRQCGGDPGQGQGSLQTPRDTVIIQLGLTRKPTCGEKEPGKEAAL

SEQ ID NO: 33564 - protein, 82 aa, Myotis davidii
VTFRDVAVDFSQEEWGQLDSPQRALCLKVRLDTGEPEREGEGEGREPRPEREELCRQRGSLKEEPAQESVVEGLLRSSLARE

SEQ ID NO: 33565 - protein, 82 aa, Leptonychotes weddellii
VTLEDMAAYLSQEEWECVDPAQRDYSWDVLPEHGGLGPQLEDGQDTLEDVSMGRERDRELVRGMAGTEQPLERGGPRRVEKP

SEQ ID NO: 33566 - protein, 110 aa, Cercocebus atys
VTFEDVAVKFTQEEWKLLSEAQRCLYRDVMLENLALISSLGCWCGVEDEEAPSKQSIYIQRETQVRIPMAGVSLKKVHPCEMCGPILGDILHMGDHQGTHPKQKLHSCEA

SEQ ID NO: 33567 - protein, 94 aa, Felis catus
VVFTDVAVRFSQEEWGLLDEAQRRLYHSVMLETFALLSSLGCWHGARDEEAPSGHSVSVGASQVRTPKPGPSVQEAQPCETCSSVLKDLLHLAE

SEQ ID NO: 33568 - protein, 146 aa, Myotis davidii
VNFEDVVIAFSQEEWGLLDEAQKLLYYNVMLEVFAFVSSVGCWHKMDDEEACSDQSVSIQGESQVGASKTATATQKTLLCKQCFSVLQHILHLTGSHAAHIEQKAFCSDACVGDVCFSTNPHQQQRNECGEEPWKEAMNGASFVSR

SEQ ID NO: 33569 - protein, 87 aa, Cercocebus atys
LTFRDVAIEFSLEEWQRLDAAQQNLYRNVMLENYRNLAFLDICPHFAQDFWPEQGMEDSFQKVLLRKYEKCGHENLQLRKSCKSVDE

SEQ ID NO: 33570 - protein, 85 aa, Felis catus
VTFGDIAVDFTKEEWALLDASQRELFRDVMLESINHLIFLGDCKRSFRLEQEGELQSEGTGFLQEHSPGEQQGSVGQEEQVPTVS

SEQ ID NO: 33571 - protein, 85 aa, Leptonychotes weddellii
VTFGDVAVHFSREEWQCLDPGQRALYKEVMLENHSSVAGLDSAVGIAGEQACEDMDVLKSEPCVAMVRSPPQGFPQSSSFRDTSE

SEQ ID NO: 33572 - protein, 86 aa, Leptonychotes weddellii
VVFEDVVVDFTQEERALLNPAQRKLYKDVMLETFRNLVSVENWEDQCIEDKHNNEWRHLRSHIVERLCESSKGNTCGETVSRIPNI

SEQ ID NO: 33573 - protein, 87 aa, Physeter macrocephalus
VVFEDVAVNFTLEEWALLDFSQKKLYRDVMGETFRNLASVGETWKDHDIEDQCKNQGRKLRSRKVGRICEGKEDSPCRENLSLIPNL

SEQ ID NO: 33574 - protein, 96 aa, Monodelphis domestica
AVQFSISCDFYPQIFICAQTGRRLFRETRILVAAWGSVSFSICFSSPGILQQQKVLHHLDSLQHGLPFSKPDVISQLEQGEESWVEDLQECEEGEF

SEQ ID NO: 33575 - protein, 87 aa, Physeter macrocephalus
VTFEDVAVNFTLEEWALLDPSQKKLYRDVMRETLRNLASVGEKWEDHDIEDQYKNQGRKLRSHVLERLCESKEGSQCGENFSLIPNL

SEQ ID NO: 33576 - protein, 90 aa, Physeter macrocephalus
VVFEDVAVDFTLEEWALLDSAQRELYRDVMLENFRNLASVDDETQFKANGSVSQQDIYGNKISKEHKISKFTGNDSLASVLGKIWEELSL

SEQ ID NO: 33577 - protein, 88 aa, Papio anubis
VTFEDVTLGFTPEEWGLLDLKQKSLYREVMLENYRNLVSVEYSELQLDPKLDPLPAESPLMNIEVVEVLTLNQEVAGPRNAQIQALYA

SEQ ID NO: 33578 - protein, 84 aa, Aotus trivirgatus
LTFMDVAIEFCLEEWQCLDTAQQNLYRNVMLENYRNLVFLVMCSHFAQDFWPEQHLKDPFRKVTLRTFKNCEHKNLHLKKDCKS

SEQ ID NO: 33579 - protein, 93 aa, Cercocebus atys
VAFEDVAVNFTQEEWALLGPSQKNLYRYVMQETIRNLDCIRKIWEGQNTEDQNKNPRRNLRCHMVERFSESKDSSQCGEPFSLIRGSIVNNSI

SEQ ID NO: 33580 - protein, 99 aa, Papio anubis
VSFEDVAVAFTQEEWALLDPSQKNLYRDVMQEIFRNLASIGNKSEDQNIQDDFKNPGRNLSSHVVERLFEIKEGSQYGETCSQDSNWNLNKRVSTGVKP

SEQ ID NO: 33581 - protein, 84 aa, Aotus trivirgatus
VTFRDVTVIFTEAEWKRLSPEQRNLYKEVMLESYRNLLSLDRVLLLLPRLQCNGIILTHCNLCLLGLSDSPASLKPEIYPCFSC

SEQ ID NO: 33582 - protein, 89 aa, Aotus trivirgatus
VTFEDVAVNFSLEEWNLLNEAQRCLYRDVMLETLTLISSLGCWHGGEEEAAPSKQSTCVHVYKDQRVHNGERPYECGEYRKLFKNKSCL

SEQ ID NO: 33583 - protein, 85 aa, Camelus dromedarius
LSFEDVAVDFTRQEWHRLDPAQRTMHKDVMLENYSNLASVDSLAHVLCHFPLTGLCVAKPEMIFKLERGEELWILEEESSGHGYP

SEQ ID NO: 33584 - protein, 92 aa, Cercocebus atys
MWSLRMWPYFSREEWGILNDAQRHLHSNVMLENFALLSSVGCWHGAKEEEVLSKQCVSVRVLQVTAPKPALSTLKAQPCKTCSSLLKDVLHL

SEQ ID NO: 33585 - protein, 101 aa, Felis catus
AAYEFLSVDYTERKWKGPALSQRAVYRSLMPENYRRVASLGNDSCPDLPAKQEVSKGLGSSDGTSGGLCGVVSGEPEARTVCEGALEKLEGQPSDEEGSRL

SEQ ID NO: 33586 - protein, 82 aa, Felis catus
LTFRDVAIEFSQEEWGCLNHSQRELYRDVMLETYGHLLFLAVSSQCTQNFLPKPCLEPSLQKVSMGEHSTLDNLHLMIDCDN

SEQ ID NO: 33587 - protein, 88 aa, Felis catus
LTFRDVAIEFSQEEWECLDPAQRALYRDVMLENYRNLVSVGSTSAGFAIKELSPKEDINKGRFYHLVLLERNESHGIKDFDLQEVWED

SEQ ID NO: 33588 - protein, 89 aa, Leptonychotes weddellii
VNFKIVTVDFTQKEEGTLNPNQRCDPRDVILENHRDLVSWDLAMALGRRESTSKQNIFDDEPSRGVKLERLTRDDPWLSSCEEVQDCKG

SEQ ID NO: 33589 - protein, 89 aa, Camelus dromedarius
VAFEDVAVNFTLEEWALLDPSQKKLYRDVMRETLRNLALVGNDDDILHIVGGKWEDHNTEDKYKNQGRNLRPVGFHRWLHKFHSKDLSQ

SEQ ID NO: 33590 - protein, 83 aa, Camelus dromedarius
VTFEDVAVYFTQTEWDGLSPAQRALYRDVMLENYGNVASLGKASLPLEFRLCRLGFPGVLPPPLIAGGASGNPILNGNPRADS

SEQ ID NO: 33591 - protein, 92 aa, Neomonachus schauinslandi
VTFEDVFVYFSREEWELLEEAQRLLYRDVMLENFALVASLGCWRETDNEETPSEQSISVGLSQLRTPESGAVIQKAHPCEACDPLLKDVLRL

SEQ ID NO: 33592 - protein, 84 aa, Monodelphis domestica
VTFKDVAVDFTREEWSLLDDPQKLLYKEVMLENAHNLLSVGEDRPEMKKASTKIALSVEGLQTVEKAHEYPECGKTFSENSSTP

SEQ ID NO: 33593 - protein, 87 aa, Pan troglodytes
VAFEDVAVNFTQEEWALLDPSQKNLYREVMQETLRNLTSIGKKWNNQYIEDEHQNPKRNLRRLIGERLSESKESHQHGEVLTQVPDD

SEQ ID NO: 33594 - protein, 85 aa, Camelus dromedarius
VTFGDLAIYFSQEEWEWLSPIQKDLYEDVMLENYQNLVSLAVVPTSYSVQCLPVCRTFLSEAKCDRLTGERESALDGGASEKTLG

SEQ ID NO: 33595 - protein, 140 aa, Myotis davidii
ISFEHLSVDFTQKEWQLLDPCQKDLYKDVMLENYSSLVALEVQSSLDYGPRESIWMKTSIMKSVVVPPPRLNNGRTGAGSTKRRQLTVFHTLFIIDSVIIRVTLWDRNGYEFMKPDVIFKLEQGEAPWIEDGEVPSSDSP

SEQ ID NO: 33596 - protein, 85 aa, Myotis davidii
VKIEDMAVSLILEEWGCQNLARRNLNRDNRQENYGNVFSQGEKPHECNECGKAFSHSSNLILHQRIHSGEKPYECNECGKAFSQS

SEQ ID NO: 33597 - protein, 94 aa, Myotis davidii
VTFENVAVFFSLEEWGLLDEAQRVLYCDVMLEVCTLVASLARASEEPFTCWEAGRASPTNSRFYPLPHSKRAEAFHPGQKHYVFSDCGKGFCKK

SEQ ID NO: 33598 - protein, 84 aa, Myotis davidii
LTFRDVAIHFSQEEWECLNPAQRKLYLDVMVENCSNLASLEKPYKCKDSGKISTWRSGCTLNQKVHTGEKPYKCKACGKTFKWH

SEQ ID NO: 33599 - protein, 90 aa, Myotis davidii
MAFEDVNVEFTMEEWAFLDPTQKKLYTDVLLETFWNLASIEEKGEDHDTEDTYEYHGMNLSSHTLERVCTRKDGSQCRENFSQIPNHTEK

SEQ ID NO: 33600 - protein, 91 aa, Camelus dromedarius
VTFEEVVVDFSQEEWALLDPAQKILYRDVMLENFQNLASVGSLQILGLDFKGQFVWDKERYHLCKHSLITEVEQEELRPEGRRLLQGACRG

SEQ ID NO: 33601 - protein, 89 aa, Myotis davidii
VMFEEVSVCFTAEEWACLGPIQRALYWDVMLENYGNVTSLEWETMTENEEGTAKSSISQRADSQKGTSKRLPGGIPQVLDFEKEAAAAA

SEQ ID NO: 33602 - protein, 90 aa, Myotis davidii
VMFRDVAIDFSQEEWECLDFAQRDLYRDVMLENYSNLVSLDLSSRYANNYLPPKEDTYETELFQWKMNDRLQIYDIKKSISRDYLEVRGT

SEQ ID NO: 33603 - protein, 94 aa, Neomonachus schauinslandi
LVFTDVAIHFSREEWGLLDEAQRSLYHDVMLENLALLLSLGCWHGAQDEEAPSEQDVSVGGSQVRTPKPGPSIQKSQPCETCSLLLKDLLHLAE

SEQ ID NO: 33604 - protein, 92 aa, Monodelphis domestica
VTFQDVAVEFTWEEWCLLSPPQKELYKEVMLENTRNLHSVEGKIRPETKANPTEMSLPVKEMNLHGPDNFSFKEWCVPSPKLSHIEHQRMHT

SEQ ID NO: 33605 - protein, 97 aa, Otolemur garnettii
MLFEDLAVYFSQEECVSLNPVQRSLSRDATQEGFEDVALMGEENKTEVNHQLSLESVKLEELTLDNYPITAPLVQYSENSSEDGVGNPEGKIPGAAP

SEQ ID NO: 33606 - protein, 91 aa, Leptonychotes weddellii
VSFADVAVYFSPEEWGCLRPAQRALYRDVMRETYGHLGALGDTPNKKEEAPQEGPGAKGPRKPPGKEPSRELVKHSPDWTIGQFSARAQRP

SEQ ID NO: 33607 - protein, 85 aa, Physeter macrocephalus
VTFEDVAVLFTRDEWRKLAPSQRNLYQDVMLENYSNLVSLGWKNSYKTTKSTQTQGSSFQELIMNRSKRNGPWDFKSEKPCKCEG

SEQ ID NO: 33608 - protein, 85 aa, Felis catus
LTFRDVAIEFSQEEWECLDPAQRVLYRDVMLENYRNLVSLGEDNFPPEVGSSAGFAIKELSPIQDINKGEFYHLVILERSESHDI

SEQ ID NO: 33609 - protein, 89 aa, Neomonachus schauinslandi
VTFEDVALYFSWEEWDLLDEAQRCLYHDVMLENFALTSSLGCWHGVEDEDAPSEESISIGVSQIGTLKAVSSSQKAQPFELHGPILRNI

SEQ ID NO: 33610 - protein, 126 aa, unidentified
  REGION 1..126: note = Bos indicus x Bos taurus
MLENYQNLLSLGKMVPKVRRPGLAGCGLLSLPWRQGICPSLPAGGAWRRGRGGQALGAQPALEGMSVSVGSSSEPPSSALAHRAPRATPLPPRAGPPVCKPDVISHLERGEEPWQAPRDGPAGPDP

SEQ ID NO: 33611 - protein, 119 aa, Myotis davidii
LTFWDVAIHFSPEEWECLDPAKRKLYMDVMLENYSNLASVGQVIPIVEKTHKGSQCVQIFQQFSNYNEQDNIHTGEESDKWNPCTRISSQIFNTNKMKKIHSEKKPYTCKDSGKRSNWP

SEQ ID NO: 33612 - protein, 88 aa, Cercocebus atys
VTFEDVAVYFSQEEWRLLDETQRLLCRNVMLENFSLLASLGCWHGAEAKEAPEQSASVGLCSSNVQQHQKQHCGEKSLKRQEGRVPVL

SEQ ID NO: 33613 - protein, 91 aa, Leptonychotes weddellii
VTFEDVFVYFSREEWELLEEAQRLLYRDVMLENFALVASLGCWRETDNEETPSEQSISVGLSQLRTPKSGAVIQKAHPWEACDPLLKDILR

SEQ ID NO: 33614 - protein, 89 aa, Felis catus
ESFKIVTVDFTQKEEGTLNPVQRTLDRDVNLENHRDLVSWDLAAALGRRESISKQNIFDDEPFHGVKLERLTRDDPWLASCEEVRDCKD

SEQ ID NO: 33615 - protein, 90 aa, Myotis davidii
LSFMVVAIDFSQEEWECLDPAQRKLYLDVMLENYSNLVSMHEDDFLLEFLLNPQDFVSFIILTSLGVSAFCVRLMLSRNKLSPSWLGSMD

SEQ ID NO: 33616 - protein, 87 aa, Myotis davidii
VAIEDVIVTFTLEEWALLDSSQKKLYRDVMRQTFKNLASIGKKWDDHDIEELYKNQGRKLRNHTAERLCEAKEGSQREDNSNLISEM

SEQ ID NO: 33617 - protein, 103 aa, Felis catus
VTFEDVTVIFTWEEWKFLDSSQKKLYREVMWENYTNVMSVGNWKESYKPQEGRFRYLEHENHPCWQGWRSASTQICKNRSYVETIQGIDSKDLKQQDLSHHQE

SEQ ID NO: 33618 - protein, 88 aa, Myotis davidii
VTFDDVAVYFSREEWGLLDEAQRRLYQEVMLENLALVSSLVHSGERRYECMQCGKSFRRKFYLILHWRVHTGERPHECRECGKSFTRS

SEQ ID NO: 33619 - protein, 85 aa, Neomonachus schauinslandi
VTFADVAVLFTPEEWMFLDSAQRSLYRDVMLENYRNLASVEPQHQPQDPISNQDIFAEIPSIGMKREQPQTGDKLYKYSELGDPF

SEQ ID NO: 33620 - protein, 99 aa, Neomonachus schauinslandi
MNFEDVAIDFSQEEWGLLDETQRLLYCDVMLENFALVASLDLHQQQRHGSWEKPWKRDVDRASYVTSCNFCVSGQPFTCRKVGEDIPATSGHLQLQTNP

SEQ ID NO: 33621 - protein, 85 aa, Physeter macrocephalus
LAFEDVAVNFTLEEWVLLDSSQRKLYRDVMREKFQSLVSVERKQEDHDIEDQYKNQGRKLRYTKELTQGRNPMNVRNVGKPSRGK

SEQ ID NO: 33622 - protein, 86 aa, Myotis davidii
LTFRDVAIDFSQEEWECLDATQQKLYMDVMLENYSNLASLATTSKDNLAFMLKPGVHDLFSEIILSTHNGDSSYQWNEHWNNFKKE

SEQ ID NO: 33623 - protein, 90 aa, Cercocebus atys
LTFKDVAIEFSQEEWTCLDPAQKTLYRDVMLENYRNLVSLDISCKCVNKDLPPKGKKSMGEAFHMVKLERLESCDEALSFEEVQKNTYDF

SEQ ID NO: 33624 - protein, 83 aa, Cercocebus atys
LTFRDVAIEFSLEEWQCLDSAQQDLYRKVMLENYRNLRIRARFMLFIFNKAGIDVSKPNLITCLEQGKDPWNMKRHSMVVKPP

SEQ ID NO: 33625 - protein, 85 aa, Leptonychotes weddellii
VTFKDVAMDFTEEEWGQLDPVQRALYKEVMLEIYGNLVLVGKKLYDCAACGKSFSRSTDPRYHQRIHTGEKPFICDTCDKAFSYN

SEQ ID NO: 33626 - protein, 87 aa, Felis catus
LTFQDVAVVFAHSEWKGLSSEQRNLHKEVMLENYRNLLCWARLCSFLYLYCRDLGRLGGSVSWASDFGSGHNLPVPEFQPCIGLCLC

SEQ ID NO: 33627 - protein, 104 aa, Neomonachus schauinslandi
VTLEDVAVDFSREEWAMLDSAQRKLYREVMLDTWANLAALGALKNQSSDTGIDDGTLSPMETSRATSPSPWVGCPLFLPVVPSHLEPGEAMWMGPQGILQISCS

SEQ ID NO: 33628 - protein, 86 aa, Monodelphis domestica
MTFKDVAMDFTQEEWRQQEIAPRKLYQDVMVGNFKNYYHIGKHMACMPKRGPPFPLSLIPKDIFHMTQPSEQQPQWECFLPPLFRE

SEQ ID NO: 33629 - protein, 110 aa, Pongo abelii
VTFRDVAIYFSREEWACLEPSQRALYRDVMLDNFSSVAALAPDQTSSLAWNSGKSRGLKTGRDLSSRQCREGPSQGQGSLQTPRDTVIIQLGLTRKPTCGEKEPGKEAAL

SEQ ID NO: 33630 - protein, 87 aa, Pongo abelii
ISLEDVAVNFTLEEWALLDPGQRNIYRDVMRATFKNLACIGEKWKDQDIEDDHKNQGKNLRGPVVEALCENKEDRLCGKSTSQIPDL

SEQ ID NO: 33631 - protein, 92 aa, Pongo abelii
MVFEDVAIHFSQEEWGILNHVQRHLHSDVMLENFALLSSVGCWHGAKDEEVPSKQCVSVRVLQVTTPKPALSTLKAQPCKTCSSLLKDILHL

SEQ ID NO: 33632 - protein, 87 aa, Pongo abelii
VTFEDVAVNFSLKEWSLLNEAQGCLYHDVMLETLTLISSLGGVPPHRLFPTGACGPQVPSSRIHPSPGHCPRPSLYLSLSPQHPTGV

SEQ ID NO: 33633 - protein, 87 aa, Pan troglodytes
VTFEDVAVDFTQEEWTLLDQTQRNLYRDVMLENYKNLVAVDRVSLCHPATTPSSVVEMVRFRRYNLLSSMLEEDWKFLKMEKQHNNL

SEQ ID NO: 33634 - protein, 83 aa, Pan troglodytes
REDPGTSESQEMEEWALLDISQRKLYREVMLETFRNLTSIGKSWKDQNIEYEYQNPRRNFRSLIEKKVNEIKEDSHCGETFTP

SEQ ID NO: 33635 - protein, 91 aa, Camelus dromedarius
VVLEDVAVAFSPEEWALLDVAQRSLYRDVMLETFRNLASIGEGHRSFTSSAERKYPQAAERVSGLGLNGGNLLLRKADRVALLWSPPWDSF

SEQ ID NO: 33636 - protein, 85 aa, unidentified
  REGION 1..85: note = Bos indicus x Bos taurus
VTFEDVALSFSWKEWKLLDAAQRRLYHDVMVENYALISSLASCVVFWLALRGVRSRIQDADLHKPLPTLTLPWIQVRCLEDPVEL

SEQ ID NO: 33637 - protein, 100 aa, Camelus dromedarius
VTFVDIAVYFSEDEWKNLDEWQKELYNNLVKENYKTLMSLGKGAFPPRDQLFLHQKLENIDLFSVPHAEGPVPKPDAPSQAEPREEPCVWEQRDPEEREV

SEQ ID NO: 33638 - protein, 82 aa, unidentified
  REGION 1..82: note = Bos indicus x Bos taurus
VTFEDVAVSFSQEEWGLLGEAQRLLYYDVMLENLSLIASLGKNCICTHLSTLSVLFVFLSGCWQGGKAEKAISKQCVSVEQV

SEQ ID NO: 33639 - protein, 104 aa, Pan troglodytes
VSFADVAVYFSPEEWECLRPAQRALYRDVMRETYGHLGALGESPTCLPGPCASTGPAAPLGAACGVGGPGAGQAASSQRGVCVLLPQESEAASRRSSPGWRRRP

SEQ ID NO: 33640 - protein, 88 aa, Callithrix jacchus
LTFRDVAIEFSLGEWQCLDTAQRNLYKNVILENYRNLVFLGKDNFNTHSQGRRGELEDTTLSDKVWSLTEQKIPQWWKHTSRQRDSRG

SEQ ID NO: 33641 - protein, 86 aa, Callithrix jacchus
VTFKDVAVTFTQEEWALLDFSQEKFYRDVMLETFRNFASIENKWEDQNVDHQVRKYRRNVKSYGKRLCDGKENSQCGEKPSARIQI

SEQ ID NO: 33642 - protein, 103 aa, Bos taurus
MTFQDVAIDFTQEEWECLDLSQRELYRDVMLENYGNLASLGLVSNLDLVTFLEPLKDPRNIRRMGTTVIYPGLVVSKLDLVTFLEQMKEPRNIRTMKTVAVYP

SEQ ID NO: 33643 - protein, 103 aa, Ovis aries
VTFKDVAVDFSMEEWELLDPGQRKLYRDVMLETCGNLASVALRNQRPNSGFEDGTICLASASQVTTFSLWTTYSLFQPVVSLHLEQGEAMWMVGKGTLRASCS

SEQ ID NO: 33644 - protein, 89 aa, Enhydra lutris
VTFKDVVVTFTREEWELLDLPQRTLYWKVMRETCRLLVSLDDKAKTNTTEPSASPPALFEGCSPHRLLTEEDSSVSTLGEAREQERPSE

SEQ ID NO: 33645 - protein, 91 aa, Enhydra lutris
VAFEDVTVKFTMEEWALLDPSQKKLYRDVMQETFRNMASIVCSSEEKWDIHDSEDQNENHGTDLSSQMVERLRKSKECSQYEEIFSQIPYH

SEQ ID NO: 33646 - protein, 87 aa, Pongo abelii
VAFEDVAVNFTQEEWALLDSSQKNLYREVMQETCRNLASVGSKWKDQNIEDHFEKPGKDIRNHMVQRLCESKEGGQYGEVVSQIPNL

SEQ ID NO: 33647 - protein, 109 aa, Vulpes vulpes
VTFEDVFVYFSREEWELLEEAQRLLYRDVMLENFALVASLDCWREADNEETPSEQSVSVGGSQLRTSKSGAFIPKAHLCEVCDPLVKDILHLAKHQGSHPLQKLYTRGP

SEQ ID NO: 33648 - protein, 88 aa, Vulpes vulpes
VTFEDVVVDFTQEEWGQLEPAQRTLYRDVMLETFRLLVSVDLETRPKTRLSALTQDITEETPSSVLVERFLWDSLWCSEDDDAEGHGG

SEQ ID NO: 33649 - protein, 87 aa, Otolemur garnettii
VSFEDVAVNFTQEEWTLLNSSQKTLYRDVMCETFDNLACIGKKWKDQDIEDNHKNQGRNLRGHMIERLCKSKEGHQYIKSTSQIPNL

SEQ ID NO: 33650 - protein, 93 aa, Enhydra lutris
LTFEDVAVNFSLEEWVLLDSSQKKLYRDVMRETFRNLASVGKKWEDHDTEDGYYTQGRKLRSHMVEKPYENKEDHCGETITQTPDLNLNKESP

SEQ ID NO: 33651 - protein, 87 aa, Pongo abelii
VTFDDVAVDFTPEEWALLDTTEKYLYRDVMLENYMNLASVEWEMQPRTKRSSLQQGFLKNQIFSGIQMTRGYSGWKLCDCKNCGEVF

SEQ ID NO: 33652 - protein, 83 aa, Pongo abelii
VAFEDVAVKFTQEEWALLDISQRKLYRELMLETFRNLTSIGKKWKDQNIEYEYKNPRRSFRSLIEGNVNEIKEDSHCGETFTQ

SEQ ID NO: 33653 - protein, 99 aa, Pongo abelii
LTFRDVAIKFSVEEWKCLNPEQGALYREMMLENYRNLESVDSSLKSMMEFSSMGQGNTEVFHTGTLERHDFCFPEIKKDIHDFEFQWQEIERNGHEAPM

SEQ ID NO: 33654 - protein, 87 aa, Macaca mulatta
LTFRDVAIEFSLEEWQCLDTAQQDLYRKVMLENYRNLVLVICSHFAEDLCPGPGIKDSFQKVILREYVKCGHKDLQLRKGCKSVNEC

SEQ ID NO: 33655 - protein, 90 aa, Callithrix jacchus
MAGPPRPQSGRKSAGRGAADASGGGPFPAASRVCEPRVVLREGLSARTRGCPPTKSHAGFLVFKPELISRLEQGQEPWVLDLQGAEGTEA

SEQ ID NO: 33656 - protein, 83 aa, Macaca mulatta
VAFEDVAVNFTREEWALLDIFQKNLYREVMLETFRNLTSIGKKWKDKNIEYEYKIPRRSFRSLIEEKVNEIKEDSHCGETFTQ

SEQ ID NO: 33657 - protein, 87 aa, Otolemur garnettii
LVFEDVAVNFTPEEWALLDCAQKNLYRDVMLETCKNLASLGENWRFYNIEDQHPIPQRHLRSQLVESLCENSESHQCGETLSQIENL

SEQ ID NO: 33658 - protein, 84 aa, Pongo abelii
LAFRDVALEFSAEEWECLDLAQRSLYRDVMLENYRNLFSLGEDNFNMQFLFHSLAMSKPELIICLEARKEPWNVNTEKTAKHSA

SEQ ID NO: 33659 - protein, 85 aa, unidentified
  REGION 1..85: note = Bos indicus x Bos taurus
VTFEDVAIYFSQEEWGLLDEVQRHLYCKVMLENFALTASMVCLQETQTKETPSEQNVSLEALSQVRTPKVGPFTENAHPCEKCVP

SEQ ID NO: 33660 - protein, 107 aa, Monodon monoceros
LGTTELAEPPNRPERPEGCGAERPRAAEAHFRRRPAGPALPGLSTGSAGGAGGSLEPVGAWRGGGRASAVLPGRAGFLVFKPELISRLEQGQEPWVLDLQGAEGREA

SEQ ID NO: 33661 - protein, 90 aa, Ovis aries
VTFSDVAIDFSQEEWACLDSRQRDLYWDVMLENYSNLVSLDLESPYETKSLPSQKNTYGVNFSKRTSNRKSKSRGLGWTCEGELDRSRAP

SEQ ID NO: 33662 - protein, 86 aa, Pongo abelii
VVFEDVAVNFTQEEWALLGPSQKKLYRDVMQETFVNLASIGENWEEKNIEDHKNQGRKLRSHMVERLCERKQGSQSGETISQTPNP

SEQ ID NO: 33663 - protein, 84 aa, Pongo abelii
VTFRDVTVIFTEAEWKRLSPEQRNLYKEVMLENYRNLLSLDGVSLLLPRLECNGAISAHHNLCLPGSSNSPATASRVAGITAEP

SEQ ID NO: 33664 - protein, 87 aa, Pongo abelii
VAFEDVAVNFTQGEWALLDPSQKNLYREVMQESLRNLASIGKKWNNQYIEDEHQNPRRNLRRLIGERLSESKESHQHGEVLTQVPDD

SEQ ID NO: 33665 - protein, 84 aa, Bos taurus
TSLLNIAVRFSQREWRLLDETQRLLYLDVMLENYTLISSLERPYKCSECGKCFTSNFKLRNHQRSHTGEKPYKCYECGKSFTST

SEQ ID NO: 33666 - protein, 83 aa, Pongo abelii
VAFDDVAVNFTQEEWALLDISQRKLYREVMLETFRNLTSIGKRWKDQNIEYEYQNPRRNFRSVIEKKVNEIKEDSHCGETFTP

SEQ ID NO: 33667 - protein, 83 aa, Macaca mulatta
VAFEDVAVNFTQEEWTLLDISQKNLFREVMLETFRNLTSIGKKWKDKNIEYEYKIPRRSFRSLIEEKVNEIKEDSHCGETFTQ

SEQ ID NO: 33668 - protein, 85 aa, Pongo abelii
LTFDDVAVLFTRDEWRKLAPSQRNLYRDVMLENYRNLVSLGSKSSHKTTKSTQTQDSSFQGLILKRSNRNVPWDLKLEQPYVYEG

SEQ ID NO: 33669 - protein, 90 aa, unidentified
  REGION 1..90: note = Bos indicus x Bos taurus
LTFKDVFIDFTPEEWECLDPAQRTLYKDVMVETLGNLLSVDVSQIRMIKKLQAKGNSGKKEIFQRVVFGRAESHEIEDFFLRKIQENMHD

SEQ ID NO: 33670 - protein, 87 aa, Pan troglodytes
VTFEDVAVNFSLEEWSLLNEAQGCLYHDVMLETLTLISSLGGVPPHRLFPTGACGPQVPSSRIRPSPGHCPRPSLYLSLSPPHPTGV

SEQ ID NO: 33671 - protein, 86 aa, Vulpes vulpes
VTFEDVALYFSWEEWDLLDEDQRCLYHDVMLENFVLTSSLGCWHGVEDEEVPSKESISVGVSQIGTLRSGSFPQKAQPFELHGSIL

SEQ ID NO: 33672 - protein, 90 aa, Saimiri boliviensis
VTFADVAIDFTQEEWACLNSAQRDLYWDVMLENYSNVVSLDLESAYETKNLPTEKSLHEIRVSKRNSDRRSKSLGHNWIYEGTPERPQRS

SEQ ID NO: 33673 - protein, 99 aa, Acinonyx jubatus
LTFKDISVDFTQEEWGQLPLAHRNLYREVMLENYGNLLSVDLKNKTETSTSASKNEILQEHLYHGIMMEGFLRDDVIYSTLRKVSKYDGELEEHQESHG

SEQ ID NO: 33674 - protein, 93 aa, Rhinopithecus roxellana
VAFEDVAVNFTQEEWALLGPSQKNLYRYVMQETIRNLDCIRKIWEGQNTEDQNKNPRRNLRCHMVERFSESKDSSQCGETFSLIRGSIVNNSI

SEQ ID NO: 33675 - protein, 86 aa, Otolemur garnettii
VAFEDVAVYFTQNQWASLDSAQRALYREVMLENYANVASLGKFSLSDSLISSSGVWAVWRILITLRFDTSKGMLVVPSEEGYSREQ

SEQ ID NO: 33676 - protein, 82 aa, Camelus dromedarius
VTFEDVAVYFTQTEWDGLSPAQRALYRDVMLENYGNEIIHLSFLFPFPTTGFPLLKPAVISQLEGGGELGGPSPLASGTGTG

SEQ ID NO: 33677 - protein, 89 aa, Camelus dromedarius
VSFGDVTVNFTQEEWGQLDPDQRTLCRDISVGPFIVHLLKLDLSFSSEFLKPGSFFYILYHFLVSGHCITKPEEAPWILEEEFASQCYP

SEQ ID NO: 33678 - protein, 97 aa, Cercocebus atys
VTFADVAVNFTKEEWTLLDPAQRNLYRDVMLENSRNLAFIDWATPCETKDATPQPDILPKRTFPEANRVCLTSISSQLSTLREDWRCTKTEGPHRQG

SEQ ID NO: 33679 - protein, 93 aa, Pongo abelii
VSFEDVAVAFTQEEWALLDPSQKNLYRDVMQEIFRNLASVGNKSEDQNIQDDFKNPGRNLSSHVVERLFAIKEGSQYGETFSQDSNLNLNKKV

SEQ ID NO: 33680 - protein, 88 aa, Myotis davidii
VNFKIVTVDFTQEEGILNPAQRTLDRAAILENHRDLVSWDLATALGRRESTSKQRIIDDEPSHGVKLERLTRDDPWLSSCEEVWICKD

SEQ ID NO: 33681 - protein, 89 aa, Pan troglodytes
VTFDDVALYFSEQEWEILEKWQKQMYKQEMKTNYETLDSLGKMILEPIYRVDISLMRVILLSAPDDEGTPRTKEEDCRLNGPQKQDLCA

SEQ ID NO: 33682 - protein, 88 aa, Pan troglodytes
LTFRDVKIEFSLEEWQCLDTAQRNLYRDVMLENYRNLVFLVMCSHFAQDVWPEHSIKDSFQKVILRTYGKYGHENLQLRKDHKSVDAC

SEQ ID NO: 33683 - protein, 83 aa, Cercocebus atys
VTFQDVAVDFTAEEWQLLDCTERTLYWDVMLENYRNLISVGKDNKKQKSHYHFLTYERYPHQSSPESDCPLVDEPRKHRESKD

SEQ ID NO: 33684 - protein, 92 aa, Enhydra lutris
VAFEDVTVHFSLEEWALLNPSQKKLYRDVMQETLRNLALVGEKWEDRDSKSQYEHHQTNLRPVVERPCKNKEGSPCEESFSQNPNHKQINKS

SEQ ID NO: 33685 - protein, 90 aa, Pongo abelii
VALEDVAVNFTREEWALLGPCQKNLYKDVMQETIRNLDCVGMKWKDQNIEDQYRYPRKNLRCRMLERFVESKDGSQCGETSRQIQDSIVT

SEQ ID NO: 33686 - protein, 103 aa, Pongo abelii
VTFEDIAIYFSQDEWGLLDEAQRLLYLEVMLENFALVASLGCGHGTEDEETPSDQNVSVGVSQSKAGSSTQKTQSCEMCVPVLKDILHLADLPGRKPYLVGEC

SEQ ID NO: 33687 - protein, 94 aa, Pan troglodytes
MVFEDVAIHFSQEEWGILNDVQRHLHSDVMLENFALLSSVGCWHGAKDEEAPSKQCVSVGVSEVTTLKPALSTQKAQPCETCSSLLKDILHLAE

SEQ ID NO: 33688 - protein, 91 aa, Myotis davidii
VTFGDVPFYFSQEEWGSLDPAQRDLFWDIKRESSRNVAVGLGLKNQRGRSPLEEAVRVPPGQAGSDVTVAWSPEEAEPWESEARPGALLEP

SEQ ID NO: 33689 - protein, 85 aa, Myotis davidii
VTFEDIALYFSREEWSLLDDGQRQLYLNVMLENFELISSLGEKPYKCNECGKSFTSKSYLPIHQRVHTGEKPYKCNECGKSFTTN

SEQ ID NO: 33690 - protein, 94 aa, Pan troglodytes
MVFEDVAIYFSQEEWGILNDAQRHLHSNVMLENFALLSSVGCWHGAKDEEVPSKQCVSVRVLQVTIPKPALSTLKAQPCKTCSSLLKDILHLAE

SEQ ID NO: 33691 - protein, 85 aa, Camelus dromedarius
VTFEDVAVNFTKEEWTLLDPAQRKLYRDVILENCRNLACVGKDAHPALGPGWDSYWATRQKTKDSILQQDSLAKKTFHEVNRACL

SEQ ID NO: 33692 - protein, 89 aa, Myotis davidii
VIFEDIALYFSREEWSLLDEGQRQLYLNVMLENFELISLLGCCCGTEDVEEPTEQKVSVRVSQASIPKLPLSSQESHPCERCGLVLGKI

SEQ ID NO: 33693 - protein, 87 aa, Cercocebus atys
LTFRDVAIEFSLEEWQCLDTAQQGLYRKVMLENYRNLVSLGMRAFGIFLCHLIYIVRLVNCIYLFICSHFAQDLWPERDIKDSFQES

SEQ ID NO: 33694 - protein, 88 aa, Otolemur garnettii
LAFEDVSVNFSQEEWALLDPSQKKLYKDVMQETLKNLASIGKKWKDQNIEDQYKNQGRNLRRHMVEPLCESKEGNWYGEIFNPNLALT

SEQ ID NO: 33695 - protein, 84 aa, Pan troglodytes
VTFEDVAVYFIRKEWKRLEPAQRDLYRDVMLENYGNVFSLDRETRTENDQEISEDTRSHGVLLGRFQKDISQGLKFKEAYEREV

SEQ ID NO: 33696 - protein, 85 aa, Pan troglodytes
VTFRDVAVDFSQEEWDCLDSSQRHLYSNVMLENYRILNCKSQCSCGFYIFSYYYFSGWEPICETEELTPKQDFYEEHQSQKIIET

SEQ ID NO: 33697 - protein, 83 aa, Pan troglodytes
VTFKDVAVIFTEEELGLLDPAQRKLYRDVMLENFRNLLSVGHQPFHGDTFHFLREEKFWVMGTTSQREGNLGGKIQTEMETVP

SEQ ID NO: 33698 - protein, 89 aa, Myotis davidii
LSFMDVAIDFSQEEWECLDPAQRKLYMDVMLENYSNLVSVGGDLAQPLLGADGLQALLQLSLQAPLGILTAVTNAMWGVQAALRQPASP

SEQ ID NO: 33699 - protein, 84 aa, Pongo abelii
LSFRDVAIEFSQEEWKCLDPGQKALYRDVMLENYRNLVSLGEDNVPEACICSGICLPGLSVTSMLEQKRDPCTLQSEVKIANNP

SEQ ID NO: 33700 - protein, 87 aa, Pongo abelii
VAFKDVSVSFSQEEWALLAPSQKKLYRDVMQETFKNLASIGEKWEDPNVEDQHKNQGRNLRSHMGERLCEGKEGSQCAETFSPNLSV

SEQ ID NO: 33701 - protein, 87 aa, Vulpes vulpes
VAFEDVAVNFTLEEWALLEPSQKKLYRDVMRETLRNLASIGKTWKDHNSEDQYKNQGRKLRSHMVERLNQSKEGSHCGGNFSPIPNL

SEQ ID NO: 33702 - protein, 84 aa, Pongo abelii
VALEDVAVNFTQEEWALLGPCQKNLYKDVMQETIRNLDCVGMKWKDQNIEDQYRYPRKNLRCRMLERFVESKDGSQCGETSSQI

SEQ ID NO: 33703 - protein, 85 aa, Pongo abelii
LSFKDVAVVFTEEELELLDSTQRQLYQDVMQENFRNLLSVGERNPLGDKNGKDMEYIQDEELRFFSHKELSSWKIWEEVAGELPG

SEQ ID NO: 33704 - protein, 103 aa, unidentified
  REGION 1..103: note = Bos indicus x Bos taurus
LTFQDVAIDFTQEEWECLDPGQWKLYRDVMVENYRNLASLGLVSKVDLVTFLELLKDPRNMRRMETTAIYPGLVVSKVDLVTFLEQMKDPRNISRMETMAMYP

SEQ ID NO: 33705 - protein, 87 aa, Monodelphis domestica
VSFADVAVYFSPEEWGRLRPEQRALYRDVMRETYGHLGALGEERVHEAEGPSSGGEGAVRVTDMESDLSLGLKAWRDPTGSKNKNKE

SEQ ID NO: 33706 - protein, 83 aa, Physeter macrocephalus
VVFEDVTLYFSQEWGLLDEAQRHLYHAVMTENFALVTSLGCWHGAQDEEAPSEQSVSVGMSEVGTPKPDPSTKKAQPYEMCDP

SEQ ID NO: 33707 - protein, 87 aa, Monodelphis domestica
VTFRDVAVDFSPDEWECLGPAQRELYQEVMLENYRSLAWLGWETKAPKLGLAIKGSSQESLTSIDICVSKLGKVWKLKANLETLQEK

SEQ ID NO: 33708 - protein, 98 aa, Aotus trivirgatus
LTFKDVAVVFTEEELGLLDPLQRNLYRDVMLENFRNLLSVADKIQSEMEAGPHEELSWGQIWKQIASDLVKYEDSMINISQFPKQGDLSCQVRAGLYT

SEQ ID NO: 33709 - protein, 82 aa, Aotus trivirgatus
VTFKDVAVAFTEEELGLLGPAQRKLYRDVMVENFRNLLSVGHQPFKGDVSPIERKEQLCIMKTATQRQRNLGKNQTVVSSYG

SEQ ID NO: 33710 - protein, 84 aa, Pan paniscus
LAFRDVALEFSPEEWECLDPAQRSLYRDVMLENYRNLISLGEDNFNMQFLFHSLAMSKPELIICLEARKEPWNVNTEKTAKHSA

SEQ ID NO: 33711 - protein, 86 aa, Physeter macrocephalus
FTFKDVAIEFSQEEWEWLDPAQRALYRDVMLETCRNLLSLSEDNFSLEVGRHSAGFAIKELSPRDDITKGELCHLVTLERSKSHGI

SEQ ID NO: 33712 - protein, 86 aa, Monodelphis domestica
VTFKDVAVDFTQEEWRLLTPPQKELYREVMLENVRNLLSVVLPLNVDSVLSHKSLRIVLDHRIATEEEIRPEMKMTPKEVNLSLEY

SEQ ID NO: 33713 - protein, 87 aa, Physeter macrocephalus
VIFEDVAVNFTLEEWALLNFSQKKLYRDVMRETLRSLASVGGKWEDHDIEDQYKNQRRKPRNHVVGRLCENKEGSQCGENFSFISNL

SEQ ID NO: 33714 - protein, 93 aa, Physeter macrocephalus
VTFEDVAIYFSQEEWGLLDEAQRCLYHKVMLENFALTASMVCLHGTENKETPSEQNVSLEALSQVRTPKDLCTDLAGSSANLIPRVTAIRTSP

SEQ ID NO: 33715 - protein, 83 aa, Papio anubis
LTFRDVAIEFSLEEWQCLDTAQQDLYRKVMLENYRNLRIRARFMLFIFNKAGIDVSKPNLITCLEQGKDPWNMKRHSMVVKPP

SEQ ID NO: 33716 - protein, 87 aa, Papio anubis
VAFEDVAVNFTQEEWALLDSSQKNLYREVMQETCRNLASVGNKWKDQDIEDHFEKPGKDIRNHMVQRLCESKEGSQCGEVVSQIPNL

SEQ ID NO: 33717 - protein, 84 aa, Papio anubis
VAFEDVDVNFTQEEWALLDPSQKNLYRDVMWETMRNLASIGKKWKDKNIKDHYKHRRRNLRIHMLERFYQSKDGSQRGGIFSQF

SEQ ID NO: 33718 - protein, 83 aa, Aotus trivirgatus
MASPSPPPEPKEEWDYLDPAQRSLYKDVMMENYGNLVSLGLTLLPRLECSDTIMPRCSFDLLGLSDQSCCYLSSWDYTCFEQR

SEQ ID NO: 33719 - protein, 87 aa, Aotus trivirgatus
VTFKDVAVAFTEEELGLLGPAQRKLYRDVMVENFRNLLSVGHQPFKGDVSPIERKEQLCIMKTATQRQRNLDTLLVKAVLFYDLAQT

SEQ ID NO: 33720 - protein, 83 aa, Monodelphis domestica
VSFADVAVYFSPEEWGRLRPEQRALYRDVMRETYGHLGALGEERVHEAEGPSSGGEGAVRVTDMESDLEEPVIKRLEDVGQPP

SEQ ID NO: 33721 - protein, 85 aa, Aotus trivirgatus
LTFRDVAIEFSLEEWQCLDTAQQNLYRHVMLENYRNLLFLVVCSQDLWPKQSIKESLQKVILRSYGKCGHENLQLRKGYKNVDEH

SEQ ID NO: 33722 - protein, 89 aa, Papio anubis
VTFDDVAVDFTPEEWALLDTAEKYLYRDVMLENYMNLASVDKKWEIQPRIKGSSLQQGFLKNPIFSGIQMTRSYSGWKLCENCGEVFSE

SEQ ID NO: 33723 - protein, 84 aa, Pan paniscus
LTFRDVAIEFSQEEWKCLDPAQRTLYRDVMLENYRNLVSLDGVALVAQAGVQWHNLGSPQPPPPGFKLFSHLSLKSSWNYRYFF

SEQ ID NO: 33724 - protein, 83 aa, Aotus trivirgatus
VTFEDVAVYFSWKEWSLLDEAQKCLYHDVMLENLTLTTSLGGCGTEDEEAPYQQSTSPQRVSQVRIPKALPSPQKTNSCEICG

SEQ ID NO: 33725 - protein, 85 aa, Lipotes vexillifer
VTFEDVFVYFSWEEWELLEEVQRLLYRDVMLENFALVASLGCWCEADNEEAPSEQSVFVEGVSEVRTPESCPFIQKAHPCEIRDP

SEQ ID NO: 33726 - protein, 130 aa, Monodelphis domestica
VTFRDVAVDFTREEWRLLSPPQKELYKVVMLENARNLFSVDEEIDSIKWLVLRHPHRSLGVSSRIYQNRMWKGGCSFKIPQQGNRHILPWTPELQTLRGLPAPPEDVLSSLEQREAPWMLEQEGPRSSCP

SEQ ID NO: 33727 - protein, 85 aa, Physeter macrocephalus
VTFEDVFVYFSREEWELLEEAQRLLYRDVMLENFALVASLGCWCEADNEEAPSEQSVFVEGVSEVRTPESCPFIQKAQPCEICDP

SEQ ID NO: 33728 - protein, 113 aa, Papio anubis
VTFEDVAVYFTQNEWASLHPMQRALYREVMLENYANVTSLYPTAGGFPLSTERTEKVPGALPSFFPSSSSLEVILALLPMSAFPFSKPDLIFQLEQGEAAWGPDPWTLAGGEA

SEQ ID NO: 33729 - protein, 104 aa, Papio anubis
VTFEDVSMDFSQEEWELLEPAQKNLYREVMLENYRNVVSLEALKNQCTDAGIKKGSLPPAQTPQVTSLSSWTGYLLLQPAASSHLEQREALWMEEKGTPRASCA

SEQ ID NO: 33730 - protein, 87 aa, Papio anubis
VAFEDVAVNFTQEEWALLDPSQKNLYREVMQETLRNLASIGKKWNNQYIEDEHQNPRRNLRRLIKERLSESEESHQHGEVLTQVPDD

SEQ ID NO: 33731 - protein, 88 aa, Neomonachus schauinslandi
VAFEDVTVNFTLEEWALLNPSQKKLYRDVMQETLRNLASIGEKWEDRNSKSLYEHQQTDLSRPVVESPCKNKEGSPCGESFSRNPNHK

SEQ ID NO: 33732 - protein, 82 aa, Physeter macrocephalus
LSFMDVFVDFTWEEWQLLDPAQKHLYRSVMLENYSNLVSLDEVWEIDGRMEWHKENQGKLRSMSKGYQCTAFGKLCLLSTDY

SEQ ID NO: 33733 - protein, 88 aa, Physeter macrocephalus
VTFEDIAVYFSWEEWRLLDEAQIRLYLDVMLESYALISSLALIPAVPNPHREGFEVSSLAVRLMDAACLPFPWMGQCVQIHAVSVATP

SEQ ID NO: 33734 - protein, 97 aa, Monodelphis domestica
MAFKDVAVDFTREEWCLLSPPQKELYKEVMLENARNLFSVEGEIRPEMTATPKEVSPNVEETGQQRFMSDGPDSLACREFAIESQNPSLIVHQTMHT

SEQ ID NO: 33735 - protein, 90 aa, Papio anubis
LTFKDVAIEFSQEEWTCLDPAQKILYWDVMLENYRNLVSLDISCKCVNKDLPPKGKNSMGEAFHMVKLERLESCDEALSFEEVQKNTYDF

SEQ ID NO: 33736 - protein, 87 aa, Pongo abelii
LTFRDVAIEFCLEEWQCLDTAQRNLYRNVMLENYRNLVFLVMCSHFAQDLWPEQNIKDSFQKATLKRYGKCRHENLPLRKGCESVDE

SEQ ID NO: 33737 - protein, 85 aa, Pongo abelii
VAFEDVAVNFSQEEWSLLSEVQRCLYHDVMLENWVLISSLGCWCGSEDEEAPSKKSISIQRVSQSLRLSAQAGVARSQLTAASAS

SEQ ID NO: 33738 - protein, 86 aa, unidentified
  REGION 1..86: note = Bos indicus x Bos taurus
VTFEDVAVYFTQNQWASLDSAQRALYREVMLENYPNITSLSESFFLKLSFCPWGLLASSIMYVGSLIPSELMLHELSSLILSCRSN

SEQ ID NO: 33739 - protein, 83 aa, Aotus trivirgatus
VAFEDVAVKFTQEEWALLDISQKNLYREVMLETFRNLTSIGKKWKDKSIEDECQNPRRNLRSLIEEKVNEIKEDSHCEETFTQ

SEQ ID NO: 33740 - protein, 90 aa, Lipotes vexillifer
LTFKDVAIEFSQEEWECLDPAQRALYRDVMLETYRNLVSLDVSHVHMIKKLQLNANTDRAEVFQTLILGRHERNKIKHFYLREIQENIHD

SEQ ID NO: 33741 - protein, 92 aa, Callithrix jacchus
LTFGDVAVAFTRIEWRHLDAAQRALYRDVMLENYGNLVSVGEDGFLLDSGLTCWATLFSQGLLSSKPKLIAQLEQGAEPWMEVREAPSGTRA

SEQ ID NO: 33742 - protein, 91 aa, Bos taurus
VTFPDIAVRFSQREWRLLDETQRLLYLDVMLENYTLISSLGKTQPPQSCVHEALSFKSPRFHVSGKPLTSGKILASVGYLQATYTVEKVHP

SEQ ID NO: 33743 - protein, 96 aa, Ovis aries
VTFEDVAVHLTREEWGCLDPVQRALYREVMLENYGNLVSLGILLRLPTTRIHSVNSCPALSHTQASAFSGETLAILSAGISRRWPRCRHPIDSARP

SEQ ID NO: 33744 - protein, 88 aa, Vulpes vulpes
VTFEDVAVYFSKEEWSLLDEAQRHLYCNVMLENLALIASLGCWHGVKAVEAFSEQYVFVERVPQARTSDPGRSIPKVHSCNMCVSVEK

SEQ ID NO: 33745 - protein, 86 aa, unidentified
  REGION 1..86: note = Bos indicus x Bos taurus
VTFEDVALSFSWKEWKLLDAAQRRLYHDVMVENYALISSLGKTVTLPRLTWARLWILPHPPFLKGCSVQTHAPWALFVSSAFWLVV

SEQ ID NO: 33746 - protein, 86 aa, Ovis aries
LTFKDVAIEFSQEEWECLDPAQRALYRDVMLETYRNLLSVVVLGRELETRILRCSLCVQKEAVDECVKYFPRPPPCNVLTPQLSEE

SEQ ID NO: 33747 - protein, 82 aa, Enhydra lutris
VAFEDVTVKFTMEEWALLDPSQKKLYRDVMQETFRNMASIGRMSEDQNENHGTDLSSQMVERLRKSKECSQYEEIFSQIPYH

SEQ ID NO: 33748 - protein, 85 aa, Pan troglodytes
VAFEDVAVNFSQEEWSLLSEVQRCLYHDVMLENWVLISSLGCWCGSEDEEAPSKKSISIQRVSQSVRLSAQAGVARSQLTAASTS

SEQ ID NO: 33749 - protein, 91 aa, Enhydra lutris
VTFKDVSGGFTEAEWGCQDPTQRKLHRAVMLENYSQLPTVSVGYGHLLSQAICRDLNENSMESLQEKGLRDLLHSLFCWLILEDMASTITC

SEQ ID NO: 33750 - protein, 94 aa, unidentified
  REGION 1..94: note = Bos indicus x Bos taurus
VVFEDVAVYFSQEEWGLLDETQRHLYHAVMTENLALVTSLGCCHGAQGEEASSEQGVSIETSEVRTAKPDPSSRKAQPGDMYGPLSRDLLPLPE

SEQ ID NO: 33751 - protein, 84 aa, Pan troglodytes
VTFEDVAVLFTEAEWKRLSLEQRNLYKEVMLENLRNLVSLESKPEVHTCPCCPLAFGSPQFLSQDELHNHPIPGFHAGNQLHPG

SEQ ID NO: 33752 - protein, 89 aa, Enhydra lutris
VNFKIVTVDFTQKEESTLNPAQRILDRDMILENHRDLVSWDLAMVLGRRESTSKQNIFDEEPSHGVKLERLTRDDPWLSSCEEVQDCKD

SEQ ID NO: 33753 - protein, 102 aa, unidentified
  REGION 1..102: note = Bos indicus x Bos taurus
DTVLDVLVCFSLEEWRLLGEAQRLLYGNVMLEILALLASLGKLLTCNWSFLDLDMPFSLALTFPNNQPPPGSCLLNPVLMSLLSGGLPHSVTFRGPTLHSNP

SEQ ID NO: 33754 - protein, 102 aa, Pan troglodytes
LTFRDVAIEFSQEEWKCLDPAQRTLYRDVMLENYRNLVSLDFRSVTQAKVQWCHLGSLQPPLPRFKQFSCLSLPSSWDYRYLFQMHDEDILLNRARQYRSDP

SEQ ID NO: 33755 - protein, 106 aa, Enhydra lutris
LSWEDVAVDFSREEWAMLGSAQRRLYREVMLDTCAHLATLGALKNQSSDTGVDDGDGTLSPAQASQATSPSPGVGCPLFLPVVPFHWEPGEAVWMGARGTPQTSCS

SEQ ID NO: 33756 - protein, 106 aa, Pongo abelii
VTFGDVAVHFSREEWQCLDPGQRALYREVMLENHSSVAGLAFSDPTLWFGYLCPCFPHDGNLWAWPSRGAAAFPGFLVFKPELISRLEQGEEPWVLDLQGAEGTEA

SEQ ID NO: 33757 - protein, 103 aa, Pongo abelii
MDLTKDEWGLLDEAQRLLYLEVMLENFALVASLGCGHGTEDEETPSDQNVSVGVSQSKAGSSTQKTQSCEMCVPVLKDILHLADLPGRKPYLVGECTNHHQHQ

SEQ ID NO: 33758 - protein, 96 aa, Delphinapterus leucas
VTFEDVAVHLTREEWGCLDPVQRALYREVMLENYGNLVSLGILLRLPTTRIHSVNSCPALSHTQASAFSGETLAVLSAGISRRWPRYRLPIDSARP

SEQ ID NO: 33759 - protein, 104 aa, Rhinopithecus roxellana
VTFEDVAVVFTDEEWSHLVPIQRDLYKEVMLENYNSIVSLDWETKPEIHDASDEKSEGSLRECLGRQSPLCPKFEVYAPDGRVGTEKQSPSGETHKKSLFREKG

SEQ ID NO: 33760 - protein, 82 aa, Rhinopithecus roxellana
VTLEDVAVEFIQEWALLGSARRSLCRYGMLDQCRTLTSRGAGAVPEDAAGALYRSEGDTVDSRGPASSPGATLVSGMHGTKG

SEQ ID NO: 33761 - protein, 85 aa, Phyllostomus discolor
VTFEDMAMYLTREEWRPLDPTQRDLYRDVMQENYGNVVSLVQGALKDGSMEAPKKKSFRPNFEIRSENEVNPKQEISDDVEFGTA

SEQ ID NO: 33762 - protein, 86 aa, Acinonyx jubatus
VTFKDVVVTFTQEEWELLDLPQRTLYWRVMRETCGLLLSLGDEAKTRTTEPSASQSAVFEGCLSHRLPTQEDSGVSMLGEAREQKE

SEQ ID NO: 33763 - protein, 107 aa, Rhinolophus ferrumequinum
VTFEDVALYLSREEWGRLDHTQQSFYRDVLQKRNRLALGALEVGKEETPPSPAPPGDVKSFRTRAGRAQGDVLQCGRQAASGQSAGPANDDGQPGLLEERQLQTAPP

SEQ ID NO: 33764 - protein, 83 aa, Pan troglodytes
VTFEDVFVYFSREEWELLEEAQRFLYRDVMLENFALVATLGFWCEAEHEAPSEQSVSVEGVSQVRTAESGLFQKAHPCEMCDP

SEQ ID NO: 33765 - protein, 84 aa, Balaenoptera acutorostrata
LTFKDVAVGFTQEEWECLDPAQRALYRDVMLETCRNLLSLGEKMESRKDHFPFLAVWNRDLRTSAQQNCTFAVDQRRLGTSFFF

SEQ ID NO: 33766 - protein, 111 aa, Acinonyx jubatus
VVFEDVAVDFTLEEWSLLDCVQKNLYRDVMLVSKSCDRFCESNEGNQHRDTCSHCPHLNSRKNISTGVKLYECTKCGNGFIHLSSLKRHVRSHCGQKPYPCQECKQAFICP

SEQ ID NO: 33767 - protein, 86 aa, Acinonyx jubatus
LTFRDVAIEFSQEEWECLDPAQRALYRDVMLENYRTLVSLGEDNFPPEVGIPSDGFVIKELSPTENINKGEFYHLVILERNGSHGI

SEQ ID NO: 33768 - protein, 94 aa, Acinonyx jubatus
LTFRDVAIEFSQEEWECLDPAQRALYRDVMLENYRNLVSVGPALNLHHNHIPIDVQAQALSPHGSLSAGFALMELSPGEDIYKEVFYHLVILER

SEQ ID NO: 33769 - protein, 88 aa, Panthera pardus
LTLEDVAVDFTQEEWRLLAPAQKDLYRDVMLENFRNLVSVDHGPVHRACLFCRFPRTGYVVSMPAALSRLERGGRWMTEDETRRRICP

SEQ ID NO: 33770 - protein, 89 aa, Tursiops truncatus
VNFHRVTVDFTQEEEGTLNPARRTLDRGVILENHRHLVSWESATALGRRESTSKQSSFGDEPSYRVKIERLTRDDPWLSSCEEVQDCKE

SEQ ID NO: 33771 - protein, 85 aa, Sus scrofa
LTFEDLTIEFSQEEWDCLDPAQRALYWDVMLETFRNLLSLDISHIYVMKILQLKANIDRGVVFQTLILGRQEWSEVRHFYLRESQ

SEQ ID NO: 33772 - protein, 101 aa, Delphinapterus leucas
VVFEDVAVSFSQEEWGLLNDAQRLLYCDVMLENLSLIASLGCWSALGTEEAASEQCVSVEQVTQDRNPNPDLSILKTLTSDMGALVEKYVLYLAEHQGVHP

SEQ ID NO: 33773 - protein, 104 aa, Zalophus californianus
VTLEDVAVDFSREEWAMLDSAQRRLYREVMLDTCANLAALGALKNQSSDTGIDDGTLSPTQASPATSPSPWAGCPLFLPVVPSHLEPGEAMWMGPQGSPQTSCS

SEQ ID NO: 33774 - protein, 88 aa, Panthera pardus
VTFEDVVVDFTQEEWGQLEPAQRTLYRDVMLETFRLLVSVDLETRPQTKVSTPTQDITEGIRTSALAESFLWDSLWYSEGDDAEGCRG

SEQ ID NO: 33775 - protein, 95 aa, Sus scrofa
VVFEDVAIHFSQDEWCLLDEAQRLLYWRVMLQNIALLSSVGCWHRAQAEEAEQGDSVRVSQVKTPKMHSPLLKDILRLAEHDGTQPEHEVYVCAA

SEQ ID NO: 33776 - protein, 87 aa, Acinonyx jubatus
VAFEDVAVNFTLEEWALLDPSQKKLYRDVMRETLRNLASVGKKWKDHNIDDQYKNQGRNLRSPMVERLHQSKEGGQCGGNFSLIPHL

SEQ ID NO: 33777 - protein, 87 aa, Monodelphis domestica
MTFQDVAVDFTREEWCLLSPPQKELYREVMLENARNLLSVEGEIRSEMKANPTEMSCLVEEMNLQRFMHGGPDNFASRELSVAHKNS

SEQ ID NO: 33778 - protein, 86 aa, Acinonyx jubatus
LTFRDVAIEFSQEEWECLDPAQRALYRDVMLENYRNLVSLGEDNFPPEVGSPSAGFVIKELSPIEDINKGELCHLVILERNESHDI

SEQ ID NO: 33779 - protein, 84 aa, Panthera pardus
VTFKDVAMDFTEEWRQLDPTQRALHKEVMLEIYDNLVLVAKKLDDCAECGKSFSRSTDLRYHQRIHPGEKPFICDTCGKGFSYN

SEQ ID NO: 33780 - protein, 97 aa, Capra hircus
LTLEDVAVNFTQEEWALLDTAQRQLYRDVTLETCGHLAYVDWVTRHQTKESTPQQNSLAKRTFQGVNRAHLASSGSQLSDLREDWMRTLKHVAATHK

SEQ ID NO: 33781 - protein, 103 aa, Odocoileus virginianus
VTFEDVTVVFTWEEWRFLDSSQKRLYREVMWENYANVMLAGNWKKSCKPQEERFRYLEHENLSCWQGWKTASTQIYENKNYVEMVQGIDSKDLKQQHLSHYQE

SEQ ID NO: 33782 - protein, 90 aa, Trichechus manatus
VIFEDVAVDFTLEEWALLDPAQKKLYRDVMLETFRNLASVDDETPCKTSGSVSQQDISGEKKFNEHRITKFTRNDSWASILRKISEDLTI

SEQ ID NO: 33783 - protein, 103 aa, Pongo abelii
VTFEDVTIIFTWEEWKFLDSSQKRLYREVMWENYTNVMSVENWNESYKSQEEKFRYLEYENFSCWQGWWNAGAQMYKNQNYGETVQGTDSKDLTQQDRSQCHE

SEQ ID NO: 33784 - protein, 103 aa, Macaca mulatta
VTFGDVAVHFSREEWQCLDPGQRALYREVMLENHSSVAGLVGRTLKEASNQRPWLAHGSTAHLCTDRHKEAGFLVFKPELISRLEQGEEPWVLDLQGAEGTEA

SEQ ID NO: 33785 - protein, 104 aa, Leptonychotes weddellii
VTLEDVAVDFSREEWAMLDSAQRRLYREVMLDTWANLAALGALKNQSSDTGIDDGTLSPMQTSRATSPSPWVGCPLFLPVVPSHLEPGEAMWMGPQGTPQTSCS

SEQ ID NO: 33786 - protein, 90 aa, Pteropus vampyrus
VMFRDVAIDFSQEEWECLDFAQRDLYRDVMLENYSNLVSLDLPLRCANKDLSPKKDTYKTELSQWEISDRLENCDLKEFNSRDFLEVRGT

SEQ ID NO: 33787 - protein, 96 aa, Physeter macrocephalus
VTFEDVAVHLTREEWGCLDPVQRALYREVMLENYGNLVSLGILLRLPTTRIHSVNSCPALSHTQASAFSGETLAVLSAGICKRWPRCRPPIDSARP

SEQ ID NO: 33788 - protein, 87 aa, Physeter macrocephalus
VTFKDVAVVFTEEELGLLDSAQKKLYQEVMLENFQNLVSVGEEGHSGTEHRISPCGHQSFTPDVISQLKREEKLWMIKIATQSRRSS

SEQ ID NO: 33789 - protein, 88 aa, Tursiops truncatus
LTFRDVAIEFSQEEWECLDPAQRALYRDVMLETYRNLLSLGEDNTPPEVGICPNTSISFLTKELLKKKNINNRELYQSVVLGRHGSHG

SEQ ID NO: 33790 - protein, 90 aa, Ailuropoda melanoleuca
VVFEDVAVDFTLEEWALLDSAQRKLYREVMLENLKNLASVDDETQLKAGGSVSQQDIYGNKISKEHKIAKFTRNDSWASVLGKIWEELST

SEQ ID NO: 33791 - protein, 83 aa, Macaca nemestrina
VAFEDVAVNFTQEEWALLDIFQKNLYREVMLETFRNLTSIGKKWKDQNIEYEYKIPRRSFRSLIEEKVNEIKEDSHCGETFTQ

SEQ ID NO: 33792 - protein, 86 aa, Canis lupus
LTFRDVAIEFSEEEWECLDPAQQALYRDVMLENYRNLVSLGEDNFPPEVGSLSAGFATKELSPIEDINKGELYHLVILERNKSDDI

SEQ ID NO: 33793 - protein, 87 aa, Sapajus apella
VTFRDVTVDFTQEEWQQLEPAQKDLYRDVMLENYRNLVSLDWETRPEMKELDPKNDILEDKPSVVGVAMGGPTRNGSQGPASEGVWE

SEQ ID NO: 33794 - protein, 97 aa, Felis catus
LTFRDVAIEFSQEEWECLDPAQRALYRDVMLENYRNLVSVGEDDFPPEVGSTSAGFAIKELSPKEDINKGRFYHLVLLERNESHGIKDFDLQEVWED

SEQ ID NO: 33795 - protein, 82 aa, Pteropus vampyrus
VAFEDVVVYFSWEEWGLLDEAQRCLYHDVMLENFALVTSLGCWYGMEAGALSGLGVPAAHTAAAQGLDSAPAAQKTPCAAWF

SEQ ID NO: 33796 - protein, 87 aa, Tursiops truncatus
VTFKDVAVVFTEEELGLLDSAQKKLYQEVMLENFQNLVSVGEEGHSGTEHRISPCGHQSFTPDVISQLKREEKLWMIKIATQSRHSL

SEQ ID NO: 33797 - protein, 101 aa, Tursiops truncatus
VIFEDVAVSFSQEEWGLLNDAQRLLYCDVMLENLSLIASLGCWSALGTEEATSEQCVSVKQVTQDRNPNPDLSILKTLTSDMGALVEKYVLYLAEHQGVHP

SEQ ID NO: 33798 - protein, 89 aa, Sus scrofa
VTFEDVALYFSWEEWNLLDEAQRCLYQDVMLETFVLASSLGCWPGAEDKEASSEQSISVGVSQIKTIKADSSHQKAQAFEMCGPLLSDI

SEQ ID NO: 33799 - protein, 87 aa, Pan troglodytes
VAFEDVAVNFTQEEWALLGPSQKSLYRDVMWETIRNLDCIEMKWEDTNIEDQHKNPRRSLRCHIIERFSESRQPDSTVNEKTPGVDP

SEQ ID NO: 33800 - protein, 87 aa, Capra hircus
VNFKIVTVDFTQEEGGTLSSAQRTLDRDVILENHRDSWDSATALGRRGSRLKQSIFDDKLSHSVKIEKLTRDDPWLSSCEEFQDCKE

SEQ ID NO: 33801 - protein, 82 aa, Chrysochloris asiatica
MTFRDVAVEFTQEEWQLLAPAQKALYRDVMLENYSHLVSLGWKEVNNHGPYPTKALLESSQTFPESQKSNSTKSQLIKHQKP

SEQ ID NO: 33802 - protein, 86 aa, Neophocaena asiaeorientalis
LTFKDVAITFSQEEWECLDPAQRALYRDVMLETYRNLLSLGEDNSSPEVGSLSAGFAIKELSPREDISKGELCHLVTLERSKSHGI

SEQ ID NO: 33803 - protein, 82 aa, Trichechus manatus
VTFEDVTVVFTEAEWKRLSSEQKHLYKEVMLEIYRNLLSLAEPKPELQPCSSCLLAVSCQRFLSQHVLPIFPGFCAEHHFHP

SEQ ID NO: 33804 - protein, 90 aa, Equus caballus
LTFRDVAIEFSQEEWECLDPAQRALYRDVMLENYRNLLFLGVSPIHATKKLQSKENSNTGEVFHTLMLGRHESHKIKDLYFRKIQENMHA

SEQ ID NO: 33805 - protein, 116 aa, Suricata suricatta
VTFEDVAVLFTRDEWRKLGPSQRDLYQEVMLAAAAAAAAAAAAAAAAAAAAAAAAAAAAAAAAAAAAAAAVRWKSSHKNTKSTQTQDSSFQELIMRRSKRSGPWDFKSEKPCIYEY

SEQ ID NO: 33806 - protein, 88 aa, Sus scrofa
VTFKDVAVNFTQEEWHHVDPAQRRLYRDVMLENYSHLVSVDWKTRPEAKSSNLRQNISEVFPSTDDLSHATLEDAWDVSGQLERHQEN

SEQ ID NO: 33807 - protein, 88 aa, Sus scrofa
FTFEDVAIEFSQEEWACLDPAQRALYWDVILETYRNLLSLGSHSPGLRIKDLAPGEDMNEGDVHHVVTLERNQSRGIKDVDLNKVCEN

SEQ ID NO: 33808 - protein, 94 aa, Neophocaena asiaeorientalis
VVFEDVAVYFSQEEWVLLDEAQRHLYHAVMTENFALVTSLGCWHGAQDEEAPSEQSVSVGMSEVGTPKPDPSTKKAQPYEMCDPLSKDHLHLPE

SEQ ID NO: 33809 - protein, 89 aa, Neophocaena asiaeorientalis
VNFHRVTVDFTQEEEGTLNPARRTLDRDVILENHRHLVSWESATALGRRESTSKQNIFGDEPSHRVKIERLTRDDPWLSSCEEVQDCKE

SEQ ID NO: 33810 - protein, 98 aa, Chrysochloris asiatica
VTFEDVSVDFSLEEWGFLNPTQRDLYKAVMLENYRNLVSLDKETCGKIKELQNGRICNQCLDCGKYFKRRSALVLHQRIHTGERPYPCKECSKAFLQK

SEQ ID NO: 33811 - protein, 103 aa, Sus scrofa
LTLEDVAVDFTWEEWQLLTPAQKDLFRDVMLENYRNLVAVGEAGSPVSLGGPQSPVAFPFAASESSRVSVRLCRVDSLSVSVPREVGVFSLLPRGKPLLCRCM

SEQ ID NO: 33812 - protein, 93 aa, Neophocaena asiaeorientalis
MVFEDVAVYFSQEWGLLDEAQRHLYHAVMTENFALVTSLGCWHGVQDEETPSEQDVSVGVSLVRTPKPDPSSRKAQPCEIYGPLLKDFLQLLE

SEQ ID NO: 33813 - protein, 87 aa, Neophocaena asiaeorientalis
LAIEDVVVNFTLEEWALLDPSQKKLYRDVMQEIFWNLASVGKKWEYHDIGDAYKNQGGNLRSPMVERLFERKDSSSCGEHFSLIPSL

SEQ ID NO: 33814 - protein, 87 aa, Mandrillus leucophaeus
VVFEDVAIYFSQEEWGHLDEAQRLLYRDVMLENLALLSSLGCWHGAEDEEAPSQQGFSLGMPEVTTSKSCLSTQKVHPSETCDPPLK

SEQ ID NO: 33815 - protein, 82 aa, Suricata suricatta
VTFGDIAIYFSWKEWSLLDEAQRRLYYDVMLENFTLHSNTLSCVCQFLFLNYQRDKCSTERNMSIIQEGGHLRRRWTFVQRP

SEQ ID NO: 33816 - protein, 83 aa, Chrysochloris asiatica
VIFEDVAIHFSQEEWGLLDETQRTLFQDVMLENFAITASLVLRDILHLTELQPTYSESKLCLDEACFRGSWCSANLPQSQKRH

SEQ ID NO: 33817 - protein, 97 aa, Chrysochloris asiatica
VVVEDVAVVFSQEEWDLLDPTQRKLYRDVMMETFRNLASLEDGRSQQYECKDGCKIYHSSSSLILNANFHQPYKCQKCEKDFSEASLLMQHVQVHRG

SEQ ID NO: 33818 - protein, 96 aa, Trichechus manatus
VTFKDVAVVFTEEELELLDSAQRKLYQDVMLENFRNLVSLGGKNLKEMETLQEVGLRYLSHEELFCSQIWQQVIRELSQGQESTINIEGTVSQLQK

SEQ ID NO: 33819 - protein, 102 aa, Equus caballus
VAIEDVTVNFTPEEWALLDPSQKKVYRDVMWETFRHLASVGKNEDIPHVINERTSGRLCESEDGSQCGENFSLLPNLSLNKKTTVGAKPWGCSACGRVFTHH

SEQ ID NO: 33820 - protein, 89 aa, Sus scrofa
VTFEDVAVYFSQEEWKLLHEAQRLLYRDVMLETFALVASLGKALIPLPAPWKGLCLFPSFVRTAPHFSQLDKGHMSVTASLSYVLWVPG

SEQ ID NO: 33821 - protein, 117 aa, Sus scrofa
VTFEDVALYFSWEEWNLLDEAQRCLYQDVMLETFVLASSLGKVLDVPLGPGQGSKFFHLLFISSSLAIFIYSSSFVVKSLRFWSFCCGSGVMNLTSIHEDVGLISGLTHWVKDPELP

SEQ ID NO: 33822 - protein, 91 aa, Loxodonta africana
VTFEDVAVDFTQEEWQYLNPPQKTLYRDVMLETYSNLVSVGPFSLLGSEDQGGIHFSLTEHQITKPDLILKLELEEQAAAEGKIPIWSFLE

SEQ ID NO: 33823 - protein, 86 aa, Sus scrofa
VTFEDVAIYFSQEEWGLLDEAQRCLYRDVMLETLALTTSLGKAFIFFSGSLAGLSFPIQEAALSIAQLDRGPGWRPHLPGLSAVGA

SEQ ID NO: 33824 - protein, 104 aa, Mandrillus leucophaeus
VTFEDVSVDFSQEEWELLEPAQKNLYREVMLENYRNVVSLEALKNQCTDAGIKKGSLPPAQTPQVTSLSSWMGYVLLQPAASSHLEQREALWMEEKGTPRASCA

SEQ ID NO: 33825 - protein, 83 aa, Neophocaena asiaeorientalis
MTFEDIAVYFSWEEWRLLDEVQRHLYHDVMLENFTLISSLGCCCGAKDAEAPFQQSISISISQARTPKAPLFSQKNYSSETCS

SEQ ID NO: 33826 - protein, 82 aa, Bos mutus
VTFEDVAVDFTLEEWAFLDPSQKKLYRDVMRETLRNLVSIELINNVLLICLFVFHRSHIVERLCENKEGSQCGENFSIIPNL

SEQ ID NO: 33827 - protein, 95 aa, Chrysochloris asiatica
VTFRDVAIKFSQEEWEYLGPAQRELYRDVMLENYSNLLSLDLESSCETKKPSLEKSIYKMESLQWTIMGNPLVHNLEYNCPGDLMAHQGQLESQQ

SEQ ID NO: 33828 - protein, 97 aa, Chrysochloris asiatica
VTLEDVTMVFTEAEWKTLSFEQKNLYKEVMLEIYQNLLSLAEPKPETYHCFSSQERDFASPLCGSTVECETSRVFSNPPQRESAWPREGHTRVRVKP

SEQ ID NO: 33829 - protein, 119 aa, Sus scrofa
LTLEDVAVDFTWEEWQLLTPDQKDLYRDVTLENHRNLVAVGEAGSPVSLGGSPVHGLSFLRFGQLWSVCEALKGEMSLSSSSGPQPMVHKLLSGELCLSLAELHIAWLVKQALLHTGSP

SEQ ID NO: 33830 - protein, 85 aa, Sus scrofa
LTLEDVAIEFSPEEWACLDPAQRALYWDVMLETCRNLLSLGISLIPVIKKLQAQAHIDRDVCQTVMLGGHERNEVNHFHLREIQT

SEQ ID NO: 33831 - protein, 89 aa, Equus caballus
VAIEDVAVNFTPEEWALLDPSQKRLYRDVMWETFRHLCCLPMKSVLRPCEEGSQCRGNVSLLPYLRMTKKTTGAKPWGCSACGRAFTHH

SEQ ID NO: 33832 - protein, 88 aa, Suricata suricatta
LTFGDVAIEFCEEEWGCLNRSQRELYRDVMLENYGHLLFLGEMTPPDFPDHTRVLFLPLKTVSQHLPLCMPGIDIPAVREERFQFLSP

SEQ ID NO: 33833 - protein, 84 aa, Chlorocebus sabaeus
VTFEDVFVYFSREEWELLEEAQRFLYRDVMLENFALVATLGFWCETENEEAPSEQSVSVEGVSQVRTAEPGLFQKAHPCEMCDP

SEQ ID NO: 33834 - protein, 83 aa, Mandrillus leucophaeus
VTFKDVAVVFTEDELGLLDPAQRKLYRDVMLENFRNLLSVGNQPFHQDTFHFLRKEKLRIMKTTSQRGGNSGGKIQIEMETVP

SEQ ID NO: 33835 - protein, 93 aa, Suricata suricatta
PGHIILLCIHISSLAPLSSKAAAAAAAAAAAAAAAAAAAAAAAAAAAAAAAAAAPKLLTLTGYCATKPEVIFRLEHGEEPWILEEEFPRRSLP

SEQ ID NO: 33836 - protein, 84 aa, Suricata suricatta
MDPEFCEEEWGCLNRSQRELYRDVMLENYGHLLFLGEMTPPDFPDHTRVLFLPLKTVSQHLPLCMPGIDIPAVREEYHVRGPPG

SEQ ID NO: 33837 - protein, 87 aa, Chlorocebus sabaeus
VSFEDVAVNFTLEEWALLDSSQKKLYEDVMQETFKNLVCLGKKWEDQDIEDDHRNQGRNRRGRMVERLCESRKGSKCGETTSQMPNV

SEQ ID NO: 33838 - protein, 87 aa, Sus scrofa
VAIEDVVVNFNLEEWALLNPSQKKLYKDVMWETFRNLASIGKKWEDHDIEDEYKNQGRKLRSLVLERLCESKEGSQCAKNLSLIPKL

SEQ ID NO: 33839 - protein, 93 aa, Sus scrofa
VSFKDVTVAFTQEEWQQLDSAQRTLYRDVTLENYSHLVSVEEYQPDELLERSLENHGKHLKQVLFTNKSLTTEQEISGKPCNLEINIFPANTM

SEQ ID NO: 33840 - protein, 85 aa, Sus scrofa
MACDVAIDFSPEEWECLDLGQRHLYRDVMLEICRHLVSLGKPSHVPLHQKRQKTYTLKTKILMKELRDDTNRWEDDTILLDWKKK

SEQ ID NO: 33841 - protein, 89 aa, Equus caballus
VNFKIVTVGFTQEDEGILNPAPKTLDRDVILENHRDLVSWDLAAALGRRESTSEQNTLDDEPSQGVKIEELTRDDPWLSSCGEVQDYKD

SEQ ID NO: 33842 - protein, 96 aa, Capra hircus
VTFEDVAVHLTREEWGCLDPVQRALYREVMLENYGNLVSLGILLRLPTTRIHSVNSCPALSHTQASAFSGETLAILSAGISRRWPRCLHPIDSARP

SEQ ID NO: 33843 - protein, 82 aa, Chrysochloris asiatica
VAVEDVAVDFTQDEWALLDLPQRKLYRDVMMETFRNLASRPYECQECGKAFRHASNLTIHVRSHSGERPYECKECGKAFHKS

SEQ ID NO: 33844 - protein, 96 aa, Chrysochloris asiatica
VLFEDLAVYFSQEECVSLCPAQRALSRDATHRCFQDVAWLGEKDKLGNNQQFSVESMEFEEFAVEKYSFAVPLIYYPEKSSEDEVGKQEGKIPAGT

SEQ ID NO: 33845 - protein, 88 aa, Chlorocebus sabaeus
VAFEDVAVNFTQQEWALLDSSQKNLYREVMQETYRNLASVGKKKRKDQNIEDHFKKLGKDTRNHMAQRLRESKEGSQYGQVVSHIPNL

SEQ ID NO: 33846 - protein, 89 aa, Chrysochloris asiatica
MIIEDVAVVFTHEEWDLLDPAQRKLYRDVMMETLRNLASVGTHSAQRPFECEECRKSFRDSSQQSRHLQTHSGDRLYECNQCEKECSCP

SEQ ID NO: 33847 - protein, 86 aa, Mandrillus leucophaeus
VVFEDVAVNFTQEEWALLGPSQKKLYRDVMQETFVNLASIGENWEEKNTEDHKNQGRKLRSHMVERLCERKEGSQFGETINQTPNP

SEQ ID NO: 33848 - protein, 95 aa, Chrysochloris asiatica
VIIEDVAVVFTHEEWDLLDPAQRKLYRDVMMETLRNLASVALTAPMQIHNGESPYECKECGKTFCQASNLTTRRRIRTGERLYECKEREKYYTQW

SEQ ID NO: 33849 - protein, 92 aa, Suricata suricatta
MSFKGVTVDFTRDEWLQLTGTQRTLCRGVMLENYSHPAAVGGGARCVSHSVPVFPSTSLSNTKFKLWDHFLKMRNVEKPFLIRQPSLHLRGL

SEQ ID NO: 33850 - protein, 87 aa, Mandrillus leucophaeus
VTFDDVAVDFTPEEWALLDTTEKYLYRDVMLENYMNLASVEWEIQPRIKRSSFQQGFLKNQIFSGMQMTRGYSGWKLCDCKNCGEVF

SEQ ID NO: 33851 - protein, 85 aa, Mandrillus leucophaeus
VTFEDVAVYFSQEEWELLDAAQRHLYHSVMLENLELVTSLGCWHGVEGEKAHPKQNISVEEVLPVRIPNTDSSTKKANSCDMCGP

SEQ ID NO: 33852 - protein, 103 aa, Mandrillus leucophaeus
VTFEDVTIIFTWEEWKFLDSSQKRLYREVMWENYTNVMSVENWNKSYKSQEEKFRYLEYENFSCWQGWWNAGAQMCENQNYGETVQGKDSKDLTQQDHSQCQK

SEQ ID NO: 33853 - protein, 90 aa, Mandrillus leucophaeus
LTFKDVAIEFSQEEWTYLDPAQKTLYRDVMLENYRNLVSLDISCKCVNKDLPPKGKNSMGEAFHMVKLERLESCDEALSFEEVQKNTYDF

SEQ ID NO: 33854 - protein, 85 aa, Chrysochloris asiatica
VTFEDVAVVFTQEEWVVLDSAQRRLYREVMLENCRNLAAVEPQLWCQKSIPNQDIFGTIPSIGMKMDQPQLGTKLYKCNEFEKPF

SEQ ID NO: 33855 - protein, 85 aa, Chlorocebus sabaeus
VTFEDVAVYFTQNEWASLDSVQRALYREVMLENYANVASLGDEARTEEERLTPKEHVSKETVSFRLMVGVLPGNVSQHLDFGSSL

SEQ ID NO: 33856 - protein, 109 aa, Chrysochloris asiatica
VVIEDVAVVFSQEEWALLDVAQRKLYRDVMMETFRHLTAVVSGDKSSTEQTTGRSIKNGTCSSGSGGMSTARGDEEERADQMGPVRRIRTHTGQRPYESKEHGKAFSQA

SEQ ID NO: 33857 - protein, 91 aa, Mandrillus leucophaeus
VAFEDVAVNFTQEEWALLDPPQKNLYREVMQETLRNLASIGKKWNNQYIEDEHQNPRRNLRRLTKERLSESEESHQHGEVLTQVPDDTLKK

SEQ ID NO: 33858 - protein, 82 aa, Equus caballus
VTFRDVAVTFNEEELGLLDSTQRQLYRDVMLENFRNLLSVGHQPFKHDVVHLVMEERLCVMKIAMQRKETSGKLQHELETVP

SEQ ID NO: 33859 - protein, 89 aa, Suricata suricatta
VNFKIVTVDFTQKDEDTLNPVQRTLDRDVILENHGDLVSWDLATALGRRESTSKQNIFDDEPFHGVKLERLTRDDPWLSSCEEVRYCKD

SEQ ID NO: 33860 - protein, 85 aa, Chrysochloris asiatica
LLFKDVAVNFTSEEWQLLGTAQKDLYCDVMLENYSNLASLEEAWQANDDTDQRQENSDKPDPVSINHVSKKVDELNAPEKLLLHA

SEQ ID NO: 33861 - protein, 90 aa, Suricata suricatta
VVFEDVAVDFTLEEWALLDSAQRKLYRDVMLENLKNLASVDDETQFKANGSVSQQYAYGNKISKENKLAKFTRNESWASVLGKIWEELSM

SEQ ID NO: 33862 - protein, 89 aa, Sus scrofa
LTFQDVAVYFSWEEGRQLGPDQRTLYRDVMLENYGHVASLDSVIGTEKELFILNQKCSEEVKTPELISTTFSRGNPQASKLQKAWDIEN

SEQ ID NO: 33863 - protein, 82 aa, Suricata suricatta
LTFRDVAIEFPQEDWGCLSLPQREVYGDNLQQYSILLELWDVKRKETVASYPAVFPNETDRLLSETFIGTSIQRGSVDGYKG

SEQ ID NO: 33864 - protein, 91 aa, Suricata suricatta
VSFADVAVYFSPEEWGCLRPAQRALYRDVMRETYGHLGALGGTPNKKEEAPEEGPGAKGPGKTPGKEPSEELAKHSPDWTIRKASARAQPP

SEQ ID NO: 33865 - protein, 108 aa, Chlorocebus sabaeus
VAFEDVTMNFIQEEWTLLSPSQKNLYRDMMLETLGNLASAKVWKEGNQRGEPFSQIPDCHLKKKSHTGVKPRKCCVCGKVFLPHSFLTAHARQKLYECDGEWGEKPRK

SEQ ID NO: 33866 - protein, 92 aa, Chrysochloris asiatica
VFVEDVAMVFTQEEWDLLDVAQRKLYRDVMLETLGNLASVGKNGSFLRAGLSQKHWLHGALREFQRGSLTYSVENVCEGNAGKLSQCEETFI

SEQ ID NO: 33867 - protein, 91 aa, Suricata suricatta
LTFADVAVYFSSEEWGCLRPAQRALYRDVMRETYGHLGALGGTPNKKEEAPEEGPGAKGPGKTPGKEPSEELAKHSPDWTIRKASARAQPP

SEQ ID NO: 33868 - protein, 87 aa, Sus scrofa
VTFDDVVVNFTLEEWALLDPSQKKLYRDVMEETLRNLASLGKTWEDHDVGDQYRNHGGKLRSPLVERLSKHKDSSLCGENFSLIPSL

SEQ ID NO: 33869 - protein, 92 aa, Lipotes vexillifer
VTFEDVAIYFSQEEWGLLDEAQRCLYHKVMLENFLLTASMATNRVLFTTQESLLGKGFMSLANMGKPCAVSTHLFSSRESTLEKGLTSAVNV

SEQ ID NO: 33870 - protein, 104 aa, Equus caballus
VTFEDVVVYFSWEEWGLLDETQRCLYHDVMLENFALVTSLGCWYGMEDEEAPSMQSVSVEQMSLGKTPNLGPPIQKTHPCEKCVLVGGEILYLAEYQGSHLGQK

SEQ ID NO: 33871 - protein, 83 aa, Equus caballus
IAFQDLAVWFSKEEWRLLGEGQRALYRDVMRENYEMLVSLGTAELLPLSAFLSPTEPGGAMGGGSSADEGQEPAREGPSGGTP

SEQ ID NO: 33872 - protein, 87 aa, Mandrillus leucophaeus
VAFEDVSVSFSQEEWALLAPSQKKLYRDVMQETFKNLASIGEKWEDQNVEDQHKNQGRNLRSHMGERLCEGKESSQCAETVSPTLSV

SEQ ID NO: 33873 - protein, 83 aa, Chrysochloris asiatica
VVFEDVAVEFTHEEWALLDFSQRKLYRDVMIETFRNIGSERPYECKECGKTFSYLSNLYRHIRTHSGVRPYECKECGKAFSRS

SEQ ID NO: 33874 - protein, 83 aa, Chlorocebus sabaeus
FTFKDVAIEFSQEEWECLDPAQRALYRDVMLENYRNLLSLDEDNVLPEYDISVGFTSKGLSPKENNKEELYHLVILERKESCG

SEQ ID NO: 33875 - protein, 83 aa, Callorhinus ursinus
VTFEDVAVNFSLEEWALLDSSQKKLYRDVMRETFRNLAAIEKKWKDHDTEYRYNTQGRRLRSHMAEKRESKEGRQCGETITQT

SEQ ID NO: 33876 - protein, 84 aa, Callorhinus ursinus
AVGCQCVSGCAEHPGRCGPGATPRMLDSVVPAPYRSRSPAGGWSDPLFFSGAGIPFSKPKLITQLEQGKETWREERTCPPAARP

SEQ ID NO: 33877 - protein, 89 aa, Callorhinus ursinus
VTFEDVALYFSWEEWDLLDEAQRCLYHDVMLENFALTSSLGCWHGVEDEDAPSEESISIGVSQIGTLKAGSSSQKAQPFELHGPILRNI

SEQ ID NO: 33878 - protein, 94 aa, Callorhinus ursinus
LVFTDVAIHFSQEEWGLLDEAQRSLYHSVMLENFALLSSLGCWHGAQDEEAPSEQEVSVGGSQVRTPKPGPSIQKSQLCETCSLLLKDLLHLAE

SEQ ID NO: 33879 - protein, 88 aa, Callorhinus ursinus
VAFEDVTVNFTLEEWALLNPSQKKLYRDVMQETLRNLASVGEKWEDRNSKSLYEHHQTDLSRPVVESPCKNKEGGPFGESFSQNPNHK

SEQ ID NO: 33880 - protein, 90 aa, Callorhinus ursinus
VVFEDVAVDFTLEEWALLDSAQRELYREVMLENLKNLASVDDETQFKASGSISQQDVYGNKISKEHKIAKFTRNDSWASVLGEIWEEFST

SEQ ID NO: 33881 - protein, 86 aa, Callorhinus ursinus
VTFEDVVVYFSWEEWGLLDETQRCLYHDVMLENFALVISLGCWYGMESEEKMALGKTPSPDSSVWKAQPCEKCVLLGRDILYVAED

SEQ ID NO: 33882 - protein, 103 aa, Callorhinus ursinus
VTFEDVAVSFSWEEWDLLDEAQRHLYQDVMLENLALITSLGCWHGAEDEEAPSEQSISVGVSHVRAPKTGLFPQKANPYEVCGPVLKDNFYSAEHQETQFSEK

SEQ ID NO: 33883 - protein, 91 aa, Callorhinus ursinus
VVFEDVAIYFSQEEWGLLDEAQRFLYHAVMLENFALLSSLGCWHGAQDEEAPSEQEVSVGGSQVRTPKPGPSIQKSQPWEMCGPVWKDILR

SEQ ID NO: 33884 - protein, 90 aa, Equus caballus
VVFEDVAVDFTVEEWALLDSAQRELYRDVMLENFRNLASVDDETQFKANGSVSQQDNYGNKISKEHKIAKFTRNDSWASILGKICEELSI

SEQ ID NO: 33885 - protein, 103 aa, Equus caballus
VTFEDVAVHLTREEWGCLDPVQRDLYREVMLENYGNVVSLGILLRLPTSRIHSVNSCPALSHTQASAFSGETLAVLSAGIFKRWPKYRLPIDIARPRSETPFP

SEQ ID NO: 33886 - protein, 87 aa, Neovison vison
AFEDVTVHFSLEEWALLNPSQKKLYRDVMQETLRNLALVGEKWEDRNGKSLYEHHQTNLSRPVVESPCKNKEGSPCEESFSQNPNHK

SEQ ID NO: 33887 - protein, 87 aa, Pteropus vampyrus
VAFEDVAVNFTLEEWALLDPTQKKLYRDVMWETFKNLVSVGEKMDDYDIEDQYQSQGRILRSHIEERICESEASVQREENLSLISNL

SEQ ID NO: 33888 - protein, 90 aa, Loxodonta africana
RSFVDDEVCLSEQEWENLEDWQRELYRNVMKSNYETLVSLKVLGQPDGEAELGAEMLGGLEEEGPGDAHPVDRGTIKQEVEYQQEGFAEL

SEQ ID NO: 33889 - protein, 90 aa, Loxodonta africana
VMFKDVAIDFSQEEWECLDSAQRDLYRDVMLENYSNLVSLEFPSRCARKDLPPKKDIYETELSQWEMTARLESCDLEVSSSRDYLEVKGT

SEQ ID NO: 33890 - protein, 85 aa, Pteropus vampyrus
VTFEDVAIFFSQEEWCLLDEAQRCLYHHVMLENLALMASLVCWRATENEETPSEQSVSIEALSQVVHTGERPYECSRCDKSFSQR

SEQ ID NO: 33891 - protein, 94 aa, Lipotes vexillifer
VTFEDVAVYFSQEEWRLLDEAQRLLYRDVILETFALVASLGCWHRAEDEETPSEQKVSVEVPQINTSKTDLSTLKSYPWQRFCLYLEGGLHLAE

SEQ ID NO: 33892 - protein, 93 aa, Callorhinus ursinus
VVFEDVAVDFTPEEWALLDRGQRRLYRDVMLETCRNLASLGENWKCPGIEHQHKNKGTYMRCHAVEMPSENNGSNQCGETNQISNFIVHKRLS

SEQ ID NO: 33893 - protein, 88 aa, Chlorocebus sabaeus
VAFEDVAVNFTREEWALLGPSQKTLYRDVMWETIRNLDCIGMKWEDTDVEDQHKNPRRSLRCLIVERFSESSQIPGSTVNEKAHGVDP

SEQ ID NO: 33894 - protein, 94 aa, Equus caballus
VTFEDVAVYFSQEEWRLLDEAQRRLYRDVMLEVFALVASLGCWHGAEDEEVPSEQRVSIEVSQTNIPKADLSTQRSFPLEMCHLDLNGDLHPAE

SEQ ID NO: 33895 - protein, 84 aa, Chrysochloris asiatica
VTFDDVTISFTWEEWKFLNSTQKKLYREVMWENYTNVMSVGKWNESYKSQEERFRYLGHGNLSCWQGWKKAGTQIYENQNCVET

SEQ ID NO: 33896 - protein, 84 aa, Chrysochloris asiatica
VTFEDVTVVFTEAEWKRLSSEQKNLYREVMLESYRNLLSLDEALKELETSRFALNSSKEDETDCGLKSDFFTNQRSLFREMLHV

SEQ ID NO: 33897 - protein, 97 aa, Papio anubis
VTFADVAVNFTKEEWTLLDPAQRNLYRDVMLENSRNLAFIDWATPCETKDATPQPDILPKRTFPEANRVCLTSISSQLSTLREDWRCPKTEGPHRQG

SEQ ID NO: 33898 - protein, 87 aa, Pan paniscus
VTFEDVAVYFSQEEWRLLDDAQRLLYRNVMAAAAAAACCWQGAEAEEAPEQSASVGLLSSNIQQHQKQHCGEKPLKRQEGGVPVLRS

SEQ ID NO: 33899 - protein, 82 aa, Equus caballus
VTFEDVAVIFTDEEWRHLVPIQRDLYKEVMLENYKSIVSLDWGTKPEIQGASEEEKSEGRLREKLGRKNPLCPKFEVHALEA

SEQ ID NO: 33900 - protein, 85 aa, Capra hircus
LTSEDVAIEFTQEEWEFLDPGQRALYRDVMLETYRNLLSVDISPTRVIKHLQPTVNSDKPETFQTLMLGSPVSCEIKHVHLWESQ

SEQ ID NO: 33901 - protein, 94 aa, Capra hircus
VTFEDVAVYFSQEEWRILDETQRHLYCYVMLETFALVASLGCWQRAEVKEKSSEQNASVEVPQIITSKTDLSIQKAYPWEMGNLDGEGGLRLAE

SEQ ID NO: 33902 - protein, 94 aa, Tursiops truncatus
VVFEDVAVYFSQEEWGLLDEAQRHLYHAVMTENFALVTSLGCWHGAQDEEAPSEQSVSVGMSEVGTPKPDPSTKKAQPYEMCDPLSKDHLHLPE

SEQ ID NO: 33903 - protein, 89 aa, Equus caballus
ELLAPAQRTLYREVMLETCRNLASLEALKNLIPESGAEDGTSSPAQTSRVTSLSPWTTYSLFQPVVSFHLEQGEAMWMGEKGIPQASCP

SEQ ID NO: 33904 - protein, 98 aa, Chlorocebus sabaeus
VAFEDVAVNFTQEEWALLGPSQKSLYRNVMQETIRNLDSIETKWEDQNIGDQCQNPRRNLSNVFLVRYRSHTCEIKDDSQCGETFGQIPDSIVNKNTP

SEQ ID NO: 33905 - protein, 87 aa, Tursiops truncatus
VAFEDVAVNFTLEEWALLNPSQKKLYRDVMRETFRNLASVGKKWEDHDIEDQYKNQGRKLRSHVVERLCESKEGSQCAGNFSLIPKL

SEQ ID NO: 33906 - protein, 92 aa, Zalophus californianus
VTFEDVFVYFSREEWEFLEEAQRLLYRDVMLENFALVASLGCWRETDNEETPSEQSVSIGLSQLRTPESGAFIQKAHPCEVCDPLLKDILHL

SEQ ID NO: 33907 - protein, 91 aa, Pteropus vampyrus
VTFEDVAVYFSREEWSLLNSTQRCLYRDVMLENFALIISLGCLPRRTTEEAPPQQVKSCGVPLSEKHLLCGESGKDIPAMLGHLQHWATHG

SEQ ID NO: 33908 - protein, 107 aa, Equus caballus
VTFKDVAVTFTQEEWGQLDLHQRTLYQEVMLETCRLLVSLGDTTKLQTREPSTSQLVLPEGDLLQGSLTEGSSRDSRLGQAKDEEGLLEMQKGQWRPATEPHKETHP

SEQ ID NO: 33909 - protein, 84 aa, Pan paniscus
VTFEDVAVLFTEAEWKRLSLEQRNLYKEVMLENLRNLVSLESKPEVHTCPCCPLAFGSPQFLNQDELHNHPIPGFHAGNQLHPG

SEQ ID NO: 33910 - protein, 85 aa, Pan paniscus
VTFEDVAVLFTEAEWKRLSLEQRNLYKEVMLENLRNLVSLAESKPEVHTCPCCPLAFGSPQFLNQDELHNHPIPGFHAGNQLHPG

SEQ ID NO: 33911 - protein, 86 aa, Callorhinus ursinus
VTFKDVAVDFTQEEWQQLEPAQRDLYRDVMLENLQNLSSLDLESRPDRDGPEEAVPAGASPGLALEELGGSRLWRSGAGESEGPPG

SEQ ID NO: 33912 - protein, 113 aa, Zalophus californianus
LTFRDVAIEFSQEEWGCLNLVQRELYRDVMLENYGNLLFLGEDNFLPDFPNHTQGFLPSLEDRLLEDSSLHDWDSDRCSKGSLVVSKPDLVIFLEQKRELWDVKGKETVAFHP

SEQ ID NO: 33913 - protein, 96 aa, Pteropus vampyrus
MLFEDLAVYFSQEESVSLHPALRSLSRDTTPECFEGMALMGRGGKIENNQQLNLKSMGIDELPLEKYSTAVPLVCYPEKSSEDGVLESKISGGTSA

SEQ ID NO: 33914 - protein, 97 aa, Equus caballus
VSFKDVTVEFTQEEWQQMGPIQRTLYRDVMLENYKNLVLVVLGDCKGDNLFKRNKRIKEKPLQQVIFINNKPLTKEEEKFGGRPFNLHIASVSSTKM

SEQ ID NO: 33915 - protein, 83 aa, Pan paniscus
VAFKDVAVNFTQEEWALLDISQKNLYREVMLETFWNLTSIGKKWKDQNIEYEYQNPRRNFRSLIEEKVNEIKQDSHCGETFTP

SEQ ID NO: 33916 - protein, 93 aa, Pteropus vampyrus
VAYEDVAITFTLEEWALLDLSQKKLYRDVMWETFRNLASVGENWKDRDIEDQYKKQGKKLRSHMVERISEEKEGSQGREIFTLNSDLNLNEKT

SEQ ID NO: 33917 - protein, 90 aa, Pteropus vampyrus
VVFEDVAVDFSQEEWALLDAAQRELYREVMLETCQNLASVDDETQFKVNGSVPQHDIYRNKISKEDKTAKFTRNDSWVSVLGKIWEELSI

SEQ ID NO: 33918 - protein, 87 aa, Pteropus vampyrus
VAYEDVAVTFSLEEWALLDPSQKKLYRDVMQETFCNLASVGKKWEEYDTGDQYKSQRRKLRSQLVEKVCESKEVSQCGENFSLISNF

SEQ ID NO: 33919 - protein, 88 aa, Trichechus manatus
VVIEDVAVEFTQEEWALLDLAQRTLYKDVMMETFRNLASVVSQNLNDGEKLCSEYLIVEFMKNDICSSILGEICKWHGIEDQHKNQGR

SEQ ID NO: 33920 - protein, 85 aa, Trichechus manatus
VTFKDVAMDFTEEEWEQLGPAQRALYREVMLEIYGNLVLVGRKLYDCAECGKSFSRSTDLRYHQRIHTGEKPFVCDTCGKGFSYN

SEQ ID NO: 33921 - protein, 109 aa, Physeter macrocephalus
VTFEDVFVYFSQEEWELLEESQRLLYRDVMLENFALVASLGCWCESDNEEAPSEQSVFVGVSEVRTPESCPFIQKVHPCEICDPLLKDILHLAEHQGSCPAQKLYTCDP

SEQ ID NO: 33922 - protein, 85 aa, Aotus trivirgatus
VTFDDVAVEFTPEEWALLDTTQKYLYRDVMLENYKNLASVEWEIQPGSQGPSHQQGFLKNEIFNGLQMERSYRLGKLCDCKNCGE

SEQ ID NO: 33923 - protein, 90 aa, Lipotes vexillifer
VMFSDVSIDFSQEEWDYLDLEQRDLYRDVMLENYSNLVSLDLETNYETKKLSSENDIHEINLSHWKVMERLKNHGLKRFILKNDWESKRK

SEQ ID NO: 33924 - protein, 87 aa, Pan paniscus
VTFDDVAVEFTPEEWALLDTTEKCLYRDVMLENYVNLASVEWEIQPRTKWSSLQLGFLRNPIFNRIQMTRSYSGWKLCENCGEVFSE

SEQ ID NO: 33925 - protein, 85 aa, Trichechus manatus
VTFEDVTVVFTEAEWERLSSEQKNLYKEVMLEIYRNLLSLAEPKPELHPCSSCLLAVSCQRFLSQYVLPIFPGLCVEHNFHPGHS

SEQ ID NO: 33926 - protein, 83 aa, Trichechus manatus
VTFEDVAVLLSQEEWDRLGPVQRDLYRDVMLETYGNLVSLGPETSEMLTLVQGRPDLCKDVKAPNLMSSLGWSMEKSPGLHTC

SEQ ID NO: 33927 - protein, 107 aa, Trichechus manatus
LTFRDVAIEFSQEEWECLDPAQRALYRDVMLENYRNLVSLDISAVCVIKQLPPIEIIDKEALFHMVILKGHESHGINDFDSREVWENMHEFERPWGYDEKNYKVVTT

SEQ ID NO: 33928 - protein, 96 aa, Trichechus manatus
VSFEDVAVGFTWEEWRHLNTAQRTLYKDVMLENYTSLVSKSALSVHQRTHNGEKPHRCIECGKTFHKKSMLTAHQRTHTGEKPYKCEECGKSFGHR

SEQ ID NO: 33929 - protein, 94 aa, Lipotes vexillifer
VTFEDVAVYFSWEEWDLLDDAQRCLYHNVMLENLALITSLGKAHQKQNIGENCFRSNMDRASFMKDCKFFVSGKSLSHGESTYTREKSNRGTEL

SEQ ID NO: 33930 - protein, 83 aa, Pteropus vampyrus
IAFQDLAVQFSEDEWQLLGERQRELYRDVMQENYEALVSLGTAEPLPLSAFLSPTEPRGAMSRSQAGEGQEEPPGDGAPGGAP

SEQ ID NO: 33931 - protein, 89 aa, Trichechus manatus
VLFRDVAIVFSQEEWEQLAPAQRDLYRDVMLETYSNLVSLGKPPLRAYRCYFETKLSIFTIDIPFLWKREKQTHTCFFCSLPGLESRPD

SEQ ID NO: 33932 - protein, 105 aa, Trichechus manatus
VTFKDVAVVFTEEELGLLDSAQRTLYRDVMLENFRNLLSVEDKHQNKNEIETLQRLRYHLYEELSCNHIWEQVVEELTRSQDSTINLQEKSPWLLKQNDFPCQIW

SEQ ID NO: 33933 - protein, 85 aa, Aotus trivirgatus
VTFEDVAIYFSQEEWELLSETQRLLYRDVMLENFAVMASLGCWCGAEDKEAPSAESISEEELSQGRTPKADPSTHKSHPCEICTP

SEQ ID NO: 33934 - protein, 87 aa, Papio anubis
LTFRDVAIEFSLEEWQCLDTAQQGLYRKVMLENYRNLVFLGMRAFGIFLCHLIYIIRLVNCIYLFICSHFAQDLWPEWDIKDSFQES

SEQ ID NO: 33935 - protein, 88 aa, Pteropus vampyrus
VAIEDVAVNFTPEEWALLDPSQKKLYRDVMRETFRNLASVGKKWEDHDIEDSYKKQGRKLRNHGVERLCEQSKEGSQCGENFSLSPNM

SEQ ID NO: 33936 - protein, 93 aa, Pteropus vampyrus
VAFEDVVVTFTLEEWVLLNPSQKKLYREVMRETIRSLASVGKKWEKHDTKDQHKNHGRTLRSHMIDKIYAMKESSQCGENFSVISHLNLNKKT

SEQ ID NO: 33937 - protein, 83 aa, Pteropus vampyrus
MARQDLAVQFSEDEWQLLGERQRELYRDVMQENYEALVSLGTAEPLPLSAFLSPTEPRGAMSRSQAGEGQEEPPGDGAPGGAP

SEQ ID NO: 33938 - protein, 99 aa, Zalophus californianus
MNFEDVAIDFSQEEWGLLDETQRLLYCDVMLENFALVASLDLHQQQRHGNRERPWKRDVDRASCVTSCNFCVSGQPFTCRKVGEDFPATSGHLQLQTSP

SEQ ID NO: 33939 - protein, 85 aa, Lipotes vexillifer
VTFEDVAVYFTQNEWVVLDPAQRALYREVMLENYANVASLGWETRTDKEESTPKEHISKEAEFHGLTLGGLPGNVPQHLGFRSHL

SEQ ID NO: 33940 - protein, 99 aa, Aotus trivirgatus
VSFEDVAVTFTQEEWALLDLSQKSLYRDVMQEIFRNLAFVENKSENQNMQDDFRSPGRNLSSHMVERLFEIKEGSQYGEAFNQDSNFNLNKKISTGVKP

SEQ ID NO: 33941 - protein, 83 aa, Pan paniscus
VAFKDVAVNFTQEEWALLDISQRKLYREVMLETFRNLTSVGKSWKDQNIEYEYQNPRRNFRSLIEKKVNEIKQDSHCGETFTP

SEQ ID NO: 33942 - protein, 84 aa, Lipotes vexillifer
VVFEDVAVYFSQEEWGLLDEAQRHLYHAVMTENFALVTSLGCWHGAQDEEAPSEQSVSVGISEVGTPKPDPSTKKAQPYEMCDP

SEQ ID NO: 33943 - protein, 99 aa, Callorhinus ursinus
MNFEDVAIDFSQEEWGLLDETQRLLYCDVMLENFALVASLDLHQQQRHGNREKPWKRDVDRASCVTSCNFCVSGQPFTCRKVGEDFPATSGHLQLQTSP

SEQ ID NO: 33944 - protein, 87 aa, Tursiops truncatus
VVFEDVAVNFTLEEWALLDFSQKKLYRDVMGETFRNLASVGETWKDHDIEDKCKNQGTKLRSRKVGKICEGKEDSPCRENLSLIPNL

SEQ ID NO: 33945 - protein, 96 aa, Pteropus vampyrus
VTFEDVAVHLTREEWGCLDPVQRDLYREVMLENYGNVVSLGILLRLPTNRIHSVNSCPALSHTQASAFSGETLAVLSAGISKRWPKYRLPIDIAHP

SEQ ID NO: 33946 - protein, 86 aa, Leptonychotes weddellii
LTFEEVAMYFSQEEWELLDPTQKALYNDVMRENYETIISLAVPVHQILAFSEKTNTKDWTVAPEFVLPESQEEWELLDPTQEALYN

SEQ ID NO: 33947 - protein, 89 aa, Pan troglodytes
VVFEEVAVNFTPEEWALLDHAQRSLYRDVMLETCRNLASLDCYIYVRTSGSSSQRDVFGNGISNDEEIVKFTGSDSWSLFGENWRFDNI

SEQ ID NO: 33948 - protein, 87 aa, Pan troglodytes
LTFRDVAIEFSPEEWQCLDTAQQNLYRNVMLENYRNLAFLGICPHFPQDFWPEQSMEDSFQKVLLRKYEKCGHENLQLRKGCKSVDE

SEQ ID NO: 33949 - protein, 104 aa, Cercocebus atys
LTFRDVAIEFSPEEWKCLDPAQQNLYRDVMLENYRNLVSLAMCSHFTQDFLPVQGIEDSFHKCILRRYEKFSSLFSSCHVISHRLSRGRNRDAEKNDLLTTEEP

SEQ ID NO: 33950 - protein, 94 aa, Leptonychotes weddellii
VTFRDVTVDFTQEEWQQLEPAQKDLYRDVMLENYRNLVSLDLETRPEMKESGPKEDSAEDRPSVGVGPPRNGARGLASEGAWTQGDWVEGQLGN

SEQ ID NO: 33951 - protein, 90 aa, Neomonachus schauinslandi
VAFEDVTVNFTLEEWALLNPSQKKLYRDVMQETLRNLASIEEKWEDHDNEDQDENSGTNLSRHTVERLCKRKQGCQCGKTFSQIPYHNQK

SEQ ID NO: 33952 - protein, 92 aa, Physeter macrocephalus
VTFKDVVVTFTPEEWELLDPAQRTLYWKVMLETYRFLVSLEHQRIHSGEKPFVCIECGKAFSRKAHLTEHQRIHSGEKPYVCGECGTAFAHH

SEQ ID NO: 33953 - protein, 100 aa, Monodelphis domestica
VTFRDVAVDFSGDEWGFLSPAQRELYWDVMLENFKNLLFLAWASELGKRESPQNIDGCASPVTGERYRRDVLQKEIFVKGFVQGTELWKQVGNISKATPK

SEQ ID NO: 33954 - protein, 87 aa, Physeter macrocephalus
VTFEDVAVNFTQEEWALLNPLQKELYRDVMQETLRNLASIGKKWDNHNIEDWYKTQGRKLRSHMVKNLCESKEGNQDGEIVSQIPNL

SEQ ID NO: 33955 - protein, 106 aa, Monodelphis domestica
VSFADVAVYFSPEEWGRLRPEQRALYRDVMRETYGHLGALGEERVHEAEGPSSGGEGAVRVTDMESDLNKENRKMLGTEEEPVIKRLEDVGQPPIGTLEHKEQPAK

SEQ ID NO: 33956 - protein, 94 aa, Physeter macrocephalus
VTFEDVAVYFSQEEWKLLDEAQRLLYRDVLLETFALVASLGCWHGAEHKEITSEQNVSVEVPRINTSKTDLSILKSYPWERCCLALDSSLCVAE

SEQ ID NO: 33957 - protein, 94 aa, Papio anubis
VAFEDVAVNFTQEEWALLGPSQKSLYRNVMQETIRNLDCIETKWEDQNIGDQCQNARRNLRSHTCEIKDDSQCGETFGQIPDSIVNKNTPQVNP

SEQ ID NO: 33958 - protein, 82 aa, Papio anubis
VTLEDVAVEFIQEWALLDSARRSLCRYGMLDRCRTLTSRGAGAVPEDAAGALYRSEGDTIDSGGPASSPGAALVSGMHGTEG

SEQ ID NO: 33959 - protein, 86 aa, Lipotes vexillifer
VTFDDVAVTFTQEEWRQLDPAQRTLYQEVMLENCSLLVSLVDKGKPKTTEPTTCEPTLFEGASIQELIQGGPGNSQFRQSKDQDGL

SEQ ID NO: 33960 - protein, 90 aa, Aotus trivirgatus
VTFKDVAVAFTEEELGLLGPAQRKLYRDVMVENFRNLLSVGHQPFKGDVSPIERKEQLCIMKTATQRQRNLGENNQSKLMTVQDRESEEE

SEQ ID NO: 33961 - protein, 90 aa, Papio anubis
LQFRDVAIEFSLEEWHCLDTAQRNLYKNVMLENYSNLVFLVMCSHFAQDLWPEQNMKDSFQKMIPKRYEKRGHGNVQLIKWRESMDECKV

SEQ ID NO: 33962 - protein, 110 aa, Aotus trivirgatus
VTFEDVAVYFTQIEWTSLHPIQRALYREVMLENYANVTSLCKGFPLGTERTEKVPGALPSFLPSFSSREVILALLPISAFPFPKPDLIFQLEQGEAAWGPDPWTLAGEEA

SEQ ID NO: 33963 - protein, 104 aa, Tursiops truncatus
VNFEDVAVTFYWEEWGLLDEAQRYLYHDVMLENLALITSLGCCHEVENEKASFEQCTSVQRVSQIRSPKADLSFRKTHPCEICVQILREFLYLNKYQGTHSKQK

SEQ ID NO: 33964 - protein, 87 aa, Monodelphis domestica
VTFKDVVVEFTREEWCLLSPAQKELFKEVMLENAWNLHSLEGKIRLEIKANPTEVSLPVEEMGLQNFMSGGLDNFAFREFCVAPQNS

SEQ ID NO: 33965 - protein, 90 aa, Monodelphis domestica
VTFRDVAVDFSPDEWGRLGPAQRELYREVMLENYRSLAWLGEARRPLETKESTSHLRLSMQESSEERFQRENPCDSNWGEAWECGASLER

SEQ ID NO: 33966 - protein, 87 aa, Monodelphis domestica
LTFKDVAVDFTREEWHLLSPSQKKLYKEVMLENARNLLSVEGETRPEMKVNPTEMSPSVEEMDVQRFMSDGPDNFAFKKFFVAPQHS

SEQ ID NO: 33967 - protein, 85 aa, Monodelphis domestica
MFQDVAVDFTREEWRLLSPPQKELYKEVMLENVRNLLSVGEIRPEMKVNPSEVSLPVEEMDLQRFMSDGLDNFASRKFCVAPQNS

SEQ ID NO: 33968 - protein, 95 aa, Monodelphis domestica
VSFKDVAVDFTREEWRLLSPPQKELYKEVMLENARNLLSVGEMRSEMTNPTEVSLPVEELNLQRFMSYGPNNIAFREFCVSPKNLSHIEHQRMHT

SEQ ID NO: 33969 - protein, 87 aa, Monodelphis domestica
VTFKEVAVDFTWEEWRLLSPPQKELYKEVMLENARNLLSVEGEIRSTIKASPTEVSLPVEKMNLQRFMRHGSDNFASREFRFASQNS

SEQ ID NO: 33970 - protein, 86 aa, Papio anubis
VAFEDVAVNFTLEEWALLDPSQKNLYRDVMRETFRNLASIGKQWEDQNIEDPFKIPRRNISHIPERLCEGKEGSQGEEGFSLMPDG

SEQ ID NO: 33971 - protein, 87 aa, Pan paniscus
VAFEDVAVNFTQEEWALLGPSQKSLYRDVMWETIRNLDCIEMKWEDTNIEDQHKNPRRSLRCHIIERFSESRQPDSTVNEETPGVDP

SEQ ID NO: 33972 - protein, 91 aa, Zalophus californianus
VVFEDVAIYFSQEEWGLLDEAQRFLYHAVMLENFALLSSLGCWHGAQDEEAPSEQDVSVGGSQVRTPKPGPSIQKSQPWEMCGPVWKDILR

SEQ ID NO: 33973 - protein, 91 aa, Equus caballus
VTFEDVFVSFSREEWELLEKAQRLLYRDVMLENFAHVASLGCWREADSEEAPSEQSNSIGVLQIRTAMSGSFIQEAYPWEMRDLLLKDILH

SEQ ID NO: 33974 - protein, 95 aa, Chrysochloris asiatica
IVFKDVAVEFSLEEWALLGPTQRQLYRDVMLETFRNLASVGKSCDSFSIEDHRRNRGLPLRHERTHNKEKFNECKECGKAFKWPSSLTRHMRTHS

SEQ ID NO: 33975 - protein, 91 aa, Tursiops truncatus
VTFEDVAVYFSREEWGILNLTQRSLYRDVMLENFALIGSLGFLCRLQDEEAPPEQVKSHRVRLSENPFLCRVSGKDIPAALGFLQPQATHR

SEQ ID NO: 33976 - protein, 89 aa, Capra hircus
VVFEDVAVNFTLEEWALLDSAQKELYRDVMLETFRNLASVDDETQCKASGSISQQDIYGNKISKEHKISKFTGNDSWPFVLGKIWEELS

SEQ ID NO: 33977 - protein, 99 aa, Trichechus manatus
VVFEEVAVNFTREEWALLNAAQRKLYKDVMLETFQNLASVDSCTQVKTSGSSPQQGIFGNEIFNGEKIISFIRSDSWSNLEEKGNVHNIEDYPQIQKKR

SEQ ID NO: 33978 - protein, 83 aa, Lipotes vexillifer
VIFEDVAVSFSQEEWGLLNDAQRLLYCDVMLENLSLIASLGHYECSECGKAFSKKYKFTEHLRVHTGEKPYECSDCGKLFRLT

SEQ ID NO: 33979 - protein, 87 aa, Pteropus vampyrus
VTFEDVAVTFTPEEWALLDPSQKKLYRDVMRETIRNLASVGKEWKGPDIDDQYKNQGRILRTQMVERLCESKEVSQRGEHFSLITDF

SEQ ID NO: 33980 - protein, 86 aa, Pteropus vampyrus
VTFGDVAVDFSQEEWARLNPAQRDLYRHVMLENYRNLVSLDWEYAFKNKEFSSKQVIYEKSSKVVILGRSHLSYSLDCPLLREDCK

SEQ ID NO: 33981 - protein, 92 aa, Trichechus manatus
VTFKDVAVVFTEEELGLLNPAQKKLYQDVMVENFRNLMSVGGKNPRQVETVPQAGAQEDLSSLHIWQQIASDLTRWQDSMINKSQFYKQGDS

SEQ ID NO: 33982 - protein, 90 aa, Zalophus californianus
VSFKDVAVTFTQEEWGQLDLAQRRLYRSVTLETCSHLVSLDWKNTFEKKESASKEDFAVEEPFHHIAMKHCIREEGPWLVSLGERQDWRN

SEQ ID NO: 33983 - protein, 87 aa, Tursiops truncatus
VTFEDVAVNFTQEEWALLNPSQKKLYRDVMQETLRNLASIGKKWDNHNIEDWYKTQGRRLRSHMVEKLCESKEGNQDRETVSQIPNL

SEQ ID NO: 33984 - protein, 88 aa, Zalophus californianus
VAFEDVTVNFTLEEWALLNPSQKKLYRDVMQETLRNLASVGEKWEDCNSKSLYEHHQTDLSRPVVESPCKNKEGSPFGESFSQNPNHK

SEQ ID NO: 33985 - protein, 106 aa, Chrysochloris asiatica
VTLEDVTVVFTEAEWKRLSFEQKNLYKEVMIEIYQNLLSLASSRPGSQKQPDEQDSDQRFWKENTDGQEREDFPRVEAERPWAFCNLYQRASSWLREGHIGVAVKP

SEQ ID NO: 33986 - protein, 88 aa, Suricata suricatta
VTFQDVAVDFTEKEWPLLDSSQRKLYKDVMLENYSNLASVGKAGLVSLFVCGCFCWKYLLWPGDYIFGKETPRGVTVERTRLGEKPAE

SEQ ID NO: 33987 - protein, 92 aa, Pteropus vampyrus
HTVEPLQFLTFFQEQQKMNIAQFDYHVPRCGSLTPSLCFLKVIEFLGSVSFEDVTVEFTPGYCITKPQVIFKLEQGEEPWSLEEEFPNQRCP

SEQ ID NO: 33988 - protein, 97 aa, Pteropus vampyrus
VTFEDVAVDFTQEEWALLDTSQRELFRDVMLENISHLVSIVDLVSMITHCYQHRAQNPHVVFLQTVSQLYKSDVISLSEEREQLSREGIGFLQGQSP

SEQ ID NO: 33989 - protein, 97 aa, Trichechus manatus
EKIEDMAVSLIREEWLLDPTQRDLCRDNRTENYRNMFSLGGETRNENRELASKQVISAGIQPHGETAAKCNGDVIGGLEHGEAQDLLGRLERQRGNP

SEQ ID NO: 33990 - protein, 93 aa, Zalophus californianus
ISFEDVTVNFTQEEWGQLDPDQRTLYRDVMLENYSIFISLECHFKPQEMRWGPEANGSGEAPMREKRKKSVSVLRKRLGAGLCRRRLFPFVRG

SEQ ID NO: 33991 - protein, 94 aa, Chrysochloris asiatica
VTFEDVAVYFSWKEWGLLDEAQRHLYCDVMLENFALVASLGCWHGAEAASPEQGVPIEGLFPCGTLGEGSCTQRAKIGDMCGRVLKDIWQHTEH

SEQ ID NO: 33992 - protein, 90 aa, Lipotes vexillifer
VSFKDVAVTFTWEEWGQLDLAQRMLYCEVTLETCSHLVSLDWKTTLEKKESASEEGIAVEQPSHHMEMKHCVQEEGPWLVSLGEVQHWRE

SEQ ID NO: 33993 - protein, 84 aa, Suricata suricatta
MSFKGVTVDFTRDEWLQLTGTQRTLCRGVMLENYSHPAAVGGGARCVSHSKPFLIRQPSLHLRGLKQKRNPLIVQNTGAIPVTS

SEQ ID NO: 33994 - protein, 87 aa, Suricata suricatta
VAFEDVAVNFTLEEWALLDPSQKKLYRDVMRETLRNLASIGEKWRDPNIEDQYKNQGRNLRSHLVERLCQSPEGGQCGGTRSPVPHL

SEQ ID NO: 33995 - protein, 155 aa, Sus scrofa
VSFKDVAVDFTQEEWRQLDAEQKTTYRDVMLENYSHLVSVGEGSLLSDLLMYPGFISNLSTLNLMRQMCYLGYQAGHLVFNSTWVLILVQHLCCVACKAALPSHDRSGSPAARFRFSLLFLLTGCHIIKPEVITKLEQGEDPWIVEGEFLLQTYP

SEQ ID NO: 33996 - protein, 95 aa, Callorhinus ursinus
LTFRDVAIEFSPEEWECLDPAQRALYRDVMVENYRNLVSLGEDSFPPEETYGPLYLSDISVRSMIKKLSPKEDISKEELFQTLMLERHKRNDIKD

SEQ ID NO: 33997 - protein, 84 aa, Trichechus manatus
VTFEDVTVTFTWEEWKFLNSSQKKLYREVMWENYTNVMSVGKWNESCKPQEERFRYLEHDSLPCWKGWRNASTQVYENQNYVET

SEQ ID NO: 33998 - protein, 91 aa, Trichechus manatus
VTFRDVAVNFTKEEWALLDPAQRKLFRDVMLENYGNLVSIDYDIQLKTKGATPQQDIFSKETFHKENRVCLTSNNSQSSTLREEPHKEKQR

SEQ ID NO: 33999 - protein, 85 aa, Zalophus californianus
VTFEDVAVYFTQNEWVILDPSQRALYREVMLENYANVASLGGETRAEKEESTPKEHISKETESHGLTLGGLPGNVPQRLDFGSSP

SEQ ID NO: 34000 - protein, 86 aa, Chrysochloris asiatica
VTFKDVAVVFSEEELRLLDSAQRTLYRDVMLETFRNLLSVGGKNLNEMETLQDVGLRCLSPEQFFCPQTWQQPHQRVHTGENPDKY

SEQ ID NO: 34001 - protein, 87 aa, Pteropus vampyrus
VAFEDVAVNFTLEEWALLEPLQKKLYRDVMRETLRNLASVGKKWEDHNIEDQYKNQRRNIRSHTVKRLCESKEGNQCGENFSRIPNL

SEQ ID NO: 34002 - protein, 96 aa, Trichechus manatus
VTFEDVAVYLTREEWGCLDPVQRDLYREVMLENYGNVVSLGILLRLPTTRIHNVNSCPALSHTQASAFSGESLAVLSAGISKRWLKYRLPINIAHP

SEQ ID NO: 34003 - protein, 99 aa, Trichechus manatus
VVFEDLAVNFTQEEWALLHPSQRDLYKDVMVETFRNLASVDCCTQVKTTGSSPQQDILGNEITTEEKISSLRNDSWYNLVEKGKLNNMENQHQIQERHS

SEQ ID NO: 34004 - protein, 83 aa, Zalophus californianus
VTFEDVAVNFSLEEWALLDSSQKKLYRDVMRETFRNLAAIEKKWKDHDTEYRYNTQGRRLRRHMAEKRESKEGRQCGETITQT

SEQ ID NO: 34005 - protein, 109 aa, Zalophus californianus
VTFEDVAVSFSWEEWDLLDEAQRHLYQDVMLENLALITSLGCWHGAEDEEAPSEQSVSVGVSHVRAPKTGLFPQKANPYEVCGPVLKDNFYSAEHQETQFREKVYTDET

SEQ ID NO: 34006 - protein, 89 aa, Pteropus vampyrus
MFRDVAIDFSQEEWECLDFAQRDLYRDVMLENYSNLVSLDLPLRCANKDLSPKKDTYKTELSQWEISDRLENCDLKEFNSRDFLEVRGT

SEQ ID NO: 34007 - protein, 93 aa, Zalophus californianus
VVFEDVVVDFTPEEWALLDRGQRRLYRDVMLETCRNLASLGENWKCPGIEHQHKNKGTCMRCHAVEMPSENNGSNQCGETNQISNFIVHKRLS

SEQ ID NO: 34008 - protein, 83 aa, Pan paniscus
REDPGTSESQEMEEWALLDISQRKLYREVMLETFRNLTSVGKSWKDQNIEYEYQNPRRNFRSLIEKKVNEIKQDSHCGETFTP

SEQ ID NO: 34009 - protein, 83 aa, Pan paniscus
LTLEDVAVDFTWEEWQFLSPAQKDLYQDVMLENYSNLVAVGEDSCPVSLRGCPVSGLPFSAAYLQKIDDPLQHHLQHRSIQKS

SEQ ID NO: 34010 - protein, 84 aa, Callorhinus ursinus
AVGCQCASGCAEHPGRCGPGATPRMLDSVVPAPYRSRSPAGGWSDPLFFSGAGIPFSKPKLITQLEQGKETWREERTCPPAARP

SEQ ID NO: 34011 - protein, 90 aa, Trichechus manatus
VIFEDVAVDFTLEEWALLDPAQRKLYRDVMLETFRNLASLDDETQFKDIGSVSLQNIYGKQIFKGHKILKFTRRDSLASILGKIWEGLSI

SEQ ID NO: 34012 - protein, 91 aa, Pteropus vampyrus
VALDDVNVKFTLEEWAFLDRTQKKLYRDVMQETFRNLASIACILEEKWEDHDSDDQHKNHGTNLSSHTIERLGKSKEGSQCRETSSQIPNH

SEQ ID NO: 34013 - protein, 82 aa, Pteropus vampyrus
LTLSDVFIEFSQEEWECLSPAEQALYREVMLESYRNLLFLGLHASFFLYAGISVSDLYIVSILEQGKAPWTQESELKLAQKP

SEQ ID NO: 34014 - protein, 83 aa, Trichechus manatus
VVIEDVAVEFTQEEWALLDLAQRKLYKDVMIETFRNLASVVIGTVSQTLNDGKNLSSKYLIVEFMKNDTWSSMLGDICKLHDI

SEQ ID NO: 34015 - protein, 84 aa, Trichechus manatus
VTFEDVAMYFSQEEWGLLDEAQRHLYHDVMLDNFGLISSLGWCGAENAEAPSEQSVSVGIVSQAGTPKSGPSTQNVHLCETCVP

SEQ ID NO: 34016 - protein, 87 aa, Pan paniscus
VTFEDVAVNFSLEEWSLLNEAQGCLYHDVMLETLTLISSLGGVPPHRLFPTGACGPQVPSSRIRPSPGHCPCPSLYLSLSPPHPTGV

SEQ ID NO: 34017 - protein, 90 aa, Trichechus manatus
VNFEDVAVYFSQEEWGLLDEAQKLLFCDVMLENFAIIASLGSWHGTEDEETSSKQNVSVEIQVRTSNAGSSTQNTHPWEMGVPFLEDILH

SEQ ID NO: 34018 - protein, 94 aa, Tursiops truncatus
VTFEDVAVYFSQEEWRLLDEAQRLLYRDVILETFALVASLGYWHRAEDEETPSEQKVSVEVPQINTSKTDLSTLKSYPWQRFCLYLEGGLHLAE

SEQ ID NO: 34019 - protein, 103 aa, Tursiops truncatus
VTFEDVTVNFTWEEWKFLDSSQKKLYREVMWENYTNVMSVGNCKESYRLEEERFRYFEHEHLSCWQGWRNASTQIYDNQIYVEMVQGIDSKDLKQQHLSHSQE

SEQ ID NO: 34020 - protein, 90 aa, Tursiops truncatus
LSFEDVTLDFTQEEWQQLDPAQRTLYRDVMLENYSHLVSVGAVKPMSLAQFPCHFPFTGYCIPKPELIFRLEQGEQPWVLEEESPSQSSP

SEQ ID NO: 34021 - protein, 87 aa, Lipotes vexillifer
VTFEDVAVYFSQEEWKLLDEAQRFLYHDVMLETFALVASLGCCYIAENKQPPSEQNVSVEVCTFTSTLERNSLEEMWRVHTGERPYE

SEQ ID NO: 34022 - protein, 89 aa, Pteropus vampyrus
VMFEEVSVCFTSEEWACLGPIQRALYWDVMLENYGNVTSLEWETMTENEEVTSKSSISQRADSQKGTSKRLQGGIPQVLDFEKERKWQV

SEQ ID NO: 34023 - protein, 82 aa, Trichechus manatus
VTFEDVTVVFTEAEWKRLSSEQKHLYKEVMLEIYRNLLSLAEPKPELHACSSCLLAVSCQRFLSQHVLPIFPGFCAEHHVHP

SEQ ID NO: 34024 - protein, 92 aa, Aotus trivirgatus
MVFEDVAIHFSQEEWGILNDAQRHLHSNVMLENFALLSSVGCWHGAKDKEAPSKQCVSVRVLQVTTPKPALSTLEAQPCKTCSSLLKDILHL

SEQ ID NO: 34025 - protein, 94 aa, Tursiops truncatus
VTFEDVAVYFSQEEWKLLDEAQRLLYHDVLLETFVLVASLGCWHGAEHKEITSEQNVSIEVPQINTSKTDLSIRKSYPWERCCLALDSSLCVAE

SEQ ID NO: 34026 - protein, 88 aa, Tursiops truncatus
VIFEDVTLGFTPDEWGMLDLEQKSLYREVLLENYRNLVSVECPEAQLDPQFHPFPAGNPLMKIEVVEILTLNEEVALPRNAQIRALYA

SEQ ID NO: 34027 - protein, 91 aa, Trichechus manatus
LTFEDVAVYFSEQEWQNLKAWQKDLYKHVMRANYETLASLVSGCWPAVKAGEREGHFLRQPSHSRYSFGALLGKGEEESFPPDAVHTLRRS

SEQ ID NO: 34028 - protein, 89 aa, Trichechus manatus
VTFEDVAVYFTQSQWASLGPLQRALYREVMLENYANVASLGKGGVLDPERKDSSGSTAFPFPKPVLISQLEREEAPLGPDPWETEVLRD

SEQ ID NO: 34029 - protein, 85 aa, Capra hircus
VTFEDVFVYFSREEWELLEEAQKLLYRDVMLENFAHVAALGCWCEADNEEAPSEQSVCVEGVSEVRTPGSCPLIQKVHPCERSDP

SEQ ID NO: 34030 - protein, 100 aa, Lipotes vexillifer
VTFEDVAVYFSWEEWCLLDEVQIHLYLDVMLENFALVCMLDVHPKHQKQHIREKPFSCDMGRPAFFKSCTIHATGNLSTYMETGNNYVAKIGLQKQVTNT

SEQ ID NO: 34031 - protein, 98 aa, Zalophus californianus
LTFKDVVVTFTQEEWELLDLPQRTLYWKVMRETCRLLVSLDDKAKTKTTEPSASQPGLFEGCSPHRLLTEDDSSVSTLGEAGEQERPSEKQGGYLRTG

SEQ ID NO: 34032 - protein, 85 aa, Equus caballus
MTFDDVAVDFTQEEWALLDLTQRNLYRDVMLENYKNLTTVGKADIIAVASYGTGYQLLKPNLISWLEHKEDLRTVERGVCQKWEM

SEQ ID NO: 34033 - protein, 84 aa, Equus caballus
MVYRNFLLPGSEKYNTRLVFLIAHLCLIRTLPFSTRRAAGGNGCCVSTCQMPGLPVPRPDVIFQLKTGDEPWRVDCHGAEEREC

SEQ ID NO: 34034 - protein, 89 aa, Equus caballus
VTFEDVAVYFSQEEWRLLDEAQRRLYRDVMLEVFALVASLGKALTLMSVSWAGLCLSPFCCVTEDLGTNPEQKLCGACGKFHRHRNWLG

SEQ ID NO: 34035 - protein, 88 aa, Pteropus vampyrus
LTLEDVAVDFTWEEWQLLDPDQKDLYRDVMSENYSNLVSVDHSPIQRACLFCHFPRTGYQVSKPDALSRLEQGEPWAVEDEVHSRICP

SEQ ID NO: 34036 - protein, 88 aa, Zalophus californianus
VTFEDVVVDFTQEEWGQLEPAQRTLYRDVMLETFRLLVSVDLETQPKTRLSAPKQDITEKIASSVLVERFLWDSLWYPEGDDAEGHWG

SEQ ID NO: 34037 - protein, 100 aa, Pteropus vampyrus
VTFKDVALNFTKEEWALLGPEQRNLYREVMLENCRHLISIDILKDSTLTCLWSKAWSRDPLRARDWRPSTETLLRLPEAQGWLEQGPWLTHNRPVTLVSN

SEQ ID NO: 34038 - protein, 90 aa, Pteropus vampyrus
VTFEDVAVDFTQEEWALLDTSQRELFRDVMLENISHLVSIDRGDDLKKQEMISIQHSYKKDTSLLDAVQRFHTQEYPFELNDLGENITEI

SEQ ID NO: 34039 - protein, 87 aa, Pteropus vampyrus
VAFEDVAVNFSLEEWALLDSLQKELYRDVMRETFRNLASVGKKWEDHDIEDQYKNRVRKLRSHMVKRICEGKEGSQCGGNFSLISNL

SEQ ID NO: 34040 - protein, 91 aa, Trichechus manatus
VVFEDVAVDFTQEEFALLDFAQRKLYRDVMMETFKNLASVGDICEFHGIEEQHNNQGSHVRSHTDEHLFESTEKEKERKECNQCGKTFSKI

SEQ ID NO: 34041 - protein, 89 aa, Tursiops truncatus
VTFKDVIVDFTQEEWKQLDPVQRDLFRDVTLENYTHLVSIDWETRPENSISVSELDISEEEPSPEAIVEKHKRDDPWGSNVLETGESEG

SEQ ID NO: 34042 - protein, 83 aa, Pteropus vampyrus
VTFEDVTVYFSSEEWDLLDEAQRRLYQDVMLENLALITSLVCQIINSTTCNFYSDFQPGVNLTSELCVLPVCSVLHLQCFPCL

SEQ ID NO: 34043 - protein, 87 aa, Aotus trivirgatus
LEFRDVAIEFSLEEWHCLDTAQRNLYWDVMLENYRNLVFLVICSHFAQDLWPEQGIKDSFQKMILRRYDKCEHDNLQLNNGCECVDD

SEQ ID NO: 34044 - protein, 84 aa, Pan paniscus
VTFRDVTVIFTEAEWKRLSPEQRNLYKEVMLENYRNLLSLDGVSLLLPRLECTRAISAHHNLCLPGSSNSPATASRVAGITAEP

SEQ ID NO: 34045 - protein, 83 aa, Pan paniscus
VAFDDVAVNFTQEEWALLDISQRKLYREVMLETFRNLTSIGKKWKDQNIEYEYQNPRRNFRSLIEGNVNEIKEDSHCGETFTQ

SEQ ID NO: 34046 - protein, 87 aa, Papio anubis
LQFRDVAIEFSLEEWHCLDTAQRNLYRNVMLENYRNLVFLVLCSHFTQDLWPEQNIKDYFHKGILRRYEKCGHDNLQFKKGCEGVDE

SEQ ID NO: 34047 - protein, 85 aa, Tursiops truncatus
ATLEDVAMDFTLEDWEQLGLDQGDLFWDTALDNYQNLFLLNTAEAKTSPLPQDFLDEGIFQEITEMFSKDGLWNSHLEEAYIDQS

SEQ ID NO: 34048 - protein, 88 aa, Tursiops truncatus
LAIEDVVVNFTLEEWALLDPSQKKLYRDVMQEIFWNLASVGKTWEYHDIGDQYKNQGGNLRSPMVERLFERKDNSSCGEHFSLIPSLS

SEQ ID NO: 34049 - protein, 87 aa, Aotus trivirgatus
VAFEDIDVNFTQEEWALLDPSQKNLYRDVMWETMRNLASIGKKWKDQNIKDHYKHQGINLRRHMVERLYQSKDGSQHGGIFSQFANH

SEQ ID NO: 34050 - protein, 85 aa, Lipotes vexillifer
VAFEDMAVYFTEKEWASLIAAARALYQSVMLENSTVPLAQFPRGYSSPRLTRAASSASKLALISHLEQGQESRFTQPQGPLSRRN

SEQ ID NO: 34051 - protein, 87 aa, Physeter macrocephalus
VAIEDVAVNFTLEEWALLNPSQKKLYRDVMRETFRNLASIGKKWEDHDIEDQYKNQGRKLRSHVVERLCESKEGSQCAGNFSLIPKF

SEQ ID NO: 34052 - protein, 104 aa, Aotus trivirgatus
VTFEDVSVDFSQEEWELLDPAQKNLYREVMLENYRNLVSLEALKNPRAHAGIEEGPFSTAHTPQATRLSSWMGHLLLQPVASAHVEQSEALWMEEKGTPQASCS

SEQ ID NO: 34053 - protein, 87 aa, Lipotes vexillifer
LAFEDVAVNFTLEEWALLGPSQKKLYRDVMRETLRNLASIGEKWEDHNTEDQYKSQGRNLRSHTLRRCCESEEGSQCGENISHIPNL

SEQ ID NO: 34054 - protein, 82 aa, Callorhinus ursinus
VMFRDVAIDFSQEEWEYLDSAQRDLYRDVMLENYSNLVSLVDLPSRSANKDLSPKKNTYETELSQWEMSARLENCDLEESSS

SEQ ID NO: 34055 - protein, 91 aa, Callorhinus ursinus
VSFADVAVYFSPEEWGCLRPAQRALYRDVMRETYGHLGALGDTPNKKEEAPQEGSGAKGPRKPPGKEPSKELVKQSPNWTVGKVSARAQRP

SEQ ID NO: 34056 - protein, 98 aa, Pteropus vampyrus
VVFTDVAVNFTREEWALLDHSQRRLYQDVMLETCRNLASVDCFTHKTSGSCSQRKILVKEISSEEKIVRFTGKDLWSVFEEPWTLHNVADQQQMQERP

SEQ ID NO: 34057 - protein, 91 aa, Physeter macrocephalus
VTFEDVAVYFSREEWGLLNLTQRSLYRDVMLENFALIGSLGFLCRLRDEEAPPEQVKSHRVRLSENPFLCGVSGKDIPAALGFLQSQATHR

SEQ ID NO: 34058 - protein, 92 aa, Aotus trivirgatus
VAFEDVAVNFTLEEWALLDPSQKNLYRDVMRETFRNLASIGKQWEDQNIEDPFKLPGRNTSHTSERICEHKEGSQGEETFSQIPDGILNKKT

SEQ ID NO: 34059 - protein, 86 aa, Aotus trivirgatus
VVFEDVAVNFTQEEWALLGPSQKKLYRDVMQETFVNLASIGENWEDKNIEDHRNQGRKLRSHMVERLCERKEGNQLGEAISQTPNP

SEQ ID NO: 34060 - protein, 93 aa, Aotus trivirgatus
ISLEDVAVNFTLEEWALLDPGQRNIYRDVMRATFKNLACIGEKWKDQDIEDDHKNQGRNLRKSTSQIPDLNINLETPTGLKPCDCSVCGEVFM

SEQ ID NO: 34061 - protein, 85 aa, Lipotes vexillifer
VTFKDVAVDFTKEEWGQLDPAQRALYKEVMLEIYGNLVLVGKKPYDCAECGKSFSQSTDLHIHQRVHTRKKPFVCDTCGKGFSYN

SEQ ID NO: 34062 - protein, 107 aa, Pteropus vampyrus
LTFRDVAIEFSLEEWEFLDCAQRALYRDMMSESYRNLLSMDVSTRCVIKELSPKEDISNGELFQILILERDISHDFNDFDFREVQQNMHKVEDQWVCEEKNYEGDPT

SEQ ID NO: 34063 - protein, 84 aa, Aotus trivirgatus
LTFTDVAIEFSQEEWKCLDPAQRALYKDVMLENYRNLVSLGSGCALGGNAENKPIETQLGVSFHLHLSELALFPGERVINGCNQ

SEQ ID NO: 34064 - protein, 86 aa, Callorhinus ursinus
VTFEDVAVYFSQEEWALLDEAQRHLYHTVMLENLALPCVRRRELEPRGAEEGTCALHGAGLRFGASTAAGSRLRGLLPVSAIITRP

SEQ ID NO: 34065 - protein, 92 aa, Tursiops truncatus
LTFKDVAIEFSQEEWECLDPAQRALYRDVMLETYRNLVSLVCGKTFFQGSHLSRHQIIHTREKLHKCDICEKVFSLNSNLIVHRRIHTGEKP

SEQ ID NO: 34066 - protein, 84 aa, Pteropus vampyrus
VTFKDVAVLFTQDEWAQLNPAQRALCRDVMLENYSNLVSLGSDMPVLGVPGTGFFWSLRTLRTQARYIRRAWERGRRMGAGHRW

SEQ ID NO: 34067 - protein, 92 aa, Pteropus vampyrus
VTFEDVALYLSREEWGRLDHTQQSFYHDVLQKRNRLALGFPFSRTFWASQVQGKGKASSSCQQTGDEDKRGAVEVGKEEPMPCPASHGDVKS

SEQ ID NO: 34068 - protein, 87 aa, Pteropus vampyrus
VAFEDVAVTFTLEEWALLDPSQKKLYRDVMQETFRNLASVGKKWDNHDIGGQDKNWRRKRRSLILERHCEGEKSSQCGENFSLISNL

SEQ ID NO: 34069 - protein, 87 aa, Tursiops truncatus
VTFEDVSVKFTTEEWALLDLSQKKLYRDVMQETFKNLTSIGEKWEDPDTEDQYEHHGTNLSSHMVERLCKNNEGSQYGETFSQISNH

SEQ ID NO: 34070 - protein, 87 aa, Tursiops truncatus
VTFKDVAVVFTEEELALLDSTQINLYQDVMLENFRNLVSVGEDSDLPVRDRIKNNISNLQEKGLSYLSPEALYFWQIWKRRISELSV

SEQ ID NO: 34071 - protein, 87 aa, Pan paniscus
VAFEDVAVNFTQEEWALLDSSQKNLYREVMQETCRNLASVGSQWKDQNIEDHFKKPGKDIRNHIVQRLCESKEGGQYGEVVSQIPNL

SEQ ID NO: 34072 - protein, 97 aa, Papio anubis
VTFEDVAVDFTQEEWTLLDQTQRNLYRDVMLENYKNLVAVDWESHVNTKWSAPQQNCLQGKTSSVVEMVRFRRYNLLPSTLEEDWKFRKMEKPHSNL

SEQ ID NO: 34073 - protein, 87 aa, Lipotes vexillifer
VAIEDVAVNFTLEEWALLNPSQKKLYRDVMRETFRNLASVGKKWEDHDIEDQYKNQGRKLRSHVVERLCESKEGSQCAGNFSLIPKL

SEQ ID NO: 34074 - protein, 84 aa, Callorhinus ursinus
VTFEDVAIDFTEEEWALLDISQRKLFRDMMLENISRLVFLGTSICSLLKVLLRGLTFKSSFYSSLVKPTLDLVIAKVNLHRTQV

SEQ ID NO: 34075 - protein, 92 aa, Tursiops truncatus
VTFEDVLVYFSREEWELLEEVQRLLYRDVMLENFALVASLGCWCESDNEEAPSEQSILVGVSEVRTPESCPFIQKAHPCEICDPLLKDILHL

SEQ ID NO: 34076 - protein, 89 aa, Tursiops truncatus
VMFEEVSVCFTSEEWACLGPIQRALYWDVMLENYGNVTSLEWETMTENEEVTSKSSLSQRADSQKGASKRLQGSVPQVLDFEEEYEWQV

SEQ ID NO: 34077 - protein, 104 aa, Canis lupus
VTFEDVAVDFSQEEWEMLDPAQRRLYREVMLETCRNLATLDALKNQRANMGIEDGTLSPTPASQATSPSSWAGCSLLLPGAAFHLEQGEAMWTGGEGAPQTSCS

SEQ ID NO: 34078 - protein, 87 aa, Homo sapiens
VTFEDVAVYFSQEEWRLLDDAQRLLYRNVMLENFTLLASLGKVLTPHPSILSWARLFLLFLGRGLFFPKLNCGHSFLLQYPEVAIVI

SEQ ID NO: 34079 - protein, 110 aa, Homo sapiens
VTFRDVAIYFSREEWACLEPSQRALYRDVMLDNFSSVAALAPDQTSSLAWNSGRSRGLKTGRDLSSRQCRGDPGQGQGSLQTPRDLVIIQLGLTRKPTCGEKEPGKEAAL

SEQ ID NO: 34080 - protein, 100 aa, Homo sapiens
VTFEDVAVYFSQEEWRLLDDAQRLLYRNVMLENFTLLASLGKVLTPHPSILSWARLFLLFLGRGLFFPKLNCGHSFLLQYPEVAIVIGLGCVYYHLLSPS

SEQ ID NO: 34081 - protein, 86 aa, Homo sapiens
LTFMDVAIEFSLEEWQCLDTAQRNVYRHVMLENYRNLVFLAVAFTFDLSGLNILSFQSILPFVSALYVMGNRNQCLQKHLEARNKD

SEQ ID NO: 34082 - protein, 97 aa, Homo sapiens
LKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGS

SEQ ID NO: 34083 - protein, 92 aa, Homo sapiens
VVFEDVAIYFSQEEWGHLDEAQRLLYRDVMLENLALLSSLGSWHGAEDEEAPSQQGFSVGVSEVTASKPCLSSQKVHPSETCGPPLKDILCL

SEQ ID NO: 34084 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTAKHSA

SEQ ID NO: 34085 - protein, 97 aa, Homo sapiens
EKIEDMAVSLIREEWLLDPSQKDLCRDNRPENFRNMFSLGGETRSENRELASKQVISTGIQPHGETAAKCNGDVIRGLEHEEARDLLGRLERQRGNP

SEQ ID NO: 34086 - protein, 84 aa, Homo sapiens
LAFRDVALEFSPEEWECLDPAQRSLYRDVMLENYRNLISLGEDSFNMQFLFHSLAMSKPELIICLEARKEPWNVNTEKTARHSA

SEQ ID NO: 34087 - protein, 87 aa, Pteropus alecto
VTFEDVSVNFSLEEWSLLDPSQKKLYRDVMQETFRNLASVGKKWEDHDIDDQYKNQERICRSHRVERLCEGKEGSQCGENFSLILKK

SEQ ID NO: 34088 - protein, 85 aa, Ursus maritimus
VTFEDVAVYFSQEEWGLLDEAQRHLYRTVMLENLALMASLGVLISVHGKHMLIASGSVLPPARRPIPAGCCMFIIHHSKIQFSSL

SEQ ID NO: 34089 - protein, 94 aa, Balaenoptera acutorostrata
VVFEDVAVYFSQEEWGLLDEAQRHLYHAVMTENFALVTSLGCQHGAQDEEAPSEQDVSVGVSPVRTPKPDPSSRKAQPCEIYGPLLKDFLQLLE

SEQ ID NO: 34090 - protein, 87 aa, Saimiri boliviensis
ISLEDVAVNFTLEEWALLDPGQRNIYRDVMRATFKNLACIGEKWKDQDIEDDHKNQGRNLRGPMVETLCENKEDRQCGKSTSQIPDL

SEQ ID NO: 34091 - protein, 85 aa, Lynx pardinus
LTFRDVAIEFSQEEWECLDPAQRVLYRDVMLENYRNLVSLGEDNFPPEVGSSAGFTIKELSPIQDINKGEFYHLVILERNESHDI

SEQ ID NO: 34092 - protein, 83 aa, Saimiri boliviensis
VAFEDVAVNFTQEEWALLDISQKNLYREVMLETFRNLISLGRKWKDKSIEDECQNPRRNLRSLIEEKVNEIKEDSHCEETFTE

SEQ ID NO: 34093 - protein, 84 aa, Saimiri boliviensis
VALEDVAVNFTREEWALLGPCQKNLYKDVMQQTIRNLDCVGMKWKDQNIEHQYRYPRKNLRCYMLERFGESKDGRQCGETSSQI

SEQ ID NO: 34094 - protein, 84 aa, Colobus angolensis
VALGDVAVNFTREEWALLGPCQKNLYKDVMQETIRNLDCVGMKWKDQNIEDQYKYSRKNLRCHMLERFGESKDGNKWGETSSQI

SEQ ID NO: 34095 - protein, 90 aa, Propithecus coquereli
VCLEDVAVTFTQEEWRQLDLAQRMLYCDVTLETCGHLVSLDCKATLEKKRSASEKGNTREKPSHHMEMNHCIQGEQPWPEPLGNVQDQRD

SEQ ID NO: 34096 - protein, 89 aa, Propithecus coquereli
VNFKIVTVDFTQEEQGTWNPAQRTLDRDVILENHRDLVSWDLATTLRRRESTSKQSSFYDEPSHGVKIEKLPKDDPWLSSCEEVHDCKD

SEQ ID NO: 34097 - protein, 90 aa, Saimiri boliviensis
VAFEDVAVNFTQEEWALLGPSQKSLYRNVMQETIRNLDCIEMKWEDQDIEDRCQNPRRNLRSHTCEIIDDSQCGETFSQIPESLVNRNTP

SEQ ID NO: 34098 - protein, 84 aa, Colobus angolensis
VSFEDVFVYFSREEWELLEEAQRFLYRDVMLENFALVATLGFWCEAENEEAPSEQSVSIEGVSQVRTAEPGLFQKALPCEMCDP

SEQ ID NO: 34099 - protein, 88 aa, Tupaia chinensis
MNFKIVTVDFTQEEQGTWNLSQRTLNRGVLLQNHRDLFSWDRATTLGRESSSKQSIFDDEPSHGVKIEKLTRDDPWLSSCEKVHDFKD

SEQ ID NO: 34100 - protein, 84 aa, Muntiacus reevesi
VTFEDVAVLFTRDEWRKLAPSQRNLYQDVMLENYSNLVSLECNSSKTTKATQTQDSSFSGLIRKTLKKDEPWNFISENPCIYED

SEQ ID NO: 34101 - protein, 88 aa, Ursus americanus
VAFQDLAVRFSEEEWQLLAEGQRALYRDVMRENYETLRSLGKEPAPAPWETEGRRDPGPGSRGQFPTCRPVGEGHSLHLTALVQLVRE

SEQ ID NO: 34102 - protein, 83 aa, Ursus americanus
MAFEDVAVYFSQEEWELLDAAQGALYCHVMLENFALVASLGKALGSPWEAQLSPALTPCLLLAREQPHTSWACGGQKPYGQEA

SEQ ID NO: 34103 - protein, 93 aa, Ursus americanus
VVFTDVAIHFSQEEWGLLDEAQRSLYHSVMLENLALLSSLGKALPPPPVSGAGHQVSPFPGGSSVVPTHLISRHFTGISLLTGCWHGARDEEA

SEQ ID NO: 34104 - protein, 84 aa, Myotis brandtii
VTFEDIALYFSREEWSLLDEGQRQLYLNVMLENFELVSSLVFTLEKDLMSAVNVANPLPRFIAFVIIGDFIQEKKPYSAVNAEN

SEQ ID NO: 34105 - protein, 86 aa, Myotis brandtii
LTFWDVAIHFSPKEWECLDPAKRKLYMDVMLENYSNLASVAMSSEDDQALMPKFGIQDLFTEIILRVHTGEKPYTCRECGKAFTGS

SEQ ID NO: 34106 - protein, 83 aa, Myotis brandtii
IAFQDLAVRFSEEEWQLLGERQRELYRDVMQENYQALVSLGTADLLPLSAFLSPAEPGRAMSRSKAGEEQEPPKGGAVAGGAP

SEQ ID NO: 34107 - protein, 89 aa, Colobus angolensis
LTLEDVAVEFSWEEWQLLDTAQKNLYRDVMVENYNHLVSLGKNSSPVSPRGAYNAQTLFYAHQIKALQKNLKSSLSLINQKRRHGINNP

SEQ ID NO: 34108 - protein, 84 aa, Mustela putorius
VTFEDVAVNFTLEEWVLLDSSQKKLYRDVMRETFRNLASIGKKWEGHDTEDGYYTQGRKLRIHMVEKPYENKEDHCGETITQTP

SEQ ID NO: 34109 - protein, 94 aa, Rhinolophus ferrumequinum
VSFKDVTVEFTQKEWQRLGPAQRALYRDVMLEIYSHLVSVEDYRRGLLEDSQVNQDKYLCQVLFTTNRPVTTQQEKVSGKPFNLDTDIIPSRIL

SEQ ID NO: 34110 - protein, 87 aa, Ursus maritimus
VTFEDVAVYFSQEEWRLLNKAQRHLYRDVMLEVFAIVTSLGCRHGAEDEAAPSEQSISVGRSQINSTQKAYAQEYGMASEGSLRPAE

SEQ ID NO: 34111 - protein, 89 aa, Balaenoptera acutorostrata
VNFQRVTVDFTQEEEGTLNPARRTLDRDVILENHRHLVSWDSATALGRRESTSKQSIFGDEPSHRVKIERLTRDEPWLSSCEEVQDCKE

SEQ ID NO: 34112 - protein, 90 aa, Lynx pardinus
VVFEDVAVNFTPEEWALLDSAQRKLYRDVMLENLKNLAAVDDETQLKANGSVSQQDAYGNKISKGNKLAKFTRNESWASVLGKIWEELST

SEQ ID NO: 34113 - protein, 103 aa, Balaenoptera acutorostrata
MDFTQEEWALLNSSQRKLYRDVMLENYRNLASLGGSMGEVTALSFRQGTAYKTDLAFTSCLGLDRVLKSTKGHQLSKPPLITQMEQEDEMEIVERRIHQDTCS

SEQ ID NO: 34114 - protein, 88 aa, Saimiri boliviensis
VTFDDVAVDFTQEEWTLLDPSQRDLYRDVMLENYENLASIEWQVKSKGSALQQDRAWFRASDETQMARSHNGGQLCDRMQCGEAVSEP

SEQ ID NO: 34115 - protein, 103 aa, Saimiri boliviensis
VTFEDVTIIFTWEEWKFLDSSQKRLYREVMWENYTNVMSVGNWNESYKSEEEKFRYLEYENFSCWQGWRNAGTQIYEIQNYGETVQGEDSKDLKQQGFSQFQE

SEQ ID NO: 34116 - protein, 92 aa, Saimiri boliviensis
VTFKDVAVDLTQEEWEQMKPAQRNLYRDVMLENYSNLVTVELRRGENCCASEVMAEMEFYFCYSGWSAMVQSQFTVTSACRDPAILLPQPPE

SEQ ID NO: 34117 - protein, 87 aa, Rhinopithecus bieti
VTFEDVAVNFTQEEWALLDPSQKKLYRDVMWETFRNLASIGTKQKEWNTEERYKSQGRNLRNHMVERLCESKEGSHGEEGFSQIPNL

SEQ ID NO: 34118 - protein, 85 aa, Vombatus ursinus
VTLEDVAVYLSKEEWRQPDLVQRDLHRDIVQEKNDLALEAVKIGKVGFIPLEAAGDAKMLGTGLGRVHGDVPQAMEQEGSRESSG

SEQ ID NO: 34119 - protein, 113 aa, Saimiri boliviensis
VTFEDVVVYFTQNEWTSLQPSQRALYREVMLENYATVTSLYLIAKGFPLGTERTEKVPGALPSFLPSSSSREVILALSPISAFPFSKPDLIFRLEQGEAAWGSDPWTLAGEEA

SEQ ID NO: 34120 - protein, 84 aa, Saimiri boliviensis
VTLEDVAIYFSQEEWGLLDEAQRLLYRDVMLENFALLTSLVCWHGIEDEETPEQCISVKGVPQVRTPEASPSIQKTQSCDMCVP

SEQ ID NO: 34121 - protein, 86 aa, Myotis brandtii
MDFEDVAIAFSQEEWGLLDEAQRLLYCNVMLEVFALVSSVGGTSCFLLVAVILTFVDMNFEDVAIAFSQEEWGLLDEAQRLLYCDV

SEQ ID NO: 34122 - protein, 87 aa, Propithecus coquereli
VTFEDVAVNFTRGEWALLNPSQKNLYRDVMRETLMNLSFVGIKWEDQDIEDRYKNPRRNLRRYMAEKLHESKEGRQRGEASSQILEH

SEQ ID NO: 34123 - protein, 100 aa, Vombatus ursinus
LTFEDVAITFSQEEWEMLAAWQQQLYRDVMKENYETLSSLSVGVGVRKCPRKENPRKQQLSGDFPGEQGETDSQPSSHKKFQEANLLPPGQMDSLMSTEP

SEQ ID NO: 34124 - protein, 110 aa, Saimiri boliviensis
VTFEDIAIYFSQEEWGLLDEAQRLLYLEVMLENFALVASLGCGHGTEDKKIPSEQNVSIGVSQSKAGSSTQKTQPCEMCVLVLKDILHLADLPGQKPYLVGECANHCEHQ

SEQ ID NO: 34125 - protein, 85 aa, Tupaia chinensis
ISFEDVTMDFTWEEWQDLEDAQKILYKDVMLETYSNLVFLGEKLYKCTQGKKTFSQNSDLTVHQRSHIGEKFYENKICEKMFYKK

SEQ ID NO: 34126 - protein, 91 aa, Vicugna pacos
VTFEDVAVYFSREEWGLLNLTQRSLYRDVMQENFALVGSLGCPCRLQDEEAPPKQMENCKVHLSEKLFMCGASGKEVPAILGLLQYQATHR

SEQ ID NO: 34127 - protein, 87 aa, Propithecus coquereli
VVFEDVAIDFTLEEWALLDSAQRNLYRDVMLETFRNLASVGQFKINGSVSQQDTNGEKISKEQKIPEFTRNNSCAYILEKNWENQGT

SEQ ID NO: 34128 - protein, 90 aa, Propithecus coquereli
VMFSDVSIVFSQEEWEYLDLEQRDLYRDVMLENYSNLVSLDLETRYETNKLSSEDDICEINLSQWKIMERIKNHSLKGLILKNDWESKRK

SEQ ID NO: 34129 - protein, 89 aa, Vombatus ursinus
LTFQDVAVDFTWEEWGQLDPAQQNLYRDVMLDNYQNLIFLGKGSFPHNSKSGVFFVLLLEVAKTRHETMDSNSKQNISGEKSPQERLTG

SEQ ID NO: 34130 - protein, 145 aa, Cervus elaphus
VTFKDVAVDFTQEEWGQLDSPQRALYRDVMLENYQNLLSLGKMVPKVRRPGPVSPRGWTWQNVGSCLCPRPLWCHWHLCLQVGAGGEGGRWTGPGSPACLGAGVSPCGVLRPTGPPVCKPDVISHLERGEEPWQAARDGPAGPGP

SEQ ID NO: 34131 - protein, 99 aa, Myotis brandtii
VTFQDVAVVFTEEELALLDPSQRKLYRDVMLENFRNLVSVVHIFKNINKSTLETNPTDVLCVVRVLVRPQVFKPISESTLERNPTNVLCVVRASVGVHI

SEQ ID NO: 34132 - protein, 87 aa, Propithecus coquereli
VAFEEVAVSFTQEEWALLEPSQKNLYRDVMRETIRNLSSIGKKWKDQKIEDHYKHQGRNLRSHTVERLCQSKEGSQCGEIFSQSPNH

SEQ ID NO: 34133 - protein, 89 aa, Lynx pardinus
ENFKVVTVDFTQKEEGTLNPVQRTLDRDVNLENHRDLVSWDLATALGRRESISKQNIFDDEPFHGVKLERLTRDDPWLASREEVRDCKD

SEQ ID NO: 34134 - protein, 83 aa, Saimiri boliviensis
VTFQDVAVDFTPEEWQLLDCAERTLYWDVMLENYRNLISVESDCPLDERGKRWESKDNFLKSVLLTFNKLLTMERIHHYNMST

SEQ ID NO: 34135 - protein, 86 aa, Panthera pardus
LTFRDVAIDFSQEEWECLDPAQRALYRDVMLENYRNLVSVGEDNLPPEVGSLSPGFSVKELSSVEDIYKGKFYHLVILERNESHGI

SEQ ID NO: 34136 - protein, 82 aa, Macaca nemestrina
VTLEDVAVEFIQEWALLDSARRSLCRYGMLDQCRTLTSRGAGAVPEDAAGALRRSEGDTIDSRGPASSPGAALVSGIHGTKG

SEQ ID NO: 34137 - protein, 87 aa, Balaenoptera acutorostrata
VTFEDVAVNFTLEEWALLDPSQKKLYRDVMWETLRNLASVGEKWEDHDIEDQYKNQGRKLRSHVVERLCESKEGSQCGENFSLIPNL

SEQ ID NO: 34138 - protein, 84 aa, Cervus elaphus
VTFEDVTVIFTWEEWKFLDSSQKKLYREVMWENYTNVMLVGNWKESCKPQEERFRYLEHENLSCWQGWKTASTQIYENKNYGEM

SEQ ID NO: 34139 - protein, 86 aa, Myotis brandtii
LTFRDVAIDFSQEEWECLDPAQQKLYLDVMLENYSNLVSVAMSSEDDQAFMPNTGIQDLFSEMILRVHSEEKPYNCGECSKAFSHP

SEQ ID NO: 34140 - protein, 85 aa, Vombatus ursinus
GTSENVALYFTRKEWMYLGLHQKALYRDMMQENYGNMVLLGKAAMMTHKKTTIEDITKKCNELGRIHTGEKSHKCIECGKIFSRS

SEQ ID NO: 34141 - protein, 87 aa, Balaenoptera acutorostrata
VTFKDVAVVFTEEELGLLDSAQKQLYQEVMLENFRNLVSVGEEGHSGTEHRISPCGHQSFTPDAISQLKREEKLWMIKIATQSRRSS

SEQ ID NO: 34142 - protein, 88 aa, Saimiri boliviensis
LTFRDVKIEFSLEEWQCLDTAQRNLYRDVMLENYRNLVFLVIWSHFAQDLWPEEGIKDSFQKGILRTYGKYGHESLQLRKDCKHVDAC

SEQ ID NO: 34143 - protein, 102 aa, Cervus elaphus
LTFKDVFIDFTPEEWECLDPAQRTLYKDVMVETLRNLLSLEVQERLHEFECQGRDDERNYKGMSITITQNKNLTNESDWRSRIAAGNKPVENRHGSSFQDEL

SEQ ID NO: 34144 - protein, 97 aa, Cervus elaphus
MTFEDVAVNFTREEWALLDAAQRQLYRDVILETCGHLACVDWATRHQTKDSTPQQNNLAKRTFQEVNTAHLASSSSRLSDLREDWMAHRIEAPGKQR

SEQ ID NO: 34145 - protein, 90 aa, Colobus angolensis
VAFEDVAVNFTQEEWALLGPSQKSLYRNVMQETIRNLDCVETKWEDQNIGDQCQNPRRNLRSHTCEIKDDSQCGETFGQIPDSTVNKNTP

SEQ ID NO: 34146 - protein, 114 aa, Saimiri boliviensis
VTFEDIAVYFSQEEWGLLDEAQRYLYHDVMLENFSLMTSVGCLHGIGAEEAPSEQIVSVEGVSQARTPKPSSSITNAHSCEMCILGMKDILYLTEHQGTLPWQEPYTSAASGKW

SEQ ID NO: 34147 - protein, 88 aa, Colobus angolensis
LTFRDVKIEFSLEEWQCLDAAQRNLYRDVMLENYRNLVFLVMCSHFTQDVWPEQSIKDSFQKVILRTCGKYGHENLQLKKDYKSMDAC

SEQ ID NO: 34148 - protein, 83 aa, Vicugna pacos
VSFLDVAVRFSWKEWRLLDEAQRRLYLDVMLKNYALVSSLGCCCGAGGDETPCEESVPEAVSQAGSPEAASSSQKTHPCETCG

SEQ ID NO: 34149 - protein, 87 aa, Vicugna pacos
VTFEDVAVNFSLEEWALLDLSQKKLYRDVMQETFRNLASVGEKWDNHNIEDWNKTQGRKLRSHMVEKLSESKEGGQHGETASQIPNL

SEQ ID NO: 34150 - protein, 86 aa, Myotis brandtii
LSFRDVAIDFSQEEWECLDPVQQKLYMDVMLENYSNLVSLATLSEDKQAMLQKAEMEDLFPKIILREHTGEKPYKCGECGKAFSRS

SEQ ID NO: 34151 - protein, 82 aa, Lynx pardinus
VTFEDVVVYFSWEEWGLLDETQRCLYHDVMLENFALVISLGCWYGMEDEEALSVPRMSLGKATDPGPPVWKSHPCEKCVLVG

SEQ ID NO: 34152 - protein, 86 aa, Saimiri boliviensis
VVFEDVAVNFTQEEWALLGPSQKKLYRDVMQETFVNLASIGENWEDKNIEDHRNQGRKLRSHMVERFHERKEGNQLGEAISQTPNP

SEQ ID NO: 34153 - protein, 85 aa, Balaenoptera acutorostrata
VAFEDVAVNFTLEEWALLDPSQKKLQRCDAGNLLEPGLSRSHMVEALCENKEGGPCGENFSLIPNLSLNKKTTGVKPHEYGACEK

SEQ ID NO: 34154 - protein, 96 aa, Vicugna pacos
LTFEDVAITFSQEEWECLVPAQRTLYRDVMLETCRNLLSVDKCDVCGEVFCFHSKLARHQRTPSCDRSYKCNLCGRVFNHKQALGSHKRIHTGEKP

SEQ ID NO: 34155 - protein, 104 aa, Odobenus rosmarus
VTLEDVAVDFSREEWAMLDSAQRRLYREVMLDTCANLAALGALKNQSSDIGIDDGTLSPTQASPATSPSPWVGCPLFLPVVPSHLEPGEAMWMGPQGTPQTSCS

SEQ ID NO: 34156 - protein, 83 aa, Odobenus rosmarus
VTFEDVAVNFSLEEWALLDPSQKKLYRDVMRETFRNLATIEKKWKDHDTEYRYNTQGRRLRSHMVEKRESKEGRQCGETITQT

SEQ ID NO: 34157 - protein, 101 aa, Saimiri boliviensis
VCFEDVAMAFTQEEWEQLDLAQRTLYREVTLETWEHLVSLDWKATLENNRLNSGKDRAWDELSHHVEVKQCVREEPPCLVSLEKVQDPSSQLREHQENSLR

SEQ ID NO: 34158 - protein, 92 aa, Vombatus ursinus
LTFQDVAVDFTWEEWGQLDPAQQNLYRDVMLDNYQNLIFLGKGSFPHNSKSGERLTGDGPEQLVKDWEYGGRFERKQEGNLERKSRQSSEKP

SEQ ID NO: 34159 - protein, 90 aa, Balaenoptera acutorostrata
LTFKDVAITFSQEEWECLDPGQRALYRDVMLETYRNLVSLDISHVHVIKKLQLNANTDRAEVFQTLILGRHERNKIKHFYLREIQENIHD

SEQ ID NO: 34160 - protein, 82 aa, Colobus angolensis
VTLEDVAVEFIQEWALLDSARRSLCRYGMLDQCRTLTSRGAGAVPEDAAGALHRSEGDTIDSRGPASSPGAALVSGMHGTKG

SEQ ID NO: 34161 - protein, 85 aa, Balaenoptera acutorostrata
VTFKDVAVNFTQEWQQLELAQRDLYKDVMLENFQNLSSLEMESRPERNGPVEAVPAGVSPELDLEELGGGCPWGCASGEAGTASG

SEQ ID NO: 34162 - protein, 109 aa, Balaenoptera acutorostrata
VTFEDAFVYFSREEWELLEESQRLLYRDVMLENFALVASLGCWCESDNEESPSEQSIFVGVSEIRTPESCPFIQKAHPCEICDPLLKDILHLAEHQGSCPAQKRYTCDP

SEQ ID NO: 34163 - protein, 86 aa, Colobus angolensis
LSFKDVAVVFTEEELGLLDSTQRQLYDVMLENFRNLLSVGERNPPGDKNGRDMEYIQDEELRLFSHKELFCKIWEEVVGELPGSQD

SEQ ID NO: 34164 - protein, 85 aa, Tupaia chinensis
VTFKDVAIEFSKTEWKRLDPAQRALYREVMLENYRNLVSVGEDDFSPEVGICPRTSPPDVTVISMLEQGEEPWTAESRVQRPEVP

SEQ ID NO: 34165 - protein, 85 aa, Balaenoptera acutorostrata
VTFEDVFVYFSREEWEVLEEAQRLLYRDVMLENFALVASLGCWCESDNEEAPSEQSVFVEGVSEVRTPESCPFIQKAQPCEICDP

SEQ ID NO: 34166 - protein, 101 aa, Vombatus ursinus
ACPPVALLAAAPEEWGHLGPSQKELYRQVMLENYGNLVCLGEDPRCRGHGEGTGGQGTGPPSEPWHGASLEVPAQPSEIRLLRQQKDKKKPSRQKTNIQRK

SEQ ID NO: 34167 - protein, 94 aa, Saimiri boliviensis
MVFEDVAIYFSQEEWGILNDAQKHLHSNVMLENFALLSSVGCWHGAKDKEAPSKQCVSVRVLQVTTPKPALYTLEAQPCKTCSTLLKDILHLAE

SEQ ID NO: 34168 - protein, 82 aa, Cervus elaphus
RSLENDGVCFSEQEWENLEDWQKELYANVMKSNYETLVSLKVLGQPEGDMELGAEMPGDLEEEESRGHPAVEEVVVKQETQY

SEQ ID NO: 34169 - protein, 84 aa, Tupaia chinensis
MFEEVSVCFTAEEWACLGPIQRALYWDVMLENYGNVTSLGEEPYKCNKCQKAFILKKSLILHQRIHSGEKPYKCDECGKTFAQT

SEQ ID NO: 34170 - protein, 86 aa, Odobenus rosmarus
VTFKDVAVDFTQEQWQQLEPAQRDLYRDVMLENLQNLSSLDLKSRPDRDGPEKAVPAGASPGLALEERGGSRLWRSGAGEAEGPPG

SEQ ID NO: 34171 - protein, 86 aa, Myotis brandtii
LTFRDVAIDFSQEEWECLDPAQQNLYLDVMLENYSNLASLAIPSKDNQAFMPKPGIQDLFPEIILNTQNGDSSYQWIEHGNKSKQE

SEQ ID NO: 34172 - protein, 84 aa, Camelus ferus
VTFEDVAVYFSWDEWGLLDETQRLLYRSVMLENFALMASLERDYGSCTFPTSGFTSSRTCEITELERWEEPFLPPPGVRAAAVP

SEQ ID NO: 34173 - protein, 101 aa, Camelus ferus
ALFDEVAIYFSDEEWEVLTEQQKALYREVMRMNYETVLSLENEDSDVKPPDWAGPMNAASQFPQPQHLDGFGLRMPRDITELPEWGEGYPFYMAMGFPGYD

SEQ ID NO: 34174 - protein, 95 aa, Balaenoptera acutorostrata
MAIEDVAVNFILEEWALLDPSQRKLYRDVMQETLRNLASVGLQIHGRSHTGENPYECKECGKAFIYPSSLQIRERSHMGEKPYECKQCGRRFSSQ

SEQ ID NO: 34175 - protein, 88 aa, Colobus angolensis
VIFEDVTLGFTPEEWGLLDLKQKSLYREVMLENYRNLVSVEYPELQPDPKLDPLPAESPLMNIEVVEVLTLNQEVAGPRNAQIQALYA

SEQ ID NO: 34176 - protein, 84 aa, Colobus angolensis
LAFRDVALEFSPEEWECLDPAQRNLYRDVMLENYRNLFSLGEDHFNMQFLFHRLAMSKPELIICLEARKEPWNVNTEKMAKHSA

SEQ ID NO: 34177 - protein, 87 aa, Colobus angolensis
VSFKDVAVDFTQEEWGQLDSPQRALYRDVMLENYQNLLALEWELKAVLSQQQGICKEEPAQEPIAERPLGGAQAWGRQAGALQRSQA

SEQ ID NO: 34178 - protein, 88 aa, Tupaia chinensis
VTFSDVAIDFSQEEWACLDSTQRDLYWDVMLENYSNLVSLDLESAYEAKCLEKNICEINFSKRNSDGKRKSLGLTWMCEGAVGRPPRA

SEQ ID NO: 34179 - protein, 83 aa, Carlito syrichta
LTFKDVAVVFTKEELGLLDSVQRKLYQDVMLENFRNLVSVGHHPFKHDAFHLEKEKKLDMLKITIQRKEKSAGKILTEMETDP

SEQ ID NO: 34180 - protein, 86 aa, Mustela putorius
VTFEDVAVYFSWEEWGLLDEAQRCLYQDVMLENLALITSLGCRQGAEDDEAPEQSISVQRASQVRTLQAVVSPQKAHPREVCGQDL

SEQ ID NO: 34181 - protein, 94 aa, Tupaia chinensis
PASIPSNPPSIQEQWGLLDPSQKELYWNAMLEKYGTVVSLGEDGLPPEVGLLPRQLAPCPAALPPSFRRGSLAAEEQGPREQAALRSPRRGPGP

SEQ ID NO: 34182 - protein, 85 aa, Tupaia chinensis
ESLEDVAVYISQEEWVHQDPSKRALSRDTVQESYENVDSLGEKPYQCNVCGKSFSCNSNLHRHQRTHTGEKPYKCPECGEIFAHS

SEQ ID NO: 34183 - protein, 90 aa, Odobenus rosmarus
VTFSDVAIDFSQEEWACLDSTQRDLYWDVMLENYSNLVSLDLESPYGTKSLPTEKGIYEINLSKWNSNGKNKSLGLDWMCEGEFEGPRGP

SEQ ID NO: 34184 - protein, 83 aa, Cervus elaphus
VVFEDVAVNFTLEEWELLDPAQRKLYRDVMLETCRNLATVDSAGADTGPGLEVGTGKSSLRGSSLAGEINSRSYRRRRRVPEH

SEQ ID NO: 34185 - protein, 97 aa, Colobus angolensis
VTFADVAVNFTKEEWTLLDPAQRNLYRDVMLENSRNLAFIDWATPCETKDATPQPDILPKRTFPEANSVCLTSISSQLSTLREDWRCPKREGPHRQG

SEQ ID NO: 34186 - protein, 92 aa, Erinaceus europaeus
VTHEDVTVIFTQEEWALLKPSEKKLYRDVMWETIVNFVSIGKLQGDHSTKEQHNHQGSKQSNIVKITEAKERSQDGEQPEEREVDNQVFTYS

SEQ ID NO: 34187 - protein, 87 aa, Gulo gulo
MSVMLSSPTKYKGILIICGCDCGLYPGGVAAPGPCSEDPVQGCAAAAAASHLVSVGCCIPKPEVILKLEQGEQPWMLEEESPSRSYP

SEQ ID NO: 34188 - protein, 82 aa, Ornithorhynchus anatinus
PAGPDVSVELSREEWGLLDRARRELYRDVMLDNYPRAGAAGGYGNLVALARRPLPEPDVISVLERGGEPWFLNWQRADDGDP

SEQ ID NO: 34189 - protein, 82 aa, Vicugna pacos
LRLPPGSKGEAPKEWENLEDWQKELYTNVMKSNYETLVSLTNDPYSLLGSHGAVSNPEVLGQPEGDSELGTEMLGDLEEEGP

SEQ ID NO: 34190 - protein, 86 aa, Erinaceus europaeus
LTCEDVTVTFTQEEWALLQPSEKKLYRDVMWETFRNLVSIGKLRGDHTSKEQYTHQESKQRNIIEKVSEGKEERQYGEKNLENEVH

SEQ ID NO: 34191 - protein, 96 aa, Ornithorhynchus anatinus
VTFKDVAIFLTQQEWESLADAQRELYTTVMLENYGHLQSLGKDTESLAGQGYSPPGRKWIFPKEAWKGKPECLSIREEQMPSTAFAESRGDVSPHP

SEQ ID NO: 34192 - protein, 85 aa, Cervus elaphus
DVAVAFTWEEWQLLAPAQKALYWDVTLENYGNLVSVGEDGCPGSLGQSMVTSDEPESSAISHEQAIKLANLMYSPSWNEKNHHGP

SEQ ID NO: 34193 - protein, 92 aa, Carlito syrichta
LTFKDVAIVFSRDEWKRLDPAQRVFYKNVMLQNYRNLVSLGEDNFLPEVKTCYCGIFEFVCMCVSMGTYLCVAVLALIFPFLDSIEDLLTQK

SEQ ID NO: 34194 - protein, 96 aa, Carlito syrichta
VSFEDVTVELTREEWLQMSPGERSLYRDVMLENYGHLIAVGEQTCHGNPSVSCLLFKKIFKTHRFFIVIKGFIIEAFTETKTVFVIIFLSKTSDEY

SEQ ID NO: 34195 - protein, 87 aa, Ornithorhynchus anatinus
VTFEDVAIFLTRWEWKSLTDAQRELYQCVMSETYEHLRSLGKDTPREGRATDDHHPPLGLKLVMVEILVSGKSGGDVQGCGHLSDPA

SEQ ID NO: 34196 - protein, 85 aa, Carlito syrichta
VTFEDVAVYFIRKEWKRLEPAQRDLYRDVMLENYGNVFSLDWIHISLIMQKAMLACFTGTPGVGRGLCASEPASVEPTDPSEERP

SEQ ID NO: 34197 - protein, 90 aa, Vicugna pacos
VTYEDVAVTFTREEWGHLDPAQKTLYQEVMLETCGLLASLGDGAEPDTADPSPPGLPLSEEVSPREQLTQRASGDSRLGQTKDRNESSEM

SEQ ID NO: 34198 - protein, 88 aa, Delphinapterus leucas
VTFEDVTLGFTPDEWGMLDLEQKSLYREVLLENYRNLVSVECPEAQLDPQFHPFPAGNPLMKIEVVEILTLNEEVALPRNAQIRALYA

SEQ ID NO: 34199 - protein, 85 aa, Tupaia chinensis
ISFDEVAIDFTWEEWQKLEDAQKILYKDVMLETYSNLVYLGEKPCECKECKKTFSQSSDLTVHQRSHIGEKSYENKICDKMFYKK

SEQ ID NO: 34200 - protein, 85 aa, Vicugna pacos
VAFEDVFLYFSREEWELLEEAQRLLYRDVMLENFALVASVGCWCEADNEEAPSKQSVFVEGVSELRTPESCPFFQKAHPCEICDP

SEQ ID NO: 34201 - protein, 128 aa, Carlito syrichta
LTFKDVAVVFTEEELGLLDPAQRKLYRDVMLENFRNLLSVGEGNLTGDKNGKNMEDIQTKEIRFHSHKELSYWKMWQQVAGELTVSQDWSVNLQGKDFQVSEDVAPCQLWEGATPWVFPTENSVDGLQ

SEQ ID NO: 34202 - protein, 94 aa, Odobenus rosmarus
ASCTELPTFSDVEEWGLLDEAQRSLYHSVMLENFALLSSLGCWHGAQDEEAPSEQDVSVGGSQVRTPKPGPSIQKSQPCETCSLLLKDLLHLAE

SEQ ID NO: 34203 - protein, 87 aa, Carlito syrichta
VVFEDVDVNFTQEEWALLDPSQKNLYRDVMRETIRNLASIGKKRKDQNGEDHYKHQGRNLRTRMIDRLYPSKEGSQCGGIFNQIPNH

SEQ ID NO: 34204 - protein, 90 aa, Delphinapterus leucas
VVFEDVAVDFNLEEWALLDSAQRELYRDVMLENFRNLASVEDETQFKANGSVSQQDIYGNKISKEHKISKFTGNDSLTSVLGKIWEELSL

SEQ ID NO: 34205 - protein, 89 aa, Tupaia chinensis
MAFGDVTVDFTQEEWRLLSPVQRTLYREVMLANYSLLVSLGSKPEIYLCPCCPLSFSSQHYLSKHLLHRHPAYRSPGSYTENDMQPRDP

SEQ ID NO: 34206 - protein, 89 aa, Vicugna pacos
VTLEDVAVHFSWEEWELLDPAQRRLYRDVMRETCRNLASVGSCSQVNTSGSSSWWAILEGEISSEQNLVGFPGNDSWSVFGENWMFHNN

SEQ ID NO: 34207 - protein, 87 aa, Vicugna pacos
LAIEDVAVNFTLEEWALLDPSQKKLYRDVMQEIFWNLTSVRKTWEGHDIGDQYKSQAQKLRSHMVERLSESKDSSLCGENFNLIPTV

SEQ ID NO: 34208 - protein, 86 aa, Odobenus rosmarus
VTFRDVAIEFSPDEWECLDPAQRALYRDVMLENYWNLVSLGEDSFPPEVGCLSAGFEIKELPPIEDINEGELYHLVILKRNESHSI

SEQ ID NO: 34209 - protein, 85 aa, Odobenus rosmarus
VTFEDVVVYFSWEEWGLLDETQRCLYHDVMLENFALVISLGCWYGMENEMAALGKTPSPDSSVWKAQPCEKCVLLGRDILYVAED

SEQ ID NO: 34210 - protein, 85 aa, Tupaia chinensis
VTFEDVAVNFTQEEWECLAASQRALYQDVMSETFKNLASVGGRKEELRDQGHREEDTSDEKVHVCTRAGQSPTAVTGPGDRTPAG

SEQ ID NO: 34211 - protein, 83 aa, Tupaia chinensis
VTFEDLAVNFNREEWALLDPSQKNLYKDVIWETVRNLVFIGKQWEDHNIEDQYKNLKRNLRNHILELCESKEGNHYGEMFSQS

SEQ ID NO: 34212 - protein, 91 aa, Carlito syrichta
VMFEDVAVYFSREEWGLLNVTQKSLYRDVMLENFSLISSLGCLCRVEDEEAPLKQVKNCRAQLSEKSFMWRESEKYVPATLGFLQHQNTHS

SEQ ID NO: 34213 - protein, 92 aa, Delphinapterus leucas
VTFEDVLVYFSREEWELLEEVQRLLYRDVMLENFALVASLGCWCESDNEEAPSEQSIFVGVSEVRTPESCPFIQKAHPCEICDPLLKDILHL

SEQ ID NO: 34214 - protein, 98 aa, Cervus elaphus
VTFKDVAMDFTPEEWGRLDPAQRDMMLENYRNLVSLYSETSPRSKDSTSVQDFSKEESCQVAVIDRLTRDSVCDSSTETTLDCEGWLENQQGSQERHW

SEQ ID NO: 34215 - protein, 92 aa, Carlito syrichta
LTFKDVAIVFSRDEWKRLDPAQRVFYRDVMLQNYRNLVSLGEDNFLPEVKTCYCGIFEFVCMCVSMGTYLCVAVLALIFPFLDSIEDLLTQK

SEQ ID NO: 34216 - protein, 84 aa, Colobus angolensis
VTFRDVAVIFTEAEWKRLSPQQRNLYKEVMLENYRNLLSLDRVLLLLPRLECNGAISAHHNLCLPGSRDSPASASQLAGITAEP

SEQ ID NO: 34217 - protein, 113 aa, Colobus angolensis
VTFEDVAVYFTQNEWASLHPTQRALYREVMLENYANVTSLYPTAGGFPLGRERTEKVPGALPSFLPSSSSLEVILALLPMSAFPFPKPDLIFQLEQGEAAWGPDPWTLAGGEA

SEQ ID NO: 34218 - protein, 87 aa, Delphinapterus leucas
VAIEDVAVNFTLEEWALLNPSQKKLYRDVMRETFRNLASVGKKWEDRDIEDQYKNQGRKLRSHVVERLCESKEGSQCAGNFSLIPKL

SEQ ID NO: 34219 - protein, 164 aa, Tupaia chinensis
VMFNDVSIVFSQEEWAYLDLEQKDLYRDVMLENYSNLVSLGCRSSSPTWASVIKRIRKPTTQMLRWMVCTKRRPKNVKMNMRRMRMVRRKFDEDEDEDVEGEEDEVGGEEEEFGYGEVDEEDEDEEEEESEKGYFISKPDVISLLEQGKEPWKVLRKRRRYSDL

SEQ ID NO: 34220 - protein, 82 aa, Vicugna pacos
VTFEDVAVDFTQEEWALLDTSQRKLFRDVMLENISHLVSVAIYFFPVISDREDDLKKQMISMQHINKKDAPLIRTVSSHTQE

SEQ ID NO: 34221 - protein, 87 aa, Erinaceus europaeus
VTFEDVVVYFSWEEWGLLDEAQRCLYHDVMLDNFALVTSLGCWFGMEDEERLSVQTVSVEKMPLGKTASSCEKCILVERDTLYLTDY

SEQ ID NO: 34222 - protein, 93 aa, Ornithorhynchus anatinus
LGAGDVAVYFSPEEWARLGPAQRALARDVMWDNYRALESLGKDGVLNFSSSPLWGHLRTHTGKPHPCPQCGKRFNRGSTLIAHQRTHTGEKPY

SEQ ID NO: 34223 - protein, 84 aa, Ornithorhynchus anatinus
VTLEDVSVELSREEWGLLDRARRELYRDVMLDNYRNVAALGEGPGARAGAAGGRRGRTSPDLPPSTRGPGGRLGRRGGRGTTSR

SEQ ID NO: 34224 - protein, 92 aa, Erinaceus europaeus
VTHEDVTVIFSQEEWALLNPSEKKLYRDVMWETFMNFVSIEKLQGDHSTKEQHNQQGSKQSNIVNITEAKERSQNGQKHQECELNNHVFTYS

SEQ ID NO: 34225 - protein, 85 aa, Erinaceus europaeus
VTYEDVTVIFTQEEWALLNPSEKKLYRDVMWENFRNFLSIEKVQKHSTKEQHNLHGSKKSNTAVKVSEDKESQNGRKSQDCEVYS

SEQ ID NO: 34226 - protein, 85 aa, Delphinapterus leucas
VTFKDVAVDFTEEEWGQLDPAQRALYKEVMLEIYGNLVLVGKKLYNCAECGKSFSQSTDLRIHQRVHTRKKPFVCDTCGKAFSYN

SEQ ID NO: 34227 - protein, 108 aa, Gulo gulo
TLYADVAVTFTREEWGQLDPAQRTLYQEVMLENCGLLVSLGKSSPLHHGDTCGLLVRAPSGSRPGWSGRPLEPSPCLSSLQLQPFSRLISLDLLSCVCLGEKQFLFGS

SEQ ID NO: 34228 - protein, 87 aa, Carlito syrichta
VSFEDVAVNFTLEEWALLDSSQKKLYRDVMQETFQNLNYIGKKWKDQDVKDDHKNHRRNLRGHMVYRLCESKKGSKCRKTTSQMPNP

SEQ ID NO: 34229 - protein, 90 aa, Vicugna pacos
VTFSDVAIDFSQEEWACLDSAQRDLYWDVMLENYSNLVSLDLESPYETKRLPTHKGIYEINFSKRNSNGKSKSLGLAWMSEGEFEGPQAP

SEQ ID NO: 34230 - protein, 85 aa, Erinaceus europaeus
TYEDVTVIFTQEEWALLKPSEKQIYRDVMWENFRNILSIGELQKDHSTKEQHNSQRSKQSSRVVNISEGKESENSLKPQECEVYN

SEQ ID NO: 34231 - protein, 93 aa, Erinaceus europaeus
VTYEDVTVIFSQEEWILLNPSEKKLYRDVLWENHRNFLSIGKLLEEHSTNKQQHNHQGSKQSNIISYLRLHERIHIGEKPYECKQCSKAFGWA

SEQ ID NO: 34232 - protein, 86 aa, Erinaceus europaeus
VTWEDVTVTFTQEEWALLIPSQKKLYRDVMWETFRNLVSTRKLPEDHYIKKQYSHWENKQRNLVEKTPEGTEGCEYEGNCHEFHLQ

SEQ ID NO: 34233 - protein, 87 aa, Colobus angolensis
LQFRDVAIEFSLEEWHCLDTAQQNLYRDVMLENYRNLVFLVMCSHFAQDLRPEQSIKDSFQKVILRKFEKCGHGNLQFKKGCESVDE

SEQ ID NO: 34234 - protein, 85 aa, Vicugna pacos
LTFEDVAIEFSQEEWECLDPAQRALYGEVMLETYRNLVSLDVSHMHVIKKLRTKANNDRGEVFQTVILGRHEWNEMRHFYRREIQ

SEQ ID NO: 34235 - protein, 86 aa, Carlito syrichta
VTFEDVAVTFTEEEWTLLDPFQKNLYRDVMQETFRNLASIGNKQEDQIIEDHFKHAGRNLSHVVERLCESKEGSQYGETFNQNPNL

SEQ ID NO: 34236 - protein, 89 aa, Saimiri boliviensis
VAFEDVAVNFTLEEWALLDPSQKNLYRDVMRETFRNLASIGKQWEDQNIEDPFKLPGRSTSHIPERICEHKEGSQGEETFSQIPDGILN

SEQ ID NO: 34237 - protein, 86 aa, Saimiri boliviensis
LTFKDVAIEFSQEEWRCLDPAQRTLYRDVMLENYRNLVSLGEDNVPSEVGTCPWYLCIFPCVLLGSPCIARCAVSSKTGNNHVTNP

SEQ ID NO: 34238 - protein, 106 aa, Mustela putorius
LSWEDVAVDFSREEWAMLGSAQRQLYREVMLDTCAHLAALGALKNQSSDTGADDGDSTLSPTQASQAISPSPAVGCPLFLPVVPFHWEPGEAVWMGARRTPQTSCS

SEQ ID NO: 34239 - protein, 90 aa, Mustela putorius
VVFEDVAVDFTLEEWALLDSAQRKLYREVMLENLKNLASVDDDTQFKASGSVSQQDVYGNKLSKEHKIAEFTRNDSWASVLGKIWEELST

SEQ ID NO: 34240 - protein, 85 aa, Carlito syrichta
VSFEDVAVDFTQEEWTLLDSAQRDLYRDVMLETCENLASIEWRLKTRGSTHWPDVFWFKPSNGIQTAKSHSGGELCDHKQCGETF

SEQ ID NO: 34241 - protein, 90 aa, Odobenus rosmarus
VTFEDIAVSFSWEEWDLLDEAQRHLYQDVMLENLALITSLGLASSRCHIVAHLGVWPPHFIPAFPSLTHFLLSGCWHGAEDEEAPSEQSI

SEQ ID NO: 34242 - protein, 122 aa, Carlito syrichta
LTFKDVAVVFTEEELGLLDPAQRKLYRDVMLENFRNLLSVGDKNGKNMEDIQTKEIRFHSHKELSYWKMWQQVAGELTVSQDWSVNLQGKDFQVSEDVAPCQLWEGATPWVFPTENSVDGLQ

SEQ ID NO: 34243 - protein, 88 aa, Odobenus rosmarus
VAFEDVTVNFTLEEWALLNPSQKKLYRDVMQETLRNLASVGEKWEDHNSRSLYEHHQTDLSRPVVESPCKNKEGSPFGESFSQNPNHK

SEQ ID NO: 34244 - protein, 87 aa, Delphinapterus leucas
VTFEDVAVYFSWEEWDLLDDAQRCLYHNVMLENLALTTSLGCCHGAEDEEAPSEQSISVNRMSQVSTPKAGVSTQKAHFCEICGPDL

SEQ ID NO: 34245 - protein, 84 aa, Carlito syrichta
VTFEDVAIFFSQEEWELLDETQRFLFCNVMLENLALMASLGCWCGADAEKAPCEQSIFAGLSQVRTQKASPFIQKSHSCKICIP

SEQ ID NO: 34246 - protein, 84 aa, Delphinapterus leucas
VTFPDVAVRFSWGEWKLLDEAQRRLYLSVTLDIYALISSLGCCCGADGEETPCEETVPVGVSQAGSPKAAPFSQKTHPCEMCGP

SEQ ID NO: 34247 - protein, 91 aa, Mustela putorius
VMFRDVAIDFSQEEWEYLDSAQRDLYRDVMLENYSNLVSLVDLPSRSANKDLSPKNDNYETELSQWEMSARLENCDLEESSSRDYLEVRGT

SEQ ID NO: 34248 - protein, 90 aa, Colobus angolensis
VTFRDVAIDFSQKEWEYLDTTQRKLYRDVMLENYSNLVSLGWLSRHKTKKLSSEKDIHEISLSKGSIIEKSKTLRLKGSILRNEWQSKSE

SEQ ID NO: 34249 - protein, 93 aa, Tupaia chinensis
VTFKDVAVDFSQEEWGRLGPGQRELYWDMMLENYRNLLSLGPKRELTSSSKVSPKKVKWSSNVCSPQSSLFSDADSSESGETLSPKASQNRLP

SEQ ID NO: 34250 - protein, 91 aa, Odobenus rosmarus
VVFEDVAIYFSQEEWGLLDEAQRFLYHAVMLENFALLSSLGCWHGAQDEEVPSEQDVSVGGSQVRTPKPGPSIQKSQPWEMCGPVWKDILR

SEQ ID NO: 34251 - protein, 84 aa, Odobenus rosmarus
AVGCQCASGCAEHPGRCGPGARPRMLDSVVPAPYRSRSPAGGWSDPLFFGGAGIPFSKPKLITQLEQGKETWREERTCPPATRP

SEQ ID NO: 34252 - protein, 85 aa, Carlito syrichta
VTFEDVAVYFSQEEWRLLNEAERLLYRSVMLENFSLMASLGCWHGAEAEEAPEQSASVKGVLISNVHQSQKLHCGEKLLEENRVP

SEQ ID NO: 34253 - protein, 85 aa, Carlito syrichta
VSFTDVTVDFTQEEWEQLDPSQRILYMDVMLENYSNLLSVGKNCSSLLSEVWKADDQMERDHRNPDEQARQFVILKNQTSIEERG

SEQ ID NO: 34254 - protein, 84 aa, Homo sapiens
LTFEDVAVYFSEEEWQLLNPLEKTLYNDVMQDIYETVISLGLKLKNDTGNDHPISVSTSEIQTSGCEVSKKTRMKIAQKTMGRE

SEQ ID NO: 34255 - protein, 82 aa, Leptotrombidium deliense
LTFRDMAIDFSEEEWECLDPAQWTLYRDVTLEIYRNLDFLEYLLAASILHEKDEDCTFFSVHNLEIENAYYFSVSVRKKLEK

SEQ ID NO: 34256 - protein, 97 aa, Pteropus alecto
EKIEDMAVSLIREEWLLDPSQKDLSGDNRPENYRSTFSLGGETRNENRELASKQVIPAGAHPHGETAAKCNGDAVGGLEHGEARDLLGRLERQRGNP

SEQ ID NO: 34257 - protein, 82 aa, Rhinolophus ferrumequinum
IAFHDLAVRFSEEEWQLLGTGQRELYRDVMQENYETLVSLGTAELLPLSAFLSPTEPGGAMNGSDPGEEREPPREGAPGGAP

SEQ ID NO: 34258 - protein, 83 aa, Ursus maritimus
VTFEDVAVYFSLEEWERLDRTLYRDVMLENYSHLVSFLNLVFIFFHFHGLFPLYFSLRHSFIHSFIVLQIVLLLVLLVLEIRW

SEQ ID NO: 34259 - protein, 91 aa, Myotis brandtii
LTFEDVAVHFSEEEWKLLAPTQKTLYNEVMQENYETVISLGLKLKNDTGNDPPMSTSTLEIQTSGCKVLRKARMKAAQKTTDKENHGSTHK

SEQ ID NO: 34260 - protein, 92 aa, Saimiri boliviensis
VTFEDVAVNFSWEEWSLLSEVQRCLYHDVMLENWVLISSLGCWCGSDEEAPSKQNISIQRVSQVSTPRTGASLKKAHPCEICGTILGDILHM

SEQ ID NO: 34261 - protein, 86 aa, Oryctolagus cuniculus
VSFEDLTVDFTQEEWQDLSIAQRTLYRDVMLEIYSSLLFLVARQKDDLIEGNQQSQDMNPRQDVRTYKKISTPKIVELRKTFNLSS

SEQ ID NO: 34262 - protein, 87 aa, Rhinopithecus bieti
VAFEDVDVNFTQEEWALLDPSQKNLYRDVMWETMRNLASIGKKWKDQNIKDHYKHRRRNLRSHMLERFYQSKDGSQRGGIFSQFANQ

SEQ ID NO: 34263 - protein, 87 aa, Propithecus coquereli
VAFEDVSVNFTQEEWALLDPSQKKLYKDVMRETFKNLASIGKKWEDQNIEDQHKNQERNLRSHMVERLCESEEGNQCRETFSPNLTL

SEQ ID NO: 34264 - protein, 97 aa, Balaenoptera acutorostrata
VTFEDVAVFFSWEEWCLLDEVQIHLYLDVMLENFAVICMLDVHQKQHIREKPFSCDMGRPAFLKSCTIHVTGNLSTYMEIGNNYVAKMGLQKQVTNT

SEQ ID NO: 34265 - protein, 82 aa, Lynx pardinus
VTFSDVAVDFTQEEWQQLEPAQKDLYRDVMLENYRNLVSLGKGAALLNFSPPACKEVRKKMDRFDYVGSLNDSKIKIKLTGA

SEQ ID NO: 34266 - protein, 84 aa, Ursus maritimus
VVGCQCASRCAEHPGRCGPGGTPSMLGSVVPAPYRSRAPAGGWSDPLFFGGAGIPFSKPKLISQLEQGKETWREERTCPLATCP

SEQ ID NO: 34267 - protein, 94 aa, Ursus maritimus
VVFTDVAIHFSQEEWGLLDEAQRSLYHSVMLENLALLSSLGCWHGARDEEAPSEQGVSVGGSQVRTPKPAPSIQKSQPWEMWSLLLKDLLRLAE

SEQ ID NO: 34268 - protein, 104 aa, Rhinopithecus bieti
VTFEDVSVDFSQEEWELLEPAQKNLYREVMLENHRNVVSLEALKNQCTDAGIKKGSLSPARTPQVTSLSSWMGYLLLQPAASSHLEQREALWMEEKGAPQASCS

SEQ ID NO: 34269 - protein, 83 aa, Saimiri boliviensis
MASPSPPPEPKEEWDYLDPAQRSLYKDVMMENYGNLVSLGLTLLPRLECSDTIMPRCSFDLLGLNDQSSCYLSSWDYTCFEQR

SEQ ID NO: 34270 - protein, 90 aa, Saimiri boliviensis
VTFEDVSVDFSQEEWELLDPAQKNLYREVMLENYRNVLSLDRTTVLKNQDSTYKKVVLQEEPAGGLNIIRLLRGDGRWKQLGESHEDPQG

SEQ ID NO: 34271 - protein, 87 aa, Balaenoptera acutorostrata
VKFEDVVVIFTEAEWKRLSLEQRNLYKEVMLENFRSLVLLDSKPEVHPWPLCPACPLAFGGQQFLSHHELCIIPGSCAGNQLQPGDP

SEQ ID NO: 34272 - protein, 119 aa, Rhinolophus ferrumequinum
LTFRDVAIEFSQEEWECLDPAEQKLYMDVMSENYRNLLSLGEDSFPLEIGICPCVHFCVVKESSPKEDVNNGELFQTLILERQVSHDLNDFDFGEVQENMHQVENQWVYEENNNEGVTT

SEQ ID NO: 34273 - protein, 87 aa, Rhinopithecus bieti
LTFRDVAIEFSLDEWQCLDTAQKNLYRNVMLENYRNLAFLGICPQFAQNLWPEQDMEDSFQKVILRRYEKCEHENLQLRKGCKSVDE

SEQ ID NO: 34274 - protein, 87 aa, Rhinopithecus bieti
VSFEDVAVNFTLEEWALLDSSQKKLYEDVMQETFKNLVCLGKKWEDQDIEDDHRNQGRNRRSHMVERLCESRRGSKCGETTSQMPNV

SEQ ID NO: 34275 - protein, 91 aa, Ursus americanus
VSFADVAVYFSPEEWGCLRPAQRALYRDVMRETYGHLGALGDTPNKKEEALEEGPGAKGPRKTPGKEPSKELVKHSPDWTIRKVLARAQPP

SEQ ID NO: 34276 - protein, 85 aa, Myotis brandtii
VTFEDVAVNFSLEEWALLDSLQKKLYKDVMRETFSNLASIGGKWEDHEIEDQYKNQGSKHRVTGGCGSLCATVIYKDQGTLGGTR

SEQ ID NO: 34277 - protein, 87 aa, Myotis brandtii
VMFRDVAIDFSQEEWECLDFAQRDLYRDVMLENYSNLVSLGLALGTSRRCEWQLWCQLQVQAGLVLAVSASGSSGTGSRYKHQVHLS

SEQ ID NO: 34278 - protein, 87 aa, Propithecus coquereli
VTFEDVAIYFSQEEWELLHEAQRLLYLDVMLENFALLISLVCWHGMEDEETPSAESVSIEKVSQVRTLKAGPSTQETQLCEMCVPIL

SEQ ID NO: 34279 - protein, 86 aa, Myotis brandtii
VTFEDIALYFSREEWSLLDEGQRQLYLNVMLENFELTSSLGKTLTLTSDLDLLGFAIFQSPSSRVCSDLPGRLWYCLIFQFPGQLL

SEQ ID NO: 34280 - protein, 104 aa, Pteropus alecto
VTFQDVAVGFSPEEWALLDHSQRKLYREVMLETRRNLASVEASKDQRPDTVIEDGTSSPAQSSRDSSLSLWTGCSLFQPAVSFHLEQGAAMMMRAKGIPQASCP

SEQ ID NO: 34281 - protein, 84 aa, Macaca nemestrina
LAFRDVALEFSPEEWECLDPAQRNLYRDVMLENYRNLFSLGEDHFNMQFLFHRLAMSKPELIIYLEARKEPWNVNTEKTAKRSA

SEQ ID NO: 34282 - protein, 84 aa, Ursus arctos
VTFEDVAVNFSLEEWALLDSSQKKLYRDVMRETFRNLASIEKKWKDHDTEDRYYTQGRKLRIHMVEKPCESKEGHQCGETSSQT

SEQ ID NO: 34283 - protein, 90 aa, Muntiacus reevesi
LTFKDVFIDFTPEEWECLDPAQRTLYKDVMVETLRNLLSLGMSHTHRSQKLPTKASSDKGEVFHTVMLGRPESHKITYFFLREVQEHLHE

SEQ ID NO: 34284 - protein, 85 aa, Ursus americanus
LTFRDVATEFFQEEWECLDPAQRALYRDVVVENCRNLVSLGEENVPLEMRVCPWVSLYFPLFASWEPLPCAPDVGLDPRMPGSRP

SEQ ID NO: 34285 - protein, 86 aa, Camelus ferus
MLKDGGAHWATREGAAMLPLKTSRKPSGLFAAETVRTLVGHRRAVMEEADQVQRRYQASKPDTLSRLERGEELWTIEAEIHGRVHA

SEQ ID NO: 34286 - protein, 87 aa, Myotis brandtii
LTFEEVAVYFSPEEWELLDSSQKALYNDKSSQDEQLDCKESRANNNESKDSSMSNGSGYQKSRAVLKLTGKESFYRRSIEEVARAKE

SEQ ID NO: 34287 - protein, 94 aa, Saimiri boliviensis
VVFEDVAIYFSQEEWGHLDEAQRLLYRDVMLENLALLSSLGCWHGAKDKEAPSKQCVSVRVLQVTTPKPALYTLEAQPCKTCSTLLKDILHLAE

SEQ ID NO: 34288 - protein, 89 aa, Vombatus ursinus
LTFKDGAVDFTPEEWGCLGPSEKELYRNVMLENYGHLVYLGCLGLEICFTLSFCGFCCFRICLEPFFLQVFEGVWGRTQASHCFYSSTP

SEQ ID NO: 34289 - protein, 84 aa, Macaca nemestrina
VTFEDVAVTFTQEEWGQLDAAQRTLYQEVMLETYGLLVSLGDNTKPKTTEPSFFHLALPEEVLLRERLTQGVSKDSQLGQAKDQ

SEQ ID NO: 34290 - protein, 96 aa, Macaca nemestrina
VTFKDVAVVFSREELRLLDLTQRKLYRDVMVENFKNLVAASFPSNQILLWMMETRTQKNKHQNKMETLQKFSLKYLSNQELSCWQIWKQVARELTR

SEQ ID NO: 34291 - protein, 89 aa, Ursus americanus
VNFKIVTVDFTQKEEGTLNPAQRTLDRDAILENHRDLVSWDLATALGRRESTSKQNIFDDEPSHRVKLERLTRDDPWLSSCEEVQDCKD

SEQ ID NO: 34292 - protein, 86 aa, Vombatus ursinus
LTFRDVAVDFSRDEGRRLSPAQRALYRDVMLQNSGNLRIHTREKSHECHEFGKAFNENTSLISHQGIHTGEKPFACNQCGKTFTNK

SEQ ID NO: 34293 - protein, 83 aa, Oryctolagus cuniculus
VVSEDVSVNFSREEWALLNPSQKKLYRDVMQETIRNLASVEVVWWRETVKVRKRVSVEMLSTTCFIHPSLGISDLMTHTGENP

SEQ ID NO: 34294 - protein, 84 aa, Muntiacus reevesi
VTFEDVTVIFTWEEWKFLDSSQKKLYREVMWENYTNVMLVGNWKESCKPQEERFRYLEHENLSCWQGWKIASTQIYENKNHVEM

SEQ ID NO: 34295 - protein, 87 aa, Muntiacus reevesi
VTFEDVAVYFSQEEWRLLGEAQKFLYRDVMLETFALVLSLGCCHAAEDEQTPSEQNFSVEVPQSNTKKTDLSSQKICPWEMGNLALE

SEQ ID NO: 34296 - protein, 86 aa, Myotis brandtii
LTFRDVAIDFSQEEWECLDPAQRKLYMDVMVENYSNLVSVAMSSEDDQAFMPKPGIQDLFSEIILKIHTAEKSYKCKAYGKAFKCH

SEQ ID NO: 34297 - protein, 91 aa, Propithecus coquereli
VTFEDVAVNFTPQEWALLDPSQKNLYRDVMQETLRNLASVGKKWKDQNMEDECKTPRRNLRSVVGERLFTSKEGSQCGETLNLDSHHMLKK

SEQ ID NO: 34298 - protein, 82 aa, Ursus maritimus
VMFRDVAIDFSQEEWEYLDSAQRDLYRDVMLENYSNLVSLVDLPSRSANKDLSPKKDTYETELSQWEMSARLENSDLKESSS

SEQ ID NO: 34299 - protein, 93 aa, Rhinopithecus bieti
VSFEDVAVAFTQEEWALLDPSQKNLYRDVMQEIFRNLASVGNKSEDQNIQEDFKNPGRNLSSHVVERLFEIKEVSQYGETFSQDSNLNLNKKV

SEQ ID NO: 34300 - protein, 104 aa, Rhinopithecus bieti
VTFEDVAVVFTDEEWSHLVPIQRDLYKEVMLENYNSIVSLDWETKPEIHDASDEKSEGSLRECLGRQSPLCPKFEVYAPDGRVGTEKQSPSGETHKKSLSQEKG

SEQ ID NO: 34301 - protein, 82 aa, Ursus americanus
LSFEDVAIAFTKEEWQQLDPAQRTLYRDVMLENFSHLVSLGKDGFPPYRNIFHLLPLSSYLIKLGGFLTYVMTDFVLSFLSP

SEQ ID NO: 34302 - protein, 91 aa, Ursus americanus
LGEIDVAVDFTWEEWQLLDTVQRNLYREVMLENYSNLMSLGKDHFPKYLTMSPLIALFSPIDRIYGEHNFCVKTFSLVKNLKRHHRIHTEG

SEQ ID NO: 34303 - protein, 87 aa, Myotis brandtii
VAFVDVNVEFTTEEWAFLDPTQKKLYTDVMLETFWNLASVACILEEQCEDHDSEDQYENHGMNLSSLGSLGKHKRNHDGKKPYECKE

SEQ ID NO: 34304 - protein, 96 aa, Pteropus alecto
MLFEDLAVYFSQEESVSLHPALRSLSRDTTPECFKGMALMGRGGKIENNQQLNLKSMGIDELPLEKYSTAVPLVCYPEKSSEDGVLESKISGGTSA

SEQ ID NO: 34305 - protein, 94 aa, Oryctolagus cuniculus
VSFEDLAVDFTQEEWQDLDNAQKTLYKDVMLETYSSLLSLGEAEPIQGQEPGASSVSTTLLKSYATIVQKMSDLIESNQERQDINLGQIANRKS

SEQ ID NO: 34306 - protein, 88 aa, Ursus maritimus
VALEDVTVNFTLEEWALLNPSQKKLYRDVMQETLRNLASIGEKWEDRNSKSPYEHHQTNLSRPVVERPCKNKEGGLCGESFSQNPNHK

SEQ ID NO: 34307 - protein, 87 aa, Ursus maritimus
VVFEDVAVDFTLDEWALLDSMQKNLYRDVMLETFQNLVSVEKNWEDHSIEDQHGNHSRHLRNPVTDRFCESNERNQHRETCSQFPHF

SEQ ID NO: 34308 - protein, 92 aa, Ursus maritimus
MCVLRLSQQKVVLSYVSEAASPQTMSCLSESLVSLGQCQFLNDFFVPGIYVQILCYFPLTGCPFTKPDVIFKLEQEEEPWVVEEEVLRRHCP

SEQ ID NO: 34309 - protein, 89 aa, Ursus arctos
VTFEDVALYFSWEEWDLLDEDQRCLYHDVMLENFALTSSLDCWHGVEDGDAASEESISIGVSQIGTLKADSSSQKAQPFELHGPILRNI

SEQ ID NO: 34310 - protein, 86 aa, Myotis brandtii
LTFMDVAIDFSQEEWECLDPVQRKLYVDVMLENYSNLASLAVPPKDNQAFMPKPGIQDLFSEIILSTHNGDSIYQWIERWKNFKQE

SEQ ID NO: 34311 - protein, 105 aa, Camelus ferus
ENLCPLHNHFSRYEEMELRSQQIPTHDPVPWLTSRACQEVGPFETCSSHPAHPVRARPIPKQDTKPSVSSPLPGLLLSKPDVICRLEQGEDPWRVQRGPPRDVTF

SEQ ID NO: 34312 - protein, 82 aa, Propithecus coquereli
LTFRDVAIEFSQEEWKCLDPAQRALYRDVMLENYRNLVSLGEDTFPPEVGICPCVSLHLMLCASWKPLHYLADIEAVFTQVW

SEQ ID NO: 34313 - protein, 90 aa, Muntiacus reevesi
VMFRDVAIDFSQEEWDCLDSAQRDLYRDVMLENYSNLVSLDLPSRGANKLLSPKENIYEIELSQWEMSARLENCDLENSSSRDYLEVKGT

SEQ ID NO: 34314 - protein, 91 aa, Ursus americanus
GTFEDVAVYFSREEWELLDETQRHLYHNVMLENLALMASLGCWCAVEEAPLEQSVSVEGALHLRTPKVCPSTQKADTCDMCGLVLKDILHL

SEQ ID NO: 34315 - protein, 85 aa, Eschrichtius robustus
SSFKDISMEFTWEEWQLLDSAQKHLYRDVTLENYSNLVSVGERPYECTKCERAFSAKSNLNAHQRVHTGEKPYSCIECGKVFSFR

SEQ ID NO: 34316 - protein, 113 aa, Myotis brandtii
LTFRDVAIDFSQEEWACLDSAQRKLYLDVMMENYSNLASLAMSSEDDQAFMPNTGIPDLFSEVILILLSIREFILERSLINVENVAKPLASPHSLRGIREFMLERSLINVENV

SEQ ID NO: 34317 - protein, 85 aa, Lynx pardinus
VAFEDVTVNFTLEEWALLNPSQKKLYRDVMQETFRNLASVGDKWEDRNSKSLYEHETNRRRVVESPCQSKEGSQRGDPRRQNPSP

SEQ ID NO: 34318 - protein, 93 aa, Ursus maritimus
VVFTDVAIHFSQEEWGLLDEAQRSLYHSVMLENLALLSSLGKALPPPPVSGAGHQVSPFPGGSSVVSTHLISRHFTGISLLTGCWHGARDEEA

SEQ ID NO: 34319 - protein, 97 aa, Myotis brandtii
VTFSDVAIHFSQEEWECLSPAQRDLYMDVMLENYSNLISLDLESTYEIENNFSGKNISEISFSQCAVKERSKTLDLEASISENNWKCKSKFDELQEH

SEQ ID NO: 34320 - protein, 95 aa, Myotis brandtii
VTFEDFSVDFTEEEWGPLDPAHRKLHRAEMPQPYSHLVSMEDLNENSVDNLQEKGLGDLLHEELFCWLILEEMASTITGSKDYIVNLHGEMYRRP

SEQ ID NO: 34321 - protein, 96 aa, Propithecus coquereli
VVFEEVAVNFTPEEWALLDHAQRNLYRDVMLETFRNLASLDCCIYVRTNGSSPRQDIFGSEVSNGAKIVKFTRNDSWSIFGENWRFDNIEDQHQIP

SEQ ID NO: 34322 - protein, 90 aa, Macaca nemestrina
LTFKDVAIEFSQEEWTYLDPAQKTLYRDVMLENYRNLVSLDISCKCVNKDLPPKGKNSMEEAFHMVKLERLESCDEALSFEEVQKNTYDF

SEQ ID NO: 34323 - protein, 84 aa, Macaca nemestrina
VAFEDVAVNFTHEKWVLLDSSQKILCREVMQETCRNLASVGKNDNIFHLITEVFPYHQDHMVQRLCESKEGSQYGQVVSQIPNL

SEQ ID NO: 34324 - protein, 88 aa, Myotis brandtii
LTFRDVAIDFSQEEWECLDPAQRKLYMDVMLENYSNLASLAMSPKDNQAFMPKPGIQDLFCEIILSTHNEDRSYRWIEHWKNIKLESY

SEQ ID NO: 34325 - protein, 97 aa, Myotis brandtii
EKIEDMAVSLIREEWLLNPSQKDLKGDDRQESYRSMFSLGGETRNENKELASKQVISTGAQLHGETAAKCNGDIIGGLERGEAQDLLGRLERQRGNP

SEQ ID NO: 34326 - protein, 88 aa, Propithecus coquereli
VTFDDVAVGFTREEWALLDSAQRDLYRDVMLENYRNLASVEWQLKTSGSALWQDIICLKTSNGIQMAGSHHGREAGDCERRAVFAERW

SEQ ID NO: 34327 - protein, 96 aa, Propithecus coquereli
VTFEDVAVHLTREEWGYLDPVQRDLYREVMLENYGNVVSLGILLRLPITRIHSVNSCPALSHTQASAFSGETLAVLKAGISKRWPKYRLPIDIARP

SEQ ID NO: 34328 - protein, 87 aa, Lynx pardinus
VAFEDVAVNFTLEEWALLDPSQKKLYRDVMRETLRNLASVGKKWKDHNIDDQYKSQGRNLRSPMVERLHQSKEGGQCGGNFSLIPHL

SEQ ID NO: 34329 - protein, 83 aa, Propithecus coquereli
LSFKDVAVVFTEEELGLLDPVQRRLYRDVMLENFRNLLSVGHHPFKHDVFYLEKEKRLDTVEAATQRKEKSADKIQSEMETIP

SEQ ID NO: 34330 - protein, 87 aa, Saimiri boliviensis
VAFEDIDVNFTQEEWALLDPSQKNLYRDVMWETMRNLASIGKKWKDQNIKDHYKHQGRNLRRHMVERLYQSKDGGIFSQFANHNLSK

SEQ ID NO: 34331 - protein, 90 aa, Saimiri boliviensis
VTFEDVAVCFSQEEWRLLDEAQRLLYRNVMLENFSLMASLGCWHGVEAKEAPKQSASVGVLGSNVQQHQKQQCGEKPLKREEGRIPVLRS

SEQ ID NO: 34332 - protein, 108 aa, Vombatus ursinus
VAFKDVAVEFNQEEWRCLDASQKELYHDVMMENYKNLVCLGKDSFTLSPKICSLEEFNTKPPPEVICTIPVDTVSFWLVFNKPAVISHLEGKEAPWMAEGQVQRNSCP

SEQ ID NO: 34333 - protein, 91 aa, Vombatus ursinus
LTFRDVAVDFTREEWKRLSSAQRDLYRDVMLENYENLVSVGKQGRPMEWPLHWDGFEFPLGKACGEGRGRHLKCFSELLAFVDVGRLQSPL

SEQ ID NO: 34334 - protein, 86 aa, Vombatus ursinus
ITFQDVAVDLSPDEWRGLGPTQRQLYRDVMLENYRNLQAQPGEMGRACNGLETCVHLRSNRVTCGQGPAGERPFECRSCGKRFERL

SEQ ID NO: 34335 - protein, 86 aa, Myotis brandtii
LTFRDVAIDFSQEEWECLDPGQRKLYMDVMLENYSNLASLALSCKDNHAFMPKPGIQDLFSEIILSTHNGDSSYQWIEQWKKFKQE

SEQ ID NO: 34336 - protein, 85 aa, Balaenoptera acutorostrata
VTFEDVAVLFTRDEWRKLAPSQRNLYQDVMLENYSNLVSLGWKNSYKTTKSTQTQGSSFQELIMKRSKRNGPWDFKSEKPCKYED

SEQ ID NO: 34337 - protein, 97 aa, Lynx pardinus
VTFDDVAVTFTQEEWGQLDPTQRTLYQEVMLETCRLLVSLGDNVKPETTEPSPSHLALSEETSPREQRTSRAPGYFQLGQGKSQDRPSEMLEGQLEP

SEQ ID NO: 34338 - protein, 82 aa, Balaenoptera acutorostrata
VIFEDVAVSFSQEEWGLLNDAQRLLYCDVMLENLSLIASLGKDPCSHTIAPYGTLPFLLHDSLCPSQPGPSLDTAYFPDFLA

SEQ ID NO: 34339 - protein, 86 aa, Balaenoptera acutorostrata
QTTGDVAIHFSQEEWGLLDEAQRRLYHHVMLENFALLSALGCWHGAQDEEPSSERGVSIEVSLARTPKPGPSIWNAQPCETCSSLL

SEQ ID NO: 34340 - protein, 105 aa, Cervus elaphus
VPFDDVAVYFSEQEWGKLDEWQKELYKHTMPSPSPRSSPRSNKGRSRAAGVALAPRFQMFPWTRVQVRGVDGRGDSKGSDGPRGGHSQGRHDLLSRESRGKTAML

SEQ ID NO: 34341 - protein, 107 aa, Cervus elaphus
EEWKCLEPAQRDLYREVTLENFGNLVSLGAARKDGCQGLQQWEAVIHSGWRGQGRKHCHWKMVRAQAVEKGWPAAGLSISKPDVVSLLEQGKEPWMVVNDMTGPWCP

SEQ ID NO: 34342 - protein, 90 aa, Macaca nemestrina
VAFEDVAVNFTQEEWALLDPSQKNLYREVMQETLRNLASIGKKWNNQNIEDEHQNPRRNLRRLTKEILSESEESHQHGEVLMQVPDDTLK

SEQ ID NO: 34343 - protein, 104 aa, Ursus arctos
VTFEDVAVDFSRDEWEMLDSAQRRLYREVMRDTCANLAALGALKNQSSDRGIDDGTLSPTQASRATSPSPWAGCPLFLPVVPFHLEPREAMWTGAQRTPQTSCS

SEQ ID NO: 34344 - protein, 88 aa, Ursus arctos
LTFKDVAIEFSQEEWRCLSHTQRELYRDVMLENYRHLLFLGTKPYKSKECGKASTLCSTLPGHHIIHSGEKSYKCKDCDEAFNHLSSL

SEQ ID NO: 34345 - protein, 89 aa, Muntiacus reevesi
VVFEDVAVNFTLEEWALLNSAQKELYRDVMLETFRNLASVDDETQCKANGSISQQDIYGNKISKEHKISKFTGNDSWPFVLGKIWEELS

SEQ ID NO: 34346 - protein, 86 aa, Myotis brandtii
LTFRDVAIDFSQEEWECLDPAQRILYLDVMLENYSNLVSLAILSEDNQAFFQKPKIGDLFPKIILITHTAEKPYKCGECGKAFKRS

SEQ ID NO: 34347 - protein, 123 aa, Oryctolagus cuniculus
VSFADVAVYFSPEEWGCLRPAQRALYREVMRETYGLLGALGESPTRLAPSSGTPSPSPLPRYWGFYTWAGDALGPGSRTRSMGFALVSPSPGGGGTKPALICWVERDAELWGPDAQDPAAAAA

SEQ ID NO: 34348 - protein, 84 aa, Ursus americanus
VTFQDVAVDFTEKEWPLLDSSQRKLYKDVMLENYSNLASVGKAGTLSLLNSLPGLIFYQFVSDWEAPSKSKWSILMEDIFGKET

SEQ ID NO: 34349 - protein, 97 aa, Ursus americanus
MLFEDLAVYFSQEEYVSLHPAQRSFSRDTTQECFEDMALMGGEGKTEISQQLNLESTGFEELAPESSSITVPLVYYPKESHTGVGDPERKVSGGAPA

SEQ ID NO: 34350 - protein, 112 aa, Vombatus ursinus
MSFADVAVYFSAEEWGRLRPAQRALYRDVMRETYGHLGALGEGSGRGGPGRAGAGAGQGRTPIGCVLPSTVSSQLSVHVLGFPGPKPALICWMDEETEVWGPDAQDPEEAGE

SEQ ID NO: 34351 - protein, 87 aa, Propithecus coquereli
VAFEDVAVNFTQEEWALLDHSQKKLYRDVMQETFINLASIGKKWEDQNIEDQYKNQGRNLRSHTAERLCERKEGSQFEETFSQTLNL

SEQ ID NO: 34352 - protein, 99 aa, Saimiri boliviensis
LTFEDVAIYFSEQEWQDLQAWQKELYKHVMRSNYETLISLGRQQAVKSEKTKSHFQLDPLESQCSFGSLLGEREAVSFRSDQGITLGSPQRHDPRAPPP

SEQ ID NO: 34353 - protein, 93 aa, Saimiri boliviensis
LTFKDVAIEFSQEEWRCLDPAQRTLYRDVMLENYRNLVSLGRRCAVSSKTGNNHVTNPLGLTFQLPLPELEIFQGEGKFYECSQVQKFSHSSS

SEQ ID NO: 34354 - protein, 87 aa, Macaca nemestrina
VTFEDVAVTFTQEEWGQLDVTQRALYVEVMLETCGLLVALGDSTKPETVEPIPSHLALSEEVSLQEQLAQGVPGYSYFGQAMDQDGP

SEQ ID NO: 34355 - protein, 87 aa, Macaca nemestrina
VAFEDVAVNFTHEEWALLGPSQKILYRDVMRETIRNLNCVGMKWENQNIDDQYQNLRRNPRCDVVERFGKSKDGSQCEETLSQIRNS

SEQ ID NO: 34356 - protein, 88 aa, Saimiri boliviensis
VTFEDVTLGFNPEEWGLLDIKQKSLYREVMLENYRNLVSVGFPELQLDPKLDPLSAESPLMNIEVVEVLTLNQEVAGPRNAQIQALYA

SEQ ID NO: 34357 - protein, 89 aa, Vombatus ursinus
VTFKDVAVEFTREEWVQLNRSQKKLYRDVMLEKYKSLVSLGRYSKKQEFILERNLINVVCVGVPFGVSQGLLCIREFILERNLMNVVNV

SEQ ID NO: 34358 - protein, 87 aa, Panthera pardus
VVFEDVAVKFTPEEWALLDRGQRKLYRDVMLETCRNLSSVEKQKFHSNGDLTRKQEGLLRSPLVESVCKRIEGDQCGETLNPITSLP

SEQ ID NO: 34359 - protein, 83 aa, Macaca nemestrina
VAFEDVAVNFTQEEWTLLDISQKNLFREVMLETFRNLTSVGKKWKDQNIEYEYKIPRRSFRSLIEEKVNEIKEDSHCGETFTQ

SEQ ID NO: 34360 - protein, 85 aa, Myotis brandtii
VSFEDVAVYFTQNEWDILDPVQRALYREVMLENYANVAFVGGETRIEKEKSAPKEHVAKEPESRRLTLAGLPGNVPQDLDRGSSP

SEQ ID NO: 34361 - protein, 89 aa, Lynx pardinus
VVFEDVAVNFTPEEWALLDRGQRKLYRDVMLETCRNLTAVDCCTQVKTCGSRTQLNILENELSSEEKIVRFTRNDPWALFRENPVFHNI

SEQ ID NO: 34362 - protein, 92 aa, Colobus angolensis
MVFEDVAIYFSREEWGILNDAQRHLHSNVMLENFALLSSVGCWHGAKEEEVLSKQCVSVRVLQVTAPKPALSTLKAQPCKTCSSLLKDLLHL

SEQ ID NO: 34363 - protein, 87 aa, Muntiacus reevesi
VNFKIVTVDFTQEEEGTLSSAQRTLDRDVILENHRDSWDLATALGRRESRLKQSIFDDKLSPSLKIEKLTRDDPWLSSCEEFQDCKE

SEQ ID NO: 34364 - protein, 92 aa, Myotis brandtii
VAFEDVNVEFTMEEWAFLDPSQKKLYTDVMLETFWNLASVACILEEKCEDHDSEDQCEHHEMNLSEEKPYECKQCGKAFRSLKSSRVHERTH

SEQ ID NO: 34365 - protein, 104 aa, Propithecus coquereli
VTFEDVAVDFSPEEWEFLDPAQRKLYKEVTLENYRNLASLEALKNQSTDAGIKDGPFSPAQTPQVTRLSPWFGYSLFRPVEPFHLQQREALWVEEKQIPQASCS

SEQ ID NO: 34366 - protein, 87 aa, Saimiri boliviensis
VTFEDVAVTFTQEEWGQLDVTQRALYVEVMLETCGLLVALGDSTKPETLEPIPSHSALPEEVSLQEQLAQGVPGYSQWGQAMDQDGP

SEQ ID NO: 34367 - protein, 89 aa, Saimiri boliviensis
LTFTDVAIEFSQEEWKCLDPAQRALYKDVMLENYRNLVSLGSSCALGGNAGNKPIKTQLGVSFHLHLSELEIFPDERVINECNQVENFI

SEQ ID NO: 34368 - protein, 83 aa, Colobus angolensis
VTFDDVAVDFTQEEWTLLDPSQRDLYRDVMLENYENLASVGEAATVLCNFCGADTRVPWEVTDTMGLMLVWSFPECGPGAVPH

SEQ ID NO: 34369 - protein, 96 aa, Mustela putorius
KIEDMAVSLIREEWLLDPSQKDPSRDNRPENYRNMFSLGGETRNENRELSSKQVISTGLQPHGETAAKCNGDVIGGLEHGEARDLLGRLERQRGNP

SEQ ID NO: 34370 - protein, 84 aa, Saimiri boliviensis
VTFEDVFVYFSREEWDLLEEAQRFLYRDVMLENFALVATLGFRCEAENEEAPSEQSISVEGVSQVRTAEPGLFQKAHPCELCDP

SEQ ID NO: 34371 - protein, 84 aa, Myotis brandtii
VTFADVTVLFTPEEWMFLDSAQRNLYRDVMLENYRNLASVEPQPQPQESILNQDTFAKIASIGIEREQPLPGEKLYKYNELGEP

SEQ ID NO: 34372 - protein, 87 aa, Saimiri boliviensis
VSFKDVAVDFTQEEWGQLDSPQRALYRDVMLENYQNLLALEWEMKEVPCQQQGMCKEEPAQEPTLEWPVGGAQAWGRQACALQRSQA

SEQ ID NO: 34373 - protein, 98 aa, Saimiri boliviensis
LTFKDVAVVFTEEELGLLDPVQRNLYRDVMLENFRNLLSVADKIHSEMEAGPHEEPSWGQIWKQIASDLVKYEDSMINISQFPKQGDLSCQVRAGLYT

SEQ ID NO: 34374 - protein, 87 aa, Balaenoptera acutorostrata
VAFEDVAVNFTLEEWALLNPSQKKLYRDVMRETFRNLASVGKKWEDHDIEDQYKNQGRKLRSHVVERLCEIKEGSQCAGNFSLIPKL

SEQ ID NO: 34375 - protein, 179 aa, Camelus ferus
VAFGDVAVDFTQEEWRLLSPAQRTLHREVMMETYSHLISLGKPYSEDQEQQQEQLFDQTCLSNKADLQEREEDFKPVCGRESRSRTLEVFSSAPEEQPGAGTRKGVPQPAFMLQGRSAGFQTLAVPEAPFFRLHSSHLHFGDLCSSPGLSISKPNMISLLEQGKEPWLVDREMSDDQYA

SEQ ID NO: 34376 - protein, 83 aa, Propithecus coquereli
VFFEDVAVNFTLEEWALLDSSEKKLYRDVMQETFKNLACIGKKWKDQDTGDDHKNQRRNLRVMVERRCEREKSSQYGKNTSQM

SEQ ID NO: 34377 - protein, 88 aa, Mustela putorius
VAFEDVTVHFSLEEWALLNPSQKKLYRDVMQETLRNLALVGEKWEDRNGKSLYEHHQTNLSKPVVESPCKNKEGSPCEESFSQNPNHK

SEQ ID NO: 34378 - protein, 82 aa, Eschrichtius robustus
FSFEDLSVDFTQKEWQLLDPYQKDLYKDVMLENYSSLVSLEQVLQVNGHITWHKDKQEKLKNMKQDQECDALGKNFNLSMNF

SEQ ID NO: 34379 - protein, 88 aa, Propithecus coquereli
VTFEDVTLGFTREEWGLLDLKQKSLYREVMLENYRNLVSVEYPGPQLSPQLDSLPAENPLMNIEVVEVLTLNQEVAGPRNAQIRALYA

SEQ ID NO: 34380 - protein, 87 aa, Balaenoptera acutorostrata
VTFEDVAVNFTQEEWALLNPSQKKLYRDVMQETLRNLASVGKKWDNHNIEDWYKTQGRKLRSHMVEKLCESKESNQDGETVSQIPNL

SEQ ID NO: 34381 - protein, 96 aa, Vombatus ursinus
VTFEDVAVYFIRKEWKRLDPAQRDLYRDVMLENYGNVFSLDGETRTRNDQDISEAAESHGVILGRFQKDVPSSLKFGEACEWEGNLERHLGNSMEE

SEQ ID NO: 34382 - protein, 101 aa, Balaenoptera acutorostrata
VTFEDVAVYFSQEEWGLLDEAQRLLYRSVMLENFSLMASLGCWCGAEAEDVAPEPGVYVEGVLRANLHQHQKLSSGEKPSRREEGEEGGKVSPASSGLPKH

SEQ ID NO: 34383 - protein, 90 aa, Rhinolophus ferrumequinum
VTFSDVAINFSQEEWACLDSTQRDLYWDVMLENYSNLVSLNLESPFETKNLTTQKGINEINFSKWNSDGKNKSLGLNWMCEGELEGAQGP

SEQ ID NO: 34384 - protein, 89 aa, Vombatus ursinus
MLENYRNLVSLGSVFVKLETDRFVILDLISVLSDQSSSLNSQCRSLKTGKFQIILARGFVVAEPDVISQLEQGEAPWIPEGRFPRSGHP

SEQ ID NO: 34385 - protein, 85 aa, Saimiri boliviensis
VAFEDVAVNFNQEEWALLSPSQKQLYRDVMLETFGNLASVGIHWKDQDIEDLYQNLGIKPRSLVKRLCGRKEGSDHRETFSQIPD

SEQ ID NO: 34386 - protein, 97 aa, Canis lupus
EKIEDMAVSLIREEWLLDPSQKDPNRDNRPENYRNMFSLGGENRNENRELASKQVISTGIQPHGETAARCNGDVIGGLEHGETRDLLGRLERQRGNP

SEQ ID NO: 34387 - protein, 83 aa, Gorilla gorilla
VAFKDVAVNFTQEEWALLDISQKNLYREVMLETFWNLTSIGKKWKDQNIEYEYQNPRRNFRSVIEEKVNEIKQDSHCGETFTP

SEQ ID NO: 34388 - protein, 83 aa, Rhinolophus ferrumequinum
MFIEFSQEEWECLDCAQRALYRDVMSENYRNLLSLGEGNFPPEIGSLPAVFAVKELLPRVDVDEGELHNPLILERNESHSTKD

SEQ ID NO: 34389 - protein, 102 aa, Rhinolophus ferrumequinum
VSFKDVTVEFTQEEWQHLGPAQRALYRDVMLENYSHVVSVANFLPPKEKDWRLDHLEKTQKNQDKYLYQVLFTTNRPLTNEQEKVSGKPFNLGRYIVPSRKM

SEQ ID NO: 34390 - protein, 94 aa, Rhinolophus ferrumequinum
VVFEDVAIHFSQEEWELLDEAQRRLYHRVMTENVALLSAIGWCHGAQDEEAPSEQGDSVGESQVRTPKPDLSTHRAQPCEMCGPLLQDVLRLAE

SEQ ID NO: 34391 - protein, 86 aa, Ursus maritimus
LTFRDVAIEFSPEEWECLDPAQRALYQDVMVENYRNLVSLGEDSFPPEVGSLSAGFAIKELPPIEDNNKGKLYHLVILERNENHGI

SEQ ID NO: 34392 - protein, 94 aa, Ursus maritimus
SLEPFTPMKFSQEEWQCLSHTQRELYRDVMLENYGHLLFLAVSSHGALSFLPEPCKEASFQNVSVGRYKHCVLDKLHLMIDWDHDRKGYVQIET

SEQ ID NO: 34393 - protein, 82 aa, Rhinopithecus bieti
LQFRDVAIEFSLEEWHCLDTAQRNLYRSVMLENYRNLVFLGTHYNTQLIFCIFLVEMGFHAVGKAGLQPLTSDDMPASASQN

SEQ ID NO: 34394 - protein, 85 aa, Gorilla gorilla
VAFEDVAVNFTQEEWALLGPYQKNLYKDVMQETIRNLDCVGKDDVIREDQYKSHRINVRCDMVERFGESKDGSHCGETSSQIGDT

SEQ ID NO: 34395 - protein, 87 aa, Gorilla gorilla
VTFEDVAVNFSLEEWSLLNEAQGCLYHDVMLETLTLISSLGGVPPHRLFPTGACGPQVPSSRIRPSAGHCPRPSLYLSLSPPHPTGV

SEQ ID NO: 34396 - protein, 86 aa, Sapajus apella
MASPSPPPEPKEEWDYLDPAQRSLYKDVMMENYGNLVSLGLTLLPRLECSDTIMPRCSFDLLGLSDQSSCYLSSWDYTFLPPCLAN

SEQ ID NO: 34397 - protein, 83 aa, Sapajus apella
VTFEDVAVYFSWEEWDLLDETQKHLYFDVMLENFVLTSSMGYWRGLEHEEAPSSSVGTDILQRISVKGVPQFRTSEGSSSQNA

SEQ ID NO: 34398 - protein, 86 aa, Oryctolagus cuniculus
VRFEDVAVYFSQEEWRLLNETQRSLYHEVMLENFALVSSLGSLSSLKDKQVRNCRVHLSKKPFVCGEPEKDDPVPLDLIKHQATHT

SEQ ID NO: 34399 - protein, 83 aa, Ursus maritimus
VSFADVAVYFSPEEWGCLRPAQRALYRDVMRETYGLLDALGSRDESGEKEELKKCPKQKEMERDKVSREEWLPSSRPPGARHR

SEQ ID NO: 34400 - protein, 89 aa, Macaca fascicularis
RDVALEFSPEEWECLDPAQRNLYRDVMLENYRNLFSLGEDHFNMQFLFHHKDFIFFHCLAMSKPELIIYLEARKEPWNVNTEKTAKHSA

SEQ ID NO: 34401 - protein, 87 aa, Phascolarctos cinereus
VTLKDVLVDFTEEEWGLLDHSQKELYKEVMLENVQNLLSLDVEIKFKVNEMARKVGIFVEEHDLHRFMSDGPCDFKLGEIHDSNIKP

SEQ ID NO: 34402 - protein, 85 aa, Pteropus alecto
VTFEDVALYFSQEEWLLLEEQQRRLYHDVMLENFVLISSLGCLCGIENEKAPSGQSVSLERMPQMRTPKPDPSIQKAHHCEMCVP

SEQ ID NO: 34403 - protein, 83 aa, Gorilla gorilla
VAFEDVAVNFTQEEWTLLDISQKNLFREVMLETFRNLTSIGKKWNDQNIEYEYQDPRRSFRSLIEEKVNEIKEDSHCGETFTP

SEQ ID NO: 34404 - protein, 96 aa, Gorilla gorilla
VVFEEVAVNFTPEEWALLDHAQRSLYRDVMLETCRNLASLDCYIYVRTSGSSSQRDVFGNGISNDEEIVKFTGSDSWSIFGENWRFDNIGDQHQIP

SEQ ID NO: 34405 - protein, 102 aa, Macaca fascicularis
RHQTHNSWSLRYEEWSHLVPIQRDLYKEVMLENYNSIVSLETKPEIHDASDEKSEGSLRECLGRQSPLCPKFEVYAPDGRMGTEKQSPSGETHKKSLSREKG

SEQ ID NO: 34406 - protein, 87 aa, Phascolarctos cinereus
VTFKDVVVDFTEEEWRLLDHSQKELYKEVMQENVQNLLSLGVETRLEVNEMRRNLGFFVEQRDLHRFMSDGPCGFNWREIHDSNIKL

SEQ ID NO: 34407 - protein, 99 aa, Oryctolagus cuniculus
VTFQDVAVVFSEEELRLLDAAQRALYRAVMLENFRNLLCVGGADQRTLGRTQELGLSSLPPAGLSRQTWRAAAGDLPKCPESVESFQGKNSQSQEQSDC

SEQ ID NO: 34408 - protein, 106 aa, Canis lupus
LSFDDVAMYFTREEWNRLDWAQKDLYRDVMLENYRNMILLEVRDAYSIPPPQSASSTSIRPVAAEKIMTDLDSKGFQFPKPEVIYLLEQWEEPWILDLPRAGTRKA

SEQ ID NO: 34409 - protein, 113 aa, Gorilla gorilla
VTFEDVAVYFTQNEWASLHPTQRALYREVMLENYANVTSLYPTAGGFPLDTERTEKVPGALSSFLPSSSSLELILALLPMSAFPFPKPDLIFQLEQGEAAWGPDPWTLAGGEA

SEQ ID NO: 34410 - protein, 86 aa, Ailuropoda melanoleuca
VAFEDVTVKFTMEEWALLDPSQKKLYRDVMQETFRNLASIGRDDDILTCSINDVVLIFYSSQMVERLCKSKEYSQYEEIFSQIPYH

SEQ ID NO: 34411 - protein, 86 aa, Gorilla gorilla
LTFMDMAIEFSLEECQCLDTAQRNVYRHVMLENYRNVVFLAVALTFDLSGLNILSFQSILPFVSALYVMGNRNQCLQKHLEARNKD

SEQ ID NO: 34412 - protein, 87 aa, Sapajus apella
VTFDDVAVEFTPEEWALLDTTQKYLYRDVMLENYKNLASVEWEIQPRTQGLSLHQSFLKNEIFSAIQMQTSYSGWKLCKNCGEVFSE

SEQ ID NO: 34413 - protein, 104 aa, Ursus maritimus
VTFEDVAVDFSQDEWEMLDSAQRRLYREVMRDTCANLAALGALKNQSSDRGIDDGTLSPTQASRATSPSPWAGCPLFLPVVPFHLEPGEAMWTGAQRTPQTSCS

SEQ ID NO: 34414 - protein, 85 aa, Phascolarctos cinereus
VTYKDVAVDFTPEEWGLLDHAQKELYKTVMLENAQTLLSLVPREDLISHFEQGGLRNCCPDTENRLDVKEMSAHLKVTPWNNYSQ

SEQ ID NO: 34415 - protein, 89 aa, Phascolarctos cinereus
VMFEDVAIYLTQDEWGHLGPAQRGLYKDVMLENYENLVSLDGETRSRNNELPPNQGIYEKVESQYMTLEILRGDIPQFLKFREVYKYEC

SEQ ID NO: 34416 - protein, 92 aa, Oryctolagus cuniculus
VTFEDVFVYFSPEEWELLEETQRFLYRDVMLENFALVATVDCWCGADNEEASSEDNSVEGVSQVTTPESGPFIQRAPPCEMCSPLLKDVSHL

SEQ ID NO: 34417 - protein, 90 aa, Myotis lucifugus
VTFSDVAIDFSQEEWACLDSTQRDLYWDVMLENYSNLVSLDLESPHETKNLPTEKGICEMRFSKWNSDGKSKSLGLDWVCEGELVGARGP

SEQ ID NO: 34418 - protein, 84 aa, Sapajus apella
VAFEDVAVNFTQEEWALLGPSQKSLYRDVMWETIRNLDYIGMKWEDTNTEDQHKNPRRSLRCHIVERFRESSQISDSIVVEKTP

SEQ ID NO: 34419 - protein, 86 aa, Oryctolagus cuniculus
MTFDDVALYFSEQEWEILQKWQKEMYQQVMKANYETLDSLDNQGPLRTREEGCHLNGLQKQDLCATLPGNERRDLCDQRATLQSPS

SEQ ID NO: 34420 - protein, 83 aa, Ursus maritimus
FKDEVTSVPSTVESQFLLNSVGMAVSFSAPVFLLYPSAGLITKELSLNSWDGCQLSKPDVISQLEKGEEPWLIEREISGSPGS

SEQ ID NO: 34421 - protein, 95 aa, Phyllostomus discolor
LTFRDVAVDFSQEELEFLDPAQWKLYTDVMLENYRNLVSLDLSALSSEDYQALLQKPGIEDLISEVILSPYNEDGSYQCHEDWKIFNHKSNLKHQ

SEQ ID NO: 34422 - protein, 89 aa, Macaca fascicularis
LTFRDVAIEFSQAEWKCLDPAQRALYKDVMLENYRNLVSLGSSYALGSNAKDKPIKKQLGVSFHLHLSELELFPDERVINGCNQVENFI

SEQ ID NO: 34423 - protein, 85 aa, Pteropus alecto
VTFADVAVLFTPEEWMFLDSAQKSLYRDVMLENYRNLASVEPQLQPQQVVLNQGIFAEMPSTVMKREQPPLGEKLYKYNELGKPF

SEQ ID NO: 34424 - protein, 107 aa, Rhinolophus ferrumequinum
LTFRDVAIEFSQEEWECLDPAEQKLYMDVMSENYRNLLSLDISTSCVVKESSPKEDVNNGELFQTLILERQVSHDLNDFDFGEVQENMHQVENQWVYEENNNEGVTT

SEQ ID NO: 34425 - protein, 113 aa, Ursus maritimus
LTFRDVAIEFSQEEWGCLNLVQRELYRDVMLENYGNLLFLGADNFLPDFPNHTQGFLPSLEDRLLEDSSLHDWNSDRCSKGSLVVSKPDLVIFLEQKRELWDVKGKETVAIHP

SEQ ID NO: 34426 - protein, 82 aa, Canis lupus
GGFSSAAVVSREDGPGCSGCCGRAPAGGRGRCTLTVIHTLPGPAEDDHIPGYSIDKPEVILKLEQGEEPWILEEAFPSQSDP

SEQ ID NO: 34427 - protein, 83 aa, Gorilla gorilla
LTLEDVAVDFTWEEWQFLSPAQKDLYRDVMLENYRNLVAVGEDSCPVSLRWCPVSGLPFSAAYLQKIDDPLQHHLQNQSIQKS

SEQ ID NO: 34428 - protein, 91 aa, Phyllostomus discolor
VALEDVNVKFTMEEWAILNPTQKKLYRDVMQETFRNLASVACILEEKWEDHDSEDQYEKHGTNPSSHTVERLYKRKEDSQCRETFSQISNH

SEQ ID NO: 34429 - protein, 89 aa, Panthera pardus
VTFEDVALYFSWEEWDLLDEDQRCLYHDVMLENFALTSSLGCGHGVDDEEVPLEESISVGVSQIRTLEADSSPQEAQPFEMHGPILRNI

SEQ ID NO: 34430 - protein, 82 aa, Gorilla gorilla
VTFEDVAVYFSQEEWELLDAAQRHLYHSVMLENLELVTSLGNALSQHGDDYLISGEADLPNCFPNWLHHFTPLSAVYKCSSC

SEQ ID NO: 34431 - protein, 104 aa, Ailuropoda melanoleuca
VTFEDVAVDFSRDEWEMLDSAQRRLYREVMRDTCANLAALGALKNQSSDRGIDDGTLSPTQASRVSSPSPWAGCTLFLPVVPFHLEPGEAMWTGAQRTPQTSCS

SEQ ID NO: 34432 - protein, 87 aa, Puma concolor
VVFEDVAVNFTPEEWALLDHGQRNLFKDVILETCRNLSSVEKRKFHSSGDLTQMQEGLLSSPLLESVCERFEGDQCGETLNSITSLT

SEQ ID NO: 34433 - protein, 97 aa, Sapajus apella
LTFKDVAVVFTEEELGLLNPVQRNLYRDVMLENFRNLLSVDKIHSEMEAGPHEELSWGQIWKQIASDLVKYEDSMINISQFPKQGDLSCQVRAGLYT

SEQ ID NO: 34434 - protein, 84 aa, Rhinopithecus bieti
VTFRDVAVIFTEAEWKRLSPEQRNLYKEVMLENYRNLLSLDRVSLLLPRLECNGAISAHHNLCLSGSRDSPASASQVAGITAEP

SEQ ID NO: 34435 - protein, 90 aa, Panthera pardus
VVFEDVAVDFTLEEWALLDSAQRKLYRDVMLENLKNLAAVDDETQLKANGSVSQQDAYGNKISKENKLAKFTRNESWASVLGKIWEELST

SEQ ID NO: 34436 - protein, 82 aa, Myotis brandtii
VTFSDVAIDFSQEEWACLDSTQRDLYWDVMLENYSNLVSLGSQCKDCGKAFICGSSLAQHKRIHTGEKPYECKDCGKAFICG

SEQ ID NO: 34437 - protein, 83 aa, Rhinolophus ferrumequinum
LTFRDVSIDFSQEEWECLHPADRKLYMDVMLENYRNLCSLGEGDFLPELLPHRRVVFPSSVQCLLGASDTLDLLPNPSIGDSF

SEQ ID NO: 34438 - protein, 87 aa, Macaca nemestrina
LQFRDVAIEFSLEEWHCLDIAQRNLYRDVMLENYRNLVFLVICSHFAQDVWSEQSIKDSFQKVILRRYEKCGHDNLQLKKGCESVDE

SEQ ID NO: 34439 - protein, 93 aa, Macaca nemestrina
VAFEDVAVNFTQEEWALLGPSQKNLYRYVMQETIRNLDCIRKIWEGQNTEDQKKNPRRNLRCHMLERFSESKDRSQCGETFSLIRGSIVNNSI

SEQ ID NO: 34440 - protein, 101 aa, Macaca nemestrina
LTFRDVAIEFSQEEWKCLDPAQRTLYRDVMLENYRNLVSLEFQSVTQAKVQWCHLGSLQPPIPRFKQFSCLSLPSSDYRYLFQMHVEDVVINRARQYRSHP

SEQ ID NO: 34441 - protein, 86 aa, Ursus americanus
VTFEDVAVDFTPEEWQYLNPPQKTLYREVMLETYSNVVSVGKNGFLGYHCHFSLAGPQATKPDLVLKLEVEEPCPAETKISFWSFP

SEQ ID NO: 34442 - protein, 93 aa, Myotis brandtii
LTFRDVAIDFSQEEWECLDPLQQKLYLDVMLENYSNLASLVMSSEDDQAFMPKSGIQDLFSEKILGRIHTIAKFCKLREDGKGFSQFSRHTQH

SEQ ID NO: 34443 - protein, 91 aa, Myotis brandtii
VTFDDVAVYFSLEEWGLLDEAQRRLYHEVMLENLALASSLGKTLTVSPGRGLGSALPPPPFPEAALWTPHAPLWTPGPALFSLLQPQYLLL

SEQ ID NO: 34444 - protein, 86 aa, Propithecus coquereli
LTFRDVAIEFSQEEWKCLNPAQRALYRDVMLENYRNLASLGEKNVFQRISLCCPAILLPQPQKPMGIYILNYRQQGKVLQEKYSTH

SEQ ID NO: 34445 - protein, 87 aa, Propithecus coquereli
VSFEDVAVNFTQEEWTLLDPSQKTLYRDVMCETFNNLACIGKKWNDQDIDDDHKNQGRNLRGHVVERLCKSKEGHQYGKSTSQISNL

SEQ ID NO: 34446 - protein, 84 aa, Saimiri boliviensis
LTFKDVAIEFSQEEWRCLDPAQRTLYRDVMLENYRNLVSLESSSELGSSTGNKCLKNQLGLTFQLHLSELKLFQAERNISGCKH

SEQ ID NO: 34447 - protein, 87 aa, Pteropus alecto
VTFKDVAVVFTEEELGLLDAAQRKLYRDVTLENFRNLVSVGEDGRPLSPSVSLPGCLCAQLFEALGLLKSFSEPGHLRVLIIPVQHK

SEQ ID NO: 34448 - protein, 94 aa, Rhinopithecus bieti
MVFEDVAIHFSQEEWGILNDVQRHLHSDVMLENFALLSSVGCWHGAKDEEAPFKQCASVGVSQITILKPALCTQEAQPCETCSSLLKDILHLAE

SEQ ID NO: 34449 - protein, 84 aa, Ursus americanus
VVGCQCASRCAEHLGRCGPGGTPSMLGSVVPAPYRSRAPAGGWSDPLFFGGAGIPFSKPKLISQLEQGKETWREERTCPPATCP

SEQ ID NO: 34450 - protein, 82 aa, Myotis brandtii
VAFEDVAVYFSRKEWRLLDETQRRLYLEVMLENFALVSSQGYASTFVVVSHHVATSIPLTSRDRGNERGREKNRMIAAESLA

SEQ ID NO: 34451 - protein, 86 aa, Panthera pardus
LTFRDVAIEFSQEEWECLDPAQRALYRDVMLENYRNLVSLGEDNFPPEVRSTSAGFAIKELSPTEDINKGEFSHLVLLERNESHGI

SEQ ID NO: 34452 - protein, 90 aa, Muntiacus reevesi
VTFKDVAVAFTEEELGLLDSAQRKLYQDVMVENFWNLVSVDTKHIEREERLWMMNSLSPVHISQFSVVIDENNQSELRAVQERGLHEELS

SEQ ID NO: 34453 - protein, 104 aa, Muntiacus reevesi
VTFKDVAVDFSMEEWELLDPGQRKLYRDVMLETCGNLASVEALRNQRPNSGFEDGTICLASASQVTTLSLWTAYSLFQPVVSLHLEQGEAMWMAGKGTLRASCS

SEQ ID NO: 34454 - protein, 84 aa, Panthera pardus
VVFEDVAIHFSQEEWGLLDGAQRLLYRAVMMENLALLSSLGCWHGAQDEEASPVRTPKPDSSVQEAQCEKDMLPSAEQDGMYSD

SEQ ID NO: 34455 - protein, 90 aa, Macaca nemestrina
VAFEDVAVNFTQEEWALLGPSQKSLYRNVMQETIRNLDCIETKWEDQNIGDQCQNPRRNLRSHTCEIKNDSQCGETFGHVPDSIVNKNTP

SEQ ID NO: 34456 - protein, 98 aa, Pteropus alecto
VTFRDVAVDFTQEEWGQLGPAQRTLYRDVMLETFGHLLSVGKALFPSQQSDSCSDSLFTVVGYGVSGPELPKPEVISQLEQGAELWVAERGIARGSRA

SEQ ID NO: 34457 - protein, 87 aa, Muntiacus reevesi
VTFEDVAVNFTLEEWAFLDPSQKKLYRDVMRETLRNLISIGEKWEDHDIEDQYKNQGRKLRSHVVERLCESKEGSQCGENFSIIPNL

SEQ ID NO: 34458 - protein, 89 aa, Rhinolophus ferrumequinum
VTFKDVALNFTKEEWALLDPEQRTLYRNVMLENYRNLASIDGQHNTKGPVPQQDILAEKTFHAASRVCLISNSSQPSTLEDLECHQTEE

SEQ ID NO: 34459 - protein, 132 aa, Ursus maritimus
LTFEDVAMYFSQEEWELLDPTQKALYNDVMWENYETVISLAVPVHQILAFSEKTNTKDWTVAPELILPESQEEWELLDPTQEALYNDVMWENYETVISLALFVLPKPKVISYLDHEEEPWVQGPLEFKNSPG

SEQ ID NO: 34460 - protein, 92 aa, Muntiacus reevesi
VTSEDMAVCFTQNQWASLDSAQRALCREVMLGNYANIDSLLERGEAPGDPNPWEAEVLRGNCTVTWEDPPTFFPFGELHAASKCQMGIQTGS

SEQ ID NO: 34461 - protein, 84 aa, Sapajus apella
VTLEDVAVYFSQEEWGLLDEAQRLLYRDVMLENFALLTSLVCWHGIEDEETPEQSVSVKGVSQVRTPEASPSIQKTQSCDMCVP

SEQ ID NO: 34462 - protein, 87 aa, Pteropus alecto
VAYEDVAVTFSLEEWALLDPSQKKLYRDVMQETFCNLASVGKKWEEYDTGDQYKNQRRKLRSQLVEKVCESKEVSQCGENFSLISNF

SEQ ID NO: 34463 - protein, 89 aa, Ursus maritimus
VNFKIVTVDFTQKEEGTLNPGQRTLDRDAILENHRDLVSWDLATALGRRESTSKQNIFDDEPSHRVKLERLTRDDPWLSSCEEVQDCKD

SEQ ID NO: 34464 - protein, 83 aa, Rhinopithecus bieti
VTFEDVAVNFSLEEWSLLNEAQRCLYRDVMLETLTLISSLGGKVPPHRLFPTGACGPQVPSSRIRPSSGHCPRPSLYLSFSPP

SEQ ID NO: 34465 - protein, 90 aa, Rhinolophus ferrumequinum
VTVKDEEMDFTQVEEEQLNSAQRYMGMDMKVENCGSLVFWDSESVSETKNSLSKQEVYEEISSERELIIERLKKDDSWDSRLIEAWECEG

SEQ ID NO: 34466 - protein, 94 aa, Rhinolophus ferrumequinum
VSFKDVTVEFSQEEWQHLGPAQRALYRDVMLEIYSHLVSVEDYRRGLLEDSQVNQDKYLCQVLFTTNRPVTTQQEKVSGKPFNLDTDIIPSRIL

SEQ ID NO: 34467 - protein, 86 aa, Panthera pardus
LTFRDVAIEFSQEEWECLDPAQRSLYRDVMLENYRNLVSLGEDNFPPEVGIPSDGFAIKELSPTEDINKGEFYHLVILERNGNHGI

SEQ ID NO: 34468 - protein, 87 aa, Oryctolagus cuniculus
VAFEDVAVNFTQEEWALLDPLQKKLYRDVMQETFRNLASIGKKWEDSNTEDQYKSQGRNLRSHIIERLCEKKESSPSGEPYSRTPNR

SEQ ID NO: 34469 - protein, 83 aa, Rhinolophus ferrumequinum
LTFRDVSIDFSQEEWECLHPADRKLYMDVMLENYRNLCSLGEGDFLPELLPHRRVVFPSSVQCLLGASALCDRVSNPGSEEQT

SEQ ID NO: 34470 - protein, 94 aa, Panthera pardus
VVFTDVAVCFSQEEWGLLDEAQRRLYHSVMLETFALLSSLGCWHGAQDEEAPSGHSVSVGASQVRTPKPGPSVREAQPCETCSSLLKDLLRLAE

SEQ ID NO: 34471 - protein, 90 aa, Ursus americanus
WEMLDSAQRRLYREVMRDTCANLAALGALKNQSSDRGIDDGTLSPTQASRATSPSPWAGCPLFLPVVPFHLEPGEAMWTGAQRTPQTSCS

SEQ ID NO: 34472 - protein, 90 aa, Ursus maritimus
VMFRDVAVDFSQEEWECLNPYQRNLYRDVILENYSNLVSVDLESRYDTKKLFQEKDIYEMNLSQWEIMGRIRSCGLEDSFVRKDYKYKKF

SEQ ID NO: 34473 - protein, 82 aa, Ailuropoda melanoleuca
LTFRDVAIEFSQDEWECLDPAQRALYRDVMVENYWNLMSLGEDSFPPEVGNYSGFTIKELPPIEDNNKGKLYHLVILERNEN

SEQ ID NO: 34474 - protein, 99 aa, Lynx canadensis
LTFRDVAIEFSRKELGCLNHSQWELYRDVMLENYGHLLFLGEDNSFHIAQTTLRDLFLPLKTVSWNLPLCMTGIQIPAVRERSRGLWMYRKISMVFPFQ

SEQ ID NO: 34475 - protein, 83 aa, Rhinopithecus bieti
REDPGTSESQEMEEWALLDIFQKNLYREVMLETFRNLTSIGKSWKDQNIEYEYQNPRRNFRSLIEEKVNEIKEDSHCEETFTQ

SEQ ID NO: 34476 - protein, 93 aa, Ursus maritimus
LTFRDVAIEFSPEEWECLDPAQRALYRDVMVENYRNLVSLGEENVPPAVGGSALGFHCIFPLFASWELRKMSLLQWGVCPWVSLHFSLVCLLG

SEQ ID NO: 34477 - protein, 118 aa, Ursus maritimus
VSFKDVTVEFTQEEWQKIGPAQRTLYRDVMLETFSHLVSVDYRICRHRVVDSILHYILISTRSVVMPRLTFLMKQGDIFSLLFFWPRYCYTKPEVILRLEQAEDPCLLEKEFLTRNSS

SEQ ID NO: 34478 - protein, 87 aa, Ursus arctos
VAFEDVAVNFTLEEWALLDPSQKKLYRDVMRETLRNLASIGKKWKDHNIEDQYKNQGRKLRSHMVEMLCQSKEGSQCGGNFSPIPNL

SEQ ID NO: 34479 - protein, 96 aa, Ursus arctos
VTFEDVAVHLTREEWGCLDPVQRDLYREVMLENYGNVVSLGILLRLPTTRIHSVNSCPALSHTQASAFSGETLAVLSAGISKRWPKYRLPIDIAHP

SEQ ID NO: 34480 - protein, 93 aa, Ursus americanus
MNFEDVAIDFSQEEWGLLDETQRLLYCDVMLENFALVASLGKIVTLLLAGLSQQKIHPCETCIPALKDILHHAEHQTISPWQKPYLGTTCMRC

SEQ ID NO: 34481 - protein, 104 aa, Panthera pardus
VTFEDVAVAFSREEWALLDPAQKRLYREVMLETYRNLAALETLKTRSAGAGIEFGVLSAAQASQAAGPSPWVGGSLFLPVVPFQLEQGAAVWMGGEGTPQTSCS

SEQ ID NO: 34482 - protein, 89 aa, Ursus arctos
IAFQDVVVDFSQEEWEQLSPGQKALYWDVMLENYRNLVSLGICSFENFISDWGTGPDNRIPSKHNISEKSPQKKGLWNMNFIKACKEDS

SEQ ID NO: 34483 - protein, 94 aa, Muntiacus reevesi
VTFEDVAVYFSWEEWALLDEAQRCLYHDVMLENFALTSSLGCWHGVEDKEAPSEQSICIGVSQIRTLKADSSLQKGQSFEMYGPVLREILHFPE

SEQ ID NO: 34484 - protein, 87 aa, Gorilla gorilla
ISLEDVAVNFTLEEWALLDPGQRNIYRDVMRATFKNLACIGEKWKDQDIEDEHKNQGRNIRSPMVEALCENKEDCPCGKSTSQIPDL

SEQ ID NO: 34485 - protein, 86 aa, Lynx canadensis
LTFRDVAIEFSQEEWECLDPTQRALYRDVMLENYRNLVSLGEDNFSPEVGSPSAGFTVKELSPVENINKGEFYHLIILERNESHGI

SEQ ID NO: 34486 - protein, 92 aa, Puma concolor
VAFEDVTVNFTLEEWALLNPSQKKLYRDVMQETFRNLASVDKWEDRNSKSLYEHETNRRHMLSHTGHKLYEYQEYEEKPYKCKECGKAFKHR

SEQ ID NO: 34487 - protein, 114 aa, Rhinopithecus bieti
VTFEDIAVYFSQEEWGLLDEAQRCLYHDVMLENFSLMASVGCLHGIETEEAPSEHTISAQGVSQARTPKPGPSIPNAHSCEICILVMKDILYLTEHQGTLPWQKPYTSAASGKW

SEQ ID NO: 34488 - protein, 93 aa, Panthera pardus
VTFEDVAVNFTLEEWALLDSSQKKLYRDVMRETFRNVASVEKKWKDHDTEYRCKTQGRKTGSPTVGKPCESKEGRQWEETISQIPDVNLNKKT

SEQ ID NO: 34489 - protein, 97 aa, Macaca nemestrina
VTFEDVAVDFTQEEWTLLDQTQRNLYRDVMLENYKNLVAVDWESHINTKWSAPQQNFLQGKTSSVVEMVRFRRYNLLPSMLEEDWKFRKMEKPVFHP

SEQ ID NO: 34490 - protein, 89 aa, Ursus arctos
VNFKIVTVDFTQKEEGSLNPAQRTLDRDAILENHRDLVSWDLATALGRRESTSKQNIFDDEPSHRVKLERLTRDDPWLSSCEEVQDCKD

SEQ ID NO: 34491 - protein, 106 aa, Macaca nemestrina
VTFEDVAVTFTQEEWGQLDAAQRTLYQEVMLETYGLLVSLGKSYYQLDRREHYDCKKRTLSQSDNTKPKTTEPSFFHLALPEEVLLRERLTQGVSKDSQLGQAKDQ

SEQ ID NO: 34492 - protein, 97 aa, Muntiacus reevesi
MTFEDVAVNFTREEWALLDTAQRQLYRDVILETCGHLACVDWATRHQTKDSTPQQNNLAKRTFQEVNRAHLASSSSRLSGLREDWMSHRIEVPGKQR

SEQ ID NO: 34493 - protein, 84 aa, Oryctolagus cuniculus
VNFEDVFVHFSQEEWGLLDEAQRLLYRDVMLENFALTASLGCSCGIAHKETHFENGVPREGVSQIRTSKGGFLIQNAHHQMCGL

SEQ ID NO: 34494 - protein, 95 aa, Pteropus alecto
VTFKDVAVIFTEEELGLLDSAQRKLYRDVMLENFKNLVSVGGKIQHDPETVPEEPNEELSCWQIWQLIVADLIRCQDSIITSFQFPRQGDSPSQV

SEQ ID NO: 34495 - protein, 151 aa, Pteropus alecto
GTFEDVAVYFSREEWEFLDEAQRHLYHSVMLENLALVASLGAITHAPEAFSRRLGASAQLADSVQISGTSMLRFCPLLLSDISRSLAVPWTADNDMVTGLFLVGCLELGQPLTHPIFLPGPASPKSCVVAHLEQGKDPWVPDREDVSPATA

SEQ ID NO: 34496 - protein, 93 aa, Pteropus alecto
VAYEDVAITFTLEEWALLDLSQKKLYRDVMWETFRNLASVGEKWKDRDIEDQYKKQGKKLRSHMVERISEEKEGSQGREIFTLNSDLNLNEKT

SEQ ID NO: 34497 - protein, 82 aa, Panthera pardus
VMFRDVAIDFSQEEWECLDSAQRDLYRDVMLENYSNLVSLVDLPSRNANKDLSPKKDTYETELSQWEMSARLENCDLEESSS

SEQ ID NO: 34498 - protein, 97 aa, Panthera pardus
EKIEDMAVSLIREEWLLDPSQKDLHRDDRPENYRNMFSLGGETRSENRELASKQVISTGIQPHGETAAKCNGDVIGGHERGEARDLLGRLERQRGNP

SEQ ID NO: 34499 - protein, 87 aa, Macaca nemestrina
LQFRDVAIEFSLEEWHCLDTAQRNLYRNVMLENYRNLVFLVLCSHFTQDLWPEQNIKDYFHKGILRRYEKCGHDNLQFKKGCESVDE

SEQ ID NO: 34500 - protein, 83 aa, Macaca nemestrina
VAFEDVAVNFTQEEWALLDPSQKSLYRDVMQETFRNLASIGNKGKDQSIEDQYKNSSRNLRHIISHSNNPYGCEECRKKPYTC

SEQ ID NO: 34501 - protein, 89 aa, Rhinopithecus bieti
VTFRDVAIDFSQEEWECLDPAQRDLYVDVMLENYSNLVSLGKMKEKSKTLGLEASIFRNNWKCKSIFEGLKGYQEGYFSQMIISYEKIP

SEQ ID NO: 34502 - protein, 87 aa, Macaca nemestrina
VVFEDVAIYFSQEEWGHLDEAQRLLYRDVMLENLALLSSLGCWHGAEDEEAPSQQGFSVGMPEVTTSKSYLSTQKVYPSETCDPPLK

SEQ ID NO: 34503 - protein, 88 aa, Macaca nemestrina
VVFEDVAVDFTLEEWALLDSAQRNLYRDVISVSRFEMWERTKQDTYREEKSKEQTIPNFTRNNSCAYTLEKTCEGYGTEDHHKNLRNR

SEQ ID NO: 34504 - protein, 86 aa, Ursus americanus
VTFKEVAMYFTNQEWQCLGPHQRQLSWAVTLENYGDMASLGEDYRRPSLPEVLRLKVEGRGGVSSLSEWCGGEWCGERPVGLLRRP

SEQ ID NO: 34505 - protein, 90 aa, Pteropus alecto
VVFEDVAVDFSQEEWALLDAAQRELYREVMLETCQNLASVDDETQFKVNGSVPQQNIYRNKISKEDKTAKFTRNDSWVSVLGKIWEELSI

SEQ ID NO: 34506 - protein, 83 aa, Ursus maritimus
MAFEDVAVYFSQEEWELLDAAQRALYCHVMLENFALVASLGKALGSPWEAQLSPALTPCLLLAREQPHTSWPRVPVPLWSLCV

SEQ ID NO: 34507 - protein, 85 aa, Macaca nemestrina
MASPSPPPESKEEWDYLDPAQRSLYKDVMMENYGNLVSLGLTVLLRLVCSDANMACCSLNLLGLSDQSSNLSYLSSWDYRCFEQR

SEQ ID NO: 34508 - protein, 83 aa, Ursus arctos
VSFADVAVYFSPEEWGCLRPAQKALYRDVMRETYGLLDALGSRDESGEKEELKKCPKQKEMERDKVSREEWLPSSRPPGARHR

SEQ ID NO: 34509 - protein, 106 aa, Ursus maritimus
LTFRDVAIEFSPEEWECLDPAQRALYRDVMVENYRNLLSLDISTRCVSRELSPKEDINNGELLQTLISERHISHEFDDFDLRKIQDVNKFESQWLFQEKNYEEDTA

SEQ ID NO: 34510 - protein, 97 aa, Panthera pardus
LTFRDVAIDFSQEEWECLDPAQRALYRDVMLENYRNLVSLGEDNFSPEVGIPSDGFAIKELSPTEDINKGKFYHLVILERNESYGIKDFDLQESCEN

SEQ ID NO: 34511 - protein, 90 aa, Balaenoptera physalus
VTFVDIAVYFSEDEWKNLDEWQKELYNNLVKENYKTLMSLASLAAAAAAAAAAAAAAAAAPVSKPDAPPQAEPREEPCVWEQRDPEEREI

SEQ ID NO: 34512 - protein, 105 aa, Pteropus alecto
VSFEDVTIDFSREEWQQLDPAQRHLYQDVMLEICSHLFSVGEHTCPGNLDGPWESGRAPQGPVLPCGTQWAISRYHVPNPEVIFRMEKEARLPHRRCQEEEFGLE

SEQ ID NO: 34513 - protein, 87 aa, Ursus maritimus
ITFEDVAMDFTQEEWALLNSPQRKLLHEGIHSRDKPYKCDQCSKTFSRSSRLTMHKIIYTREKLYACNDCGKTFCILSYLTSHCGKA

SEQ ID NO: 34514 - protein, 86 aa, Panthera pardus
VTLKDVVVTFTQEEWELLDLPQRTLYWRVMRETCGLLLSLGDEAKTRTTEPSASQSAVFEGYLSHRLPTQEDSGVSMLGEAREQEE

SEQ ID NO: 34515 - protein, 88 aa, Macaca nemestrina
VNFEDVTLGFTPEEWGLLDLKQKSLYREVMLENYRNLVSVEYSELQLNPKLDPLPAESPLMNIEVVEVLTLNQEVAGPRNAQIQALYA

SEQ ID NO: 34516 - protein, 94 aa, Ursus arctos
VVFTDVAIHFSQEEWGLLDEAQRSLYHSVMLENLALLSSLGCWHGARDEEAPSEQGVSVGGSQVRTPKPAPCIQKSQPWETWSLLLKDLLRLAE

SEQ ID NO: 34517 - protein, 84 aa, Pteropus alecto
LTFKDVFIEFSPEEWECLDPAQRALYRDVMAENYRNLLSLEKPYKCSDCGKAFSKSSQLMNHERIHSGQRPYKCNECGKDFMLH

SEQ ID NO: 34518 - protein, 86 aa, Ursus maritimus
VTFADVAVLFTPEEWMFLDSAQRSLYRDVMLENYRNLRIHAGGDPYECHETFRYSSDLSRHEKTHTAEKCFECQECRQAFKYSSNL

SEQ ID NO: 34519 - protein, 115 aa, Macaca nemestrina
VTFEDVAVYFSQEEWRLLDETQRLLYRNVMLENFSLLASLGCWHGAEAEEAPEQSASVGLCSSNVQQHQKQHCGEKSLKRQEGRVPVLRSCKVQVSEKSLQSWEVGKDLPTSSVI

SEQ ID NO: 34520 - protein, 87 aa, Muntiacus reevesi
LTFKDVAMVFSKEELALLDSAQINLYQDVMLENFRNLVSVEDRILNPNLMNLQGKGLSYLSPEVISELIVSHDYVIMNLQGDCPQYL

SEQ ID NO: 34521 - protein, 82 aa, Muntiacus reevesi
VTFEDVAVDFTQEEWSLLDMSQKNLFRNVMVETVTHLVSVGDWNKGKSCGVKQQTSKVRQVSHPQGDPAGCADLREEITPTS

SEQ ID NO: 34522 - protein, 89 aa, Pteropus alecto
VMFEEVSVCFTSEEWACLGPIQRALYWDVMLENYGNVTSLEWETMTENEEVTSKSSIPQRADSQKGTSKRLQGGIPQVLDFEKERKWQV

SEQ ID NO: 34523 - protein, 85 aa, Rhinopithecus bieti
DVAVNFTQEEWALLDSPQKNLYREVMQETCRNLASRLCESKKGSQYGQVVSQIPNLDLNENTSTRLKQCEFSICGKVFVCLSLLN

SEQ ID NO: 34524 - protein, 84 aa, Ailuropoda melanoleuca
VTFEDVAVYFTQTEWDGLSPAQRALYRDVMLENYGNVASLEKHNTSFELQRDFSEETDFSEACILEKQQEVHLVGSMKKEKSSV

SEQ ID NO: 34525 - protein, 88 aa, Phyllostomus discolor
DTFKDISIYFTRGEWEVMGDWEKSQYRNVKRSYCGFISRGFCFFPCLRAPQAAFMCQRMPATKPPMDKSEDSDEEWTPRQQGEEKSPP

SEQ ID NO: 34526 - protein, 91 aa, Myotis lucifugus
VAFEDVAVNFTLEEWALLDPSQKKLYRDVMRETLKNLASIGRKLEDHNIGDQDKNQGRNLRHMVERDCESKGSQYGENFNLISNLNLNKKT

SEQ ID NO: 34527 - protein, 84 aa, Oryctolagus cuniculus
VTFQDVAVVFSEEELRLLDTAQRALYRAVMLENFRNLLSVGEDGRARILGVTLCSDLVCPGIKRAHRGERRCKCAECGKEFSQS

SEQ ID NO: 34528 - protein, 92 aa, Rhinolophus ferrumequinum
VTFKDVAVGFTEEELGLLDSAQRKLYQDVMVENFRNLVSVGDNNQSELRTVQDRGPHEELSCWQIWQQIVNDLTRCQESMIKSSQFHKKGES

SEQ ID NO: 34529 - protein, 87 aa, Macaca fascicularis
LTFRDVAIEFSLEEWQRLDAAQQNLYRNVMLENYRNLAFLAICPHFAQDFWPEQGMEDSFQKVLLRKYEKCGHENLQLRKSCKSVDE

SEQ ID NO: 34530 - protein, 83 aa, Ursus maritimus
VTFKDVAVDFTQEEWQQLEPAQRDLYRDVMLENFQNLSSLGKTNHSGEGPLPGSGPGTSRVLAGRQGGVPFGRALSPFMRAPP

SEQ ID NO: 34531 - protein, 93 aa, Rhinopithecus bieti
LTFRDVAIEFSQEEWKCLDPVQKALYRDVMLENYRNLVSLGRCCAVRSKARNKPITNQLGLTFQLPLPELEIFQGEGKIYECNQVEKLISHSS

SEQ ID NO: 34532 - protein, 86 aa, Puma concolor
LTFRDVAIEFSQEEWECLDPAQRSLYRDVMLETYRNLVSLGEDNFPPEVGIPSDEFAIKELSPTENINKGEFYHLVILERNGSHGI

SEQ ID NO: 34533 - protein, 85 aa, Oryctolagus cuniculus
VTFGDVAVHFSREEWQCLDSGQRALYREVMLENHSSVAGLDSRKRTDYEQACGSTVTPKPESSVTMVRALPQGFSRGLGYGDTCD

SEQ ID NO: 34534 - protein, 82 aa, Rhinolophus ferrumequinum
TPSFPQSIDFTQEEWALLDTSQRKLFRDVMLETIDHLVSVGDRYVEQITLSHSSRHPDFFHNLHNYLKDISLRYIFIIILEC

SEQ ID NO: 34535 - protein, 87 aa, Rhinopithecus bieti
VTFEDVAVYFSQEEWELLDAAQRHLYHSVMLENLELVTSLGNALSQHGDDRLMPCVFSSSQSQMAGCWHAVEGEEAHPKQNISVEEV

SEQ ID NO: 34536 - protein, 96 aa, Oryctolagus cuniculus
VTFEDVAVHLTREEWGCLDPVQRDLYREVMLENYGNVVSLGILLRLPTTRLHSVNSCPALSHTQASAFSGETLAVLTAGISKRWSKYRLPIDIVRP

SEQ ID NO: 34537 - protein, 84 aa, Rhinolophus ferrumequinum
MTFDDVALYFSKQEWEILENWQKEMYQQVMKTNYEILNSLGDQGTLRVEEECHLNGLQKQGLCATSSGEEKILPAQRATLQHPS

SEQ ID NO: 34538 - protein, 90 aa, Ursus maritimus
VVFEDVAVDFTLEEWALLDSAQRKLYREVMLENLKNLASVDDETQFKASGSVSQQDIYGKKISKEHKMAKFIRNDSWASVLGKIWEELST

SEQ ID NO: 34539 - protein, 85 aa, Panthera pardus
LTFRDVAIEFSQEEWECLDPAQRVLYRDVMLENYRNLVSLGEDNFPPEVGSSAGFAIKELSPIQDINKGEFYHLVILERNESPDI

SEQ ID NO: 34540 - protein, 86 aa, Panthera pardus
LTFRDVAIEFSQEEWECLDPAQRALYRDVMLENYRNLVSLGEDNFPPEVRSPSAGFTVKELSPVEDINKGEFYHLIILERNESHGI

SEQ ID NO: 34541 - protein, 93 aa, Panthera pardus
LTFEEVAMYFSQEEWELLDPTQKALYNDVMRENYETVISLAVPVHQILAFSEKTNTKDWTVAPELVLPESQSSLTFEEVAMYFSQEEWELLDP

SEQ ID NO: 34542 - protein, 103 aa, Macaca nemestrina
LTFRDVAIEFSPEEWKCLDPAQQNLYRDVMLENYRNLVSLAMCSHFTQDFLPVQGIEDSFHKCILRRYEKFSSLFSSCHVISHLSRGRNRDAEKNDLLTTEEP

SEQ ID NO: 34543 - protein, 83 aa, Macaca nemestrina
VAFEDVAVNFTQEEWALLDSSEKNLSRKVMQETCRNLAFVEIIWYRDCVKAKKVVSMMDKLTFLLDENNVNVVFVEKSLYVIP

SEQ ID NO: 34544 - protein, 89 aa, Sapajus apella
VAFEDVAVNFTLEEWALLDPSQKNLYRDVMRETFRNLASIGKQWEDQDIEDPFKLPRRNTSHIPERTCERKEGSQSEETFSQIPDVTLN

SEQ ID NO: 34545 - protein, 89 aa, Puma concolor
ESFKIVTVDFTQKEEGTLNPVQRTLDRDVNLENHRDLVSWDLATALGRRESISKQNIFDDEPFHGVKLERLTRDDPWLASCEEVRDCKD

SEQ ID NO: 34546 - protein, 89 aa, Ursus maritimus
IAFQDVVVDFSQEEWEQLSPGQKALYWDVMLEDYRNLVSLGICSFENFISDWGTGPDNRIPSKHNISEKSPQKKGLWNMNFIKACKEDS

SEQ ID NO: 34547 - protein, 97 aa, Rhinolophus ferrumequinum
VVFADVAVNFTREEWALLDGAQRKLYREVMLETCRNLASVDYYSEIKTGESRSQWMFLDNNMSNEGKTVRFLRIDSRSVIGENKLMNNNGNRQLTQE

SEQ ID NO: 34548 - protein, 85 aa, Myotis brandtii
VKIEDMAVSLILEEWGCQNLARRNLNRDNRQENYGNVFSQGCESRNENEESTSKAEITKDSASRRETRGRIQKDFGEKHEQQGRT

SEQ ID NO: 34549 - protein, 104 aa, Lynx pardinus
VTFEDVAVAFSREEWALLDPAQKRLYREVMLETYRNLAALETLKTRTADAGIEFGALSATQASQAAGPSPWVGSSLFLPVVPFQLEQGEAVWLGGEGTPKTSCS

SEQ ID NO: 34550 - protein, 87 aa, Colobus angolensis
VAFEDVAVNFTQEEWALLGPSQKNLYRYVMQETIRNLDCIRKIWEGQNTEDQNKNPRRNLRCHMVERFSESKDSGQCGETFSLIRGS

SEQ ID NO: 34551 - protein, 87 aa, Propithecus coquereli
VASEDVAVNFTLEEWALLDPSQKKLYRDVMRETFRNLACIGKKWEDQNIEDWYKNQGRLLSNHMVERLCERDQCGGTFSQILNLNLD

SEQ ID NO: 34552 - protein, 92 aa, Balaenoptera acutorostrata
VVFEDVAVYFSQEEWGLLDEAQRHLYHAVMTENFALVTSLGCWHGAQDEEAPSEQSISVGMSEVGTPKPDPSTKKGQPYEMCEPLSKDLLHL

SEQ ID NO: 34553 - protein, 86 aa, Balaenoptera acutorostrata
VTFEDVAVYFSWEEWDLLDDAQRCLYHNVMLENLSLITSLGKAHQKQNIGEKCFRSNMDRASFMKDCKFFVSGKSLSRGESTHTRE

SEQ ID NO: 34554 - protein, 109 aa, Mustela putorius
VTFEDVFVYFSREEWELLEEAQRLLYRDVMLENFTLVASLGRWRETDNEETLSEQSISVGVSQLGTPESGAYIQKAHPCEVCNPLLKDILHLAEHQGSQPLQRLYARGP

SEQ ID NO: 34555 - protein, 82 aa, Clostridiales bacterium
KGISDSDMEQLLKDWNLEDAEQQAAYRNAVPKQHRMLLEASVIVIPLLKQKTDVLRPENLSHLNGFASMWCSIENILLASTA

SEQ ID NO: 34556 - protein, 82 aa, Clostridiales bacterium
KGISDSDMEQLLKDWNLEDAEQQAAYRNAVPKQHRMLLEASVIVIPLLKQKTDVLRPENLSHLNGFASIWCSIENILLASTA

SEQ ID NO: 34557 - protein, 93 aa, Micrurus lemniscatus
FREVSVYFSEEEWSWLDPDQKALYWEVMLENHRNMASLGDDGQENKDSYELLQGITARDTMETSAIEMEVERYKEKQSDDWNQESSSCTDDSV

SEQ ID NO: 34558 - protein, 85 aa, Micrurus paraensis
VSFEEVAVYFSEEEWSQLDPDQKALHSEVMIENHRNVVSLGNNGQENQDSCELFQVIIAKDGTEKLGIQMEFESHERNQSKNCNQ

SEQ ID NO: 34559 - protein, 91 aa, Micrurus paraensis
VSFEEVAVYFSQEEWSQLDPDQKALHWEVMLENYSNVASLGDNGQDHKESRESFQGFRHRGIMEKPEIQMEFQRQERNQSNNWNEESSCSI

SEQ ID NO: 34560 - protein, 84 aa, Micrurus paraensis
VSFEEVAVYFSEEEWSQMDAHQKALHKEVMLENSQNVASLGAREQENEGCKEPFQKINQKKEERLKEREKPVKKRKKEKNQSKK

SEQ ID NO: 34561 - protein, 86 aa, Microcaecilia unicolor
VTFEDIAVYFSQEQWEYLNEGQRELYWEVMKENYETLISLEKDYPRNSNIETQHWKINEKPEGEKASEKEEETAFCSDWGEKGKYQ

SEQ ID NO: 34562 - protein, 94 aa, Microcaecilia unicolor
VTFEDIAISFSQEEWDYLDEGQKELYRQVMKENYETLISLDGKIKQQHKREENREEYPVQMEQTSRQSENIGETISQGTEWRNIRNYQQEVEQG

SEQ ID NO: 34563 - protein, 94 aa, Geotrypetes seraphini
VTFEDIAVSFSQEEWEYLDEEQKQLYREVMKENYQTLLSLDQQIQHEWKREKNQGEDPVEMEQIQTQSENVCENISQGNEKINTKNYKQESKKR

SEQ ID NO: 34564 - protein, 89 aa, Anas platyrhynchos
VAFSDASFSFSEEEWKNLNEWQKELYRHIMKGNYEAVISMGKNLPGVFLLACWCPRSSRARLCPADRGGGVMRGVWSGVVLAPDGSSWC

SEQ ID NO: 34565 - protein, 94 aa, Geotrypetes seraphini
VTFEDVVVSFSQEEWEYLNEEQKELYREVMEENYQTLISLDHQIQHEWKREKNQGEDPVEMEQIQTQSENVCENNSQGTEKINTKNYKQESKNQ

SEQ ID NO: 34566 - protein, 87 aa, Geotrypetes seraphini
VTFDDISISFSQEEWEYLDEGQKELYQEVMKENYETVMFVADNEVKESREEPPLKRKLRPRPLCVSQGTERGESGSCQLRSQKKQRD

SEQ ID NO: 34567 - protein, 94 aa, Geotrypetes seraphini
VKFEDIAISFSQEEWEYLNEEQKELYREVMEENYQTLLSLDHQIQHEWKREKNEEEDPVEMEQIQTQSENVCENISQGTEKINTNNYKQESKNQ

SEQ ID NO: 34568 - protein, 87 aa, Geotrypetes seraphini
VTFEDIAVSFSQEEWEYLDEEQKELYREVMKENYEILISLADTEAMQEMKREENEEKCLLEIEHIPRQPGNVSENISHSNENQNTRN

SEQ ID NO: 34569 - protein, 86 aa, Geotrypetes seraphini
VTFDDISISFSQEEWEYLDEGQKELYQEVMKENYETVMFVDNEVKESREEPPLKRKLRPRPLCVSQGTERGESGSCQLRSQKKQRD

SEQ ID NO: 34570 - protein, 97 aa, Geotrypetes seraphini
VTFEDITIYFSQEEWQDLEEWQKELYKDVMKENYETLVSLDYEIGAKYEETQDGNLAENLDWNKMLFPEEKRDIYPCPYWGERCWIHRRPVKEENGL

SEQ ID NO: 34571 - protein, 95 aa, Geotrypetes seraphini
VKFEDIAISFSQEEWEYLNEEQKELYREVMEENYQTLLSLADHQIQHKWKREKNEEEDPVEMEQIQTQSENVCENISQGTEKINTNNYKQESKNQ

SEQ ID NO: 34572 - protein, 83 aa, Geotrypetes seraphini
VSFSDIAVYFSEEEWQLLEEWQKELYRNVMMENYVTLASLGNIITSCLYFTRHTSVKPVIVSKIEDGEAPCTSQFSDAEKRKA

SEQ ID NO: 34573 - protein, 83 aa, Geotrypetes seraphini
VKFEDVAVSFSQEEWEYLDEGQKELYREVMKENYETLLSLGLQCLQKIHESERPFTYPSCGKSFNRQSNLRKHKRNHTRKKPF

SEQ ID NO: 34574 - protein, 91 aa, Geotrypetes seraphini
VTFEDITVSFSQEEWSYLDEGQKELYWEVMKENYETLISLGDEVMWKEENGEDGAVELVLIPIEFKNGCENISQGDMKRTTRNQEQESEKK

SEQ ID NO: 34575 - protein, 94 aa, Anas platyrhynchos
ILKWDLLLLQEPERWVLLDPVQRTLYVDVMLENYETITSLGKESWPLEFWSQELLELWLLELTPTLEKPPSRRSLLKGNLSMGRRVAGAGSSDL

SEQ ID NO: 34576 - protein, 94 aa, Geotrypetes seraphini
VTFEEIAVSFSQEEWEYLDEEQKELYREVMKENYEILISLDHQNRHEWKRTENREEGPIEMEKIQTQSENVYDNISQTPEIINTKNCKQESREQ

SEQ ID NO: 34577 - protein, 91 aa, Geotrypetes seraphini
VTFEDITVSFTEEEWEYLNEEQKKLYREVMKENYQTLISLDQQISQEWKNRGEDLAKMEQIQTQSQNVCENISQGPEKIKTKNCKQESKDQ

SEQ ID NO: 34578 - protein, 97 aa, Colinus virginianus
MSFVEVAVYFSREEWVLLDPEQRALYWDVMLETYQCVASLAGAGIRNLRKGLQENGVARRQCGSIYVEEIRRDVQVDQEQGQGIDSITNKEVAAAFT

SEQ ID NO: 34579 - protein, 94 aa, Geotrypetes seraphini
VKFEDIAISFSQEEWEYLDEEQKQLYREVMKDNYQTLLSLDHQIHHEWKREKNQGEDPVDMEQIQIQSENVSENNSQGTEKINTKNYKQESKNQ

SEQ ID NO: 34580 - protein, 83 aa, Anas platyrhynchos
ILKWDLLLLQEPERWVLLDPVQRTLYVDVMLENYETITSLGKESWPLEFWSQELLELWLLAFMLRRVLKTKMLSKHGGVQLRV

SEQ ID NO: 34581 - protein, 94 aa, Geotrypetes seraphini
VKFEDIAISFSQEEWEYLNEEQKELYREVMEENYQTLLSLDHQIQHKWKREKNEEEDPVEMEQIQTQSENVCENISQGTEKINTNNYKQESKNQ

SEQ ID NO: 34582 - protein, 92 aa, Geotrypetes seraphini
VTFEDITVSFTEEEWEYLNEEQKKLYREVMKENYQTLISLADQQISQEWKNRGEDLAKMEQIQTQSQNVCENISQGPEKIKTKNCKQESKDQ

SEQ ID NO: 34583 - protein, 85 aa, Geotrypetes seraphini
VTFDDIAVYFSQEEWEYLKEWQKELHREVMEENLQLLISLGYGTGTEHQKECPEVLHFQPLMPAEDDRSTEHRFSSDRNWTYTSQ

SEQ ID NO: 34584 - protein, 85 aa, Pelodiscus sinensis
VTFEEVAVYFTRAEWALLPPTQRALYRAVMQENYENVTSLVGHWAARQGQKKCFRSLFDDESLSVYVPSRDKILREKRKNACTKR

SEQ ID NO: 34585 - protein, 82 aa, Pelodiscus sinensis
VTFEEVAVYFTQGQGALLGPAQRALYRDVMQENYEAVTSLGDELTSENEGNTQLEVPELVEPQETFSERAEGATSQSNEQEE

SEQ ID NO: 34586 - protein, 108 aa, Colinus virginianus
VTFVDIAVYFSAEEWKNLEEWQKELYNNLVKENYESLISLGTRPLWPRSGAVPPVPLCGHGEGRPAAVTRVVFPRADAALSRSDTQPRLERGDVPCVPEQQDLEQREM

SEQ ID NO: 34587 - protein, 87 aa, Geotrypetes seraphini
VTFDDVAIYFSQEEWEELNEQQRELYQEVMRENLELLTSLGDPPENKKEESPVQVIIAPAIPKRIVLLKDRRDPFYQRTCGGERSPH

SEQ ID NO: 34588 - protein, 87 aa, Geotrypetes seraphini
VTFEDIAVSFSQEEWEYLDEKQKELYREVMKENYEILISLADTEAMQEMKREENEEKCLLEIEHIPRQPGNVSENISHSNENQNTRN

SEQ ID NO: 34589 - protein, 94 aa, Geotrypetes seraphini
VTFEDIAVTFSQEEWEYLDEGQKELYREVMKENYETLISLDIGAMQEMKREENQEKCLLEIERISRQSGNVSDNISQRNESRNIRNYQQELEKN

SEQ ID NO: 34590 - protein, 94 aa, Geotrypetes seraphini
VTFEDIAVSFSQEEWEYLNEEQKELYREVMKENYQTLISLADNQIAQGWKRVQNQEDPLKLVQNQIRSEKVCPNISQGPERINANNCKQESKKQ

SEQ ID NO: 34591 - protein, 94 aa, Geotrypetes seraphini
VKFEDIAIYFSQEEWEYLDEEQKELYREVMEENYQTLLSLDHQIQHEWKREKNQGEDLVEMEQIQTLSKNVCENNSQGTEKINTKNYKQESKNQ

SEQ ID NO: 34592 - protein, 84 aa, Pseudonaja textilis
VSFEEVAIHFNNEEWLLLDPNQKTLHREVMLETSRIECGKSFISSSSLTNHISIHITEKLYQCAECVKSFRWKSQLISHKRIHT

SEQ ID NO: 34593 - protein, 84 aa, Thamnophis sirtalis
APFEEVAVDFTEEEWALLDSSQKAFCREVMLEVNMNMAALGGGDGLENENEKQRRLFKPQYAMSSKSQSEFCISRNLMHHQKIH

SEQ ID NO: 34594 - protein, 91 aa, Pseudonaja textilis
VMLEEVSVTFSEEEWALLNPDQRALHRDVMAENSGIASSLGKFPLKKKKGWCCDSGIGICSSHTTKKPHKCLECGKSFSTRQYLGCHQRVH

SEQ ID NO: 34595 - protein, 94 aa, Pseudonaja textilis
VSFELVALYFMEEEWVPLDSSQRALLREIILENSKKVSILSKEYILQIIHCIVKMCLIPFAATVRCLFDGSLKAVFLKIRTGRDLKKLSDPHFI

SEQ ID NO: 34596 - protein, 107 aa, Pelodiscus sinensis
VTFEDVAIYFSQEEWDLLADWQKELYQEVMRENYANLNSLGKDQPVFYRCTNGEWGEVGCSTLHSPDLRKWIWLHPRGKQAPKKRARLHKCDECWKSFTWRSELVQH

SEQ ID NO: 34597 - protein, 82 aa, Pelodiscus sinensis
VNFQEVAVYFSEEEWALLDPGQRALYRDVMQENYDAVNWLAGNGSTRQEWQILELWGWVQLLLVSAEYPFASGLSPSESFPA

SEQ ID NO: 34598 - protein, 86 aa, Pelodiscus sinensis
VTFEEVAVYFSEEEWALLNPGQRALYWDVMQDNYEAVSWLADDRTLSKNNEESPHVQVAPCAMFLGRSEGHVSQSPERGETCENQS

SEQ ID NO: 34599 - protein, 91 aa, Pelodiscus sinensis
VTFEEVAVYFSEEEWDLLDPGQRALYWDVMQENYEAVSWLAMAGHAPSATKGQKRKRVVLTITQKLDLIRRLERGEKRSQLMQEFGVGSST

SEQ ID NO: 34600 - protein, 107 aa, Pseudonaja textilis
CFFSLPSVFFSMEEWALVDSEQKALYREVTLENKRSKASLDINVLLDTDDSHEKQMCSRCGKRFCDESGSCDCCESPAGEKQDESRQHPRRSLPPPLRERINEGGNP

SEQ ID NO: 34601 - protein, 100 aa, Pelodiscus sinensis
VTFEEVAVYFSEEEWALLDLGQKALYWNVMQENYESVSWLAGDGMMSANNEKSLHQEGLHQQVVLHGMLLERSEEHVSPRAEQGETGVSQHTPERQQGNH

SEQ ID NO: 34602 - protein, 88 aa, Pelodiscus sinensis
VTFEEVAVYFSEEEWALLDPGQRALYWDVMQENYKAVSWLGFPVSKAHAISWVEPILWLCSPFPVPLSAQRLTPVWILSLSQQVMGRC

SEQ ID NO: 34603 - protein, 95 aa, Geotrypetes seraphini
VAFEDIAISFSQEEWEYLDEGQKELYREVMKENYETLISLGLKCLQRIDESGRQFTYAECGKGFNRQSDLKMHKRIHTGEKPYACPECDKCFTYS

SEQ ID NO: 34604 - protein, 95 aa, Geotrypetes seraphini
VKFEDIAISFSQEEWEYLNEEQKELYREVMEENYQTLLSLADHQIQHEWKREKNEEEDPVEMEQIQTQSENVCENISQGTEKINTNNYKQESKNQ

SEQ ID NO: 34605 - protein, 110 aa, Anas platyrhynchos
AQSREWPCYFTKERWVLLDPVQRTLYVDVMLENYETITSLGKESWPLEFWSQELLELWLLISFTSQIILKSLMPLSPLGQVFLLLSHDLLTQEGGEHWAPNLQEMEKKEV

SEQ ID NO: 34606 - protein, 103 aa, Anas platyrhynchos
VTFDDVSVYFNDKEWEKLEEWQKELYKNVMKGNYESLISLGKTRVPPLLPRGGFLGIPGCLQPQASSISSSISQFDPPETQMSLLKGRLKKYRRSPDEEAACE

SEQ ID NO: 34607 - protein, 93 aa, Geotrypetes seraphini
VTFEDIAVSFSQEEWEYLNEEQKELYREVMKENYQTLISLDNQIAQGWKRVQNQEDPLKLVQNQIRSEKVCPNISQGPERINANNCKQESKKQ

SEQ ID NO: 34608 - protein, 94 aa, Geotrypetes seraphini
VSFEDIAVSFSEEEWEYLDEGQKELYREVMKENYETLISLANHQIKHEWKREKNQEDPVEMEQIQTQSENVCENISQGTEKINTNNYKQESKKQ

SEQ ID NO: 34609 - protein, 88 aa, Callipepla squamata
EASEGDAACFTEQEWENLEEWQKELYKNMLRGNSESLSSLGQFDAVQKHSHFCSLTDYADSKPDLLSRLQRGESHCSEVTSGHKEIPT

SEQ ID NO: 34610 - protein, 87 aa, Alligator mississippiensis
EVFEDVAVYFTRKEWELLDDEDKVLYRDQMLRNFQALVFLAEPRPGRGLCPHTVRIMSVKVKEVSTDEAAGGGRAEGNPGASGQATP

SEQ ID NO: 34611 - protein, 84 aa, Pantherophis guttatus
VSFEEVAVYFSEEEWSQLNPAQKALHGDVMLENSRNLAYLGYSEQANKNCEEECQPVHPKEKNRNFAGQMETKIDETNRSQSEI

SEQ ID NO: 34612 - protein, 86 aa, Pantherophis guttatus
VSFREVAINFNSEEWLLLDPSQKALYQEVMLETSRMVASLALDAQKKESDQEPNLMPLQIIKTEIPEETSTNTWGRKKHEKKHNWR

SEQ ID NO: 34613 - protein, 86 aa, Gopherus agassizii
VTFEDVAVYFSEGQGALLDPGQRALYKDIMQENYGMVTSLGKDSCPLMEQGSHEPDGHANSSPSLQLSQGKNPKETTAQQTNPKEK

SEQ ID NO: 34614 - protein, 84 aa, Gopherus agassizii
VTFEEVAMYFTREEGAVLDPTQRALYRDVMQENYENVTCWVRVTVPLGFRRGTAELRFMPAPQCHLCSTCTVLPPLCPQPEFSF

SEQ ID NO: 34615 - protein, 88 aa, Micrurus lemniscatus
SFEDVAVSFSEEEWALLDSEQKALYREVMLENKRNVASLGGDGWEMEDSGQEAAAPLPKDKKEEKIYRKQSSEEIQLMGELENCSGLP

SEQ ID NO: 34616 - protein, 91 aa, Podarcis muralis
VTFEDVTVHFTEEEWALLDPGQRALHREVMEENYRNLASLGDERESSEENEPQGIKTEAEENLRKDTVVPDGAGFNETLMLEKHHTGKKQE

SEQ ID NO: 34617 - protein, 90 aa, Gopherus agassizii
VTFEEVAVYFTQGQGALLDPAQRALYRDVMQENYKMVTSLGKGFSSPWLLEAMGSVCLNLETTAPQTYHQEEKPYKRLENRKRFSVSRNL

SEQ ID NO: 34618 - protein, 113 aa, Gopherus agassizii
VTFEEVAVYFTQGQGALLNPAQRALYRDVMWENYETVTSLGKGFPSPRLLEAVGSACVTLVRFFPCQLDQKQMGPIMHSCCVRETLTPSVLHPLTQGSVPGEVEPQGTFVGRA

SEQ ID NO: 34619 - protein, 84 aa, Gopherus agassizii
LTFEEVAVYFTREEWSLLDPAQRALYGDVMQENYETVVLLGKESSPLGGWTRYLLRSKGKVSRSCARREKAKAYETQQMPEENF

SEQ ID NO: 34620 - protein, 83 aa, Gopherus agassizii
VTFEEVAVYFTQGQGALLDPGQRSLHRDIMQENYETVALPAQGFGTWPDQLLLLVFPGHFNFRGRGASGRWGLGGRGSMGALA

SEQ ID NO: 34621 - protein, 91 aa, Micrurus lemniscatus
VSFKEVAVYFSEEEWSQLDVDQKALYWEVMLENHRNVASLGNDSEEDEKSRELFQMINRGYNTKNPTVLMEVESHERSHSICNQECSSDVH

SEQ ID NO: 34622 - protein, 89 aa, Gopherus agassizii
VTFEEVAVYFTREEWALLDPAQRALYWDVMQENYETVVFRSLPDLMSFLSGSDLCLDSLCLLSGDGMLSENEEEKPQQEDALKVEPHGT

SEQ ID NO: 34623 - protein, 82 aa, Gopherus agassizii
VTFEEVAVYFTREEWARLDPRQRALCRDVMQENYENVTSLGKDSLDKDRELWQRSKRNVSRSHEQRNSCEIQHRPEKEQGNQ

SEQ ID NO: 34624 - protein, 86 aa, Gopherus agassizii
VTFEEVAVYFTQGQGALLDPAQRALYRDVMQENYETVTSLGKGFLLPLVTGNCHICDVPCRASAQVLPCLLQFLGSVFPSSSGRQS

SEQ ID NO: 34625 - protein, 92 aa, Taeniopygia guttata
VTFEDVAVSFSPEEWAQLAPWQRALHREVMGDNYDLVASLGEGPESHGGAPCAGGHSGDTNTSDTCECPGVPCGAGGALGGEGRALAPCDTP

SEQ ID NO: 34626 - protein, 82 aa, Gopherus agassizii
VTFEDVAVYFTQGQGALLDPAQRALYRDVMQENYETVTSLGKGFLSPQILEAVGSVLDESSNGGGGDEDPRAQQTTVKEEAP

SEQ ID NO: 34627 - protein, 85 aa, Strigops habroptila
VTFEDVSVHFSSEEWAVLAGWQRRLYREVMDNYRLLTSLGNPTWNTCDRGGPACWTPSEPRCFQQYEALMGAFGTMSGVTVLSAA

SEQ ID NO: 34628 - protein, 87 aa, Micrurus lemniscatus
VSFEDVAVFFSVEEWALLDCEQKALYQEVMLENKRNVASLGQDTVLFHQLFLRLEVYSQGKQPSSTQAQHGGDGWEMEDSGQEAAAP

SEQ ID NO: 34629 - protein, 95 aa, Micrurus spixii
VSFEDVAVYFSEEEWTELDPDQKALHREVMLENYRNVASLGDDEQDHKEPRESFQGFRHGDVMEKLAIQTKFQRQKRNPSNIWNKESSSSIEAHM

SEQ ID NO: 34630 - protein, 87 aa, Micrurus spixii
VSFEDVAVFFSVEEWALLDCEQKALYKEVMLENKRNVASLGQDTVLFHQLFLRLEVSSQGKQPSSTQAQHGGDGWEMEDSGQEAAAP

SEQ ID NO: 34631 - protein, 95 aa, Micrurus spixii
VSFEDVAVYFSEEEWTELDPDQKALHREVMLENYRNVASLGDDEQDHNEPRESFQGFRHGDVMEKRAIQTKFQRQKRTPSSIWNKESSSSIEAHM

SEQ ID NO: 34632 - protein, 87 aa, Micrurus spixii
VSFEDVAVFFSVEEWALLDCEQKALYKEVMLENKRNVASLGQDIVLFHQLFLRLEVYSQGKQPSSTQAQHGGDGWEMEDSGQEAAAP

SEQ ID NO: 34633 - protein, 83 aa, Patagioenas fasciata
VTFEDVALYFSPEEWAKLSGCQRQLYREVMLENYEMVASLGEDSLLMLGWGQARIHLFKRAGALEQENPAVPVDSRVVPTTGF

SEQ ID NO: 34634 - protein, 112 aa, Meleagris gallopavo
VSFAEVAVCFSREEWALLDPAQRVLYRDVMLETYQCVASLECHSGPNCGFSLGRDTVELEKQLCQNDGNAHISPVSLTEASLLTPKPVLISLLEGGEEPWIPDVRSPEATPG

SEQ ID NO: 34635 - protein, 97 aa, Aquila chrysaetos
VTFVDIAVYFSAEEWKNLEEWQKELYNNLVKENYESLISLGKHPFSPLSRHAGVMAACPRRVPGVGALVARERSVERCPHAEPPEEVGLPGGSGELL

SEQ ID NO: 34636 - protein, 89 aa, Micrurus lemniscatus
VSFEDVAVYFSEEEWTELDPDQKALHREVMLENYRNVASLGDDEQDHKEPRESFQGFRHGDVMEKRAIQTKFQRQKRNPSNIWNKESSS

SEQ ID NO: 34637 - protein, 91 aa, Thamnophis sirtalis
VSFKEVAVYFSEEEWSQLSVDQKALYWEVMLENHRNVASLGYGGEEDEDFREVLQMASCGYNTKNPIILMEVESNDRNQSNNFNQEILSSV

SEQ ID NO: 34638 - protein, 96 aa, Alligator sinensis
EAFEAMAVYFTQEEWELLEDVQKGLYQDQMLRNCGALIFLGKDVSCSPRLFVAQQRLCRPFLLWAFTCYNRCLLPSVLRIQGSWYLCFQPCRICKV

SEQ ID NO: 34639 - protein, 82 aa, Pantherophis guttatus
VSFEEVAIHFTSEEWSLLDPNQKSLHQEVMLEMSRIVAFLAFHVEKNENYQEPSAVPLQIIKSEIPEETSANKWERRKHEKK

SEQ ID NO: 34640 - protein, 110 aa, Amazona aestiva
LTFEDIAAYLSRTEWATITAGQRELYRSVMMDNYRLLTSLGYAVAMRLLKAPPWGWWPGAGAPEERAQSPCQEAAAVAGSKVLHPEVCAHSEKQPICTSDVNQSTKGQEP

SEQ ID NO: 34641 - protein, 86 aa, Micrurus lemniscatus
VSFGEVAIHFSSEEWLLLDPSQKALYQEVMLETSRMVASLAFDAQKKENDREPDLVPLQIIKSEIPEETSTNTWGMRKHEKKHNFW

SEQ ID NO: 34642 - protein, 84 aa, Pantherophis guttatus
VTFEEVAVRFSKGEWGMLDPEQRALYQEVMVENYGTLVSLGDTWGNDGKNRPVGMVASEGPGKEVEDNLWNQSGGKEEEEETQP

SEQ ID NO: 34643 - protein, 85 aa, Micrurus lemniscatus
VSFEEVAVYFSEEEWSQLDPDQKALHWEVMLENYSNVASLGDNGQDDKESRESFQGFRHGDIMEKAEIQMEFQRQERNQSNNWSE

SEQ ID NO: 34644 - protein, 89 aa, Micrurus lemniscatus
FKEVAVYFSEEEWSQLDVDQKALYWEVMLENHRNVASLGNDSEEDEKSRELFQMINRGYNTKNPTVLMEVESHERSHSICNQECSSDVH

SEQ ID NO: 34645 - protein, 82 aa, Pantherophis guttatus
DPFEEVTVDFTEEEWALLDSGQRALCAEVTLEAFRNIIALAGDTMEKEKQEWLMSLPGEVTFDHQANPKRQERSHSEGGLEK

SEQ ID NO: 34646 - protein, 118 aa, Meleagris gallopavo
VAFEDVALYFSAEEWALLARWQRELYQEVMMDNYDLVACLGKEQCCTAPPSAPGHSHPAMEAGEDPQDGRHRGFTTPHGTGELQDPRVRVHPPMPSIVLTQGTQEWLSLPQERTGLEE

SEQ ID NO: 34647 - protein, 108 aa, Meleagris gallopavo
VSFAEVAVCFSREEWALLDPAQRVLYRDVMLETYQCVASLGPNCGFSLGRDTVELEKQLCQNDGNAHISPVSLTEASLLTPKPVLISLLEGGEEPWIPDVRSPEATPG

SEQ ID NO: 34648 - protein, 93 aa, Pogona vitticeps
VTFEDVAVYFTEQEWTLLDPDQRALHQEVMEENLANLVSLAADMREKSCEEEEEGGICLGIVIDKNRKHCLECGRNFIQSTTLDDHMKIHTGD

SEQ ID NO: 34649 - protein, 117 aa, Pogona vitticeps
VTFEEVAVHFTEEEWLLLDPDQRALHKEVMEENRGLLASLDDWKERRICSKCGKCFTPKLGLSRQQRTHTEGEHHARNNSYRGNVCWKCFAPKRMLTLHRGDHRGKRNFRGERMGKP

SEQ ID NO: 34650 - protein, 95 aa, Pogona vitticeps
MSLEEVAVSFTVEEWALLGPGQKALYREVLEEIKGHLASLAEAERPFLKEKGWPEKSKGICRILVLKIEQPVSQNPEKGDSSRTSRKPTPEMKKS

SEQ ID NO: 34651 - protein, 83 aa, Pogona vitticeps
VTFDEVAVYFTDEEWTLLDPDQRSLHTEVMEENLGMVASLGDGTQMPQTCATFFLNSEALGTVSEKPDQVTFEEVAVSFMEDK

SEQ ID NO: 34652 - protein, 88 aa, Pogona vitticeps
LTYEELAVSFTQEEWALLDPDQRALHKEVMEENWRMLSSLELFDSSVQSFLHSSFFPEDMSKEKNVRSKCEKSCTQKLDFAGHQTTHR

SEQ ID NO: 34653 - protein, 83 aa, Cricetulus griseus
VTFEDVAVNFTLEEWAMLDSSQKDLYKDVMQETLRNLASIGNKWEHQNIEHEYENLWRKLSSQLLERLCEYTEGRQCTEVFNW

SEQ ID NO: 34654 - protein, 92 aa, Cricetulus griseus
VSLEDVCLYFTEEEWDLLNDAQKLLYHNVMLENFSTVLSLGLPISKAFSGITENGNESYGVIGPFTVIFLTFIQINCLPWNLSFQVNRAETD

SEQ ID NO: 34655 - protein, 89 aa, Cricetulus griseus
VTFEDVAVNFTLGEWTMLDSSQKKLYRDVMKETFLNLISIGKTEEEDTEEEYQKPKGNLRTLVVERLCKFDHGGQSGETHRQSPEHVVN

SEQ ID NO: 34656 - protein, 91 aa, Homo sapiens
VALGDIPFYFSREEWGTLDPAQRDLFWDIKRENSRNTTLGFGLKGQSEKSLLQEMVPVVPGQTGSDVTVSWSPEEAEAWESENRPRAALGP

SEQ ID NO: 34657 - protein, 97 aa, Pan paniscus
EKIEDMAVSLIREEWLLDPSQKDLSRDNRPEDFRNVFSLGGETRSENRELASKQVISTGIHPHGETAAKCNGDVIRGLEHEEARDLLGRLERQRGNP

SEQ ID NO: 34658 - protein, 85 aa, Homo sapiens
LTFEDMAVYFSEEEWQLLGPLEKTLYNDVMQDIYETAISLGKQRTGKIMGIEMASSFSKEEKKLTTCKQELPKLMDLHGKGHTGE

SEQ ID NO: 34659 - protein, 107 aa, Paroedura picta
FSFEDVAVSFSEAEWALLDRGQRALYREVMLENYGSVASLGGYQGNEEGEELHHESPEDFRGNVWNQVRPKTQKGSQLAEKRDQLVPLQEGDFHELIHMTEETCHNT

SEQ ID NO: 34660 - protein, 85 aa, Podarcis muralis
VCFDDVAVCFTDEEWELLDPDQRALHKDIMEENRGIVASLDSDGLEIKDKGDHDKIPTMEKLYKYLESRKSSNSTSHQGNLIRKK

SEQ ID NO: 34661 - protein, 93 aa, Podarcis muralis
VSFEDVAVCFTAEEWALLDPAQRALHKEVMEETWRTMISLGKVPCWVIISVLEFSRYFSGTNLPYLDGSQRCHLECGDELEMKNKGDHDEIHT

SEQ ID NO: 34662 - protein, 85 aa, Podarcis muralis
VCFEDVAVCFTDEEWALLDPDQRALHKGVMEENSGIMASLDSDGLEINNMGDHNKIPTMEKLNKYLECGKSSFSTSHQRNPIGKK

SEQ ID NO: 34663 - protein, 83 aa, Paroedura picta
FSFEEVSVFFTEAEWVLLDLDQRALYREVMLENYGSIVSLADVEETGGEFQGFSLGKAKYEEAEGNSGEGPQRRQESHAEDQR

SEQ ID NO: 34664 - protein, 85 aa, Paroedura picta
AQATEYSQDSLSCEWALLDPGQRALHREVMLETQESVAFLEARRIRETMGETHKGLASEERLETSSRGSREHLSFPNELAETDDE

SEQ ID NO: 34665 - protein, 99 aa, Paroedura picta
APPAQVAVSFTEAEWALLDLGQRALYRDVMLENYGLVAALAKKDQKEKEAEELHQFLDKVKNKDLKGNSYHGRPKRQKGDHTVLKRDKLIPCQNGECQK

SEQ ID NO: 34666 - protein, 96 aa, Alligator sinensis
EVFEAVAVYFTRKEWELLGDEDKVLYRDQMLRNFHALVSLGGACLLGRAEEQRPEEGPANVEPPQTSPGTLGEMGSLRPEKDQWQKGQENIAVNQV

SEQ ID NO: 34667 - protein, 85 aa, Paroedura picta
FSFEEVAVSFTEAEWALLDPGQRALYKEVMLENYGNVASLASLHSQVTKGFFSQLEVTQEKRMEMEEQKPEVLGTGKTASQGFPP

SEQ ID NO: 34668 - protein, 84 aa, Paroedura picta
FSLEDVSISFCPAERALLDLAQRALWREVMRENAENMAFLKARGIGETPVETSSGLASEERLESFSGSREHISFPDELAEEDDR

SEQ ID NO: 34669 - protein, 87 aa, Paroedura picta
VSFEEVVVYFTMEEWALLDPCQRALYREVMLETYVMVVSMERCWCSISPLISLLREICLFFQSTTEDHESAGDFWEILGEHSRMSLG

SEQ ID NO: 34670 - protein, 100 aa, Paroedura picta
ASFEDVVVSFTKEEWALLDPGQQPLHREIMVENDGTVASLGDRGESTRKTGSPGKSGGGACRRGEGEKSRAIEKTDTSDASRRGDTPEALAHDKAEKEEE

SEQ ID NO: 34671 - protein, 85 aa, Paroedura picta
VIFEDVSVCFSEEEWALLDQREKALYWNIMHQNYDNVAWLSGGTSSQRGKDPWQEPSEPIVELVKKNNKDSTWGTKQDSNREAHQ

SEQ ID NO: 34672 - protein, 83 aa, Paroedura picta
FSFEEVSVCFTEAEWALLDAGQRALHKEVMQENFENVAFLEGRRETIVETENSTASKEKLESSSRGSQEHISFPSKLAATVDD

SEQ ID NO: 34673 - protein, 94 aa, Alligator sinensis
EAFEDVAVYFTQKEWELLEAGDKELYRDQMLRNYQALVSLDPFSKSQLDAGITTPSTLANTGYQGPAPDLICRIQRGEMELWVGDKKAAGESSL

SEQ ID NO: 34674 - protein, 91 aa, Paroedura picta
FSFEEVAVYFTEAEWALLDPGQRALYREVMLENCGSVAFLGDDQRNEEDEEQHHLSPDENNIWYVLMLDTPFDIKDSGAGLEILGVILEME

SEQ ID NO: 34675 - protein, 85 aa, Podarcis muralis
VCFEDVAVCFTDEEWALLDPDQRALHKGVMEENSGIMASLDSDGLEIKDKGDHDKIPTMEKLYKYLESRKSSNSTSHQGNLIRKK

SEQ ID NO: 34676 - protein, 93 aa, Paroedura picta
YSFEEVAVYFTEEEWELLDTEQRDLYWDVMQENYENAMFENSPLADHLGIHPGVATAAGKTEVGLRNAGTANQQGSGRNPEPSDGQRDPGAPP

SEQ ID NO: 34677 - protein, 89 aa, Lithobates catesbeianus
IRCQDVTVYFSMEEWEYLEGHKDLYKDVMMENQPPLTSPDGSSNGNPPERCPRPLYSRDSTQEDHTIPHHHQGEELKDIKIEVKEEEEE

SEQ ID NO: 34678 - protein, 91 aa, Pantherophis guttatus
VSFEEVAVHFHEEEWSQLDPHQRALHWEVMVENYKNVVSLGENENDNKDSGEPIEVFRQGDVMEKPAIQTEFQRQERNLSTNWNKESSSSI

SEQ ID NO: 34679 - protein, 86 aa, Pantherophis guttatus
VSFEDIAINFSGEEWALLDFDQKTMYTEVMLENAKIVASISGDEQNFENDKKPAAEKLQTVKNKIKERFFKNPWEPKRPTENQFNN

SEQ ID NO: 34680 - protein, 89 aa, Pantherophis guttatus
VSFEEVAVHFSKEEWSQLDSDQKALHGEVMLENSRNLASLGYNGQENKNCKKECQAIHSKEGKGKLYQYMESFSRKRVLIHHKTVHTEE

SEQ ID NO: 34681 - protein, 87 aa, Alligator mississippiensis
EVFEDVAVYFTWEEWELLEDEDKVLYWDQMLKNYRALVSLGKVLFDFCFSPERCVLIRHTRKKCHVCAQCGRTYTCLSTLDAHLKIH

SEQ ID NO: 34682 - protein, 82 aa, Pantherophis guttatus
ALFEEVAVYFSKEEWSRLDPDQKALHREVMLENFRNVAFLGHMRARHPRAVHLLPRPIVVACRSSGAKCYKKEPESSRVNYV

SEQ ID NO: 34683 - protein, 91 aa, Pantherophis guttatus
VSFKEVAVYFSKEEWSQLDSDQRALHWEVMLENYRNVASLDNNGQGNEDFCELFQVINAGKEIEEPAIQMQLENHERNESENWNPESSSSI

SEQ ID NO: 34684 - protein, 85 aa, Pantherophis guttatus
VSFGEVAIHFTSEEWLLLDPSQKALHQEVMLETCRIMASLVDEQKNDNYQEPNLVPLQIIKIEIPEEITADKWGMRKHEKNQAYN

SEQ ID NO: 34685 - protein, 98 aa, Pantherophis guttatus
VSLKEVTVCFSEDEWSRLDPLQKALHRDVMLENARNVAFLEQWWQTYSTHARGGKQNPLCRHASPRQVALWPKDFPFIKWEGKNGPLDCRFRSHGPGP

SEQ ID NO: 34686 - protein, 84 aa, Pantherophis guttatus
VSLKEVTVCFSEDEWSRLDPLQKALHRDVMLENARNVAFLGPAAPEPRPLLPDLGCFSRTSAACLLSPIGPSSSCHRLSVPAPP

SEQ ID NO: 34687 - protein, 85 aa, Pantherophis guttatus
VSFEEVAVYFSEEEWSELNPDQKALHSEVMLENHRNVVSLDNNGQENQDSCELFQVINRKDGMEKFQIRMELESHERKQSNRRNQ

SEQ ID NO: 34688 - protein, 91 aa, Pantherophis guttatus
VSFKEVAVYFSEEEWSRLTVDQKALYWEVMQENHRNVASLGNNREEDEDSRELFQRISCGYNTENPIILMEIESHERNQSNNYNQENSSSV

SEQ ID NO: 34689 - protein, 85 aa, Pantherophis guttatus
VSFEEVAVYFSEEEWSQLDSHQKALHREVMQENSQNVASLGANEQQNETCGITLQTIWPVKGVEKMADQKETECCQRNLSQIGNQ

SEQ ID NO: 34690 - protein, 89 aa, Pantherophis guttatus
LSFDDVVVFFSVDEWDLLDFNQKILYNEVMLENARNMAYTGFGWPESANYKQTSVEHSHTVRNDIGEGMFENLRGPETSECNQLNKRRA

SEQ ID NO: 34691 - protein, 82 aa, Pantherophis guttatus
ISFKELSICFTEEEWGLLDSDQKALHGEVMLEMSRNVASLGNERKNEIYQESEEAPIQILKVEVGEENQWQPKNEDGIRLND

SEQ ID NO: 34692 - protein, 91 aa, Pantherophis guttatus
VSFKEVAVYFSKEEWSQLNVDQKALYREVMLENHRNVASLGNNGEDDEDSRELLQMISRGYNTKTPIILMEVESDERNQSNNYNQESLSSI

SEQ ID NO: 34693 - protein, 85 aa, Pantherophis guttatus
VSLEEVVVYFSKEEWSQLDADQKALHGEVMLENSRNLFSLGYNEKENKNYNEQHHAICEKEGKGKLGDQMQPKCHETNRSQSRMK

SEQ ID NO: 34694 - protein, 88 aa, Pantherophis guttatus
VSFKEVAVYFSEEEWSQLDPDQKALHSEVMLENHRNVVSLGNNGQKNQVINAKDGTEKFGIRMELETHDRNQSNDWNQENSSSTDAAM

SEQ ID NO: 34695 - protein, 90 aa, Pantherophis guttatus
NSFEEVAVDFTEEEWALLDPRQRALCSEVLLEVSRNMAALTGDGLENENDKQARLMPLQTTKHEVEEIMFDYEGDPKSQERRHSEDMGDS

SEQ ID NO: 34696 - protein, 85 aa, Pantherophis guttatus
VSFEDVAVFFSEEEWALLDFNQKSLYREVMLENAKNVESMVDRQKPENYKESGVNSLKRTETREGLLQNQEEPNMTENQLNNRME

SEQ ID NO: 34697 - protein, 96 aa, Pantherophis guttatus
VTFEEVAVHFSEEQLSQLDPDQKTLYWDVMLENQRNVASLEMSSQEERSSSTSAQHGGKKQRKRINLDLKMKIIKAHEEGKKVKTIGEEEGLACST

SEQ ID NO: 34698 - protein, 91 aa, Pantherophis guttatus
VSFEEVAMHFSEQEWALLNVNERALYKDVMQENYKHVLSLGDISEPGSPITTTLFGRLMGHLQATDSLNSDLPYLREELQEEKQIAQGSFD

SEQ ID NO: 34699 - protein, 90 aa, Pantherophis guttatus
ALFEEVAVYFSKEEWSRLDPDQKALHREVMLENFRNVAFLGTLQSPCLFLPRSHEGSTSKSSAPSPPPHCCCVQKQRSKVLQERTREQPG

SEQ ID NO: 34700 - protein, 86 aa, Pantherophis guttatus
VSFQEVAVCFTKEEWALLDSMQKSLHGEVMMENSRNVTSLEGDEQETVNDQKLDIAMSETLEEELGQETSEYQWSSKIHEEYHLQY

SEQ ID NO: 34701 - protein, 85 aa, Pantherophis guttatus
VSFEDIAINFSGEEWALLDFDQKTMYTEVMLENAKIVASICDEQNFENDKKPAAEKLQTVKNKIKERFFKNPWEPKRPTENQFNN

SEQ ID NO: 34702 - protein, 122 aa, Notechis scutatus
VSLKEVAVCFSEDEWSWLDPVQKDLYRDVMLENSRNVAFLEQWWRTYATHATGGTQSPLCGHVSLHQAAFWPTADFPFTKWGKKNGPLDCRQRSSGPHGLGLAASGPRPLLLDLGRCSQTLP

SEQ ID NO: 34703 - protein, 85 aa, Notechis scutatus
VSFEEVAVYFSEEEWSQLDPDQKALHSDVMLENHRNVVSLGNNGQDNQDSCELFQVINAKDAMEKFGIQMKFESHDRNQSKNWTQ

SEQ ID NO: 34704 - protein, 87 aa, Alligator mississippiensis
EAFEDVAVHFTREEWELLDDGDKGLQSCISLSDLQIHQRMHVGDKPYRCNECSKSFTRRYHLQVHTRVHTGEKPFSCPQCGKSFTKN

SEQ ID NO: 34705 - protein, 87 aa, Notechis scutatus
APFEEVAVDFTEEEWALLDSGQKDLCREVMLEVSKNMATLGDGLENENDKQPGLMQVQTVKHELEEMMFGHERGPQMQVRSPSEDGE

SEQ ID NO: 34706 - protein, 115 aa, Notechis scutatus
VSFEEVAVHFSKEEWSQLDPDQKSLYREIMLENSRNLAFLRNHVQENKEASQTLGDVERRVDFANPTETKEPERNLSGNDSKNSPNLPSPESQEILPKGEPKENIKAENAETSEE

SEQ ID NO: 34707 - protein, 85 aa, Notechis scutatus
VSFEEVAVYFSEEEWSQLDPHQKALHKEVMQENSQNVASLGANEHQNETCEITLQTIWPVRGAEKMANQKETECCQRNVSKHENQ

SEQ ID NO: 34708 - protein, 83 aa, Notechis scutatus
VSFEEVAMHFSEQEWALLNVNEKALYKDVMQENYKHVLSLGQLQSLLIFLSRRVHPKTSFAGDISQPGSPTTTTPFGRLLGHL

SEQ ID NO: 34709 - protein, 91 aa, Notechis scutatus
VSFEDVAVYFSEEEWSQLDPDQKALHWEVMLENYRNVASLGDNEQDHKESRESFQEFRRADVMEKPAIQTEFQRQERNPSNNWNKESSSSI

SEQ ID NO: 34710 - protein, 82 aa, Alligator mississippiensis
LTFDDVAVYFTRKEWALLDDGDKALYRDQMLRNYQALVNLDSSGMEETDSSAEEGSEGSLPCPEPSPDTAGAGTDSRAEEHP

SEQ ID NO: 34711 - protein, 90 aa, Notechis scutatus
SLFEEVTVDFTEEEWALLDSGQKALCREVMLEVSRNMDALGDRLENDSDKQMRLMPMETANLQVEEVIFGHQQDANPQEKSYSEDQGARS

SEQ ID NO: 34712 - protein, 93 aa, Notechis scutatus
VSFEEVAVHFSEEEWSQLDPAQKALHGEVMLENSRNLASLGYNEHGNKNCKEQCQPVDPNEQNRNFADQMQTKIDETNQSQSEVEKTFHSTHH

SEQ ID NO: 34713 - protein, 85 aa, Notechis scutatus
ITFEDVSIHFNEEEWTLLDHKEKNLYWNVMHQNFENIACLASDQIKGKSQKEDPLQEVFEPAVERLEKSKETILQHPEQKLNYTV

SEQ ID NO: 34714 - protein, 96 aa, Alligator mississippiensis
EAFEDVAVYLTQVEWELLEDEDKGLYRNQMLRNYQALVSLGSTWLLSGAEEQVPEEEPANLEPPQAPAGSLDKVDSMTPKEYQWHESQVKHQHSHA

SEQ ID NO: 34715 - protein, 85 aa, Notechis scutatus
LSFKEVAVYFSEEEWLQLDADQKALYGEVMLEISRNLASLGAPGTHKGWNECMGTNGVQQPPQPTNSLAGALWGYTAHAAQVNTS

SEQ ID NO: 34716 - protein, 85 aa, Podarcis muralis
VCFEDVAVGFTDEEWELLDPERRVLHKDVMEENRGIVASLYSDGLEIKDKGDHDKIPTMEKLNKYLESGKSSYSTSHQRNPIGKK

SEQ ID NO: 34717 - protein, 85 aa, Podarcis muralis
VCFEDVAVCFTDVEWELLDPDQRALHKDVMEENRGIVASLHSDGLEIKDKGDHDKIPTMEKLYKYLESRKSSNSTSHQGNLIRKK

SEQ ID NO: 34718 - protein, 88 aa, Podarcis muralis
VTFEEVAVDFTEEEWALLDPDQKCLHREVMEENYGNLDSLMLPWFSNLIRSGSLFQNQSVPKPRAHQRIHTGEKLYRCAECGKSFTES

SEQ ID NO: 34719 - protein, 91 aa, Microcaecilia unicolor
VTFHDIAICFSEEEWQLLGEHQKALYRNVMKENYDILISLAGRRTPHKLVGSSSNTRYQEALFWLHPNQLYSILKKCSLWYIPSALKNGSF

SEQ ID NO: 34720 - protein, 85 aa, Crotalus horridus
VSFEEVNVHFTNEEWSLLDPDQKALYQEIMLETSRIVTSLVDAQKNENYREPRVVPSQIIETEVREQKCADKWGRRRYEKKESYT

SEQ ID NO: 34721 - protein, 91 aa, Microcaecilia unicolor
VTFKDVAAYFLEVDWDLLGDWQKELYKKVIKEIHAILLSRGYSIVNPDALFKDIPTKYDEFRNDSERMRMCDEQQKEEWKRKDSSRDSTDP

SEQ ID NO: 34722 - protein, 90 aa, Pantherophis guttatus
DPFEEVTVDFTEEEWALLDSGQKALCREVMLEVTRNTATLGDGLENDNEKQVRLMPMQTANLQVEEVIFDHQQDAKPQENSHSEDQGERS

SEQ ID NO: 34723 - protein, 85 aa, Pantherophis guttatus
VSFEEVAVSFSEEEWSQLDPDQKALHSEVMLENHRNVASLGEKPYKCMECDKTFAHRGNLISHQMTHTGEKPYKCMECGKTFAYS

SEQ ID NO: 34724 - protein, 100 aa, Pantherophis guttatus
VTLEKVALGFTEEEWGLLNPEQKALHEEVMEEIKGIVVSLKAERQQSESKGEPSNLFFEGIGSEGEEREKKITKAELNNEAREGRIEKMMGKNEYAMCGK

SEQ ID NO: 34725 - protein, 91 aa, Pantherophis guttatus
VSFEEVAVYFSEEEWSQLDPHQKELHWEVMLENHRNVVSLGNNGQENKDSREPFQATNPGNGIEKPAIKMELEHHETKQSRDWKQESSSFT

SEQ ID NO: 34726 - protein, 85 aa, Pantherophis guttatus
VSFEEVAVYFTNEEWALLAAGQKALHREVMLENSRNVASLAGDGGEGSSNNSNVSKCRMSLVIPSCPGMKESWRRWEGAEEPRGS

SEQ ID NO: 34727 - protein, 86 aa, Pantherophis guttatus
VSFGEVAIHFTSEEWLLLDPSQKALHQEVMLETCRIMASLAVDEQKNDNYQEPNLVPLQIIKIEIPEEITADKWGMRKHEKNQAYN

SEQ ID NO: 34728 - protein, 85 aa, Pantherophis guttatus
VSFEEVAVYFSEEEWSHLDADQKALHGEVMLENSKNVASLERAHGEEGRNYIQQFHAHHPEEEDKKKLANERGSKGLERKQLTQG

SEQ ID NO: 34729 - protein, 89 aa, Micrurus lemniscatus
VSFEDVAVFFSMEEWALLDSEQKALYREVMLENKRNVASLGGDGWEMEDSGQEAAAPLPKDKKEEKIYRKQSSEEIQLMGELENCSGLP

SEQ ID NO: 34730 - protein, 99 aa, Paroedura picta
VSLQEGAMLFTEEEWALLDPGQRKLFWEVVQENHETLAFLWNYISQEDLRAPETSTRPFLGVSGAVSPEDKDMQFLRASLLSCFPRMETQFGLGTSAGK

SEQ ID NO: 34731 - protein, 120 aa, Paroedura picta
PTLEEVSVPFTEAEWALLDASQRALHREVMLENYGMVASLEGDIRESKKEGRPSTVLLDRVRFNGGEQLPRRKTDAKRRRENRSLASQEANFHKNPTQEKIDQGKEKKCEMQENENEEEP

SEQ ID NO: 34732 - protein, 84 aa, Paroedura picta
VSFEEVVVCFNEEEWALLDQGQRALYGEVMEENYETVASLGMRWSENEGDPYGGGPSEEEEEQKRENGETRRRKSSTSRRGVVP

SEQ ID NO: 34733 - protein, 96 aa, Paroedura picta
VTFEDVAVYFSEEEWDLLDLDQRALHRKVMAENWSNLDFLGAGRTPVLHSRPSHCDRKETPSGHPDQGLVTVEDVAVCFSEEEWVLLDPDQRALHQ

SEQ ID NO: 34734 - protein, 82 aa, Anolis carolinensis
VDCDELAVDFTEEELPLLDPDQKELHREAMEENFRLVISLDGDDDDDGGGDGGDDHDEQLEKEEGGPSEDLFKRVKCEENEP

SEQ ID NO: 34735 - protein, 85 aa, Anolis carolinensis
IAYEDVAVHFSPEEWVTLNPDQKVLHMQIMEEIHGIVDSLGQEPYTGQECGKGFAQNTYLLDQWRSNTGEKPYQCQECGKCFAYS

SEQ ID NO: 34736 - protein, 88 aa, Anolis carolinensis
VTFEDVSVDFSEEEWALLDPSQKALHQQIMEENLGIVSSLGSDSFPSTNHACDCVGTVKEEEHALAEYVKQSEEPALIEVKNQKLLKA

SEQ ID NO: 34737 - protein, 109 aa, Chelonia mydas
VTFDDISVYFSEQEWGSLEEWQKELYKNVMKGNYEALISLGNSFFFARLREAVRLLKVELAPAQVYSPIPFIPGGSVDYAISKPDLLSRIERGEEPCVGDRGRSEESEI

SEQ ID NO: 34738 - protein, 83 aa, Pogona vitticeps
VTFEEVAVCFTEEEWILLDLHQRALHTEVMKENYGMMASLGADRRESENKGGLCAMLLETTRHPEEEKQNKKRERKEKQKTES

SEQ ID NO: 34739 - protein, 95 aa, Pogona vitticeps
VTFGEVAVYFTEPEWALLDGDERALYWDVMQQNYEHLTFLGGMFQQGNSKTTVLCRILFGGSQDEDSLGSSSIVRSTQAWKSYILSRHKSLDSGN

SEQ ID NO: 34740 - protein, 100 aa, Pogona vitticeps
VTFEEVAVDFTKEEWVLLDPDQRALHEEVMEENHATVASLDDNWRETTICPQTRWNLRGKLAVVRHVPSYEEQKGNIQEKAYKRILTWKQFAQKMSLAHH

SEQ ID NO: 34741 - protein, 83 aa, Pogona vitticeps
VTFEEVAVCFTVDEWALLNPSQRALQRDVMEENYGNLASLTGDSRKSHSEEESYREYLERLICTEGGKDRRDTEAKQTKRSKS

SEQ ID NO: 34742 - protein, 83 aa, Pogona vitticeps
VTFDEVAVNFTEAEWVLLDQNQRACHRDVMEETHENVLSLAQEGRHSENQEELCWEGLETVVCKESHLQGRISEANSHSRSED

SEQ ID NO: 34743 - protein, 102 aa, Pogona vitticeps
TTFEEVAVHFTQEEWVLLDPDQRTLHREVMEENCGIVASLVPDLKHVSEMEPRVDPWILNGNKRSDIGSVTSLVPKLEAISETAPREDSQGLDEREITESRS

SEQ ID NO: 34744 - protein, 83 aa, Pogona vitticeps
VTFDEVAVNFTEAEWALLDQNQRACHRDVMEETRENVLSLACEGRQSENQEELCWVGLERIVCKESHLQGRRSETNTHSRNED

SEQ ID NO: 34745 - protein, 86 aa, Pogona vitticeps
VTFEELAVHFTKGEWAQLDWDQRSLHREVMLENYGMVASLGGDEWENKNEGTLYKVLLERPRSKERGERNEKICVEEKRKKTSPAF

SEQ ID NO: 34746 - protein, 84 aa, Pogona vitticeps
LTFEDVSVHFTTEEWALLDYRQKTLYWNVMHQNYNNVAFLGGGIDGLHKAPAPQQESPAHVVELSEICKETFSQGSELSLVREN

SEQ ID NO: 34747 - protein, 85 aa, Pogona vitticeps
VMFEEVAVAFTQEEWALLDHDQRVLHQEVMEENHEIVASLADNWRATTIWPQRGRSFRQKLALIRHHPSHEKEKSNFQGKAYKQI

SEQ ID NO: 34748 - protein, 82 aa, Pogona vitticeps
VTFEEVAVNFMEDEWTLLDPGQKALHKEVMEENVGHLISLGDGRKINKRMLTRMTRVGVFRKEHRGKPFKCSECGKSFSWRM

SEQ ID NO: 34749 - protein, 92 aa, Chelonia mydas
WALGVTKESASRKGWFNFSPEQGTWAIQLSMGQYREVTADWSPLDPPQSPSKIRVYLDYEGFPIPKPSMISQLDQGEEPWVPNVQGSQAREI

SEQ ID NO: 34750 - protein, 90 aa, Anolis carolinensis
VTFEDVSVHFREEEWVLLDPDQQALHWEVMGENHKTLASLGGAEKNNENGRASCKVWLKTKGYKEGEEGNLEREREDYRRKECSAETRKI

SEQ ID NO: 34751 - protein, 100 aa, Anolis carolinensis
VTFEDVSVHFSDEEWALLDADQQALHWEVMEENYKMVASLAGDGEESENRGALCTVWLQTLRCEEEEEQSEIAEADVDGRSQWLADPWEITVREIADQTR

SEQ ID NO: 34752 - protein, 85 aa, Thamnophis sirtalis
VSFEEVAVYFSEGEWSQLDPDKKVLHLEVMLENHRNVVSLGNNGQENQDSCELFQVISAKDRMGEFEIQKKFERHERNQSKNWNQ

SEQ ID NO: 34753 - protein, 86 aa, Anolis carolinensis
VTFEDVGVNFHDAEWALLDPGQRALHWEVMEENYKMIVSFGGDGQESENGQVPCDALLQTEKCHEMNHRGEKPYKCLQCGKSFSYK

SEQ ID NO: 34754 - protein, 92 aa, Thamnophis sirtalis
VSFEEVAVYFSKEEWSQLDSHQKALHGEVMLENSRNVASLGSDGQCEMIQDGEGKQEFRNWTQSRIPEKNKSIPRNKKPTSKCVQNENILAH

SEQ ID NO: 34755 - protein, 86 aa, Anolis carolinensis
VAFEDMTVDFTEEEWALLDTGQRALHGEVMEETFKLVFSLGADEQLEEKEEEPSRSLFKRDKLKENRPKGRTPDAGGKEQKEASAS

SEQ ID NO: 34756 - protein, 86 aa, Anolis carolinensis
VTFEEVAVYFTDEEWAMLDLGQRTLHCEVTEEILGMMMSPAGDGRLSENEGETCRLLSERATYKQTEENGRNEKSGDKALAQGAES

SEQ ID NO: 34757 - protein, 86 aa, Anolis carolinensis
VTFEDVSVHFSEEEWALLDPDQRALHWEVMRENYKTVASFVGAAKENENGGTPCKAWLNIPRYKEREEESLEMEAEKYRRNQCPAD

SEQ ID NO: 34758 - protein, 84 aa, Anolis carolinensis
VIFEDVSVDFSEEEWALLDPSQKALHQQIMEENLGIVSSLEGTKQVPGGSYKQIEQANPSALSGFASPPLRLSSENSVSQASTH

SEQ ID NO: 34759 - protein, 82 aa, Anolis carolinensis
VAFEDVAVPFSGEEWALLDPDQRALHKEVMEENLTIVASLSDGRESGNEMQPRMSWLQRVPCQQEKGKQIEMDSQKKMENKA

SEQ ID NO: 34760 - protein, 85 aa, Anolis carolinensis
VTFEDVFVHFSEEEWALLDPDQQALHWEIMGENYKMLASFGGAGKESENGTASYKVWFKPAEYIEGEEGNLETEREDYRRKECSA

SEQ ID NO: 34761 - protein, 85 aa, Thamnophis sirtalis
MSFGEVAIHFNSEEQLLLDPSQKALHEEVMLETCRIMASLVDEQKNENDQEPNPVPLQIIKIEIPEETSADRWGMRKHEKTQTCN

SEQ ID NO: 34762 - protein, 82 aa, Thamnophis sirtalis
LSFDDVAVFFSLEEWDLLDFNQKILYNEVMSENARNMASTGVGWPESANYKQTSVEHAQTVRNNLGEEMFENPRGPETSECN

SEQ ID NO: 34763 - protein, 99 aa, Thamnophis sirtalis
VSLEEVAVCFSEEEWSRLDPAQKALYRDVMLENSRNVAFLEQWRRTYGMRVRGGTQSPLCGHASPRQVAFWPKADFPLTKWEGKNGLLDCRHRSPGPRG

SEQ ID NO: 34764 - protein, 82 aa, Thamnophis sirtalis
VSFEELSIYFTEEEWGLLDCDQKALHGEVMLEMSKNVASLGSKQKNEIYQESEETPIQILKVEVEEENQWQPKSEDGVQLND

SEQ ID NO: 34765 - protein, 87 aa, Thamnophis sirtalis
MLFEDIAIFFSEEEWALLNPDQKLLYREITLENARNVTSIGERWEDEDSKKEMIEHLPSVKNEIGERMFQCQWGVQSPEEKQLKVEP

SEQ ID NO: 34766 - protein, 85 aa, Pantherophis guttatus
MSLKEVAVNFTEEEWALLDSTQKALHWEVMLENSRNVNTLGDEKEIENCQEPDMATSPAIHLELRKEIFGVQWRSQTHRESHSQP

SEQ ID NO: 34767 - protein, 91 aa, Pantherophis guttatus
VSFEEVAVYFSEEEWSELDPDQKALHWEVMLENYRNVASLGDNEQDHKESRESFQGLRHGDVMEKPAIQMELHKQDRNLSNNWNKESSSSI

SEQ ID NO: 34768 - protein, 82 aa, Cricetulus griseus
FTFSDVAVDFSQEEWECLDSAQRALCIDVMLENYSNLVFVENYFKCDPVHHHVKTENESCQCNELGKVLHDLSTCALYRTSE

SEQ ID NO: 34769 - protein, 91 aa, Marmota monax
EKIEDMAVSLIREEWLLDPSQKDLSRDNRPENYRNMFSLGVETRNENKELASKQVISTGVQPHGETAAKYNGDVIRGLEHGETQDLGKLER

SEQ ID NO: 34770 - protein, 83 aa, Peromyscus maniculatus
AALGDIPFYFSREEWGSLDPAQRDLFWDIKRENSRNAALGLGSQSQSDRGPPEEAVTALLGQTDCEVSASWNPEEAETEVWRS

SEQ ID NO: 34771 - protein, 97 aa, Ictidomys tridecemlineatus
EKIEDMAVSLIREEWLLDPSQKDLSRDNRPENYRNMFSLGVETRNENKELASKQVISTGVQPHGETAAKYNGDVIRGLEHGEAQDLGKLERQQGNPT

SEQ ID NO: 34772 - protein, 97 aa, Peromyscus maniculatus
EKIEDMAVSLIREEWLLDPSQKDLNRDNRPEKYRNMFSLDGETRSENKELFSKQVISTGIQPHGQTAASCNGDVILGLAHGKTQDLLGRLERQQGNP

SEQ ID NO: 34773 - protein, 90 aa, Heterocephalus glaber
GGLGDIPFYFSREEWGSLDPAQRDLFWDIKRENSRNTTLGLELQSQNKRALLEEVKVLPGQAGGERTVSCSPREAKAWRREHQPGASLGR

SEQ ID NO: 34774 - protein, 84 aa, Cricetulus griseus
VTYDDVHINFTWEEWALLNPSQKNLYKDVMRETYRNLTSIGYSWEDYHIEEYWQHSGRYERKERSQTGEKPSVYAHCVKAFAYD

SEQ ID NO: 34775 - protein, 119 aa, Cricetulus griseus
ATFEDVAIYFTQEEWSLLDRQQKELYRDVMQMNYELLVSLGKAFHKLLYTTVIGSGTSEQPWPLPEISFPHGQRHCLLWVAVLCHLFKPPAAKPDLIIRLKQRAAPWIKDPNGLKSGKS

SEQ ID NO: 34776 - protein, 91 aa, Cavia porcellus
VALGDIPFYFSREEWGSLDPAQRDLFWDIKRENSRNTTPGLGLQSQSKKVLLEEVVKVLPGQADGEGTVSWNPRDAEAWEKEHQPAVSLGR

SEQ ID NO: 34777 - protein, 83 aa, Cavia porcellus
ESLEDVAVYISQEEWGHQDPSKRTFSRDMVQESYETVDSLEPHILSQEALSIPAGTEKKFGFFSLPGKEKYDNQEGNVQSVSP

SEQ ID NO: 34778 - protein, 87 aa, Cricetulus griseus
ENFEDVAMYISQEWGHQDPSKRALSREMVQDSYENVGTLGVDKFENPERSVESVSPESAHPPVLLPGQARREVPWSPEQGRPDDREE

SEQ ID NO: 34779 - protein, 83 aa, Marmota monax
VALGDIPFYFSREEWGSLDPAQRNLFWDIKRENSQNAALGLGLKSQSSKTQLEEAVLVLPRQTGSEVSVSWSPEEAEAWESEN

SEQ ID NO: 34780 - protein, 95 aa, Mus caroli
VSFEDVAVHFTRDEWALLDPSQKSLYRDVMLETCRSLAAIGNRWEEENVEDHYKNPWRNMSGSMSETPCERTEDDQIEETLTWISNLHASMTVFP

SEQ ID NO: 34781 - protein, 89 aa, Mus caroli
VSLGDIPFYFSREEWSSLDPAQRNLFWNIKRKNSRDAALGLKPKSQKPPAEEAVTALLGQTEVPMSWNPGEAETEVWESENPMRTALDP

SEQ ID NO: 34782 - protein, 89 aa, Mus musculus
GSLGDIPFYCSREEWSSLDPAQRNLFWNIKRKNSRDAALGLRPKSQKPPAEEAATALLGQTEVPMSWNPEEAETEVWESENPMRTALDP

SEQ ID NO: 34783 - protein, 83 aa, Ictidomys tridecemlineatus
VALGDIPFYFSREEWGSLDPAQRNLFWDIKRENSRNAALGLGLKSQSSKTQLEEAVLVLPRQTGSEVSVSWSPEEAEAWESEN

SEQ ID NO: 34784 - protein, 96 aa, Fukomys damarensis
HPFPAVTVASAQEPWVLLDRSQKELYWDAMLQKYGSAVSLGEDRFALGPRALHPVRVCACLMPPSAGLPDPEPIPDREANPEQQLSPPPTRQDPPT

SEQ ID NO: 34785 - protein, 90 aa, Peromyscus maniculatus
LTFEDIEMHFSKEEWCSLDPSQKTLYSDVMLNIYKMATSLGLKPGDVMGNDQPVSASTSEIEARPSKVSKARKKATQNNTNRKSHADTRR

SEQ ID NO: 34786 - protein, 89 aa, Mus musculus
GSLGDIPFYCSREEWSSMDPAQRNLFWNIKRKNSRDAALGLRPKSQKPPAEEAATALLGQTEVPMSWNPEEAETEVWESENPMRTALDP

SEQ ID NO: 34787 - protein, 92 aa, Fukomys damarensis
VTFRDVAIDFSQEEWEFLDSAQRNLYRDVMWENYSNFVSLDYQRVHNGEKLYECKECRKTFIRRSTLSQHLRIHTGEKPYKCKECGQAFRQR

SEQ ID NO: 34788 - protein, 84 aa, Ictidomys tridecemlineatus
LTFEDVAVYFSEEEWQFLDPSQKTLYNDVMQDNYETVISLGLKLKNGTGNDQLKSVSPSEIQAPGCKVSKKTRVKVVQKTMGKE

SEQ ID NO: 34789 - protein, 87 aa, Dipodomys ordii
VALGDVPFFFSQEEWGSLDPAQRDLFWDIKQESSRNTVLDLGLKSLSVETGLAEVAMALPAPAGGGAGGQAAVAWSPEKAETWESEN

SEQ ID NO: 34790 - protein, 93 aa, Dipodomys ordii
ATFKDVAVYLSQEQWGDLEPTQEFYGEYVLEEDCGIVVSLSFPIPRLQDTALGEGEPQIPDDQELEEPEILSFTYTGDRSGDEHECAAQEGGS

SEQ ID NO: 34791 - protein, 95 aa, Dipodomys ordii
MSFDDVAIYFTWKEWQDLDPGQKTLHRDVMLETYSNLMSLGCLRPYRNDDPARAIVLHYLLIIRHSVPKPKLIVKLEQGAETWIREGSDKNFKDI

SEQ ID NO: 34792 - protein, 97 aa, Odobenus rosmarus
EKIEDMAVSLIREEWLLDPSQKDPSRDNGPENYRNMFSLAGETRNENRELSSKQVISPGIQPHGETAAKCNGDVIGGLEHGEARDLLGRLERQRGNP

SEQ ID NO: 34793 - protein, 83 aa, Vicugna pacos
SRFNDAAYYYWMLSMQCLDIAQDPAQKDVMLGKFHHFQHLAELYHGYHAIQRYTMKKLRLRTEGLQLEEPFSFHLPETLFNIS

SEQ ID NO: 34794 - protein, 92 aa, Delphinapterus leucas
VTFGDIPFYFSREEWGSLDPAQRDLFWDIKRENSQNVALGLGLTSHSERSRLEEVVTALPGQAAGDVTVSWRLEEAETRPGVPRGRAVGARR

SEQ ID NO: 34795 - protein, 97 aa, Delphinapterus leucas
EKIEDMAVSLIREEWLLDSSQKDLSRDNRPENYRNMFSLGGETRNENRELASKQVISTGIQPHGETAAKCNGDVIGGLEHGEARDLLGTLERQRGNP

SEQ ID NO: 34796 - protein, 86 aa, Cervus elaphus
VTLKDVVVTFTQQEWKLLDLTQRTLYQEVVLETSRLLVSLGDKAKTKTTETTAAQQALFKGHLLQRSVSQEGCSVSPLGQAWELEG

SEQ ID NO: 34797 - protein, 90 aa, Tupaia chinensis
VVFEDVVVNFTKEEWALLDPSQKKLYRDVMWETIKNLEYIASGGGARSLANQGPRGGPCELVSEVSRVFTSAAGLGVWLSPDPCGDSVFA

SEQ ID NO: 34798 - protein, 96 aa, Tupaia chinensis
VAFEDVAVNFTKEEWALLDPAQRKLYKDVMWETIKNLNTAGLSASGRCDCELHTGRVGFAGSFTEETLQRCDAGNHQEPGLYSYLRKHERTHNGEK

SEQ ID NO: 34799 - protein, 85 aa, Delphinapterus leucas
VTFADVAVLFTPEEWLFLDSAQRSLYRDVMLENYRNLASVEPQLQPQDSIPNQDIFAEIPSIGTKREQPQTGEKLYKCNVLRKPI

SEQ ID NO: 34800 - protein, 97 aa, Gulo gulo
EKIEDMAVSLIREEWLLDASQKDPSRDDRPENYRNMFSLGGETRNENRELSSKQVISPGIQPHGETAAKCNGDVIGGLEHGEARDLLGRLERQRGNP

SEQ ID NO: 34801 - protein, 97 aa, Colobus angolensis
LKMEDVALTLSPGWTQLDSSQVNIYRDEKQENHSNLVSLGGEIQTESRDLPPVRKLSKKEHGKICHLREDIPQNPTCAEAGEQESRLQRKQKNAVGS

SEQ ID NO: 34802 - protein, 99 aa, Chelonia mydas
VTFEEVAVYFTEGQGGLLDPAQRALYRDVMQENYETVTSLASDETVSENEEENCQSEGPEQMEPLGTVMKTADGNFSQCLEQGEAWGSWHRLERQLGNH

SEQ ID NO: 34803 - protein, 91 aa, Sus scrofa
VTFGDIPFYFSREEWGSLDPSQRDLFWDIKRENSRNVAPGLGFKSPSERPQLEEVVTAIPGQAVGDVAASWRPEAAEAWEREARPGARGRA

SEQ ID NO: 34804 - protein, 82 aa, Chrysochloris asiatica
LMFEEVAMYFSQEEWELLEPTQKMLYHDVMQENYEAVISVGLKLKNDIGNHMLISLPSLEMEASGDTVSKKSRVNIFYKTTG

SEQ ID NO: 34805 - protein, 97 aa, Mandrillus leucophaeus
EKIEDMAVSLIREEWLLDPSQKDLSRDNRPENFRNVFSLGGETRNENRELASKQVISTGIQPHGETAAKCNGDIIRGLEHGEARDLLGRLERQRGNP

SEQ ID NO: 34806 - protein, 93 aa, Bos mutus
LTFEEVAMYFSQEEWELLDPTQKALYNDVMQENYETVISLAVPAHQLLAFPKQTNTSEWTVAPELILPESQSLLTFEEVAMYFSQEEWELLDP

SEQ ID NO: 34807 - protein, 84 aa, Nomascus leucogenys
LTFEDVAVYFSEEEWQLLNPLEKTLYNDVMQDIYETVISLGLKLKNDTGNDHPISVSTSEIQTSGCKVSKKTRMKIAQKTMGRE

SEQ ID NO: 34808 - protein, 88 aa, Bos mutus
LTFKDVAVNFTQEEWHHVDAAQRRLYRDVMLENYSHLVSLDWKTRPEAKSSHLQQSISKVSLSTDELSHTTGEDAWDLSGQLERHKEN

SEQ ID NO: 34809 - protein, 97 aa, Bos mutus
EKIEDMAVSLIREEWLLDSSQKDPSRDNRPENYRNMFSLGGETRNENRELTSKQVISTGIQPHGETAAKCNGDVIGGLEPGEARDLLGSLERQRGNP

SEQ ID NO: 34810 - protein, 91 aa, Nomascus leucogenys
VALGDIPFYFSREEWGTLDPAQRDLFWDIKRENSRNTTLGLGLKGQSEKSRLQEVVPVVPGQTGSDVTVSWSPEEAEGWESENRPRAALGP

SEQ ID NO: 34811 - protein, 98 aa, Gorilla gorilla
LKMEDVALTLTPGWTQLDSSQVNLYRDEKQENHSSLVSLGGEIQTKSRDLPPVKKLPEKEHGKISCHLREDIAQIPTHAEAGEQEGRLQRKQKNAIGS

SEQ ID NO: 34812 - protein, 97 aa, Nomascus leucogenys
EKIEDMAVSLIREEWLLDPSQKDLNRDNRPENFRNVFSLGGETRNENRELASKQVISTGIQPRGETAAKCNGDVIGGLEHGEAQDLLGRLERQRGNP

SEQ ID NO: 34813 - protein, 83 aa, Canis lupus
VKVENVAVSLTWEEWDRRDAAQRDFCPESALKDCRNTVSLVSQNLETRTEKKEFIPKQEILEVEPQGQLQEWSPRLAPLFSEC

SEQ ID NO: 34814 - protein, 97 aa, Muntiacus muntjak
EKIEDMAVSLIREEWLLDSSQKDLSRDNRPENYRNMFSLGGETRNENRELTSKQVISTGIQPHGETAAKCNGDVIGGLEPGEARDLLGSLERQRGNP

SEQ ID NO: 34815 - protein, 98 aa, Bos indicus
VTFGDIPFYFSREEWGSLDPAQRDLFWDIKRENSRNVALGLGHRSHSEKSRLEEVVTALPDQAAGNETASWRPEEAEAWEGGARPGAPRGRVVGARRG

SEQ ID NO: 34816 - protein, 98 aa, Nomascus leucogenys
LKVEDVALTLTPEWTQQDSSQGNLYRDEKQENHGSLVSLGDEKQTKSRDLPPAEELPEKEHGKILCHLREDIAQIPTCAEAGEQEGRLQRKQKNATGG

SEQ ID NO: 34817 - protein, 84 aa, Gorilla gorilla
LTFEDVAVYFSEEEWKLLNPLEKTLYNDVMQDIYETVISLGLKLKNDTGNDHPISVSTSEIQTSGCEVSKKTRMKIAQKTMGRE

SEQ ID NO: 34818 - protein, 89 aa, Lynx canadensis
VMFEEVSVCFTSEEWECLGPIQRALYWDVMLENYGNVTSLEWETMTENEEVTPKPSISQRADSQKGTSKRLQGSVPQTLDFEEECEWQI

SEQ ID NO: 34819 - protein, 98 aa, Muntiacus muntjak
VTFGDIPFYFSREEWGSLDPAQRDLFWDIKRENSRNVALGLGRRSHSERSQLERVVTALPDQAAGDETTSWRPEEAEAWEGGARPGAPRGRGAGTRRG

SEQ ID NO: 34820 - protein, 97 aa, Oryctolagus cuniculus
EKIEDMAVSLIREEWLLNPLQKDLSRDNRPENYRNMFSLGGETRNENRELASKQVISTGIQPHGETAAKCNGDVIRGLEHGEAQDLLGRLERQRGNA

SEQ ID NO: 34821 - protein, 84 aa, Ailuropoda melanoleuca
VTFGDIPFYFSREEWGSLDPAQRELFWDIKRENSRNVALGSAQLGPLPLPLKCFSAGILSCPCFTVEETEAGVCAAQGFLDLSP

SEQ ID NO: 34822 - protein, 103 aa, Macaca fascicularis
VVFEDVAVYFTRKEWGMLDKRQKELYRDVMRMNYELLASLDILLIPTVEDGDTALLHHLGPHFSSLHPLRTGPAAAKPDLISKLERRAAPWIKDPNGPKWGKG

SEQ ID NO: 34823 - protein, 82 aa, Pteropus alecto
VTLEDVAVYLSQEEWGCLDSAQRDHSWDMLPESEGLGMQFEDGEDTRKDTPVRTEWDQMLSARCRGPSPPTLVQEPAPVRGL

SEQ ID NO: 34824 - protein, 87 aa, Puma concolor
VTFQDVAVDFSLEELTYLSAAQRNLYREVMLENYRNLVSLDGEKRPKTKDLTPEQSLPVEKPSLGVGMEDLQVGNFFSVHEGESSPD

SEQ ID NO: 34825 - protein, 91 aa, Gorilla gorilla
VALGDIPFYFSREEWGTLDPAQRDLFWDIKRENSRNTTLGFRLKGQSEKSLLQEVVPVVPGQTSSDVTVSWSPEEADAWESENRPRAALGP

SEQ ID NO: 34826 - protein, 83 aa, Myotis lucifugus
VKIEDMAVSLILEEWGCQNLARRNLSRDNRQENYGNVFSQGKNNVQLSVDKDLETTEPISSDQVENGNISQFPNLIVIQRSSK

SEQ ID NO: 34827 - protein, 97 aa, Gorilla gorilla
EKIEDMAVSLIREEWLLDPSQKDLSRDNRPENFRNVFSLGGETRSENRELASKQVISTGIQPHGETAAKCNGDVIRGLEHEEARDLLGRLERQRGNP

SEQ ID NO: 34828 - protein, 86 aa, Bos mutus
VTLEDVAVYLSQEEWGCLDLAQQDHSCDVLLEDAERGRRLEDGEDSGEDASLSTAWAQALPDLGPGPGQARPQRPQDRAGPLGVRK

SEQ ID NO: 34829 - protein, 87 aa, Phascolarctos cinereus
VTFEDVAVYLSQEEWGHQEPSKKAISREAMQENYENVVTLESQIPNQDPATQVEQEEKARDPNLQSVKEQGSSRAEEKKENKEESSP

SEQ ID NO: 34830 - protein, 89 aa, Puma concolor
VMFEEVSVCFTSEEWECLGPIQRALYWDVMLENYGNVTSLEWETMTENEEVTPKPSISQRADSQKGTSKRLQGSVPQTLDFEEEYEWQI

SEQ ID NO: 34831 - protein, 85 aa, Nomascus leucogenys
LTFEDTAMYFSEEEWQLLDPLEKTLYNDVMQDIYETAISLTLKLKNDTGNDYPIISVSASEIQTAGYKVSKKNRMNIAQKTKGRE

SEQ ID NO: 34832 - protein, 91 aa, Desmodus rotundus
VTFGDIPFYFSQEEWGSLDPAQRDLFWDIKRENSRNVALGLGLKSQRGPSRLEEAVRVLPGVADNDVTVAWSPEEAESWESEARPGVPLEP

SEQ ID NO: 34833 - protein, 91 aa, Macaca fascicularis
VALGDIPFYFSREEWGTLDPAQRDLFWDIKRENSRNTTLGLGLKGQNEKSRLEEVVPVLPGQTGSDVTVSWSPEEAETWESENRPRAALGP

SEQ ID NO: 34834 - protein, 93 aa, Phyllostomus discolor
LTFEEVAVYFSREEWELLDPSQKALYSDVMKENYETVVSLAVPAHQTLVFPEQTNTKDWTVASELFLPESQTLLTLEEVAVYFSREEWELLDP

SEQ ID NO: 34835 - protein, 88 aa, Macaca mulatta
ESLEDVAMYISQEEWGHQDPSKRALSRDTVQESYENVDSLGEEKFENLEEGVPSVSSENTHPQVLLPDQARGEVPWSPELGRPRDRQQ

SEQ ID NO: 34836 - protein, 89 aa, Bison bison
VMFEEVSVCFTSEEWACLSPVQRALYWDVMLENYGNVTSLEWETMTENEEVTSKLNISQRADSQRGISKRFQGGVPYLLDFEEEYEWQI

SEQ ID NO: 34837 - protein, 84 aa, Cebus imitator
ATCDDRAVSLCQQEWMCPGPARRALYRDATQEDRHVSLATGVPWGYEETRTLLAILSSSQFYGKLQTCQQNSQIYRAMAERLWE

SEQ ID NO: 34838 - protein, 97 aa, Cebus imitator
EKIEDMAVSLIREEWLLDPSQKDLSRDNRPENFRNMFSLGGETRSENRELASKQVISTGIQPHGETAAKCNGDVIGGLEHGEARDLLGRLERQRGNP

SEQ ID NO: 34839 - protein, 84 aa, Macaca mulatta
LTFEDVAVYFSEEEWQLLDPPEKTLYNDVMQDIYETVISLGLKLKNDIGNDHPISVSTSEIQTSGCKVSKKTRMKIAQKTMGRE

SEQ ID NO: 34840 - protein, 84 aa, Callithrix jacchus
LTFEDVAVYFSEEEWQLLDPPEKTLYNDVMQDIYETVISLGLKLKSDTGNDHPVSVSTSEMQTPGCKVSENTRRKIAQKTMGRE

SEQ ID NO: 34841 - protein, 91 aa, Pan troglodytes
VALGDIPFYFSREEWGTLDPAQRDLFWGIKRENSRNTTLGFGLKGQSEKSLLQEMVPVVPGQTGSDVTVSWSPEEAEAWESENRPRAALGP

SEQ ID NO: 34842 - protein, 93 aa, Tursiops truncatus
VKIEDMAVSLILEEWGCQNLARRNLNRDTRQENYGNVISQGCEKNEESTSKAEIAEDSASHGETTGKFQKDFGEKRDQQGRVVERQQRNPEEK

SEQ ID NO: 34843 - protein, 97 aa, Sus scrofa
EKIEDMAVSLIREEWLLDPSQKDLSRDNRPENYRNMFSLGAETRNENRELASKQVISTGIQPHGETAAKCNGDVIGGLEHGEARDLLGTLERQRGNP

SEQ ID NO: 34844 - protein, 106 aa, Camelus dromedarius
VTFGDVAVFFSRDEWLHLNPTQRALYREVMLDNFSALASLGEEVARRGHLLVWLVSPGVALLRSVQTPFPSSRAGIPFSTPKVICRLQLGEDPCMVEREIPEDPRL

SEQ ID NO: 34845 - protein, 97 aa, Bison bison
EKIEDMAVSLIREEWLLDSSQKDPSRDNGPENYRNMFSLGGETRNENRELTSKQVISTGIQPHGETAAKCNGDVIGGLEPGEARDLLGSLERQRGNP

SEQ ID NO: 34846 - protein, 83 aa, Camelus dromedarius
VTFGDIPFYFSREEWGSLDPAQRDLFWDIKRENSRNLSLGLGLKDQSERSRLDEVVTALPGQVVGDGTVSWRPEEAEAWEGEA

SEQ ID NO: 34847 - protein, 85 aa, Callorhinus ursinus
LTFGDIPFYFSREEWGSLDPAQRELFWDIKRENSRNVALGAGLQSQSQRSGLGEAVTALPGQAGGGGGGGGGGRGDVTVSWSPEE

SEQ ID NO: 34848 - protein, 84 aa, Cebus imitator
LTFEDVAVYFSEEEWQLLDPPEKTLYNDVMQDIYETVISLGLKLKSDTGNDHPVSVSASEMQTPGCKVSKNSRMKIAQKTMGRE

SEQ ID NO: 34849 - protein, 97 aa, Rhinolophus ferrumequinum
EKIEDMAVSLIREEWLLDPSQKDLRRDNRTENYRNMFSLGGETRSENRELASKQVASAGVQPHGETAARCNGDVTGALEHGEARDLLGSRVERQRAN

SEQ ID NO: 34850 - protein, 98 aa, Pongo abelii
LKMEDVALTLTPGWTQLDSSQVNLYRDEKQENHSSLVSLGGEIQTKSRDLPPVKKLPEKEHGKISCHLREDIAQIPTCAEAGEQEGRLQRKQKNAVGS

SEQ ID NO: 34851 - protein, 82 aa, Bos taurus
LTFEDVAFYFSEEEWKIMTPDEKTLYLDVMQELYEDVASVGLKLKNDTGNDPPVSLPTLEIQPSGCEVLGKAAMKDAETTVG

SEQ ID NO: 34852 - protein, 82 aa, Bos taurus
LTFEDVALYFSKEEWKIMTPDEKTLYLDVMQELYEDVASVGLKLTNDPENDPPVSLPTLEIQPSGCEVLGKATMKDAETTVG

SEQ ID NO: 34853 - protein, 89 aa, Ovis aries
VMFEEVSVCFTSEEWACLSPVQRALYWDVMLENYGNVTSLEWETMTENEEVTSKLNISQRADSQRGISKRFQGGVPQLLDFEEECEWQV

SEQ ID NO: 34854 - protein, 82 aa, Bos taurus
LTFEDVALYFSEEEWKIMTPDEKTLYLDVMQELYEDVASVGLKLTNDPENDPPVSLPTLEIQPSGCEVLGKATMKDAETTVG

SEQ ID NO: 34855 - protein, 84 aa, Enhydra lutris
VMVDNVAVSLTWEEWDHLDLAQRNFCWENALKDCRNTVSLVTPSLETRTENKEFIPKQEVLEEVEPQGQLQEGFHRKGPPFSRC

SEQ ID NO: 34856 - protein, 90 aa, Otolemur garnettii
VTLGDIPFYFSREEWGTLDPAQKDLFWDIKRENSRNTALGLGLKSHSERSHLEEVTTLPSQAVGELTVSWSCKEAETWESENQPRAALGQ

SEQ ID NO: 34857 - protein, 97 aa, Ovis aries
EKIEDMAVSLIREEWLLDSSQKDLSTDNRPENYRNMFSLGGETRNENRELTSKQVISTGIQPHGETAAKCNGDVIGGLEPGEARDLLGSLERQRGNP

SEQ ID NO: 34858 - protein, 84 aa, Pongo abelii
VTFKDVVVEFSKEEWGQLDSAVKNLYRNVMLENFRNLNSLRKDMKSISGEESSHGVIMTRLTESGHPSSDVWKGENWLYRNQKK

SEQ ID NO: 34859 - protein, 91 aa, Rhinopithecus roxellana
VALGDIPFYFSREEWGTLDPAQRDLFWDIKRENSRNTTLGLGLKGQNEKSRLEEVVPVLPGQTGSDVTVSWSPEEAEAWESENRPRAALGP

SEQ ID NO: 34860 - protein, 98 aa, Bison bison
VTFGDIPFYFSREEWGSLDPAQRDLFWDIKRENSRNVALGLGHRSHSEKSRLEEVVTALPDQAAGNETASWRPEEAEAWEGGARPGGARGRVVGARRG

SEQ ID NO: 34861 - protein, 85 aa, Ovis aries
VTFGDIPFYFSREEWGSLDPAQRDLFWDIKRENSRNVALGLGHRSHSERTQLEEVVTALPDQAAGDETASRSPERAEAWEGGARP

SEQ ID NO: 34862 - protein, 94 aa, Odocoileus virginianus
VKIEDMAVSLILEEWGCQNLARRNLNRDARQENYGNVISQVTLNHLSVKVSVTFTDATTSLSPSTLLLEHITSLLPGGKKPFHVSEGPRHLPDC

SEQ ID NO: 34863 - protein, 97 aa, Callithrix jacchus
EKIEDMAVSLIREEWLLDPSQKDLSRDNRPENVRNMFSLGGETRSENRELASKQVISTGIQQHGETAAKCNGDVIGGLEHGEARDLLGRLERQRGNP

SEQ ID NO: 34864 - protein, 89 aa, Panthera pardus
VMFEEVSVCFTSEEWECLGPIQRALYWDVMLENYGNVTSLEWETMTENEEVTPKASISQRADSQKGTSKRLQGSVPQTLDFEEECEWQI

SEQ ID NO: 34865 - protein, 89 aa, Leptonychotes weddellii
VMFEEVSVCFTSEEWECLGPIQRALYWDVMLENYGNVTSLEWETMTENEEVTPKPSISQRADSQKGTSKRLQGGVPQILDFEEACEWQV

SEQ ID NO: 34866 - protein, 87 aa, Pongo abelii
PASTSFHPPRIQEEWGLLDRSQKELYWDAMLEKYGTVVSLGLPPHQPEAQAQSELGMLLTGTGVCRSLRSGNESEGLPGCPEAQPPQ

SEQ ID NO: 34867 - protein, 97 aa, Ailuropoda melanoleuca
EKIEDMAVSLIREEWLLDPSQKDPSKDNRPENYRNMFSLGGETRNENRELSSKQVISTGIQPHGETAAKCNGDVIGGLEHGEARDLLGRLERQRGNP

SEQ ID NO: 34868 - protein, 97 aa, Pongo abelii
EKIEDMAVSLIREEWLLDPSQKDLSRDNRPENFRNVFSLGGETRSENRELASKQVICTGIQPHGETAAKCNGDVIGGLEHEEARDLLGRLERQRGNP

SEQ ID NO: 34869 - protein, 101 aa, Camelus dromedarius
VMFEEVSVCFTSEEWACLGPIQRALYWDVMLENYGNVTSLEWETMTENEEVTSKSSISQRADSQKGTSKRLQGGVPKVLDFEEDCEWQVLAKKMTAELREA

SEQ ID NO: 34870 - protein, 93 aa, Rhinopithecus roxellana
LTFEDMAVYFSEEEWQLLDPLEKTLYNDVMQGIYETVISLGLKLKNYTGNDYPISVSASEIKTAGCKVSKKTRMKIAQKTYGFSKEEKKLTTC

SEQ ID NO: 34871 - protein, 97 aa, Ursus maritimus
EKIEDMAVSLIREEWLLDPSQKDPSRDNKPENYRNMFSLGGETRNENRELSSKQVISTGIQPHGETAAKCNGDVIGGLEHGETRDLLGRLERQRGNP

SEQ ID NO: 34872 - protein, 82 aa, Bos taurus
LTFEDVALYFSEEEWRIMTPEQKTLYFDVMGELYEDVTFLGLKLTNDTGNDPPVSLPTLEIQPSGCEVLGKATMKDAEITVG

SEQ ID NO: 34873 - protein, 86 aa, Balaenoptera acutorostrata
EDVADVAVSFILEEWGHLDQSQKSLCRDDRKENYGSITSMAYSDYLHHNKNYESRNDNVELIVKQISDEAESPWMTSGSPERNVPP

SEQ ID NO: 34874 - protein, 86 aa, Ursus americanus
PASTSFHAPRIQEEWGLLDPSQKELYWDAMLEKYGTVVSLGIPAPPPEAQAESEPEARAESEPEARAESEPEALRSETEGRRSLHP

SEQ ID NO: 34875 - protein, 97 aa, Rhinopithecus roxellana
LKMEDVALTLSPGWTQLDSSQVNIYRDEKQENHSNLVSLGGEIQTESRDLPPVKKLSKKEHGKICHLREDIPQNPTCAEAGEQEGRLQRKQKNAVGS

SEQ ID NO: 34876 - protein, 97 aa, Rhinopithecus roxellana
EKIEDMAVSLIREEWLLDPSQKDLSRDNRPENFRNVFSLGGETRSENRELASKQVISTGIQPHGETAAKCNGDIIGGLEHGEARDLLGRLERQRGNP

SEQ ID NO: 34877 - protein, 84 aa, Macaca nemestrina
LTFEDVGVYFSEEEWQLLDPPEKTLYNDVMQDIYETVVSLGLKLKNDTGNDHPISVSTSEIQTSGCKVSKKTRMKIAQKTMGRE

SEQ ID NO: 34878 - protein, 84 aa, Macaca mulatta
ITLKDVAVNFSRGEWKKLEPFQKELYKEVLLENFRNLEFLGKDTFSSLPSAYPWVSFCPLLLKGKCYVKYFVLAGDPGTDRTDP

SEQ ID NO: 34879 - protein, 92 aa, Cercocebus atys
VMFEEVSVCFTSEEWACLGPIQRALYWDVMLENYGNVTSLGKDSSFCDGNKFHSWGLGKAIKEVAFILELEEKCRILFGEINIQNWVISHRN

SEQ ID NO: 34880 - protein, 97 aa, Leptonychotes weddellii
EKIEDMAVSLIREEWLLDPSQKDPSRDNRPENYRNMFSLGGETRNENRELSSKQVISPGIQPHGETAAKCNGDVIGGLEHGEARDLLGRLERQRGNP

SEQ ID NO: 34881 - protein, 82 aa, unidentified
  REGION 1..82: note = Bos indicus x Bos taurus
LTFEDVALYFSEEEWRIMTPEQKTLYFDVMGELYEDVTFLGLKLTNDTGNDPPVSLPTLEIQPSGCEVLGKATMKDAETTVG

SEQ ID NO: 34882 - protein, 82 aa, Neomonachus schauinslandi
VTLEDMAAYLSQEEWECVDPAQRDCSWDVLPEHGGLGPQLEDGQDTLEDVSMGRERDRELVRGMAGTEQPLERGGPRRVEKP

SEQ ID NO: 34883 - protein, 91 aa, Felis catus
LTFEDVVVSFSEEEWKLLDPAQKILYNDVMQENYESVISLGLKLKNDTGHDRPVSVSASEIQASGRKVLGKARMKGAQKTTGKENHGATRR

SEQ ID NO: 34884 - protein, 92 aa, Physeter macrocephalus
VTFGDIPFYFSQEEWGSLDPAQRDLFWDIKRENSQNVALGLGLTSHSERSRLEEVVTALPGQAAGDETVSWRLEEAEARPGAPRGRLAGARR

SEQ ID NO: 34885 - protein, 89 aa, Leptonychotes weddellii
VTVENMAVSLTWEEWDRLDPAQRDFCPESALKDCRNTVSLVSLSLETRTENKEFIPKQEVLEEVDPQGQLQEGSHRKVPPFSGCDDTHK

SEQ ID NO: 34886 - protein, 84 aa, Cercocebus atys
LTFEDVAVYFSEEEWQLLDPPEKTLYNDVMQDICETVISLGLKLKNDTGNDHPISVSTSEIQTSGCEVSKKTRMKIAQKTMGRE

SEQ ID NO: 34887 - protein, 89 aa, Neomonachus schauinslandi
VTVENMAVSLTWEEWDRLDPAQRDFCPESALKDCRNTVPLVSLSLETRTENKEFIPKQEVLEEVDPQGQLQEGSHRKVPPFSGCDDTHK

SEQ ID NO: 34888 - protein, 101 aa, Monodelphis domestica
VKIEDMAVSLIQEEWGLLDPAQKDLCNDGRPENYGHVYSLGGETRSENRDLTQNQLPSAEMEPHGERTAKHNGNVPESVDHGQAGECTGRVDRRRGNPTGE

SEQ ID NO: 34889 - protein, 87 aa, Monodelphis domestica
ERAASSLPSGSQEEWGLLDPSQKELYWDVMLEKYGSVVSLGGRGQKPRECPSRDAARPQASPHPVPRQGQGAGPGASSGRGLWPVAD

SEQ ID NO: 34890 - protein, 109 aa, Camelus dromedarius
VTFGDVAVDFSQEEWEWLDCAQRTLYRSVMLENYRSLVSLGKGPSRCITVPCTRPLLSLQTRTDAQHHHAPFLLTYVGLCVSKPEMISSLEQRKEPWTVKRKCTRGQCP

SEQ ID NO: 34891 - protein, 84 aa, Camelus dromedarius
VTFADVAVLFTPEEWLFLDSAQRSLYRDVMLENYRNLASARSAHPLHLSTRAGDQLCTPSMFSHLEPREELCITERGLFPGAHA

SEQ ID NO: 34892 - protein, 97 aa, Physeter macrocephalus
EKIEDMAVSLIREEWLLDSSQKDLSRDSRPENYRNMFSLGGETRNENRELASKQVISAGIQPHGETAAKCNGDVIGGLEHGEARDLLGTLERQRGNP

SEQ ID NO: 34893 - protein, 84 aa, Otolemur garnettii
LTFEDVAVYFSEEEWQLLDTSKKTLYNNVMQDNYETVISVGLMLRNDTGNDQPISVSASEIQTPRCKVSKNSRMKVVQQTRVRK

SEQ ID NO: 34894 - protein, 85 aa, Pongo abelii
LTFEDMAAYFSEEEWQLLDPLEKTVYNDVMQAIYETAICLGKQRAGKIIGTKMASSFSKEEKKLTTCKQELPKLMDLHGKGHTGE

SEQ ID NO: 34895 - protein, 98 aa, Otolemur garnettii
PASTSFQPPRIQEEWGLLDPSQKELYWDAMLEKYGSVVSLAGLPPPSEAEPETLGMGTNISRSRCPGVECEGPSGCPEVQRPRGPEPVSWEGLAQAAP

SEQ ID NO: 34896 - protein, 84 aa, Macaca mulatta
VTFKDVVVEFSKEEWGQLDSAVKNLYRNVMLENFRNLNSLRKDMQSISGEESSHGLMITRFTGSGHPSSDVWKGENWLHRNQKK

SEQ ID NO: 34897 - protein, 82 aa, unidentified
  REGION 1..82: note = Bos indicus x Bos taurus
LTFEDVALYFSEEEWRIMTPEQKTLYFDVMGELYEDVTFLGLKLKNDTGNDPPVSLPTLEIQPSGCEVLGKAAMKDAETTVG

SEQ ID NO: 34898 - protein, 98 aa, Pan troglodytes
LKMEDVALTLTPGWTQLDSSQVNLYRDEKQESHSSLVSLGGEIQTKSRDLPPVKKLPEKEHGKISCHLREDIAQIPTCAEAGEQEGRLQRKQKNATGG

SEQ ID NO: 34899 - protein, 83 aa, Myotis davidii
VAFKDVAVCFSQEQWNDLDPTQKEFYGEYVLEEDCGIVVSLSFPIPRLDEITHIIEEDPLVPDITESQEPDILSFTYTGDRSE

SEQ ID NO: 34900 - protein, 91 aa, Enhydra lutris
VTFGDIPFYFSREEWGSLDPAQREFFWDIKRENSQNVALGLGLRSHREQPGLEESVTAPRGQAGDGGCGTGHSDVTASWSPEEAEAWEGEA

SEQ ID NO: 34901 - protein, 92 aa, Lipotes vexillifer
VTFGDIPFYFSREEWGSLDPAQRDLFWDIKRENSQNVALGLGLTSHSERSRLEEVVTALPGQAAGDVTVSWRLEEAEARPGVPRGRAAGARR

SEQ ID NO: 34902 - protein, 84 aa, Papio anubis
VTFKDVVVEFSKEEWGQLDSAVKNLYRNVMLENFRNLNSLRKDMQSISGEESSHGVMITRFTGSGHPSSDVWKGENWLHRNQKK

SEQ ID NO: 34903 - protein, 84 aa, Aotus trivirgatus
LTFEDVAVYFSEEEWQLLDPPEKTLYNDVMQDIYETVISLGLKLKSDTGNDHPVSVSASEMKTPGCKVSKNTRMKIAQKTMGRE

SEQ ID NO: 34904 - protein, 82 aa, unidentified
  REGION 1..82: note = Bos indicus x Bos taurus
LTFEDVALYFSEEEWKIMTPEQKTLYFDVMEELYEDVTFLGLKLTNDTGNDPPVSLPTLEIQPSGCEVLGKATMKDAETTVG

SEQ ID NO: 34905 - protein, 82 aa, unidentified
  REGION 1..82: note = Bos indicus x Bos taurus
LTFEDVALYFSEEEWKIMTPDEKTLYLDVMQELYEDVASVGLKLKNDTGNDPPVSLPTLEIQPSGCEVLGKAAMKDAETTVG

SEQ ID NO: 34906 - protein, 82 aa, unidentified
  REGION 1..82: note = Bos indicus x Bos taurus
LTFEDVALYFSEEEWKIMTPDEKTLYLDVMQELYEDVASVGLKLTNDTGNDPPVSLPTLEIQPSGCEVLGKATMKDAETTVG

SEQ ID NO: 34907 - protein, 87 aa, Pan troglodytes
PASTSFHPPRIQEEWGLLDRSQKELYWDAMLEKYGTVVSLGLPPHQPEAQAQSELGMLLTGTGVCRSLRSGTPPVPTQPTPAETRLE

SEQ ID NO: 34908 - protein, 91 aa, Phyllostomus discolor
VTFGDIPFYFSQEEWGSLDPAQRDLFWDIKRENSRNIALGLGLKRQRGPSRLEEAVRVLPGQADNDVAVAWSPEEAESWESEARPGVPLEP

SEQ ID NO: 34909 - protein, 97 aa, Pteropus vampyrus
EKIEDMAVSLIREEWLLDPSQKDLSGDNRPENYRSTFSLGGETRNENRELASKQVIPTGAHPHGETAAKCNGDAIGGLEHGEARDLLGRLERQRGNP

SEQ ID NO: 34910 - protein, 96 aa, Trichechus manatus
VKIEDMAVSLILEEWGCQNLARRNLNRDNRQETYGNMFSQGCGNRNENEESTSKTKVAEDSASHGETTGKVQKVFGEKREQQGRITERQQRNSEEK

SEQ ID NO: 34911 - protein, 91 aa, Pongo abelii
VALGDIPFYFSREEWGTLDPAQRDLFWDIKRENSRNTTLGLGLKGQSEKSRLQEVVPVVPGQTGSYVTVSWSPEEAEAWESENRPRAALGP

SEQ ID NO: 34912 - protein, 82 aa, Trichechus manatus
LTFEDVALNFSQEEWELLDPTQKDLYNDVMREIYETAICLGLKLQNDTGNNWTTSLYEVEIQAPGGRVSKKAKVKAPQKTTG

SEQ ID NO: 34913 - protein, 91 aa, Mandrillus leucophaeus
VALGDIPFYFSREEWGTLDPAQRDLFWDIKRENSRNTTLGLGLKGQNEKSRLEEVVPVLPGQTGSDVTVSWSPEEAEAWESENRPRAALGA

SEQ ID NO: 34914 - protein, 97 aa, Chlorocebus sabaeus
EKIEDMAVSLIREEWLLDPSQKDLSRDNRPENFRNVFSLGGETRSENRELAPKQVISTGIQPHGETAAKCNGDIIRGLEHGEARDLLGRLERQRGNP

SEQ ID NO: 34915 - protein, 91 aa, Chlorocebus sabaeus
VALGDIPFYFSREEWGTLDPAQRDLFWDIKRENSRNTTLGLGLKGQNKKSRLEEVVPVLPGQTGSDVTVSWSPEEAEAWESENRPRADLGP

SEQ ID NO: 34916 - protein, 90 aa, Chrysochloris asiatica
VTLGDVPFYFSQEEWGSLEPAQRDLFWDIKRENSRNVTLGLGLKSQNTRSRLEEEAVAPCQAGGGTVVSWSPEEAESWENENQRGVQPGP

SEQ ID NO: 34917 - protein, 97 aa, Suricata suricatta
EKIEDMAVSLIREEWLLDPSQKDPRRDDRPENYRNMFSLGGETRNENRELASKQVISTGVQPHGETAAKCNGDVIGGHEHGEARDLLGRLERQRGNL

SEQ ID NO: 34918 - protein, 97 aa, Equus caballus
EKIEDMAVSLIREEWLLDPSQKDLSRDNRPENYRNMFSLGGETRNENRELASKQVISTGIQPHGETAAKCNGDVIGGLEHGEARDLLGRLERQRGNP

SEQ ID NO: 34919 - protein, 97 aa, Zalophus californianus
EKIEDMAVSLIREEWLLDPSQKDPSRDSRPENYRNMFSLAGETRNENRELSSKQVISPGIQPHGETAAKCNGDVIGGLEHGEARDLLGRLERQRGNP

SEQ ID NO: 34920 - protein, 82 aa, Pteropus vampyrus
VTLEDVAVYLSQEEWGCLDSAQRDHSWDMLPESEGLGMQFEDGEDTRKDTPVRTEWDQMLSAQCRGPSPPTLVQEPAPVRGL

SEQ ID NO: 34921 - protein, 89 aa, Lipotes vexillifer
VMFEEVSVCFTSEEWACLGPIQRALYWDVMLENYGNVTSLEWETMTENEEVTSKSSLSQRADSQKGASKRLQGSVPQVLDFEEEYEWQI

SEQ ID NO: 34922 - protein, 98 aa, Aotus trivirgatus
LKMEDVALTLSPGWTQLDSSQVNLYRDEKQENHSSLVSLGGEIQTKSSDLPPAEELPEKKHGKISCHLSEDMVQIPTCAEAGEQEGRLQRKQKNAVGS

SEQ ID NO: 34923 - protein, 97 aa, Aotus trivirgatus
EKIEDMAVSLIREEWLLDPSQKNLSRDNRPENFRNMFSLGGETRSENRELASKQVIPTGIQPHGETAAKCNGDVIGGLEHGEARDLLGRLERQRGNP

SEQ ID NO: 34924 - protein, 97 aa, Neovison vison
EKIEDMAVSLIREEWLLDPSQKDPSRDNRPENYRNMFSLGGETRNENRELSSKQVISTGLQPHGETAAKCNGDVIGGLEHGESRDLLGRLERQRGNP

SEQ ID NO: 34925 - protein, 97 aa, Callorhinus ursinus
EKIEDMAVSLIREEWLLDPSQKDPSRDNRPENYRNMFSLAGETRNENRELSSKQVISPGIQPHGETAAKCNGDVIGGLEHGEARDLLGRLERQRGNP

SEQ ID NO: 34926 - protein, 82 aa, Chrysochloris asiatica
LTFEDVSLNFSQEEWELLEPNQKALYNSVMQENYETVISLGLKLKNDCENDQTISTSELEMPATGSKVSKKVRVDIPQKTSG

SEQ ID NO: 34927 - protein, 92 aa, Tursiops truncatus
VTFGDIPFYFSREEWGSLDPAQRDLFWDIKRENSQNIALGLGLTSHSERSRLEEVVTALPGQAAGDVTVSWRLEEAEARPGVPRGRAAGARR

SEQ ID NO: 34928 - protein, 91 aa, Trichechus manatus
VTFGDIPFYFSREEWGSLDPAQRDLFWDIKRENSRNVAPGLGLKSQSKQSWLEEAVMVSPGQAGRDTAMSWSPEEAEAWESENQPGMPLGR

SEQ ID NO: 34929 - protein, 89 aa, Trichechus manatus
VMFEEVSVCFTSEEWACLGPIQRALYWDVMLENYGNVTSLEWETMTENEEVTSKPGISQRSDSQKGTSKRLQGGVPKVLDFEEECEWQV

SEQ ID NO: 34930 - protein, 83 aa, Trichechus manatus
PTSTSFLPPRIQEEWGLLDPSQKELYWDAMLEKYGTVVSLGMPPPRPEAQALAQLGAPHAGTHAGTGSRPGLRPGDEGESPRE

SEQ ID NO: 34931 - protein, 97 aa, Loxodonta africana
EKIEDMAVSLIREEWLLDPSQRNLCRDNKTENYRNMFSLGGETRNENRELASKQVISAGTQPHGETAAKCNGDVIGGLEHGEARDLPGRLERQRGNP

SEQ ID NO: 34932 - protein, 84 aa, Monodelphis domestica
MTIGDVPFYLSREEWGCLDPAQRELFCHIKRENFCNVSLGLEMKSQNERAFSQASLKEIDPLPGRSGGEVPWSTEEGEVWESEN

SEQ ID NO: 34933 - protein, 84 aa, Sarcophilus harrisii
MTFGDVPFYLSREEWGCLNPTQRDLFWDIKRENFRNISQGLGIKSQNEKASSQPSLKEVETLPGRSAGDLPWSTEEGEVWESET

SEQ ID NO: 34934 - protein, 91 aa, Papio anubis
VALGDIPFYFSREEWGTLDPAQRDLFWDIKRENSRNSTLGLGLKGQNEKSRLEEVVPVLPGQTGSDVTVSWSPEEAEAWESENRPRAALGP

SEQ ID NO: 34935 - protein, 91 aa, Aotus trivirgatus
VVFEDLSVDYTQKKQKCPAVSQRAMHWNVMPENDHSMASLAGENKLESSELTPKKEIFKSSNRTSGELFGVVPGGTETGDVCEHTFKELEG

SEQ ID NO: 34936 - protein, 82 aa, Callorhinus ursinus
LTFGDIPFYFSREEWGSLDPAQRELFWDIKRENSRNVALGAGLQSQSQRSGLGEAVTALPGQAGGGGGGGGGRGDVTVSWSP

SEQ ID NO: 34937 - protein, 84 aa, Saimiri boliviensis
LTFEDVAVYFSEEEWQLLDPPEKTLYNDVMQDIYETVISLGLKLKSDTGNDHPVSVSASEMQTPGCKVSKNTRMKIAQKTMGRE

SEQ ID NO: 34938 - protein, 97 aa, Propithecus coquereli
EKIEDMAVSLIREEWLLDPSQKNLSRANKPENYRNMFSLGGETRNENRELASKQVISTGIQPHGETAAKCNGDVIRGLEHGEVQDLLGRLERQRGNP
